United States Patent 7,504,490 (NUCLEIC ACID AND AMINO ACID SEQUENCES RELATING TO APERGILLUS FUMIGATUS FOR DIAGNOSTICS AND THERAPEUTICS) - sequence listing, part 5

SEQ ID NO: 18678 - DNA, 2136 bp, A.fumigatus
catggtgaggccgtgagaagaagtcatcctttacgacgcccatcgcaacacatcatgccccgaccaaagcgcactattgaggaattggcgaacaagtcggactcggatgacgagaattacagcgatcgtccggtgcgctcatctcgccagtccgctcgatcgaagtcgaggaaaaagccgaagccaacgaaaaagagagcgcgccgccattcgaacgacgacatcacatccgatgacgatgatattctagatgatgtggacgagctcgacttcgatgatgaggatgaagaagacccgaacgccccgaagaatgcaagaggccttaccgctcggaaggctgccactaatcggccggtatataacgagggcgattctagcagcgtcgacgatgatttcgaagaggaggatgactccgagcccacccgttcgccgaagaaacgcaaaagcaccgtcgtgacattgaaagtgaatgctctcaaacgccagcctctccctgaaagcggcaggcggatgactcgccgtactcgcgacccctcagaggatatcgtcgctctcacgaactccggtcgccatatggagctcgtggagcgaggtacacacagtccggagatggaagcgcggagaagccggcgtgggtctcgcgcctcgaaacgtctcaattttgggcctgaaaaagttgaaatcgatgagaaaccggaggtgttcgagcccatagaggagacttcgatggaagtcaaggcttggcagccagaaatcatggaaagcgatcaccaaggagattttgaggaaggtgttccatcggggcaggacagtggcgaaggtgcagcagaagccgacgaagttggagttgtgcccgaatctgagaacggcgatgtgaagcatcaggaggaggatgatgaagacgacgaaggtccaacaacgcggaggaggaggggcaagcccagtcgaagtcagcccactgaagaggcgcagccggacgaagaggaggacgcacacccacgtcgttccggccgcaagaaacccagaagctctcagcgaaagcgacaagacgatgagagcgattttgaacctgaggaagacgagtcgaatgacgacgatgatgaggagctctctctgtccggaaaatcacatggatcaccgcgcaaagccagtcaagctcgagatgacgaggaacaggatagcaccgccggtcggcgccctggtctacgcaagagagcttctcgctcccgtggacagtccgaagtacgaggggatattgctgaggagcttgcagaggagttggaagatctcagaggagatcgaccccgcagaaggcttcagacagatatcgtttacgagaaaccaaggcgcagccggaaggacgtcgactaccgtatcattcgtccagacctcatcctgccaatcgaggaagccgagaatgaggtcaacgagtcgccttcacggcgaggtcggggaggcggaggcagcagttggcagcgcacacttttcccaacctatggaccttttggaggcggcgggccaccagcgatcctggctcctcctggcgcacctgctgcaacagggggtgttgacagcgatagtagcgatgatgaagtaatgcaacaccccaaaactggcggctctgtgtctggacccccaggtgcaggtcttctgccttcagcacaaacccacggagccgatcctctacaagggccatccggaacacctgccaatttaggaaaaatcaaggataagcaggcgcttgctgacgccgatcccttgggtgttgacgttaatgtcaatttcgacagtgttggtggcctacaggggcatatcgaccagttgaaagagatggtttcccttccactcctttaccccgagattttccaacgttttcacatcgtgccgccaaggggtgtcctcttccacggaccccctgggacaggtaaaacgctgttggcaagggccttggccaacagtgttagctccgagggccgcaaagttacattctacatgagaaagggtgcagatgcactgagtaaatgggtcggtgaggctgaaaggcagctccggctgttgtttgaagaggctcgaaaaactcaacccagcatcatcttttttgacgaaatagatggtaagtgctcgcgccgactttga

SEQ ID NO: 18679 - DNA, 2946 bp, A.fumigatus
cgctgttatgttgctaacgttcatctactcacaggactggcccccgtgagatcaagcaagcaggaacagattcatgcctccatcgtgtcgaccctgttggctttaatggatgggatggatggccgtggccaagtgattgtcattggagctacaaatcgaccggactctattgaccctgctttgcgtcgccctggccgcttcgatcgcgagttttacttccctttgcccaatacagaaggccggcgtgcaatcttggatatccataccagaggttgggatccaccgctccctgatcacatcaaggacgaactggcggagatcacaaagggctacggcggagccgatcttcgtgctctttgtacagaggctgctctcaacgcggttcagagaagatatccccagatttacaagtcagatcagaagcttctcatcgatcctaagaagattgatgtcactccgaaggacttcatgctggctataaagaagattgtcccttcatctgagagatctgcctcctctggtgctactcctctacccaagaccgtggagcctttgcttcgtcgaccgttctccgatatcaaaaccattttgtccgaaatactcccacaaagaaagaggctcacagctctcgaggaagctcaatttgaggaacccgaagggccaaaaagctttcgacgtgagcagatgcagcaagagtttgatacctccagagtgtaccgacccaggatgttggtgcgtgggcctttcggcatgggccagcaacatcttgcaggcgccatcctccaccatttcgagggtctgcacgttcaagctttcgaccttccgaccctgctcagtgactcaaccaggtctcccgaagcagccgtcatacaactctttcaagaggtcaagaggcacaagcccagcgtaatatacattccaaaccttcagtcttggcttaataccgttgggccgactgtcatatctactctcttgggccttttacggtctgttcccccttcagatcctgttctcctgttcggagtcttggaatcgactggtgaagaggtggataatgggctgctgagcaacatgtttgggttctcgaagaagaacttttacgacctaaaggccccggattatgacgctcgatatgagtttttcggtagggtgatcgactacgtcaagaccccgccgtccgattttccggatcccgaaaatcgtaaaaggagagaactcgagacactggaggttgcacctcctcctccaccgaagcccgcaccgcccccgactaaggagcaactcaaggcccagaagaagaaagatcaccagaccctgaatttgctaaagatcaggatccagcccatcatggaccagatcaagaaatacaagaggttcaggacaggtgtaattgacgagtcacagattcggtacctgtgggaagaggatgatccgaacatagttactagcgacttgcccattgagcagcgaacaacgttcaggccctttgaaaaggctttcgataagcatggggtcccgggtctccgggaaactgtttcgggaaagtttttctacaatatggaaattgtcactatcgaaaagagactttccaatggttactataagcggcctaaggatttcctggctgatatcaagcgcttggcaaaggacgcgcggcagctaggcgaccaagagaggttgttgcgagccaacgaacttctctctaacgtcgaggtcgacattgccacaatcgagcaggcggagcccgccttagtcgcggaatgtgagaatgtttatctgcgggagctggagagggagaagctcgcagcagaacaggcgaagaaagccgcgggtgaaggaggctattcccgtctctcagcgaccggcaatgttccccacggcaatacagactccggcccttcaagcggacctgtggtgcttggtgaatctttcccggatgggcaagctcgtccgcagacaccgacgcggcgctcggccgtgagctttctcaccaacggttatcatgaaggtggtggctcggatctgaatgatcttagtaaccatgccacgatcagtaatgggtcccacgagtctcgcggcgatggagatggagatggagatggagatgtttatatgactaattcggaagatcattctggggagagagaggcgcagggtagttctttcggaccctccgcccaaccccggccgccgtactcgcacacggcgccttcgcagcaagtgagacgtgaatcgggattctcaagtctgtctcaaaaaggaccaatgactccaatggccccgggatcacagccgaatgactatacaaacgaggcatctaccacgcagactacctcggacaagaagtcctccgtacagtcctccgtgccgcaaaatctcacccagagccctatggctgcgcatgggctgcggcacgacttccctgatctcactcaataccccgaccgtgtgtcgcaggaggaacatctcccggatacgcagcagccggaaagtagccagccctctccgcatccccgcgagtccttgccaggacacgcagactttgctgccggggagagccaatcccagcccaagcatcaaccccctgtgcccttgtttgaggcgcctgtcaagcagccctctcatgtccccacggctctccagtcattgctcaacaacgaagatctttctccaaaagtgtcacttgagcacggacttatcgacaacttacacaaccaactaacgcaacgaaccagtgggtgctcggtcgagcagctggagcagatcaatagcaacttgatggactatatctggcggatgcgaggggagtggaaccgcaacaaggttgcggctggtatcagggataccttcaatgaagttctggaggacatgcaggcgatgcaggagatcggccctatcagtcaaagaacaaaggagcagttgggggctgatatcttccacgcttag

SEQ ID NO: 18680 - DNA, 651 bp, A.fumigatus
tcgctttccatgatttctggctgccaagccttgacttccatcgaagtctcctctatgggctcgaacacctccggtttctcatcgatttcaactttttcaggcccaaaattgagacgtttcgaggcgcgagacccacgccggcttctccgcgcttccatctccggactgtgtgtacctcgctccacgagctccatatggcgaccggagttcgtgagagcgacgatatcctctgaggggtcgcgagtacggcgagtcatccgcctgccgctttcagggagaggctggcgtttgagagcattcactttcaatgtcacgacggtgcttttgcgtttcttcggcgaacgggtgggctcggagtcatcctcctcttcgaaatcatcgtcgacgctgctagaatcgccctcgttatataccggccgattagtggcagccttccgagcggtaaggcctcttgcattcttcggggcgttcgggtcttcttcatcctcatcatcgaagtcgagctcgtccacatcatctagaatatcatcgtcatcggatgtgatgtcgtcgttcgaatggcggcgcgctctctttttcgttggcttcggctttttcctcgacttcgatcgagcggactggcgagatgagcgcaccggacgatcgctgtaa

SEQ ID NO: 18681 - DNA, 1056 bp, A.fumigatus
actaacaattgcgacaggggatccggacgcgtcgttgaaactttagcaaggaccggaggattcgccgcagatgtcgcacgacacaggatgctggaaacccttcaacacgttctccaggtcaccgggtccgttgatgccatgagaccaggaggagctggtcacgcgtcatcggttcgagtgcggttgcttcacgccgctgtacgttcaaggatattggacctggtcaagaacaagcccgaatattacgatgtcgacaagtacgggattccaatcaatgacctcgattgcatagccactatcaataccttttcgacaagcgtagtctggattgggttgcctcggcagggtatcttgctgcgagagcgagagattgatgactatcttgccctgtggcggctggtggcgtactatatgggcgcgccgcatgagtttctcgagacgagggctaaggctaaggtcatgatggagtccctcctcgcgtcggaaatacatcccaccgagacgagcaagattctggcgcagaatatcatcctgagtcttgaaaacacacccccaacctacgcatccaaggagtttatggaggccatggctcggcatctcaacggcaagcagctgtctgacaagctcggccttccacggcccaccctctattaccaggcgctcgtatatggatactgcattgtcctgatgtggtttgcttatactttcagattgcttccctctattgaccaagcaatgatcaaggtaagaatgcatgtcttgcttcggtcactaactgtgaactatctttgtgctgatgaatcacagttccgtcgcaagaaatactataagataatcaatgacaaggacgaagggctcggtggggagacattcttcgagttcaaatatgtacctttctacactcgtaatacgcgactggggaagcgcaaaccaccgaagcgagccaagcgtggggtagagtttctggcactcatgggtcttctgtttgctgttgctgctgctggcgcactgttgggcagcattttgcgcttactgaataaactacaacgtgcgtaa

SEQ ID NO: 18682 - DNA, 888 bp, A.fumigatus
ggcattatcccaacagtcaccagtttcacagacaatagtagcgtgattgaaggactaattgttcaatttccagtttgggcggctctgtacacctctgcctctattggactcgctcacgcagtatcacgaggcctggggctcccagtttgggtaacgcccgcatgcgcattcaacaacacaacctcgctgccattgctcctcctgcaatctctagaaagcgtggggagcttgaaactaatcattccggaaggtgactcaatgtcaggcgcaattactcgcgctcagagctatttcctcctttgtgctgttgtcagcaagaccatcggctacgccgttgggcccaagatgctccaaaacggcaacaaccaggacgaaagaagagatgcacaagacactgacgccgaagcaggacagagtaataacggcgattacgcagacaacgacgaggaaaccagcgaggagacctcgcttctgccagagcgcgtacagaaggcccggcgcaaggtcactggcaagttcaggcgtgtgggccgctgggtgtcgtctttcttgcccgagcgcgtgaagcaggaactgatggcaccgtttgagtcaccatttgccgacgttgcgatcttatgcactatcatcggtgccgcccttggtctcgtccctcagctgcacagagcattcttcagaccctacgaggaaggcggcatcttcaacgcctggcttacgtcaagcgttaagaatatcggcaagttgttcaccaccttgcagatctttgttgtgggaggaaaactgggagctagcttccagagaatgaaggccagtgggaattccggggagatacctaaaaaagcaatcgtgacaattttgctggttcgccttgtcatttggcctgcgtga

SEQ ID NO: 18683 - DNA, 675 bp, A.fumigatus
gtgagttccagaaggagatcctaccctagctgcttcactctcagtgatactgatcggagtggtagcttgttgatgtgccctcctgagcatctgcgtaaccaggctggctgggaagggcccataagctcttctcgggagcggttattatctgaactgtcaagtgagtacagatatctaccttcgtgggtgtctgacgaccctattgctgatctccttccagaatccatatccccatccgtgatgataccaaacaaccggcttgcgattctgctaaatcatgtcaagcaaaatcaaataaatcgctgcttatatcataatactgcaacaccaccatcgctatattccgatcatatgtgcgataggaatgactttccacttcgaactggagttgagctgcgccagcattcagatgaggtctggtactgccaattctcccatgacggctcaaagttggtcacggcagggcgggatcgtcacgtatacatctatgacacatccaatttttctgtgtaccggcagttggagaagcacgaggagggtgttgcgcacgtcagttggagtccggatgatagtaaactgatcacgtgctctcaggataagaaagcccgtgtctggagtgttgaggtatggatgtcgtcattaatctctggtgtccgtctatcgtccctaacgtaa

SEQ ID NO: 18684 - DNA, 1077 bp, A.fumigatus
agctcccggcgagtatcggtgaacccgccactggttcaggtctgctcgcctggttctgctccagagccaggaggaagggcagatctaccgatcttcgacctggcagacaactcttcctctaatacaccctcctccgtcgctcccgaccgccccaaccttcctatcccactcgaacccacgtcatttacttccgctcctcctccgaggagctctacagacggcattccatcgtcatctcggttcgagtcaggtgctgggagtgacagtacagcatcttctatcgacaatcctcctacatccgctggcacccgacgtcgacgtttcagtacgatcgacccatctgctttcactggtggaacaggaggtgtttcgggaaattttacgcctagtcaggaacaggcctcggttcagtctcataatccacgggcagaacacccaccgtcccccaagcgcaggcgcctggcaaacatgcggcccgatggtatctcgagtgcaaatggcttctcccaagcgtcaaacggcctgagtgtatctccgtctcggaagacagttttcgcgcactcttccaacagccagccagcacactcatcatcaaatggcgaatctcaaaagaatggcccctcgaaaacatcaaagaagtcctcctcttatttcgggcatgaccgcgaagaagtgactagaatactgatacaaagtctgtatgagcttggatacgatggggccgcctcgctactttctatggaaagcggctatcagctggaaagtccggcggttggcatattcaggaaggcagttcttgaggggcgttgggctgaggcggaggatatcctgattcaatcattcacacctgatgcaaatgtgcgcgagccaggcttcagttctgggaagcctgcaaccacagagaagctgctattggtggaaaatgctgagaagaatgagatgctgttctatctacggcaacaaaagtttctcgaattgttagaagcacgagaccttggctcggccttgaccgtgcttcggcacgaactgacccctcttaactatgacgtcgggcgtcttcatgctctttctaggtga

SEQ ID NO: 18685 - DNA, 198 bp, A.fumigatus
ttcgatactgatgattgcgtcaaacgttcctggataacttcattcacaatgaccaagcctactttgcctttgcctttttggcgaatcatcgatgaactaactatgagcaaccccgcctacttcccgctccctcttcggaagttggggttcaacatcttgaaccactccaacatccccaggtggcagtactattcctga

SEQ ID NO: 18686 - DNA, 231 bp, A.fumigatus
gtctccagctgtggtcctccgtcaattcccacacggtactcatcaacttcccaattaggatactcggattccacttcctttgatcatttctacataatgggagacacctgcacctgcactagctcgggcgactgcccctgcaacggaccccagtcctgcacctgcagcaacaactgtgcttgcaagggttgcggagtatgtatctcttggactctctcaggaaactggtga

SEQ ID NO: 18687 - DNA, 342 bp, A.fumigatus
cttttctacgtggatgaaatacaggagcggccgtgcacgcgttgtataaagcgcaacataggccacttgtgtcatgacgaacccagggagccttcaaagcgggcgcggagcgaacacgagcattcgactgctgaagaggatggtcattcgaacaatgagttttcaaatgctcaaagcatgcctcgaaacgttgatgttcaagatgctgccggacagcaaatccttcccgatgggactgtcgccctgcctccttcgtctgtcagtgctgtgcagcataacaccatcccctcctcctctgcgcaaaacagcctaggccacaactcccaacaacgtaagttttaa

SEQ ID NO: 18688 - DNA, 993 bp, A.fumigatus
ggcggccgcctctattccctgactggtgctaatgataggacagttctaggctacaacgaatggctcggaggccaaagccaatttcaggatatgcacaccttccacccgtcctacatgttcaatgccccggaagtcacgaatgaatacaacctcctgggagacttcctcagcagcagtcttctagatgacggggggatgttttcgaacgataacttacaagggatatactccgatccgacgttgatcaattcaatggccaatctggataatacggctttactgcagcaagctcagccttctcagccaacgcagagtcaaccacatcagaatgattcggttcaaggtccaagctctacagtagtgaacgacaaggcaagagagacttattatatgactgcggcggatccgtcagggtcagacccgccagaagagcggatgaataagcttctcaaggcgaaatacgatgctggtctcctgaaacctttcaactatgtgaaaggctacgctcgcttgaaccagtatatggagaagaacatgaagcagtcatctcggcagaagattttgcggcagctggacaaattccggcctaaatttagggagagaatgcaaagcctaactgatatcgagctgatcctcgtggaaatgtggttcgaacgaagtctgatggaatatgaccgtgtctttgctagcatggcgattcccgcctgctgctggaggcggacgggagagatcttccgcggcaacaaggagatggcagaacttattggcgtgccgatagagagtctgcgagatggcaagctggcaatccacgagatcattgtagaggatcagctcgtgagctattgggagaaattcggtgctattgcattcgacaacactcagaaggcaatgctcacaagctgcacactaaagaatccgaattcgagtaatccagggaacgggatcccatgttgcttctctttcacaattcggagggacaatcataacatgtga

SEQ ID NO: 18689 - DNA, 396 bp, A.fumigatus
tcatccatccatcgtccatcagcccacgctacgcaaatacaaacctggctcgctaacgcaagcacctctgaacaatcccagagagtggataccttcgtcaaactcctagacaactatctcggtgatatacccttgttcacaacggcaccctcatcaaccattcgtcgtcaattggatactgaagggacgaagctatggaatgcatgcacgcaactcatggcaatatctgctgacagttgcgtgccgaagttactgagtaaaggtttgacaacttcacaatttgcttcttcggcagcaattctaatcatcacagtcaaagcttttgcttttgcaatgctggattgtgcgacgtctgcccagaagcaaggtattgagtccacctgcgtcaatgagtga

SEQ ID NO: 18690 - DNA, 231 bp, A.fumigatus
ttcacagacctataccataacaaaaccgaaaccaaagaccgagtctttctgtatctcatgggggagtacgtcaaatccaacaaattggtagccgaggcccgtggtcatactccctcgtctgtgaaggtcatttttcaagctatctgtttgagacacgccagattgacaagaacaggtctacaagcaaatccgccgatccgtacagcgcttcgaagcctacattcaaattga

SEQ ID NO: 18691 - DNA, 186 bp, A.fumigatus
tatcatttgcaccaagaccgacggggcggggcaagttggaggggctggacaccgaccatcagcgcctaccaaatcttcctctccccgctccatgtccatgccattgagtcactcttctggccaacttataagcttcagaaactgaatatattcgagcaaagtttctccgtctctatcatcaattga

SEQ ID NO: 18692 - DNA, 336 bp, A.fumigatus
cttcatccctggtgccaacagcgagtcattgaagcatattgcaagagaaatggcattgtcgttgaagcatattccccgctcgtgcgaaactataaagccaacgacccaacgctggtcgacgtggccaagaagtacgaaaggacgacggcacagattttgatacgctacgcgctgcaaaaaggatgggttccgttgcccaagagcgacacgcctgagcggattgtggctaatgccaatgtattcgattttgagattggtgaggaggatctggcggtattgaatggccttgatcaaggaagcgctggtgctattgttgaggccgtcgaaaatgagtaa

SEQ ID NO: 18693 - DNA, 651 bp, A.fumigatus
atatattcgagcaaagtttctccgtctctatcatcaattgactcctgtcgagacacaaacacaatgtcttcaaaactcaccatcacggacttactgcctcttcccaattccgacgtcaaaatcccccgccttgggttcggtgtctaccgctctcccaccggccaatgtgttcagtcatcactgagagcccttgaagcaggataccgtcacattgatacagcccagttttatggcaacgagaaggaggtcggggaagctctccgcaagtgcggcatccctcgcagtgacgtcttcgttactacgaaaatcctgagcccagccgggtcccccgaagctacgtatcagaagctactagaaagcgtcgagaagattggcggtcgggatggatatgtggatttgttcctcatccacagctcaagctctggttcggccggtcggaaagagctctggcaggccttggagaggcttctggaggaaggcaagacgaggagcatcggtgtgagcaactttggggtgaagcacatcgaggagatgaaggcatatgccaaggtctggccgccgcacgtaaaccagattgaggtaagctctatggtcgagaagccctttcaagtagattcagattcgttatggccagaacctgaggtacactga

SEQ ID NO: 18694 - DNA, 270 bp, A.fumigatus
atttcctgttcggtgcgcagcctgatcttaccgggcgcagtgatgcctgatgccttgtctaagactgtaccaatatggtgcgccgtcatgaatcgtgcgcttttcccatccgatgctgcatatcatgcagtacagcttccgccgaattatctcggcgcctcggaggagtcgcagattgaacgccgaattgatggtttcgtgaaatcgctcaaggtactcttttccgtctaccatcactgtactcttttaagcccagcaactttagattga

SEQ ID NO: 18695 - DNA, 855 bp, A.fumigatus
ctgaaggtccaggatctcaaactggatctggatgatctcaggcagcaacttggaaagcctattcgggtggcatgggccaatcggtcctatttttatcctaccgatctgcacaaaaaacccgactacaaccttttcgttctctgctctgcgtccaaacgtgttcacggagcagaagtttcggaaggtggctacattcaaggcgcaggggatgacagcgagggctgggcccaggggttgactccgccagtcttctgggcccacaaagcgattcttctgaagacgcccgaggaggatttgcccgaactggtcgaagaactggtgaaagagcatcgagatcaggatactgctgaacaagccacattggttgcgcctactcggaacctttatatcagtcagacgaacgccagtattaacgactgtggtctctatgacctcgtaatcgattgcaatggcagacctgaggcctcagaaggagacccaaagcgcctcaaccttggatgtaggttgtcaaaactgggaagccgcgacttgagacaagagctcgataaggttcgagcttttgtcagttctcagctcgccaccgatccttcccgatcactcctagttacctgtgaaactggtaaagatctctccgctggtgctctgcttgctatcatatgtctattctacaatgatgatggtatgccacccttccgcacattttcttgtcttccctattgctttcatcacctcgtttctcattctttcctttttctaacggttcttaggatcgttcacaacatgcccggcgaggcgatcaatagacaagcaattcatacgacaacgtcttgcctggatactgtcatcaaaacatga

SEQ ID NO: 18696 - DNA, 1650 bp, A.fumigatus
  unsure (1353): Identity of nucleotide sequences at the above locations are unknown.
gtcatcctcatccatctcctcgaaatcctcggcggagaatccctcggccgttatgcttccaagcccaagcttcgcgtgcaaaaattcgagaatgtcaacaagagtctcgacttcatcagagggaggcggatccagatgacgaatatcggagcggaggatattgttgatggcaatcggaagattatcctgggtttgatatggacgctcatcctgagattcactatcagcgacatcaacgcggagggcatgactgctaaggagggtcttctgctttggtgtcagagaaagaccgcttgctacgagggtgtagaagtccgcgacttctcgaccagttggaatgacggtcttgctttctgtgctctcctcgatatccaccgaccagatctgatcgatttcgacgccctggacaagaaggatcaccgggggaacatgaagctagcgttcgatattgcgacaaatgaaatcggtatccctgatttgctcgatgtggatgacgtctgtgacgttgcaaaacccgacgaacggtcgctgatgacttatatcgcctactggttccatgccttctcccagctggaaagggtggaaaatgcgggtcggcgagttgagaaattcatcaacaatatgcacggtgcctgggagatgcagaactcatacgaacggaggatgaaagaactcttgcgtctaattagagcccagcgagaggcttggaagaatgcatcgttcgagggaacttacaaagatgctaaggaacaagctcgccagttctccttatacaaaagaaatgagaaacgacgatgggtcgccgagaaatcagaccttgctgctctactgggcaatatcaagaccaaactcagcacctatcggcttcgtccgtacgatccgcccgaagagctacgcctcgaagtctgtgacaacgaatgggagctattgactcgtgatgagcatgagcgaagccagctcatcaacgagaccattcgggacatcaagaacgctctacgtcgatccttcgcggacaaggccaatgactttgcactcacactgaaaaccttgtcccttgctatttctggtcttgacggcgatgtagaggaccaattagagcatgtcaagagactcaatgacaatcttcctccactcgacgctttcttagagaccattgcggaacttgacgaacagtgcgtcgaagcgaacattgaggaaaacgacttcacaacatatacgctagatgaactttcttacgagctgagcttagtcaaatcaagtatctccaagaagctggcgttcctcgagaaccagctagttgcccgcaatatgaccaacctgactcccatccaattggaagagttcgaatctgtntttagacattttgaccgtgattcatcgaatacactccatgagctcgagttctctgcggcactcgccagtcttggacttgtatacgacgaggaagaaatgcacaggtctacgtcggaaacttgcgggccggccaggctagcgcaggatggcggcgtcagcttcggacagttcatccacttcatggtcagcgtgacggaagaccagcatactgcggagcagttctttcagagcttccgcgaagttgcggacggcaaggtatgttccccacaacctgagcggtttcgcagccgttactaa

SEQ ID NO: 18697 - DNA, 447 bp, A.fumigatus
tggagccgtttccagactgcatattatgatttccagctgaccttgtctctctttttgcgtcacaacagtcctacagagaagaacgagttgacttggatctgtaattcaccccgcacaaatcacaattttcagttcgcgtttgctgatagggtcgcacttacagtgattgggtccacgacagatatgacgacgacagagacagtgcgttttgaacctggcttcgtggcgattgtcacgggggattttcttttcattccgctcgtttgttttaacacaggtttctttcagcacgccctgctcgtggttcccgacgtccacgcggtgaccgttactccccatcgcccgatcggtatgtctggcttggatttactgctgaagccctttgtggtcatggcggctaactcctgcagcagcgtctcgaccgcggggcaagaagattatgcgctg

SEQ ID NO: 18698 - DNA, 417 bp, A.fumigatus
tgccaactaaccttctcaagcttcttaccatcgaaaaagtcactgagcagcttctggattcgagggatacgagtggagccaccaacgagcacaatctcatcgacctggctcttctcaaggccagagtccttgagaacttgctgtactggctcgagcgtgccagagaaagccttggcgttgagatcctcaaagcgggcacgagtgatagacgagttgaaatcctctccatcgaacaaagagtcaatctcaacagttgtctgtgtagcgttggacagtgtacgcttggcacgctcgcaggccgttctcaaacggcgaagagctctggcatcgcctgagagatcctttccagtcttcttctggaattccttcttgaagtgttcaaggaggttggtgtcaaaatcttgtccaccgagatga

SEQ ID NO: 18699 - DNA, 612 bp, A.fumigatus
cgagactcgaatttcttggtaaaggcctcgtcgctcgacttgaacttggcggcgtctataacagcgttaggtttgtttccttgtaagaacacagtgagacaacgcagtagacgtaccattaatcatctgttcgatttcagtggtggagagcttgccaacagcgttggagatagtaatattggcggaacggccagaagacttctccgtagcggtgaccttaaggataccattgacatcgacctcgaaaacaacttcaagagcggcctcgccagccttcatgggagggataggagcgagagtaaactcgcccagggaggtgttgtcagcacagtttgtgcgctcaccctgataaactgggaactgaacggtcgtctggttgtctacaacagtcgtaaaggtgcgcttcttgatggtgggaacagtttgaccgcggggaacaaccggggcgaaaatattgccttccatggcaactccaagggaaaggggaacgacatccagaagcagcaagtcctgagtttcagccgaggtggccttaccagaaaggatgccagcttgcacggcggcaccataagctacagcttcatctgggttaatgctctacgccataattag

SEQ ID NO: 18700 - DNA, 369 bp, A.fumigatus
cttgaggacatgaccggagacgttggaggattgatgccaactaaccttctcaagcttcttaccatcgaaaaagtcactgagcagcttctggattcgagggatacgagtggagccaccaacgagcacaatctcatcgacctggctcttctcaaggccagagtccttgagaacttgctgtactggctcgagcgtgccagagaaagccttggcgttgagatcctcaaagcgggcacgagtgatagacgagttgaaatcctctccatcgaacaaagagtcaatctcaacagttgtctgtgtagcgttggacagtgtacgcttggcacgctcgcaggccgttctcaaacggcgaagagctctggcatcgcctga

SEQ ID NO: 18701 - DNA, 264 bp, A.fumigatus
gagatcctttccagtcttcttctggaattccttcttgaagtgttcaaggaggttggtgtcaaaatcttgtccaccgagatgagtatcaccggctgtggccttgacagtgaaaacacctccttggatgttgagaagagacacatcgaaagtacctccaccaagatcatagatcaggacattacgctctttttcggattttccggagccgagtccataggcgatagcggcggcagtgggctcattgatgatgcggagaacatttaa

SEQ ID NO: 18702 - DNA, 207 bp, A.fumigatus
ttcgtgatataccttcatcaagaccatagaagagatttcctggggagaaaatgtcttggtttcacccaaatattcaacctcgacaacggggtttccgccctggtcaactaccttgaaaggccacgactcaatatccttcttcacgataggatcttcataacgtcgaccaatgagacgcctaggttggtcagtaagagaacttcttga

SEQ ID NO: 18703 - DNA, 282 bp, A.fumigatus
gtgaggaccaagcaagtctcttgccatgtctacctctcccattcaagaagttctcttactgaccaacctaggcgtctcattggtcgacgttatgaagatcctatcgtgaagaaggatattgagtcgtggcctttcaaggtagttgaccagggcggaaaccccgttgtcgaggttgaatatttgggtgaaaccaagacattttctccccaggaaatctcttctatggtcttgatgaaggtatatcacgaactacctggtatattatcgatcgtgcatagttga

SEQ ID NO: 18704 - DNA, 768 bp, A.fumigatus
atgaaagaagtcgcagagaccaagcttggaaagaaggttgagaaggctgtcatcaccgtaccagcttatttcaacgataatcaacgtcaggcgacgaaggacgcaggtgccattgccggtttaaatgttctccgcatcatcaatgagcccactgccgccgctatcgcctatggactcggctccggaaaatccgaaaaagagcgtaatgtcctgatctatgatcttggtggaggtactttcgatgtgtctcttctcaacatccaaggaggtgttttcactgtcaaggccacagccggtgatactcatctcggtggacaagattttgacaccaacctccttgaacacttcaagaaggaattccagaagaagactggaaaggatctctcaggcgatgccagagctcttcgccgtttgagaacggcctgcgagcgtgccaagcgtacactgtccaacgctacacagacaactgttgagattgactctttgttcgatggagaggatttcaactcgtctatcactcgtgcccgctttgaggatctcaacgccaaggctttctctggcacgctcgagccagtacagcaagttctcaaggactctggccttgagaagagccaggtcgatgagattgtgctcgttggtggctccactcgtatccctcgaatccagaagctgctcagtgactttttcgatggtaagaagcttgagaaggttagttggcatcaatcctccaacgtctccggtcatgtcctcaagctaattatggcgtag

SEQ ID NO: 18705 - DNA, 531 bp, A.fumigatus
agcattaacccagatgaagctgtagcttatggtgccgccgtgcaagctggcatcctttctggtaaggccacctcggctgaaactcaggacttgctgcttctggatgtcgttcccctttcccttggagttgccatggaaggcaatattttcgccccggttgttccccgcggtcaaactgttcccaccatcaagaagcgcacctttacgactgttgtagacaaccagacgaccgttcagttcccagtttatcagggtgagcgcacaaactgtgctgacaacacctccctgggcgagtttactctcgctcctatccctcccatgaaggctggcgaggccgctcttgaagttgttttcgaggtcgatgtcaatggtatccttaaggtcaccgctacggagaagtcttctggccgttccgccaatattactatctccaacgctgttggcaagctctccaccactgaaatcgaacagatgattaatggtacgtctactgcgttgtctcactgtgttcttacaaggaaacaaacctaa

SEQ ID NO: 18706 - DNA, 336 bp, A.fumigatus
ttaatggtacgtctactgcgttgtctcactgtgttcttacaaggaaacaaacctaacgctgttatagacgccgccaagttcaagtcgagcgacgaggcctttaccaagaaattcgagtctcgtcagcagctcgaatcttatatctctcgcgtcgaagagatcatctcagaccccaccatgtctctgaagctcaagcggggcaacaaggaaaagatcgagtctgctctaagtgacgctatggctcaacttgagatcgaagactctgcccctgaggattacaagaagaaggaactcgccctcaagagactcatcaccaaagctatggccacccggtaa

SEQ ID NO: 18707 - DNA, 450 bp, A.fumigatus
gacttcgttcttatccaagcggattgttctcaaggaaattgcatgcagcaagtcgtatactcagggttatactcagggttgctaatgatattttcgtcccagcacgtgaagccgatcacctcagcgatcctttcttccgatttgtctttaacgccacaacctgaccctcataatattcttcaactgaatatatcgatcccgccacccacgaaagaattacgggaacagacagtggttgctgctagagcggccatggaaaaggcagctggtgcagttcgcgaatcgaggagtgttagtcataagcgccttcaagatatgcagaagaagaagctagccaggccagatgacgttcgcaaagctcaggaccatatggaacggctgacagagaagggacagaaagaggtgaaagaattgtttgatgctgcaaaaagggcattagaacgagtatag

SEQ ID NO: 18708 - DNA, 918 bp, A.fumigatus
tgttcagtaaacggagtactcgaactaggatttcgaccgagggtgccgtggtgcggatgggaggccacccgatgtttctgggaaaagatgacatccaactgggtgttattgggcccctatacgccacggcagtgggggtctcttcgatggtctcttggcatcgtggctcgcgtcggcaagcatgcgaaagttgccgacctcgcgaagcactcaaccgttcctgtgattaacgctctctgtgactcattccatccgctgcaagcaattgccgatttccagaccatgcacgaaacgttcacacccaaggctcatggtctctccagtctgggcctggagggcctgaagatcgcctgggtcggcgatgcgaataatgttttgtttgacatggctatcgcggcagccaagatgggcattgacctggccgttgccacgcccaagggctatgagattcctgcgcacatgctggagatcattgagaaggccggggaaggcgtgtccagccccgggaaactcatccagaccaatgttcctgaggaagctgtcaagggagcggatgttctggtcacggacacttgggtatccatgggacaggaagcagaatcgattaagcggctcaaggactttgaaggcttccagatcacagccgacctggccaagcgtggtggtgctaaggaagggtggaaatttatgcactgcttgccccgtcacccggaggaagtgaacgatgaagtcttctacagccagcggtccttagtcttccctgaagcagagaatcggctgtgggccgcaatttctgctattgaggcattttgttgtcaacaaagggaaaattcctatgaaaatcgaatggtttctatagaaaaagcaagccgaaaccaaattagcaaggttgatcgaataccattctgtcccaactag

SEQ ID NO: 18709 - DNA, 1296 bp, A.fumigatus
gagctcgttaagttgtccccttccagccaagaaccgtttcatcgatctctcaggaatagatcaaatggatgtatgggtctctccttccatctgtattccttctatccactcactcaagctccacagggttctgcatctcaaagcgggagcggatttccatcccgccgctcatatccttcactaaaccatgtctcgctcgcacctttgacaaatcggttccctatcgacgacgacacagagccagaggactatttctcaccacgagatgagcgatctgccgacacctcgacacggacatcctatctctcaagcttttccgttccagggacccccggcgttctctcttattcccgcagcggatcccgagtccgtctgcactcccgaagcaagagctcaagtcgtatccaccgcagcgacagcagcctgcagagccaggacgacgcacgacccctccaccatcaccaacatgctcacggacctaagaagaagcacacatcctcatcgcggcatcagccctccgagtcggccggacgccgagacgcagaatggatgcttcgagccgggatcgcgctcgcttcgtctacccgagaggaaaaaggccagagctggatcgtgaagcgcgagagctcaacgagcctcgtctcggaaacaaatgtcgacagtccagttctggcccgccggtcgagatccgggaggtctacaccagccgcgcattcgcgatggggatcccgtgcggcaagtcgaaggaacagcagacacgatctggctatgacgagcctcgatgcgctccccactgggtcaggatcgaatgctcgtgactcgacccgtccccacgaggagacacgccatttcatccctgactttgtggatgagcgtatccgcgcggaaatggcattcattcagcaattcgaggacgggtatgcctcggcctcggacgaggagtccgactcggaggacgagatcgacgagcaggaactgcagcgtttgactcgagagcgagggttcggtctgggaggttggatcgatcggatggttgagtggacactattcggtgtcgaagatctacctctttctgcaaatgtccagtccgccgagctagcaaagcatccggactcatctccagacaacgatagtgtccgcgatgatcactcttctgcggctgaattgaccgacgacaatgctagcgtgtcagctgacgaatctatagcttcgactgtggtggagaagccaggggagaatggaggctgggcggatgtcgggtggttcctccgtgtcatgaagcgtgcactatcatga

SEQ ID NO: 18710 - DNA, 192 bp, A.fumigatus
catttcggcagctccgccaagccttctcgtattgactccttcctgaagcttatcagccccttcggtattctcgagtccacgcggactggtctcatggccctgcctcgttctcctctttcttctgagcccagcgaagagcttgagaaagaggccgccgatgttgtcgatgctagcacccttcctcctggttaa

SEQ ID NO: 18711 - DNA, 636 bp, A.fumigatus
tggcatcccttgcgcggatgcttcggctcccttggtgaagaccctacggccgtctcgtcaattttgtacgagacacctgtcacaccgaccaatcctccaaagcgtcacatcctgaactgcctggtgcagaatgagcccggtgtgctgtctcgcgtgtctgggatcctggccgcccggggcttcaacatcgacagcttggtcgtttgcaacaccgaggttgaggatctgtcccgcatgaccatcgtgctgcagggccaggacggtgtcgtcgagcaagcacgcagacagctggacgaccttgtccccgtctgggccgtcctcgactacaccgactctgccctggtgcagcgcgagcttttgctcgccaaggtcagcatcctgggccccgagttcttcgaggagctgctccagcaccaccgcgagatcaccactcccggtgacgccctggaagggcagaaggagaacaaggctggcgatgcgcaagccaagaaggccgagtttcaccctcgccatctgcctcccagtcaggcactgagacacaagcacgagcatcttgatgccatcacccgcttgactcatcagtttggcggcaaggttctggacatcagcaccaacaactgcattgttgaagtgtaa

SEQ ID NO: 18712 - DNA, 600 bp, A.fumigatus
gtcattccttcaactgacttctataccgccaaatttactccgtacagcgtcgttgggttctctcaattccatatttcaacctcattcaccatggcttgtggtctgaaactggctgctgcccgattcggcgcattgaacggccaacacttgcgtcaacgtgtctccctcaatggcttgcgacaatattcgtcccagaccacccctcctatctctcctttcgcacctcgccattttctctccattgccgatctgacacataccgagttcgctaccctcgtccgcaatgcgtcttcgtacaaacgctcgatcaaatcgggctccgtgcctcaaaatctccttggagccctgaacgggaagaccgtagccatgatgttcagtaaacggagtactcgaactaggatttcgaccgagggtgccgtggtgcggatgggaggccacccgatgtttctgggaaaagatgacatccaactgggtgttattgggcccctatacgccacggcagtgggggtctcttcgatggtctcttggcatcgtggctcgcgtcggcaagcatgcgaaagttgccgacctcgcgaagcactcaaccgttcctgtgattaa

SEQ ID NO: 18713 - DNA, 189 bp, A.fumigatus
atccattatttaactctcttttgtgcgcaagaagccagtgcccataccgacacgtggctgggccactacaagtctagaatgcgtcggaagttccacactgctgcgcggcgacaattcattctgctgtttaaaaaagcttgtctacgcattgtgaatgcgacttatttcattaaaccccgagcaggctaa

SEQ ID NO: 18714 - DNA, 195 bp, A.fumigatus
agagagcacaagactacagggattacttctgttatcgcgtctttcttgcccgtcaagctacatcataacaccaccgacacgaatcttcacaagcctcttcccttcccgtctttcattttgctcacttttccttctcatttctgtttctattctgctacggccgccttctttagcctggatttttgcgccatttga

SEQ ID NO: 18715 - DNA, 681 bp, A.fumigatus
  unsure (172): Identity of nucleotide sequences at the above locations are unknown.
tggttggagacccttgaacacagatgccttggagggggatattacgttcaaatgggcgaacgtcacccggttttggttgacgaagtgatccacaagtccccacgccggagtgtttcttctgctcttcaggttttacgcaattaccaatcgactctgcaaaactcatttccgntaggcggcaatcctgagtcggactatgcctacaaccgtgtccgacagccgctggggaatctgctggatgctctgagtgatttcacgcctcatttcttgccgccacaagaaactcaagcgtccgtgtctctgagttatctggacggggctacagatatcattcacgcattgccacgatggcactcaccacagaacaacatagagcgggactctgcatatgatgaaatctgcaaggcatggattctggtaatccgagaggcggcaaagcgtggtggcggaattcagctacagtatggtggatgggatcagaaattggcgaaacataaccagaatgcgggcggtcgacttcaggctgccgttaacgagcttggtaacagcttgggttggatgcacggcccagactcccaaggctatggaagttcgaccggtggggatcttgtctcggtccgagaacagttactttccggcacttacggtttgggaactcccgtcaaggttggaccctggtaa

SEQ ID NO: 18716 - DNA, 342 bp, A.fumigatus
ctgcacctttggtcatccactgccgagttcaccctgttttcgcctctcccgaggacgctgatagacatcatgtctgtgcaagcccacgcttactacgcggaacacgaagaggtcggtagtattaactactccgttcctttccaggtgccccctggagtctcgaagacgccccggttgcctgtcgagatgaatccggatggtatcggttacgatgctctgaaaagagctctgggaggttcccttgaacttgatgcaatggccacagtcggcgttcgggtaggccactatacggccacaattgactatcacagcaagggaattcgggccaatgtgaaaatctaa

SEQ ID NO: 18717 - DNA, 792 bp, A.fumigatus
ctccctaccaggaacatgggtgcagaaaaccagcagatcatgcgttatgacataatccagaagcaagctgttgctgccctcatgaacgaggttgagaaggagaacaaagagcctgtcaagggccacggcaatcgagctggaagctgggcgcagattgccggatccatgacgaaggttcagtgccaaccaaaggaaacactgcactatctgtcgcctatgtcaatgtcatctgtttctggatccaagcagagtcacagcattgatggcgagaatggcgcgagagccatgaatttctccggggcaccactctcaccggagattgctgaagccaaagcgggcgtcgtacgtatttacggcagggtcaccagggaggcgatccgcttcgtcaccacccgtatccacgagggtccgctgcaggagatccgcattgagacaaacgaaaggaccagagtcaccttccagtatgcttctcacgcacttgcctttgtgaagtcaaaccaggacatggaggaaatgctcggatacgggcgctttggcaccggctacactgtcgagatggccgagatcatcaattggaacgatgaacaccgtcggatgaaccagcccatccgagagcgtcggcgcctgtccttcgcgagaaagaggttgtttgccgataatatgtcgccggagaaatggaagtcggacgttcgtgccgtcgctggactcggcaacatcgactttctctgggtttttaactctggaaacggtgagtttcatgttataggttccttgtatacacatgaaggctaa

SEQ ID NO: 18718 - DNA, 255 bp, A.fumigatus
ttcttcacagtcctccatccgttcaccctcctggtgatctttctttgtctttcaattattctttttaccggtgtctgcacatatctattctcttatacaatatcagccaccatggtgcggatcggctcttcacttctcctggccactctggctgctacaacagtctcggctgcctccgaccctccaaagtgcagccaggactctcactgccctgaagaatggccttgctgctctcgtaagttcaagactacctag

SEQ ID NO: 18719 - DNA, 654 bp, A.fumigatus
gttcaactgtggatcccggaccatggttttctgcaatttaactcacatatgttttttctttttctagacaaccacggcggaaacgcatccgtctcaggtggtaacacctttggcgactggcacgagtacaccattgactggaaacccgacgccatcacctggtctgttgatggtgaggtgaagagaactcttaaaaaggaatccacctacaacgagaccagcaaacaatacatgtaccctcagacgccctccagaatgcagctgtccctgtggcccgctggtcaagccagcaacgccccgggtaccattgcctgggccggcggtgagatcgactgggatagcgaggacatcaaggaccccggttactactacgccacctttggcgaaatcaccgtcgaatgctacgaccctcccagtggcgcggatatcaagggcaccaaggcatacatcttcaaggacaaagccggcctcgaaagctccgtccaaatcaccaacaacaaaaccgtgctcgcctcctttggcgctactggacttgacatggacgttggcgccagctcttccgcttcgggatctgcgaacaagaccagcagcagcgccaacactgttccctctggcaatggtggctctggaaacgagccctggcaactcccatag

SEQ ID NO: 18720 - DNA, 330 bp, A.fumigatus
ttgatggctttcgctccatcggcaatcagatcgactttgttctcacgatactttcgcgctttctcgactatctctactttcctatccttgacctctgaatccacagctcggaacatgtccgaaatcacgcaaacggcaacattggccgcgggctgcttctggggagttgagcatctcttccgcaagcactttggcaatggaaagggcctgctcgaagctaaagtaggctactgtggtggatcaacgtcttccccatcgtatcgcgctgtgtgcactggaactactggtcgtatgttgcctttccttgggacttgttggtcaaagttatga

SEQ ID NO: 18721 - DNA, 354 bp, A.fumigatus
tgctcacgttattcttttttttctgtgacagacgctgaagctgttcaattaacctttgatccctcggtcgtcagctacggctccctgttggaattcttctaccgcatgcatgatcctacaaccaaagaccgccagggccctgacgtcggcacacagtaccgcagtgcgatcttcacgcatggcgaggagcagcacaagattgcggaggaaatcacggataaagtctccaagcagtggtacaagcaacctgtctcaacgcagattatacctgcaggccagtggtgggatgccgaggagtaccaccagctttacctaaccaagaacccgtccggctacgaatgtcctgctcagtaa

SEQ ID NO: 18722 - DNA, 222 bp, A.fumigatus
aggctaacaataaacatagcaactgctgtgttcacgagcaccgctgttgctcgcagagtcctggaggccttcaacaagtggaaggacacccgtgctgtctacagtggcgtttcagtgacttactcctcggatccctgcgaaaaggagttggttctggtcaatgatacagcacggtccggctttgcgaagaacttgaacttcgcgaagaaatcgatgcgttga

SEQ ID NO: 18723 - DNA, 534 bp, A.fumigatus
cctaaccattcctctacctcagtgtacggccagtgtggtacgggcgcttactgcttgggcggatgcgatcctctcatgtccttctctctcgactcctgtacccctgaaccgatttgccagggcaagacctacaaggactggtcgaacctcgacaatcttgcttcgaacaccaaatacctgggcgatgcgagcaaatccgactgggtctacagcggttatcccaaggttgaggatggaaacctcctgctcaccatgcctaagaacagcgtcggcaccctgatcgcaaacaaccactacatttggtacggcaagattacggccaagattaagagcagccgtggcgctggtgtggtcactggtttcattctgttgtctgacactaaggacgagattgactacgagttcgtcggtgctgacctgaccaatgttcagactaactactacttccagggtgttcttgactgtaagttcaactgtggatcccggaccatggttttctgcaatttaactcacatatgttttttctttttctag

SEQ ID NO: 18724 - DNA, 654 bp, A.fumigatus
agagaactcttaaaaaggaatccacctacaacgagaccagcaaacaatacatgtaccctcagacgccctccagaatgcagctgtccctgtggcccgctggtcaagccagcaacgccccgggtaccattgcctgggccggcggtgagatcgactgggatagcgaggacatcaaggaccccggttactactacgccacctttggcgaaatcaccgtcgaatgctacgaccctcccagtggcgcggatatcaagggcaccaaggcatacatcttcaaggacaaagccggcctcgaaagctccgtccaaatcaccaacaacaaaaccgtgctcgcctcctttggcgctactggacttgacatggacgttggcgccagctcttccgcttcgggatctgcgaacaagaccagcagcagcgccaacactgttccctctggcaatggtggctctggaaacgagccctggcaactcccatagcggtagcagcggctccggtaccagcacctcggacggctctggcagttccaccggattcagccagggcagcgagacttttgcttcgagcaacaaaaacgctgctccgtctcagaacgagcgagtcctgaatggttccttctttgctgttctggttgccgttgttgccctggtcaccctgtga

SEQ ID NO: 18725 - DNA, 216 bp, A.fumigatus
cctctaaaccatcacaaggttacttatagcaccttccatgtaacaaacaagcagaaaacagtccgtaacacctggccatccttccatgacccttccatacatattgtggaacaatcctacattccaacagacatcatatggacgccatatctgcgacacagtcagattattctatcccccctgatgatgaacattgccggctgcatcgtattgtag

SEQ ID NO: 18726 - DNA, 507 bp, A.fumigatus
attgaagaaaacaattgcagaataatatccaagggctacgctggtcgtcccttatctctcgtttctcaccaaacctcaccaaccgcttcacacctcgactctcacttttcgatattacagtcacaatacaccaaccacagaatgaagcctttcacagcccgatccgcttttacagcctcagtgctgctcctcaccaccaaccttccagcagtcttcgccgccgaaatggtaagccagggctgtttcagtgactctacacccttggtagaccaaggcccctatacgtatcagagtaacggttactgtcaacaactctgcatgaagaccagcaacaatcttgtctttgccttgacgaagggatcgaactgtctctgtggaaatcagctgcccgcaaagtcggcaaagacggctgattccgattgtaatgtcaaatgcgctggttggcctgatgtcatgtgtatggtcttctctataacttttcgcggttctgttgccgtgctgacttga

SEQ ID NO: 18727 - DNA, 483 bp, A.fumigatus
aaattttattttcacgacgaacaaatctcccatatagaaaaaatgacttccggggatttggatgaaggtgttcatgaaattacgtcggcggaaactgcatataccgatgctccaacagtcaaaaggcccggagatgaagacttatatgccgaaaaagatgcccattcatcgctcgcgggatcacccgcacagtcggccatggatgtgaagggcacagcgatcgacattccgtatgcagagcatgaaagcttgccgatagcggtgccgaggctgaagcaccgagggcttttcggacaacttacactgctggcagaggttgagaatccgaagacgtatcttcgaaaaacgaagtggtttatcacattcattgtcgcgctggcaggatctacagctcccatgggtagctccatactgtttcgtaagtcgctcccagctcaaatggccaacccacttgttgatgcgctctccttgtcggcgaactga

SEQ ID NO: 18728 - DNA, 1233 bp, A.fumigatus
aaggcttgtcggcgaacgatatacctcgtatccttcagtctttttgtgttgttcaacgttctgagtgccgtagcccattccatatcaatgctaattgtcatgcgcatgttgagcggtggggcatcggcatcagttcaagcagttggggcagggacgatagcagatctgtgggatccgcatgaaagaggacgcgcaatgagcattttctacctgggtccgctgtgtggtcctttgctagctcccatcgtggggggcgctctggcagagcgttggcgatggagaagtacgatgtggttcttggccgtttatggtggaatcctcgtgatattcatcttttttgcacttcctgaaacattggccaatcgaaagcagcctcatggcgatgaacaagcacccgttgaacaacaactcagtcggatgtcttcacgccaggtcgttcacttcactgccaaatggttgaaggcccttaagatggttttccttgaccctcttaagattgttctttacttgcgctatcccgcagtgcttttgactgtatactacgcgagtatcaccttcggctctttgtatgtgttgaacgttagtgttgagcatacgttttcaacaaacccctacaactttagcaccattattgttggatgcctctatatcccgaactcgctgggttacatagctgcgagtgttttcggcgggcgctggatggaccaaatcatgcaacgtgaggcgaggaaggccggcagatatgacgagcacggcgagctgatctatcgcccagaggatcgcatgcgtgagaatgcctggctgggtgcatttctgtatcctgcggcattgatctggtacggctggactgctgacaagggggtcttctggtttgctccggtaagtggtctagggttttgttctaccggatgggggaaaactaaccttgtcttccagatggccgccaacttcttttttggtatcggatctatgctcatattcagcatgtcaacgacgatgttgaccgaattcatgcctaacaaatcatcaactggtgtcgcgttgaacaactttatgagaaatatcttctcatgcatcggatcgctcgtgacagcccccattattgatgctatcggtaatggatggctctttacgatcctcggactggtcgctttcgccagcagctcggtgatcctcgctatgaaagtatttggacctcgttggaggaagtcgatggatgccgtgagtcactag

SEQ ID NO: 18729 - DNA, 582 bp, A.fumigatus
cttgatggtttaacaggcggtggtcaaaatacattctccgtctacctgactggcctaagttccaacgttgcgtactaccacgatgatgatgcgtctaccagcgccaacgccaactccagctcaacatcaacgaccaacggcgggtcgactgtgactactggcagtcagggtcaagtcgtcacgcaaggggagcagacagtcgtcgtcacagcaccagcaggcaatggggtgggcgcaacaaacggactcaacgaggaaaagaataaggatggcccgaacactgctgccattgctgctggtgttgttgtcggtgtggtcggattctgttcccttgtcggagctggattcttcctctggcgtttcaggaagcgcacaaacgtgcgaccgcaatactcgaataacgctggcgccaccgagcactttggcaagcccatgtcgcaagattctatgtccgattcgagattcgatggcgacttcatggcacaaaggcgacaaagcaatggtagcattgatgatgatcaagacttttcccgtcgtatattacaggtgaggctcttcagttccgcgcttggtatatcctga

SEQ ID NO: 18730 - DNA, 207 bp, A.fumigatus
cgcagtcggcatattctcccgctccagaatgggctgggactcttcctgacgcggtcgtacgcttcgaatgtcaccatattcgtcaagagtccccgcgatcgtgagatgaccggccccgtcacgcacgtgcaattgattgtttcgggctatctcgtagaatctgttggcttcctggacggttcgccactgtctcggtcagctctgtag

SEQ ID NO: 18731 - DNA, 1194 bp, A.fumigatus
ttcaggggatccagagaagatgactcactgggttctttcacttttctccatttttgctttaatttcagtgcttggttctcgttatcacttcaagaccaaacctccctgagaatgccggcgtcagatatcagtgacgcagagctcccccctcgatacaattttatcgatgattacagcgagggggctcatccacagattctggaatctctgttgcggtcaaataccacacaacaatcgtcgtacgggacagatgagttcagcaatgaagctcgacggttgatccgcgagaagctccacgccagcgaggatgaagttgccattcattttgtcccgagcgggacatcggccaatttaatctcaattgccagctgtttacggccctatgaagccgtcttggctgtggaatcgggacatattgtctccaaggaagccggcgcaatcgaagccacaggccacaagatgatcctagtccctggagtaaacgggaaaatgaccccggcgaacctggagcgcgtgttcgagcagaatcaattctttccacacatggccaagccgcggctggtgtatatctccaacgcaaccgagctgggcacaatctacaccaaggccgagctgtcagccctctcggcagtttgcaaacgtctcgggctgctcatcctggtcgacggggcacggttgggagtcgcgctgagcgcaaaggacaacgacctgaccctgcgcgatatggtcgatctcaccgatatcttctggattggcgggaccaagatgggagccctgctgggagaggcgattgtagtcaagcagcacctggccgagggctttgtcttccatctcaaacagcacggggctctgctggccaagtcccgtgtgatgggtattcagtttgtcgagctcttccggacgcatctgttcttcgatctggcgacgcatgcgaacaacatggcagccaagatctcggccaactttgagaagctggggtatacccttgcagcgcagacggagaccaaccaagtatttgctatcctacccgaccgggtgattcgcagactgcaggatcggtttgggttctatatatgggagaagcgcgaggatgggcatgcggtggttcggattgtgacctcatgggcaacggattctcttcaagtggacaaattcaatagctgggtgcagcaatggaccgagctggatgtatga

SEQ ID NO: 18732 - DNA, 321 bp, A.fumigatus
gaaaatggtcaatgggcaatgggtaacctcaatgtcatggcctcttacgacagttgcttcacattgcagaatatgtacaaaaagctaatcatggacctgttcaatcacctctgtagtgcccccttcaataactgcacttcgattacaggcgtcttcaaaggcaccaaaggtcggctctgcctgatgtgctcactcacccatcgtatatacgcggcaaatattcctagcttgatcagcggtaccgctttctggcttgtcccaattctcagccaagaactcgcgacccgcggtgaaaagaccgttggaagctttcatggctga

SEQ ID NO: 18733 - DNA, 1416 bp, A.fumigatus
cctcccaaacgagccaatccgttagcatggcctggacttaccactcggattgattcgctgatcgtcattgttgttctgtatagtcaagcgaaggtcaagtgcattcatgaaggccaaccaccatgtcgtcgctgtcaacgcgcgaaacggaccgactgtcagttgacggacacttattcttccccgtcaagacggtcaaaacgaaccacactgaaatcacagaggcagcgaagggtgatatcgggaccgacaaccgctctcaatagcccaccgttacctcctgaaccgcaaccagaccgtccatcaccatggtgcgctgagaatcccgtggaggccttaccttcatccacaatcattgcggcgtgcgagacctaccgcaagaaattccccgtcgccaatttccttcactatccatctctgattgcagaattgtcatcgaatccagcctcggttgatccggtttttgtagcagctctgctgtcactatgtgtgagattcatgcctgatcaccgcctggaagcagccgaaacatatgcggaatatgcttgcaagcagctcgcgcatcgcgcgttcgaggccccgtcgctctaccttgcgcagtctctggtgatgatcaccttttacgaatggggttccggtcgtccctacaaggcctggatgtacagtggtatgcctgcgcttcatgttccctatacgaggctaatgatgtcaggaatggccacgtacatgattcagtccctcctcaagaccgccgacgatagcatggagcacaatccacaagacttccaggccagccaaactcagtacgagcagctcgttcgcacgtactggtgctgtttcgcgcaagactgcgagctgagttccggagcacgccagcacttcgccctttcctttcgacagatttcagttccgttgcccaccagtgaccgggacttcaactttggtcggctttcatcgcatcgcttgatgccgtccgatatgagcaaacactcaccgttgtcgaggaatctaaccattgactatggactcacgattgtcacccgagggttcgatatcttcgtgcggattctgcggttcgcgaacgagagtcggcgcggtcggacattgaccttgcctcaggatccttcatcgccgcgcgtggtctggcagcgcttgaaggaggaactggacgagtggaggtttctacaggacgtgacggtgcgatacccggccaccagtgcgcaggcgcatgttgcgttgggatacggcgagttgttcgcatacatcaatctggtctatttcatgaggtacctccctgactctcttccgaggcttgcccattctaatagcagcttagtatcctctttctatatagagaccagctcctatccagtctcaaacctcatgccgacttgctccatgattcgcagcccttga

SEQ ID NO: 18734 - DNA, 273 bp, A.fumigatus
gattacctcccacccccacatcaccaccgcgttaccgcctactgttgcattcatttaacgttccccagaatcgagtgcgaccaatattcaacctataatggcgatgggacattggcactggatggacaccgtgatcctagtaacatgtttcctgggatcctgagcttcttccctaatataggctcattttacctatttcagtttctggaaggtcttgaggttcaccaagcctctacgaacacaatagttatctcagagttgccagcgctttga

SEQ ID NO: 18735 - DNA, 183 bp, A.fumigatus
acacgtagaaaccgggttatgcacaaagccatcaagccgccgcccgcttgtgtcaagcaacaagatacaaagactcagaactccgaggctgtgagaccaaccatgacaggtaaaaatccccgagtgacacagatgcaagcagaaaaccaagacaacgagttgatttttcttttgagtggataa

SEQ ID NO: 18736 - DNA, 1401 bp, A.fumigatus
gctctatcttggtttgcccccttgaccagcaagctggcacgggatactaataggtggacattctctcaagatatccggtttgctgtgcgcgcagaagtccagcatcgcgaaccatttgtcgcattctttagttacttgcggtccaagttcgacaggatcactagttccaaatccaacaccacactgtccattctaattgcgcttctgtccatcgcattcatgcgcgcattgttcttgcctagtctccctcaatcgattccagatctggtgaaattgtcaagctttgcgcgatcgtttgagcctctcatatactactctgagaatggagtacagcagattggaacgctgcaggagaccggtgttgctgtctgggatctgagtgaatccgtccgcggtaccaatatgaccagcgcgccgatcattgtgcgccagctagacgaactgtccgagtctctgaaaacattgtcgctggagctaacgcgctttttcgccaatgtcgactccgatgtcgactctattctgatagtcatggactgggccaaaagagagctggagactttatcgtcgcaacctccaagttctctgccgtccattgtcctcgacaatgtgcatgatctcttatcacgactaggtacgctggagcggacagacgctccaagcggtgaggcaaccagcagccagctgacaaccaccccaaccacatttggccgcgtcgtgacggccgtattgggtcagacttccgcccagcgcacacaggccactctcatgcgaaccttcacggaattcctatccgtgcttgaagagtcgatcaatagtgaattgacccattccactgcgctatttgccctctttgaatccatagatcgccaatttctcaatctgcagcgtaccgttgtgcgcgagtcagacgcccaagaacgtgccgagggggagatgctgagctccctatggactcgagttctcggtcctgatgccgctatggttcgtaaatatgagaagaacaagcgcctgttagccaatgtgcgcagccgcactgtcgccaacaagcatctcctgatggatcaccgcggccgtcttttgacactgaaggtcaacttggagaccctgcgacgaaagctggtcagtccccttgtccgccgaaatgattcggtgagctttgttggtgctgtcgagggaggcagcgggcgcagtcacggacggatgctcgggccggtcgaagcggtcattgaaggccagatccgcgggttggagagtacatacgattacctccgatctgtccgagaaaagcagaaagccaaactcatggaaatggtatatggaagcggtcgcaaaatcccatcaccgtcaatgttaccggacggatcggacgatctagggtcagataccattgaaggggtctga

SEQ ID NO: 18737 - DNA, 555 bp, A.fumigatus
  unsure (529): Identity of nucleotide sequences at the above locations are unknown.
ggcggaaaaaccaacgtgagtctacagtccctagaggcttgcggacgtcgttcatgcaggagctcagaaatgtcgtcatcaacgacttccacacccgataagaagctaatctacccggaatccttaggctacggctctaaaggcgaaaggctcgtggcgggtgtcgtccctctttctcatgacaaaacgcgggtgctcatgattcagtccgtaggaagtggtggctgggtcctccccaaaggaggatgggagacagatgaggcactagcgcaacaagccgcttgcagagaggcttgggaagaggccggtgttatttgcacggtccacaaggatttgggattgattcctgatatgcgcccgtcctccgttctgacgtcaagtgcccccaaggcctcatatcagttttttgaggtgacggtcgatcgtgaagaagaccagtggccagagatgcacaagcggaaacggcaatgggttacctatgcacaagccgctgccgctcttgcaagccgacccgaactcttggaggctntaaatcgcagttctctgaaaagatag

SEQ ID NO: 18738 - DNA, 240 bp, A.fumigatus
atgaataccgcacaattagcgaccccggatcaacctgtaatatctaatggctcacagtacacccataacaggcttcctgtacctttggcttctatgtattatagcttggacatctcgcagaattcacgagttggggctagtcccctagtgcctcgcctttcgtcagaggttattctgcattcgtacttcatgattaacagcatggaatgcaaagaccatgaaggtgattgtatcatgtag

SEQ ID NO: 18739 - DNA, 783 bp, A.fumigatus
  unsure (183),(192),(279): Identity of nucleotide sequences at the above locations are unknown.
gactttatcgccaaaatggattatgagatggatattgagcccactgggccccaggtgaccgtgagagaggtgtgttcgagctgtcttcggaagaatgttgaatcaagcagctcttcaagagaggacgccgttgatgggttttttcaggccgagccataccgtgtcgatttcaaactcagttcngtcgatttngctttcgccaactcctttcgccgagtaatcttcgccgaagtcccaacgatggcgatcgacctggtcgaggtcgaaaagaacacctcngtactccccgacgaattcttcgcccacagagtgggcctcatcccactcaattcgaaaaactgcgaccaggatgtcgagtacacgcgcgactgcgactgtgaggaccactgcgcgcgctgcagcgttacgctcacactgcatgcgcgctgcacaggcgacgagatcatgcccgtctatgcgcgggatctggtcgtcagcggcgagcgcgccaacgagtgggtgggggaccctgttatcacggatccggagggaaagggccctctgatctgtaagctgcggcgggggcaggaactcaagatgacctgtgttgcgaagaaggggatagccaaggagcatgcgaagtgggcgcccactgcggcggttgggttcgagtatgacccgcataataacctccggcatgtggattactggtacgaggaggatcccatcaaggaatggtatgttctgatttttcgtttctttttcgggctcgtcccatttttacgctgcaaaagcagtcgctaa

SEQ ID NO: 18740 - DNA, 456 bp, A.fumigatus
tttttcgtttctttttcgggctcgtcccatttttacgctgcaaaagcagtcgctaatgatctacccaggcccgtctccgcaaacgccgcctgggaacacgccgcgccccccgaccaacccttcgactacgacgctcaaccaaacaacttctacatcgacgtcgaaagcatcggaaacctcgaaccggacatgatcatccagcagggcatcgtcgtcctccaacgcaaactagccaccgtcatctcctccctctccggcgccggcaacggcggccgcaacggcctgcctgaagacgaggacatgttgggcgtccgcagccccgacgcctacgagccgccagaaggcatggacggtggattcacagcgtacgccaacggcggtacgagtgcctggggagccagcgcggcaactccctacggtgcgacgccgtacggtggcggtgggtacggcttctag

SEQ ID NO: 18741 - DNA, 324 bp, A.fumigatus
cctcccccattcgcggctcttctgccacgtggtgaaaaccagaccgtgggttcggccaaggaatcgctcggcaacttgatcggaaacgataatctgcgccgcgagggccaggagcaaaatgcgagcggcaaggcacaggaggcgaagggtcaactgcaggattggggtgagggcgctgcggaccgggctaagggggctctcggatcagttggtgctgcggtcaagggggatcgcaccgaggaggataattggagggatgtgcatgacgaggggaaagtcagacatataggcgctgaggtcgatatggagaagagatatgattaa

SEQ ID NO: 18742 - DNA, 936 bp, A.fumigatus
tcgagatgtgtattcttccacagaaatctcatgacgagtggcggttcgtccgtcatcagacattcaggcacaacgaaatcgaacgtcgagctgatcaactcgttacgagcgaatttccaggctgcgcaacagcttgctgccgcggctgaggccgaggcaaaacccacggagagatacaaggcatggacgtcgatgcaagatgatgcgctttacattcccgcaatcgacttctcgcagcatgggctagcagaggagaggtcgcagtacgatattacagtgaaactgttctatctacccggaatcccggtgtcgagacggtgcgcgcatacgcggcaggcgattgatctggtattgaaagagctacatgtggattctatcgacctgcttattgtttccttccctgggattctgttcgacgcggaggatgacagcgagggagaggtgtcgtcggatgacggaagcgaggagccagatgacttcgacagtatcattcagtcgtggaggacactggaggggctgcatgagcaaggcatgattgctcagctgggtgtggcggagtttggaagcgacaggctcgctcggttcctaccacataccaaggtcaagccgtcagttgatcagatcaacctcaaggactgctgtgttgtccccaagtcattgattctctatgcgaagcaagagaatatccaactgcttacgcataacgactgcaatgatattctgccagtaggcacgacacgggagctgctgggtccaggcgagaagggcgctggaatccttgcgtccgctccagatgccgacgacgggatcaaaggcgatgttgagccacaatgggtggtcaagtacacgtcggtggtcaaagaccgcggagtggtggagaacaaggggtattttgcgctagctgacgtaggcacttgtatccagacgagttcatga

SEQ ID NO: 18743 - DNA, 186 bp, A.fumigatus
gtagactctgcgatcatgtaccgcaatgaaaaagcctgcggtcgcgcaatccagaactctggtctcgatcgctccgaagtcttcttcacgacgaagatcccgccaggctcgatggggtacgagcgcacaaagcgcgcagttgacgctagtctgcaagaggccgaggtggattattttgatctgtag

SEQ ID NO: 18744 - DNA, 630 bp, A.fumigatus
actctgcgatcatgtaccgcaatgaaaaagcctgcggtcgcgcaatccagaactctggtctcgatcgctccgaagtcttcttcacgacgaagatcccgccaggctcgatggggtacgagcgcacaaagcgcgcagttgacgctagtctgcaagaggccgaggtggattattttgatctgtaggtacctcccggtacatggccccgacgcatgcactgagtcatacgacagaatcctcatccacgctccttacggcggcaaggacgcccgccttggctcgtggcgcgcactagtcgaggcgcaaaaagctgggaagacacgctccatcggcgtatcgcactatggcatccatcacctcgacgaattggaagagtacatcaagggtggcgagggccggggcaagatcgacgttggacagtacgagctgcacccatggctagacagatcggagatcgtcgagtggctaaagaaacgcgatatcgtggttgaggcgtattcgccgctggcgcacgggtatcggcttaacgagcttatcttgaagactttggggaagatacacggcaagtctcctgcgcagatcatgatccggtggagtttgcagaaggtgagcgttctatctgtttatatttag

SEQ ID NO: 18745 - DNA, 243 bp, A.fumigatus
cgcaaaataccccttgttctccaccactccgcggtctttgaccaccgacgtgtacttgaccacccattgtggctcaacatcgcctttgatcccgtcgtcggcatctggagcggacgcaaggattccagcgcccttctcgcctggacccagcagctcccgtgtcgtgcctactggcagaatatcattgcagtcgttatgcgtaagcagttggatattctcttgcttcgcatagagaatcaatga

SEQ ID NO: 18746 - DNA, 189 bp, A.fumigatus
gagaagtatgattggatgagcggcttgctcgaagcatttatgatctatacccacgactctgttgtctatttgagctatgagaaaatcaacatacacgtgcaatcattcgtcatcattgaagaaccaggatattgcgccacgctatatcgcacaatgcaacgaagaaaaatgtgtactttgcaagaatag

SEQ ID NO: 18747 - DNA, 510 bp, A.fumigatus
gactatctcgttcttcccagcacagaagcgagacatcaagttgacgtccttcgacagaatttggccaaagacaatgattactactcttactcttcgaggatccatcctgaccgagtcattaccgaaaccaacgctacggactcctatcagaatgtgcttttctctctgctcagattcagatcgtacgtcggagcgtatccgagaaagatcaccgttgttacgcacgaattcaagcgccagcggttcatggagtgtcattttccggctcttggattgagggctggaggccaagcttcgtgtcctggagctgtcgttgggatcaatcctccggaagaagtaacgcctctcgcgtcgctgatatcaggggaagagaagagtgggattggcctgtggaggctggatccgtatggtgtcggcgaagagctagctgcgaagagagttaaacgaggatggaagcctggcaaaggaagccgaactgtttgttgggacgaagttggacgctgtcgttga

SEQ ID NO: 18748 - DNA, 849 bp, A.fumigatus
caacaatctcgaacgatggcttcaacggacccatacacaccgcctcccctcccttctcccttcacgaacacaacccctccaccgcaattgctcacccaaggcgccgaagcgcacctctacaagaccgtcttcctctcaccctccaccccagctgctctgaaggtccgcccgtcaaagccctaccggcacccgattctcgaccgacggctcacgcgccagcgcatactgcaggaagctcggtgcctggtaaaactcgtccgggaaggcgtcaatgtccccgcggtgctggcgctggattgggagggccaatctggcgaaaaggggttcggcggggcctggttgatgatggagtggattgagggaatggtggtgcgcgtcgtactggagcggtgggagaaatacatgaagcggaaccaggcgggcctgggcgcggaggaattggaaaaggaagaagcgcgggtccgagatttgatgaagagaattgggcacgcagttggagcgctgcacaaagccggcgttatccacggggatctgacaacgagcaatcttatcctgcgaccgcctactcgtgcggagcagcaacccgccgctgacgagacaaatccgtctatggagggggatgttgttctgatcgattttggcttggccagtcagagtctgcaagacgaagaccgcgccgtcgatctatacgtgcttgagagggcgtttggtagcacccatcctcgtactgagccgctcttcacagaggtcctcagcgggtataaggaaagctacaagggcgcaagctctgcattgaaacgattagaggaagtacggatgagaggccgtaagagaagtatgattggatga

SEQ ID NO: 18749 - DNA, 216 bp, A.fumigatus
gcccccatcaagtgggagcccgtcgacgtcacccccatcttgaaggacggaaagaccactatccccgaagaggccatcaaaagcgtgcagaagaactatgtcgctctcaagggtcctcttgctgttagtcaacctcgcgcccttgcggtccacataagtataatactaagatggaatcttgcagactcctgttggcaagggtcatgtttcccttaa

SEQ ID NO: 18750 - DNA, 219 bp, A.fumigatus
gccgcctgtgtctccctccgcctcgtcctcttcgctttcttcttgcgccccatccgacccttcctcgtcgccttcttcgtttgccccggtctcctcggaccctacgtcttcttccccggcaccggatcctttacgagcttcaatctcgacttggagtctcatcgaacgggtgcctcgcgttccttggcgagcattgcgggttccttttctgcctcgtga

SEQ ID NO: 18751 - DNA, 753 bp, A.fumigatus
gatggaatcttgcagactcctgttggcaagggtcatgtttcccttaaccttactctccgtcgtactttcaacctgtttgcgaacttgcgtccctgccgctcggtcgccggttacaaaactccttacgacaacgtcgatactgttctgattcgtgagaacaccgagggtgaatactctggcattgagcacgttgttgtcgatggtgttgtccagagcatcaagctcatcaccagagaagcttcggagagggttctccgtttcgccttccagtacgctcgttcggtcaacaagaagaaggtccgtgttgtgcacaaggccaccatcatgaagatgtccgatggtctgttcctcaacactgcccgcgaaattgccaaggagttccccgatatcgagtttgatgctgagctgctggacaactcttgcctgaagatcgttaccgatcccactccttacaacgacaaggtccttgtcatgcccaacctgtacggtgacattctgtccgacatgtgcgccggcctgatcggtggtctcggcctcactccttccggtaacattggtgatgaatgctccatcttcgaggccgttcacggctctgctcccgatattgctggcaagggcctcgcaaaccccactgctttgctcctgtccagtattatgatgctgcagcacatgggtctccacgagcacgctgctcgtattcagaaggccaccttcgacaccctggctgagggcaaggtatgttcaatcccgtga

SEQ ID NO: 18752 - DNA, 402 bp, A.fumigatus
aagagaacccaaggagctgaatcctatcgtcgccgaccacctcttctggttcctgttcccccgcccctgcctcctttttgtctggatttggtcgtctgcgcacgtgtgctccttgtagttggtgagccgcctgtgtctccctccgcctcgtcctcttcgctttcttcttgcgccccatccgacccttcctcgtcgccttcttcgtttgccccggtctcctcggaccctacgtcttcttccccggcaccggatcctttacgagcttcaatctcgacttggagtctcatcgaacgggtgcctcgcgttccttggcgagcattgcgggttccttttctgcctcgtgacggtgctggggacgagcgtggttctataaccggacaagaattagaatcatgcgagtag

SEQ ID NO: 18753 - DNA, 276 bp, A.fumigatus
ggaaagtacacagtcaccctgattgagggtgacggcatcggtcccgaaattgcgcagtccgtgaaggatatttttgctgccgcaaaggtaaagcttgttcttcttgtttgccctcgcgccgaagaattgaggactaaaatagttgtaggcccccatcaagtgggagcccgtcgacgtcacccccatcttgaaggacggaaagaccactatccccgaagaggccatcaaaagcgtgcagaagaactatgtcgctctcaagggtcctcttgctgttag

SEQ ID NO: 18754 - DNA, 1947 bp, A.fumigatus
caacttctccttgaagatttgaatgaggggctctttaagagccatctcaagctacacgtggaagatgcagacccattaccccaactggataatatcgaaggacataactttttcctcttcgatcagccggcagagtcggtcacagatgcgttcagtgatacccaagtagacgataaccttagccaccagaacaatgatatctctgaagctgggtctgatagtatctggacccttgaaaacttgcaaaatactacaattcctgagattgcacggcgatcatgggagaggtaccatgatcgatcgtctctcgagccgatgtccgcttattttagcgagtccggtgggaaaggctttgattcggctttgacacgccagtactccagaaatggatctaaagacgcgggacgtgtggctcggaatgatgtcttcttccatgctctattcaggcttggactaggctggaactccgtattcttccgttacaataagcagcggaaagcgtttgaaagggtatctgacaacatccgcgtctctggggtcagcctcgccgttgtcaatggtctgactgaggaagtcctccgctgtggtacagctatgtacaacttaagggattttgcacgccggactcggatcaaacccgagggattctctgctcgatctgcttttgccagtgctgtggcaatgatcatctacacactggagaagcaaataattaactatttcaaggaagtctcgtccctcattcaaatcatgacactttttcagcggtgtggtgatctggttggtgcgttatcgaacatagtcgaagcggtccagaaagctgcgtcagatgcgcaagtaatctctgctgtcattgagaaggcggctcattattccgaagccttcggctctatggaaaatctttttcgtgaacttgttgctcgtgtgattgcaccttggctccagtacgtggaagcttgggttggcctgcgcactgagacgcccgcgttagtggatttggctgcgaagagtgaaggctttgtggccgtagagcgatacgagggtagagcaggttcgagaagcatgaaagcatcaagtttgcaatatcgttatcatcccgagcaaatgccgacctttatccccgcggagcaagcagacttgatattcgagactggtcgaagcttgcggctactcagaagataccatcctcaacatccaatcgcaaatgatgcgatccttaccaaagattctcccaatttgcgatgtgcgggaagttggtccgacatcgagagaatccaaaagaaagcccagcaatatgagactcaactccgctcagaaatcctcaaatacagtcagggccaacgcgtggggcaagtcgaaatggacaaagtactcgcagaagaacaaatgcagaagtttgtttctgccggagacgatccagctatctctcctgctttcgagctcttcgacatcgatgattccaagcacacgaccgggttgcttgcaagtgactcttccttagaaaacgacgaactaggaccattgttcgacgcaagtacgttggaggtgtctcgaccaattcatccacacagaaagaactttggaccagaaatgatatccgctgtctccctttctctggcgcctctactgtcgtcccaggctttactcgttgacttttcctgtcttcatctcttattcaaggaacacaaattaagataccacctcaccttgcagtggcgattccaactgttaggcgatggcttctttgcttcgcgcctctcgcactcactttttgatcctgaaatggagagtggcgagcgtagatcaggcgtcgtacgaagcggcgtgcataccggtttgcgcctaggaaatcgtgacacttggcctcctgcaagctccgagttgcgactggtattgatcggccttctcgtcttcaccacggggctggacggatccgagcttaggata

SEQ ID NO: 18755 - DNA, 411 bp, A.fumigatus
cggatacagatggtgagaaatttttataatgactactcgcatgattctaattcttgtccggttatagaaccacgctcgtccccagcaccgtcacgaggcagaaaaggaacccgcaatgctcgccaaggaacgcgaggcacccgttcgatgagactccaagtcgagattgaagctcgtaaaggatccggtgccggggaagaagacgtagggtccgaggagaccggggcaaacgaagaaggcgacgaggaagggtcggatggggcgcaagaagaaagcgaagaggacgaggcggagggagacacaggcggctcaccaactacaaggagcacacgtgcgcagacgaccaaatccagacaaaaaggaggcaggggcgggggaacaggaaccagaagaggtggtcggcgacgatag

SEQ ID NO: 18756 - DNA, 267 bp, A.fumigatus
tcagacaggactcccattatccagattgccttctgtagctcactgtctttctcaggacagtgctatgttacaatgccacctaagaaaaaaccaaagctggctgatgtccaagccgaatctgtgcagccggccgccgatacacctgccagtgagggtgcgggcaagccagaaaatgggcacgacttggtgtcggatccctggactgacgagcaggagacagctctgctgaaggggattatcaaatggaagccagttggtaagttctga

SEQ ID NO: 18757 - DNA, 786 bp, A.fumigatus
acataccttgccctcagccagggtgtcgaaggtggccttctgaatacgagcagcgtgctcgtggagacccatgtgctgcagcatcataatactggacaggagcaaagcagtggggtttgcgaggcccttgccagcaatatcgggagcagagccgtgaacggcctcgaagatggagcattcatcaccaatgttaccggaaggagtgaggccgagaccaccgatcaggccggcgcacatgtcggacagaatgtcaccgtacaggttgggcatgacaaggaccttgtcgttgtaaggagtgggatcggtaacgatcttcaggcaagagttgtccagcagctcagcatcaaactcgatatcggggaactccttggcaatttcgcgggcagtgttgaggaacagaccatcggacatcttcatgatggtggccttgtgcacaacacggaccttcttcttgttgaccgaacgagcgtactggaaggcgaaacggagaaccctctccgaagcttctctggtgatgagcttgatgctctggacaacaccatcgacaacaacgtgctcaatgccagagtattcaccctcggtgttctcacgaatcagaacagtatcgacgttgtcgtaaggagttttgtaaccggcgaccgagcggcagggacgcaagttcgcaaacaggttgaaagtacgacggagagtaaggttaagggaaacatgacccttgccaacaggagtctgcaagattccatcttagtattatacttatgtggaccgcaagggcgcgaggttgactaa

SEQ ID NO: 18758 - DNA, 798 bp, A.fumigatus
ggacgaagacgacactgtatcaaatgcttcctcggggctgggtatgcactatctccccacattttcaggcccctctttatcaccactatcaaatgggtgtcaagtactaatatctccttagtatacaacatggcgcagctctctctttctacggagtctatctctaccctgtcctctgagatgtctcatttcggaggatcacgatccgagagcttcggtacttcgtactctgaagacgaggatgcggaccatttcgtgcatgacgctgcagccagtgtctacgacagtttgaaagatggtgtcacatcggacgttgtgcagttggaattagtcagtttgcggatgactgcgaatgcctccgaccaccaggtccgacgagctgttgtcacagcgttcatgaagcgaacccaacaactgatcgaaggaggaaaaggtgccggtgaagcgattagggacctttttggtacatatcgcgaggttgttgaacggtgtatgttcgatcgagacagcgacgagaaaaccgaccaggtcgacttcttactcctgctccaacaagaccttgtacatcggcctcgcggtgagacagtcctactcttcgctgctaaggagctatacgatttggagctcttcgaggaggaagcctatgagcagtggtgggctgatgagcggtcaagtgccagcgaagagatgaggcaggtgcggagtcagacccaacaattcgtggattggctcgccaatgccgaggaagaggaaagtactgaagaggaagaaagtgaggaagacagcgatgaggagtga

SEQ ID NO: 18759 - DNA, 993 bp, A.fumigatus
cgcgagccttgcagataccaaacgctgttgatgcggacttatgttgatgacaaagagaatctcaagtggtgcccggcgccaaactgtgaatacgcagtcgactgtcccgtcaagcaacgcgacctcaatcggatcgtacccacggtacaatgtgcttgtaagcatttcttttgtttcggctgcacactgaacgatcatctaccgtctccttgcaaattggtcaagatgtggctcaagaagtgtgaagacgactcagagaccgccaactggatttcggccaacacgaaggagtgtcctaagtgccattcgacgatcgagaagaacggtggttgcaaccatatgacgtgccgcaaatgtaagcacgagttctgctggatgtgcatgggcttgtggtctgaacacggcaccagctggtacaactgtaatcgctatgaagagaagtccgggtcggaagctcgctcagcacaggcgaaatctcgagcatctctcgaaagatacctccattactacaacagatacgccaaccacgagcagtctgcgaagctcgataaagatctctaccttaagacagaaaagaaaatgacaagcctacaatctcagtctggtctctcatggattgaggttcagttccttgatactgcatctcaggcacttcagcagtgccggcagactttgaagtggacttatgcctttgcatactatcttgctcggaacaacctgacggaaattttcgaggacaaccagaaagatctagagcttgcggtggagagcctaagcgagatgttcgaaaagccggtacctgaattggccaatctgaaagttgacatcttggacaaaacggcctactgcaacaaacgccgagtgatccttcttagcgacaccgcccagaaattgaagcaaggtaagctctattcattacataatgttgatgcatggcataaagctgacaaccatatctcttcaggggtatggtcattcaatgttgaatggtag

SEQ ID NO: 18760 - DNA, 714 bp, A.fumigatus
cttgcacgaccttccacccgtggtgaagacgatcactacgcagctcgagtgaggaatctgaaagcatacgacgcagtgagtaaggatattatctccagatggacgtatccactgtgcccggacacaaatttgcttcccggacacacctatgatcttcgcaagggcaatctgtatgcagaacagggcgttactttggcgcgttcatgcgtcgttggacgacaaacagtcatcggaaaaggcacaagcattggtgacaagacgacagtcaaaaacacagtccttggtagggactgcaaaatcgggaaaaatgttacattggacggtgcatacatttgggatggtgtggtgattggcgacggcacaacggttcggcaggctatcattgccgataaggttgtggtcggcaagaattgcagcgttaagcctggcgctcttctctcatatgaggtcagaatcgctgatggtgtgaccgtgagcgaaggcagaagaatcacaaaggcgtcgagagaggaagacgggggtctaccagctaatgacctggatgttgtcggtgagggaggcgaaggtcacgaatatttccaagaggaagatgaggacgaagacgacactgtatcaaatgcttcctcggggctgggtatgcactatctccccacattttcaggcccctctttatcaccactatcaaatgggtgtcaagtactaatatctccttag

SEQ ID NO: 18761 - DNA, 258 bp, A.fumigatus
ggaagagctgataatcctggttcggcaggtccggcgcatgcagtgtacttcggtacttacgaggttgtcaaggagatggccggtggaaatgtcgacgagggccaccatccgcttgctgccggtaagtgctcaaatagtaattctatcgacgcaggaaagaatactgacattctccaagccgctagtggagcggcggccaccattgccagcgatgctctgatgaacccattcgatggtaagtcatcttcgatggactga

SEQ ID NO: 18762 - DNA, 210 bp, A.fumigatus
cacctggaaatagtcatcaagcaacggatgcaagtacatggctccgtacataagagccttttacaatgcgccacgtccgtttaccgcgccgagggtctgcatgcattctacgtctcataccctactacacttctgcatgacggtgcctttcacggctactcaattcgtggcgtacgagtcaatctcgaaagtgatgaacccatctcatga

SEQ ID NO: 18763 - DNA, 954 bp, A.fumigatus
atcttcaccacgcctcctctaacgagaaaaaggaaggcggccgaggcggcgattacagaccaggaaccatccataaccgccaccgaggtttccgtcgctgattcacgaaccgccaccgggaaaacctcgtcaaacaagagacctactcgcagaagggacaagctgacggaccaagggcctgacgcagattcggtgtcggtggcgtctgcaagcatcaccgtccagaacaagcagaaggcaaccgatctcgtcacaccagcttccaccagtatggattcagacgatgattttatgacggatgcgtccagtgccgatgatttcttggatacacagggtagtgaagatgagagtctaggagaaggtatgttgcagcgattttccgtttcatactctactgacgcggtctttcttctgctactagagttcggtgacgagttcgacggcggattttctcaagataaggatctattagggaacacaaagaagccatacgaagtcgacttcagagttctgagtccagaagatatcgatcgggagcagagtcagcaggtcaacgaggtctcgcagattttgggcctgcccccggagtcgtccgcgatcctactacggtttgggagatggaaccgggagaagctcatagagtcctacatggaccacccggaggagacgctcgaggaagctggtcttgggacgaactttgacatgacaccgaagacagaggttgtaccagggttcatgtgtgacatttgctgtgaggatggcgacgatttggagacatatgctatgcgctgcggacatcgcttctgcgttgactgctatcgacattatcttgcccagaaaatccgcgaggagggcgaagctgcgaggatagaatgtcccggggatggctgccatatgattgtggattcaaagtccctgagtcttctcgtcgccgatgatctgaaagaaaggtaa

SEQ ID NO: 18764 - DNA, 468 bp, A.fumigatus
tcatcaagcaacggatgcaagtacatggctccgtacataagagccttttacaatgcgccacgtccgtttaccgcgccgagggtctgcatgcattctacgtctcataccctactacacttctgcatgacggtgcctttcacggctactcaattcgtggcgtacgagtcaatctcgaaagtgatgaacccatctcatgaatatgacccgttcacccactgcatcgctggtggcctcgctggtgccttcgctgcaggtcttactactcctttggacgttgtgaagacgcttcttcagacacgtgggttggctcagaatgaggagattcgatcggcaaggggccttttcaatgcggcggccatcattaagcgccagtttggctggagaggcttcctacgtggcgctcgtccccgcatcatctccacgatgcccagcactgcgatttgctggtacgttgttatccgcgcatga

SEQ ID NO: 18765 - DNA, 210 bp, A.fumigatus
agatggtgtcgacagcgatggaagggtaaactgaactatgaagcgctagcaccaaaaggggccgttacgtcgcttatcaagttcagcgtcaagggagaagagcgaggggtgattgtgcttagttatcacgtatggtcgctggacgtcacgggagtggggcgtcttaaaagtttagaagcaagcatgcactgttacccaagacatcaataa

SEQ ID NO: 18766 - DNA, 219 bp, A.fumigatus
  unsure (157): Identity of nucleotide sequences at the above locations are unknown.
ccgcagggaaagctttcctgcctgcccaacgccagcacaagtataggatacatcggtcaagcggcagaacactttgatttaggagctcacattttcgtcttgaaaatctcgttaagaggagctgccgcaagtatgtctccaatgaaagaagcccttntatatcaagcccagaacacccgtcccaaagagaacttatgcacacaatatctgaacccataa

SEQ ID NO: 18767 - DNA, 1263 bp, A.fumigatus
ttagattccgcggttgacaggacataccgtaataagcattttgctgctgcttggaagaaatccacacatggcggtccaaaaacctcaacagcgaatggcgcgccggcaagtggccaagattcccaagatgagccagtggtactacctactcctgagcttattgcctctttcgcccacctgccaattcctcgagctgagcctgaaattgaaggtacacctccgccaccttgtcctattgcgaacattccaaccgaggtcctactggtaatccttcgacatgtcgcgttgatggaccctgcatcattttgtcggatggcgttggtctgcaagcgcctggcatatcatttcgccaatgaacaacacatctggaaacgactttgtcagggtttcgagtttggctttaagtcgatgcattactcatttgcttgtgacattcacggcaatcctgagtatactatgaggcaacgctatacgccctttccattctcagtacccgtgcagattcctaagccattatcctcgtggagccaggtcttccagatgttccctcgaattcgtttcactggtgtgtacctaagcaccgtcaattatactcgcccgggtgccgcatcttcataccacaatatatcgtgggacagtcccatacatatcgtcacctattatcgatatttacggttctactcggatggttcagtcatttctatactgacaacagcggagccgttggatgttgttccttatatcagtaaggagaatatgaaagctgcacgtgcaacttcctcgcatcggcatcatcaacgtaatacatctgatccaggtatcactttagctggaggcgcagaaccgatacccccagtcgctttgtccgctttgaaggaagctcgtcgaggacgttggcatcttgtcaagccacttgccgcttctgagtcagaagacgacaaccgcataccgtcggtttccgaccggccgcccttcccagtcagaacagtgcacactcctgccctggatccccgagatgtcatcattgaaactgaaggtgtcggttcaaagtacacgtacacaatgcatctgtctctccggtcgtcctctggagggtcgaagcctgccaaccccacagccacaccagccaacacatcgaaaaatacgaagcttgtgtggaagggattctggagtcacaacaagctgaccgacgactgggctgagtttggacttcgcaatgatcgagcatttgtgttccgaagggttcgcggttggggtatgtga

SEQ ID NO: 18768 - DNA, 2193 bp, A.fumigatus
tattttctttgccagcaaaagagatcgcatacgaggctcataatgcccgaaagggtacgtatcgttttcgacgactcggacgacgcccccgtccctaaaaaagtccctgaggccgaacaaattcaaggctccgagccagtcaaacgaaaagaccagcctacagaccacccgaagaagaaaagcaagaagcgaaaggttgagtggccttcagatacacggtcgcaagaatccccgtcgtcaaacgaaacgcagtccgagccagtctcgcgcgacaccaatgagaaagatgcggtcaacggcgtcgcaaatggcacataccaccactccaagaacaaaaagcataagatgaagaaccaagcgccccaaggagcaaagcataaatttacctccctgagagaaaaggccaaggcgctgtacgaaacccgcaagaacctccccatcttccctcacggcgatgagatccgacagaagctccgtgtaaacgacgtgatgctgctggtcggtgaaacgggtagcggaaagagtacacagattcctcagttcttggtcgatgagcgatggtgccgtccgaccaaagcgacggttactcaggataatgggtctaaaaaggaattgacggttggagggtgtgttgccattacacagccgagacgagtggctgccatctcgctggcgagacgtgtagctgaggaaatggggacgccgctgggttcttcatcaccggcgagtaaagtgggttactcggtgcggtttgatacgtccacgtcgccaagtacgcgaatcaagttcctgacggagggaatgctccttcaggagatgctgcatgatccctcgttgacgaagtacagtgcgattgtggttgatgaagtacacgaacgtggtgtcaatgttgatctagtactggggttcctgagaaacttggtttcgggtaaaaaggaagggcgaggtggtgtgcctctgaaggtcgtagtcatgagtgccacagctgatatggagagtctaattgatttcttcaaggagggtctacaggggcaaggagatactaagacaacaaaggggaacaatgatcagcaggattctcctcaagcgaatggcgaggacaaggtttctgtttgccatataaaaggtcgtcagtttccagtcaaaacgatctactccccggcgcctgttcatgattttgtggatgccgctctgaaggtgatctttcagattcattataaagagcccatgccgggagatatccttgttttcctgacaggccaagaaacggtcgaagctttagaacatctggtcaacgagtacgcagctggaatggatcctgcgttgcccaaggtccaagtacttcccttatttgcggctcttcctcaggtcgctcaacaaagggtgtttcttcccgcgcctcctcgcacgcggaagatcatccttgcaaccaacattgcagaaacctctgtgactgtctccggggtacgattcgttgtggactgtggcaaggcaaagatcaaacaattccgtacccgcttagggctggattctcttttggtcaagcccatctccaaatccgccgccattcagcgaaaaggtcgtgctggtagagaagcgccgggacaatgttacaggctctacacagaaaaggactatctagcgcttgatgagaccaatacaccagagattctcagatgcgatctaagccaagccctgctcaacatgaaagcccgcggtgttgacgacgtcatgggcttcccgtttttgacacgacccccacgcgagtcgttggagaaagcgcttcttcaactgctaagcatcgatgctctggaagaatccgggaagatcagctcgaggggacagcacatcgataagatacataaaacgccaaccctcgggcgtgtcctattagcagcagcagaacatggagaaggatgtattttggacgtcatagacatcatctctagtatcagtgtagaaaacatcttcctcaacaccacatcggaggaaaagaaggaggaggcagaaaaagcgcgccgagacttgtatcggagagaaggcgatcacctcaccatgcttgccactgtgcaagcgtatgcagcggaaaatacggaccgaaaggcctgggccgaacggcacatggtgtctcatcgagccatgcagtcagtgatggtatgttgtcattattcgtctccgtctaacgctctttga

SEQ ID NO: 18769 - DNA, 363 bp, A.fumigatus
  unsure (49): Identity of nucleotide sequences at the above locations are unknown.
ctattacaggatgtccgcaagcaactcaccgctcaatgccgacaagcanagcttcttcccagcgccagcgactctcgcaacggctctaccaactcggccactcgcgagccctcaccggtgctcattctccagagtttcctccggggattttccaccaacacggcccgcctcgtcccggatggcagctatcggaccgttgtcgggaatcagacggtggccatccacccgtccagcgtcttattcggcaagaaagtggaggctatcatgtataatgagtttgtgtttacgaatcgcagttatgcacgaggagtgagcgcggtgcagatggattgggtcggggacgcgttgacgggagcattatga

SEQ ID NO: 18770 - DNA, 306 bp, A.fumigatus
gcaccataccatacagctgtcttttcgagcaaggagcaaggagcatcgaatacgaaagtcctgattgtcaaacaggctaaatggcgatcatctcatccattggccgatctcactgacatgtcatcaattcgtattggactcgtcactagctatttcatcgctgcaagtctgtggcaagagtgtattagcgatgtgccgatgctctcggaaggtcgaaagttgtcggtgctgcaatgcgagaggaaacaattttgtacacctgagtttattaccgaacagatacggggcacattttgtggtctgtaa

SEQ ID NO: 18771 - DNA, 246 bp, A.fumigatus
ttgtgttcagcaactcctcttgacgtcgtccgtgtccgacttcaatcacaatcttccgttcataatgcatccccctacacctctcacacaacccagacactaaaacacttgccaccgaatctgggagtaactgcttgttgccgcgaagtgttctggtttggtcaagatccacaagtgtgtatggtaggtccaggcacagggaccctaggacttttcatcacgatcgccaagggccgcgatatgcaa

SEQ ID NO: 18772 - DNA, 192 bp, A.fumigatus
ctagaaattgatttttttctgtgtatctaccaaaatgacaaaggacctggtgagcctcacgacgaagtgtattcacccgaggcattgttccgttctgactggctccagaccttcgatatccatttcgacaacgagctcgcgcacgattactacggtgacggcaagaagttggccgagaagtatgaaacctaa

SEQ ID NO: 18773 - DNA, 558 bp, A.fumigatus
gcaacgcgcagaactgggacgcttggtctctactttgccatgaagatacttggctacacgccctaccacatgtacgaagtggcacttgtgcagggcacaccagggatggcagcccttctggaggccgtaatcgcggaacacaatcggctatcaggcatcaaacggttcgacaagggtgatttggacaagttgacagccgactatgatgtacgtgtccacgtaccgattgcgttctggatactcaccatgctacagtgccttattgagatcccgagtttccttggcccagccctcctcgacgagtacgcacaggaccccgaggtcaagattatcctgacggagcgggaccccgatcgatgggccaagtcggtcaacggcacggcaggctttgtcgtcaaggcggccgcttcgtttccgttgaacgtgctcaagcatttcgacgaggaattagggatctttctggccctcaacaccactgtgtacgccgtcgttgctgacagtacaaagccgggccagccgggtaatgaggcggctctcaggaggaattacgttgagtag

SEQ ID NO: 18774 - DNA, 1011 bp, A.fumigatus
  unsure (25),(965),(1003): Identity of nucleotide sequences at the above locations are unknown.
taccgcccgcccccattgcggttgnggtataggcatagcgcggatccttcggcccccgtggtgaagatcgcgatgtacgatatgacttccttccaccggtttgaggtgtcggggccgggggcgagcgcgctgctgtgtcggttgatgacaggccgtgtaccggacgtaggacagatcgcttatacgctgctgttgaacgagcggggcggcgtccgcagcgatctctttgtgacgaggctcggcgcggagatgtttcagattggagccaacaccgcgactgactttgcgtatctctcctgcgaagctcggcgacagggccagaagtccccaaggcagtgggttcaggtgcgcgaggtgacgggtcatacctgctgtcttggcctttggggccctcgcgcccacgacgtcgttcgcacgttaacgactgacgacctctccaataccgggctgccatatatgcatgctaagcgcaccaccctcgggggcctccccgtcacagtcctccgcaagtcctacgtcggtgaaagcgggtgggagatccagacgagcgccgagtacggacatcgcctgtgggatatcatatgggccgcgggccagccgcacggtcttattgccgccggacgagcagccctcaacgcgttacgactggagaagggatacaggacctggggggtggatatgaccagcgagcacgatcccttcgaagcgggagtgggttccgcggtgcagctggacaaacaagaagactacgtgggtaaggctgcagtgcagcgactcgcaagggtgcagcctacgcgtcggttacggtgtttgaccatcgacgacggacggtcgatggtgatgggtaaggagcctgtcttttggaagaacaaggccgtagggtatgttaccactgcagcgtttgggtatacgattcggaaacctatcgcgtatgctggcttcttcattcgatccgagacagtganacggtggacgtggaatatttcgggcggaagatcagggntacggtga

SEQ ID NO: 18775 - DNA, 228 bp, A.fumigatus
gtagcacccggcgagtattggggtgacctgctcaaattcttcaagaagctcacgggctttggaaatcaggtcttgttcctgttcaccgttgctgctcagcacttcggcgggatgcgtcacaatcagatagctgctgagaaaagtgcgaacagcacctcttccccccactgtcccgctttccatatcctgcagtccgcaaagtctaagaacacgggccgtcgcagataa

SEQ ID NO: 18776 - DNA, 987 bp, A.fumigatus
ggggagttctccattgatcttgccatatcggagcgacccagttctatcaatgatccgctattagaagaaccccacctactttactgctctgtctgcgggactccgaccacagacatcagcgacagcggcccaacggaagaacaaggagttgagagaaaaaagggaaaagggatatatcagaaacgcctacgatatatggtcatggcagccgaagcgtcctcccagttggctctcctatcggatctcacgcctccatctctcgaacgtacttggctgaccgcaccacaccccactctcccaatcgttgcgacatgcagctccgacaaaacggtccgtgtctactcattgactaatttccggcttctttcaactatatcgggcggtcataagcgcagcgtaaggacatgcgcctggaagccgcacgtcaagggggaaagcgtactcgccacgggcagcttcgatgcgactgtcggcatctggcgacgctgggatagctacgggcagacagagcgtggtatagaggattggcgccatgccgacagccatgatcatgtggatggtatgggggcagcaggaatcaacaacggtggcggtgatagcgccgacgaggacgacgaggagtggcggttcgctgtgctgctagacgggcacgacagcgaggtcaagtcggtgtcgtggtcgccgtccgggatgttgctcgcaacgtgctcgcgggacaagtcgatctggatctgggaggatctggatgacggtgataacaactttgagaccgtggcggtcatgcaggagcaccagggcgatgtgaagtgtgttgcctggcatccagtcgaggagtgtcttgcaagtgccagctacgtcgataccattcggctgtggcgagaggatctcgatgattggggccaggtagcttgcatcaaagggccaccagggcacggtatggtgcgtcgactgggagggcgcagagaatgtgccgtccgcaccaactga

SEQ ID NO: 18777 - DNA, 312 bp, A.fumigatus
cggcgctacgaatggtttgagtgtgcctgttgtccacccaatgtcactcgaacactgggctgtctgggcggttatctttggagctacaaggtcaacaacgagactcagaaggctactgtcaacgtgcatctttatacctcagctaccttgcgctttgaggttgcggattccaggatcgagattactcagaagacacagtggccatggaacggggacgttacattttctgtgaatattgacggtccgccagtgaacttggagctgcggctgcgaatccctggatgggcaagcacctgggaggttagtggatga

SEQ ID NO: 18778 - DNA, 672 bp, A.fumigatus
cttgcatcaaagggccaccagggcacggtatggtgcgtcgactgggagggcgcagagaatgtgccgtccgcaccaactgacttgccggatgacgatccggtcaccgcgcagtggaagaaggcgcatgcgctttccggtccccgtctcgtctcatgctctgacgaccgtaccgtgcggatctggagacggcaaccgaaggagcagcaccagcaccaagcccagccatcgccgtctggaggctcgggaatcccgagcatcatccgtccgacggggtccgacgagttctgggacgaggagtgcgttctaccgcaggcgcatgatctatctatttatacggtagcatggagcaagcggacgggcttgatagcatctgtcggggcggatggtcgggtcgtggtgtacgaggagcgtttcattgtaggctcgacagcagaggccatggagacggatcatcctacatcggcggacggcacagcagcggactcaccggctgctcttagaactgaatggagagtcatcgccacggtggatggtgcccacgggatctacgaaatcaaccacgttacttgggctaagcgcgcagatcgcggacggatagagggtacagatgaggaggtcttgatcaccacggctgatgacggcactgtcagggtgtggactctcaagatgtag

SEQ ID NO: 18779 - DNA, 1809 bp, A.fumigatus
  unsure (1591),(1774): Identity of nucleotide sequences at the above locations are unknown.
acgtcatcggcgacccagatcatgattcgtcgcaattcagatattgaaatacagctacccgatgctggaccaaccgtcgcgccagagtccgttactgaaccagacgtggacatgctcccagatgagcagaagcccccgctgaacttacccgctcggatcgctgcccgattctcgcgaaagtcgagtttggctcgccgctcctctgcaacatcttctcgtaggagctcgatctcatcgctacattcgcaccattctaacgcctcttccaatggctcgtcctccaccgaccacgttgcgcaacatctgcggcgaacttcgattttggaaaaccgcaaagcaaggcttgcggaccgtgcgttgcatgcggaaaaggtgaggttacgtgctgcacttgccgctgctaccaaaaacctccaacgagaggagcgagcgcttgctgctcagcagtcacgcgagcggttacttgcgcagatcaccgccaagtgcgaagaggaagttcgtcgggcgaagaagaaggctgaagacaatcgagaaagactagctgcagagcacgcccgcctccggctggaaatggcggaaaagttcgcggaagcagagaaaaggcggctgctttaccagcaaactcaacggcgccatcgcactagtagcctccccgcgacagaggagcaaaagatggctcaagtggttaccaaatctctgactcgggatgcagccgcaaggacaattcaacgtgtctggcgggcacatcacgcaaagctggtcatgcaggagtttcgaagtctcaacctcacggttaaccgcatccgcaccatgagctttgaagatgttggagccatgctctcagatgaaaacgtgttatctgcgacggcccgtgttcttagactttgcggactgcaggatatggaaagcgggacagtggggggaagaggtgctgttcgcacttttctcagcagctatctgattgtgacgcatcccgccgaagtgctgagcagcaacggtgaacaggaacaagacctgatttccaaagcccgtgagcttcttgaagaatttgagcaggtcaccccaatactcgccgggtgctactcaccgacggtgatctcgaccgatcttcaaacattttgtgaagcatacagcgtattcttctcagcatttcatgcctggaaaactcacgattccagcgtcttgatcgagatcatgcttgctcagttcgtagaattagagttgatatggcagacggtcaaagatgaccgcgccggaggtgttgccgatgactattggcaaggcatcaggcagaatcaaattctcctccttgctaggctgaaacgtctggctggctctgacaaggcaatgcagatggtgcgggactcgctcaagaaagccaagcgagagagaaaacgtacaacttccaagcaggccatcccgcgatctgccgaagtagctccctcatcagcggaggcattgactgagagtgtggcctcgccactcagcgagagctttaacaacgtggaaagtccagtctttcgcgagctggataagcaaaggatttctccgcatgagcggtttacccaagtgcttactgctctccctgaanaccgcgctctggtacacgagcttctcattaacaaagagtacaaagtcgatgagacgcagtacacgacaccacgcaagcagattatgaagcacatgtgcgatatgatgcgtagagatgtggatgctggaatgggtgcaaatgggacggtggccatggccacagtgatccaggatcgactgttgncttgctgcgacccggaaactcacttcacgttctga

SEQ ID NO: 18780 - DNA, 483 bp, A.fumigatus
ccgtactgtgggactgtaacacaaagtatctactatgcatacttcacatcttatctctcttctaaattgacttactcctttttcttcgctgcaggattcaattcttttgcatcccgatcagcaaagttgtctcctcttctttcaaattaccagaatcctactgtaatcttcgactggtatggagtagccacggaggccgtgattggcgctgtcagtcgcgcaggcagacagagtcacaggctgcaggatggcgaaagaggaattcccctcatcctgcataccttgtatggcaacactacagagtacttttctgacctaccaagcaccctacccattattaaaaaaaaacaatacgaatggagatggcaaaatccttttccagtccaagcgacgcagggctggttgattggcgcacagtcctctctcttccccggtgacgaagccgccaggtcgcggactcatttcgtgtggtccatactatga

SEQ ID NO: 18781 - DNA, 273 bp, A.fumigatus
ctgctgagtctaggaggaaggaaggttggtcccttttccctttccctcctctacccttccgctggtgatggcggacgacttcacagcatcattattatgtgtcgttttcccccgtctaatttcccccatctaattctgatttattattactctcctccttatttccctcccacagttcgcttttactggagccgaatcctgtctattacttttccactcagtgcggacggagtactaaagtgttttatctttttttcttgtgtgccagtataa

SEQ ID NO: 18782 - DNA, 189 bp, A.fumigatus
ttgcacctagcctatcgtcctagcctccaccctgattatttccccctcccttccaatcataacgcgataacgattgcctcctcatccatccccctctctgggcctctggttgctgctcaggcctacctgactaccggattaccatgggtcgccccgcccacacgacgacctcagctgcccatcaactag

SEQ ID NO: 18783 - DNA, 1455 bp, A.fumigatus
aggaacggaaagatggtgaacggcaccgctgcggtgttggaacccacgttcactgggtatgttgcaacgacgcaagatgcactgatcttgttcgaggcctgcttgacgggcatcctacatcacgttcctcgtcgacctcatgatcgcgaaaggagccatctcgtccgcagtggcagtgtgtttatctacgaagagaactcgtcagggatcaagcgatggacagatggagttacgtggagtcccagtcgcatcttgggcaactttctagtctaccgtgagcttgaaaagccgttcccaccaggagaaaagaaacgagcaatgaagaaggccaaccgacgtccggtgccgtctgcgaggcctggcgaaccctacccgcgtcacgatagcaacggtggatcttattctccctcgtcgacatctgggtcgtttggcgatcgatcgcatcagtcggacgtggaacgcgcactggtcggttccttggtggattcatacggcttcaaggattcggggctggtcaagaagacaatgagcgtaactgtctctggggtgactcaccacctggtgtcgtattacagcgtcgaagatgtgatgcggggcgttctgaatccgccgtccatggtggaatcgctgcgatatatccgcccacgcgcggaactgacgcagaagcagagcttccgcgctccaatcgatgatctggagacaggtgggcttgagaatccgaatgatccatcccatgccatttacggatatcggccacagctgatggcgcctcctggatacgccatgccgaatccccaccctgagttttatctgcatacggcgccttacactgcttttcacgcaccacagtttgcaccaatccccggatattccattggaagctcgatgcccgcacagcccgcaccgaatccgtaccttcctgccccttctgcacccgcgcatgttcagcagaagacggaggactatccgcagtacagaaatcccaacccagctccaagtgcgtatgggaccagttttgactccatcagccatgcgccattgtcttcatccatgccttccaccctgaacagcagtatacctagttctctaagcgagcgcaatcgctctacatcggatcaaagtgtgtcggcttaccgaaactcctcgatctcgtcgcgcagtgttgccacggacgtgacatcgccaatcgatccttccaccccagcgaccttctctcgagggaacagttttagtctctcgggccacatggatgggccatcgcaacaaccacccgagcagcgtggcattgcgccagcgttcgatcctagtatccctcgtcgggagtctataccagctcattactatgcaggaagcgacaggcctcagtattacatgggagcgacggcgccggccgcacatgcgagttaccctgtctcgacatggaccacggctgctccagctcagccgcaaatgtaa

SEQ ID NO: 18784 - DNA, 219 bp, A.fumigatus
agcggatgtctgatagaagccatcttcgatgttattgactgcgttaggctggtggcgaagccgactttcatggaaggcgaggatgtcattaacataagaatcgaccgtggcataagtcgcattccgcggcatgtcgactgggatgtgctcattttccagctgatggatttccagggtcagaggccggttattcaagctcaagtaccccttctcatctag

SEQ ID NO: 18785 - DNA, 414 bp, A.fumigatus
acaaagccccctttgcgactcgcaatgcgtttctcccttgccgccaccactcttctcgctggcctggccacggcagcgccttcgagcagcaagaacgacgtcaatctcgataagcttgctcgacgtaatggcatgctttggttcggcactgcagccgatatccctggtacctcagagacaaccgacaagtcttatctgagcatcctgcgcaagaagttcggcgaaatgactcccgcaaacgcattgaaggtgagccagagtgatagtacccctctactcgtgtcggcgctgacagacgacgttattcacatagttcatgtataccgagcccgagcaaaatgtcttcaacttcactcaaggggactacttcatggacttggccgatcactatggtcacgccgtgcgctgccataa

SEQ ID NO: 18786 - DNA, 855 bp, A.fumigatus
ttcatgtataccgagcccgagcaaaatgtcttcaacttcactcaaggggactacttcatggacttggccgatcactatggtcacgccgtgcgctgccataacctcgtctgggccagccaagtgtccgactgggtcacctccaggaactggaccgccacagaactcaaagaagtgatgaagaaccacatcttcaagaccgtccagcattttggcaagcgctgctacgcgtgggacgtcgtcaatgaagctgttaatggggacgggaccttctcctccagtgtgtggtacgacacaattggcgaggaatacttctaccttgcattccagtatgcccaggaagccctggcgcagattcacgccaaccaggtcaagctttactataacgactacggcattgagaaccccggccccaaggcagatgctgttctgaagctagtcgccgagttgcggaagcggggcattcgcattgacggagtcggtctcgagtcccacttcatcgtcggcgagactccttcgctcgctgaccagctcgccaccaagaaggcttatatcgaggccggacttgaggtcgccatcaccgaacttgacgtccgtttttctcaggccccgttctacaccgccgaggcccaaaagcagcaggctgccgactactatgctagcgtcgccagttgcaagcatgccggaccgcgctgtgttggtgttgtagtctgggatttcgatgacgcctactcgtggattccgggtaccttcgagggacagggtggcgcctgtctatataatgagacactcgaggtgaagcaggccttctatgctgctgccgaggcgttggagaacaagccctgcactgtatgctag

SEQ ID NO: 18787 - DNA, 1092 bp, A.fumigatus
tttactgttctcgatcatgtgcctttcataacccgtgttatccagcgtctacgccggtgtttgttgaattggttgaaatatccgtctccatccccttacgttcagcatcagactaaagatcaaaatgtattaggaaccccctatcttttgattgagtatattgatccaatgagaggaaaaatgctttctgaaacatgggaagaagggcgccacaataccacattgcgcacgaacctctttcgtggtctctcccgcattatgttgaccctggcacgtattccgttaccgaagatcggttcctttactctagatgagaaggggtacttgagcttgaataaccggcctctgaccctggaaatccatcagctggaaaatgagcacatcccagtcgacatgccgcggaatgcgacttatgccacggtcgattcttatgttaatgacatcctcgccttccatgaaagtcggcttcgccaccagcctaacgcagtcaataacatcgaagatggcttctatcagacatccgctttaatggttatgagaagcgtctggtcttgctttttccgccgtgatctccttcgaggcccgttcttccttaatctcacagatcttaaccagaccaacatctttgttgacgaggattggaacattaaatgtctgatcgatctcgagtgggcatgctcccatccggtggagatgatccatcctccgcactggttaacaaatcaagctgtcgatctgatcagcattggtgactacgaaattcttcgaaaagagttcatgatggccttcgcagaggaagagacgaaaatcgagctaccagtccggctctatcctatcttgcagggtgggtgggagagaggaacattttggtattctctcgcgctcagcagccccactgctttgtttaagatcttttatgattttattcaacagaggttttcgacagcccacgacgatcccgctttttggaagatcactatgccgtactggacctttaatacttatgagttcattaaaaataaagtgagggacaaggagcaatacgatgtctgtttacgtgaagcctttgagattggagatcctcatggctag

SEQ ID NO: 18788 - DNA, 291 bp, A.fumigatus
gggacaaggagcaatacgatgtctgtttacgtgaagcctttgagattggagatcctcatggctagaccctacaaactcaatgctcttcactcactgcccttcacgcttgctcccctcaccaccactttgttctttcctttggaagtcctctactgcagcctgaaggttctgaatggacttcttccctctgttctgctgtgcagctttgcccgaagaagagagctggttgagggtcttggcgtccatcttcatagccacttgcgcctcttcaactttaccatcataacttga

SEQ ID NO: 18789 - DNA, 183 bp, A.fumigatus
actaccttcaacctcctccatccactattgactgatatatacgcgtttcgatccactgtgaccttccctgtctttacctctactattcacttttgcatattcatttcgcctgcagaaatggtgcgaaaacgaagaactagaaagctttttacatccgagattatatccttacttgaatcgtag

SEQ ID NO: 18790 - DNA, 1503 bp, A.fumigatus
ccgaagatgctgagccggatgggatcgatgttagatgactcgtcgctggcagcggacgcgtcggtcttggtatccttgagatcaattacgacgcacgtctccaggacgcttgcaacagcgttgggcacgacaacaatggtctgtgtcttgtcgatgatgatggcaggcccatggacacgagtgctcttctcgagcttatcgagcagatacactggggtatcgatgcgggctagagttgccatcgaagtatgccttggtgacattatcaggcgggtgactgacgtctttcaaagacgcctccttcagctgggacgagtggactcttttccgtgcgcactttgggaagcggcgatcgtacgcacggcggatgtcatcaacgaggactgctcgctccgaattgaagccgaattctcggcgatgacggtctcggaattggtcgaggaaaccagagtcttcctccggcttcaagatcatcaggctggtgtccgacccttcatatcgcatgttgaggtacagttcatgatggacctgatcggcacggaagccctgtgtcaccatctcctcggtagcagcttgggtcatggcgtcaaatcgtttctgcagcgtcgactgcgaggcgtggtagtcggcagagactggctcctgagactccttgacgacttcagccaaggccaagccgtaagccgacaggacggaggagtacttgtggatgatgatgcgggagattccaagggacgcagcaacggaacaggcgtgttggccaccggcaccaccaaagcaagccagatgatgggaagcagtttcatatccgcgagcctcggtcagattgcgaataggacgggccatggactcatccgccaccttcaagaaacccaacgcgatctcttccgccgtgtactcggactggcccttttctctcctttcggcgttgatcttgtccgtcagttcgttgaacagcttcgtagtaacttcaaggtcgagcggctggtcctcgttcggaccaaagatgtgtgggaagtactccggcagcaagcgaccaaggaacagattggcatccgtcaccgtcagagggccacccttgcgataacaagcgggaccggggtgggccgaagcagattcgggaccaacatagaacagaccattccgccaggtgaggatggagcctccacccgctgccacggtgttgatgtcgagttggggggattggatcagaacgccagcaaccttggatccgaacacatgctccagatggccggcgaagcgcgaaacgtctgtggatgtgccacccatgtcgaaaccaatgacgggaatcttctcagtgggatcatagctggtggccgcgaaaccgaccacaccagcagccggaccagacaggatcgccttcagcccgctgaagcgacgaaagtcaaccaggccaccgtcggattgcataaattcgaagcgacactctcgctgctgttccagacccccttcaaaggcggcagagatggaatcaatgtataa

SEQ ID NO: 18791 - DNA, 2127 bp, A.fumigatus
gtacacttcctttccccctccatccctctccgcgtttttacatcatctccgcacacatacacaaacacgatggaggaagaatcagggaagatcactatttccatcgaccgtggtggtactttcactgatgtccatgccattgtacctggtcgtccggatatcatcctcaagctgctttcggttgaccccggtcactacgaggatgcccccacagaaggtgtccgacagatcctcgagctcgtaaccggcgagcctcaccctcgagggcagccattgaagctagaccgcatccgctgtttgcgaatggggacaacagttgccacaaatgcgttgctcgaacggaaaggtgcgcgatccgtgctcttcacaacgaaaggtttccgagatctcctgaagattggcgatcagtcgcgtcccagtatctttgacttgacaatggccaggcctggcgtcttgccagagagcgtggtagaggttaatgagcgtgtcgtgccctgccacccgtctgctgacaaagattgtttccctggtgcccgcattgtcgagggtgtgaccggcgagaagtttcgtgtggtccaggagctggatcttgacgcggttcgggtggagctgcagagactgaaggagcaagggtatcagtcattgtctgtggcgctcgttcattcatacgcatatccagagcacgagcgtctgatcggcgaactggccgagagcatgggcttctccgtcacactgtcgtccaagttacaacccatgatcaaggtcgtgcctcgagggatgtcggccgcagccgatgcctatctcactcccgtcatcaaattatacattgattccatctctgccgcctttgaagggggtctggaacagcagcgagagtgtcgcttcgaatttatgcaatccgacggtggcctggttgactttcgtcgcttcagcgggctgaaggcgatcctgtctggtccggctgctggtgtggtcggtttcgcggccaccagctatgatcccactgagaagattcccgtcattggtttcgacatgggtggcacatccacagacgtttcgcgcttcgccggccatctggagcatgtgttcggatccaaggttgctggcgttctgatccaatccccccaactcgacatcaacaccgtggcagcgggtggaggctccatcctcacctggcggaatggtctgttctatgttggtcccgaatctgcttcggcccaccccggtcccgcttgttatcgcaagggtggccctctgacggtgacggatgccaatctgttccttggtcgcttgctgccggagtacttcccacacatctttggtccgaacgaggaccagccgctcgaccttgaagttactacgaagctgttcaacgaactgacggacaagatcaacgccgaaaggagagaaaagggccagtccgagtacacggcggaagagatcgcgttgggtttcttgaaggtggcggatgagtccatggcccgtcctattcgcaatctgaccgaggctcgcggatatgaaactgcttcccatcatctggcttgctttggtggtgccggtggccaacacgcctgttccgttgctgcgtcccttggaatctcccgcatcatcatccacaagtactcctccgtcctgtcggcttacggcttggccttggctgaagtcgtcaaggagtctcaggagccagtctctgccgactaccacgcctcgcagtcgacgctgcagaaacgatttgacgccatgacccaagctgctaccgaggagatggtgacacagggcttccgtgccgatcaggtccatcatgaactgtacctcaacatgcgatatgaagggtcggacaccagcctgatgatcttgaagccggaggaagactctggtttcctcgaccaattccgagaccgtcatcgccgagaattcggcttcaattcggagcgagcagtcctcgttgatgacatccgccgtgcgtacgatcgccgcttcccaaagtgcgcacggaaaagagtccactcgtcccagctgaaggaggcgtctttgaaagacgtcagtcacccgcctgataatgtcaccaaggcatacttcgatggcaactctagcccgcatcgataccccagtgtatctgctcgataa

SEQ ID NO: 18792 - DNA, 1323 bp, A.fumigatus
gttattacgcccgtctttgaccgccccggcggcaccgagatcatgttctacgtggcgtctcgcggccatcacgcggacattggaggcatccttcctggatcgatgccgcccaaatccaccgagctatggcaagaaggagctgctatcgagggcgacaagatcgtcagcaacggcgttttcgacgaaaaacgcatcatggagcttctggttgacgggcccgctcagtacgagggctgctcaggcgcaagatgtgtcagcgacaacatctcggacctgaaagcgcagattgctgccaacgcgcgcggtatctctttgatccaggctcttttcgccgagtacggcgtcgagaccgtccagaagtacatgtacgctatccagcacacggccgagagggccgtccgcgaccttctcaagggactccacaagaagttcggcggtcgacccctggaagcagtcgactacatggacgacggcaccccgatcaagctgaaggtcactattgacggctcggatggctcagccgtcttcgacttcgccggcaccggcccggaggtctacggcggctggaacgccccgatcgccatcacccactcggccattatctactgcctgcgctgcatgatcaacgccgatgtgccgctcaaccaaggctgtctggccccgatcgacatccgggtcccatcgcccagcatcctctctccgaccaagaccgccgccgtcgtcggcggcaacgtcgtcacctcgcagcgcatcaccgacgtcgtgctcaaggcgttccgcgcctgcgccgcctcccagggctgctgcaacaacctcacgttcggcacgaatgcgcgcaccgacccgactaccggcgagacgctcccaggcttcgggtactacgagaccatcgcgggaggcagcggcgcggggccaacctgggacggcgagtccggggtgcacgtgcacatgaccaacacgcgtatcaccgacccggagatcctggaaaaacggtacccgacgctgctgaggcagtttagcctgcggccaggatcgggcggcaagggtctgcatcctggtggggacggcgtgattcgcgagattgagttcctcgcgccgatgcagtgctcgatcctctcggagcgacgggtgcatcgtccatatggtctggagggcggcgaagatgcgcagccgggaatgaatctgtgggttaccacagataaggagacgggggtggagcgccaggtgaatattggcgggaagaataccgtgtctgtgggcactcatgaccgatttgtaattatgactgctggtggtggtggatggggggctgcacaagcatga

SEQ ID NO: 18793 - DNA, 891 bp, A.fumigatus
  unsure (890): Identity of nucleotide sequences at the above locations are unknown.
caacttgactgcaggcatggcgctcgactagatgctgctgacaaaaattggcatctcacctctcccaccccttatgatcctcccctttcctatggcggttggctccagtcccgcgcgctcggagctcgaatcatcaacctactccaatccttcgacgaccaaccccccgtttcgtccatcgtaccatcagatgagccaaaattcccctcatcgctcccgaattccaaaaagaagcgcagattcatcatccatacttctccatatcttcgttgcgtgcaaacggccatcgctgtcagctcagggatcagccagcactatacagacagcgacatcgttcaccccgccgtcgcttccaactccactcaggccaatggacattctatgggatcaactgcagactcacgaagcgggtccacctcgagcccgatcacatcttccccttcactgtctggtcccaacaatcatcggtgtcttctgcgcgtggacgcgtttcttggagagtggctgagtccagactactttgaccagatcatccctccccccaagtcggaaaggctcgtggctgcggccaaagccgaattacttcggcggggggacgacgtcgttcctgaagcggacacggctaacaagccgagtacaggcaacttccctggtggctggggtggtttcacgaactctgacacagctcgcgtggatggaacggtaaacagtggtggcccttccccgggtgtcacccacactccgggccaacgcacccgtgcagggagttacgacagtctcaattctgcccaaacccctcgcgctagaagaatcctcggcaaaatcaacactgatcttccaccgattccagacggcgcgtacgtgcctcctacgccgagctacgccatctng

SEQ ID NO: 18794 - DNA, 1125 bp, A.fumigatus
gtcaacctagtatgctcataccaattggaaccgcggagtcacgcgatgagcgaccctgaaccgccgcggataatacgatgcggggcccctcgagacaattggcgcaccggtttcgtgtccgaccattccggacaggcgggccaccttgcaatcgggtggattggagcccgacaagcgcgccagtgggttcggccgctggaccacgttgagaaagtcaaggtcgtgctagcaggctcgagtattgtgcgtgcgtcggatactcagaaccaggagattctcttcgctgtcaaaggtgctgctgccagctttgggatagtcacggaattcaaagtgcgcaccgaagaggcgcccggattggctgttcaatattcgtttacgttcaatctggggactgctgctgagaaggcaaagctcgtcaaagactggcaggcattcatagctcaggaagatctcacgtggaagttctactccaacatgaacatcattgacggccagatcattctcgaaggtatttactttggctcgaaagcagaatacgacgcgctgggcctggaggaaaagttcccgaccagcgagcccggcaccgtgctagtcctaacagattggttgggaatggtcggtcatggactggaagatgtcattctaagactggttggaaacgccccgacctggttttatgccaagtccctaggatttgcacctcgcgcactgatcccggattccgcaattgacgacttcttcgagtatatccacaagaacaaccccggaaccgtgtcctggtttgttacactcagcctggagggtggagctatcaacaaggtgcctgaagatgccacagcatacggccaccgcgatgtgcttttctgggttcaaatcttcatgattaacccgcttggtccagtctcgcagaccatatatgatttcgcggatggtctgtacgatgttctagctaaggcagtgccagagagtgcaggtcacgcatacctcggatgtccagatcccagaatgcccaacgcccagcaggcgtactggcgtaacaacctcccaagattggaggagctgaagggtgacttggatccgaaagacatcttccacaatccacagggcgttatggttgtctcctga

SEQ ID NO: 18795 - DNA, 885 bp, A.fumigatus
aagacgtcagtcacccgcctgataatgtcaccaaggcatacttcgatggcaactctagcccgcatcgataccccagtgtatctgctcgataagctcgagaagagcactcgtgtccatgggcctgccatcatcatcgacaagacacagaccattgttgtcgtgcccaacgctgttgcaagcgtcctggagacgtgcgtcgtaattgatctcaaggataccaagaccgacgcgtccgctgccagcgacgagtcatctaacatcgatcccatccggctcagcatcttcggtcatcgtttcatgtccattgccgagcagatgggccggacgcttcagaagacctcggtgtcgaccaacatcaaggagcgtctggacttttcctgcgctctgttctcccctgatggaggactagtagcgaatgcgcctcatgtccctgttcatctcggctcgatgcagtttgctgtccggtaccagcaccagaaatggttgggaaatctgaaagacggcgacgtcctcgttgccaaccaccccagctgtggtggaacccacttgccagacatcacggtacgctctactatccggtccgctattctatttactgactccattaggttattacgcccgtctttgaccgccccggcggcaccgagatcatgttctacgtggcgtctcgcggccatcacgcggacattggaggcatccttcctggatcgatgccgcccaaatccaccgagctatggcaagaaggagctgctatcgagggcgacaagatcgtcagcaacggcgttttcgacgaaaaacgcatcatggagcttctggttgacgggcccgctcagtacgagggctgctcaggcgcaagatgtgtcagcgacaacatctcggacctga

SEQ ID NO: 18796 - DNA, 438 bp, A.fumigatus
cgaccatcaggtgccccccacgctgaccctgcggtcttcgaactcggtgttcccgttctgggaatctgctacggtcttcaggaaattgcctaccgacttggaaaggataacgttgtcgccggtactgctcgtgaatacggccatgccgacctgaacgcccagagacttgacaaccagggacacgtcgacaagctgttcgctggtctggaggagcacgtcaaggtatggatgagtcacggtgacaagcttgtcaagttgcccgagggtttccataccattgctactaccgccaactccgagtatgctggtatcgcacacgagaccaagcctgtttatggtaattccccgatcgccgcgcaacccttcagctatctactgacgcagccacaggcattcagttccaccccgaagttacagtatgatcctttcgctcaatag

SEQ ID NO: 18797 - DNA, 222 bp, A.fumigatus
ctcatcttgcagggtgacaagcgcgtctacgctgagatcatcattctgcgcgcggttgagaccaccgactgtaagttgacattgggcattgatggagactttgtactaagatatatcatatcagtcatgaccgctcgtgccttccccttcgacaacgagttcttgagcaagtgcgctactcgcatcatcaacgaggtccacggtggtaagttcgagtcttga

SEQ ID NO: 18798 - DNA, 714 bp, A.fumigatus
  unsure (711): Identity of nucleotide sequences at the above locations are unknown.
cgcagccacaggcattcagttccaccccgaagttacagtatgatcctttcgctcaatagtcggcaaagtgcacgaaggtctaaccaagcgcagcacacccccgatggagccaagctcctccgcaacttcgccgtcgacatttgtggtgccaatcccaattggaccatgtcgaagttcgtcgatcaggaaattcttcggattcggaagctggtgggtgagaccgatcacgttctcggtgccgttagtggtggtgtcgactccaccgttgccgccaagctcatgaaggaggctatcggtgaccgtttccacgccgttcttgtcaacaacggatgcatgcgtttgaacgagtgcgagactgtcgctgagaccctgaacaagcaccttggtatcaatctcactgtcgttgatgccagcaagcgctttttggatggcctcaagggtgtcactgatcccgagaagaagcgcatgttcatcggtgctaccttcatcgacgtctttgaggaggaggcggagaagatcgaggccttggccgagaactccggtgccaaggtcaagtggttcctccagggtactctgtaccccgatgtgatcgagagtatctcattcaagggtccttccgccaccatcaaggtttgcctcccccgtctattttggggagtctgttactcacacatttctctagacgcatcacaatgtcggtgcactgcctantaa

SEQ ID NO: 18799 - DNA, 276 bp, A.fumigatus
tgcaacggcagggtccttggtgaagtcaccccggagcgggtcgacatcgcccggaaggcggatcacatcttcatctccatgatccgggaagccggtctgtatgacaagatttctcaggcttacgctgccctcgatcccagcaaggccgtcggtgtcatggtgcgtttggttgcgtccttgaattggtttcaatctaactcatcttgcagggtgacaagcgcgtctacgctgagatcatcattctgcgcgcggttgagaccaccgactgtaagttga

SEQ ID NO: 18800 - DNA, 225 bp, A.fumigatus
gcactacgtctataccctgtcaatttggcaatccatgttacagacaaacctggagaaggacactttactgcgtctccactcgatcatagatttcctttgggactgtcagttaagccgcacagcagcaaggaactcaagttgtcccagtggtacgaccagcgcaacgatatcgacttctatgccgccaagggtgggcaatggacaaagaacaatactcaatcttaa

SEQ ID NO: 18801 - DNA, 786 bp, A.fumigatus
acgaccaccgtcaaaatgacagcaccagatatccaccctcccaatttcacttcgtgcctggaccaaacccaaagctcactcttctcgataatcccaccagaaatccgccgggaaatcttcgcctatgctctggccgcatgtgaggacaccaagaatccatacagcaaagacacatactggacacgaccgggctatgacgccccgcgccgcacctacacagagctcctccggagctgtaaacgcgtctaccaggaagcctggtttatgccgttcacatacgccgagcacgccttctatctaacatggcgcgaccgagcaccgaagcaactctcgcccatggcattccagcaatgcctagacctgatccaccagatgcacggcaaggttgaagccggcaggatcaggatcttcgcgcagcttttcatgctcgaaaaaggacatgcaatgacggcgctgttggacatgacgcatttctatcctcgcagcatcacgctgacgatccggtacacggacttctggatgtgggaggagaaccagcctctctatattagtgcggggtgggtgaataggatctgcttcccggaaagcgtgaggcggttcagtatagattttgagagtatcgagcgccgcaaggacgaagtcgagtacattgccaacgaagcggctgagaagtggtttttccggcggaaggacgggaggttcctgacggctgataaggctgatatgtcggtgtcgcagtggaacggggagttctatattgaacagcaagagatggctgagggatga

SEQ ID NO: 18802 - DNA, 438 bp, A.fumigatus
cagactccccaaaatagacgggggaggcaaaccttgatggtggcggaaggacccttgaatgagatactctcgatcacatcggggtacagagtaccctggaggaaccacttgaccttggcaccggagttctcggccaaggcctcgatcttctccgcctcctcctcaaagacgtcgatgaaggtagcaccgatgaacatgcgcttcttctcgggatcagtgacacccttgaggccatccaaaaagcgcttgctggcatcaacgacagtgagattgataccaaggtgcttgttcagggtctcagcgacagtctcgcactcgttcaaacgcatgcatccgttgttgacaagaacggcgtggaaacggtcaccgatagcctccttcatgagcttggcggcaacggtggagtcgacaccaccactaacggcaccgagaacgtga

SEQ ID NO: 18803 - DNA, 291 bp, A.fumigatus
cgacacctatcaaaactcatagaagcctcacagtccttcaatcgcaagtccgacctttgccgacatcaccgcatccacaccaacgaacgaccataccactgcaccgtcaaaggctgcaacaagagcttcgtccagcgcagcgcactaaccgtccacttccgcacgcataccggcgaacgcccacacgcctgcaactttgctggctgcgagaaggccttctctgacgtacgtcctcctccacacatcacacacatgtactgtagcctaaaccttcgtagtcctcaagcctag

SEQ ID NO: 18804 - DNA, 222 bp, A.fumigatus
ctcaaggaacacgtcctagtttctagggatacacatgaaaatgaaataactagtcctagactcctagctaccagcattgtctggtcctcatccctcgcattgactccacagtcaaatcaattccaggaaagaaacccggctgccaagagcaacagacccaacctaatcttgcatggccgaacctacaccacagcgattctcgtctggccgggaatgttgtag

SEQ ID NO: 18805 - DNA, 585 bp, A.fumigatus
gatactctcgatcacatcggggtacagagtaccctggaggaaccacttgaccttggcaccggagttctcggccaaggcctcgatcttctccgcctcctcctcaaagacgtcgatgaaggtagcaccgatgaacatgcgcttcttctcgggatcagtgacacccttgaggccatccaaaaagcgcttgctggcatcaacgacagtgagattgataccaaggtgcttgttcagggtctcagcgacagtctcgcactcgttcaaacgcatgcatccgttgttgacaagaacggcgtggaaacggtcaccgatagcctccttcatgagcttggcggcaacggtggagtcgacaccaccactaacggcaccgagaacgtgatcggtctcacccaccagcttccgaatccgaagaatttcctgatcgacgaacttcgacatggtccaattgggattggcaccacaaatgtcgacggcgaagttgcggaggagcttggctccatcgggggtgtgctgcgcttggttagaccttcgtgcactttgccgactattgagcgaaaggatcatactgtaacttcggggtggaactga

SEQ ID NO: 18806 - DNA, 300 bp, A.fumigatus
cattctcccactatgcgaatacaatcgagcctctcatcgtggttcctctcctccgctctcttcaccggtctagcctcggcgtcaggatcgttcgactgccgtaatatcatcgcagaggggatcaaatacgacctctacggcttgcacggcgtgcacacgatctaccatgtcgacaaggcggaagactacatcgtgaacacgacctacgtgctggacatctgcaaggcgctcggcaaggcctcgatccggggggatctgaaatgcgggacttcgaagaatagtgcgtgccatggcacctag

SEQ ID NO: 18807 - DNA, 348 bp, A.fumigatus
ctgttgttctactctgtagtctgcggattccagtacaagtatacccccgacggctcggaggagatcagccatgccttccccattgccggactggaccccctgggtcacggcagcaaggacgccgaggtcacgcggctgaagggagatgggcaggaagggctcctggtaaaactggcggggggcgagtacatcgacaaggacaagaagaagaaggatgcacgggcggtgattgagttccaatgtgatcccgatcggtcaggcctggaggggttgtctttctgtggaggaggaagaggaggaggaggagacgcgccgattttcaccacgggcgtcgaaggatacgcacta

SEQ ID NO: 18808 - DNA, 555 bp, A.fumigatus
actggcttttcatgttgcgatttaggaaccatgcagacgcattattaccgctctccggctagcccaaatcatcagagtggtcgttatgagttacctccagtacagtcagtgacctctccttctggtcctttcccacagggaacttccgcggggttgtgttccgctccgccgagcaggcccggcagcggactgagaatggctcagctgttacagcctttgggacaaccaccctcgacaacttcaacatacactcgttcctatgagtctagcggttcccccgccgaagttcctccaatccgttcggatgtctcttcgctcaatggatctgtatctgggggctcaactcttccacctgcatctgcggtggggcagcagcagcagcagccaccaccaccaccaccgcagcaacatcatcatagtcaccaccatcaacagggtcatctacatcagaaaagggcgtatcgccaaaggcggaaggatccgagctgcgatgcttgtcgcgagcggaaagttaaggtaattactattcgtgcaagtccaatgaccatagattga

SEQ ID NO: 18809 - DNA, 246 bp, A.fumigatus
ctctcttaccctcagtgttgtctcagcccaccctttccgccttcaggaataaacttcatatacactaccaagctttcgctctataagctttccatcatcaacctgtctctagagttggcttcccctcggtgcagccaagtcaacccaactgacgccactttgagcgtgggcgacacacacacacttttccaagcaagacgcggcaccaactcccctgatgaactggcttttcatgttgcgatttag

SEQ ID NO: 18810 - DNA, 270 bp, A.fumigatus
tcccgtatgtatctttcctctagtgttctgctttattcatgtacaccgtcaggctggatgttgctgacgcatagcaggtacaagattggcgacgccttcttccagctgcctctggcagacgcgcagtctcttctggcgtcgtcgaccgagcagattgatttggaggtgtccaggctggaggagactttgggagatgtacgtgaggagctgcagcagctcaaggttactctgtacgcgcggtttggacgcagtatcaatttggagacgtag

SEQ ID NO: 18811 - DNA, 195 bp, A.fumigatus
ctttccgctcgcgacaagcatcgcagctcggatccttccgcctttggcgatacgcccttttctgatgtagatgaccctgttgatggtggtgactatgatgatgttgctgcggtggtggtggtggtggctgctgctgctgctgccccaccgcagatgcaggtggaagagttgagcccccagatacagatccattga

SEQ ID NO: 18812 - DNA, 231 bp, A.fumigatus
atcatatggcaatactcaccgagtacgctgtctttcctcaaccgctccatgacaatagacacctccgtgtaccatctcatctcgtcccatcctaacagaacagccatgctgctgtatcctgccccgcacggaccacctcccaccacagtcaaatcagtctccaaatccaccaagaatcagatactcaagcccattaagcccatcgccacaaagctctcaaccctcacttaa

SEQ ID NO: 18813 - DNA, 294 bp, A.fumigatus
gcggcgactaatgacatcagatatgttggcaacaaaatcgctacgctggtcatgcagttgttagggtgcgatgttgccgccctgaatactgtccatttcagtaatcaacccaatatccgccgtcaggttgagtcaactaacattcaacaggcaaccacactggctacaggcagtttaaaggcacacggtcaacagctcaagagattagagacctatatgagggtctctgccagagccatctcacggattttgatgtcatgttgtcgggttatgcccctagtgctgcggcagtag

SEQ ID NO: 18814 - DNA, 1662 bp, A.fumigatus
cccttgctattactggcgctggaggactatttcaagtcgccgtaccccgagactctagcgacgctgtacaacgccgtcaatgagatggatctgtcattgatgcccaagctttcgctcctagaacgacagattctgcaggctagtaatgcgaaggacatgtttatcgaaaaatttgagcagatgatccagcagcgactgatcgaggagggagagcctgtggaagattccccaccatcacccaaaaagcccgcccctcggtatgcgcttccccgcgacacccacgagttcgaatcgcgagtcatttacaatgacattcccatccctgtcaaagtgccaaccgttatatggcctgagattgtgggagacttctctctcatcaagctcatccagacgttctctactgttcatgccacagcgcctcaggcctttccgcttcacccgcacttgaccaccaacggttcctatacgcacccgatcatcgttcttgtcaacgccatgctcactcagaaacgggtgatcttcttgggccacaatcggccctcgggcgaagtagcagaggcagttctggctgcgtgcgctcttgcatccggtgggatcttgcgtggcttcacgaggcatgcctttccctataccgacttgacgaagatcgatgatctgctgaaagttcctgggtttatcgctggagtaactaatcccacgttcgcaaatcatcccgaatggtgggacctcctgtgcgaccttcccaccggcaggatgaaaatcagcagccacatcgagcccgccccggttacggagggtctactgtattttcaacagagctctttcctccaaaactacacgccgagtgcccatccggatcccaccggcgacaacgccttcatggaagacgttcaacggagtatcacgaaccgtcacggagagaatgcgatccgtgcaaaatggcgcgcatacattaccaaatttacgcgcgtcgcggctgcgtttgaggagaccgtgtacggagcgtcgaatctctacatcatcgggccgaacgaggagctatctccggagagcccgagtggcgtccaagccgaccccctggaccccacaacgctacgtggccatggctatgtgtggcccgacgaggcaacgaagcagcgagaattgatcgcctctgtgtcgcgaatcgaaggctggcgcacgacacggtcctactattcgtttatacaggacatcgcggccatgtactaccccgcaagaccaatccagaaacctgacctgcaccatcaccatgatcgactgcgcactttgcggctatctcatgctgacgctggagctatttaccttgccttttccaaagctgtcaaggactacgcaggcatatgccagctgctgacggtgacgccagaaagccaagccgggctgttgtacatcagcatgggtcttttccatcctgatcaaacggttcgtgaagcaaccgccgatcttctagatcgaatagctgctcaccccgccggccgacacttctgggcccaacttagccgcttcaataaactggcatacttccgagtccgacgcgagagggatgcagcgcaaagtcctgtatcagggacagggtcgagcctgggggcgccgcaatctctcattggaattgccaccggcaacgcctcaaggcgaagctga

SEQ ID NO: 18815 - DNA, 702 bp, A.fumigatus
  unsure (537): Identity of nucleotide sequences at the above locations are unknown.
tccggaacacccttcgttaaccacatcaccctcagagtcctctccggaatcaagatcacctccctcagcaccctcgccgaggccatcactgccatccacgccacctactccatcccccatgtcatcatcacctctgtccgcatctcccagttctcgtcatccccagaagcgaccaccgacagcctaaccgttatcggctccaccatcaaatccgacgactcccctcggctcttccgcgttgacgtccccgccctcgactgcttcttcagcggaacaggcgacatgttcgcagccctgacggtcgcccggctccgcgaggctgtgttcgccgccgactccaccctccgctcgactaaatcgtgggtttccccggatgacgtcaaagccacggatctaccgcttgccaaggccaccgtgaaggttctggcgagcatgcacagtgtcttggaaaggaccctggaagcgcgcgatgcggagctccgggccgctgcgtctgcggaagagactgaaccgggcttggttgaggagagaaagccnaaagggagaccttgcgcggaccaaacccccctagggaaggttgttccaaaccggcggttcttgcggaagccggattgtgagttcccgcccccgattggaaaaggaagatctggctctaggggtttcaatatcgagggtttgaataaaccactcttccggttaacg

SEQ ID NO: 18816 - DNA, 189 bp, A.fumigatus
caacacgactacaatgttcccgtctatattacatataacgacagtgaatatatctatttggttatacaattcttggatatcattttctctttatttttttttctttctctttcatgtggatggggaggtgggttccacctcatgtgtattgttctaggcgatacggcattcaatgacatggcggtatga

SEQ ID NO: 18817 - DNA, 399 bp, A.fumigatus
cattcaacaggcaaccacactggctacaggcagtttaaaggcacacggtcaacagctcaagagattagagacctatatgagggtctctgccagagccatctcacggattttgatgtcatgttgtcgggttatgcccctagtgctgcggcagtagaggcagtaggggctatcggcttagatctgcagcgcaaggccgagtcaaatcctggctcattcttttggggtatgcgcaatcctatcctcgtcgagctccccgctaacggtgaacggagcacagtcctagaccctgttatgggcgaccagggccggctatatgtcaacgatgatgtagtgcccgcatataaaaagatcatccaccacgctgatctgattctccccaaccaattcgaagccgagtaa

SEQ ID NO: 18818 - DNA, 714 bp, A.fumigatus
ggagcatactttcattcgcacttgtcacgctcgcttctaccccggtccgactcgctgccgacaccctttgacaccaaatctccctacaacttcagagccgagagctgcccccagttcttcaacgacttcctctccaactcaacggtcacctcctgctatcccatctcgctcctcctccacgactccacctccttcttccacactcttacctccgcaaccgccacctcgcacgtcctcgacctctcctgcgccgcctccgtcgacacctgcgcctccatcttcaaccgacttgccaccgacctgctgaaagccgacgcctgtggtaaagactacgagctcggaaacccgctcgtcgcaagcgcctacacaggcttcatcacctacgagcccgtctaccgcgccgcctgcctcaagaaccccgacacaaaagattattgtttcgtcgacgcagctaccaacgcctcctccccgcagaacctcgacacctactccatccccgccgggtacaccaccgacgaagccccctggcccacctgcaacgagtgcctgcaagccagcatggatatcttcagccgctgggcgcaggtcgacggccagccgctcacgacgtcctatctcccctctgctttggcgctgaaccggcactgcggcgataacttcgcgaatgtgaacatcactgtgggcgagaaagcgaaaacgacatcgggggcttga

SEQ ID NO: 18819 - DNA, 753 bp, A.fumigatus
cacgctctcccttatcgccttgaggtcaattccgatccattgtgggcaatgtcattcattcaattctctgccaaaatgaaatcattctctcattttagtccatattggccaagcagaccgtcgcagtggggtgaaactatggggcctgatgtctgcagtacctcacaacatcaccagtccggcaacccgaaaacgacttcccgattgtcgaccttgatcacgcttctgatggtactgcttctgtcgtcggtggtttctgcggctgccattccagatgaatctcccccactagctcatggtgcgttcctatcgcgaacggaggcgtttccgggcgatcatctggatagtgggcaagcccgatacggcaaaacctgggtcatcgagagcagtctagccgacgaagcagccacgctacccatcctcgttgcccccgatgaggacgttgaggagcatactttcattcgcacttgtcacgctcgcttctaccccggtccgactcgctgccgacaccctttgacaccaaatctccctacaacttcagagccgagagctgcccccagttcttcaacgacttcctctccaactcaacggtcacctcctgctatcccatctcgctcctcctccacgactccacctccttcttccacactcttacctccgcaaccgccacctcgcacgtcctcgacctctcctgcgccgcctccgtcgacacctgcgcctccatcttcaaccgacttgccaccgacctgctga

SEQ ID NO: 18820 - DNA, 1128 bp, A.fumigatus
aacaccgttgatccttccagccccgtggtgaagacatattctcatttgatcaatgcaagaacgggccaagcaattaatgtcaggtcaccatctactgaaattacagtcgacgagcgcccccgatctgctggaacaattcagacactgcgagcgctcgataggtcaaggccaaggtcggcaatctcaagcacaagtcataatatctgggtcgagagcctcttgagaagatgggaaaaccctgctttccgtcgaccggaaaggccaataaccgcgattagcgacggtgaaagtcacagaaacatgagtgataatggtctcattcggccttttgactgctcaagagggtcttacggattggatgattttggattggcgaaattccgaggccgattaagcaagagtcatctagcgacggccaacgtcattgcacaggtggatcgaaagtttatcctcgtaaagctcgccgatggccgtagctcacggtcggccttggtcttgattgatcagcatgctgcggatgaacgatgtcgaattgagagcctttttggagccatgttcgctgacggtcatcgccaagttcaaagcatcaggattgaccctattactttcgatatcccgctcgtggaagccgctctttttggaaagcatgccgactcttttgcatcttggggtgttgggtacactgtcgagcggaaatcatcagctagagctgccctcgttgtagtgacttcacttcccacgctgattgccgagcggtgtcgattagaacccgacctggtcagcgacatgatccgcggcgagatatggaaacatgaagagaacggacagggagctttggctcttagcgatcaacgagcccagagatccaaggtgcatcgggacgagttgggggttgagactgagggtaactgggtggaccgattgacgagttgccctcaggggataattgacttgctgaactctcgggcatgcagaacagcaatcatgttcaatgatatgctgacagccgaggagtgcaaaagtcttgtaggtcgattggcgggatgcatgctgccttttcagtgcgctcatggacggccgtctatggtcccgattcttgatgtgagggaaagtgaggagttcttatga

SEQ ID NO: 18821 - DNA, 759 bp, A.fumigatus
cgaattgaacgatcatccacctgctatcaactcatcacaccccctcatccccccccctctcaaaaaataatgccttactcttccacccccgaggcgtcaaccacgcctcttgcggactacttttggatagctggcgtggatggcactgaggtactagagacctttcgaaggttgggcgatgaatacagggcaaacagcgccacttctcctggtcccgctctcacagataccattgaggaggatgcggacgctgaggaggctcacgactcccgtttcgacgggctctcgagacccaattcgactttgcccggctggaactcatttcagcggttctccatgcgctcggaaaacgccgccgagggaaacgcgaacggctccaacagcaatcgaagcagcctgacgatcaagggtgcgcaatcccctcggggctcgtcgtttctggaggactttgacttcgacaaggcgctgttcaagttcgcgtccgagagagactcgttcctgtccgacctgagcctcagtgccggggccatcacgcccgcctcacgcccccggtcgcggttgcgcacgcaaaagatcaccgccgaggagactccatcacagccgtcgagcctactacgatctgggatcggtagcgtacgacgacacatggccttccgggatatgaacagtatgaagcggcagccgtcggttgcccgtcaaggtgagtccattcccggcgatattcgccatacggcgccatctacgctgacaatctactaa

SEQ ID NO: 18822 - DNA, 2121 bp, A.fumigatus
actctgttcttttcctggacagcttccattcgtacttcacggcgtctcagcaattacaactctgtcatccccgctccgcaacccctagaattctcccccaccatgcaccctctgaagcggcgattcgagcccgttcttctcgatcgatatccaacaaaaggtatgacggaggagctgaagcagcgcggaaccttcccggattacgtcccgatgtttgcctttcccaatgatatcaatatcgtgtcttccgaccagcggcctcgatccacgtggcatgggttcaccatgacgactgacaacgggtcccgactgcatgcaatctgcgtaatcatctggatccctctgaaccaacgagcggccgaagagttggagaagcgctgtgaagagtggaggaaagagaacatgacggacgaggagcgagagctggcagcgagtctcggggaacggctggcctccgagcgggccaagctgtcacggctcctggcgaagcttcccaccgtcgtgtccgggtcggagtcgagagaacagttggaggatgagatcagcgcggtggaagagaagattggactcatgaccgatctgctccggccggtgcgccacggggcggcgtcaaagatcgaaggcttgaccgacggagaaaccggtttctggatcccccgcgcatatggcattttggggcgtgaggagaacatgactagcttctggaaggagtggttaaaggccatcattgtccccatgaccgacggcggcgttcagcgagtcccccccagctcgccgcgcatgggcgtctggcaacccttggagcgatacgtgatgaatctgtgcaccgaggcattcagccccaactcgtccaagacgcaggtcgagctggccgtccgggagctgcgcctcttcgcacgcaaggaggcggtcaatgagctgcccgggtcccgaaacacggatctctatgcgttgttccggacgctgtccctgtcaaacatcatcattttgttcgagtacgccctgaccgagtcccgcatcatctttctctcgtcccacacgtcgatgctctacctggccaccagagccctcgtcgacctgctcttcccgctccagtggaccggtgtgctgattcccgtgctcccagcacggttgatccaggccctggaggccccctgtccgtacattgtggggatcgagcgtcgatatgagaaggtcgaattgccgtccgatgactttgtcctggtggatctggatgccgacgtgatcgagagcacagtgcagccgacgcccctgccgcgtcatcagcgccggaagctgctgtcgctgctccagctggccgctccccaccacagtcggtgcgcggtccccactggccctccagcttacgcaatcgagacgttcccattcgatgcctttatgtcggaaaacccgtccatgttcaacgcccgggcgcagtccacgcaactggccaagtatgtcagtctcaattcgagtgcgtttggtcaacagtctgtgctgccgactacgttccagccactcatcttcaacgcgtatctgtatgcacgtaacgagcaagcggcgtccaggggcttctcatccaaaggctccgaccgaccgagcaccgggtccacgtccaagaccgggtcacccccttccccgagggaccattcaccgacctcgggccacttcccgcccagctcccggaacgattcgggaatggctctgcaggcttcgctgcgggagaaacggtcgggccattttgatgcctcatcccggcgaagctcgtcctttggcatggagatgaggccgggtgttccgagacggccgagtgctcctttccttggtcatgcgcccaacctgtcagtcaccacgttgaacacggaatacaactcgggctccacctatgcaccgtccgtctatgctcagtccacggtggcagcctcgacgatcgtgccgcagtctgtcgcgcagcccatccacaatgccgagggcacgtgctgggttgagggccactgcctccaggtggtcccggccgatgacaaggccgtctgtgccgtgtgcgatgagcgagcggaggacggcatgtaccgatgcagtgccgtcttcaccgggggtgaaaaggcgtgcagtgggagtcaa

SEQ ID NO: 18823 - DNA, 432 bp, A.fumigatus
ttttcagaaaggaatatttatgtctcagccgaggattcaatggctatttggcgtattgatggcaatcaacatgcatcgagcctgcattcattcaggccaattgagactcctgattttgatgtactacctgaggagtccgagggaaacatccgcgaacggactaagacgatcacaaaacacctggtcaaagagaacgagaatgcaaaagacgcgtccatcaattaccagacttacgatctgtacatgaagagggccttgctcctgaactacgccccgccaggttactcgatcggaccttttttcgagtcttccactactgtcatacgacatggaaagatagtgcgacggcgctccgccaagaatcgattgagatttaagctcgctggaaagacttcaactatggccaagaaactctctgaacacgagctctga

SEQ ID NO: 18824 - DNA, 1353 bp, A.fumigatus
cgttggcaaaggaacaattacccggctgctcggctacaaggtctcgaacgcgatcttaacctcagcgatgccgactatcaaaccggtctttccattctattcgtcggatacattctcatgcaagtgccgtccaacctgatcctgaactatatgggtcggccgtcgctatatctgggattcttcacctccgcatggggcctggtctcgctgctgacgagccaagtcaagagcttcggtggaatcgtcgcttgtcggttcatcctgggtctggtcgaggccccattcttcgctggtgtgctcttctacctctccaagtggtacaccaagaaggagctagctctgcgcatgagtatcttctacgcaggctcactcctcagcggagcattcggaagtctcatcgcggcaggtatcctgaagggtctcgatggaaagaacggcctagcagcctggcaatggctgtatattattgagggtgccattaccatagccgtcggcatcgcggtcatgctattccttcccgacttcccctccacctggaaacgcctttccgaggaggaacgccacgttgcgaaccgccgactggccatcgaagcggccgacgccgacgtcgacgaagccggcaagatgagccagatcaagggtctcaagctcgccttcagcgacatcaagacctacgttctcgccatcgcctacatgtccatcaccggggccagcggcttccagaacttcttccccaccctcacctcaacactcaagtacgaccactttatctccctcctgctcgtcgcgcccccctacgtcttcgtcgtcttctacagcatggcgcactcccacctctccgatcgcttcggcaaccgcttctggtttttcttctaccccatccccgtcactatcatcggtttcatcatcttcatgacaaccgacagtttcggaccaaagtacttctccttcttcctcatgaacatcatcttcgcccagaacggcaccatctacgcctggatcggaaacgccatcccccgtcctccagctaaacgcgctgccgcctacgccttcatcaactccatcggtaactccgccagtatctggaccccctacacctaccgcaagcaggacttcccgcactaccgtcctgcgctgggcgtctgcatcggcctgcaaaccctcggcggtatcatggcgatcatcatgtacttccatctgcgctcgttgaacaagcgcctggagcggctggatgataccgaggtgacgctcacggataaggagatacggcggctggagcgcacggcggagatcgagggcattgaccttgcggctgcacgtcggctgcaaaagggattcagatatatcgtgtaa

SEQ ID NO: 18825 - DNA, 678 bp, A.fumigatus
tcaacgcaattgtcaatcctgtactacatccgcacgaaaggttcgttgatagatgcttttgacgcaatatgcaggcgtgctggtcaatcatgtcacgcacccagccaagaattcatggtgtgtactggtatcgaccggattgaaacgggagtccctgcttacttggtctttgaaaaatgtaaacgagctaacggtggtatcaaaaactctgcaaaggctttgactatagcgactggtcgaacgccaagtgctcttcctgcccagacggctattggagaaggctatcagcccgtgttgatagccgcaagacgaatgttcaagcatgtccctgagttagagtactacgttctggatatcgagagggaacttctggccaaagacctctcctcgttccacgtcatcacctcaacaaattgcatccatgcaacgcagaacctaatgaattcgctatcaaagatccgtaaaatgctacgtaacgatggagtcatcgccttggtggagatcacgcgcaatatgttctggcaagatatcgctgtttatcttttcgagggatggtgggtgttcatgatgggcgcgaacatgcgtgatcctgggctcaccgatgtggcatggacctctggagaggagcccgaaactaacactattcggatcattggaggctttgccgggtcgggatag

SEQ ID NO: 18826 - DNA, 237 bp, A.fumigatus
gtcgtcccgtcactggaagattctgccttattagactttccccgctataatttaacatcaaacggccacaacttgtccgcttttggtgattttagagcctcgccacgagcctatgattctctggtcgtgtttatccattatcgtatgccttacgatgagcattttttttgcagcattcaaatttttatttggaacccagccatcagagctcgtgttcagagagtttcttggccatag

SEQ ID NO: 18827 - DNA, 579 bp, A.fumigatus
ggtttcttgcgtcgagcaggctgccgggtggttttaaaatatcatagtataaatgaagctggaaggcctccttccagctcaattgagagtatcaacaatcatccagactttcttatactgcctttctctaggagcccatcaaatctctctcgcaatttcatcatgaatctcaagactattaccatcctcctcagcctatgcgagacactcttcgccgtccccattcaaggctcccaaaaagataaacgccagggtctcggaggctttaatttcggtgatctggcgagcatgggtacctctggcaccagcgcaggctcaaacaccaatccatttgggtcgttgttctctggcatcattccgtccacgagcagctcaggctcctcagccggcacggggaatatgattctcccagctggagctttgacctctggatctcaaaccggtaacgacgaaacaaaccaaggacagtctggttctggcgactttttccagggcggagaggatggtgaggaggccgccgcggtggcggttcaagacggcaatgagggtgacggcccagaagatgagaccgttgcttga

SEQ ID NO: 18828 - DNA, 315 bp, A.fumigatus
  unsure (109): Identity of nucleotide sequences at the above locations are unknown.
cgaaccgctagggtcttggacatttttcgcagttactatggtggactcatctgcgtctgctggtcgcctgatggcaaatacattgtcaccggcggacaggatgatttantgactatttggtccttcccggagcgcaaaatcgtaactcgttgtcagggtcacaactcttgggtttccgcggtcggcttcgatccatggcaatgcgacgaacggacctacagatttggtagtgtcggtgacgactgcaggcttcttctgtgggacttcagcgttggcatgctgcaccgaccgaaggtggtacgtatccctttataa

SEQ ID NO: 18829 - DNA, 276 bp, A.fumigatus
acaccgcaggtctatacagaaatctccatcttcaggacacttacagacaaggtcaatgaaatgaccaaaggatcgggcccccggaatactgcatatagggattctgaccatgaacaactaatcggaagtaaaatactgatctacatcaacggtgttacaatcacgataactctggcttggttggatttcctgctgcctgaacttcatgcaacacagcgatttgttatgtttttttttttttttttttttttttttttttttttttttttggcttga

SEQ ID NO: 18830 - DNA, 966 bp, A.fumigatus
aagaacgactttccattaggcacctacgaactcaaggacgacctgcacctagcaacccctcctccacacccatctgaagctccaatcataaatccaaatcctcttgcgactgttccaacacctccgacatctggcgtcaaggtttcactagtttgtgtcagtcctcgaagcaggactccctctttcatctcaaagcagatcgtaacagcgcccccttttggagatggaaacccggcactggtacctgctcctgtcaaggacgggttgaaaaggcggaagcccaagaacaacattatcaagagcagttcgtccttcgtatcacgggtcatcactcatgaagtggccacaaagcggttgagtgagcggagtccggaaggcctctttgctttcgccaatatcaaccgcgccttccaatggcttgatctcagttcgaagcagaaggaagacccgcttgcaaagattctcttcacaaaggcgcacatgttgtgtcacgatatcaatgaggtcaccaaaagcccttctcatatcgacgtggttatgggttcctctgctggtgacatcatctggtacgagcctatttctcaaaagtacgcccgaataaataagaatggagtcgtctgcaattctccggtcactcatattaaatggattcctgggtcggaaaatctgtttatggcttctcatgcaaacggacaattagtagtctatgataaagagaaggaagatgctcttttcacccctgaaatccagaatcagtcagcggaggcagtcaaggcatcaagtacacagccgctgcaggtgttaaagtccgtcaactccaggaaccaaaagactaaccctgtcgctctttggaaacttgcaaaccaaaggatatcccactttgcattctccccagaccaaaggcatttggcagttgtcttggaggatggctctctacgagtgatggactacttgaaagaagagtag

SEQ ID NO: 18831 - DNA, 1278 bp, A.fumigatus
gagctcgaaaaggaatactgtcctcctctggattcagctttgtttacggctatcgtctgcgactatgacctagaaaaccccgcgcaggtccagcaactccgcgacaccctggacactctgaagttatcagcatgggagcaggaggatctacccttcgatccgtctggaaccagcggactgagtcctggcgctagtggtgacgcagatggcatcctgtcagagcccagcggctcgcaaaacggcactgctccgtcgcgagaaacagatatcaccagtctggcgtccgacttctcctctgtgggtctggacgacaggcgcacaaggagtcagggcaatagcaattctttgcgttacacgattaaccctgatggatcgctgtcgctatcgggcgcttccgagaacgacaaagtctgttatctgacagatatgtttccttctttggatcgctttactgtgcagcattcgcttaggaagtctgacggtgatattgatcgcgccatggacgtgctattgaacattgcgttctttgatgagcagcaagaagacgaagatggaactaagcttgccatcccaaagggcatcgatgggttcgaggagtgttctactggaggcactgggcggaagaagaaccgcaagcgcaaggggaagaataagaacgatccggttcggggactctcttctccggcagcttcaggttatttgcaggatgagaatatccccctgaacaaatgggacgctggtcagaaagatatcgagtttatctgttctaggactttgcctgtcctaaagaaggaggctgtaacttctgcttatcatgctaacggagcctcactgccactgacgattcgatctcttgcgatggcacatgcgccggaggaaaaacatatcaatggacaccccgtaatgcttgcacaagttgcagaattgacgcaagaatttccgtctgttgcgccaatactactgggtggcctactgaacatcactcgcaattcgacgtctgctgccggtgaactggcagtcgccatgctcacccgtccagcggctccttctgtgtctaacctgatcaaaatcaccactgcgcctccacccttggatctcgatgacgatgagcccaagagacctcctgtggagtcgcgagtccttcgcaaatacgggactgctccagttaccgctggcgaccactttgtggccagtgcagaggctttccacaaagcttcagcagcttaccgtcgtggaaaatcagacaaattaatgggaggagcagctgcttactactcc

SEQ ID NO: 18832 - DNA, 324 bp, A.fumigatus
gctgactccgaatcaaaagaaacggctatcaggtcaacttcgtcagcacgggacccacgaacacggggatcctggcccaatctccccagttcaacgtcacagacgtcaagactgtgccaaagactacttccaccggtgagattctacatcaaaaattctgcatcatgcgttctaacaaattttccctctgcagagagccaaaccgccaccgcgactgcttccgctaccgccaccgctaccgcgacgactaacgctgctgcatctctcatcgccccagctgctgtgggctcctttatttggggtcttttggttatggtcgtgtaa

SEQ ID NO: 18833 - DNA, 249 bp, A.fumigatus
gcagcatctgatggtactttggtgcggcataacatacatctctacattctccttttagccacagcactcagaattctgaaatcctgtcatcggcactatataagccaaaagatgaccggaaagaagcaaacacaggtgcccggccaccgatcagtcaatgcccgaaactcaaccctgtcctttgcctacattgacaaaacaactggaatccttgctcttccgatgacgtgtttggcttcgctgtcatga

SEQ ID NO: 18834 - DNA, 246 bp, A.fumigatus
ctccgaatcaaaagaaacggctatcaggtcaacttcgtcagcacgggacccacgaacacggggatcctggcccaatctccccagttcaacgtcacagacgtcaagactgtgccaaagactacttccaccggtgagattctacatcaaaaattctgcatcatgcgttctaacaaattttccctctgcagagagccaaaccgccaccgcgactgcttccgctaccgccaccgctaccgcgacgactaa

SEQ ID NO: 18835 - DNA, 921 bp, A.fumigatus
gtcatggcggacgtgtctggcaacatgctgaagcgacctcgtcccgaggacgaagacgataacgcacagaaaagaactcgttccaacaatggctcgccgttgccagctcaaggaggcaacgctcccgccgggaaggtggacatcgagaagatggtggcggaagcgagagcaaaagcagaggctgtgcgcgccagacttcaggccgccagaggcggagctccagcgttcacaccagcagctccaagcccgagtcccactcctcctcctgctacctcagcaatgtcgaaattagaacaaatgaaagcgagagtcgccgcagctaccggacgtgccaacgcgactgctcagcaacgaatccctgttccacctcctccacctcctcccttcgacgatgacgatggttcgtcacgggcccgcggcggcctggatgttggccttcatcctgcgcttctctcagatactacagattttcgaagtggtaaaggacggcagtcagctcagtccaagatcggaacaggccatcggactgactctccactgcctggcacgaaggatcgggctggactcgacttgtcagggccttcactcgaagaaatcaagagtaacccctactttgatccaagcctcggtcctaaagctactatcgccaagccgagacaatcccggcaactgatattcaatcagaagggcaaatacatccagcaggcggcggctctacgtcgacaagcccagctggaggatatgaaaaggcgcatcgcagaaagagcacgacaggctggtatcgatgaggatctggatgtcgaaaaagcatttcttgtgcctgctcctccggccatcgaatggtgggacgagggtttggtgaatggcaacgattactccgctatcgatgacgaacgcaacctcaagatcgacacacctgat

SEQ ID NO: 18836 - DNA, 771 bp, A.fumigatus
tcctgtccctggtggtttatacgatccggctctgggtgcttggggagatcatgtgtaagtccaacacttatgctatgtgtcttcctacgtcagctgtcgctggttattgcctacttcggacctttttggctgaccgcatttagctgcacgacctgccgtcagaattcgtggtcttgtactggccatcctggacatattgagcttcctgttcgcgtttacaatgtcactttcttcgatcagttataccgactacttagagcgcaatgtgtttactgccatcgtttccagatggcgcgagttcagatcaacgcctatgtgtgcaagctacgactcctacaatacggactagtcgacgaagttgaggccatagaggcgatggggactggtcaaggaaacaagaagaagtctgcaaaggacgccgatgattcaggcagcgaggaagaagacgacgatgacctcgtcgctcgcagaaatgcatatgtcaagaaggtaattcgggaggcacatgctgccggcagactgaagggtattatgtctggtgcgaagaatcccatggctgcggagcagagacgcactttggtcaagcagttcttcaaggatcttgttagcatcaaaaaatgcagcagctgcagcgggtatgttatgtcgttatcactctccccatgctatttctatcgtttgctgacgatgtgcaaagaatttcacctagttaccggagagatcgtttctcgaagattttccggaagcctctgcctgagaagtctagattag

SEQ ID NO: 18837 - DNA, 669 bp, A.fumigatus
caaaagctacagtacgaggacacgaaccctgacaaacttcttcgagacaagaagaagaatattgacggtctcatcagtaagaaggcattcaatactttgatgaacatgaaatatctcaagtctgttgtcgatcctggcgaagcagtcggtatcgttgctagtcagtctattggagagccgtcaacccagatgaccctgaacactttccatttggctggtcactcggcaaagaacgtgacgctgggtattccccgtctgcgtgaaattgtcatgactgcaagcgctcacatcatgacgcctacaatgacgctgatcttgaatgaagaattgtcaaaggaacattcggagagatttgcaaaggccatcagcaagctcagtattgcggaggtgatcgacaaggttaaagtcaaggagagaattgccacagccggttcacgctttaaggtctacgacgtcgagattgccttattcccagcagaggaatacacgaaagagtatgcgatcacaaccaaggatgtccaaaacactctgcagaacaaattcattcccaagcttgttaagcttaccagagccgagctcaagagacgtaatgacgagaagtcgttgaagagcttctctacggcccagcctgagattggtgtctctgtgggtgtcatcgaggaagggccg

SEQ ID NO: 18838 - DNA, 330 bp, A.fumigatus
cgcacggcagaaaaaagttcttgggtcaacttttttgcagcatcaccaccgaacgaatcccgccatttatttctccaggctagcagccaaagaaaatcgcattgccagcgatttctgtcgctcaaggagctgcaggtaatcatggcgacatttgcacggcctgtagcctcgtcaatttcgggcattgaattcggagtctattcggatgaagatatcaagtccatttccgtaaagcgaattcacaataccccgactttggactcttttaataatcctgtccctggtggtttatacgatccggctctgggtgcttggggagatcatgtgtaa

SEQ ID NO: 18839 - DNA, 2943 bp, A.fumigatus
catcaaaaaatgcagcagctgcagcgggtatgttatgtcgttatcactctccccatgctatttctatcgtttgctgacgatgtgcaaagaatttcacctagttaccggagagatcgtttctcgaagattttccggaagcctctgcctgagaagtctagattagctatggtacaggctggattccaagcgcccaactcccttattcttctccagcaggccaagaagtttgatatgaagacaaaagagtcgatggccaatagcatttctgatacggctaatgcagtttcagaatcacatggcgctgaggaagaagttgctcgcggcaatgccgtcgttgcacaagcggaaagcaagaagtcagcagctggcgatgctggacaatatatgccttcgccagaagtgcacgctgccatggtactgctcttcgagaaggagaaagagatcctaagccttatatacaactctcgaccgcttcccaaaaaggaagctaaagtcagcccggacatgttcttcatcaagaacatcctggtaccaccgaataaatatcgaccagctgcccctcaaggtcctggtgagattatggaagcacaacaaaacaccccgttcacccaaattctgaagaactgtgacatcattaatcagatcagcaaggaaagacagaatgctggtgccgattcagtcactcgaatgcgtgattaccgcgaccttcttcatgctatcgtacagcttcaagataccgttaacgggttgattgacaaggagagaggcgcatcgggcccggcagcaggccaagccgccaacggtgtcaagcagatcttggaaaagaaggagggtctgttcagaaagaacatgatgggtaaacgtgtcaattttgctgctcgaagtgtcatttctcctgaccccaatattgaaacgaacgaaattggtgttccactggtcttcgcgaaaaagctcacttatccagagcctgtgacgaatcacaacttttgggaaatgaagcaggcagtcattaatggtcccgacaaatatccgggtgccactgcgattgagaacgaattgggccaagtgaccaacctcaagttcaagagtctcgatgagcgaacagctttggccaatcagttgctggcaccgtcgaattggcgcatgaagggagcacgtaacaagaaggtctaccgtcacctcaccactggcgatgtcgtcctcatgaaccggcagcctacccttcacaagccgtccatcatgggtcataaggctcgtgtgctggccaatgagagagtcattcgcatgcactacgctaattgtaacacctataatgccgacttcgatggtgacgaaatgaatatgcatttccctcagaacgaacttgctcgagctgaagctatgatgcttgcagacgccgaccaccaatatcttgtggcaacatctggcaagcctttgagagggttgattcaagatcacatctcgatgggaacgtggttcacatgtcgagacacattttttgacgaggaggattatcatgagctgctctatagctgtctcaggcctgagaactctcatactgtcacagaacggattcagcttgtggagcctactctgttgaaaccaaagcgtctctggactggaaagcaagtaattacgactattctcaaaaacatcatgcctccgggaagagctggtctcaacctgaagagcaagtcctccactcctggagacagatggggtgagggcaacgaggaaggcactgtgatcttcaaagacggcgagatgctatgtggtattctcgataagaagcaaatcggccctacggctggcggtcttatcgatgccatccatgaggtctacggccacaccattgccggacggctgatcagtattctcggacggctcttgacaagatatttgaacatgcgtgcattcacttgtggtatcgatgatcttcgactgaccaaggaaggtgatcgtctccgtaaagagaagcttagtcaagctgccagcatcggtcgggaggtcgctctcaagtacgtgactctcgaccaaaccacagtccctgatcaagatgccgaactgcgccggagattggaagacgttcttcgggacgatgataagcaaagtggtttggacagtgtctcgaacgctcggacggctaagctctctaccgagatcactcaggcttgccttccaaaaggcttggccaagcctttcccgtggaatcagatgcagtctatgactatctctggagctaagggttcgagtgtcaacgcgaaccttatttcttgcaacctgggacagcaggttttggaaggtcgacgtgtacctgttatgatcagtggcaagaccttgccatccttcagggcctttgacactcaccctatggccggcggttatgtttgcggccgtttcttgactggtatcaagcctcaggagtactacttccatgctatggcgggtcgagaaggtcttatcgatactgccgtcaaaacctctagatctggttatctgcagcgctgtctgattaagggtatggaaggtctgagagccgagtacgatacatctgtccgcgagtcttccgatgggtccatcgttcaattcttgtacggagaggatggacttgatatcacaaagcaagtgcacctcaaggacttcgatttcctgacttccaattatgtctctatcatgcagtctgtcaaccttacaagtgacttccataatttggagaaggatgaggtgacagcctggcacaaggatgccatgaagaaggtccgtaagacaggaaaagtagacgctatggacccggtgctgtccgtctaccaccccggaggaaacctgggtagtacatccgaagcattctcgcaggcactcaagaaggtatgggacatctgctaccactctcattccacatatttgagtctaacaaaagctacagtacgaggacacgaaccctga

SEQ ID NO: 18840 - DNA, 351 bp, A.fumigatus
tccggaagccccctgaaacccagcgagcatgtcagaaatatgctgcaccgtctccactatcagctcaaggcgggaaataacgttgtcatatcagaattcagggatacgctgcgaatagctgctgctatcttgtgtggctcagactactttcagccctcaattctgcaccacctggtcatcttgccgtttcaactgttctcagaggagtcgatgaacatgggtgtcgcactgtggcttggtgcgatatatgaaaatccaaagcttggaccccggatcctcgcagaagcgatagaagcttgggaggaaactattcagcgcaggaagggcttgttcgaccgttctttcgagtga

SEQ ID NO: 18841 - DNA, 507 bp, A.fumigatus
gtatactatccttcacatttaaaatttggggtattgatggagttgcgactatttagctacgttgatccgatgtatacgaagattgagctgcttcctagtgacaaagccctattgttgaagaagcaacagaaggctcaggccactctcgcgccgcatcttattgcccttcgtttttttgagagccattttaatgccgttcgattgaacagcgcccagaaccgccgtctattcagtcgtcttattgatagaacgactgttgggcttctgcaaacaagtggccaccccttggctagagagttacatttccgtattgtcctctttggcttaagggtcatacaagattcttttcaaccagaaaaggtggcttggtggaagctcaacgatcaattattgtctgctgcgctcgattggttcaagcatccgccgaggtttgtctaccctattttaatgatgtcggaaacgattgcttactctatacttgatcaggtggtcctttgggggcaatag

SEQ ID NO: 18842 - DNA, 318 bp, A.fumigatus
cctcaccagtatttattatattgggcagcagtcaatcccacagaagctttgacttattttttaccagcatatggcaatcatccgtttgttctacaatacgccatgagagcgttggaaagccaccccatagatgttcgtttctactttgtcccacagctcgttcaggctttgcgatacgatgcattgggctatgtagagcgttacattcttgagacagccaaacaatcgcaattgtttgcccatcaagtgatttggaacatgaaagccaactcttataaggacgaagactcccagattgtgcgttatgatcacccgtag

SEQ ID NO: 18843 - DNA, 201 bp, A.fumigatus
aaatttataagctcagagcctagtattgggcggatgggtccagaactggtaaggctacacactgtagacctacgccaagctacgtcactacgcatatttgctttccagacgtactcggtttacctttccgtctggaacccggcttcattgcaagtctattactcgacatttaaacgtcacaagagcaccgatgccctctga

SEQ ID NO: 18844 - DNA, 291 bp, A.fumigatus
tttggagcgctgattggtcagttgggagacaatagaagatacaccttcagcatcgtggggtccggcctcattgtttctctggtgcgtacggataagtctagctatgtgcgagtgcaaggaattttggacgacaagcatgtcgatagctgtccattggcactctgccaggagctctactggccgggccactggcagatcgagtcagttgaaaaatggtctattgcgttcaggtgcgtcaatctccaagtcggtctgatcatagagatatcttctccggcgccgaaatggtaa

SEQ ID NO: 18845 - DNA, 399 bp, A.fumigatus
ggggtgccccaaaatcgtcgtgtgattttggaggagctcagcgaatcgaggatctgctcgaggcagagagtgcgtctaaatgggaatggcattgctaggtcaagacgtttcagggaccttgtatgccgtgccggatcttcctcggtatcgtgctacaagccttacagcaagctgactggtgctaattacttcttctactacggcactgttgtgtctaatggagccggtatcagagtcacctatgtcacgcagatgatcgttggcggtgtcagcttgggcacgacattcggaggtctgtatgtcatcgagcactacgggcgccgcaaattactcatcactaggggggtttggatgttcgtatgttttatgggtttcgccaccgtcggaaatttctcctaa

SEQ ID NO: 18846 - DNA, 333 bp, A.fumigatus
gttgctgagctttatccatcgcgataccgtgcgaaggccatggcattagccacggcttcgaactggctttggaactttctcattgacttcttcactccggttattaccggcgatattcacttcgcgtacgggtgtgtctccgccggatccctatttgctggggttgtgatcgtctgcttctgcgtgttggaagataggggccaaactctcgaggagatggacatgatgtacgtacgttctgcatgtcccggcatgggagaagcagaaaatgggtacctccaaccccagagcaccggattactacggcgcaagctctggactggaggacagtag

SEQ ID NO: 18847 - DNA, 1314 bp, A.fumigatus
cagcccgacccgctcaagccgactcttgaccgtttcatggatactctcatttcaagcttcagcgacgaggagcgtgatttttatgaaagggagttttctttcttcaacgacatcaccggtatatcaggaaaacttcggccatatatcaagaaaagtaaacccgagaagaaggcgaagatcgaggaagaacttcgaaaaatcaaggtcgagattggtgtttatcttccgagcaatccggatggagtcgtcgttgggatcgaccgaaaatctggtaaaccactacaaagccatgcaaaggctccatacatggcaacctttcggattcaaaaaacaaggacccgtggggacgaacgagaatcccagggccaatcccgctcgagtactgctggccatgatgcctcgacgaagacgttgtcggcgcctctgcattctccttcctcccaagagacgtacgaagtttggcagtcagctatcttcaaggttggtgatgactgtcgccaggacatgctggctttgcagatgatcgcggcttttcgcagtatctttgctagtgcagggcttgacgtttgggtatttccctacagagtgacttcaacggcccctggctgcggagtaattgacgttcttcccaactccatctctcgtgatatgctaggtcgcgaagcagtaaatggtctttacgactacttcatttccaagtacggcggggagcattccatgcgattccaggaagcgcgaacgaattttgtgaagagcatggctgcctattcagtcatctcttaccttttgcagttcaaagatcggcataacggtaacattatgatcgatgatgctggccatatcatacacattgactttggcttctgctttgacattgctccaggtggtgtacgttttgagcgcgcacctttcaagctcacatccgagatggtggctgtcatgagcggtacttcacatccacatatccattcacatagtggctcgaatggcgggctcggcttgcctggagggcactccaacaacccaacttctacacagccgtaccggtggtttgaatccttggtaataaaggctttcctcgcatcccgtcccttttgcaccaagctctctcatattgtgtcgttgatgcttgatagcggcctgccgtgcttcaaacctgatacgctcaagaacttccgtgacaggtttgtgctagagaagaacgagagggaggcagccgagtacatgcgggaactcatccgcaaatcctacatgagcgtttcaacgaagggatatgatcagtttcagttgttgacaaacggaataccttactga

SEQ ID NO: 18848 - DNA, 912 bp, A.fumigatus
gattgtttgtacatctcgtcttggattggctgtctacaattcaccaaaatgggcgccggtgcaagtacaccatccgttccccctacagactcagcgcccgctgtgacttgtcctgtcgaccacaaaacccgtgaggtatggttgcagcagcacaaggcttcgggcggagctccccatcctttacccggcgaagaagagaaaacgaagccaaagctccagcggcctttgtccaccgatcgtgaagtgagcagtataccacgcgctttcgacgcctcatcgtcagcatcgtcctctcaagcgcccgctgcatgtccgtcgccatatgccgcatcgcacggcacaccatcgaatgcagaggccgagacgggtcatgaccagaatacaggcaattggatctatccgtctgagcgacaattcttcgaggctctagtacggaaaggaaacacgcctgcgaccacaagctccgcgtccgagctggcgacaacagtagcatcgattatccctatccataacgccgtcaacgagcgtgcttggaagcagatccttgaatgggaaagtctggcgccgtcgtcagatcctggtagcaagaaatgcggtggaccaaagctgtattcattccgcgggctgggcgtcgacccccagtttcttagtccccgcgcccgcttcaacagcttgctaggataccaaaagcccttcgaccgacatgactgggtggtggaaagatgtgatggtgagcgtgttgagtacgtcattgatttctaccaagggaagtcatcaggaacggacggcgctgcagcaggattgacggccaacgcggggccagggaaactcagtttctacctcgacgtacggccaaagctcaatacgttcgagggctggaggatgagattcagacgctttacggggctatag

SEQ ID NO: 18849 - DNA, 1554 bp, A.fumigatus
agaggaatcaggccacacgagcgaccaacactgaacgagagaccgatctaccttcatacctaccatgtgctgttggcaacggcccaatcgatcgtccatctttactacgactatgaccgcgttcctatccccgtggttaggccagactctggtgcttcagaccgcagaactcatccgttagagccagtctccaagcgcattcaatgggctttacccagaatgatcaggggtggtctcgcaaggagcgcacttgttgcagccatttgccctttcgcctacgtcttactcctcaggcggccagcatggagcttcaccttgtatttcgccaagttgttttggaattttcctagatctgcagcggatcctcctggtgttatccctgacttaggatttggccttttgattcggactgccatatccggagcactactaaccttttgctggcaattcgcgaaccttttcttctcgatgtttatcagcaaggaacccctcaagctaggtcaaccattgactgcagaagcaaaggatcccaacggcagcctactgaccggcctaaaggcgaagaaggagacagtgaaggcctttgcattctgggagctctgcctcatcagtcagcaatttcctgatcggagaaaggcgattttcaatgacatcgaccgtgaaggtggctccacctggactcagatcctgcagtctgccactgaggtcatcgagggcgtttctaacaggatcaatgagaagaagaacccgacgtcaaatgtgaagccagaggagcagaccgacaaatcacaacctgttctccatactctgccccgcttagcagagcctcccaaggaagacaacatttttgcgagctcgcccaaagcggtgtcgcgacatgagaaaatcggagaggccttcagttcagctgccaagaagtatggacaatcgcccgactggactccggcagctagggctcgagctcgtgatgtctttgaccgcgcatcctcagttgtgctgagccctgaacgaaaacagaaattgctcgcttcttcccgggagctcaagatgctcaccggaccaacgagcaaaccagagaatgtgcaccctctgctggcacaggtacttcgctcaccagtaggcctcatcctccgacagaactacgcccgccggttatccggaatagtccttggcacaccgcatgcaaatttatcttccatcattgatgctattgagtcgttgacccgactcctcatcgcaagtcttgcagaggatcaatacggcaaagtacaaagcgatgttcctagggttgtgcgcctcttcacagaaacaatcacggttcttgagccattcatcaatggcgggctagatgctcactggacggatgtgaacttcccaccctctagcgatcccgacgcccaagccgaagcgcgtcgtgtaccagaggttggactcgtgctggatacagttaggagttgcctcagagacctcttatcagccttcaatctatacttcaaggacattggcctggtccggaaggatctcccatttagcaaaagaaactgccggggttga

SEQ ID NO: 18850 - DNA, 1005 bp, A.fumigatus
acggcaagccacaggatattcagacctccaaacgtacactcgcttgtctctccaacctacgttccctccgtcaggctctcgaaaatgccgacccctcattgcctaaactgtctactctcccgttgcgaattgtttctgagaacaactttcccaccgctgcggttttcgcaagctcagctgctggtttcggcggccattgtccggtccgtggcagatttctatcagcttccacaatctcctctggagctcagccgtattgcccgtcagggttccggctctgcttgtcgatctcagatgggtggttacgttgcctggcgtgctggtgagcgggaagatggtagcgacagtctggctgaggaagtcgctcccgcatctcattggcctgagatgcgagcaataatccttgtggttagtgccgagaagaaagacgtccccagtacagagggtatgcagactacagttgctacctcgagtctctttgctacccgggccgcatctgttgtccctgagcggatggccgccattgagacggcaatccagaacaaggacttcgccacctttgcggaaatcaccatgcgtgactctaacagcttccacgcaacttgcctcgactcctggcctccgatcttctacatgaacgacgtctccagagctgccgtgagactcgtccacgacatcaaccgtgccgttggccggactgtatgtgcctacacattcgacgctggcccgaatgccgttatctactaccttgagaaagattcggaggtagtcgcaggaaccatcaaggctattttgggccctaacactgaaggcttcgacggcccattctatgatatcttgaaaaacgtcactgcttcggtcgtgcctctggagaaggttgactctagagctgtagaaatcttgaagaacggcatcagccgcgtcattctgactggagttggggagggtcccatcagcgtggaggatcaccttgtgagcgcgacgggtgatatcctcgcttcttga

SEQ ID NO: 18851 - DNA, 519 bp, A.fumigatus
ccctcacaaaaatggactcaacagaagctgtcttctgagttcaaagcgacactggaggagtttcagaccgttcagcgtcgagcattggagaaacaaagagcgtctgcagttgccgctcgcacagcagtggaagagagggagcatgggccggcagatggtaccacccagcagcaacaacaattgctggaggagcagcctcgtctcgccaaccaagctgaggtcgacttccaggaggctctaatcatcgaacgcgaagcggagattcgcaacattgagcaaagcgttggcgagctcaacgaactattccgtgacgttgcgcatattgttcatgaacaaggaggccagctggatatcattagcgagaatgtggagagagtcactacggacacccggggcgccaacgtcgagcttcgtagcgccagcagataccaaaagaacgctcggaataaggcttgctgcctccttcttattcttgctgtgattttggtcattattgtcctagcagtcacactcggatag

SEQ ID NO: 18852 - DNA, 519 bp, A.fumigatus
ccccctaatccgtcctgcggtgattcttgtttcctcctaacagggtcttttaggtactggggtaaaagagatgcgtctttgaatctgccaaccaattcctccctttctgttaccctttctcagcgctccctccgaaccctcactaccgcctcctgctcagctatctaccccgctgcagacgagctcatcttgaacggcaagccacaggatattcagacctccaaacgtacactcgcttgtctctccaacctacgttccctccgtcaggctctcgaaaatgccgacccctcattgcctaaactgtctactctcccgttgcgaattgtttctgagaacaactttcccaccgctgcggttttcgcaagctcagctgctggtttcggcggccattgtccggtccgtggcagatttctatcagcttccacaatctcctctggagctcagccgtattgcccgtcagggttccggctctgcttgtcgatctcagatgggtggttacgttgcctggcgtgctggtga

SEQ ID NO: 18853 - DNA, 210 bp, A.fumigatus
gtttgccctgacttggaaccacttttcgcttctagttcaagccgagaacggtttactcatttcatattctccagtctccgccgtggtttccaggtctaccgtgaggtctgcgccagctgccgctctcttacccgtgtgccctggcgttcgtttgttggtgtcatgcacactgtcgacgagatgaaggccttcgccgaggaacacgaatga

SEQ ID NO: 18854 - DNA, 345 bp, A.fumigatus
tgtggaagatctcggaacgaccaaagtactgatattaccaagcacggaattggatgggctttgggagtcgtatgtgattttcttttcatgcagcataggcaacaaactaacgaatatgagcagtctgcagtacgaccaacctctacagtcaacactgctccgcgccataactcgaatgggtgggtaatcttcactgatactgcattattaggaacgtcatgtaactgtctcatagtgtccttctctgctcggaagcttgataaatggacgatcaattggaataggctaatcctcctttggggtcccccgggaacagggaaaacgagtctgtggtacgtcaaatag

SEQ ID NO: 18855 - DNA, 765 bp, A.fumigatus
tcgttaactgacaggatcagccgtggcctgtcccagaagcttgccatacgcctcggaaagcattacccacagagtaagctggttgagatcaacgctcactctctcggaagcaagtatttcggtgaaagtgataaattggtcagcaaagcgttcgagagcattgagctactacttgaagaggaggaagattcttttgtctgcgtgtttgtagacgaaatcgaaacgctggcagcccgaagggaacgcgctttgagtagcaaagagccgtttgatgctgttcgagcagtaaatgccttgctcacaggacttgacaggctgaagcaccatcacaatgtgatcgtgatctgtacaagcaatttggtgacagccttggtaagtgtatcaagcaaagccctgtcgagggatatactgaagagcgtccaggaccaggccttcctcgatcgcgtcgatatcaagcagttcgtacctcatttatcaaataaaaccatttatgggatctacaaagaatgcctggaagaactaagctggcgaggcattatcgagggcgcctcgtttgacgttgttcaagtcaaaccggaagatccacagacggccttgcaatatgtggagcagcctgcaaggttcctgatgctaccaatgtttgaagaaatgcttctcaactatcagatcttcccgaacgccatacccaagcagctagcggatgccgcttccgccagtgtggtgagcaacagatcccgagttgaagacatcacggcaggtgcctaa

SEQ ID NO: 18856 - DNA, 381 bp, A.fumigatus
aggccttcgccgaggaacacgaatgacgataccgagcccaacgaccaaggcgagatcgagaagcgccccggaaagctctctgactacattccccctccctacaagaacgaggaggccgctcgtgccgctaacggtggtgctctgccccctgatctcagcttgatcgtcaagggtcgtcacggtggctgcaattacatcttcagtcttctgaccggttaccccgacgagccccctgctggtgctcaggtcgccgagggcatgaacttcaacccttacttccccggcaccggtacgttttcgttaccatacttgatcttagtctcgactaatccgcatcttaggtattgccatggcccgtgtcctgttcgatggtgtcgttga

SEQ ID NO: 18857 - DNA, 288 bp, A.fumigatus
  unsure (285): Identity of nucleotide sequences at the above locations are unknown.
tctcgactaatccgcatcttaggtattgccatggcccgtgtcctgttcgatggtgtcgttgagtacgaggatggcacccctgccaccacctcccagatggccaaggatgtcaccgagttcctcaactgggctgccgagcctgagatggatgaccgcaagaagatgggtgccaaggccctcgtcatcctgaccggcctgtttgccctttctgtctgggtcaagcgctacaagtgggcccccatcaagacgagaaagatcgtgtacagcccacccgttccccggcgntag

SEQ ID NO: 18858 - DNA, 1230 bp, A.fumigatus
cgcaataagctaactgaccacagaagcgaggctgtcctaccgcattattggttggcgaaaatgaccgtacagtttcctacttcggacggggaagcagaccctggggctacttcaccctccaagttcaatgcccttcaaacattccggcgattatgggaacttgtcagcccagctcgccccgaggatatctcttcccgagagaccgattgccatcctcccaagaccaccgttcagagacgccgacaatccatcgcggatcagtcacttgaccgagacgaacacctcgctgagaaggtcacaagtcaccggatcgaggatactgtacctcccgagaagaccgttctatacctcgcctatggctcgaacttgtgtgcgaagaccttcctaggcaagcgagggatcaggcctctgtctcagatcaatgtcgtcgttcccagcttgcaactgaccttcgacatgcccgggattccatacgttgagccatgttttgcagcaacctggcgccgtgcgcacctatcgaaggaggcagaggcaggagaaattggaaccgtcgaaagcccggcggacgcagatacgtttgagcaagtcgccctcctatcggaaggctctgcatctatgcctcttgtcggagttgtgtatgaagtgactatcaccgattacgccaagataatcgcaacggagggtggtgggggcggatacaaggacatcgtggtggattgctatcccctcccgaaatcccaaagtccgaccgatccaatacccgaacatcctgaaacgaagcccttcaaagctcacactcttctatctccgagcgaggatccagatccttctcatctgactagcaaagatcgcaagctcccccctccatacaggcgtcctaaatcttgttacgcccagccgtctgctcgctacctcgatctgatcaacaccggtgcagccgaacataacctcccgcttccctatcgtaggtacctctcgcagttccagccgtaccgtatcacgaccgtgcgccagatgttcggcaaagccatattcgttgcattatgggtacctgctctcattactatcatatcactttcgaaactgctggctggtcctgatggtcgcagtccgccgtggcttgtgcgagggtcgaatctattgttcaatgtaatgtggactacgtacgactactttttcgcacccatatttggtgatggagagcgaactatggaagatacgtgctcataa

SEQ ID NO: 18859 - DNA, 396 bp, A.fumigatus
tttgattttggtatagaagctgctattgacagaagtttagctgtgaaaggcggcacaggtcctgctgatgccctctatattgatgacatcccggttccgcctattagtggcaatcaggcgctggtgaagatcaaagcattcggattgaaccggatggatcttgttcagcgtgagggccaatatccgcttccgcctcaggcgccggaaaccatgggagtggaattctcagggactatcgagaacctgggaccagacgccaacagggacttcaaagttggagatgaggtcttcggcctggcttatggaggtcagcttacgaaaactgctatttgtcttaccacagctgacaattcgacgcacaggggcttatgctcaatacattgcagtatctactaa

SEQ ID NO: 18860 - DNA, 372 bp, A.fumigatus
acttggatcacagcgactcaggcactctatcttgttggtgagtacaagccgggccagtctgtcctgtggcatgcaggcgcatcgtcagtctctatcgctggtatccagcttgcaaaggcagacggagccaaggcaatctatgtaaccgctggctccgatgaaaagatagacttctgcgtcaagaagctcggtgcgactgctggattcaattatcatacccaggactggtccgctgaaatccagaaagccactaacggagagggcgtaaacatcattgtcgatttcattggcgccacttacttccaaggaaatctggatgctgctgcgaaagacggtcgcattgtcaatcttgctgttatgggctatgtgtag

SEQ ID NO: 18861 - DNA, 255 bp, A.fumigatus
ctacctgaaggtgtaaacattgccccatttcttcgcaagaggctccgatttgagggcagcactctgaggagcagagacgaacaataccaaaagaagctacgcaatacccttgtagagcatgctttacccaagttcaaggatggaagtttcaaggtgtttgtggagaaggtctttccgatggagcaaattatcgatgcgcataagttgatggaaagcaatcagaccaagggaaagattatatgtactgtgtcatag

SEQ ID NO: 18862 - DNA, 213 bp, A.fumigatus
tacacttaccaaggctgtcaccaaattgcttgtacagatcacgatcacattgtgatggtgcttcagcctgtcaagtcctgtgagcaaggcatttactgctcgaacagcatcaaacggctctttgctactcaaagcgcgttcccttcgggctgccagcgtttcgatttcgtctacaaacacgcagacaaaagaatcttcctcctcttcaagtag

SEQ ID NO: 18863 - DNA, 1059 bp, A.fumigatus
  unsure (40): Identity of nucleotide sequences at the above locations are unknown.
ctggccatgacgtctatcctggggaggacgtacccgctgngaggcatcattacagggattggccaagtggagggtgtcacctgtatgattgtggctaatgacagcactgtcaagggaggaacatactaccccattaccgtgaagaagcacctccgtgcgcaagcaattgcccaggagaacaagcttccatgcctctaccttgtcgattcgggtggtgccaatctcccgcaccaggcagatgtcttccccgacaaggagcatttcggacggatcttcttcaaccaggccagaatgagttctcttgggatccctcagatctcggtggtcatggggccctgcacggctggaggcgcctatgtccctgccatgagcgatgagacgatcattgtcgagaaccaggggacaatcttcctggctggtcctcctctggtcaaggcagcgacgggtgaagtcgtctccgcggaagatctgggtggtggccagctacacagcaccatctccggtgtcacggattatttggctgtggacgatgcccacgccattgtcctcgcccggagatccgtcgccaatctcaactaccctaaaacaagcgtacctcaggtctccgcagataccatcaaggagcctctgtacgacccggccgagctcgacggcatcgtcggaaccaatctccgccggcagataccagcccgcgaggtcattgcccgtatcgtcgatggcagcgagtttgcggagttcaagcgtgactacggaactacccttgtgactggatttgctcgtatctatggccaccaggtcggtatcgtcgcgaacaacggcattctattttccgagtcttctctgaaaggagcgcacttcattgaactgtgcgctcagcgcaagatccccttgctattccttcagaacatctccggcttcatggtcggagcagatgcagagaagggcgggatcgccaaaaacggtgccaaactggtgactgcagtggcttgcgcggacgtccccaagtttactgttgtgtttggatccagcgccggagcaggaaactatgggatgtggtaa

SEQ ID NO: 18864 - DNA, 315 bp, A.fumigatus
ctctgctgcgtctcttatagcggccgcgcctactccccacgattgatgttcatgtggcccaacgcgaagattggtgttatggggtccgaacaactatctgccgtcatggaggcagtcggtagaaccgccgatccggaactgaaagcacggatcgaccgtgagtcggaagcaatcttttcttccgctcgtctctgggacgatggcgtcatcccgccagcacaaacgagacatgttctgggcctgagtcttgcagctgctcttggtggcagagtagatgaggatgcgcagactcgttttggcgttttcagaatgtaa

SEQ ID NO: 18865 - DNA, 270 bp, A.fumigatus
atgccaaaggatatcggaattcttctttactttcatctttcatacagtctatgcatactccttgttgaaagcgcgcccgataaccatccgtctgatctcactcgtaccggctccaatctcatagagcttcgcatcccggagcagccgcccagcagggatctcgttgatatacccattaccacccataagctgaatagcatccagagcacactcggtggctctctcggcagcgtacaggatggcgccggcgcagtcctgcgttcggattga

SEQ ID NO: 18866 - DNA, 231 bp, A.fumigatus
ttactactcacgtttgtgatccacatcttcgtcccgttcagcacccagccaccgtcgactgctttagcagtcgtcttcatactgaccacatcggagcctgcggagtgctctgacatagccaatgctccgatcttctcgccagacagaagacctgggaggaaccgagccttctgttcttcagtaccgttcaaggacagttggtttacgcagagctgcgaatgtgctgcgtag

SEQ ID NO: 18867 - DNA, 516 bp, A.fumigatus
  unsure (458): Identity of nucleotide sequences at the above locations are unknown.
catttcctttgctccacagtcatccccgcaatgcgtggcccatctccgctcctccgcggcttgtgctccagagcaaccgccctttcgtatcctcgacgactcccgacccaaagacacctagtgataacatactcccgtgtctcatcacgatctgtggccagctatacacatccgcatcatgccagcgccatctccgtgctccccactgcggtggacaccacctccgatgaattccgggagaatgcacgacagatgaaagaattggtggaccgaatggccagcctacacaagaccattgcacagggaggaccgcaaaaagctaaggagaagcacgtcgctcggggaaagatgctcccgcgcgatcgtgtcacggcgctcattgatccagggacgtccttcctggagctttcacccttagctggccatgacgtctatcctggggaggacgtacccgctgngaggcatcattacagggattggccaagtggagggtgtcacctgtatgattgtggctaa

SEQ ID NO: 18868 - DNA, 264 bp, A.fumigatus
actgtgcgctcagcgcaagatccccttgctattccttcagaacatctccggcttcatggtcggagcagatgcagagaagggcgggatcgccaaaaacggtgccaaactggtgactgcagtggcttgcgcggacgtccccaagtttactgttgtgtttggatccagcgccggagcaggaaactatgggatgtggtaagcaccctcgttatgctgttattatctcggagacagtgcattaggctaactctgctgcgtctcttatag

SEQ ID NO: 18869 - DNA, 474 bp, A.fumigatus
acgccatcttcggctcgccacatggtgctaaccatctttctctcactctccagggaactttacatgaagcagggtcaaggctttctgctcgtattctccatcaccagcatgtcatcgttgaacgagttgtccgaattgagagagcagattatccggataaaggatgatgagaaagtccccattgtcattgtgggcaacaaatccgatctggaggaagaccgcgctgttccgcgagctcgagcattcgccctttcccagagctggggtaatgctccctactatgaaacttcggcgcgtaggagagcaaatgtcaacgaggtctttattgatctttgccggcagataatcagaaaagatatgcaaggaaactcgtccagcggttccgacaattcagcgagaaagcgtgaaggtaccggtcgctacgataagaagaaagaaaagaaacgacgaaagggcccttgtgtcatcttatag

SEQ ID NO: 18870 - DNA, 525 bp, A.fumigatus
  unsure (444): Identity of nucleotide sequences at the above locations are unknown.
ctggccaccacccagatcttccgcggagacgacttcacccgtcgctgccttgaccagaggaggaccagccaggaagattgtcccctggttctcgacaatgatcgtctcatcgctcatggcagggacataggcgcctccagccgtgcagggccccatgaccaccgagatctgagggatcccaagagaactcattctggcctggttgaagaagatccgtccgaaatgctccttgtcggggaagacatctgcctggtgcgggagattggcaccacccgaatcgacaaggtagaggcatggaagcttgttctcctgggcaattgcttgcgcacggaggtgcttcttcacggtaatggggtagtatgttcctcccttgacagtgctgtcattagccacaatcatacaggtgacaccctccacttggccaatccctgtaatgatgcctcncagcgggtacgtcctccccaggatagacgtcatggccagctaagggtgaaagctccaggaaggacgtccctggatcaatga

SEQ ID NO: 18871 - DNA, 306 bp, A.fumigatus
atattcatcatcctctttcgttgcctgcgaattctcgaatctctcctggaagagtgtttattgtcattcacaaatggcttccgtagcatccctatttcggacttcgtccaggaccctttgcaggataagaacgccgctcatctacactcccgcatcaaggtcgctggcaaccaaacatcccaagggattcgtaccgcccaccgaggacgagctgctggagttgagagagcgagtacaagagttcacgagtatgtaatgagcctttttttttcatccgaatctcaggttatatctgcccttgtctga

SEQ ID NO: 18872 - DNA, 387 bp, A.fumigatus
ttgtcggtcgtctgcgctgtaggaggtgtgggaaaaagttgccttactggtacgtacgcttcttttcccgtttcacccttgtcccccctcttcactcgcagcgagaactgcgtcgttgagtcaagcatctccatccatgaggcacgcgatctgacttccacagctcaattcgttcagaatgtgtggattgaaagctatgatcccacgattgaagactcctatcgaaagcagattgaggtcgatgtgagtcgctttcgacctttgcgctggaattctaatactgacttttccagggccggcaatgcattctggaaatgtatgttttcgcaggaccttgttgtctgggagaattgccaccgatgctggcttgagagtactgacacatga

SEQ ID NO: 18873 - DNA, 282 bp, A.fumigatus
ggccctgacgcagactacattgttgtctatgccaaaacagagccggaaaagggctccaagggcatttccgcatttgtcgtcgaaaagacgttcaagggcttctcctgcgcgcgcaagctcgacaagttgggtatgcgtggatcaaacaccggagaacttgttttcgaagacgtcttcgttcccaaagagaatctcctcggggagttgaacaagggtgtccgagtcctaatggaaggtcttgatctcgagcgtcttgtcctcagtgctggtccactcgggtag

SEQ ID NO: 18874 - DNA, 426 bp, A.fumigatus
ttgggattcaatagaatcatgcaagcagccctggatctcgtgctcccatatacccatacccgcaaacaattcggagcccccattgctcacaaccagcttattcaaggaaagctggcagatatgtatactaagctttcagcatcgcgagcctatacctatgctacggcacgacatattgataactccgcagctaccggcgaggtttcaatccgaacgcaggactgcgccggcgccatcctgtacgctgccgagagagccaccgagtgtgctctggatgctattcagcttatgggtggtaatgggtatatcaacgagatccctgctgggcggctgctccgggatgcgaagctctatgagattggagccggtacgagtgagatcagacggatggttatcgggcgcgctttcaacaaggagtatgcatag

SEQ ID NO: 18875 - DNA, 276 bp, A.fumigatus
tctgcagggagtatcgctttgtcctacgcagcacattcgcagctctgcgtaaaccaactgtccttgaacggtactgaagaacagaaggctcggttcctcccaggtcttctgtctggcgagaagatcggagcattggctatgtcagagcactccgcaggctccgatgtggtcagtatgaagacgactgctaaagcagtcgacggtggctgggtgctgaacgggacgaagatgtggatcacaaacgtgagtagtaatcaaacctacaacagctcttga

SEQ ID NO: 18876 - DNA, 213 bp, A.fumigatus
ggaaggacgtcagtatgggtaagtgatgcgacatctttaccagaagcgagaagaataggagtgtctaactttcagcgaagacgaggaaaatctggtgggcaggtgcgcgacgaataccgtgaagagtacgatcctggccgcggtggttatggtcgggcatacgcagatgaccagcgcaggcgggaagaagaagagtacggcaaaggtaggtaa

SEQ ID NO: 18877 - DNA, 1146 bp, A.fumigatus
  unsure (955): Identity of nucleotide sequences at the above locations are unknown.
ctcctccctcgtttgaagatatcaccctttgttcgcgaaaccttattgattacttcgcaactgtccgaaaaaaatggctctgcacaaaacgagaggattccctctcttacgcgatggtacatagacacgcgtcaattgacagtgacaaatccatccctcccattgttggagaccctccaaccatcggaccaagaggccgtcaagaggttctaccacctcagggacagacacatgtccctcgcctcaaacctgctgaaatacctctttatccaccgctcctgctgcatcccctggaataagatcagcataagtcgcacacccgatcctcaccgccgaccatgcttcatcccctctcccgccctaacggaggccaccgacgagcccatccccggcatcgaattcaacgtcagccaccaagcatctctcgtagccctcgcaggcacaatcatcccacagtcccatggcgcaagcccaaaccccaccacggtattcgccaaccctagcccatcctcagtcccagctccctccgtcccacaggtaggcatagacatcacctgcgttgacgagcgccatgcacgcacaagctccgccccatcaacccgcgaccaactagccggatatgtcgacatcttcgcggaagtcttctccagtcgcgagctggacacaatcaagaacctgggcgggagattcccggctgacgcacaggatggcgaagcggtggagtacggcctccgcttgttctacacgtactgggctctcaaggaggcgtatatcaagatgactggtgaggcgcttcttgcgccgtggctgcgggagctggagtttacggatgttattgcgcctgagcctgcccctgcgccggggcagggctcggcggagaattggggcgagccgtacactggtgtcaagatctggttgtatgggaagagagtggaggatgtgcggattgaggtantcgcgtttgacacggggtatatatttgcgacggcggcgcggggggccggattgggggccgaaagtcggccattgtccagggatgcgggcgtctctgtctcggtagatcgctggatgcatatggagaatatcgatatcgacagggatattgcaccttgtgcgacgggtgtctgtcagtgtacaaaaaaatag

SEQ ID NO: 18878 - DNA, 309 bp, A.fumigatus
ttctctaaagttccttttacacaacagaggagcaaattcatgagcttttctcaaagtcagcagacccgcaggcccatcatggtgcgaggcccaaaactaacaggcgcatataggtgcggtgaaatcaagcgccttgtaatgggcctggaccgatacaacaaaaccccctgtggcttctgcttcgtggaatactatacccatcaggacgccttggattgcttaaagtatatcggaggcaccaagcttgacgagagaattatccggacagatcttgaccctggctttgaggaaggacgtcagtatgggtaa

SEQ ID NO: 18879 - DNA, 525 bp, A.fumigatus
  unsure (76): Identity of nucleotide sequences at the above locations are unknown.
tcctgctcgcccaatctgctaatcggaccaaagaaaggcggacaggacctcctcggcggcttcgacgttcgcgtanacagaaatcactttggccggcaaacggaaagtttcgaggcgcccttggacctgccgtttttgggccccacggagcattctttccctgcagtctttatccgggcgcccgtggtggaaaaaattctgcctcatcaacaaggtatccaggtggacgaaacccaaagggacgagacggtggtggcgccttcgagacagcctcaggatcaggcggccaaagcggcgatggcagacgaagttgaagtactagcacgtctctccggccgagcagctgaactagccgccgtgggaacacatatcgatgcagagaaagagaccggtgatatcgttgcagtcaaacagggtaatgtgttcggaacaagctttcaccccgagttgactggtgatgccagaatacattcctggtggttgcgccaggtggaggagtcggtaaggaagaggaatgggatataa

SEQ ID NO: 18880 - DNA, 246 bp, A.fumigatus
ccctggcgtgatcaagctcaaaggtgtgtgcatgtggggattgttattgcgctgtatgagactaactggctcctcctagttttacctcccatcagcacggagggcttgaccgctgcggatgtcgaccggttgaccaagaccgcccaggagagcatgctcaaggctctactcgaactctccgatcaggatcgcgatgagatcgactccgatgtcaagaaggctacttccactgctgtcgagatctga

SEQ ID NO: 18881 - DNA, 309 bp, A.fumigatus
cctaagcgcggagcctggccgccccgtggtgaacacggggaggagatgcgcaagtacagacagagcgtgttcatcttccccgaaggaacgaggagttattctgagaaacctgagctgctgcccttcaataagggcgcgttccatctggcggtcaaggcgggggtgccgattgtccctattgtcgcggagaactactcgcatatcctgtcgccgcggaatatgcggtttaaccctggcgtgatcaagctcaaaggtgtgtgcatgtggggattgttattgcgctgtatgagactaactggctcctcctag

SEQ ID NO: 18882 - DNA, 300 bp, A.fumigatus
tattgttttctacagtcaggaattaccatggccagcatcactgtcggagttctcgctttacagggcgcattctatgagcacatccagctgctgaaaaaggcagtctcggaacaaagctccactactcaatgggagttcatcgaagtgcggacaccacaggagttggatcggtgtgatgcgttgattctccctggaggagagagcacgactatctctctcgttgcggcccgatcgaacctcttggagcctttgagggactttgtgaagtatgttcgcgcaataaccgcgaggctatcctag

SEQ ID NO: 18883 - DNA, 1296 bp, A.fumigatus
  unsure (1110): Identity of nucleotide sequences at the above locations are unknown.
gacatccttgtcgctgcatcgaaagtggatgtggatgctctgatgatgggcgaggacgatgagctctcggtggaagacaacgatcaattgtcggccactgttatctgcctctcgacgcgcactggcagagtccatatctgccttgaacttgatggcgtcgaggggcagtggcttcccaagctcaggaagaacgccttcagtactcccttgtctgagccatctgatttggtcttggttgagtcattggatacgctcagacaagaagaccagcatttgaacgactggccgaccttcactaatgatattgtgtctcgatacagtttcttcgtcacaactgcaactaatgtcacgtctatttcactaagttcgtgggtgcagaggcttgaggccgagctccggtcagaggatactgccggctcggctttccgtttgcaagtactatgcgaaggcacggtatctctcagggagcggatcatcgaagtagatgatgatggcagtgctgctaaaggcgaatcagaccatctggcctcttctctggtcttctacgactatgatcttggttatttgctgttgagccaccacgcgtctcgcccatatgctgccatcatggatgcgcctgaggctagccttccaccagttgcagatatgggaccaattggctcaggggcgcagcagtcgacatctattctaccacctaaaagacctccttaccaagtcccttcaatcctctattcggactctcctctggaattcttcgttgagaagcatgttccccatcgacaacgccaatcactcaaagagcaggtgcgcttatcaccagcaacgctcgacctagttgctgctgcacaccgcattctgtctgctcatacaaatgctcttgagcgagcagcatcggaccttttccgtcgctgtgaacggctgcaaggggagatgaaggagcaactgaagcagctatcggacgtggctgagcgcatcaagggggtctcgagtgatattggcgaagatggtcaacggcgagggggctcgaagagtgatgaggcgctggacaagaagctgaaagctgcaaaagagagacaggcgcaattagttgagagaaacgagtcgctccgnaaacaagttctgaagtcaggtggtcgtccactgagcgagaaggagaaagcatggctttcggaagtggaggccctatctgcttcgttggagagagagaagaacgaagaaaaaaaggatcagagtttgtcacagcgattggaaaccgtgagtttcattggtctcatgaaccacacactgtggtgctga

SEQ ID NO: 18884 - DNA, 375 bp, A.fumigatus
gagggttttgattggcacggacccttccagccccgtgatgaagacgctcttttgatcttccctactgagaacctggcgccatcccttgcgccattgttgcatcctgacctacgtaaagatattgctaccagggtaaatgaagctatcctgcaaagccagggtgcccgtaaagaagctcggctgcgcaatctggttaaattacgcgcctgggcggagcagaaggcccgagaagccaagaaagatcttcctgagaagctcgacctcggactctatgatggcaacaacgtaaagaacgctcagagcaccagtcagaatggtgactcaaatgatactgtaatggccaacaacggagatgttgacccgatgatttcatga

SEQ ID NO: 18885 - DNA, 2484 bp, A.fumigatus
tattgcaatgacgcccttgcaccccgcggtgaagaccgctgcattggactgcttaaagatatttatctcaagacatctcgcaccgaattgaagctggctatagtcgatagctttctccaacggacaacagatacagaagaaagcgtagccactttggcgcgacagacttttgaggaggtttggcttaccccgtttcatgagcttatcgattcatcacaagatggctcgaagctcagagttggtctgggagagcgggtgacgttgatcgcaagcttggtgcagcgcagcgagactgctctcgaaacattagggttttgtttgaagaagattctatcggacaattccaagacggcctcattgaacttcaaagtttgcaaagcgatggttgcaacgatgttcgaaaagttagttgaggatgagagctcggagaaggagttccagcaggctctccttcaaacgatcacagtatttgccaaggcaaatgcgaagctattcagccctgatcaactagagacccttcatccttacatcggcaatctcgccactgcggaggatttgttcattttcagatccgtggtggtaatttatcgctgtgtcttgccatacctttcgtccgctcacaatagtcttctgaaagaagtgcaaaacgatcttttcaaaagtgtagccaaacttgctcgctcagagctcaacgaagttatggcctgtttgtggacaatcaatggcgttttgcgcaacactgacagactcgtgaaactgaccatatcggttttgaaaccgattcaacattatcgaaatgtcgatcttgcagataatgctaattcggctattgtggccagagccaagagctatattcgaattgccggctgcgtcgggcggcattgcgatctagagaagtatgagcctcatttcaagaacgcttttccgtcttggaaaggcggatcggtggctgggttaatgatcgactccattgtcccttttactctcccgaaacagcctctggaactcagggttatggcgttagagagcgtgggctcgatatgccagtcctggccagctcagttcagccgggatgaaccgagaaagattctttccatggtcttcaaagaagacaatgcaagccttcagaatatcgtactgaaatcctttgcggagttttttgccatgcacgagggcaaagcagagaagtcagtcgtgccgtctgctgaaaaagcggaccaggagaactcaaccagactgggtggctcattaaaagcaagtgacaacgacggggctgccgctctgatagctcaacacttcctacagagcatgcttcgagtcgcgcaatctcggcaggacgcgtacgctctcactgccattgaattaattgctagcattaaccgtcaaggactggttcatcccaaagaatgcgcaggcgtgttggtttcactggagacatccaccgtgccagccattgccaaggttgcgtttgacacacacaaaatgttgcatcaacagtatgaatcaatgtttgaaagagaatatatgagagccgttcaggaggctttctattaccaacgcgatgtggtcggtgatcccagcggcgctttggcccgaccttacatcgcaaaattggcaccgctttttgatattatcaaaaccagtaacagtcggtatcagaaaaaatttctgtccaacctgtgttcgaaggtagacttcgaattgaagaagctcgacagcactggggatccgccagagcatcttctacttacgcgatttgtggctcaaaacctggcattcttcgattatggccagcttgctgagctggtctcagcagttgagtgcatggagcgcattgtctccgcgacaggaacagtcgtagcccattcaatcgaaatagagatttttccgcctaggatggaggcaccactgggagaactgtcatccgaacctgtgccacaagggccaggcaatgcagagcctccaccccaagtcaatccgtccgtgttacggcaactagcgacagcagccgcatccctctcaatgctttgggaggctcgaacataccttcgccgtctgtacgggatacatgcccatgtacgagagaaggacggcaaagctgcggccaaggagctgaacaagtccgccaccaaagtgcaaggtgtgaccggcgacaaattttgggacgccatatctcggaacatggaagcactgaatagcgaagatcaaatgatcagcaaatgtcgagaatttgccaccttgcttgcgattgacgatgaattcaaggtcggccaggatgaggatgctgaaggcaacagcttcgacgctgtcgctgacctagacgacaccgggcctggtccaggttccctcggtgggcagcgacctggcaaacggaggaattctgtttcatctcaaaatcccgcgaagcgaccccgtggaagaaagagcggctctggcaagaaaagagccagcactgaaccagaggatgacatgatttgggactaa

SEQ ID NO: 18886 - DNA, 915 bp, A.fumigatus
aatcatccagccagcatcgacagaatccgacactgccgaatagaagcacctagccgcacacctcccttgtacgccatgagcacggcgctactccgaagccgcccaaacactgcggcgctcaggaggatctgtcttgtatcacatagaggtcaattcccgaaacctaactcctcaattagcattgttacgtctcgagctttacatacgacccggcggcgaccagtgacccagcagcgcatctcaaatatcctgcacagtgcgtcgttatcagttcgatatgagtcgacgggaaaggacccaatggctaaagcggcccgcaaatcccctgccctcaacatactcgtaaagagcttcacatactgtggatttttcattgtcatgactggtgttgcagtagtcgcgttcttcatctacgatgcgaccacataccgtgaagaccctagctctgaagacattcctgtgtctgaattggcacttaaccctcgacgcgggggcccgaagaacctgcctatagcggaggtcctggtgggagacaacgactcggaggcgatggtgcagcagaacgacaagccacgtttggtcattctgggcacgggctggggcagtatcgcgcttcttaaaaatctcaatcctggagattatcatgtcactgtggtatcgccgacgaactatttccttttcacgcctatgttgccctctgcgacggttgggactctggggctgcgctcgcttgttgagcctgtccggcgaatcatccaacgagtacatggccatttcttgaaggcagaggccgaagatgtggatttttcggaaaagctggttgaggtgtctcaagttgatgccaatggcaaaaagcagaacttttaccttccgtacgacaagctggtaattgctgttggtgagtgcgggccgtga

SEQ ID NO: 18887 - DNA, 606 bp, A.fumigatus
acaagctgttcgaacagtatgacaaggaccgctccggcaccctcgacttcggcgaactgcacgaactcctccaccagatcgacaccaagctcacctccctcccggccaccgcccagcgcgccaaccaacaaggccaatatctgggccgcaaactcaccaagatcgcagctgcgctccccggcatgcgagccaacgagatcgaacacggagacgtcgacaacatcgtttacaaacccttcagatacaagcatctcggcagcctggcatacatcagcaacgcggccgtcttcgacttcggcggactcaatttcagcggtggcgttctggccatgtacctgtggcgaagcgtctatttcgcggagagcgtcagcttccgcacacggtgcatgctggccatggactgggccaagagagcactttttggacgaggtctgtttcttcgcacatgttctttctcatgaatccatagctaaacttttgtctctcaatagatcttatgagcttctaatcggaccctctggatataagcagcctgccctggcatgccataggaaaggacataccaccgtgtccattcatccttgtggtttgctgttagatcgataa

SEQ ID NO: 18888 - DNA, 450 bp, A.fumigatus
gtttggactacaaaaggatgtgtcacaaacccccacggtgtcaaaggactcgagcattgtaatttcctgaagacgatcgatgatgctcgtaaaatcaagaacaagatcctcgagaacatggagttggcttgtttaccgactactagcgacgaagaacgtcggcgtctgttgtcgttcgttgtctgcggcggtggcccgacaggggtcgagttcgcagccgaattgttcgacttgctcaatgaggacctgcttcactcgttcccaaagattttgagaaatgagatctccgttcacatcattcagagtcggagccatatcctgaacacttacgatgaggctctgtctaagtatgccgaagtacgctgtttcacctgtttcgctgacattaagacgattgacgaggctaatacctacaggcccgttttaaccgtgatcacgttgaagtcctga

SEQ ID NO: 18889 - DNA, 942 bp, A.fumigatus
agtcctgacaaatgcgcgagtgaaggaggtccgcgacgacagagttttgttcactcaagtcgagaatggccagccggtggtgaaggaaatcccaatgggtttctgcctttggtcgaccggagttggtatgtgattactattttggtctgcgacgtactcggaactgactattgcacagatcgcgctgaactttgcaagaaactctgcgacaagcttgaggcccagaacaataagcacgctctggaaactgacactcacctgcgtctaatcggagctccattgggcgacgtgtatgccatcggtgactgttcgaccgtccagaacaaggtcgccgataatatcatttcgttcctgcgcactatcgcctgggagaagggccaggatccccagaaagtccacctcacgttccgagaatggaaagacgtagccaaccgagtcaggaagcgtttcccccaggcagccaaccacctccgccgactagacaagctgttcgaacagtatgacaaggaccgctccggcaccctcgacttcggcgaactgcacgaactcctccaccagatcgacaccaagctcacctccctcccggccaccgcccagcgcgccaaccaacaaggccaatatctgggccgcaaactcaccaagatcgcagctgcgctccccggcatgcgagccaacgagatcgaacacggagacgtcgacaacatcgtttacaaacccttcagatacaagcatctcggcagcctggcatacatcagcaacgcggccgtcttcgacttcggcggactcaatttcagcggtggcgttctggccatgtacctgtggcgaagcgtctatttcgcggagagcgtcagcttccgcacacggtgcatgctggccatggactgggccaagagagcactttttggacgaggtctgtttcttcgcacatgttctttctcatga

SEQ ID NO: 18890 - DNA, 774 bp, A.fumigatus
tgcaatgacggccgggaagaccagcttctccacttcataaccagtgatccccaaatatttgccatccgcaactcgccagaggcggtactcgccgccgtcgacgagttcgcgcgcaccaaggacttcctaatgaatgtgggcccatataaaggcggcatcatcaccgacattattgccaccgagcagcccagctccattctcgaaatcggcggctacatcggttactcggccatcatgttcggcagcgccatgcgtgacacaggtgttctggcccctcgctacgtcagtcttgaaatgaacccgaagttcgcatctgtctcacgcaccttggttgaggttgccggtctcagtgacgttgttgagattcaggagggtccttgtcggaagtctctgcaccgtcttgcggcgggcacctcaaacaagggacccagctcaaagaagtgggatattctgttcttagatcattcaaagatctcgtatttgaatgatctgaaactagcggaggagttaggaatagtcgcgcctgggtcaattgtgattgcggacgatatgaagaggccaggcaatccgatgtattcagattatgtgatggctgatacagcgactaagacggaggcctatatgccgtttgtgggatgtctgtctgacggggggatctcgttgggaaatccgtacttgatatatcagactgtgctgcttgaagggttagagccgacaggacacatggtgagtttctattatccccgtttattgcgatttgcaaaagcaagctga

SEQ ID NO: 18891 - DNA, 207 bp, A.fumigatus
gtaagagatgtgtactatgaagatgctcataatatccaaaaattgtgtaatggaatgagtttaatcatcaaactatattactatgataaaaacaaaagactcacagcagtattaaataacatatttctcaacatttacatttgtaatgatcccaaatcctcaggcacctttattctttgcctattacaaatttcctcacccttctag

SEQ ID NO: 18892 - DNA, 186 bp, A.fumigatus
aatttggccgcggccgaaattggaggctattttgaacccctaaaacatgattttattactaaatctagttattcttgcgctgcggacattgtaattgcctatggcctagaatatggcagtcactgcagcgtgggggtgcctattgagggtgttgttctgtatctactacctgctctggagggatag

SEQ ID NO: 18893 - DNA, 201 bp, A.fumigatus
cctctagatgttggctgtttctctcctcttaagtgtgtgtatggctgcttgattaaggataagatgcagcttggtttcaaccatattgacaagtttgatttccttgaggcctatccacaagcttgtacggcaatctttttagcagataatattaaaagtggcttttcagcaactggattaataccactgaatctagattag

SEQ ID NO: 18894 - DNA, 234 bp, A.fumigatus
  unsure (5): Identity of nucleotide sequences at the above locations are unknown.
tcaantaattctgtcctaaaaacaccttacaatctcaagcagttgaagaagcaggaaactatgcttaagaagctacttagggagcatacatacagccctcctacccctataaaggctgtgctaggtcagattatcaaggggtgtaagatggcaatgaataacgctgcccttgttgcaaaggaaaatcatgatgtatgtgctgcacatgaaaagcaccttcaaaagcagaagtaa

SEQ ID NO: 18895 - DNA, 258 bp, A.fumigatus
gttggcatggtagtgacttctatcagcgtgtatgtaggcacgaccctaacctactcctactgctctgatcgctacaagtcccaggcagctaaggtttcaatctttaacaactatttccgtcaaacatgcattcactatttgcttttgcgccttgccattcagactagggtatgtttattgccattaactctgtggtctaggtacccttattattacttatctagaagggtgaggaaatttgtaataggcaaagaataa

SEQ ID NO: 18896 - DNA, 216 bp, A.fumigatus
gaagtccttggtgcgcgcgaactcgtcgacggcggcgagtaccgcctctggcgagttgcggatggcaaatatttggggatcactggttatgaagtggagaagctggtcttcccggccgtcattgcactagttggatcatttaattcacagtatattcaagcttcgcggggagtcccttaccaagacattttcctcaggcttgtaaaacccttgtga

SEQ ID NO: 18897 - DNA, 339 bp, A.fumigatus
  unsure (190): Identity of nucleotide sequences at the above locations are unknown.
tatggatgtgcccgctcccccccgcccccccccgcaccccccccccctctcccgccccccccccccacaccccccccccccccccccctccccacccccccctccccaccccccccccacccctccgcacacccccccccctcctcccccccccccagcacctaccttcgtcgtgcgacgaccagtatangaatacttctgcacccggaaacagacaccatcaacttagggcttcaaatgttacgcggtcccacccaacccatttcatccaggtttccctacaacaattcgttgccacctggtatgtctcaacagtgcctcctgaacgccgaagtttga

SEQ ID NO: 18898 - DNA, 219 bp, A.fumigatus
gggttcaaaatagcctccaatttcggccgcggccaaattctatggtatggtgatccgctcggttgcgtgatccgctcgcttaccgattacgttagtaccacagggcaatccttttctgttgtcacagccttgagtatttctaatgatctgtctaagttcataattacacagaatagaacgcttctgtggatactgttaactcttagatatataaggtaa

SEQ ID NO: 18899 - DNA, 231 bp, A.fumigatus
aaaaggttgatggcggccgcctggatgtcccggatgggagtgaagaccataatgattgatcagaaatcgcatcagacgcgatgcggtcgagcggacggactggagagtcgaacgctagaaattctggatagtttcggcctggcggacaaagtctgggctcaagcaaaccacaccgtggagattgcattatgggtacggcctccaagttgtctgcaaaaacaattccactga

SEQ ID NO: 18900 - DNA, 549 bp, A.fumigatus
ctgaacctctgtcgcgtccagggctccacagccgatggtaagctggaaaggcagagtgtctccgcgaattctaagcctggatggtcccggttccatgagtccacactcagccaaggtgaaatagaagagtatctcatggaatttgtgcggactggaaagcacgttgaagtgaagcgggaaacaatccccacatcgttcgagatcgattacgcgatgatcaacgaccatgatgcgtttccgatccgcgtcaacctggaagatgtgccatgcaacccaaagactccgtttgatggcgtggctactccgaacagtgagctcagcgaggctccatcggatgattccggatacgcaggaatggggacaacggttgaggccaagtatattctcggctgcgatggagctcatagctgggtcagaaagcagctcgggttgagacttgagggcgaaagctacaacgattgtgggggtgttctggatattatccctttgacagattttcgtgagctcagccgcataatcaccaccgttgacattgctaatccaacctga

SEQ ID NO: 18901 - DNA, 567 bp, A.fumigatus
  unsure (263): Identity of nucleotide sequences at the above locations are unknown.
ttcacagtatattcaagcttcgcggggagtcccttaccaagacattttcctcaggcttgtaaaacccttgtgatatggatgtgcccgctcccccccgcccccccccgcaccccccccccctctcccgccccccccccccacaccccccccccccccccccctccccacccccccctccccaccccccccccacccctccgcacacccccccccctcctcccccccccccagcacctaccttcgtcgtgcgacgaccagtatangaatacttctgcacccggaaacagacaccatcaacttagggcttcaaatgttacgcggtcccacccaacccatttcatccaggtttccctacaacaattcgttgccacctggtatgtctcaacagtgcctcctgaacgccgaagtttgacagtctccattgagcgacaaaaacaaaatttgtctgatcatgacgcagaccagactagccggattatggggtcccatattccggaccgcaacgtttgcactaatatgtactcactcaattgcatttcggttgctcgccaaagacatgtgtcttga

SEQ ID NO: 18902 - DNA, 1338 bp, A.fumigatus
tcaccaccgttgacattgctaatccaacctgatcatccagccgacattcgaaaacgtttcattatcaagtcaaagcatggaactctcatgatgatcccgcgggagagaaaactggtgcgcgtctacgttgagcttccacccgaagtagccaacaggtatcgcgcagatcgcaatgcggacatcctcacagagcaggtcgcgactatcatgcagccgtatactctgaaaacaaatcgcattgactggtcaaccatatataccgtcagctcacccttcctttgctcctttgacgctgtacctggaacacccaagttaataacaaaccaggtcggccaacgcatctgccgaaagatcggtctacataaccgcatattccttgctggagacgctatccacacgcattccccgaaggcagggcaagggatgaacgtcagcatgcaagacacgtttaatctcggctggaaaatcgcgtccgtcatcaagggtgtattgcacccatgggtccttgagacataccaagaagaacggttgcccgttgctgaaagactgatcgcattagaccagcgaatctgccgaggaatgtgcagccagcggagcgggcatccagaggtgcaacaaggccacttcgacgaggaccacaagcgagcgctcgaggatgagaattcctcaatgtcgggactcgctgtaatctaccaacctaattctctggtcacatcaacagcttgggatgcgcccttgccaaaagacgtggcgtcctgcatcagcagaccatctgtggcccagaacctccaagtcggcgcgcgcattcctagcgtgctgatccttaaccaaagcgactcgcaagcatgccatttgcagcagatcctccccagtacgggacaatggaatctgcttgtttttggaggggacattgcggatgcggatcagaagagccgcgtccaagacctcgcagatgctctcaattcctcgggttcagtttttgaaaagttaaatgacccagtctcggtggcgcggcgcgggtttccggctctcggcgtgtatctcattcactgtgcagatagacttagcatcgagctaaacgacctgccaatggtcttccgtccttggacaaaagacggtgtagactatggcagggtttgggctgatggagaagcttaccatcatgccggcggagggaagctgtactcgtcttttggtattggggacaaggggtgtatggccttactgcgacctgatcagcatctggcttttctttcggatattaatgatgtggagagtctggaacagtttctgcggtcgatcatgcctgaagcgacgcagaagcctatgcccatataa

SEQ ID NO: 18903 - DNA, 1692 bp, A.fumigatus
ggcggcgaagacatcattacgatgaggatcgtgaggatatcgaaatgggcgacgacgcccatggaagagctctccctggaggagttagctgatgtaaaggcggccaacatcactgattgggtgctgcagccacaagttctgcgctcgatctatcgagaattcaaggctttcctcacagagttcaccgaccaagctggtcagtcagtctacggacacaagattaaaacacttggtgaggtgaactctgcatcacttgaggtctcctatgttcacttgagttccaccaaggccgctctttcttatttccttgcgaatgaaccgactgaagtcctcaaagtctttgaccaagttgcgcttgatgtcacactctttcactaccctcaataccaagatattcacaaggagattcatgtacgaatctcggaccttccgatcgtctacacattacggcagctgcgccagcaacatctgaactgccttgtccgcgtcagtggcgttgtcacccgccggaccggtgtcttcccgcaattgaaatatgtcatgttcatttgccagaagtgcaatatcacattgggacctttccagcaggaggcgagcgcggaggtcaagatctcttactgtcaaaactgccagtcgaaggggccgtttactatcaactccgagaagaccgtgtaccggaattaccaaaagctcacgttgcaagaatccccaggctctgtgcccgccggacgactgccgcgtcagcgcgaagtcgtcttacttgcagatctcatcgattctgccaaaccaggtgatgagatcgaggtcactggtatctaccggaacagttacgacgctcagcttaataacaagaacggcttccctgtctttgccacaatcatcgaggcgaaccatattgtgaagtcgcacgaccagctggctggtttccacttaaccgaagaagacgagcgccagattcgtgccttgtccagggaccccgatattgttgataagatcgtgcgctctatcgcgcctagcatttacgggcaccaggacgtgaagaccgctgtcgctctctcgcttttcggtggtgtgagcaaggaggcacaaggcaagatggccatccgtggagacatcaacgtacttcttctgggtgaccctggtacagctaagtcgcaggtgctgaagtacgttgaaaagactgcccaccgagcggtctttgcaaccggtcaaggcgcaagtgctgttggtcttacagccagcgtacgtcgcgatcctttaaccagcgaatggactctggaaggaggagctttggtgctcgcagatcggggcacatgcttgatcgatgaattcgataagatgaacgatcaggaccggacttcgatccacgaagccatggagcagcagactatttctatctccaaggctggtattgttaccaccttacaagcccgttgtgctgtggtggcagccgccaaccctattggtgggcgctacaacagcacaattccgttctcccaaaatgttgagctcacagagcccatcctttcgcgtttcgatattctctgcgtcgtgcgggacacggtcgacccaaatgaagacgagcgtctagccaactttgtcatcgagtctcaccaccgatccaaccccacccggcctctcagggaccaggacggcaacttggtcgattcggagggcaaccggatcgactag

SEQ ID NO: 18904 - DNA, 300 bp, A.fumigatus
gaaggctatcgcctatataagcacggcaaccgcttgcccccaactcccgaagagatcgccaagcgtgaggcagcccagcgcaaggcggaagaagagaaggagggcgagatcccccaggagctcctgcggaagtacatcctgtacgcgcgcgagaaatgccacccgaagctctaccagattgatcaggacaaggtcgcgcgactcttcgccgacatgagacgcgagtctctggccactggtgcctatcccattactgtaggtggttttctaacatggtcttctttcaaactatcgcactaa

SEQ ID NO: 18905 - DNA, 222 bp, A.fumigatus
ataataatactgtatctacttcatcaccgaatattcatgctggatctacttctgtactactctgccccaaccatgcctcatgcccatgcaatgtcaacttcgctacttgctcctacttactcctgggttgactccactctgccgtaccccagagtatttagtcccgtcactagtcatttagtcgaccacactgcagaagtcagtcatccccaatgcccataa

SEQ ID NO: 18906 - DNA, 378 bp, A.fumigatus
cggcggagctgccagccccgtggtgaagatcacttccctgctcgctgggatcccagatacactctgcactcgggaacggtggccttccccgatcgccgggagaactaccaggtccacgcgtccggccctcgcacccctgccaccggctccaagaccaactactacgccaactacaaggatgccgtgaccgggttcctggtcaacggtaccctgccagtggacgccaaccagggcgtgcactcgctgacggatgtgcccgtgttcgcgcagggtccatgccaggaactgtttggcggagtatacaactctattgacatcttcttcaacatggccgagtgccttggactggcacagaccaagaaacccaagggcaaataa

SEQ ID NO: 18907 - DNA, 366 bp, A.fumigatus
  unsure (170): Identity of nucleotide sequences at the above locations are unknown.
cgttgcgtcgcttgccttcttattttattctggtctgttatcctcgcgacgatttctcttactgacggtaatcttggtgaactagacggtcagatttcacctcgcctggctgtcaacctaggctccaataaccctttcagaaaccgcgccctgtctcctgccggttgtgntacatctggatcccgaccgccgcgaccgacctttacgaatcctttcctcgacgataccgatagcctctcttctccacggtcggctccggtgggaactctgttctcacctgtggaacagcaggacatgacctccaacacacgggagcttttcgtacgtttgtcttattcgcttggcggtttctctggacctatctaa

SEQ ID NO: 18908 - DNA, 795 bp, A.fumigatus
tcacctgtactagtgttccatcacgatggtcctttcgatgcctgcaaccctcaccgcaaccgcaaagggtcgcgcaccgctcccatgcaggccttccccaaggactctcccaacatggcgctgggaggttctggacccgtcaacaagaatatcaaccttgaccaatttcacggtacgatggaggaagggttcaatgattacagctcaacgggtgctgcaagaagcggggaggccgtgagcttcgacccgaaatcacgcatcgaacccattcatggagcagaaagtatgggccttggtacaagcactttccttgagggagcgccagcaagtcgtgctgcgatgcagcgtcgcgcgagcgagaatgagaaccaactctcccagaacggaggtcttcagcggaagaagagtcttgctcaaagactacgaggcatcaataagccgcaaggcggacggatggcctcccccgacgcctcctataatcctccactcagctccagccactctgggccgcttcgagcgaacgagaagaacccattcttccaagattatgatgacgcttgggacaagaaaggcgctcggatcaacaccgctgaggaatcacggtcaggcattgaaggcggccgtgcacggtcttccagtagccccaaacagagcaccaacctcgaaagaaggttcaccaatgaacgttcgaataccgggggtgaagatgggaagagcggaggcggcggcggcttcatcaacagaatgaagagtttgcggaagccccggcccgagcggcggatcagcaatgactga

SEQ ID NO: 18909 - DNA, 960 bp, A.fumigatus
ccgatcatcaaagacatatctgcgaaggactatagcaaatattccaattcttccattatcgacattcttctcgaaatgcctgcccttgtcagccgccaaatctccaccccggagtctaacatctcggttcagaacggcaccaaggtgccgtccaccacttcctgtggccttcttgtgaatgcagcccgcaagggcaatgtggatgtcatcaggttcctgatctatctcggtgccgacgtcaatgaatactatgacggcgtgaccccactcctcgcggcagccatagccggccaggaagccgccatgactgagctcctccagaacgacgcgagccccaccgcccgtgacagcgaaggctgcaccattttcaagctcctccttgacaacggtcactacaacatcgcggagatgctaatcaagaagtaccccgacctcaccgtgacggacccgcgtctgcccaaaggagagaaatggctccgggagcagttcgaggagatctcagacaatgtcaaagacccgaagagcaagcctagcaaggagatcctggagtatctcatttcaggtcagctccctcaggaggagggccgctccgtctcggacgtctactgggagcatatcttgctgcgttatatcggggatgttccgctggatatcaagcggaactactcccgctctctgcgtctgtcgctgatgggaactttcgacagattcttcctcggacatgagggcatcaaggagtcggctaggctgcttaatagtaaattgcctactactgcttacaccatagagggcaccgtggtggatggagacgggggatgggtgacggagcgttggagctaccatgacgcctatggcatcgatgtgagagatggtatagattcgttcttgatcgatagtgagaagggaaagatcatggtcaagatgatcaactataacgtttgcgagaagacgaagggatag

SEQ ID NO: 18910 - DNA, 279 bp, A.fumigatus
acggccgacggatcgcccttgttggcgggcgacgttctagcttcttccctcccgtggtgggctactatgttagccgttgccatgcctgctctggagatggcccttatcatcgcagggtggctgtactgcggattgaacgcaaagagactggcaccctcgggtgtcgttggccacggaatgctctggctgtccgtcgtcgtgggcctttcgctgtgtattcgtgccttgttcacgctgcgcaaccaggggaaaaggccgtttggtagggatctggcataa

SEQ ID NO: 18911 - DNA, 654 bp, A.fumigatus
  unsure (5): Identity of nucleotide sequences at the above locations are unknown.
atacnatctgagctcccgtcgcattctaccagccccgtggtgaagaccatgggcacagccctggcgtctcggttcctcgaagagaagtacaaggtcgccgtatggaatcgatctccagaaaaagcaagctccttgctcggaaagggtgcgacactttcccatactgcagtggatggcatcaacgcaagcgatctgatcatcatctgtcttcttgataacgccgccgtggaagcaactctcgccggcgctcttgaccacctccacggcaagacaatcatcaaccttacaaacggaacgcctgaccaagctcggaaattatcagaccgttttgtcagtcacggcgctcggtacattcacggcggaatcatggccaccccgtccatgatcggttcgccttatgcccttgtcctatacagcgggtccccggatgcattcaaggccgccgagggcgacctgtcagtgctagccaagtgcgtcttcctaggcgaagatgcaggcactgcgtcactgcatgacctggctctgctcagcggcatgtacggtctcttctcaggcttcctgcatgcaacccgccttcgtgaggtcgagcacgcccgcggtcaagttcatggacctcctggttccgtggctgggggcaatgacccaatacactaa

SEQ ID NO: 18912 - DNA, 222 bp, A.fumigatus
agggatgggcaaagcagattgatgaggggaagtacaccagcgaaggatcgaatctcgcctatgcaattggttggcattcagaatattatcgacgccagtgaggcacagcaagtctctgcggaattcattcggcccatgaaggaatttatgcagaaggcagtggcagctgggcatggcggtgacgatatttcgtccttgattgattttgtgaagtcaacatga

SEQ ID NO: 18913 - DNA, 216 bp, A.fumigatus
tctttatcacataacagacatacagacctcttcttaggcaggctagctcgatatgtctatgagcgttgcagggtagattccgtcattggtaatgagttactgaaatatatcgtccttaaggctgacgtcttatgtaccgtcgtttacgtgatgctattcacaatacagctttcctggtcaagtcttgcactagccatattcttcctgtttatatag

SEQ ID NO: 18914 - DNA, 960 bp, A.fumigatus
gcatccttctataaaccgaataatccagttctacatcaaatctgttattgtcacttatctatcctaatgccggacttgggtacatctaaacatcgctcatcccgcgcttgcacggcctgtcgggccaagcatgttcgatgcgacgcggctctaccacgatgtactcggtgcgtcggcgaagaaaaagaatgtgtgtatgtcaagtcacgccggggaggtcgtcgccgggtcttgaacaccctgacttcgtctatgaacgggacgaaaatggatcaagaatcatttatatcgatactgccaatcctatcacaaacagggaccagggaattgaatccaggcttcaacttgactacctcaacaagtgctccgagcggtactgtggacgaccagctgctctcattgtattatcgatactttcatagcgcgcacccatgcgcagtacctcgatttgcaatccagcgttatgcggtcagcgaccgccgcgcaatacagccactttatgcagtgatgaagtacatcggctctcttcataacgcattgatcccgtcctcgcaattgaaagatcatgttgaggcggaattggctgtcgctcggagtaccgatcatgtagtctcaccgttcgcagtccaggccgtgcttctctactccattgcagtctattggtgtgacgaaacggaaaaaggcctggatctgcttgaggaagctatccagatggctcttgggcttggaatgaatcggagtaactttgccaccgagcatgggaggaacgatccgatcctcgaggaaagctggcgacggacttggtggcagatttatattaccgacgcgcatatcgctggaagtacgcacagttatcctttccgaacggatgggatccttatggatgttcatttgccctgtgaagaggaagagtatgagtccggggtaggtggtcttccttctggtatgttgtgttgctga

SEQ ID NO: 18915 - DNA, 1023 bp, A.fumigatus
catcgaaaaaaaaacacgaatagtagcaaaatgtccatcccaaaaacaatgcgcgctctcctccagccctccattgaggaaccccgtctggtcattaccgcagatcatcccgtcccaaccgccacagaaggaacggacgagcatctcatccacgtgcattgcgtcagcccctgtgctaacgaactcaactgggcaaaggctttccctgccctccaacaacgcgagcagatcccctgctacgatgtcgcgggaacagtagtgaccgcaccgccatcctccgacttccaaccgggtacagaagtctacgcgcgctcaaactatctccgtccggggtgcgcacgcgactacgccgttatatccggcgctgatctcgcgcggcgtcctcagaacctgggctgggtggcgagcaccgccatcccgctgagtgcgcagacggcgctgcaggcgctgtttgtgcagtctgggatcggggagctgggcgaccaggcatggaaagggaagagggtgcttgttacggctgcgtctgggggtgtggggatctgggtggtgcagttggcgcggctggctggcgccacggtgattgggacgtgtgggccgcggaatgtcgagtttgtgaagtcattcggagcaagcaacgtgatcaactatcgggaggcggatttgaaggagtggggccagaggccggagaatcaggttgatctagtggttgattgtactggcaagaaatcgttggaagatgcgtggtggtgtgtcagggatggtgggattctgatcagcatctgtcagcctcccgagcaagtgcagcctgaggagtgcaaggggaagaatgtccggaatttcttcttcatcgtgtcggcaaatcgggcagatctggagaaagtcaccaagctggtggaggagggcaagtgtcgaggtgttgtggacagtgtttggccgctggagcagttcgaggacgcttttaagcgactggatgagggacacgctaggggaaagatcatcttggatttgtcactgaatcattga

SEQ ID NO: 18916 - DNA, 210 bp, A.fumigatus
agaatacacaatgggaactttccgatacttggattattacttgtatatatagttcaggagatcggcataaccctgaactgcggagttgctctcctctacgcagaaatgagaattctggcatttcaatatggcacaagcggcaaagacaatgacgagaacaaaatagacaatttgaacctcgactttgataagagtgcatggacaacgtga

SEQ ID NO: 18917 - DNA, 1992 bp, A.fumigatus
gtgaagaccctggtcggccttgatgatctgcatgttgaagggaccggtgatattccaggccttggcaaccttctcagcaatctccttgacacgacccatgaccttctcatccagagaagcaggagggaggaccagagtagcatcgccagagtgcaccccagcgggctcgacatgctcgctgacggcgtgcaggaggagcttgccgttggaggcaacagcatcgatatcaatctcctgagcaccctcgatgaacttggtgatgacgacggggtggtcgggagagacagcgctggcgttgagaagcttctccttgagctcgtcaccactgtagataacactcatggcagcaccagacaagacgtaactgggacggaccaagacagggtaaccgacagactcagcgaagcgctcggcctcggcaaccgacgtgagctcattccaagcaggctgatccacaccgatgctgtccaggatctgagagaacttgtgtctgtcctcagctttgtcgatatcctgaggatcggtaccaagaacgtgggcaccgccagtctcctgcaagcggagggcgatgttctggggcagctgaccaccgacggacacgacaacaccgctggcactctcgagttcgtagatatccatgacacgctcgtagctgagttcctcaaagtagagcttgtcagcagtgtcgaagtcggtggagtatgtctcagggttgtagttgatcataacagtcttcttgcccatgttcctcagagacagggtggcgttgaccgcacaccaatcgaactcgacagagcttccaatacggtagacaccacttcccagaatgatgatgccgtggtcatcgaaagtgacgtcgtgggaggtagcgttataggtggtgtagaggtagttggtatcagcggggaactcagcggccagagtatcaatcttcttgacccagggtcggatgccgaagctctttcggcgagcgcggacatcattttcggtggaaccaacgaggagagcgatctgcttgtcagagaaaccaagtttcttggccttcagcatcatctccttctggatgccaaacaggctgccaatctccttgagttcattgttgcaatcgacaatgttctggagcttgtagaggaaccacttgtcgattttggtcagctcgtgaaccttgtcaaccgaatagttctcgtgaagcatagcctgaccaacggccaaccagcggcgatcagtggggttcttcaaggcctcatccaagttctcaaatttgtcaccctggaaacctacgaagcgaggatcgacctggcgaatagccttctggaacgactcctcaaaggtacgaccgatggccatgacctcaccgacagacttcatggcactgccaatgtcccgcttgacgtgctggaacttgctcagatcccaccggggaatcttggtgacaatgtagtcgagactaggctcaaagttggcggtagtggtcttggtaaccgcattgggaagttcagggagagtgtgtcccaggccaatcttcgcagcagtgtacgccagagggtaaccggtagccttggaagccagagcagacgaacgacagagacgtgcattgacttcaatgacacgatagtcaagtccatcaggttgcagagcgtactgcacgttacattcaccaacaacaccgaggtggcggacgatcttgatggcagcggtacggagcatgtggtactcttcatcagaaagggtctgactgggagcaacgacaatactgtcaccggtatggatacccagggggtcaaagttctccatgttgcagacagtgatacagttgttggcggcatcacggacgacttcgtactcgacctccttccagcccttgagggacttctcgaccaggatctggggagcaagggtcatggaacgagaagccaaattcttcagctcctcaggattctcagcgaaaccggaaacccagacctccaagcgcgtaagccgaacggacaatga

SEQ ID NO: 18918 - DNA, 216 bp, A.fumigatus
ttcaacatgttgtacacctcctgcagtacatgctcggcgtccgtagccgcctcctggccctgtaccagcctcttctcgacgtactggtgttcgttcgttgctgccgcttccgacgcgaaggcccaagattcagctaaggtaacaacttcgtcgggtttcggcaacccagtcgcgctagtcgcatgcctcgaactgatatgcttgaaacggggttga

SEQ ID NO: 18919 - DNA, 405 bp, A.fumigatus
ttcggcggccttcagagcctcgtcaacagtgttgacggcgatggactcggcaatggggatgttgatctccttcagagcctgggcgaacaggtcacggtcctcactagtctcgagggtcctgatgcttgttcccagaactctgacaccgtagcgctcaaagatgcccatgcggttcatttgtacaccaaggttcagggcagtctgaccaccgaacgacaggaagatgccgtcggggcgttctcgctcaataacgtgagtcacatattcgggggtaacggggagatagtacacctcatcggcgagcttgtgatcggtttggatagtcgcgatgttgggattgatcaggacggacttgacaccggcctccttgagagccttgagggcctgagaacctgtgattattga

SEQ ID NO: 18920 - DNA, 1638 bp, A.fumigatus
ctcctgagcgaatccctcgtcatggctgatcgatctgaagctgatatcccgaccgatgttcctccttttgccaggccgttggctccctacatcagaactcgccaggaagcgctccgcatccgacaggctttgacctactaccttcgttcgcaaatagattttgcagaggatgactccgaaaatcccaattgccattcccaatcccatctttccctttgcgtaccgcaagatgctgcggtcaatgttaagcgtatcccggcagagttgactgggctgaggaaggaatacttgcaagcactccaggcgaatctggccgcgcggaaggagtatcattcattgaccgagaaagttgcgtcagcgaaagagagaacaaaaggctcaaagactgagcccccgtctatcgaccccagttcggaactacagacatacctccggcttctgcgtggtcgccgtcgacatgcgaagttgcaggtctttcagcactatctacatgaactcaaagaacgagactcgaatatctctgagcgcattggtgaccgagcgagccacagccagcaaatcgtgtctttggaggagaccgaggaggaatgcaaaccgacgggacgtgatgcggacgatggtattgaaggcttgatacataaactggaaagggctgtgatccgtgccaaggctcaactggaccgagagagaagcttgctggatggtttgaagtcgcagcttgcgtcagacagtacagatgtacctcctgcagtcaaagttgcggcactgcagcggacgcgggatgagctggtgcaatgggttgaagagaaattagtgagcgtgggtaatgccgacgatgctccagtgcacgatctttctcccgaggagatcgaggagtccactcggttagtcgaagaccaaaaggcagaaattgtggcgcagtatattgcctacgtggaagcacgtaagcgagtgttggatgctgcttcccgggcctgtcagcctatgacgatgccatctacgaagccgtcacgccaatcgatcgacctagggaagctcgagactggggatcgatcttcgctgggcccgctggaggttctgtcttttacaagcgagaatattcttccactatctaaggcccagcgagcattggctctgcagaagaactacttatcggggttactgaccaaggaaaggtctatgacactccgtattctgaatcgcttgagtgatgagagtcaccttcttccggagtaccctcttttgacccatcaaccccgtttcaagcatatcagttcgaggcatgcgactagcgcgactgggttgccgaaacccgacgaagttgttaccttagctgaatcttgggccttcgcgtcggaagcggcagcaacgaacgaacaccagtacgtcgagaagaggctggtacagggccaggaggcggctacggacgccgagcatgtactgcaggaggtgtacaacatgttgaatcaggacctcgaggagacgttgcgagatctgcagtcatcagaagaagactcgattgacatctgggcgtctgaggctcgttcgacccggcctcgcacgaggggcaccaggtcacaaaagcaatccaaaggtccatgggccaagctcgatgggcaattaggcatgaccgagtga

SEQ ID NO: 18921 - DNA, 489 bp, A.fumigatus
ctaacattacattcttcaataatcacaggttctcaggccctcaaggctctcaaggaggccggtgtcaagtccgtcctgatcaatcccaacatcgcgactatccaaaccgatcacaagctcgccgatgaggtgtactatctccccgttacccccgaatatgtgactcacgttattgagcgagaacgccccgacggcatcttcctgtcgttcggtggtcagactgccctgaaccttggtgtacaaatgaaccgcatgggcatctttgagcgctacggtgtcagagttctgggaacaagcatcaggaccctcgagactagtgaggaccgtgacctgttcgcccaggctctgaaggagatcaacatccccattgccgagtccatcgccgtcaacactgttgacgaggctctgaaggccgccgaatcagttggctaccctatcattgtccgttcggcttacgcgcttggaggtctgggtttccggtttcgctga

SEQ ID NO: 18922 - DNA, 315 bp, A.fumigatus
aaaaaaaaaaaacctccgcacaccggagctcttatcactagtcccaagaaattactctggtatttgcaccttttttggcgggagattctggtcaatcctctgggaccgattccgattctctgttcgtctccagaaaatcgcattgactcataccctacctactcctctaagagtcatccaattcatctcttctctcctcccgtctgtttcttgttctctcccaattcctccttgattgcttcctgtacctcaggcccaaggccaccagtccttcctaattcctctctagtcctcccctgtcaattgggtgtgtga

SEQ ID NO: 18923 - DNA, 564 bp, A.fumigatus
tcttctatatctattatcttttccttagcgcagtgcgcaatggtcctcgccgctcgttgcgggcaggctacgtcctccattctgcgtcagcgatgtctgactgaaagccgccgttccgctttcgctttgcgccccttctccgctcagactacggcccggtcgacggcgtcgggtctgcgattgcagcagaaggttgcgtcgccattgcgatctcaacagctccgttccttctccagtgcccttcgtcgcttggcctctcaggcaaacaaccctccctctgccgacagctacctcgccagcggagttgtcaagcccggtagcaatctggtcgatgtcaagaaggtccttgtcatcggtagtggtggtttgagtattggacaggctggagagttcgactattctggtaggttgcaatttggctcgtatttctgcgcgtggtatccaaaagcagcgttgattgtggattccactataagcgaaatgccatcatggacgggaacgaaaagaaacacaacaaaaaagggccagaaaaagccgttcagcactgaagattcaagtgactaa

SEQ ID NO: 18924 - DNA, 2019 bp, A.fumigatus
aggccgccgaatcagttggctaccctatcattgtccgttcggcttacgcgcttggaggtctgggtttccggtttcgctgagaatcctgaggagctgaagaatttggcttctcgttccatgacccttgctccccagatcctggtcgagaagtccctcaagggctggaaggaggtcgagtacgaagtcgtccgtgatgccgccaacaactgtatcactgtctgcaacatggagaactttgaccccctgggtatccataccggtgacagtattgtcgttgctcccagtcagaccctttctgatgaagagtaccacatgctccgtaccgctgccatcaagatcgtccgccacctcggtgttgttggtgaatgtaacgtgcagtacgctctgcaacctgatggacttgactatcgtgtcattgaagtcaatgcacgtctctgtcgttcgtctgctctggcttccaaggctaccggttaccctctggcgtacactgctgcgaagattggcctgggacacactctccctgaacttcccaatgcggttaccaagaccactaccgccaactttgagcctagtctcgactacattgtcaccaagattccccggtgggatctgagcaagttccagcacgtcaagcgggacattggcagtgccatgaagtctgtcggtgaggtcatggccatcggtcgtacctttgaggagtcgttccagaaggctattcgccaggtcgatcctcgcttcgtaggtttccagggtgacaaatttgagaacttggatgaggccttgaagaaccccactgatcgccgctggttggccgttggtcaggctatgcttcacgagaactattcggttgacaaggttcacgagctgaccaaaatcgacaagtggttcctctacaagctccagaacattgtcgattgcaacaatgaactcaaggagattggcagcctgtttggcatccagaaggagatgatgctgaaggccaagaaacttggtttctctgacaagcagatcgctctcctcgttggttccaccgaaaatgatgtccgcgctcgccgaaagagcttcggcatccgaccctgggtcaagaagattgatactctggccgctgagttccccgctgataccaactacctctacaccacctataacgctacctcccacgacgtcactttcgatgaccacggcatcatcattctgggaagtggtgtctaccgtattggaagctctgtcgagttcgattggtgtgcggtcaacgccaccctgtctctgaggaacatgggcaagaagactgttatgatcaactacaaccctgagacatactccaccgacttcgacactgctgacaagctctactttgaggaactcagctacgagcgtgtcatggatatctacgaactcgagagtgccagcggtgttgtcgtgtccgtcggtggtcagctgccccagaacatcgccctccgcttgcaggagactggcggtgcccacgttcttggtaccgatcctcaggatatcgacaaagctgaggacagacacaagttctctcagatcctggacagcatcggtgtggatcagcctgcttggaatgagctcacgtcggttgccgaggccgagcgcttcgctgagtctgtcggttaccctgtcttggtccgtcccagttacgtcttgtctggtgctgccatgagtgttatctacagtggtgacgagctcaaggagaagcttctcaacgccagcgctgtctctcccgaccaccccgtcgtcatcaccaagttcatcgagggtgctcaggagattgatatcgatgctgttgcctccaacggcaagctcctcctgcacgccgtcagcgagcatgtcgagcccgctggggtgcactctggcgatgctactctggtcctccctcctgcttctctggatgagaaggtcatgggtcgtgtcaaggagattgctgagaaggttgccaaggcctggaatatcaccggtcccttcaacatgcagatcatcaaggccgaccagggtcttcac

SEQ ID NO: 18925 - DNA, 189 bp, A.fumigatus
atgggaattgactgtactgatgtctggcgttcatctggagagagtccagttattgtccctccgctgatgttgaaggtggggactatggcggtccaatattctgccatcatcactcctgtttgctcggtttggatcggtatttcagatgctctgtcttacggaatatgtaatttttgcaacaagaaatga

SEQ ID NO: 18926 - DNA, 576 bp, A.fumigatus
ccgcgcattcagctaatattcatactcatcagacaaggggatctcgaagcttacgtcgcacacgtccttgaccggcttgtgcgccactcgaacgctttagataccgagtcattgtgcatcctcaagggagtcagttgctggagcatccgcgctgacgtgcacgtcaccgattacgatggcaacctcgttgacgctgcgtgtattggagtgatggctggactgcagcacttccgtcgtccggatgcggttgtcaaggacggacaggtgattgtctacgggcttgacgagcgggtaccggttcccttgaatattacgcacaaacctctttcggttacctttcacacctttgatgaaggtaaacgggtcatcctcgatgcgactcggaaagaagagcaagcctccgaagcggacgttgtctttggcatgaataatgccggagatgtgtgtttcgtttccaagttttccggctcccctgtggatgcactagtatttgtatcgaagtcatcggttgctcttgagaaggtcaaggagatcaatgcgattatcgacaaagccctgcaagccgatttttgttaa

SEQ ID NO: 18927 - DNA, 411 bp, A.fumigatus
tactctttccaaaatgctttctcgggtgaagttatttacgagtcctggacgctctccttctacaacgttttcttcaccgtgctccctccgtttgtcatgggaatctgtgaccagttcatctctgcccgtctgctcgatcgctatccgcaactgtaccagcttggacagaagggaatgtttttcaagagacacagcttctggtcgtggatcgccaacgggttctaccactcgctgctgctttacatcgtctctcagctgattttcctctgggacctaccacaaggagacggcaaggtggcgggccattgggtttggggctccgccttgtatacagcggtcctggccactgtcctgggcaaagcggcattgatccccaagtcttcaccacggggctggaaggacccgcgctac

SEQ ID NO: 18928 - DNA, 2112 bp, A.fumigatus
cggaggagtttacccgcaccaagcatcatggccagcggtaggcctccaggtctccatccagccgctggccgcgatgaggacctgatgcagatggaggagtcgactcccatatacagtacagggcagcgaccgccggtcaacgacgactacttgttgcgacagtacaatattgacgattccgatcagcctcaaccccgtccctcggtctcatacgatagctttgttggcgggcgggcaccgccagctgctggaagccatgcatcgacctctgcgcatcctccggcccaaccgggggcatatctcagcgatccttactccggagcggagatgtctcgaacctattcgcaaacatctggcctgaacaactaccagcggtattcagttgacgattttgacgacgaccgggatatgcatgggtactataacatggatgatgacgaccatatggcgtcgccccatcgcgtacggcaggcgaaggacaggaatagtattttaggtttgggaggtggcctgatggggagagcgaagcacatgcttggaatgggacctgagtactcggaaatggatctcccgctgacggaggccggggctagagccgcacgggtggacagcgttgaaggcgacacggctgcgcctagggctcagaaaaagtccagaaagtcggacttcaagttcggctttggtcgagggaaggtcgatccctcaacgcttggtccgcgtatgattacactcaacaacccgcctgccaatgctgtccacaaattcgtcgacaaccatgtgtccacggccaaatacaacatcgtcaccttcatcccgaagttcctgttcgagcagttctcgaaatacgccaacctgtttttcttgttcaccgccgtgctgcagcagatccccagtgtctccccgacgaatcgttacaccactattgtaccactgatgatcgtgttgttggtttccgcgatcaaggagctggtggaagacttcaagcgaagaaactcggataagtcgctcaaccactccaaaacccaggttctgaagggttccgcttttcatgaaacaaaatgggtcgatgtggctgtcggcgacattgttcgtgtcgaatccgagcagccttttccggccgacttggtgcttctggcctcgtccgaacccgaaggtctctgctacatcgagactgccaacctggacggggagaccaatttaaagatcaagcaggcaattcccgagaccgcgcacctggtcagtcccgctgacctgagccgcttgagtgggcgcatccggtcggagcaacccaacagcagtctttacacctatgaagcgactcttacaatgcatgctggagggggcgaaaaggagcttccgttggcaccagatcagcttctccttcgaggagcaaccttgcgtaacactccctggattcatggtatagtcgtctttacgggtcacgaaacgaagctgatgcgcaatgcaactgctaccccgatcaaacggaccgccgtcgagcggatggtgaatgtccagattctgatgctggtcagcattctcgtgtctctcagcgtagtcagctccgtcggggacctcatcattcgacaaactcaggccaagaagcttgtctatctctactacggcagtacgagtccggtcaagcaattcgtgctcgacatcttcacgtactgggttctctactccaaccttgttcccatctctctgtttgtcaccatcgaaattgtaaagtatgcacaggcatttctgatcaattctgaccttgacatctactacgacaagaccgacactcccgccacttgcaggacgtcttcgcttgtcgaagaactcggtcagattgagtatatcttctccgataagactggaaccttgacctgcaaccagatggagttcaagcagtgtagcatctacggtgtgcagtacggtgacgaagtctctgaagaccgccgagctacagctgatgacggaggcgaacccggaatctacgactttaaaaagctcaaggagaacttgcactctcatccatctgctgatgccatacatcacttcctcactctcctagcaacctgccatacagttattcccgaaaggaatgcggtagaccccgactag

SEQ ID NO: 18929 - DNA, 834 bp, A.fumigatus
taccaagccgcatcccctgacgaaggtgcattggtacagggtgctgccgcgctgggctatcgcttcaccaaccgaatgccgcggtccgtgttgttcactacaaatggtcaagagtacgagtacgaattgctcgcaatctgcgagttcaattcaacaaggaaacgaatgtcgaccatatttcgctgtccggatgggaaaattcgcatctacacaaaaggtgcggacactgttattctcgaacggttgggacccgataaccctattgtggaagccattgtgcagcatctcgaggagtatgcatccgaggttcttcggacattgtgccttgccatgcgtgagatcccagaagaagaatatcagcaggggatacagatctacgagaagggtgcaacaacagtcggcggcaatcgtgcagaagagcttgacaaagctgcagagctgatcgagaaggacttttatctccttggtgctacggctattgaggatcgactgcaggacggcgtcccagacaccatccatacactgcagacggctggaatcaagatctgggtcttgaccggtgaccgacaagaaaccgcaatcaacatcggcatgtcgtgcaagcttatatcagaagacatgactctactgattgtcaatgaggagaatgctcaagccacccgggaaaacctgaccaagaagctacaggctgttcagagccagggcacatctggcgagattgaggctcttgctctcatcattgatggtcggtcattgacatttgcgctggagaaggacatggagaaactgttcttggatctggcagtcctgtgtaaagcagttgtttgctggtaa

SEQ ID NO: 18930 - DNA, 369 bp, A.fumigatus
gtcactgctttaacctttcactcaattcatgatgctgattccttgatagtcgtgtatccccccttgcagaaggctttggtcgttaagctggtcaagcggcatctcaagtccttacttctggccatcggtgacggcgccaacgatgtttcgatgatccaggcagcccatgtcggcgtcggtatcagtggtgtcgaaggtcttcaggctgcccgatccgcggacgtttcaattgcccaattccgttatctccggaagctgcttcttgtccacggtgcatggagttatcaccgtatcagtcgagtcattctatactcattttacaagaatatcgccctttacatgactcaattctgggtaagcaagctctga

SEQ ID NO: 18931 - DNA, 216 bp, A.fumigatus
gaacgcgaacgtgctgcaaaggaagaggagcaacgagagtatgacattgccaggggcaacccgctgctcaatccccaggacttcaatctcaagcggagatgggacgacgacgttgtcttcaagaatcaagctcgcgggaccgaagagaaacggggaaaggagtttgtcaatgtaagtcttatcagtagaggatctcgaatggcactaatcatatga

SEQ ID NO: 18932 - DNA, 705 bp, A.fumigatus
acttcttatcaaccatatcagctcgattcacacgacacgtccaaacaatcccatatcaacccactctctgcatctccctctcaatccagtcctccatcgacaaccacttcttacacgacagcaaccaaaatgcctccttcgcaacctctaaccctcatcgtcgccacgaccccaatccgcacaagcgaaaacctccccacccgcctcggcatcggcctgcacggcaccctcccctggccgcgcataaaagcagacatggcgttcttcgcgcgagcgacatcacggccccctcgcccgggaaccacaaacgcgatcatcatgggccgcaagacctacgactcgctgcctcagaacctccgcccgctcgcaaagcgcatcaatgttgtgattacgagggatagtactggctctgtgcgggaacggattatgaaggagttggaggcgaagagggcgaaggcggcggctgctgctgcttctgagcaggctcaggcgcaagctcagaaacaagagcaggtgcaggcgcagacagatgctctcgtgagtacagggctggaggacgcgctggcgagtttggagggcagctacggggcggaggggagactggggaatgtatttgtgattggtgggggggagatatatgcttctgcgttgcggatgagcgagacacagtcttcaccacggggctggaaggatccgcggaggagt

SEQ ID NO: 18933 - DNA, 4965 bp, A.fumigatus
  unsure (58): Identity of nucleotide sequences at the above locations are unknown.
ttcggatatgtgccaattcatatttcccttaggcagcatggcgtcttctccttattgnatatcgtataccgcgtgttccatcgtaacgttgtgaaaaagaagggaatcgcttacacgttcttcgtgaacgatgaagccgagaatggtgtatccagtaccggaccagctgatgaagaggacggagatgacggagaagaaaccgatccgatgttatttaaggcgacgcagctggagcagacgcgattggagttcgaccgtccgcgaggacaaatcgccatcataactttggaaatagctgcgttagtgggcttagtgatcacgtttgtcatcgtactgaacaccaacgcctggggcgacaatgggatgcttccagctgtggggaagctgatttcatggagctatatactgtttttagtgctggttcgattcattctttcaactttgaagctgcaatcgtctcctcggttgtggaaccacactgcggccctttatgggatgcaatggttgttcaacctttttgtgtttcgatcggccgtcatttacccttcgtcgaaacgcgctttgacattgagcgccgtcgagtttgcactgtcgacactgctcttcatcattgctgtgaccacacgcagaggtaacaaggcagttgtggtacaacgtgaagatggtttagagccgccaagacatcccacggccagcttattgtcactagtgactttctcctggttggatccactgatctggaagggttacaggcagccgcttgaactagacgacgtctggaacttaacaacatcacaaaaagctgctacggttttggaggactttcgccgtaagcatcccaaaggatcgttggtctggaggctcggacgctacttttacggtacgctcctgctacagggtgcatggacgatattctccaatctcttcacttatctgccgacccttctcctcaaagctattctggaatatgtcgaggatcccagatcaaccaccgcctatgcagcctggctgtatgcaatccttctttttagctctggagctatccaaggcatcgctgatggacaggctctttggattggccgtaagctaggcgtcaagcttcgcgccattattatcggcgaaatctatgctaaagctctgcgtcgaaaagccggttcctctcctgatgcaccaaaaaagaaggaagaacctcagaaggtcagcaaaaagaaccggatcttttcctttggcggcaagaagaagaagaaggccacagtggactctgagaatccagctccagcagagtccaccaaggcagatccggctcagttggccaatgtcggcaccattatcaacctgatggccattgactcttttaaggtcagcgaagtgggcgcctatcttcacttcctctgggctagtgttccagtccaaatcatcattgctgtcacgcttctgtatcgactccttggattcagctcgttcgctgggatcgttctcatggtccttatgcttccggtaaatctatttattgccaaaagcttcgctaggttgcaaaaccagattttggctggaacggatgcacgtatccacgcaaccaacgaggtgcttcagaacattcgtattgtgaaatatttcgcttgggaacagcgtttccaagatattattgacgagaagcgcagagcggagttgaaatcgctacggaatcgctacattctgtggtcattcgcggcaacggtttggtacggcacgccgattctcatcaccttcacctcattcttcttgtatacggtggttgaaaagaagaaactaacgccatcggtcgctttcccggctttgtcaatgttctccttactccgcgtacccttggatcagctggcggatatggttgctcatgtccaagaatcaaaagtttccttggaccgtgtggatacgtatctcaatgaagaggagacagagaagtacagcatactgagcacaggcacagatcctgaaactacgcctaaaattgcattggagaacgctactctttcctggggcacacccaagaaggacagtcatggggacgctcctgacaacggggaggcctttcgtttgattaatatgaacgtatccttccatattggtaaactcaatatcatcgctgggcccactggttctggaaagacatccttattgatggcacttttgggcgaaatgaaactgctggaaggcagagtccgtctaccgggcggaacagccaatcgagctgaattgcccgttgatccccaaactggactcattgagagtgtcgcatactgtgcacaagaagcatggcttgtcaatgccacggtcaaagagaacattgtgttcgcttctccttttgacgagagtcgctacagggccgttattaaggcctgtgctctcgagcgtgacttgtctattctcgacgctggcgatcaaaccatggttggcgagaaaggtatcagtctttctggaggacagaagcagagaatctcactggctcgcgctgtctacagcagggctcgtcatctatggcttgatgactgtctcagtgctgtggactctcacacagcaaagcacattttccgagaggctctcagaggtccactgatgatgaaccgaacctgtgtgcttgtaactcacaacgtcgctctgacagttcctcaagcagattttgtcgtcgtcctcgacaatggcaagattaccgctcaaggtcgtccagatgatgtcgccagttcgggcgtttttggcgaagactatttcaagtctcggcccgcctcgagagccagcacacctcgtttatcacgcatgccatctgacgggagcgacggacacgcggaggaacaaccctcgacaaacgggaaggtgaacggatctagcaaaccgactacgcaggatcagaaaggggacaatgaacagtcgaagctgactgagtcaaaagctgtcggaagtatcaagtggcccaccattcagctttacctcagatcgatgggcccctggtcctactggataagtgctgctcttgtcttcagcttgcagcaagtgggatccgtctcaaccaacatttggatcagacagtgggcgaattcctatcaggttgaagcaaacggctcagttgatgctggcacttacgctgccgcgacaacactcaaattcccatcatttaatgttaggggcgttccgcggacttccaactcttacgttccccagttcggtgtacaacgaagtccagcgaccgatggcgatgtcaacgtctcctactatttgggagtctacgcacttctaggaattggttacgtcctaatttccctgttcagggagggtgttctcttctggggctctctcaacgcatcttcccggattcacaggcgccttctagaaaccgtgatgcatgccaagtttaagttcttcgattcaaccccactgggtcagttgatgaaccggttctccaaggatatagaagctgtcgaccaagaagtcgcccctgtcgctattggtatgattcactgtttggcatccgtcatcatgatagtgattttgatctctgtcataactcctggtttcctgatcgcggcgatcttcatatctatgatctatttcgctctaggggcagtttatctcaatgcgtctcgtgatatgaagagattggagtcggtacagcgaagccctctttaccagcagttcggcgagaccttgaacggcatcgtcaccattcgtgcgtatggtgatggcccgcggtttatagtcgacaatcaccggcgcatcaatgcctacaaccgtccccacatatacctctgggctgcaaatcgctggctggcattccgtgtggacatcactggcgccttagtttcattcttcacagccactttcgttctgatcaatattgggaagattgatgctggtgctgctggcctgtcgctcacgtatgcagttactttcaccgagaacgtcctgtggctggttcgcctgtactcggaggttcagcagaacatgaactcggttgaacgtgtgaaagagtaccttgacgttgagcaagaagccaaggcggtaattgtcgattcgaggccgccggccgactggcccactggaggcgccgtggaatttataaattacactacccggtatcgggctgaccttgaccctgtccttcgaagtgtgtcgtttgcagtcaagcccggagaaaaggtcggtatcgttggccgcacaggtgccggaaagagctccctcgcgcttgcgcttttccggggacttgaggcagagcagggtcagattctcattgatggactagacatcggcaccattggactccgcgacttgcgggaggcaattacgattgtgccccaggatccaactcttttcacagggactattcgaagtaaccttgatccgttccacctgttcagcgatgaacaaatcttcaccgcccttcgtcgtgtccacctcatcgggtcgggaacgtcaggatcggcaactcctattacagccagcactgggtcagtcgctgaagcgcacctcttatcgatccatggagccgacgtggatggcgcctctgttcaggacaataagaatatcttccgcaacctggagtctccagtctccgaatcaggctcgaatctgtctcaaggccagaggcagcttctgtgccttgcgcgcgcccttttgaagaaccccaaggttctgatgatggatgaagcgactgcatcgatcgactacaacactgattccaagatccaagaaacgttgcgggaattgcgagagagcaccattatcacgattgcacaccgcctgcaaaccatcattgactatgataaagtcttagtgcttgatcatggccgggtcattgagtacgatcatccctggacgctgatcaacaagcaagacgggctgttccgtagcatgtgcgagaatagtggcaatctagaggtcctcttggacggcgcgaaaaaggcatgggaaaacaagcgccttgttgatgactcatag

SEQ ID NO: 18934 - DNA, 501 bp, A.fumigatus
gagagtcactcagcgagagtacgcttggcacaagctgtattctgttcccactataaggtatatcaactgcgcctacggtctcgacgcatcattcaaacgaaccccagtgactctttgactctcaccatgcatatcctcccaacattgagcagcctcttgctggccggcgcggccaccaccgccgccctcaataatagctactgcgcccccaagtctggcgacgcccaggttgtccaatatgcctgggccctcgaatacatggtccagcaatactacgcctccgtcgcaaccaaccagaccttcctcaactcggcgcagaacagctccaccgcaaacgtcgtctccaacctgcagggtattggccaccagaaccgcctcggcgtccgcgccgcgcaacaactccgcaagcgcatcggcaacttcacctcacctgggctgcaacttcaccttccccgctcccgccagcggccaggccttcctgacgaccgcccaggcgtttga

SEQ ID NO: 18935 - DNA, 219 bp, A.fumigatus
tccggatttcatcatacggttgcattcatgaccggttggacagtcgtcgttgttcataatgactgcaaggacttgggctatgccactgagggaacttataagagagtcactcagcgagagtacgcttggcacaagctgtattctgttcccactataaggtatatcaactgcgcctacggtctcgacgcatcattcaaacgaaccccagtgactctttga

SEQ ID NO: 18936 - DNA, 756 bp, A.fumigatus
gcagcctcttgctggccggcgcggccaccaccgccgccctcaataatagctactgcgcccccaagtctggcgacgcccaggttgtccaatatgcctgggccctcgaatacatggtccagcaatactacgcctccgtcgcaaccaaccagaccttcctcaactcggcgcagaacagctccaccgcaaacgtcgtctccaacctgcagggtattggccaccagaaccgcctcggcgtccgcgccgcgcaacaactccgcaagcgcatcggcaacttcacctcacctgggctgcaacttcaccttccccgctcccgccagcggccaggccttcctgacgaccgcccaggcgtttgagtccaatgcctccgccgcccttatcgggctcgagggctatacacaggcccccgaggtctccttcctgatcgcccgtctggccgcccagcatgccggccacgccgcctacctcgcgacgacccagcaggcctccgtcttccagagcaacgttacctcgctggtgcgcgcgtacagccctagctacgtgctctccaacggcaccagccccggccagctgggccgctatttcaagggatgcgtttcggcgcctcagcctccttgcggtaatcttaccgtcgggccgttgatcgctacctttggtaacaactcgacgagctcgtcttcctcctcgtccaccgccacggctagctccgcttctggtacggccacttctacggggtctagcaataggaggttctggtaa

SEQ ID NO: 18937 - DNA, 561 bp, A.fumigatus
gtactggggtccgtgaagatttattttttgcctgcaggcggctttggaaacaacacaacatatagcccttttagatttttaccagaacctcctattgctagaccccgtagaagtggccgtaccagaagcggagctagccgtggcggtggacgaggaggaagacgagctcgtcgagttgttaccaaaggtagcgatcaacggcccgacggtaagattaccgcaaggaggctgaggcgccgaaacgcatcccttgaaatagcggcccagctggccggggctggtgccgttggagagcacgtagctagggctgtacgcgcgcaccagcgaggtaacgttgctctggaagacggaggcctgctgggtcgtcgcgaggtaggcggcgtggccggcatgctgggcggccagacgggcgatcaggaaggagacctcgggggcctgtgtatagccctcgagcccgataagggcggcggaggcattggactcaaacgcctgggcggtcgtcaggaaggcctggccgctggcgggagcggggaaggtgaagttgcagcccaggtgaggtga

SEQ ID NO: 18938 - DNA, 792 bp, A.fumigatus
tgttccgctcgagacatggacggtgcggatcttcagcgattccgcgtcgactcccacccttctgatgaacagccccgatcgctgtcctccctggcagacgacgcggccgctttagctgcaacccaacatcagcatcaccagtcacatacacaagagcttgcagatccccaggacgcgcagtcgctgcagcctctacaaactgcgctcgaacactcggagctccatctccaccacccgcagaaacagcagcaccatcaaaatgcgggtcatccgctcaatataccggcgtcgatgcagccgccgtcacggcctggcgagccggtcaacaccgagctaatatctcctcggcagttcaacgagaagctgcacaactaccaccaagcatcccgagagcacacattcccgggtagcctttcggatggccagcagacgcaatcctgtttatctcacagcggcaatcaagatggacaccacgagcaggtcctgtcgcaagtacgttcggatcttgcacataccgctgtcgagtgcaatgggaatggggccgacgatgttacgcacatgcgcaacaccagcctgcaagtatcgccgtcctttccgcatcatttgcagctacagccgcaaagtaacggctactccgtggccccggaactctcgagacaagatggctgtctgaaagacatgaaactggttcctaatcctccggaccttgaatactggagggaaaaactattcaacgtggacgagacaatcaccttgacggaagaccagtacgtccacgcagttttgatttaa

SEQ ID NO: 18939 - DNA, 276 bp, A.fumigatus
gcatcaagtctttcagcccagtcccagctaaacaaagcatattctagcccttttgtacaacgcgtttggattgccttggaaatcaagggtatcccataccaatatatcgaagtagatccataccaaaaacctcaatctctgttggaggtgaacccaagaggcctggtgccagcgttgcggcacggtgactgggggtcgtatgaaagttcggtcctgctcgaatatgtaggtttcaacccacactttcctttcttggaggaggccattatctcctaa

SEQ ID NO: 18940 - DNA, 672 bp, A.fumigatus
aactcagtgaaattgggttatctaaccacttggcctgcaaccagattccgaacctacttcccgcacgtcgacaacgtctactcccaccgctccacacagcgctacaagcgcaaacccttcgtctcccactactgggactgcagactcaaaggccgcccgcccggaacccccaaatccgacgacccgaacaaaaagaagcgcaaacgcaccgcccgccaacgagacctctgcgatgtcaagatcaaaatcaccgagtacttccccgggtacggcgtggctgctgtatcggactttgctgccaccgggcccgagacctcctttccttcctcggagtttctgccgagcgtgaactcgttgttccatgagtcgtcggccttggggcagaggaggggcagccagccgttcggcgtgctcacgccgaatccgaccttacctgaggatcatcccggggcgaatggggagagattctttacgatccagcgggtcaatggcaatggtgcgaatgggaagaatgatggggtgggcggaggccatcggcatacgttggaagagagcgaccgggtcaagaaaaacagtgttcagcgctatttgctgaaagaggccaaggagaagaagaagacaggctcagtaagtgtgcgatctgttcttttgtttactagttgtcagatttga

SEQ ID NO: 18941 - DNA, 369 bp, A.fumigatus
atgtgctcgagagtgtgcttattgacgcgcagtaggtatcttctcgggcaagcactgggtggtatcctgttcccgccctactctgaggctttcggacggaagaagctctacatcatcagcactgctctgtacagcatcagctgcctcgtcgtagccgccgttccatcactttctggtgcgactgtgggccgtttcgtcagtgggtttttatcggcgattcccaccactgtggtaataggcagtatagaggatatgttcaacgctcgcgaccgggtttggatggtatgtatctgggccataacaagcaatttgggtcttatcgtggggccaattttgagcatctacgtagttgcagatctggactggtaa

SEQ ID NO: 18942 - DNA, 906 bp, A.fumigatus
aggcgttggctattttacattgcggccatcgtaacaggtctccttaccttcctccttcttaccatccgagaatctcgcccctcactgttgctggcaagagaagttgcacagctccgcaaggcgtcaaaggttgagtcgctggaaggagtgaacccagatcataccccggatctgcatagctttgtgcggcttgcactatctcggcctgtacttcttttcttcaccgaacctatcgtgttcatagtgtctatgataagcgcaatctcaattgcactggtttatcttttcacggaagcattgcctcccatctatgaatcctttggtttcagcccccgacaagcgagtttgcccttcgtcgctatcggtgttgggcttagtcttggcttgctgactcgcttctttgacctgtacatcatcgaccagcaccggcagcagggccgcgtcctgctccccgagcacaagctgcttggtctctggctgggtacaccgatcctcgcgggcgggctatgggtcttcgcttggaccattcccccaggtgtgaaggatctacattggagcgtctctgtgatcgcgctgttgttggtcggatactcgctgaccgagttagactacgtccttgggggctatctcactgacagctatctaagctacgcatcgagtgggttctcagccctcagcttcctccgatcgatcctatcggctgtctttccgttagtctcgccccatctattctcggctctaggtgcaaatcttgctgtgaccgtgctggcggccatggcaactatcttctgcattgttccgcccctgttcacgcgatacggcgagaagcttcgggcccggagcgcgttcgccaagcagagtttgaccacgtatcgtcagtatagtgttgacgagaatggttattga

SEQ ID NO: 18943 - DNA, 420 bp, A.fumigatus
gtatcgcgtaatccgacattagtttccagaccatgtgctgaacagctgcagatcaatcgtcacatcgtgcccagcttctatagggttctccaggaacaggaggaacaaaagcagacggcgaatgtgcaggagctccaagacggtctcaaggcgctaatcacggcagccaatcccgaaggtccatttttcctgggaccgaccatctcctttgtggacgtccaaatcgccccttggatcctccggttgagccgagtgctcaaaccctaccgtggctggccagaccccgagcctggaagccggtgggcagcatgggttaatgcgattgaggccaatgagcatgtcaaggcgacaactagctctgacgagttgtatcttgacagctatgagcgatatgcccgtgggtataccttcacggcgtga

SEQ ID NO: 18944 - DNA, 2118 bp, A.fumigatus
gcttcaaaatatcttctctcgccctcgggcgacctcaaaccacttttctttcccatattttgtttggagcggcctgcgccagctgcgcaacagagttccaagatgcctcaccgcgcggcatccccagcggtgtcggaaaatgagttcgacatcacaggcgctctcttccagaacgacagcgactccgacaacgaacagccctcggccaagtccaaacgacaacctccgaagaaggttccctcgcaggcgctcgacttcctcggcgatgtgaatgaagacgacaatgacgacgaggcttttattgccgagcagcaaacttctgccaaccgcaaggcctcgaatctcaaaggtcgcactgttaagaagggtggtggtttccaagccatgggcttgagtgccaatctgttaaaggcaatcgctcggaaaggcttctcggtaccgactcccattcagcgcaagaccattcccgttattatggacgaccaggatgtagttggtatggcacggactggttcaggaaagacggccgctttcgttatcccaatgatcgagaaattgaagagccatagcaccaaggttggagcccgcggtctggtcttgtccccatcgagagagctggcactgcagacattgaaagtcgtcaaggaactgggtagaggcactgacctgaagtcggttcttcttgttggtggagacagcctggaggagcaattcgcgatgatcgccggcaatccagatattattattgcaacacctggtcgattcctgcatttgaaggtggaaatgaacctggacttgtccagtatccgctatgtcgttttcgacgaggctgatcgactgtttgagatgggtttcgccgcgcaactaacagagattttgcacggtcttcctgcgaatcggcagactctcctgttctctgccactcttccgaagtcccttgtcgagtttgcccgcgccggcttgcaggaacctacactagtccgtctggataccgagagcaagatctcgcccgatcttcagaatgctttcttctctgtgaaatcttcagagaaggaaggggccttgctctacatccttcatgaggtcatcaagatgccgactgggccaaccgaggtttcgcaacaaaggaaagaagaagatgcaagcgccaagaacttgaagaacaagaagaggaagagagcggaaatggagaaggctgtcaatacgagagagtctccaaccaagcattcgacaatcgtttttgccgcgacgaagcaccatgtcgattatctttactcactactctgcgaggcgggattcgccgtctcctacgtttacggctctttagatcaaaccgcccgaaagatccaggttcaaaactttagaacgggcatgaccaatatcctcgttgtcaccgacgttgcggctagaggtattgatattcctatcctggcaaatgtcattaattacgatttcccctcccagccaaagatttttgttcaccgtgtcggccgaactgctcgtgccgggcgcaagggctggagttacagtctggtccgcgatgcagacgctccttatttacttgatttgcaattattcctaggaagaaggctggttgttggccgcgaattcggggatcaagtgaacttcgccgaagacgttgtaacgggcagtctacctagggatgggctctctcaaagctgtgagtgggtaaccaaggtcctggacgataatgcagaccttgcagcccaacgcacggtcgctgctaagggtgagaagctctatatgcgaacccggaacgcggcatctcttgagagtgcgaagcgatcgaaacaggtggtttcttccgacaattggacaagcgtacacccgctcttccaagatgaaactagtaatctggaggccgagcgggagaagatgctcgcccgtattggtggttaccggccgccagagacaatctttgaggtcaacaaccggcggatgggcaaacatgagaacgtcgacgctctcgatacgattaagagagttcgtagcactctagagtccaagaagaagcgtgcacaagcgaatgaaaagtccgagttcctcgaagacggtcccgacgaccggaaaggcagtcaacgaagccaaagaaactga

SEQ ID NO: 18945 - DNA, 279 bp, A.fumigatus
aaacagacgagccaaatttgtgcacactgcattatgcactctgcaggtgctgtgtgtgacttcagttctcttcgagtgggttactctaactcatccatgaaaacgcacaacccgaatgagcttagaccgctaaagatgaagcagcaagaagtattgaacattatcagacaagatatgtactttgtgatgaattgctatgagagtgggtcttactctcaaaccgctgaacacaaccattacggagaattgcagcttttgttccttcgctggaaagcttga

SEQ ID NO: 18946 - DNA, 885 bp, A.fumigatus
agtccaagaagaagcgtgcacaagcgaatgaaaagtccgagttcctcgaagacggtcccgacgaccggaaaggcagtcaacgaagccaaagaaactgagagcgagggagcattttctgatgaggaggagacgttcccaccggcgtggcagataacatgtcgatggcattcccattcagagtggaagtcacttctcgtcatattcaaattcaaagacaacaaggcaagaaagcgagcgcggcatctttccagaaccctgaatacttcatgtcctataccccgaaataacacctccctggcggaggacagagcttatggtgtgcattccgtacccaactccaacttcgcccagccatcacgcagcgcgaccatggatctggcaggcgacgatggaggccgcgggttcggcgaggctcgtacgctgatgcgctgggacaagcgacacaagaagtacgtggctcgacagaatgacgaggacggctccaagggcacacgcatcttccgcggtgagagcggggcgaagatcgcagccagcttccggagcggacggttcgacgcttggaagagagaaaatcgtctcggccgcttgcctcgggtgggtgaggccgaagctgctaatctcgctgctggtctcaacgcagccatctcaggcaagcggttcaggcatcgcaaggagcaggcgcccaagaaggctgatcctctccgtggtgattacgagaagatgaagaagaaggctgaactcgccaaggagcgagcaatgtctaaggctggcggcgctgcaccacgtggcaagagcgagctgaagagtacggacgatatccggattgcgcgcaaattgaagcagaagagacgagagaagaatgctcgtccctcgaggaagaagtaa

SEQ ID NO: 18947 - DNA, 564 bp, A.fumigatus
acatgggtaggcgcaacgcagacctcaccgggtgtgatcacgcatatcaaatccgaggatatgcagattgggctcttcccgaatccttcggttgaagcctcggttgagaattcccgtctggaagagttcacgtccttcctggcggccggggggacgaagttccaggttgtggaggatatgcagctcccccggtgggagaaggtagtttggaacgcggcatggaattccattactgcgttgacgatggtggatacgcagacgtggttgacttcgtctgcggacgcgacgccgttgacgaggcgtctgatgggggaggttattgctgtgggccggggttgtggtgttgaccttgacaaagggcttgtggataggttgatggacaagattaatgcgctgcccgggattgggagtagtatgcaggttgattgccggaatgggaagccgatggagattgaggttatattgggggttccgttgcggagggcgaacgagttggggattgatacgccggtgttggagacgttgacatgtttgctacgggctgtggatgggcggtttcgttga

SEQ ID NO: 18948 - DNA, 267 bp, A.fumigatus
agcagttgtcattcctttcttacccacttattcattcctttgatcaacaagatgtatagaaacttcctccttgcagtgctggcactgctttctgcatctgctcatgcccataccaccttcacgaccctctacgtcgatggtgagaaccaaggtgacggagtgtgtgtgcgcatgaaccgcgacgcaagcaaagcgagcttccctattgagcctctctccagcaaggacattgcatgtggtaaagtcctcccataccatggtttttga

SEQ ID NO: 18949 - DNA, 1356 bp, A.fumigatus
gttccaagactaacagacaaaggctacgacggcgaaaaagccgtcgcgcgcgtctgccccgccaaggcatcctcaatcctcaccttcgaattccgcgaatacgccgatggctcgcgcccgggctccatcgacggaagccacaaggggccctgcgccgtgtacatgaagaaggtcgacgacgcgacagccgacaacaacgctgccggcgacgggtggttcaagatctggcagtcggactatgatgcagctgagggcaaatggtgcaccgagaagatgatcgagaataacgggcatatctctgtgcagatcccggcagatatcgagggcggatactacctcgtgcggcccgagttgctggctctgcatgcctcgcaggataacccgcccgatccgcagttctacgttggctgcgcgcaggtgtttgtgcagtcgacggggacagcgaaaccggccaccgtccatatcggcgaggggacttatgatttgagtctgcctggtatgacctacaatatctacaagacgccgttggagctgccgtaccctatgtatgggccgccggtgtaccaggctagtaagactgcgtctgccagtcctgcccttaccaacactgcttctgccaatgctggttccgaccaggctgaatttgcgcctgcccctgttgcgtctggaagcactggatccgagaagtctaccgatactgggtcggccaatacgacgcctaccaatgcagcgtctgccaatactgagtccgggaagtctgccgatacggcgtctggcaatgccgcatccaccaacacggcatccgagaaaaccgactcagctcccgccaatgtctgcaagaacaagaccaagaggaacaagaacaagaagaagaacaagaacaagaagaagcgcgcgatgctcgtccagaccaaaggcctcaagccagaaggctgtatcctcgaacgagacaactggtgcggatttgaagtgccctcgtatacagacgagcagggctgctgggctgtaagttcctcttccccttcattccttcaaagaatcaaactgacagaaacagtcatccaaaaactgctgggatcaagccgacgtatgctggaacacggctctcccgaccggctcagcacactgccagatctggtccgacaaatgcacggcgctcgacgaatcatgcagcaacaaggtgttccctggtccgccaaatgcaggccaggatctcacgccgaagaaggcttcgttggtggggtcgatcaagatatttgggcggggcgtacggtcgcatatcaagagaagaagacatactcatgtttagccttgcgcgtcaatttggatatccacttagaagctattgaaaaataa

SEQ ID NO: 18950 - DNA, 573 bp, A.fumigatus
ccacaccagtgcctcgctctctccaccatcctcggcgacaaagtctcattcccccccacccatcgctacaaatcatgcacaaactcctatttctcgcaacaaaactccaagctccagcctctgtgcttcgtctcccctaccacggtcgaagatgtctctaccgccgtcaccaccatcacaaacagcaactgccagttcgccatccgctctggcggccacaccagcttcggcggcgcatgcaacgtcgccaacggcatcaccatcgacctgcgcgccctcaatgccatcaccctcagcgatgatcgcaccacattgtcggtgggcgtcggcgcctcctggggcgacgtctacgctttcctcgatccgctaggtctgtccgttgccggcggacgcgccgcacaggtcggcgtgggtgggctcaccatcggcggggggatctcctacttctcgccgcggtacgggtggacctgcgacaccgtcacgaattttgaggtcgtccttgcggacgggacggtcgtgcaggcgaacgagaacgaaaaccccgagctccttgtggccctccgcggcggggcg

SEQ ID NO: 18951 - DNA, 414 bp, A.fumigatus
ctctcagacctctgcccacttacaactacggactacaacactgaccacaccagtgcctcgctctctccaccatcctcggcgacaaagtctcattcccccccacccatcgctacaaatcatgcacaaactcctatttctcgcaacaaaactccaagctccagcctctgtgcttcgtctcccctaccacggtcgaagatgtctctaccgccgtcaccaccatcacaaacagcaactgccagttcgccatccgctctggcggccacaccagcttcggcggcgcatgcaacgtcgccaacggcatcaccatcgacctgcgcgccctcaatgccatcaccctcagcgatgatcgcaccacattgtcggtgggcgtcggcgcctcctggggcgacgtctacgctttcctcgatccgctag

SEQ ID NO: 18952 - DNA, 462 bp, A.fumigatus
ctgactcctgtgcagtgtcaggctttgacgagcatcctaggccccagggtactctatccaaatagcacggcatataaatcctcggtggattcatactggtcccagcaagagcagctgataagcccttcatgcgttttgtcagcgacgtccgctgaggacgtttccaaagcgctgcgagttcttgttcccaaggcctgcaagtttgctgttcgcagtggtggccatggagcaattgccgggattgccaacatccaagacggggtgacgattgaccttagtgctttgaactgggttattccctccgcagacagaagcctcgtgtcagtcgggccgggacagcgatggggaagggtgtatgcagccctggacagactcggactgtcggtaccaggagggagagatagtcctgttggagtcggggggactactttgggtggtgggttgatcgtcaacatggaatga

SEQ ID NO: 18953 - DNA, 522 bp, A.fumigatus
tcccttctgactgacaggctaggcggcttcggctactttgctacggaagctggtttcgcctgcgacagcgttgtcgagtttcaggtggtcctcgcaaatggcaggattgtcaacgcgacaaaggacaatgagcatgatctgtgtcttgctctgaaaggaggagcaaataatttcggcattgtgacaaacttcatcttcagaacctttccgctcggacgggtatggggaggacacatttactaccccgtgagcacacttgaccaacagctggacgcattctatcgcttcacatccgatccgaactacgatgtcaaggccgggctcattcacaactttgcattcaccccagccacgggtcctttgctcaccaatctattagcttacgccagtccagaggagaacccagcgcctttcagatcattcacctcgatccagccgcaaatcatggccagcacgaaagtaatgacacttgaagctctcgcagaagagggaggctcgctgtccccgaactctcgccagtaa

SEQ ID NO: 18954 - DNA, 531 bp, A.fumigatus
gacatcacattgacaacaatgacattacaagtatgttctaacaatagtagacaactcacattcgcagtcacctttgagaacaatctggacctgctgacgcaagtctttgacatatggaatgcaagcaccgccgacgtatcagccatccccagcatccagtggtcccttagcattgagccaatcgtccctgctatagcacaccaaagtgctatcaaaggcggaaatgttctgggactcgatgtgccccgacaaggtctcgtcctggcactgttatctgctacattcaaccattcgcaggagtatcccattgtccgcgcggcggctgagaagctctcgaacaatatcatcagcgccgcaaaggcagcttgtgcctataatccgtatattgacctcaaccatgctgcgccctggcaggaccctatagcgagctatggggatagaatacaagcatttttgaggcagactgcgggaaagtatgatccccaaggggttttccaacgtctctgtccgggggggttcaaagtcaattga

SEQ ID NO: 18955 - DNA, 318 bp, A.fumigatus
tccgtacagcacaccatcagcattcctctcaaccaggagatgacttctcgcgacatccgcaacatttaccaggagcgttacgccggcgagaagcttgtgaagatcatcggtgaggcacctctcgtcaagaacatcgccggtcgccatggtattgaagtcgggggatttgccgttcactccagcggcaagcgcgtcgttgtttgcgctactatcgacaatcttctgaagggtgcggccactcagtgcctccgtaagtgctcccgtctagtggtatttcgaaaggacagattactcatacgcctgtcacagagaacatga

SEQ ID NO: 18956 - DNA, 2652 bp, A.fumigatus
gttttctctagacactgcgttcgttccaagacgattgaaagctgccgcatgctggttgacaagatgttctcccttcgcactactgtgcggagagcttccaccagcaagcccctccgcgctctctccgcaccgcacgctgtttcctctgcgagactcagctctcctcgtcatgctctgaaagcttccgctgtccccttactgcagagccgttcctattcccgcgccgccgatcctcacctctcgtcgactcggtctactgttgtccagctgctgagcaacattggttcgaagcgtgaggtgcagcagtatctctcccacttcacatcggtctcttctcagcaattcgccgtgatcaaggtgggcggtgctatcattaccgaacaccttcagaccctttcatcggctcttgccttcctcaaccacgtcggactctaccccattgtcgtccatggagccggacctcagctcaatcgcatgctggaggctgctggtgtggaaccacactttgaagatggtatcagagtgacggatggcaagactttggcccttgccaggaagctgtttttggaggagaatctgaagctgatcgaggagctggagcgcatgggtgtgcgagcccgcccaatcaacgcaggcgtgttttacgccgactacctcgataaggagaagtacaacctggttggtaagatcaatggcgtcaacaagaagccgattgaatctgccatcgaagccggctgtctgcccatcctcacctcaatggcggaaactccggacggacaggttctgaacgtgaacgcggacgtcgctgccggtgaactggcccgtgccctgcaacctctgaagattgtctaccttgctgagaaaggcggattgttcaatggtgatactggagagaagatctctgtgatcaacctcgatgaagagtacgaccacttgatgacgcaatggtgggtgcgccacggcactcgcttgaagatcaaggagatgaaggagctgctcaacgaccttccacgtacctcgagtgtagccatcatccaccccgctgatctccagaaggaactgttcaccgactctggagctggaactctgatccgccggggtaacaaggtgcacacgaaaacttccctttcagagttcgaggacttggagaagctgaaggatgtgcttgtgcgcgaccgtgagggccttgatgcgagagctaccgtggaccgctatgtcgaaggcttgaaggagcgtgacttcaaggtttactacgatgagcctatggaagctcttgccgtcgtcttgcccccaagcaaagataactcttcttccttcccccacctggctacgttcacgatcaccaagtccggatggttgtccaacgtcgccgacaacgttttcgccgccatcaagaaggacttccctcagttggtttggacagtcaaggagaacgacgagaatcttacttggttctttgacaaggctgatggtagcctgagccgtgacggcgaggttctcttctggtatggtatcgagagcggcgaagaggtcaagcagctggtgcaggaattcaaccagcatggtcgccagatgtttggtgacatcaaccttgaggccagactccagcgcgctgctcaggcggccactaacattggaaagggcttcggtgccagcggtgcctcagtcgagcagaagcgcgcattctcctccaccgctaatgctttgcgggctgctcgcttcggacgtcccgctgtgtctccccgcgtggtgagatcctactccaccacgaatcccaaccctccactgggagagaaaaacatgtccaacaaccggccctccaaggttgctcttattggagcccgtggctacactggccaagccctgatcaaccttctcaatgctcacccctacatggatctccgccatgtttcttctcgcgagctggctggcaagaagttgcagggttatgacaagcgtgagatcatttacgagaatctgagccccgaagatgtgaagcgcatgtctgcgaacggtgatgtggactgctgggtcatggctcttcctaacggtgtctgcaagccgttcgtggatgctgtcgaccagggctctgagacgggcaacgtcattgtcgacctgagcgccgactaccgcttcgatgacaagtggacttacggtcttcctgagctggtcaaccgtggtaagatcgctcaggccactcgtatctccaaccccggttgctatgctactgctgcccaaatcggcattgctcctctcgttccctacctcggtggacaacccaccgtctttggtgtctccggatactcgggcgctggcactaagcccagccccaagaatgatgtgcagaacctcacgaacaacatcattccttacagcttgactgaccacatccacgagagagagatcagtgcacagctcggaactagcattgcgtttatcccccacgttgctgtctggttccaaggcattcacgtatgtacttcgccgacatttatctattggcccctcttctatatacttgtttcaggtactgatgtagtccgtacagcacaccatcagcattcctctcaaccaggagatgacttctcgcgacatccgcaacatttaccaggagcgttacgccggcgagaagcttgtgaagatcatcggtga

SEQ ID NO: 18957 - DNA, 486 bp, A.fumigatus
tgtctttcagtccagtgcatctattgccagcaaattcgcgcaaagaatacatcgcgccagaagcagcacctgcttgagtgtcccggacttcgcggtcagaatcagacagcacaaactgcgcccaacggcatcggtggtgcaaatggatattccgcaactccgaatggtgctgctgccacggcacctggcgctggcccaggagggcctggcacagctgcacttccgactcctaacggacctatgatgacgaacggcgtcaacccacatgctacctcgatgcaaactccgctgcagaacatgcaaggacgcgccgcattgccgactcccggccctcccaccggacctgcatctgctactagctcccatcaaccgactcgcgccacccccaagtcgaagaccaaggcctccacttcaaatctcccagctcttcctctagatgacgttcatgtcttcaccgaccggggctggaaggaaacgcgatccgca

SEQ ID NO: 18958 - DNA, 441 bp, A.fumigatus
ccacaccttgacagcaccttgatgtcagtacggcgatgctgggacttgcggaaacctagaaacacatatatacccacggtatcccgagcattgtcatcggtgcatcaccagcaacttattcgctgccaccacacctacaatttcgatctcctgcaacttctcaaccataccattccacgagacactatagttaagatgtccaaccgcgccgaaagagaagctgaggacatgtacgaggcagagaacgatgcctcgcccgtctcagctgatgttatcgacaactcctacgtcggcgagacacgctctgagctccgaaaccaggtccccgttcagcccgaccaggacgattacgaggatcccatgcaacctccatactcgaacacggaccagcagcttggtacgtactctacttcagggaccatgttggttctgagcgactga

SEQ ID NO: 18959 - DNA, 1425 bp, A.fumigatus
gaggacgattccaacatatctacgatgtctgaacaagagtttcccttactgacctgggaggaggttcatcagaatctagtgctgtccagccgcagtcgatcaactgtaccggatctcctgggcgccaacaaaatcacttcgcttttgtctgcatcctcgtacttactcccagaacgctctattagtccacaaacagcgacatctcaccctcaaacgcacctttacggcggcttttatctggcagatccgcctagtggggatcagcagcccgaggcgcctaaacctaagtcctcgaaacgaaccagaacagatatcgaacccccggatggctcgcactcaagaaaacgagggcgacctcgcaagacagcaggcgaaggagaagatcctcatgaggtgcgtcaacactcctcttatcttgctctagttagcattctgcctatcaagctgaccgggcagcgacgtcgaatgcaaattcgactagcacaacgggcctatcgttctcgcaaggaagccagcgtttcttccctccaaagccgcgttcttaagcttgagagtgcagtggagcagatcagcgcagcatttttgtcatttagcgatgagctgatccaatccgatgtcctgacctcccatcctcggttgactctccgtttacgggacactgtacagctctgtttgtcattggcgaaaggagccaatatgacagaagatcaaaatattactacaaacgtgtcgtcccctagcgaggaaagccactcgtcttcagaggaaaaggagtctcagcgtaggcaaagttctctcgcaacatcgcctccttcgagagaatctacgggaagccaaggtttggggacgctacaagctaccggcttcagggaaccagcagaagataagtatccccacgaggcaccttccctggatctgagcgcctttatcgaacggcttcactttgcgtgtctctatgaaggctactcagctctcagcaataccgctgttggcatggatgttttacagagaccatttcgatttctccttcgcttgatggataggaaacgtgtagcctcatactttgaagcatgcttacacgcaaaagccagtcggaagcgcctggatgagtggaacgagataccctacttcaaaatcggtggcgctggtacccactatcctcgcaagacaaaggcaagctcaaacgaaactctgccacgatgggagaacatccaagatcctacgtcagagctaccgcaggagatccagcatgagcttgatggtgagtggtttgatatacaggacctagagggatttctcctggaaaaagaagttgcatttgtcgtgggcgatacgaactccagtgataagcgaaacgtagtgaacgcggcacatttaattcaaggtcggcatctgttcctcctcttggtgttttcatcctactga

SEQ ID NO: 18960 - DNA, 1740 bp, A.fumigatus
tcgttgttcatcgtgaatcatttcctttcgttaattcttcttttaagctggccaatctcaggcctttacattctctcaatcttcagttcatcatcgcagatcgattctgcccaccttcctttcttaccagctattgctagactacaccctggacggtgtctcatccattctttgcaagcaattctgtcttctattcttcgcctgagtagcgatcggctggaatctttttcagctgcgttcctaactttaagcgaccatcgctccttagtcttggtgattgttcgacagtgcaacatggccccgtcgtcgctcttattaagcgtaggatctctcattacttcgtccttggtctcagcaacagccctggaggctcgtcaatcacaaacgtatcagcttgcagagtcctggcagggcgaaagcttcatcaatgactggaatttcttcgacggagctgaccctactaacggctatgtgacatacgttaatcagagcttcgctaaacaatccgggttggtcaaagtcactgagagcggtagcttctatatgggtgtcgactacgagagtaccttgaaccccaacggcgccggccgtgagtcggtacggatcgaatcgaaaaattactacacggagggattgtatgtcatcgatatcgagcacatgcctggtagtatttgcggcacatggcccgccttctggtccgtcggtaagaactggcccaacgacggtgagattgatatcattgagggtgtcaacttgcagaaggcaaacaaaatcgtccttcacaccagcggctcctgcgatgtctcgggcagcaacgacatgacgggtactctctcttcctctgagtgtggcgaggcttccggcacggtcggatgtgtagtcaagggaaccaatggcagctctggcgatcctttcaatgagtcgggtggtggtgtgtatgctatggagtggactgacacctttatcaagatctggttcttccctcgaagccagattccggcttctcttgccagcggcaaccccgatacctcgtcgtttggaacccctatggcgcatctgcaaggctcatgcgactttgcagagcgcttcaaagcacaaaagttgatcattgacacaaccttttgcggcgactgggccggtaatgtttttgccgaatccacctgccccatgagcgatcccagcagccccatgcagagctgtgtcaactacgtcgctcagaatcccgcggctttcaaggaggcgtactgggagatcaactccatcaagatctaccagtacggtgtcagcgctgcttcgtccgccgccgtctcgcaagctacagcctccaaggtcgaaggcactcgggtgtcggcccaggccgccaataccgcgacgcccaccgttcccgccccggttgagacaaccactgttccccagccagctcagaccaacactgttgcgacttccgctgctgatcacgccacaccgtcgtctgccgagaccacgactgttcccgctgccactggggctcccagtgtgtcggcgactgagggcggcgattcggagttggaatcaaccagcaccgtctacgtcacatcgactaccactatctgccctgtcgcagaaagttcatccgcagctgccgcgggtggcaaggaggacgcgccctctaacgggacttctggcgccgaggtcgctgcaacttcagtcgctgctgctgctcccgctgcttctacacgccgggggcgaggatatcgcgta

SEQ ID NO: 18961 - DNA, 486 bp, A.fumigatus
ttccaactccgaatcgccgccctcagtcgccgacacactgggagccccagtggcagcgggaacagtcgtggtctcggcagacgacggtgtggcgtgatcagcagcggaagtcgcaacagtgttggtctgagctggctggggaacagtggttgtctcaaccggggcgggaacggtgggcgtcgcggtattggcggcctgggccgacacccgagtgccttcgaccttggaggctgtagcttgcgagacggcggcggacgaagcagcgctgacaccgtactggtagatcttgatggagttgatctcccagtacgcctccttgaaagccgcgggattctgagcgacgtagttgacacagctctgcatggggctgctgggatcgctcatggggcaggtggattcggcaaaaacattaccggcccagtcgccgcaaaaggttgtgtcaatgatcaacttttgtgctttgaagcgctctgcaaagtcgcatga

SEQ ID NO: 18962 - DNA, 363 bp, A.fumigatus
cgtaccagtctgctccccgttgaccccagcatccaacattggctcgatgccgctgagctcctccagaaaagtcaccttcagtacacgcgggtcattcccggcttcttcatggactactggggcatgcctgtggtgcgcacgaatctcacgccctacatctttggcatcaacatccagcactgccaggctgccatcccaggcgacggaaatgacgtgatctgcatgacctatgcatacgacatggcagcatttctgatcaggttattggatgttgcggactggcctgaattcagcatcatggttggcgacgaggtcacgtacaaccagcttctggagatggccgaggagattcgaggtcagtga

SEQ ID NO: 18963 - DNA, 279 bp, A.fumigatus
ccagagtcttattatttgatccagaaatccagatcggatcctgctttggacagaactcgacaagtgcaggtagactacaacaatattccctctcttgtccaagttctggaacagcacaccatccataccatcatatccgcaattgggatctttgatgccacgaccagtcaatctcagttaaacctcatccaggctgcggaggaatccagcgtcacgaagagattcattcctagcgaatactcttttattcaaaccaaagagtatttccccacttactga

SEQ ID NO: 18964 - DNA, 204 bp, A.fumigatus
catcaaggtgctgtcaaggtgtggtcatcgtggacgttgagttttcgattgagttctgaggagtcagcttccaccaaagcctacgaccaactacctcaatgtctcttattcgtgcttagtctagttgggatatacaaacaaactgcgggcacattgatcaccttcgtcttcacaacgggaatggacgcatccaagcttgattat

SEQ ID NO: 18965 - DNA, 435 bp, A.fumigatus
agacagagaatgcaacggtatgtatttcgcaagcatctgttctatttcgcttccatgctcatttgtttgtacagtgtcttctccgccaagtttacgcccgacaacaagtacatcctttcggggtcagacgacggcaacattcgactctggcgtgcgaatgcctccgaccgtagcggcatcaagagtgcccgccagagacagaaattagaatatgaccaggctctaattaccaggtactcgcatatgcctgaaatccgaaggatcaagcgccagcgtcatgtgccaagaaccgtgaagaaggcggcagagatcaagagagaagaacttgctgctattaagagacgtgaggagaatgttcgcaagcatgctaagaagggtgcactgccgccaagacggagtgagcgtgagaagatgatcttgacacacgagcaataa

SEQ ID NO: 18966 - DNA, 261 bp, A.fumigatus
gagtggcaacttcacaacatttgtctttggaggcaattctgttcgatgacaatcgacgataactcagggagtctgtacgatgcttacagcatatcgcgcaaccttcttgtggcctacatcttgctcatggcattgggtcatcattcgccctccttgactttcagttcatctggcgatatctggctcgacaacacaccgtgttttgacctatctgctgcagatgacccttgtaaagcagcacggtcgataccgctcaagtaa

SEQ ID NO: 18967 - DNA, 321 bp, A.fumigatus
tttgacgggaccacaagctggatgatcaacttctgtaaccattcctcgtgcttgcactacgcggacgattccatgtcagtgaatggcttcgcccaatcattagacatcggcgcacgacttaccatgagaatgattgagcgtcccttggatgtcattgatcgcggcatatggcatcccactgccttccaggatctcgagccattcctgcgtggttttctgcttaactctcttctcaatcaggtcatcaagctcttcccgatgctttactcggtcacggttggtgataaagcgagggtccgtcttccattcggggaaccctag

SEQ ID NO: 18968 - DNA, 1485 bp, A.fumigatus
gcgttgtcgtattgttctatacggccatcttttctgttacacctaccctcgaactctggcattatgcctccttccctaacaaaacaaatcacacagatcgaaggtgtaaggctagcagatgccaatgatattgaatgggacattaccatcaattaccccggaaagtcagcaaaaggaacaatcgttgcaatcaccccccaccgcagctcatcaccaaatgacaactgttctcccctggcgcttccagcattgacccaccctcacattcacctcgataaagcctatgtccacagcacacgcgaatacgcacatcttcttccagcggaaggctccttccaggaagcgctatccttcactgcccaggccaagaaacagttcagccaggccgatctcatgaaaagaggcgaatggcttcttgcagagtcggtttctgctggcgtcacagcaatgagggcgttcgtggaggttgatcacactgtcaaactgacgtgccttgagactggtctcaaactcaaagacgaatggaaagagtgctgcaacgttcagatcgtctgcttcgctcaggatcccatcttttccggtgagtatggcgatgaaaatcgcgacttgatcgagaaggccctcgagcgctatccacagattgatgtcatcggcacgacaccctacgttgaatcgagtacggacgctgcgagacgaaacattggctgggcgatcgaaaccgctgtcaaactggacaagcatgccgatttccatctagactacagcctagatagcagcaaggaagctctagtgtggtatgttctgcaagcacttcagcgcaataactggacaagccagtcaagtagcagacgggtcatgttcgggcattgcacccgcctgacttccttcactgataaagaatggtcggatttggccaaagaaattcgtgacaatgaccttcccgtgagcttcgtcggcctaccaaccagcgacatgtacatggcctcgccgtatcccgcagccaacgctcctcacaatcggccaagaggcaccctgcatgtccttaagatgataagcgagcatggtctagatgctattatcggagtcaataatgtcggaaacgcgttcacaccctggggctctgcagaccccctgtcccttgcttgtctaggcgtgggaatctaccaggccggaacgcagaaagatgcagaattgctgtacgaatgtgtatccacgcgtgcgcgtgctgcaatcggattactgggcagccaaggcggatcaaatttgatgctcaaggaaggagatcaacctgatctagtcgtgcttcacaatgtggatgacacaggatgcaacgttttaaggccaagaaatagtgtagcagatgttgtgtgggatccgccggcaagggtgagcaggcatatcatctccaatggccgtctgaaactgccaccgcatcctatgtatccggggacagcacggtatgctttcaaggatagcgacgcctga

SEQ ID NO: 18969 - DNA, 1947 bp, A.fumigatus
aagcaattgatcaaagttggagagattgacaagcacttttatacaccgtgcaacgttgcttattcagtccagctttggggaatgtcacggcaaaatggggctacttcttccctggcatctactttagagaccacccatggaacaccgaggaccatctcgagcccccatccatcagtttcgacagttgaaggaaacacagccaatagcactcctccttcctcgatcgatttatcatcgaaaacgagctgttcaacaggtacggttcgggggaaagtgcaaataccgaaactttcggcagccactacagagctcctttcacggatcgctggtaacataagaggagatcagcagaagaatgataacttcactacccgttggagcacttcaatctttgatccaagcttgaatagtttgaattttcaaaagttcaacacgatgaaggcctcttccacaatcatagagctgcccacggcgccgttcgcttatacgaacaatacactggcacctacagcagtttccaaccaagcccctataacgtctggggacggctcctcgagacccaagaagcccgttaccattgctcccaaaccaagtgtaacagtatcagctggtccatcggcgacattggcgccatctcagatacaacaaacattgccatcacaacctacggctctgatcccaaatcctcctctggcaccgctggcgccgtctcaaatacaaacaacattccaaccacagcctaggggtcttaaacctaaggctcctctggtctcattggccccgaagcctgcaaaagtcccagacggcaacccacaaaaagcaacccccggacaacgctcacgcaaaaatgcttcaaatgggtccagaaaatcgagaaaacggagacgcggcggtgatagtgacggcgaagacattataagggctggtgactccagttcggatgaatccgacgtcgcccctaccgccactcaaacaaagtccggcagacaagtgaaccgaccgtcattatatgtacctccagcttcatctccagccattaccaaggcgaacggcacttcctcccatggctcagagactataggtgcgcgaagacacaagcgcgtgtttcgcaagacgaaggaggcgtatgtcaactgtatgcattgccaaagaggtcatagcccgcagagcaatgctattgtattctgcgacgggtgtaatcgagcatggcatcaactctgtcatgaccctccgatcgactctgatgttgtgaacgtggtggagaaggaatggcactgccgggaatgcaagcctgtgcaaatctccatcgtccagccaacagttgtcaggagcaaccctgatttacaagctcaagcattgcgtcatccactacaacaccatgtgccttctcccaagaccgaagtaggaggcgagcgcttttctgcggaggagcggcggggttatttgtcgagcctctctcacgcaagtctcgtcgagcttcttgtcactatatcggaccggaatccctccttgtcgatgtttccaagcaatttaaaggaactgcagttgtcgaaatttctattcacctcaaatacatcagctggtccagtctcggcagcaacttccactgagacaattacaacaaccgaaacaccggtctctcactcggggaaagacacgacttctgagaagccgagcactgagaatactgaggaaccattgccatcagcttcttcttcacggaagagacactggtacgagtcagatgaagagtcagaatacgaggagtttcaagagcatcgactgtacccacgcgctggaaatgggtttcgtctctcgctcaacgccgacgatgttgacatcatgcgtgaagacccagattgtcccacttttagctatgcattgcatgggccggccaaagctcgcgccgaggccaatgaaactgcacctgtatggggggctgcgtga

SEQ ID NO: 18970 - DNA, 654 bp, A.fumigatus
ttgggtacaccgactgtgctgatcaactgcgcggccgcaggaattaacagtcaaccggtcctgactctacctgcagaggcattcgagaaaacaattcgaaccaatctcctcgcagtcttccacacttgccaagtatttcttcccggaatgttatccgccgagaatggtggtaccatcgtcaatatcagctccgtcctgggccacctgtcggccgccggcttgtctgactactctgcgagcaaggcaggtcttagcgcccttcatcgaacgttggaagctgagcttcgtgtgtcgagatatgacgggatagtgaaaatgctgctcgtggagacagggcagatatcgacgcctctgttcaaatcaatcaagactccaaacaaattctttgcgccagtcctcgaaccagtccatgtcgctcagaaaatcattaccgcaatagacgaaggacggggtggcctaatcaggttgccggcgttcgccgttctcatcgactggtatgccgtactacctgccagcatacagcgaattgcccgttacttgagcggtatcgaccgtgctgctttacaagggtcatctgcagcagataggtcaaaacacggtgtgttgtcgagccagatatcgccagatgaactgaaagtcaaggagggcgaatga

SEQ ID NO: 18971 - DNA, 327 bp, A.fumigatus
cacgatcaagcatcaattgtaccctaccgaagctaccagacgcttgatggagatattcttttcggggggggaaatgacaggttattcggcgtcttatgcgatcgactagggttccccgaatggaagacggaccctcgctttatcaccaaccgtgaccgagtaaagcatcgggaagagcttgatgacctgattgagaagagagttaagcagaaaaccacgcaggaatggctcgagatcctggaaggcagtgggatgccatatgccgcgatcaatgacatccaagggacgctcaatcattctcatggtaagtcgtgcgccgatgtctaa

SEQ ID NO: 18972 - DNA, 231 bp, A.fumigatus
catggaatcgtccgcgtagtgcaagcacgaggaatggttacagaagttgatcatccagcttgtggtcccgtcaaattagtcaacacacctatcaagtattcgcatgcaacccctggggtccgaaggccgcctccgactcttggccaacacaccgacgaaatcctcaaagaactcctcaattatgataaggccgatatcgatctcctcaagaaagagggcattgtgtcgtaa

SEQ ID NO: 18973 - DNA, 333 bp, A.fumigatus
tttgaattttcaaaagttcaacacgatgaaggcctcttccacaatcatagagctgcccacggcgccgttcgcttatacgaacaatacactggcacctacagcagtttccaaccaagcccctataacgtctggggacggctcctcgagacccaagaagcccgttaccattgctcccaaaccaagtgtaacagtatcagctggtccatcggcgacattggcgccatctcagatacaacaaacattgccatcacaacctacggctctgatcccaaatcctcctctggcaccgctggcgccgtctcaaatacaaacaacattccaaccacagcctag

SEQ ID NO: 18974 - DNA, 807 bp, A.fumigatus
  unsure (45): Identity of nucleotide sequences at the above locations are unknown.
tggactgaatcaacggccacgccatttcgtgacatgactgccaantacgacggagcacgccgcttacaagagaaatcacatgtcccaggagttttacccctagacactgaatttggtagtgctacaattctcacaaaacgtgatactggtgtcgaagatataatcaatgataatgtgagaaaggtagccgacctaggtccatcacacataatgtccaccacatcaccctcgcccatctctcagtcacctgataaaggatggcttgaacacctcacattcgacctttttatgaaggttattaatcgcacacttttccacccgttcctcgcctgggtcggggtgctcagcctccgagcccaggccaccccttacacccatatctcgttcatgatcgcgacgggctatgctgccttcctcacggtcttggctcttgcccgtgcgatgaaccagagactggcgcatgggcttccccgacctgttgacttaagcgaagaggttgttgttgtcactggtggtgcgagtggccttggcttactgattgcccggatatatggactacgtggagttagtgtggccgtcttggacatcaaggctgagagcgatatcgagggctgggaagaagtgacgggagtggactactatcggtgtgatattactgatcgagaagcggtggagcggatggcaaggagaattaaggaagaggtatgcaatcgcttcgcgagactacagccctgtggaagatataatgatatgaacatttatgaaataatgctaatcttccttagttgggtacaccgactgtgctga

SEQ ID NO: 18975 - DNA, 594 bp, A.fumigatus
tatattatggatggttaccatgtctctcacgatcccgctgttgagtacactgtagagcccaccactggccgtaaactcaacatcctcgatgtccccggtggcaagagctccaaccctgctcccaagacacgccggggttccaacgacgtcgtcaagggccgagccctgtctccatccaagatccaccaccccaagccttccaagccctacgcttctcgacagatccgggaaaccgactttgctcccaccatggaggacctgaccaggcgctttgccggctcccgcatgtctgacgagtactcgtactccaacagcccgcccagctctgtcggctcttccctgtcttctcggtcgtcaggcagcacctcgccgtcgtccttgtcttctatgagtgacccacccaccccgatctgccgctgtgaacggtatggcatcactcgcaagggtgaccgcgtcaagctcgactgcggtggcagccgctgtggttatgtcactgagtcttcagatgccagctgctccgagtctgacagcgatgaagaatatcgccgggctcgtactgccgtgcgccgtcaaggcatcgttgtgcgccgataa

SEQ ID NO: 18976 - DNA, 321 bp, A.fumigatus
aaagagtgcggcaatgatgggtggtggaagaagctaagatggaaagttgttgtggccaggttattattactattgatgcctggggaattcaatgctttccgtcccgactatccggggactgtcattgctactattctcctcccaccctccatgaaagatcaatcgtatggactatggcccaagttgatgaaaagatatggtgcccacaaatacccctacacgtacatgctagacaagaacgatgcgcaagtcgcctctatcaaacaggccccagagcaccgaagctcaagcctcgggctaatcccaaccgtatcatcttga

SEQ ID NO: 18977 - DNA, 183 bp, A.fumigatus
ccaatcatttcgcatgacagaaaactgaagaagggactctttgagtgtcgactgtgcaacaacaagcacaggatctcgcaggtgcatatcccgtatgcggccaagcttctgttccaagaattggccgcgatgaatatcgccgctcgcatgtttaccaatcgttctggcgtgtcagtgcggtaa

SEQ ID NO: 18978 - DNA, 351 bp, A.fumigatus
aggtgctgtagccgctgtctacttgacgagccttctcttctccttctctttctttctttcttctccagcaagcttttgttggttcgagctgccttttctttggaagtatcctgtgcactggttgcactggtttttgttattgttgttattactgcatcttctatactactaattactttccccacactatatcaaaaaaagtcctcaaatctttccctcccccagtttgctctgtcagacgagctgtgctctctggtattcttgtttatttacccttgctcaggatacttcctagattatacaatcttcttcacacggttctcaatcctcgtcgccggccgacgttgttga

SEQ ID NO: 18979 - DNA, 264 bp, A.fumigatus
tctttagttttacttcaatcatctaccgccacaatgaccgctgttcagctgaagttctctctccggacttcctccaacgtcaaaaccgtccatctggtcggctcctgggataactactctcgtcaaattcctctttcccgggatgattccaagccgggctcatgggttggcaagttccgcttccagacctcgatgctgaagctgggtggtcggtactggtactacgtaagtattcgccgctgccgaattgataagggaagttga

SEQ ID NO: 18980 - DNA, 1281 bp, A.fumigatus
agacttggtgtttgtgccagtatcattcccttcccggaccacaaccagtcgcctcgtaatacctaccagtctgcaatgggcaaacaagccatgggtgtgtttttgaccaactttgaccaacgaatggagacaatggcaaatattctctattacccgcagaaaccgctagccacaacacggtccatggaattccttcgattccgtgaactaccagctgggcagaatgccatcgtcgccattgcttgctactccggatacaaccaagaagattcggtcatcatgaaccagagcagcatcgatcgtggtctcttccgaagtctcttctatcgcacatacacggatagcgagaaaatggttggcctgactgttgtcgagcggtttgagaagcccatgcgctcggatacgatcggtatgagaaagggcacctacgataagctcgatgaggacggtatcattgcccctggtgtgcgtgtctccggagaggatattatcatcggcaagaccgccccgttggcacccgaggcggaggaacttggccagcgaaccaaggcacataccaagctggatgtgtcgacgccattaagaagcactgaaaatggtattgtggatcaagtcctggtctctaccagcaatgatgacctcaagttcgtcaaggtacgcatgagaacgacaaagattcctcagatcggagacaaatttgcctctcgtcacggacagaagggtaccattggtatcacctaccggcaggaagacatgccgtttacacgcgagggtgtttcccccgatcttatcatcaacccgcatgctattccatctcgtatgacaattgctcacttgatcgagtgtcagctcagtaaagtgtcggcattacgtgggttcgaaggtgatgcaacaccttttactgatgttactgtcgactcaatctctcgtctgcttcgggagcacgggtaccagtctcgtggcttcgaagtgatgtacaatgggcatactggacgcaagctggttgcgcaagtgttcttgggaccaacgtactatcagcgtctgcgccacatggtcgacgacaagatccacgcccgtgcccgtggaccgacacagattctgacccggcagcctgtggaaggtagagcccgtgacggtggtctgcgtttcggagagatggaacgtgattgtatgattgcgcacggtgccagcgccttcctgaaggagcgtctgtttgatgtctccgacccgttccgtgtccacatctgcgatgactgtggactcatgaccccgattgcgtaa

SEQ ID NO: 18981 - DNA, 426 bp, A.fumigatus
atgaacaccagtgaacgagctcagcaatcgagcaatcgaccatcaaagaaaatgacaacctcaccttcatatgccttctcatcctcatcagcaacgcccatcctgctcctcaagacgaaatctaccccgcatgatggctacgaggaattcttctccgcccacggctacaaccccgccttcgtcccagtcctcgagcaccatttccatcagacgaacctccacaccgtaaaggatctcttcacgtcgggcagtctaaatgccggcccgcgacggaaatacggcgggctgatatttaccagccagcgcgctgtagaggggttcgcgcgcttggtcacgtccgaggtggatggtacgtactgtttgccttgccctcagcaggcatggtcagaactcaaagagaaatatccacaagctaatgggctgtaa

SEQ ID NO: 18982 - DNA, 597 bp, A.fumigatus
ggtactagagaggcaactccttcgcctactccgtatggaagcaagacattagctcgactatgctgttccaggaccccgatagtgctctgtagatctggcaagttcgcatctagcagtgataatgtgtccgatatgtctccgaatgatggtattaagacttgccagttcaacttaacctctttattactctatagtagctatctcagattgagtgaaaccggttatagcactcttactctttccttgcatttcttccacatcgatctcttcacatatcgctcagaagcctttcaaatcatcacgatgtcggactttactgagttgaacagacaatatttcaggtcagtccacgatcagtaccgggtgcagagtgcattccttacaaatccacacagtaaactagctagttcctacagggaggaattccgacaaggccaggaattgatctttaatgaggttcaagggcgtcgtgcatggatcagtgatacttggaacgacaccaagtcgggaaaaggtcataaaattaggatgctcgagtacgcttgcgggcctggtgctgtctccgcagtatgtatctcaaacagacttttgaggtga

SEQ ID NO: 18983 - DNA, 252 bp, A.fumigatus
catgaatgcctttgctttaggtcataccgctactgtttttggtgctactggctttctcggtcgttacattgtcaacaagctcggtatgtcaacgagatgacccgcagggtggaagcagatgttgattcgcaactagccaaccagggatgcacggtcgttgttcccttccgcgaggaaatgacaaagagacatctcaagccgactggtgatctcggaagagttgtcttcattgtacgtgatcgtcttttctag

SEQ ID NO: 18984 - DNA, 240 bp, A.fumigatus
gtggctgcgtcatgttttttcatgaggtgggacgagctgctgatgcttcgcagaaacttctcctataccgacgttcatgttgatggaactgagcgcatcgccgaggctgtcgccaaatacgatgttgacagatttatccacgtctcctcctacaacgccgacaagaactcgccatctgagtttttcaggacaaaggtccgtttcggtcccctgcgagcggtggctgcatggcaatactga

SEQ ID NO: 18985 - DNA, 192 bp, A.fumigatus
ttgatcgtacaggcgtggggtgaggaggttgctcgctcaattttccccgaaaccaccatcgtccggcctgctcccatgtttggtttcgaggacaatcttctccacaagctcgccggtgtcaccaatcttttcacttccaaccacatgcaggaacgcttctggcccgttcacgtaagctcagcaccaatctaa

SEQ ID NO: 18986 - DNA, 528 bp, A.fumigatus
actgagaaaaaggcgctggcaccgttcgtcgaccatattgttggcattgacgtatccgaagaaatgattaagcaattcaacatcaacgcccaagaaacgggctttgcggataagatgcatggctaccacggcgacctcctcgctgaacccgtgccggaccatctatctgggcctgaattcttcgatttcgatctcgtcgctgtgagcatggcacttcatcactttgacaaacctgacatggcgttacaacgccttggtgagcggctgaagaaggacggcatgtttttgattatcgatttggtattggaagatgagcactcctcgaatagcctgcagaaggcatttccccaggcaagcgcgacagttagaacacatggcttcacctcggacagcatgcaaaagttgttcgaagaagccggaatgggtcagaacttcgactacaaggtcattcaggagccgatagtgtttagaaaggagggaaaagagatcaggaagactgttttcatcgcgagatctcagcgcagttag

SEQ ID NO: 18987 - DNA, 219 bp, A.fumigatus
gagcaattgagtcggaattgttcggtaactgggatgctaacaggctgcttcgttataggtcctctctcggaggtatgccagtcatcgccaacaattcgcgtcgcttgcagctcgcctaacatgaatgcctttgctttaggtcataccgctactgtttttggtgctactggctttctcggtcgttacattgtcaacaagctcggtatgtcaacgagatga

SEQ ID NO: 18988 - DNA, 486 bp, A.fumigatus
gctcagcaccaatctaacagttcggagcatgacgcttatccttctatacaggtcattgatgttggctccgcgctcgagttgatgctccacgacgacaccactgccggccagactttcgagctctatgggccgaagaactactctactgcggaaattgctcaattggttgaccgtgaaatcgtcaagcaccgccgccacatcaacgtccccaaggctgtcctgaagcctatggcatactacctgaacaagctcctctggtggcacaccatctccgccgatgaggtggagcgggagttcattgaccagaagattgacaagactgctaagacattcaaagaccttggtatggagcccgccgagctcagcgacctcaccttccactacttggtacgtcattcgccctcctttaagttgttaccgatactaatccctccaccagaaaggctacagaagttcctcctactacgatctgcctcccgccactga

SEQ ID NO: 18989 - DNA, 267 bp, A.fumigatus
ctgacagtccatggaatgacagatgaccaagagcgactttccttccttacatcgcttgccgacaaagtgaacaaacccgacacacaagaagcttacgtgtatgcccttgcggaagttgcaaacgtgaagcagcgactacaggacttggatggagcgcaaaaagatctggaagtatgccagaaggttttggactcgttcgattccgtcgagacggtggtgcacgcttccttttacaaggtcaacgcagattactaccacgtaagttga

SEQ ID NO: 18990 - DNA, 306 bp, A.fumigatus
ccgtacgtgaaggccaaacaagaattcgccgcctattacaaaaacgcccttctttacctggcctgcatcaacctggacgatcttagcgagtcagaacgtgtctcccgcgcatacagcctgagtgttgccgcgctcgtctctgacacgatctacaactttggtgaactcctactgcacccgatcctggactcgctcaccgagacgccgcacagctggctgcgcgacctcctgtttgccttcaaccgcggcgaccttactgcgtacgatgtcttcaccacggggctggaaggacacgcgcatcgtaat

SEQ ID NO: 18991 - DNA, 396 bp, A.fumigatus
gtagaccatcaccaattgaccctcattctggatgttctcggaacaccaaccatggaagattactacggcataaaatcgcgccgggctcgagagtacattcgctcccttcccttcaagaagaagatcccattcaaggcattatttcccaagagcaacgaactagcattggatctcctggaaaaacttttggctttcaaccccgcaaaacgtatcacggttgaagaagctctacgccatccgtatctggagccgtaccacgaccccgacgatgagcccacggctccccctattcccgagggcttctttgattttgacaagaacaaggatgctctcagcaaggagcaattgaaaagtcagttgtcactctatccgcttgcttcattgaaaggccgctga

SEQ ID NO: 18992 - DNA, 414 bp, A.fumigatus
aagttagcaaccatggtgcagcaacctcctcaaggaggatcgaggaagatctccttcaacgtttctgagcaatatgaaattcaagatgtcattggagagggtgcttacggtgtcgtttggtgggtgatctctattgtccgtagcgatagtctggctccagtactgacttgttccagctcggctatccataaaccctctggtcagaaagttgccatcaagaagattacgcctttcgatcactccatgttctgtttgcggactttgcgtgaaatgaagttactgcgctactttaaccacgaaaacatcatttcgatcttggatattcagaggcctcgcaactatgagagtttcaacgaggtgtatttgattcaggtacattcctcagcacaagcacacacacacgcacacgtctag

SEQ ID NO: 18993 - DNA, 426 bp, A.fumigatus
ttgcttggacaggagttgatggaaaccgatatgcatcgtgtcatccgcacccaggatctctccgatgaccactgccaatactttatctatcagaccctccgtgcactcaaagccatgcactcagcgaacgtgcttcaccgtgaccttaagccttcaaatctgctacttaacgccaactgtgacctgaaagtctgcgactttggcttggctaggtcggctgcatcgactgatgacaactcaggtttcatgacggaatacgttgccactcgatggtatcgtgcgccggagatcatgctgacattcaaggagtatacgaaagccattgatgtctggagtgttgggtgtatcttggccgagatgctgagcgggaagcccttgttccctgggaaagactgtaagttgctgtgctttgaggaattcccttag

SEQ ID NO: 18994 - DNA, 750 bp, A.fumigatus
  unsure (15),(16),(46),(108),(144),(165): Identity of nucleotide sequences at the above locations are unknown.
acagccaccggcggnntcaaagacaacctaccgaacctcggcatcngcaagcgcttcaccaccgtcctcggcagagagaacaacaacggttccgccgatgaaatcacngacacacccacccgacgcagcaccgacggccgcgcngtccaccacccccaccaccgngagaatgccccctacaccactgacttcgtctccgacgtcgccaacaaagcctccgccatggccccaacagcagacggcttagtcggcccaaccgccaatctccgcggcgccgcagcgcacacgaagctcgcaacaacctccaccatcccccgcgccaaggccatcgcgtacctcgagcgcaccctcgccgaagtcaagcgcttcaagcaggaactcgccttcaatcccgcccaccaggccgagaaccgctacccgcctgctgcagtcctttacggcaagtccgtccctaccgtctacggcgcgcgcgtctggtcgcccgagcagatcaagcggcaggatgcctacgatgatctggccttcgcggctggcgacggcgtctgtctcgcctcggcggcgatgctgcccccggggtaccggatcatcaaggacgggctggtcaagagcgagcgcgggcatgttgggctgctgggcgatctggagggggtgggccagtgtctccgggctttagtccgtggccgacgggaaggtgtgggattagggccgagtccaggaccgggacctcagcctgctgcgcctttttcgtaa

SEQ ID NO: 18995 - DNA, 594 bp, A.fumigatus
ccgagacttgaccagcacggctgtgctttcgacgacggtatcaatggccttgagaccagcagccttcatggtctcgccggattctgcaccggtcagtatcgaactcaatcaagggaaacagacacggcaacacataccaaccagatcgacaatcccatcggccacacccagagcgcaagcagcctcgacactaccgccgacatacttgatcttagtgctgagcttctgccccaactccacgccctccagccgagagaagaaggcctgcgtcagcgccgtgaagctagtcacaacattcttgccaatcaactgcttcgcctctgtgatgtcgcccttctgcggaacctgcacctgcagcttgcacccgccgaacccgagatccatgatctcctcgacgcccgagacctcgccctcggccagctgcgcatcgtgttcggcgacctggtcgcggccggtgataccgaggtctacgcgaccctcgccgacgaaagtcgggatgtctgcggcggggaggaagatgagtgcaatcgggaggttcttgaccagtgcgatgtcgaggcgggtttcgcggcggaattggatgtcactgcctga

SEQ ID NO: 18996 - DNA, 426 bp, A.fumigatus
tcggcccaaccgccaatctccgcggcgccgcagcgcacacgaagctcgcaacaacctccaccatcccccgcgccaaggccatcgcgtacctcgagcgcaccctcgccgaagtcaagcgcttcaagcaggaactcgccttcaatcccgcccaccaggccgagaaccgctacccgcctgctgcagtcctttacggcaagtccgtccctaccgtctacggcgcgcgcgtctggtcgcccgagcagatcaagcggcaggatgcctacgatgatctggccttcgcggctggcgacggcgtctgtctcgcctcggcggcgatgctgcccccggggtaccggatcatcaaggacgggctggtcaagagcgagcgcgggcatgttgggctgctgggcgatctggagggggtgggccagtgtctccgggctttag

SEQ ID NO: 18997 - DNA, 468 bp, A.fumigatus
aaccgcctgcgcgatggcaaccccatcatgtgtagacgtaccccgacccaactcatcgaggatgaccagcgaacggggcgttgcctgcttgaggatgtcggccgtttccgacagttcgaccatgaaggtcgattcacccgccagcatgttgtcgaaagctcccatgcgagtaaacacggcgtccagcatgccgagcttcgcggaccgagcaggcacgtaggacccaatctgtgccataatggcaatcagggctatttgccgcacataactggacttaccgcccatgttcggaccagtgacgaggagggctcgagtcttgtcactgtccagatcaatgtcgttggggacatagctatcaagcagaagttgctcgaccattggatggcgcccttgttccacgtgaatacacgtttgatcggtatattcgggcttcacatatcctggctggctagcaattgcagccagtga

SEQ ID NO: 18998 - DNA, 543 bp, A.fumigatus
tttatcctcttgttctcgacagagggtcgtctccaacaggctaccctagaccttttgtcaggcagtgacatccaattccgccgcgaaacccgcctcgacatcgcactggtcaagaacctcccgattgcactcatcttcctccccgccgcagacatcccgactttcgtcggcgagggtcgcgtagacctcggtatcaccggccgcgaccaggtcgccgaacacgatgcgcagctggccgagggcgaggtctcgggcgtcgaggagatcatggatctcgggttcggcgggtgcaagctgcaggtgcaggttccgcagaagggcgacatcacagaggcgaagcagttgattggcaagaatgttgtgactagcttcacggcgctgacgcaggccttcttctctcggctggagggcgtggagttggggcagaagctcagcactaagatcaagtatgtcggcggtagtgtcgaggctgcttgcgctctgggtgtggccgatgggattgtcgatctggttggtatgtgttgccgtgtctgtttcccttga

SEQ ID NO: 18999 - DNA, 516 bp, A.fumigatus
ttgagttcgatactgaccggtgcagaatccggcgagaccatgaaggctgctggtctcaaggccattgataccgtcgtcgaaagcacagccgtgctggtcaagtctcggtcaaccaagaacccccttgttgacttgatcacctctcgtattagtggtgtcatcagtacgtctcccttgctccgattgaattgcaactttgcttacggtcgttcattacagccgctcaaagatacgtcctgtgccagtacaacatccttcgctccgggctctcggttgcctcgaagattacccccggcaagcgggcgcccacaatcaccgctctggaggaggagggctgggtggctgtcagctccatggtggagaaaaagaagattgcgacggtcatggacgagctgctcaaagtcggcgcatcggacattctggtcctcaacattgccaactcgagaacgggttagaggtttcctttttttttttgtttactcgtttttagatttctatgcggcgcgtgatttgtag

SEQ ID NO: 19000 - DNA, 1524 bp, A.fumigatus
cttgattgtactggcgcggatattttgctaacgtggaaacagtgtacgcgcccagagcttctcactgttctccagacgctgcagaccattgcacaggagtacgttgacgtcaagaccccccaggactccggcttcacatcgccaattctcggtgaggctattgcccgagtgccgtcaatattgggagatgttgtcaagttcctgaacaagatcaatatgcatgctgcgcgaaacgacgataaatatgagttctttcgggaatcggaagagacagaaggaattagcgagcacaagtgcgggatcgccagcgttgaacatgagttagaggaacatcgctctgtcgctgcagggatcctcaagtggccgaaggtgacttatgttacttcgtcagggattgagtatctgatcgaggttgagaactctgcagcagccatcaaacgagtgccagcatcatgggtcaaggtgagcgggaccaagaaggtttctaaattccatacgccagaggtcatccagctattacggcaacgagatcagcacaaggaagcgttggctgcagcgtgcgaccaagcgttcgcggctcttctggccgagatagcaagtaactatcagtccttccgtgactgcgtccagtctctagcgacgcttgactgtctgctctcactggctgcaattgctagccagccaggatatgtgaagcccgaatataccgatcaaacgtgtattcacgtggaacaagggcgccatccaatggtcgagcaacttctgcttgatagctatgtccccaacgacattgatctggacagtgacaagactcgagccctcctcgtcactggtccgaacatgggcggtaagtccagttatgtgcggcaaatagccctgattgccattatggcacagattgggtcctacgtgcctgctcggtccgcgaagctcggcatgctggacgccgtgtttactcgcatgggagctttcgacaacatgctggcgggtgaatcgaccttcatggtcgaactgtcggaaacggccgacatcctcaagcaggcaacgccccgttcgctggtcatcctcgatgagttgggtcggggtacgtctacacatgatggggttgccatcgcgcaggcggttctagattacatggtgcgaacgatccgaagtctgaccctctttatcacccactatcagcatctttccaatatggctcaatccttcccagaccacgaacttcgcaacgtgcacatgcgattcaccgagtcggggtctggcaaggatgaagaaatcaccttcctctacgaggttggagagggtgtggcgcatcgcagttacggattgaacgtggcacggttggcgaatctaccagcaccgttgctcgaagtagcccggcagaagagttcggagctagaggagcggattcgccgccgtcgacttgccagacttcttgcggacgtgggaggattaattgaggatcctgcaaagggagatgagaacttcttccaaaggctcatcagcaacgcggagcaactgtag

SEQ ID NO: 19001 - DNA, 870 bp, A.fumigatus
ctcaggagtccacagcgactcccgcgaggtaaaatgacactaagttcatcgcagtcatcgccgccatccacacaaaatctcaagcgtaaacaacagaccatttccagcttcttcacgaagcgggcgccgagcgcagagaagagaagcaacgacattgaagatgggcgagcgacgacccagaaaggggcagagatgccgctgcgtgaaaccgcaggggatcaaaataatttggaggacgacgaggatggggatgtagtggttcgggctccgaagcgggttaaaacgaacggagttgatcccgagaacggatttggacgcaatatcaaagaggcatcgaatatcgcacggcgaccagaccctccattgagcagcagccaacgcactaatctttacaagttcgcgagctctcaagctgatgatgcaggcattgagaaaacagacgatccagaggcgaggcagcggcagcttgaacgcgagaaactacacaaactatttgtcaagaaactgggcggagctgactgccttatcgggatcggtagggatgccaccactgaggctccctctggtacggaggatgtggcggaaggcgatgaggatgatgaatccccaccccaaccccggtcaaaggggaaaggactatcaaagaagggcgggagcaagctgactccgctggagaagcaagtgatcgagatcaagcgcaaacatatggacacgatcttggtggtcgaggtgggctacaagtttcgattctttggcgaggatgcgaggatcgccgctaaggaattgagtattgtatgcatacctggcaaaatgaggtttgatgaacgtaagtcagttcagaacactttttctgtctttctgcgtaggtga

SEQ ID NO: 19002 - DNA, 1158 bp, A.fumigatus
tggatgcaattgcaaacagatccctccgaagctcatctcgatcgcttcgcatccgctagtataccggtccaccgattacatgtgcatgtgaagcgtctcgtatcagctggatacaaggtcggcgtggtgagacagatggaaactgccgccctcaaggcagccggagacaatcgcaatgctcctttctctcgaaaacttaccaacctctacacgaaaggcacttatgtagatgatgttgaggggttagatggcgctactcctgctgcatcaggcggtgcttccccagctaccgggtacatgctatgcattactgaaacaaatgcgaagggctggggcaatgacgaaaaggtacatgttggtatcgtcgctgtccagccaaacactggtgatgtcatctacgatgactttgacgatggatttatgagaagcgaggtggaaactagattacttcacatcgcgccttgcgaacttgtcattgtcggagaattgtccaaggctacagagaaactcgtgcaacatctctctggtagcaagctgaatacgtttggcgacaaagtccgtgttgatagggttgcgaagaagaagaccgcagtggccgaatcacatagtcatgttgcaaacttttatgctgcaaaactgaaggcagccaatactgcggacgatgcgccagccagtaacttgctccaaaaggtgctcaatttaccggagcaggtgacggtgtgtctctcggctatgatccagcatctgacagagtacggattggagcatatattcgagctcaccaagtatttccagcacttttcttctcgatcacacatgctgctgaacgcgaataccctggtcagtcttgagatctaccagaaccagacagatcactctgccaaaggcagtcttttctggaccttggaccgaacgcaaacgagatttggacagcggttgctccgaaaatgggtgggacgccccttgctggacaaggagcgcctggaggaaagggtgaatgctgttgaggagctgaagagtccggaaagaactgtacatgccgagaggctgaagataatgctaggaaagatcaagagcgatctggagaagaatctgattcggatatactatggaaaggtaccatgtgacttgattgtactggcgcggatattttgctaa

SEQ ID NO: 19003 - DNA, 303 bp, A.fumigatus
tggtgtcatcagtacgtctcccttgctccgattgaattgcaactttgcttacggtcgttcattacagccgctcaaagatacgtcctgtgccagtacaacatccttcgctccgggctctcggttgcctcgaagattacccccggcaagcgggcgcccacaatcaccgctctggaggaggagggctgggtggctgtcagctccatggtggagaaaaagaagattgcgacggtcatggacgagctgctcaaagtcggcgcatcggacattctggtcctcaacattgccaactcgagaacgggttag

SEQ ID NO: 19004 - DNA, 234 bp, A.fumigatus
aaaagcagtcgggtcattactcgtattgccgtcatcataaaaacaagcgcttggggtatcaaatgcatgcagtccgtagaagagcttacgaaaaaggcgcagcaggctgaggtcccggtcctggactcggccctaatcccacaccttcccgtcggccacggactaaagcccggagacactggcccaccccctccagatcgcccagcagcccaacatgcccgcgctcgctcttga

SEQ ID NO: 19005 - DNA, 624 bp, A.fumigatus
tctgttcagctcatactaacattctacgcggccataggtgcggacaaagccgttaatctctctcacgccaggattaaggtccttgaggctgcaaaagcaggcgcgaagctcatcgttctccctgaatgcttcaactcgccgtatggaacacagtatttcccttcatatgctgagacactactcccttcgcctcccacgaaagagcaatccccctcatatcatgctctgtcggctatcgctgcggaagcccaggcatacctggtaggaggcagcatacccgagctggacacttcaacaaagaaatattacaacacttcccttgtgttttcgccgacaggttctctcattggcacacaccgcaagatacatctattcgatattgatatccccgggaagattacgttcaaggaaagcgaagtactctcgcctggaaatcagttgaccctggtcgatctcccagaatatggcaagattggtctcgccatctgctacgatatccgtttcccggagttggcgatgattgcagcgcgcaagggagctttcgcgctgatctaccctggcgcctttcatacgactactggtcctcttcactgggcccttccttgttcgcgctcgtgcggttga

SEQ ID NO: 19006 - DNA, 312 bp, A.fumigatus
tctaccctggcgcctttcatacgactactggtcctcttcactgggcccttccttgttcgcgctcgtgcggttgacaaccagatctatgttggcttgtgcagccccgctcgtgatacaaacgcaacataccacgcttggggtcatagtctgatcgtcaaccctaatgcggaggtcctgacagaagcagccgagacggagacaatcatctacgcagacctggataatgagtctatccagaacactcgaaagggcatccccgtctatactcagcgacgttttgacctataccctgatgtgagcgccgagaaatga

SEQ ID NO: 19007 - DNA, 225 bp, A.fumigatus
ccactcatgttccgtgatcagggcaccaaggatgtccgcctcgacccccagctgaacaagaaggtctgggaagccggtgtcaagggcgttcccttccgcctccgtgtccgcatctcccgcaagcgtaacgacgaggagggcgccaaggagagactctactcctacgtccaggccgtcaacgtcaaggacgccaagggtctgcacaccgctgttgttgacgaataa

SEQ ID NO: 19008 - DNA, 477 bp, A.fumigatus
gaaagaaggcgttatcgcccgcgaggatgtgcgcaaagcgctcgtgtaggtcctctcattcattcatctacaaacccagcgtggaacgcgttattgacgaagcagaaaagagcgctaggcctgcctccctctgactccagcgagcttcactcgatcctctccgcggttgatccaacgaataccggttttgtcccgtatgcgccatttgtgtcagtcgcagcggcgaaattgaggtcgcggtctgatgaggcaatgtccgcagaggtggatgcggcgtttcagcttttcaccaaagggacggatggtccgattacgctggggcatctgaggcgcattgcgcgcgagttaaaagaggataaccttggtgatgagttgctcaaggatatgattcttgaggcgaatggtggcgccggtgtgaatgccggcgttacgctggaacagtttcatgacgttatgactcgtgctggggtcttctga

SEQ ID NO: 19009 - DNA, 1407 bp, A.fumigatus
cgacggctaacaactaggctcggaacagatgtcactgaagccatcttcaggcttggttccactagcccggcttcggttcttctagattcagttgatctcttggagaaaaaatcgcccaaggctgatgaaaacatacaacgcattcgctccagtttaccagaagcggtagatacctgtgtcaaggctgcgggtcatgaatttgatgtatactggcagaagagactgctgaaagctgcttcatatgggaagtctgtcttggatctgtacaacagcgatgaattcgtcgaaatgacggagaaacttcgagtgctgaaagcagtgagggactaccagatagggctgcctctttcttatgagcaatatctgcgactcacaccggagaagctcatcgagcgtctggtaaaccgccatgaatatctgctttccatccggatatccgaatatcttcagattccagcggacagaatctatgttcactgggccagccagaaggtcaaggtgtccacagtcgacgatgaagccgtttgcaaactcatcgtgcagaaattggaaggcaagcccggaatatctttcgagcagattgctcaagctgcatacgacgaaggacgcgctcacctggccacacagcttctgaatcacgaacctcggggtggtaagcaagttccgctgctgctgaagatggaagaagacgaagtcgccctggacaaggcgatcgagagtggagatgacgatcttatcatttatgtactcttgcacttgaagagtaaactccctctcgccagcttctttaggatgatcaacacccggcccattgcctcggcattggtcgaagcgaatgctcgcggggaagacaccgagttactgaaaggcctattctaccaggatgaccgacctattgatggttcaaatgtcctcctgtcggaggcactgaatgcgacagacttaccgcataaaactgagaaactcctcctcgcatcgaagctcttatcagattctaaggatgcaactgcggttcaacaacataaacttctctctgaagcgtcacagttactcaaggtccaagaggctttggacaaagacattgcagatcgcgcagagtttgtcggcctcagcttaaatgacactatctacagactgatcaaaacgggcgacggaaaacgagcacataagatccagagcgattttaggatgccggaaaagacttattggtggttgcgattaagagcgctggtcgctaagagagactggggtgaattggaagagatggcaaagaagaaatccccgattgggtgggaggtgagtaaaacactacccatactccgatatctcattgaacactgcccacatcccaatatttcaccaaacactacacacatccataaaaacatatgctcacataccacgtga

SEQ ID NO: 19010 - DNA, 537 bp, A.fumigatus
gccaatagcagagccatgaatgctaacctttcctggcagggagctgaagaatatggcgtaagagcatgcaagttctggaataacggctttgtcgctctgctctcgaataaccaactcattgctgtctcaaactatgatgagccgcgacctaagttgctagcgccgtgtccagaaggtgaaatctcttcttggtcgttgattccaccaccatatactctttctcgttcagtggaggtgctactggcagtcgacaagactatatttttgattgattcttcagaagcagaagacaaagtgcttcaaaatggaccttttaaacatgccagcgtgtcacctactggtcgattcgtggccctttacaccgccgagggtcaggtctgggtagtgagcagtgattttcagagtaaacacaccgaatatgacccgcaatcccgagtgacacctcgtaccgtcgactggtgtggtgacgacgctgtcgtcattgcatgggaggacgagatacatcttattggtcccaatggcactgctgctaagtaa

SEQ ID NO: 19011 - DNA, 2088 bp, A.fumigatus
tcctccaaaagcctctatgctgtcgtcgttcttttcttctggttagccatgaatgctcgaagagggggatttgacatcctcactcagagtcctttccataaccctcaaaatagccagcatgagacgttcctgcagcggttgcagagtaataataacactctgacctacggagttgcaattggccttttggtttattttgtcttaaactacttcggagtcgcgccaattttgatatcacgagctctgtggaacctcatagtctatttgacaccgtctcgaatagttgtcgccctggattcgaagacatcgaacctagattcaactgacaaggcccttctttctatgaactttcaaacgaaaagcgaagcaatgcaacgtatccttggactcaataactcctccctctcctccttccttccttgttctacgaccttttcaggattcggtacagcgttactcggcgccaagaaccatctgcccccagggctcggaaactgggacaattcgtgctatcagaatagcatcattcagggcctagcatctctactctctcttgcagagtttttggagcacaacatccggacattgggggataaaggatccttttcgactcatcaggctctcagaggcgtcatcgagcgattaaacaatgctgataaccatgatcagcggctgtggattccagcggagctcaaatcaatgagcagttggcaacagcaggatgcgcaggaatacttttcgaaagttgtcggtcaggtcgatcacgaggtgcagcaggctacgaaacgccggactaggaatttggggttgaaaatggcagggcctgtcgagaacatcatcggggcagaaccacatacggatgtggatggtgcagacagttcatctcctcgtttagctgaacggcatctgacgcgcaaccctctggagggccttcttgcgcaaagagtaggttgcatgaaatgcggctggactgaaggtctttctctcatcccgttcaactgcctaacggtaccacttggcgggcaatacgaatacgatgtacggcaatgccttgatcagtacatgcacctcgagcccatcgaaggtgtggaatgtgcaaagtgcactcttttacgcgccaaggaccagttagaaaatcttctaaaccaaatcgaagaagacatgaaactgccgaacacgcctgactcttcaaaagtctcaggagcactcaggacctccgctgaagagcgattgcgggctgttgaggaagcactagaagaggatgattttgcggagaagaccttgtcgaagaagtgccatattccatccaagaaccgcgtcacgtcgaccaaatcaagacaggcggtaatcgcgaggacgccgaaatgccttgtgatacatatcaaccgaagcatgtttgacgagaatacagggatgctcaggaagaattatgctgccgtcagattccccaatgtccttgacttgaatgaatggtgtctggggacaaagtcctccagttggggtcagatggacattgaaagatggggcaccgaccctagggagtctatgctacctgaagctgggtcggcttccgatgttcccggccgcttttttgagttgcgggccgtggttacgcactacggtcgccatgagaatggacattatatctgctacagaaaatacccatcagatgtcttcccggcccacgtcccagacactgtactggaggcggatggcgaaaaggacaaagctgaacggtggtttcgattgagtgacgacgatgtacaaatggtcagtgaggcaagcgtgatgtctcaaggtggtgctttcatgttgttctacgaagccattgatcggcaaggctcagactatactccgactcacggaacacacgcagtggaggacgagaagctcgagtccgtctgtgatttaacaacttcaaacgatatgtctacgacatctacgatcactgacggttctcctgatacctccccggcgacaagcgtatccgctgcagacagattcgatgtgcccctttataagcttcagcttctgactgatgatcatgcaagttcactgggcgaatcttctcttgaggtcacgccttaa

SEQ ID NO: 19012 - DNA, 1497 bp, A.fumigatus
  unsure (1013): Identity of nucleotide sequences at the above locations are unknown.
aagaccggggcggtcttgaagatgttggccaacaatttcggggagatcccaaaggggacgggcaagctacctggctacgccccagtccaagctgcagagatctatagcagaactcatatggctctacgtcatgtgatgcagttgattccttctggtagtgggaccctatcccccatcttgtctatgcagtttcccttcgatacggattccgcaaaggccaacattgcgtacacgcggaatcttctaaaggtcattagctacgcccctgagctccaagccgacattctagctctcatcacggagaaagtcgtgaagatcgatgtccagattcaggtagatatggaagacatcgaggacgaagtgggcgaggatgttctccacgcagtctcgcctgaagccacgatgttggaggatgacgagaatgaagttgacgacaatgcatccgtcgctagcgatgattccctagacgtggagtcccggcgagtcaaggccatcaaagacaacatactcaaattggatggcatgatcgattcgctgtttgaatactacgccccgcctttcaccacgggcactttggatgacaaggagaatgcactggatttacttctgagccatttccaaagtattatccttccgacctatcgctcccgccactctcaattcctcctcttccacttctcccagtcgtcgcctattctggtggatcgatttgccgcaacctgtgttcagctcatcttcaataagatgcaacctggaatcctacggcagtccgcagcagcctacctcgctagcttcgttgcccgtggtgcgcacatctctggcgaggttgtaagagatgtctttgacctcttaggcacccatctgaacaacctccgtcttgactatgaagccacctgtcgaggccctgatcttcgccgctacggtcctgtctactccacggcacaggcattgctgtatatcttctgcttccgctggcgagacctgacgaccgcagcgatggagggcgatacccntgaacaaattgatgaactggagccagaagacatcacgttccttccttcggtcaaggaggtctttcaccaagcaatccattccaaactgaaccccctcaaagtatgctcgccggcgattgtgtctgaattcgcccgtatggctcagcacctcaacttcatgtacgtgttcagcattctcgagacgaacaaaagactgcgcgtctcctcgttccggagcatctcagccatggcagacccgcgcttcagccatgtcgagcgagaaactcgtgccggcgatgacctgggttatcagcttgatgcctattttccctttgacccataccagctacctcgcagccgccgttggctggaggatgattacgtccactggcgtggtatccctggcgtggacgaccaggacgagggcgattcggacagtgacctcgacgggagcgaatccgaaggagacctgagcgacgtcactgagaccgacgaagacgactga

SEQ ID NO: 19013 - DNA, 1164 bp, A.fumigatus
ccgtccgcgagaacctcggattcgtctggaggatatctcttcgagcagtgtcggccaggaagtcttcttcacagcccgcctgcactttatacgccggatgagcgcgaggctagtcttcctcgtcttccgtcagcgtctcactaccttgcggggggtccttcacgagaagcctgggggccaatccattgcgatggttcagtgggccaacatctacgcgtgggttccatcgtgcgcgtgcgcggcatcgtccaaacgccccaggtgccagtgctgggctgctctattcatgacgtcgagcttgatgtcgaacagattcacctggtcgtccaccgcgaggaaccggttccctttagcgtctacgaggccgaaattcgcaccgcagaggaagacaaggtcgaaggccgccgcagtcacttaccggaccgtacacggctgaacaaccgtatcttggacttgcgcactccaacgtcgcaatccatcttccgccttcagtctgcgctctgcaatatcttccgatcttcccttgacgagcaaggcttcatagagatccacacccccaagctgcaaggctctgccaccgagtccggtgccagtgtcttccaagtgaactatttcggtcgcgatgctttcttggcccagagtccccagctcgccaagcagatggctattgcagccgactttgagcgagtgtacgagatcggtgctgtgtttcgggccgagaactccaacacccaccgccatctgaccgagtacacgggtctcgatatcgagatggcgatcgaggagcattatcacgagatgttggacgttttggatgccgtgatcaagaacatgctgaagggggtctatggccgctaccgccgcgagatcgagattgtcaagcatcagttcccctcggaggacgttgtgtggctcgaagagacacccatcatccgattttcggatggcatcaagatgctcaacgagtccggatggcgtgatgaggatggcaacccactgccggaagacgatgacctgcatacccgagacgagatacggttgggtgagcttgtcaaggagaagtatgggaccgattactacattcttgacaagtttccggtcgcagctcgtccgttttacgcaatgccccgatcccgaagacccgcgcttcaccaactcctttga

SEQ ID NO: 19014 - DNA, 282 bp, A.fumigatus
tgtaccaaggggggtagctgtaacgttgactatatcaagattatcttccctaggcctagagtagcatattatacaatactggtgatcagagccatgcaggtcaaccaaatagcccctacctaccgcgtcttcttttcatcaccgtcaacagtcgtactctcgccaacctcccgctctaccatcgccccaaacgcccccattacccacctcgcaagcaagacagccaccatccccacaacacacagataccccgccgtccggcaccatataccgcgggaataa

SEQ ID NO: 19015 - DNA, 843 bp, A.fumigatus
ctgtacacgtccagtgacaatctaggtggtctctcatccgtcaccatgtcgatcaaacgtgctttgtctaagatcaggcccaaagccgatgacgattcgagcaaatcaaacctatctaatgggtcctcgccgcgtcgcagcatcttcagtagcttcttacgcgatcgcgattatgtttcctcctctgacgatggctccgacgattcggggtcgggttcgctgagcagaaaccagcagaagcgcttggctcgcgaacagcgtcgaaaacagcgcagtcgactcagcgaggaacaacaatcggatgactccgagcggcgtcataaggaagagatcgcgcaggcggctcgcgaagagacagccgaaatgagggcccgctatggagagctgcccttgctccagtccactagccgtccgcgagaacctcggattcgtctggaggatatctcttcgagcagtgtcggccaggaagtcttcttcacagcccgcctgcactttatacgccggatgagcgcgaggctagtcttcctcgtcttccgtcagcgtctcactaccttgcggggggtccttcacgagaagcctgggggccaatccattgcgatggttcagtgggccaacatctacgcgtgggttccatcgtgcgcgtgcgcggcatcgtccaaacgccccaggtgccagtgctgggctgctctattcatgacgtcgagcttgatgtcgaacagattcacctggtcgtccaccgcgaggaaccggttccctttagcgtctacgaggccgaaattcgcaccgcagaggaagacaaggtcgaaggccgccgcagtcacttaccggaccgtacacggctga

SEQ ID NO: 19016 - DNA, 1644 bp, A.fumigatus
agggggtctatggccgctaccgccgcgagatcgagattgtcaagcatcagttcccctcggaggacgttgtgtggctcgaagagacacccatcatccgattttcggatggcatcaagatgctcaacgagtccggatggcgtgatgaggatggcaacccactgccggaagacgatgacctgcatacccgagacgagatacggttgggtgagcttgtcaaggagaagtatgggaccgattactacattcttgacaagtttccggtcgcagctcgtccgttttacgcaatgccccgatcccgaagacccgcgcttcaccaactcctttgatatctttattcgaggccaggagattgtctctggcgggcagcgtattcacgacccgcggatgctggaggagagcatgcggcgctcgggcatcaatccggacacgatggaggattacttggagggctttcgctggggcgctcctccgcacgctggagccggtgttggcctggagcggttgctgatgcttcttctcaaattgggcaacattcgtctcgcgtcgctcttccaccgggaccccaagagtttcccgcctaagcccccggctttgctgcttcgtcatcccgaatcgtccacgattgagccaccgtggcaacgggagggacgcggatcactcgcgaaggacgaaagcgagttgcagccattggagcacctgatcgccaactatggagatgccacgtccacctcgtggggcgatgagcgtttcaagatttggcgagacatggccaccggggccgccgtctcatacgtccccagcagtaacaactatgcagtgattcccggcaaccctttatgtgatccctcgcagtacaaccgcatcatcacgcagttcctgcagtggatgcgacgtgagaccaagtacaaacctatctggcttctttgctccccagaagttgaaagtattctgggcgacaagctcggatggcgcagcttgtcctgcattgctgaggagcgtgtggatccgtcccgcaaccaggccgcgtctgatggcgaaattgcacggaagattcggcgcgcggagaacgagggtatcaagatcgtcgagatgaagtacggtgagatggtccccgacgacgtccgggagaagattgatgcacggatccaggattggctggcgaatcgtaagggcactcaggtgcatctgtcggagatccatccttggcgtgattcggagcaccgttggtacttctacgctgtggacaagtcgggcaccatctgtgcgtttgttgccttggccatgctgtctcctcatttcggcatgcaggtcaagtatagcttcgactttccaggctctcccaacggggtcattgagtacatcgtgactcatgccatccaaacagctgccagggccggcaccaagtcacttactttcggagccggtgcaactgccacactgacgcccggccataacctgcacggagccaagatcaagatgctccagcacacctatgagactctggccaagcaattccatctcgtgcgcaagagtgaattcagggccaaactgggggctcatgaagaacctctctacatcgcatacccaccgcatgggctgggttccaggggtattcgggcggttctgcacttctttgaagactaa

SEQ ID NO: 19017 - DNA, 1056 bp, A.fumigatus
actcgtgacggtcatcgttgtactagatcaacgtccatggcctctcatgcccctcctcgatggtggctctacatccaggccgtcttttggcggttcctgatgcgaataggaatgttctttcacaacttaccggctccccgtcctccccgtccagcctttgtccgatccgttcgttccggcaactcgcagatccgtctacatttctactgcccacctgactaccaaaaaaatcggagagagggccgccggctacccgtagtgattaactttcacggaggcgggttcacactgggatgtcccaccgacgactcccgctgggctcaatgcatcctggaggatgtcggagcagtggtagtcagtgtcgggtaccgtcgaagtccggagcatccgttccccgctgctgtagatgatggtgtggaagcactgcaatatctggccgcccatgccaccgaactgggcttggatgtgacccgaattgctctgagtggtttctcagcgggcggcaacctcgctgtcactgtgcctctacggctgcgaagcttgatggccaaggagcagcatggtcccccactcgatcgggcgaattcgacgcaacagcttcttgatacgtcgggcgatattagcatcgtcgctctcttctgctggtacccgatcctggactttgaggagtcgcgtgctttccgccgcgcggcgagcatcatgccagaacagacgcttccgaagttcctgaccgatctattcgataactcctacctgccgaatcatgaacaccgtcgctcgccctacgcatcccctgtccgagcgacagacgagatactggccgacgctttaccccacgatatctttctgtacatctgcgaatgggacatgctgatgaacgagggccagctgttcatgcggcgactgaaggattccggcaaacacgctcgggctatgatgattgaaaaagcccgacatgcctgggacaagtccccgaatcccttccgagatcaagccaaggtcaatgttctctaccgcgatgcctgcgcggacatgaaagcgatttttgacagatag

SEQ ID NO: 19018 - DNA, 429 bp, A.fumigatus
tctcattcatattccacaagctctctttctaccgtcatggcagaaaaaacacttgcctcaaacccggtgacctccagctcaccagaagctggagatgaccagaagcagcccaaggacatcaaccatgtcgaacgggtgttgtctgatgggctcaaaaaagatgaggccgactactctcggatggacaaggatctccaggaatatgtggctcgcggacaggtcgatgtcgatgaagctacgagcaagcgtttgaagcgcatgatcgatcgccgcgtgctgatcatcatgatcttaacgtatttcctccaggctctggataagggtaccttgtcttttgcctcgatcatgggcatccgcaccgatctgcatttacagaacggccagaaggtaactcttgtcttccctttttcactgggatatcttctctga

SEQ ID NO: 19019 - DNA, 306 bp, A.fumigatus
tactcctggctcaccacctgtatctacatcgctgtcttgatcgtcgaatacccgaccaactggattatccaacgtgttcctattgccaagtacctgggcatcaacatttgtctctggggttctgtgctggctctgcatgcggctagcaagaatttcacgcacatggtcgtgctgcggaccctgctgggtatctttgaggcctgctgccagccaaccttcgtcttgctgtccagtatgtggtacaagagagaggagcaggcggcgaccgtaacctactggtatgtcgatcacacaacgttaacatga

SEQ ID NO: 19020 - DNA, 510 bp, A.fumigatus
agctcgccgtgctcgtccacggcgctcatcacggccggcgatcgctttctccgcgacgggccgatactgcgcgccaatgtaccgcttgcggacggctttcaagatgccatacgcaaaccccgcggttgcggacgattcgacatacgagtccggatggtccaggagggtgtgccagaaacccgtctcgctctcctgcagccgctgcagggcctcacactgggcctcgagcgtgtcgatgaggtggatgcggatcggatctgtcggctcaaggtcgagcagctcgataatctcaggaatgacgatggtgacccagctgttaccgcgggcccagcgcgctcgtgcaaagttgtgccctccctcctcgaaggtccagccgtggaaccaaagccctgtctgggtgtcaaagaggtacttgatgtgaacgagaaactgcctcttggcctcggcaatgtactcgggacggttcaggagcttgccgatcttcgccagcggcagaacggtcatcattag

SEQ ID NO: 19021 - DNA, 534 bp, A.fumigatus
caatccatcaggtacatgatgaacggtggtcagcagatcgtcggcggtctactcgcgtactgcttcagtctgatcggcaaggacaaggccatccactcgtggcaggctcttttcatcacctacggcgttatctccgtgctgtggggtctcttcgttatcttctggatgcccgactcgcctatgcgcgccaagtgtttcagcgaggaggacaagcacctgatggttgaacgagtccgtgccaaccagactggtatgcagaacaagaagttccgcgcctaccaaatgtgggaggccttccgcgatccccagatgtactgctactgcgccattcagatcttcaccaccctgccaaccagcggtctgggtgcgttcgccaacatcatcatcagcggcttcaatttcaccgtgctgcagacgcagcttctcgccatggtcctgggtttctatatcattatcgtcctcctgggctccgcctggctggtcaagaagaccggacagaacctgttcgtcatgctgggttttgtcatcccgtga

SEQ ID NO: 19022 - DNA, 330 bp, A.fumigatus
gttttcttgtttgcccccttctctactactagcgccccatccactgacatccatgaccccagatcctacatcggaaccatcgtcctcatgaccgtcgagaacaagaacttgggcaccaaggtcggcctgctaatcagctactacatcaccctctccttctggtccgcccagaccctgtgtctctccatggtctcccgcaacatcgcgggcgccaccaagaaatccaccgtcgtcgcagccaccttcgtctcctgggccgtcggcaactccatcggtagtcctccttcattcctcccccccccccccacaaaaaagcagacatcaaactaa

SEQ ID NO: 19023 - DNA, 258 bp, A.fumigatus
cacgaatctcatccaggccctcaagtcttcctcgacagagacgccccccgctatttcatcgctttcggcgtccacctgggctgctacgtctgcctgaccctcgccatcatcttcctgcgcttctggctcgccctccagaacaagaaaaaggcccgtgtgctggaagagaatggcctgtccgcggcggataacaacctcacccatgcctttgaggaccgcacggaccaggagaatttgcatttccggtatatctactag

SEQ ID NO: 19024 - DNA, 1014 bp, A.fumigatus
acgagaatggcttcccagagtacctctcagaccgatgtccatcagaccgtcaaacagctcatctataacctggtcaacatcagagacgccacaggcaagttcctgctgcggttacaagatggccgcgttattgacaccaagtcctggcacgggtgggagtggacgcatggtatcggcctgtacgggatctggaagtactatgagatgaccggcgacgagtccctcctgcgcattattgaagattggtttgctgcgcggttcgccgagggcggcaccaccaagaatatcaacaccatggctgtcttcctgacgctggcctacgtctatgagaagacgggcaatgtgacctacctgccctggctggatgcttgggccgaatgggccatgtacgagctgcctcgcacgcgatacggtggcatgcagcacgcgacctacctgaccgagaactaccagcagctgtgggacgacacgctaatgatgaccgttctgccgctggcgaagatcggcaagctcctgaaccgtcccgagtacattgccgaggccaagaggcagtttctcgttcacatcaagtacctctttgacacccagacagggctttggttccacggctggaccttcgaggagggagggcacaactttgcacgagcgcgctgggcccgcggtaacagctgggtcaccatcgtcattcctgagattatcgagctgctcgaccttgagccgacagatccgatccgcatccacctcatcgacacgctcgaggcccagtgtgaggccctgcagcggctgcaggagagcgagacgggtttctggcacaccctcctggaccatccggactcgtatgtcgaatcgtccgcaaccgcggggtttgcgtatggcatcttgaaagccgtccgcaagcggtacattggcgcgcagtatcggcccgtcgcggagaaagcgatcgccggccgtgatgagcgccgtggacgagcacggcgagcttcagaataccagcttcggcacaggaatgggtga

SEQ ID NO: 19025 - DNA, 204 bp, A.fumigatus
taccctcggtggttgtatattgagatcataaacacacttgacatattcttcctgtcagctgcaaaggcagtagtaaaagaacgcggcataagtatctattcaattggcctcattcctgaaacatcgggcaccccctctccctcaaccaccctggcgcttgcgatctcatataccggcagctctgcaagtcgcgagatgacatga

SEQ ID NO: 19026 - DNA, 483 bp, A.fumigatus
gcattcatgttcctgagggcttgtcgcggctctttggtgaggatctggacatgctcgctggcatattcatcggccagtttccaagcttcgtcaatcgagtccacgacgatcacctcgccgaaccgttcccacgaggttcccgctagttcagcggtggacaggttcttcaagagctcggtaataatccgcatcgattctcgaccaacggcctcagacgtggtgatgatcaccgcgggcgaatcaggcccatgctcggcctgcgagagaatgtccgttgccaccgtaaagggattggcagtttcatcagccacaataagaatctccgttggcccggcaaagagatctatcccaatttcgccaaataactgcctcttcgcctcggcgacaaaggcattgccaggccccgcgatgaaatccaccttgtccatggtctcagtgcccagcgccatggctgcaatggcttggactcctccaagcacgtag

SEQ ID NO: 19027 - DNA, 960 bp, A.fumigatus
tcttggaggcatcaatttaacagcgtccagcaatggctgctagcgcatcgcattgatttgcataaccagctcaaaagggcagccacgagcactgatgcgggccgcgaggccatcccattccgaaccgctagtcgggtggtgcacgtcgacccagcatcagccacaatcacacttgaagacgggacccagttccagggcgatttggtggttggagccgacggagtccactccgtcactcgcagcgcaattccaggcggcaatgtcaaggcttcctgctgcggcaaaagcgcctttcgcttccttgtctccaaggacgcagcactgggtgatcccgagacggccgctctagtcgagcgtccgggacagctatccatctggtacggaaccgatcggcggattgtactctatccgacgtcgaacaacactgtgttgaatttcgtgttgattcaccccgaagaggagtcggcagaagaggcagacgagagctggggccagtcaggcaacctacagaaaatgctccagatcttctcttcgtttgaccctgcagtgctaaagctggtgagcatggcggatccacagagcgttcgggtttggaagttgctagatatggaggagataccctgttggtatgaggggcgtttggctttgctgggcgatgccgcccatccctttctcccacatcaagggcagggagcgggggttgcaatagaggacgctgcttccctggctgtcgtgctgccttttgggacgacggtcgaggaaataccagagcgtcttcagttgtatgatgagattcgccatgaacgcgcgagccgcatccaacaatactctcggttggccggccgtgatcgtgtcgatggacaggaaaccgctgacagtaagcgttccactttcattcctcgaaattcgcactctaactgcgttagtgtatggcttcaccaactacaattttggccatga

SEQ ID NO: 19028 - DNA, 543 bp, A.fumigatus
caaattcggccggcggccagtctacatctctgctttcattctctacttttttatgatacttggagccggtctatcaaagacgtatgcaggcgagctcacgacccggaccatcctagggatcggagcaggtgccggcgagtgcctggcgcctgttaccattgccgatgtgttctatcttcaccagcgaggttatggcatggcgtgagtgttcttaccctgcgctggagtcggcgctcagagaagctgacggcctgtatgactaggatatataacgctgccttgagtgccggagttgccttcggtatcatcatctcgggactagtcacgatcaaacacgactggcggaccatctactgggtgggatgcgctctagtcggagccctgaccgttgtggtcgtcctctttttcccagagactgcctaccggcgtgttgggaatcccttggtggaacgcgccgtcgagatccaaaagctctcggacagcaacaacgtggaatttgcatcagtaccttccattcttcccaaggtgagctacttggcgtag

SEQ ID NO: 19029 - DNA, 219 bp, A.fumigatus
ttaactgactttaagaagggttggggctgggcgtgcgagagagtcaaggctgtcgatgtggtgacggcagagggggaactgctgcactgcaatgagaatcaaaatgaggatctctactgggcagctcgaggtgccggtccaggtaaagctcttaacctacatcatcaattcctcatgctgattctcgaatcatcctcttggcaggcttccctggtgtga

SEQ ID NO: 19030 - DNA, 258 bp, A.fumigatus
ccaagtaaggtcattggcaccaaccacgtccttcccaccaagaaagctgcgagatttacgggaggtctgtgggttggaaaatatcttcgcaccgtgacatatcaagaagtcaccagccgtcaagcaagcggcgaattgggacggctgtgcggaagagcagcacgcgctgagaacttcgagggtcatgcacggtctggcgatcttcgggcttacaactatctcggtgatcagtttgaatggattcagagagatatctag

SEQ ID NO: 19031 - DNA, 1155 bp, A.fumigatus
aggacgctgcttccctggctgtcgtgctgccttttgggacgacggtcgaggaaataccagagcgtcttcagttgtatgatgagattcgccatgaacgcgcgagccgcatccaacaatactctcggttggccggccgtgatcgtgtcgatggacaggaaaccgctgacagtaagcgttccactttcattcctcgaaattcgcactctaactgcgttagtgtatggcttcaccaactacaattttggccatgacgagtgggataattcgacgcagagactccgcgagtggacgtggaaacgcatcccgaatccctactggcgcatgcccatcgcctttggtcctatgcccggtccgcgccagaaccatttgggcatcccccgggatggcaccaaatccaccttcactactgcctcgatcaagttcaagacctcacgtaccgtactacagaacctcttccccccgggccgccgtggctggcgattcagcgctcctgataccgtggcatatgcctccttctcgcagaccaccctgaacaagatggagtggttgggtggctcaggatatcatcatatcggtttgtatgtccatggtgtcgagtacgtcaagaaggacggcaccgtcattcgaggctcctacctgcccatcctctttgaatcgctgaccgaccctatcgtgtcgggaagagaagagctgggcgctcccaagttatatacttctgtggacatctatcgccgggaaaaatcatatcgaattcgtacaggatggcaaggcgctctctggggccatttcctactggaagacctggtcgaagttgacccagcgtcagcccccggaggattcagtggagaagctgatgaagggatcctggtacacaaatatctacctcagaccggtcgattgaacaagaacaaggcggctgaggagtacgcggcctttgatcccttctcagaggctgtgcccatccccaatcctcgcaaggtgtggacctcctccaaggccagtttccaaatcgacccgctggactgggagcaactgcctacgctacatcatgtcatctcgcgacttgcagagctgccggtatatgagatcgcaagcgccagggtggttgagggagagggggtgcccgatgtttcaggaatgaggccaattgaatag

SEQ ID NO: 19032 - DNA, 741 bp, A.fumigatus
aaacagctcaggaggtgcacgtcgcttcattggttacttcctttctccaaatatttctgggctggtattaatgcccttccaacctccaggttattctctcgtcagctgtcctcctccttggtcacattacattttaccatggcagacactattctgaaaacgacagagacaatcgagcatgtcgaggacagtcagtctcgcgacctctttcatctacacaacctcggccatgtccgtctgcggcatgagcacaccaacgaggtcatcctgattccagctccctcactggacccgaatgatccccttcgctggtcgactggctacaagatctatatcgccattctcgtctctctagccatggtcatgtgtaatttcatggctgccggtcccacggtcgcaatggttgcaattgcgacggacttcaaagaagggggaaacacaacgatgagtgactggatcagtcgagccgcgtactttttcaacaacagcgctctgatgcagggtgtctcgtgtctcttctgggtgccgctacttaacaaattcggccggcggccagtctacatctctgctttcattctctacttttttatgatacttggagccggtctatcaaagacgtatgcaggcgagctcacgacccggaccatcctagggatcggagcaggtgccggcgagtgcctggcgcctgttaccattgccgatgtgttctatcttcaccagcgaggttatggcatggcgtga

SEQ ID NO: 19033 - DNA, 492 bp, A.fumigatus
gctacttggcgtagtctgcgcttctggtccggcgagacatataccgacgagtctttctggcggatgttcgtgcgtccctttgggctgatcctcatcccgcccatcttttgggccaccatcgtcatgtcggtgactatcgggttcctggtggcggttgtatctaatttcgcctcggcgttcagtacaacctacggctttgaggcgtggcagtccggtttatgtttcatcgctggcatgttaggttgtttcctgggtacgttcgcaggtggtccgttttccgactgggtggcggattactttacaaggcgcaatggaggaatccgtgagcccgagatgcgattgcctgcgattatccccagcgtgatcgctgcgccactttctttggtgctatatggatgtggtatcgccaatggctggcactggatggtacctacctttggcttgggcttgtgtatgtttgtcctgtcattctcgtttaaaccatctacctga

SEQ ID NO: 19034 - DNA, 489 bp, A.fumigatus
tctagacaaacacaaaccgcgatcttctttcaagtcactatacttcacagtacaatgcgtattatttggcgcgcctcggctgatccagccgtctacgaagaagcccgcgtgggtcgcgtcttcaaccaccgtcgcccacgacgatatcccctggcagtagtcaaggctacttgtctagaggacatcgtgctggcggtcaagttggcaaaggagaagaaatgccgtgtcgctgtgcgctcaggcgggcattcatgggctgcgtggagtgtgcgtgatgaatccattcttatagatttgggcgattacaagcacttggaagtggatgcagaaaagcgcatggcgcgaacatcacccagtatgacagggaaggagatcaatggaaagctgatcaaggagtatgggttgatgtttcccgggggtcattgtccagacgttggcctggggggctttcttctgcaaggggggatgggatgggtctgccgggtatga

SEQ ID NO: 19035 - DNA, 603 bp, A.fumigatus
agacagattcctcatgcaacaattgcagccatgcatctcgctggtgccgacgagatctacgtgcttggaggagtccaagccattgcagccatggcgctgggcactgagaccatggacaaggtggatttcatcgcggggcctggcaatgcctttgtcgccgaggcgaagaggcagttatttggcgaaattgggatagatctctttgccgggccaacggagattcttattgtggctgatgaaactgccaatccctttacggtggcaacggacattctctcgcaggccgagcatgggcctgattcgcccgcggtgatcatcaccacgtctgaggccgttggtcgagaatcgatgcggattattaccgagctcttgaagaacctgtccaccgctgaactagcgggaacctcgtgggaacggttcggcgaggtgatcgtcgtggactcgattgacgaagcttggaaactggccgatgaatatgccagcgagcatgtccagatcctcaccaaagagccgcgacaagccctcaggaacatgaatgcctacggtgctctattccttggagaaaagacttgtgtctcctacggcgataaggtatgcccctga

SEQ ID NO: 19036 - DNA, 240 bp, A.fumigatus
ccgaccctatcgtgtcgggaagagaagagctgggcgctcccaagttatatacttctgtggacatctatcgccgggaaaaatcatatcgaattcgtacaggatggcaaggcgctctctggggccatttcctactggaagacctggtcgaagttgacccagcgtcagcccccggaggattcagtggagaagctgatgaagggatcctggtacacaaatatctacctcagaccggtcgattga

SEQ ID NO: 19037 - DNA, 183 bp, A.fumigatus
cttagagcaaatcaaccttctcgcactcttctattctcgtttccccttaataattcctataatattcggtcaggaaagaggacatcctccatcgcctacttttcctatctcatgcattaccgcatattactggctggctgtatatcctccctggaactactccgcattttccaccagtgctaa

SEQ ID NO: 19038 - DNA, 261 bp, A.fumigatus
gttttctttacctcgatggcggttatctacctgctaacacccgcagcttgctttggattcttactttccttctataccaatccgtggatcgaccagtccggctatattgctgcctatggcgctatggcgggtatttcaggcggctgcctacttttcttcatcccactgtttttctggggcaagtctatccgacatgcctccatgaagtggtcgttggttcagtttgtattctggaaggatgatcgtgaggtgggagagtag

SEQ ID NO: 19039 - DNA, 522 bp, A.fumigatus
cctacatcatcaattcctcatgctgattctcgaatcatcctcttggcaggcttccctggtgtgatcacacaattccaccttgagctcatcccgtatcctaagcgcgggtttcggtcgtctgggtacatctaccccatcagcaaatattatgaagccttcagctggatagtcgccatcactccggatttcgatcgtgacaccgaaatcgctgtcgtgagtatgtatcccgagggcagcaatgaaatctgcctcttcgtgctccttgtgactctaaagcacactccggaagaggcagaagccgccctcactcctgcccagcagtcacgccctgctggcaccatcgaggaatggttttgccgagaggacagcctagagaaccaatatgtgaaccaaggcaaggcaaatccagaaggccaccgttactgtgccgagaatgcatacgtgcacaacgacgcggacgtccccaaagtcctcgaagaagccttcaccaccttgccccatcgcaaggcttttcccccgtgg

SEQ ID NO: 19040 - DNA, 1230 bp, A.fumigatus
tatcgagttgaaaagctttatgataatgcccacgccttctcattgattccagcattctgtttcagtgattttaatctggagttcaccttagatgtctatccatccttccattgtttacattgcttatcgcggtatcctattgtacaccttgcagtcagcatgggaaggaccatgcttgtctgcctcgtaggcagtatcacagccttttccgttctcactgatcttgctatctccattactttctacaggcttcgagagagcgcatcaaacggacccaaccctaccaaatgcagcagcctattatctctctcagccgtcaatttcctacttgttagtcttctgtcctacctattatactctgagagcgaacctcaagcgacggaatggatcctgcgcaaattcaaagctcgtgctctcttctgtctcatcatctttcttaatatcggcatcattaccggtgagaggctgcaacacctctacgtcagcaaaccaaagagttcgtccagcagcgtgtggctctctctgaacatagcccatgccgtcgtatggacgatctcagcatactgtcaaggattcctctgtgccctctcgttcgtcctccccgatatcctcaacaatgaatccggtcgagcgtccaatccacccattaatatcggccgcacggctgagtcggtcttctcgacgacgaacctcatctcaccacaaagtccacaatggagaaatcccctcctatcacccgtcccctcattcctggaccccttaccatcccctcagagcgagatgagtgtcagaacaagcatcctccgctcaccactcccaaagtactgcacctgcaaagaccccgagccgctattcgtgcagccccgccgcagagaaaagtccctccaatcgactccatccatcgacaccgtcattcggtgtcctgaatccaacggggaaatggcggaaggcatctcgccgactcccactccgaccactcgcaaacccctcatcgaggataatgagaagaacatccgcccgctcttcaggcctagcacgccacatctttctccaatgccaaatatgtccactgcaattattgctccgttggaagggcccaaccaggtgtccgtgaccgtgccatgccagagggaaaacgtcgatccgcagctatcgtctgaaacggcgcagcctgtcttaccattctatgttctcaatgcgacggcaaggaatagccttgcgcaatattaa

SEQ ID NO: 19041 - DNA, 729 bp, A.fumigatus
cccatccgagctcgtctactttcgcaaacatcccatttttccgcatcagccgagtcgcatcccaacatgaaagctctcgtccccataacgtccgccgtcctcggcaccaccgccgtgggcgtctacctcttccgccagaacctcaaatcccgcatctcaataaacgcgcaacacggccatcttccgcgctcaatatcctccaatatcaccaccgcccccgatgaggtcttcaccgagcaaacagtagccgtcttcgactcggcctctatatcggtgccacgcggaaaactccccgctctgccgactgaggaactgctcacccgcttgatgcggcggaatatgagtagcttcacgagattgccgcaggcgtatatcctgcgagcgatgagcacagaggccgaaaagcccagtttcaaggctgcgaacatcgagcgcctcgatttcaaggagggggatctcgtctgcggcacttaccgggtgattctgcggacgccggggaaagtggagtttcaactgaagccgatgggggctgttcggggtcgtttggtgactacgatcacggagaaggacgaccggatggtcatcatgaatgagacgttgatgtggaagccgaagggggagaagggggtgatgcccttggagactgcggtgggcaagtggatgcatgagttgacggcgtggtggatgctagattctggggtcaagtatttgatgaatttgaagaattga

SEQ ID NO: 19042 - DNA, 321 bp, A.fumigatus
cagcatctagcgctggaacgaacattcttggcgtatatccgtacctcgatcgccgttgccatgcagggtgtgttcatcgctcagctgttccgtctgcagagcaagaccgctgaccatgctcgcctgggttactatagacttgggatacctcttgcggtcacctgtcatgtggttgccatcctagtcgcttttatgggagcgcatcggttctggagacagcagagcgctgtcgcacatgggaaggtctatgcagggggctgggagctaaactggataggggcctttattggtctggtaggtatgcttccttctttcaagtga

SEQ ID NO: 19043 - DNA, 471 bp, A.fumigatus
cggattcacggcaggtcgaaatcatttccgacttttacctccagggaggttgaatcatctactctgcatgtattagatacatgcctcctaattctaatatacatactcaacactaatctacttcttccgcgaatcatcaacatctatgaaacatgcaagcaaaaatggaacagaagcatatcgctaggtgcaagaagagaagacaaacagacggcgaaaagaggggattcatccatagaattagtctaccgtcaattcttcaaattcatcaaatacttgaccccagaatctagcatccaccacgccgtcaactcatgcatccacttgcccaccgcagtctccaagggcatcacccccttctcccccttcggcttccacatcaacgtctcattcatgatgaccatccggtcgtccttctccgtgatcgtagtcaccaaacgaccccgaacagcccccatcggcttcagttga

SEQ ID NO: 19044 - DNA, 276 bp, A.fumigatus
cctacccatacatgtgatatggccgccccctgtagagcacacgccgcgaagttactccatctgccagctgaggtcatccagcttattgtggatcacctgtggcccgaagaaacgacatcgcttctcattgcagtcccaaagctcgcctatcttgtgactgttgagcaactgtggtatcaggatggatggggctataccatattgcactgcgccgttgataagaacgatgaagccattgcccatctgtcttcaccacggattgccagagcgcgataa

SEQ ID NO: 19045 - DNA, 720 bp, A.fumigatus
tcgcactgcgctggagaatatcttccaaaagtacgtttgtatcacgtcgtgttccaattcctttggggcagtattgattgtttttgcagcatcattgaacaagtctcacgatactcgagcgtacctgtcgcagtttctgcagtccaacagcagcattatcaagaacaccatgtcaagatatcaaaagtgggcgcagattggcatcacagcgggactctgcctccgacactcacgacagcgcacataaccagtattcagcagccaacttcccaaaacgtgccatctgagtatatcctgaagaaccagtcactggaatgtttagtggagattctacagtcactggacaactgggcctctcaacgaattgatggcccagccgctggggttacaaatctgctgtcccagaaatcactcgataattccagagagtcgatggacaccaatgctgcgacctttttatcctctccaagagtcgagggtaccgatggcagcactggtcggtcgacacctgtggccgaagacgatccaagccagatcgagaaagtcaagcagaggaaaactgcgctgatgaacgcaattcagcagttcaatttcaaggctaagcggggtatcaagctctttatccaagagggctttatacgttcagactcgcccgaggacattgcaagtttcttgtttcgcaatgatcgactggataaggccatgataggggaatatctc

SEQ ID NO: 19046 - DNA, 432 bp, A.fumigatus
ggggggttgatgacagcggtgaaccgctcaacagcagggttcatgcccatgttgctgatggtaaaagtgccgccctggtactcctcaggcttgagcttgttctcccgagcgcgcttgccgaggtccttgatctggttggagatgctggaaaggccaagactatgtacgttcttgacaacgggagtgataagaccattaggagtggcaacagcgacactaatatcaacggtgttgtgctggcggatgacaacctggccgttctcctcgcgccagctcgagttgaccgcagggaccttcataagagcggcagcacaagccttgacaaggaagtcgttgacggagagcttgtatttgccctcagcagaagcgttgagagcctggcgtagcttcagaagcttcgtaacggacagagtggtcgaaacgaagaagtga

SEQ ID NO: 19047 - DNA, 2217 bp, A.fumigatus
atggcggatgttgagaacggctcttcgcaggagcctaatcagacattattggtgctgccgcagggagacaacaaagagaatactgtcgatacctcaacgcctgttgagactgaagatgctgtcgaggaagactcgaagcctcctcttcctctcgagtcacagaggcagaaaattgatttagatgaagttacagactccaattcaccacagatcaaagtagactcctccgaaataacagagaccgcggacagacctccgagccctccgaacgatgccgctgatgctgaacgccccgaggaacacggctcccctcagcgggacttgaaagcaaacgatgtcactaattcgggaaatgatcaggcagaggctcctccaggagactctggcgacaagcaggatgacggcgctgtgccccagtttgagcttacaccaggtacccgactgcgctccgactcgagatcaacaactgctacgtatgctactcagcgatccgtgcctgtcagctctgcagtgttcatagtcaacgctctcgagacaattggggcgtctaaggaagcaaagaagagtaaagaactggatgatgccgtgaagagcgcgttggcgaacgttaagcaatcagaccgtctgccgattgatccggaacttatatttcgccctcttcagcttgcgacaaaaagcttgagcatccctttacaagtcacagcgctcgactgtatcgggaaactcataacttactcttactttgcctttccatcatctcaggatcgcaagagctcggaaattgaggccacgccagaacaaactcctctcatcgaacgtgcaatcgatgccatctgtgactgcttcgagaacgaagccaccccctttgagatacagcaacagatcatcaaatcacttcttgcggcagtcctaaatgataagattgtggtacacggagctggtctcctaaaggctgtccgccaaatatacaacatcttcatctactcgaagtctaatcagaatcaacagattgcccaagggtcactgactcagatggtcagcacagtgttcgacagggtccgtgtgagactggagctgaaagaactacgtttgcgtgaaggagaaaaaggacaggagaacacacctgatgctgcgacagccgaaacagttgaagtgcccctgtcaaccgatcaggatcagacatctgatgcagcctctgttgtagcacctgatcaacctgtcgcgaaggagcctggagaaaagcttactctgcaaagtttcgagtcaggcaaggatgtcacgtccgtcgcagataacgcgccgacaatggttacccgcgccaagctttctcaaaaaagaacgcagtcattgtctagcacatcaggggaagagaaggaggacggcgacgggactaccgacgatgatgaggacgagatttacatcaaggacgctttcctggtatttcgagctctatgcaagttgagccataaaatcctcagccatgaacagcaacaagatctcaaatctcagaatatgagatccaagttgttatccttgcacctccttcattacctcatcaacaaccacgtctcggtctttacctccccgctcctaaccatcaggaacaactccaacagctccgatgctatgacgcttctgcaagctgttcggccccacttgtgcctcagcctgagccgaaacgggtcgagctcagtccccagggtcttcgaggtctgctgcgaaatcttttggctcatgttgaagcatatgagagtgatgatgaaggtttgtctatgtgcttatcttcttagtctgacgggttctaactcctcacagaaagaacttgaggttttcttgaaagaaatatacctggcaattcttgagaaacggaactcacctgcttttcagaagcagtacttcatggagcttgtggaaagactagccgatgatcctcgtgcattggtagagatttatctcaattatgactgtgatcgcactgcgctggagaatatcttccaaaagtacgtttgtatcacgtcgtgttccaattcctttggggcagtattgattgtttttgcagcatcattgaacaagtctcacgatactcgagcgtacctgtcgcagtttctgcagtccaacagcagcattatcaagaacaccatgtcaagatatcaaaagtgggcgcagattggcatcacagcgggactctgcctccgacactcacgacagcgcacataa

SEQ ID NO: 19048 - DNA, 516 bp, A.fumigatus
ttgtatcatagctacagcacttggcaccatggttgcctcagctgtccgaatgcgcattcccagcgccatgttgtcaaaaggcggcctctacgtgaggcggcctcacgttattcacagattcaaggatgctgtccagtatggttcaccttggacatttcgtggtcaaaccgcattgacaatgatactgatcaaatctatagaccccaattgcctgcgttatccgccctctcccgtttctatgcctccaagtgtatgtcctctcgttttttcctcctctccgtcacattcacgcattgcagacttgatcctaaccatgcgcctctacagcctttccgccccacaccatcatcagcatgcctgccctctcgcccacgatgtccgcaggaaacattggagcttggcagaagaaggccggtgattccctgtcgccgggtgatgttctcgtggaaatcgagaccgataaggcacagatggactttgaatttcaagaggaaggtgtcttggccaaggttctga

SEQ ID NO: 19049 - DNA, 1131 bp, A.fumigatus
gctgaaaaaaattttcgtggtccgctgagtcccatcgctaatgcgcaaaaacagcctatcgccgtccttgtggaggaaggaacagatgtcgccccctttgagagctttactctggaagacgctggtggtgataagggaactgctccccccaaggagagcaaggaggagcccaaggctgaggctgcaccagcgccctcgacgcccgagcctgcacccgccgctcaggagcctgagacatctactgagaagctccagcctagccttgaccgtgagcccaacatcagccctgctgccaaggcattggccctggagaaaggtgttccgatcaaggctctcaagggtactgggcgtggtggccagatcaccaaggaagatgtggagaagtacaagcctagcatttccgccgccgctgccgcccctacgtatgaagacatccctctcacatcaatgcgcaagaccattgctacccgtctgcagcagtcgatgagagagaaccctcacttcttcgtttcgaccactctgtccgttacgaagcttctgaagctacgccaggctctcaacgcttctgctgagggcaaatacaagctctccgtcaacgacttccttgtcaaggcttgtgctgccgctcttatgaaggtccctgcggtcaactcgagctggcgcgaggagaacggccaggttgtcatccgccagcacaacaccgttgatattagtgtcgctgttgccactcctaatggtcttatcactcccgttgtcaagaacgtacatagtcttggcctttccagcatctccaaccagatcaaggacctcggcaagcgcgctcgggagaacaagctcaagcctgaggagtaccagggcggcacttttaccatcagcaacatgggcatgaaccctgctgttgagcggttcaccgctgtcatcaacccccctcaggctgatattttggccgtcggcaccacccgcaaggttgctgttcccgttgagaccgaggagggtacttctgttgagtgggatgaccagattatcgtgactggcagcttcgaccacaaggttgttgatggtgctgttggtgctgaatggatcaaggaactgaagaagattgttgagaacccccttgagcttcttctttga

SEQ ID NO: 19050 - DNA, 255 bp, A.fumigatus
  unsure (219): Identity of nucleotide sequences at the above locations are unknown.
ccatgcgcctctacagcctttccgccccacaccatcatcagcatgcctgccctctcgcccacgatgtccgcaggaaacattggagcttggcagaagaaggccggtgattccctgtcgccgggtgatgttctcgtggaaatcgagaccgataaggcacagatggactttgaatttcaagaggaaggtgtcttggccaaggttctgaaggagactggtganaaggatgtggctgtcggcactgtatgtataggctga

SEQ ID NO: 19051 - DNA, 720 bp, A.fumigatus
ttggtcgatgcttatctaggcttaaagatatgggggaaaatgtgggggacgtgttcccgatatcggtacatctccggatcaattgagacattgagagataagaaggatggcccagtatatagacgtgaacgaagcgacagcccataccaacatggcagcatccgcaaacacaccatggcttcccttgacaccaaataccctgtggagaccaccgagccggccctcgccaaagatgactcccctgccggcgcagacatcaatcctcgcgcagagcgtgccctagtttggaagttcgatttgcgtgttcttcccgtattggccgtcatgtaccttttcaatagtctcgacaagtccaacgtggggaatgccaagactgccggactggagaagacgctcaacctcaaaggcaacgagtacaacttgatcctcagcatctttttcattccgtatgtcctgacggcgccgtttctcggtatcctgggcaagaagtacggccctaaccgcgtgctgccgtgcatgatgtttgcctttgggctgtgtaccatcctcgtcgtcgcggtgtttaatttcagtggtttgctggcgattcgttggttcctgggaatggcggagagtgcattctttccgctggttatctactatctcaccacgtatgtccgtctggccagcctccaggcaagtaaactgaccgaagcagattctaccgccggggcgaactag

SEQ ID NO: 19052 - DNA, 516 bp, A.fumigatus
catcctggcgctaccttttcctcatcgaagggggaggcaccatcctcgtggcactcttcacactatggtatctccctcgctcggccgcgcacgcatccttcctcacccccgatgaaaaacaactcgcatacctccgcctccaacgcgacagctccgccatcgtcaacgagaaactcaacctccgcgacgcattcaagatcttccgccacggcacctcatggctcatcctcgctatccagatctgcctcggtgtgcctctgcaatcggtccagctcttcctcccctccatcatcaaacgcctcggctacgacaccgtcaagacgaacctgtacaccgtcgcccccaatgtctccggcgccgctatgctcctcatccttgccttctgcagcgactggacccgctggcggttccccttcgtggcgctggggttcttgttcacgttcatcgggttcgtcatctacgccgcaattgacgtcgaggcggatatcaatgtcgcatattttgcttccttcatga

SEQ ID NO: 19053 - DNA, 258 bp, A.fumigatus
gttgtgcgcaggggcacctccgcgccatcggtcctcctggacgtctggtacaacaacaacatcgcaaacgagggccgccgcgttgtgctaaccagcattgcggtccccgtcgcgaacctcatgggcgtcgtcagctcgaacatcttccggagtcaggacgccccgcggtatatgcctgcgctgatcaccacggcgtcgttcggggggcacggggattctgttgaccttgttgttgggtgggtggatgatggtggataa

SEQ ID NO: 19054 - DNA, 552 bp, A.fumigatus
ctaatcttcatcagctcgacggcaattgaggctgtcaaagatgctatcgccacgcgcacctccagccaggtgatatactactactgctcattccacttgactacctcgcaggagctggtctacctgctgggagcattgctggtgcaactatcagaaagctacccagaaatcctcgacgaattgcaagagagcttcaagagacgtgctctccctcagccagatgaactggttagcctgcttctgaaattcacgaaaccactgtcggagctgttcatcgtcgtggatgcgatcaacgagagccgtaaaagtgcacagattctggacgcactgctcacccttctggaatcatcacacaacattcggattatggttacgagcacgaccttaccaccagtgtcgaatcccaccattaatatcctcagggtgcaaatgaaaccttcaactaatagaactgacattgaggcaattctcgatacccagctaacgtcagtcccagctcttcaacggctaccggaacacatcaagtgtcgcattaagacttgtcttgcttga

SEQ ID NO: 19055 - DNA, 717 bp, A.fumigatus
cgcattcgtcagtcaaagcgttcctcacatcggacgcaatcaaacacgggccagcagcgtactacagcttggacgagaccgaggggttcacggcgcatctggcaaaagtgcctgacgtacctgatgtttgacgacttcaaacagccttgctcggacttgcgctctcttacaaagcgtcggaaaacgtacccgctgctcaagtacgccgccgagaactgggcgagccactgcagtccgtcctggccacctggctatcctctcgttgatgccgaaatcgacgggattttatctttcttcgatacccggcatctccctggcgggggaaactatacatcctggacccagatgctgctgtccgaggcgcccgccgaacaagcccgtcgcacggagccactatactacgctgcctcgtacggcatcataccccttgttgaccgtctcatccagtccggagcgaacgtcaacgcagccggcgggcgtaacgacgcaacgcccctcatcgtcgcctgtttcaggggacaggaagctaccgtgcagcgattgttagaagcaggggcagaccctatcatccaggatgcagcggagatgtgcagcctggaatgggcagtgcggaggcaacatcgtggtactgttgagatcctcctatcgcacatgcgtaaatccatgggaatcggttcatcggatctctgttggcagtgtcgggcttgcaagtattag

SEQ ID NO: 19056 - DNA, 939 bp, A.fumigatus
actgaccgaagcagattctaccgccggggcgaactagcccgccgtctcgccatcttctacgcagcgcagagcatcgcctccgccttctccggcctgctcgcattcggcgtcttccggatccaatccggccccctagcatcctggcgctaccttttcctcatcgaagggggaggcaccatcctcgtggcactcttcacactatggtatctccctcgctcggccgcgcacgcatccttcctcacccccgatgaaaaacaactcgcatacctccgcctccaacgcgacagctccgccatcgtcaacgagaaactcaacctccgcgacgcattcaagatcttccgccacggcacctcatggctcatcctcgctatccagatctgcctcggtgtgcctctgcaatcggtccagctcttcctcccctccatcatcaaacgcctcggctacgacaccgtcaagacgaacctgtacaccgtcgcccccaatgtctccggcgccgctatgctcctcatccttgccttctgcagcgactggacccgctggcggttccccttcgtggcgctggggttcttgttcacgttcatcgggttcgtcatctacgccgcaattgacgtcgaggcggatatcaatgtcgcatattttgcttccttcatgatgacctggtatgtcctcctctctctctctctctcaaacccacatgtcataaagctagcgctaagttgtgcgcaggggcacctccgcgccatcggtcctcctggacgtctggtacaacaacaacatcgcaaacgagggccgccgcgttgtgctaaccagcattgcggtccccgtcgcgaacctcatgggcgtcgtcagctcgaacatcttccggagtcaggacgccccgcggtatatgcctgcgctgatcaccacggcgtcgttcggggggcacggggattctgttga

SEQ ID NO: 19057 - DNA, 822 bp, A.fumigatus
gttctttcatggtggtctaccgttctggctaacaaagtagtgtacaacaatcaaccgcctccggatcctcaagaagtttcgatgatgctggttcaattccggcaagagcttgatgactggcgcacggccgcgcctgtgtatccgcctgcactgttatactcgaccagctactacgattatctctattacaccactctacttctgatgtaccgccccagtccgcggaatccgacccctgatgctactagcattgttagctgtggcgactccagcattcaggtcattcggtcgtactgggacagctattcggtgggcaagatcaaatggatctggctgacgttgaaccagacgtattttgctggaattaccatcctgtggtgtttagaacaaaattcgcgggcccttcgggatggacggccgcccttatggcagccggatgagcagatgatgcgccgggcaatccaggcggtgattgtgctgctggaggagtttggcaagcgacggccgggagtggaaagactcggggagacctttcggtgtcaaagctcgatgatcttcagccaaatggcatatcagcagcaacaacggcagcaacaccctcagcaggaaacaccatatcccccacaacagccacctcttccccctacaccaccgtcttcgctgccagccatcccaccgccgccggtccccctggcgccgatgctggatgatgtgttgctggttgatgggataccccggcagattgacccgcagctagcagagcaattgttttactcctatgattggtttcaggaggagatggcgacatattataccctgtag

SEQ ID NO: 19058 - DNA, 1515 bp, A.fumigatus
ttgatcactaaacttccaccatcttccttggcgtctgatcgctatggcctctcgttcgagcatgctttccgcctttcacgaccgacaccagtgaccgcaaccaccatggccgccggctcgagcgccagggacaaggaatttcgcgatcagttaggcaaattccgtctcgagtccgtcgtcactccgcttcctcctcttcagccatccacttcttcgtcgcagtctaagtcgccgcctcgatccgtgcctcctctttttccaccgccaaactccaccaccagtgtcgcttccccgctgcagccttctcacggcacccgccccaaacgcgtttccaccgcgtgtgatttctgtcgcaaacggaagaaaaaatgcgattttcgatacccaaattgttctgcgtgtactcgcgccggggttcgatgtactgttcctccaccaggtccgcagatcgccagcgcctctgtccctcgcgaccagctcgagaatcttcagaaacgagtagaatggttggaagatgtcctccggcgaaaaacaggactatcggtggctggcataccgacagggagcaatgtggatggggaagttgatccggattggtggtaccaggtgccggccataatggccagatacagtaatcgacactccatcggtgcgggcagtgttgcgacgtcaagtcctgctggtagcggacgagggtcttcaaccggtgcgccagcgtcagacacgtcggggtttggaaccgagttgcccaatgtaggggagatttttcgcgaccagcttgagcaccgtcggccgtcgatcgcacgcccgacagtgtctgccccgcgcgtcgtccgtttaccgtcgttagaagaggcagagcgaatagcaggcaactactttgacagtctgggttaccagtacccttttttgtcgcgaccggactttacgacgctgctgcgacacatctatgcgggcggagtaccgactccggaagatcactattcgtaccatatcacgatatctattggcctattgatcggatcggcggacgaggcgcagatcgacgagttctatcgcgctagtcagcagacgctttcgctggccttgcagaacgaggacctggccgccgtacgggccttgctgagtctggcgctatacacaatgtttgcgaccaccggccctagcgtgtggcatgttctggggacggccatgcgactggccaccagtcttggtctccacaagatgcggtcctcggctagtctggtggaggaggaaatggccaagcgggcattctggagtttgtataatctcgaccggttgattgcgtcaacactggggcggccgttggggattgctgatgaggacatcagcgtgggtttgccccgggagtttaacgatgactggaccgaagtgccgggaggcagtaccatgaccattccggtccaggtggttaagctgcgccgcctgttctcccggatctatcgttactgtgagttctttcatggtggtctaccgttctggctaacaaagtag

SEQ ID NO: 19059 - DNA, 228 bp, A.fumigatus
aactgtacggtttctaactgcaaccaatgttctgtgtgggctggtgagaatggactcctcagtttacttgattacaaaacctaccgtttcttaactgctgctttcattacatatctatgtcgccggcttcttcatggcttggccgtcctgtccctacacagtatgtccgttactaatttgccagccacatatctggtgacagagttatgggcgttggctacttgttaa

SEQ ID NO: 19060 - DNA, 231 bp, A.fumigatus
gagtcgtcgtccggcaggccaggtctgaccttatcgccttctcagacacaatcaatcaacatgatgttgctggatctaaagcaggttgcggccgtcctcctggcttcggcctccctggcccaggccgccgttcaaggcttcgacatctcccactaccagtccagcgtcaactttgcggcggcgtataactccggtgctcgcttcgtcatgatcaaggtgtgtttcttatag

SEQ ID NO: 19061 - DNA, 1470 bp, A.fumigatus
gggttcgtgggtcaaatcaaatttattggagcagaagtggcaactttgaccgcgaggccaagacagacatcgttcaaggatttggtgaataagttcaatcagactgttgaccaagtgctcccacttccaacgacatcttcgtctgcctcaaagtcaccctcaagagctccgagcccgatcggtctcgtcgacagcacagtgagacccaggacaccgtcccaattgcgagaattgcgtgacctcccaaaagcaaggagagagccgccatcccggtggaagtcgatcgatcgttcccaggaagatttcctgtcgagatcatctcaggcaggcgtggtcaacaacagtgccttggaaactccggaggcatcgttacctcggcgtccgttcggtggattgctcacagttgatacaggagttccgagatccggattgggaattccggcacatttgcgacgtcgaggttctgagggaagcattcccagcccgaatcctgccctccttgacaatccagatcgttcagctgggctaacccctctgacacctaccgcatggtatctgggccggacaccatttcttgaagccgtgagcactggcgagggcggcagtagtcatcgaagaactagaagtgatctgtctggagttttgcctgttggtgttgtggcacagtcgcctgagtcccacatggcggtgctgagccccttgcatccagggctgggaggctctctggagagctcacattccaagtcccgcatacctataccgtccacccgtctccatactgcttccgttgcggaggactgttcccgactgaaaatcgacccactttctaacaaccgcttcgacgtacaagttccgctgccaccgaaaggcattagccgactccccaaaccgtcccccaaatccccacctgctgtcgcagattatgaccgtacacccatcgggatgacatcgcctcggaggcgagaaatgacttatggccgaggttcccgtcgaggaacggagaggaacacccttcttgaagcatacatagcctctcctcccaagaaatcacctccgctgcgcagttcgagacctcggcagcctgtttcgcaaacaaattccaccacgtcacgatctcgagttgtggaaacagtgtccaatcttcagagacagctaaaccgcgatcaggatttgcggtcctcgcggacgcgcggacgtcgacttccggagctgggtaacgtcgactttgcgactcgacggcagagaatccagcaggcattcaatcgtacagtgcaagagaatgaaagaaaagaggaagaagcagcacagcttcaacttcgtgccaaagcccaagagagccagcgggctcatgatgagccgaccgggtcagagcagaacccccaaggagacaccggaatcgaccgttctctaccagccgactgtaactctgatgtgaatgagatctcaaccggggccgatcatgaggaataa

SEQ ID NO: 19062 - DNA, 2685 bp, A.fumigatus
cgcttgacattggatgacggggggagttcacaggaaccaccccggctgcagattgacaccaatgtcgctgttcacgacacagcagcaaaagaccccaatgcccatccaatgacaatggattccccaacgttggggcttccgaatataagtactggagagcatgcgattcgcatttcttccccgggagctgccgacggccatactgcttgcgccgaaacaccagtgtcggtcgaaactaatatcactgcccttgacccggagccgcaagctagtttaagtcgacagagcctccatgcctctcaccgaacattactgagccaaataatgcagatccgggaatcgagtcctgacacctcgtcttgtgatgaagcggattacagtttttctgatactgaggatagggtatcagttccagtattgctgagtgatgccccatgctctgaagaatcggtcgcgtccagcgattgtcaaatacactctgatgctttcgtgcattcggaccaagttggtcatgcgattttgaacaggtggagtataggttcctggtcatcttcccttcacaaccaacagtctacggacgaccattgtgatggcagcgacgatgacctctcccagctacaagaagttgcacaggacggcgaagtcactacccagtcctgttccgcttcgtcaagtaatacaccctctgtcgctggtcatcaacccacaacatacgttccagccaatagggaaccagtcactgaacataaaccagatctcgtttctgaaagaagcgcttatattcatcctagcgctcccaaccttgcgagacttggtggatgggattcgaaaagggtatctaggctatatattgaggagctggctcgtggcagaggccatagtcttccgatgcctgcaatccgcgcgtcgcctgaacctcggcttgagaggcccacggatggaagaacggatagcttgactgatgacccggttgtgatatccaaggccgatggtatccctttgtcggaacaagttgggcatacggcaagcctaatctttcgagatgattgggaacatgcttctccatctattgcagactggatgcaagcggccgctactgatgaaacgggcccccaacagcgagatagcaatggtatttctgcagcagatagcatatcaaccacacatttggacacatcagctacagatcggaccgggcacgaacaggaccaaaacaccatgggcctcgctatcagagtccaaccaccgcaagagctcgaatcaggggagattcaacagatttcgctcaccagctctgatcctgtcacccattcggtcaccaagggagcgattaaccagtcgcaacaaaagccagaggctgcactgagtatccagtcaatacaaacaccctctcgtttcgcgccgtcgcaggctttcgcacccttgggccaagttgaaagtgctggaagcagcgaggactcctctcttcggaggcttcaacctacgccctcctcccacactcttgactcatcagcaacatccctggttccttcgactgccgaccagatccgagtcgatattcgcaaatgctccccatccccggagcaaaaacgcctaaagaaacggaagcatgtcatcaaagaactggttgatactgagtacagttttggaagggacatgaaggtcgttgacgatatctacaaagggacttcgagttcgtgcttggatctgtcacccgaagatgtcaaaatcctattcggtaactcagatcagattgtgcagttttcaatgagcttccaggatgcactcaaagaggctgcaagaagcgtttatgttatgccgaaatctcagcgatggagcagtacacgcagcgctcgtaacaaccataccaacgcatccaggacagactcagaggctgcgaatggcgcagatgaagtgtctgatgcagagaaagacagattaacctttattggccaggttttcctggctcatattgctcccatggaaaaagtgtacgctgattatctgaagaaccacgatgccgccaacaagaaacttcaagtactgcaacgaaaccccaaagtagccatttggctgaaagaatgtcgggaatgggcttcagatctcaccactgcttgggacctagactcgctacttgagaagccggtgcaacgaatattgaagtaccccttactcctaagcgagattgtggattccaccccaagcgaccacccggaccgtccatatctgataaatgctctagaagaggttactaacatctcggtccgtatcaatgaaatgaagaaacgagcagagttggtcggtcaggtagttggccgcaagaggaaagaatcagatgtcagaactgggctgtcaaaggcgtttggtcgtcgcactgagaaattgaggcaacaagtcggcctttccgatattttcgaagacaagcagtacgatgccctatcgcagcgatttggggatagcttcttccagctacaagttgtgatgcgtgatgcggagatgtacacacgggaggtccagagctcgttagatcgattcagcgagtttgtcaccgcgattgaaggattcgttgatgtggctcagtcgggctacttggatgtggagagcaggtggcgtgagctgaagatggcagtgcgtgaaataatggccacagctctgcctgaacatgtaagtggggcagacccttga

SEQ ID NO: 19063 - DNA, 636 bp, A.fumigatus
cttgctcgcagattatttctttctgggaggagtaagtcaggcaagtgttgtgatggctgtcggagaactgatgaatccagatatctggagagggaatttctcgttcagtataagacgtcaaatattgtgcttcttcgtcccagcatgtctttcatgctattacagacgccgaatcctctctcattgcgtgaggccttacccgacttctctcgtacaacgcatgtctttcttcccatcaacgattgccggaacgtgactgaagctgagggtggctcgcactggtcccttctgctgatatccattgttgatggcgtggcattccactatgattctctgcctccggggaactactgggaggcaagagccgtgacgcagaaatttggcacgcttctcaaccggccaatacggtttattcatctggaggattcccctgtacaggaaaatggcagcgactgcggcgtctttgtatgcctgagtatgcggcaccttcttctgaaacggctgttaacggccaatgcaaacgagaaagtcagcatgagtttgggtgggaggaaggttgatgctcgtgctggtaggaaagagattgccaagattatcgaaggttttcgaaaagaaggcgagaggcgtcggtcgtaa

SEQ ID NO: 19064 - DNA, 1209 bp, A.fumigatus
gcgcttaggctaatgcaagatgctcagcttgccgttgtccggaaaagtgttattgacccgatggtaacgctgctcaagctttacgacgggccccagagagtgatgaagaaacgagacaagcgtctcatggaccatgcgcgattcaaatccatcaaggaccgtggtgacaagcccgacaagaaaacgacggagcaaagcgaacaattcgtagctctcaatgagaccctcaaggacgaattgccaaagctctattctctgactgctaaattgatggaggcatgcctgaaaaactttgtgcacatacagactacgtggttcaatatactccaaagaagactagcggatctcattgatccatttcccgacgatatccagcagatcatcggtgactggtctgcaaatttcacactggcggaggcgcaggttttgtcacttggtatgtgcaacggatcgttgctcgctgatactatcaatcttgtcaacttcaacacgccttcgactggacctaccatcagttctcctcggcggccgtcaactgtgaacagcacgagtacccgtgtagggtctaacatgggcgaatcacctaaagtctcccacgacttcggtaatggcggcaacattttccagtctccaagcctcgacgctcagtccctgagatcgtacggccgccaccgagccgattcagctatctctggtcgtgctgcgccagaaagctctgaactcccgcggagtcagattctgcagcagatcacgaactcctcgtctgcgtccgcgggcccccagcccaagtcagagtcctttcccagcctgccgaggttgagtcttgactcgccattcctcgtcgacgttatagccacttcatcaaacaacgacgaggtctccgagaatccaccaacctctcctgggggtcgttattcgggctttttctcgtccgctatgcccatgtcggacaatccacaggacgacgcacctgtggaggacaccacgcccaagaagccgacagtgctcttccttgcggcaagtatctatgagttcaatatcgatcgggcgcggcgtgaagccggctatccttatctcacttacgtcgccggagagatttttgatgtcatcgctgaaaagggtgagctttggcttgccataaaccaggacgatccaacccaccaggtcggttggatgtggaacaaacactttgcgaaactctccagttag

SEQ ID NO: 19065 - DNA, 273 bp, A.fumigatus
aagacatgctgggacgaagaagcacaatatttgacgtcttatactgaacgagaaattccctctccagatatctggattcatcagttctccgacagccatcacaacacttgcctgacttactcctcccagaaagaaataatctgcgagcaagttagttaccgcatgcattctacggccactatgcaacccacattatccgtaagccagtcattcttgagagtctgcatgtcctctctcgtcactgcaatttatcaggtcatccagtcccgctga

SEQ ID NO: 19066 - DNA, 408 bp, A.fumigatus
tcgttcaccatggctaccacttcgaacatgttcatgtattccctgacgatccagcctccgactgcgatcacacaagctattctgggccagtttgcagggactaaggagcaacagatcgtgacagcgtcagggtcgaagctcacgattcatcgtcccgatccgactcagggcaagattacaccaatctattcccaggatgtcttcggtatcatccgtactctggcagcctttcggctggctggaagcagtaaaggtatgtttgacattctcccccctcgcccctatcgcaggaccaacttagtgattcgtcaagcttcccgggcagcacgatccttatctgccgagccgaccttattggaagcgggacgtgctccggtcggcgttgctgacactggatgctgtttgtga

SEQ ID NO: 19067 - DNA, 186 bp, A.fumigatus
atcgcgtgcggcggcgtgaaaacggtcaatcgagggcatggctatactggcaacgccgatagtgaccaaaattcagctcttatgaaggcattctggcatgacatttcaatcatccttgaacaatatacctctcgattcgtggctatactgacgagtacgaacggaaaacagcgaaagagtcgctga

SEQ ID NO: 19068 - DNA, 537 bp, A.fumigatus
cactggatgctgtttgtgaattgtgctgaaagaatattgcttctagattacataatcattggttcggactcgggacgtatcacgattattgaatatgttccctcccaaaatcggttcaaccgtatccatcttgagaccttcggcaagtccggtgttcgtcgtgtcgttcctggtcagtaccttgcggtcgatccaaaaggtagagcttgtttgattgcctccgtggaaaagaataagctcgtttacgttctgaatcggaactcgcaggccgagctcacgatttcgtctcctctggaggcccacaagccgcagactgtggtctttgcgatgactgctctggatgtcggctacgagaatcctatcttcgcggccctcgaggttgactattctgaggcggatcaggatccaaccggtcgagcgtacgaagagtccgaaaaactgcttgtatattatgaacttgatctcggtctaaatcatgttgtccgcaagtgggcccatcctgtcttcacgcccgagggctggacagatccgcgctat

SEQ ID NO: 19069 - DNA, 642 bp, A.fumigatus
tttctctctgtagcgcatcagctctatcccctcatactcattcccgcacatacattacgtatcatggccgacgataccgccacgaccgaagattcgcccatcaccttcacaatcaaatcctccaatgacgccaaatttaccctcactcttcctctttctactcaagtctcagagttgaaacagaagctttcatcttccgaatatgccgatactccagctgagcgtcagcgtttgatctactctgggagagtgctcaaggataatgagactctagccacttataagatcaaagatggccacactgtccatttggtaaagagtgccgctagcaatcagagacagggtggggctactcagagtacggctacatctgcagctaccggtacctcggctgctcctgcagctggtgctgtgcccaccaatctcgctgccggtactggaaacaacccgctcgcgggcctcacaggtgcaagatatgctggatttgcgcagctaccgggtgctggcatgttcggtccagatggcggggtaagtgtttgttattgtcggttgagaagttttgcttggtttttcgatcggcagctgactgatgcgctagatgggacctcctcccgacgccgaaagcatgctcaacatgcttga

SEQ ID NO: 19070 - DNA, 954 bp, A.fumigatus
atgggacctcctcccgacgccgaaagcatgctcaacatgcttgaaaacccccagtttcagtccaccatcaatgaagccctgcagaacccagccatgatcgacatgatgattcaacaaaatcccatgttgcgtgatatgggtcctggagtgcggcaaatgatgcagagccctgaatttcgccgcatgctcaccgatcccagttctatccgtcatatgttgcagatgcagagggcgtttggtgccggcggattgggcggaggtagtgcgtttccagcgcctggagtgaccaacacgacgcccgaggagaacagaaacaaccagaacagcaacaatgcgaatgcggctgcagcgggcgcgcctcctttcaaccctttcgctcctcctgcgctaggagccggcaatcctttcgctgttcttttcggtggagccccaccagctttcggcgccaacccgtcaagtacctcgacagctgcaggtggcgaccaatcccaaggcacgcaaggagcaactggcagcgccgctgctggcagcacaactaccggtgagggccagaaccagcagaattttcagaatccattcagtttcttgatgaaccccgccatgttcggagctactggttctcagggtggacaggccggcttcaatccttttaatccgcagcagaaccccttccttcgagatcccgcgctgctgtcgcagatgatgcaggccatgggagcccaaggaggtgcagccggtgccggtgctaatcctttggcggctctgcttggaggcgccggccttggaagccctccgccgcaggacaatcggccgcctgaggaaagatacgcggaccagctgcgacaactcaacgatatgggcttctttgagtttgagagaaatgtggaagctctgcgacgctcaggtggcagtgttcagggtgccatagagtatctcctgagtcatccttcgtaa

SEQ ID NO: 19071 - DNA, 1137 bp, A.fumigatus
gcttatgttccttcttacttcgtaggttactctgtcacacgctataacgacgacgaacccattcccctcctcgtcaacaagatcttttcggaccacacgcagctacagtatgcctactttgatcttccgttcgtgtgtccgccaagtgggaagagtcatggtggctcgccgttcggctcaggaaagagtgtctcactcaacctgggagagatcctccgcggcgatcgcatcatgacctcggattttgagcttcatatgggcaggaatgtggaatgccagaaactctgtacagtggaggtcggacggaaagacgtaaaatggggccggcagctcatcagggaaggatatgtggcggaatggatcgcggacaatttgcctggagcaacgagtttcgtcaccgtcgaccgtagccgcaaatactatgccaccggattcaagattggagacctggacttctcgcctggcaccggcaaaccacgttattttatcaacaatcatttcattattgtcattcgttggcggagtgctccagaaggaggcaaggtggttgtcggttttgagatctatccgaagagcatcaaggccagcgattacgaggaagacggatgtccgaaacaagtgcatggcaatcacgagggcctggaactgtacattcctcctaatctctcgaggctgaaggagatgtatcctgaatcgtcgtatcttcccaaggaggatgatgagatagacgatggtgccaagctgaagatcccatacagttactcggtctatttcaaagaagagcctggtatcgagtggtcgaaccgctgggacctctacttcagcaatcaaggcgaaagttcgatgacacattggctggcggttctgaactctttgattatatcgggtgccctcggtgtggcggtctacgtgatctgggatcggacggtgcaaggagatatcaagggtcgtggggatggcgctatggaggacggtaagatcaaattacgctccaagtcaaccgagaagaaaggagaaggcctcctggatcaaggcatagatgttgaacgggatgcagacggatcgtctgatgacgaaactctggaagatttgagcggatggaagctccttcatggagacgttttcccgggtgcctga

SEQ ID NO: 19072 - DNA, 345 bp, A.fumigatus
aattatcactggtggtggcagagcttcctgaccggtggaagcagcgccttctgggtgtttgcttactgcatttggtactacttcttccatctgcacatcacaggcttcgtatcgagtctgctcttcttcagctacagcttcctagcttgtgcggtgtacggcttgctgactgggaccgttggattcctgacggcatatgccttcatccggcgtatctacaggtatgatggcccttcgagtatattagaacaggctgaccgcgatacagctcgattaagatcgattgattcgacatatagtctacagtcaatctgcaggcacttcctggcagaaataagcttgtaa

SEQ ID NO: 19073 - DNA, 282 bp, A.fumigatus
gcggatggaagctccttcatggagacgttttcccgggtgcctgagtatagcggtctattagcgccattggtgggctcaggcatgcaactcttctttatggtctctgggctgttgatcctcagttgcttgggtgtcttgaatcccagtttccgcggtggatttgttagtgtgggcatgggcttgttcgtctttgctggccttttctccggatatttctctgggaggttgtacaaaaccttcggaggtgtccattggcgaaagaatacgctcatcgtaagttga

SEQ ID NO: 19074 - DNA, 534 bp, A.fumigatus
accgctcttttcttcccggggctgatcttttgcctcatcttcatactgaatctatttgtctgggcacaagcatcgagtacggccattcctttcggtacattgatcggcatgcttgcgttatggcttctcattcaagttcctctggtatacctcggcagctggtatggcttcgtgcgagccaagccgtgggaacacccgaccaagacgaactcgatcgcgcgccaaattccgccccaaccgtggtatttgcatagctttcagggagctgccatcaccgggttacccccatttgctgtcctgttcattgaactactctttgtgttcaagaatttgtggcaggacaagagtggctattactatgttttcggcttcctcagtactgtgtcgacgattgtgattatcacggtgagcgaagtgaccatcatcgcaacgcacagccagttgtgtgctgaggtaaagtgtccgcctttattgtgtgtatttatgaagactaaccagagtagaattatcactggtggtggcagagcttcctga

SEQ ID NO: 19075 - DNA, 885 bp, A.fumigatus
gcgtttggtttgatcattcgtacattgaacaatgaacctcttgatgccccctctaccgcccaatccaagacataccctctgcgtttgctgatcccccatctccttattggctccatcattggcaaaggtggttcacgcattcgcgaaattcaggaagcttctggtgctcgactgaatgcatccgattcgtgccttcccttgtcctctgagcggtcacttgtaattctcggcgttgccgattctgtccacatcgctacctactacgtcgccgtaaccctcgttgagcagctcactgagcgctttggaggtcctgcagcctcagcttatgccactcgcagcggtggccctgctggagcagtgcctggcggtatgcaggttgtcccgtatgttccacagcccgctggtggtcaatatggccatccagaacatttcaagagacaccatccccaccccaatcgcgctgctgcaggcgcctatggggtcccttaccttcacggtcagcctgctcccgcaccagtggcccagccggctttgcattatggagctgctccccatgccccttacgcaggagctggcccccatcagcctgctccatacggcgcaccgcagcccgctcaggcacgcggcgctcctacccctgccacacccgttggaggtgtcatgcctggtcagccattgactcaacagatctacatccccaatgacatggttggtgccatcatcggaaagggcggtgcgaagatcaatgagattcgacacctcagtggcagtgtgatcaagattaatgagcctcaagagaacagcaatgagcgcttggtgactattactggaacccaggaatgcaaccaaatggctctgtacatgctttactcgcgacttggttag

SEQ ID NO: 19076 - DNA, 603 bp, A.fumigatus
gtgaagccagactgcacttttgacaaaatgtctgcttctccatccgcactgcaatcgaccaagcggcccttggaggacccttcttcgccgtccggaccaaatgatcagccagaagctaaacgtcctgccttggacaaagtagtaaagggagacgagtcggagacctatacggatgccaaggctgagccttccgctgcgccaagtgctactgctgatggccagggcgacactgctgttcctgatgctccaaatggtaagggtgcatccacggagacgcagccaattcagtcgaccgcgtctcatggcgagcgcgctacttctcagcccgaacagcagcgcccacaagatgaatccagctggattcacattcgcgctgtaatttctagccaggaagctgccacagtcattggcaagggtggagaaaacgtatctcagattcgtcgtttgtctggagcaaagtgcactgtcagcgactactcccgtggtgcagtcgaacgtattttgaccgtgagcggcccacaggatgccgttgccaaggttggttttttgatctatccttcgctgtttgaaagattgctaattcagagtaggcgtttggtttga

SEQ ID NO: 19077 - DNA, 537 bp, A.fumigatus
gctgtaaaaatcggaagatttctaaatgactcgtgtcaaaaaattagtttggaagattcccatgccaaatgtcaagcagatctcctggccccatacctcgaaccaaactcgaaggtcctctcgttctacacaacgcttaacccatccccctctgaaacggagacttttaccacgaaccaggtcacggagctggcaacgttgaccttccccagttcgctgaatccggaggagcacaagaagctcaattcggacctgattaacctccgcgtggcgctgacagagaagctggacgagaaatcgaggtcgaagtcctggtccatggcgcaggttcaccggccagggacattccaacatccgaagagtccgtctggggaggcgttcgtgtaccttcttgtcgtgggatgggagagcgtggatgcccatatggccgctagagagaccaaggagtttgaggagtccatcaagccgattcgagagaagatgcttcctgctttggagggattgggcatgaaacatgttagcttcaagaagatctga

SEQ ID NO: 19078 - DNA, 264 bp, A.fumigatus
agtcaagcaatagactctctgacagatttgactttagagaaagtaaataacaccactatggacatctcgcaagaaaccgttgataaaatacgacgtttcgcgcaaaagcgccaaaaagcggaggagttctacgaggaacactcggtaaacccagctaattttgacgcttacaatcgcaagttggatgagacgttggcagagctgcaggctcaagtcaaacgtcatgaggatgagctccgcaaggtacgtcaacaagttgcctag

SEQ ID NO: 19079 - DNA, 1029 bp, A.fumigatus
gtcgtccctttttttttttttttttttttttttctgtcgctggtcgcaactgacaaattgacaattcagaactccatccgtcacaatctctcgctgaacaaagcgttccaaaaagtccctcggcgtacggacgagccaggaaagggaatgaagtggcagattgccgcggagtaccgcgaagagtactggaagacgcagctccgaaagggaacgactcaatcttccgccccgtcgtcacctgccacgaaagaacctgtgtcgcggagtgctaacaaccactccgaaaacgtcttcaatggcaagaaatcgccggcagtgtcctccccaggatttagctcgttccccgtagcacccgtggaggcctacacgccggaacggggctcgcgggtcgctcgtggtgtcgaccatccgctgcgcaacaccaatcctcgggattacgaggagccttccccgttgcccacacattctgccaccaagaatcacgggaccggcagcgcattgactcgtgcctatggactctctgacaatgtggtgaactcgccgcccgttctctcgtcatcgtattacgacgatggtccgtcgtcgatgattacgccggccccgcagcggcagcagcctcgacttccgcctcctagcaccgcccaggtcccgtctaagttcatgccgatgagctcgcccgcgcaattctggaaattcgcggacattggtagcacaccagcgcgaccggtgcccgacatgagtccgctcaagggcgaagtcggggatggcattggtagtttcccaagcagtagtccgcctccgccgaacctggtcagtcccagtaagccggggacatcgaacggtctcggacacggacggacgcttccaccactgcgaaccgagccaaatctcggggaaacaaggccaggcgtcaatggggcggccaagtcggagcgaccgatggcgccggcggggccggatgcggatgacgatgacgaagaagaaggaggatttgatctcgccaggtttgttcccctacttctgatctga

SEQ ID NO: 19080 - DNA, 207 bp, A.fumigatus
ggggcaggaggggcaaatggtgggctggagcttatcattatcattatcagtatcggtatcatcgtagtgaataactatcagtttgacgtcagtcaagtcggcgactatcctagtaagtcaactagtcaggaacaatgcatcttaatgataatatctaggaaacttaatgttctaacagtacagagaaaagtcatggacctttcttag

SEQ ID NO: 19081 - DNA, 1125 bp, A.fumigatus
atgctgactctgctcccacaggttgatcaccatccttcgcctcctgcccgtcccgccaaagcgcaagaatccgccgatgaggccgacgactcgtcccccgaaaatgaactgtccgccaaccaagacctggtggacttggtcatatcctgcctgaacgtcgcccgggaagaagtgcgcgtgggacgggaccactcgaaccagaagacggagaacacgcagagtatccgcgcatatgcaaaaatcgccggccgcaactggacctattatgtcaaaacactgcatgtcaatatcgggcgcgaaccggatcgcgaaccgaagctggacgagcagtccagtcccgttacgatcgcagcaagggccctccccgacgtccatgttgatctgggtccaagcaagtttgtctctcgtttgcacgcggagattttctatgacggcggggagaccctttcctggcacatccgcgtcaatggacgcaatggggttcggctgaacaacgtcattctgaagcgcgggaccgatgcgattatctcctgcggcgacatcatcgagatcgccaatacccagatgatgttcgtcacgcctggagacaaggccaatatccatcccagttttgtggcgcgcgcgcagcgcatcgccaatggcgaagaagagttgctgtcatgggatcccacccagcactcgcatccccagccgtcgcagtcgagcgcagtgatgaacgaccagacctcagcgactgcttcagctggcgccagcggtcagccatcgcttgcccccgctccgcagttcctcaaacgccaagtgactcccccgccgcgctcgccagacaccgtcggtccgcgcactgccaaacagtcgccgctctataaccgcgggatgatgatggaaagtaccgaggagattgactacagcaaggactcggcgaaggatctgaaaccaccatatagctacgccactctgattgcgcaggcgatcttctccagcgaggaggagaagcttactctgaacagcatctacaattggatcatggacaaatacgccttttaccggcactctcagagcggatggcaggtaggtcgtccctttttttttttttttttttttttttctgtcgctggtcgcaactga

SEQ ID NO: 19082 - DNA, 1368 bp, A.fumigatus
ccaaccgattcttcaacggggggaagttttggcagagagtctgggatttgtgagttacccggcttacactcttatagctgcttactgatgaagaaatgtcgcagatactatgtccatgtccctcctcatctcaggccacgtccgctgttgctcgtgcctgctgctcaagtcaggaagttcatacaggaaatcaatcgtgagcttgaagctacgctgtcgatcccggaggagagagaaatgggattgctcttggactttaacctggacggagtccctcaaccgacattcatcggccagtgtacaagccgggagatgaaagatgaactggaatcgaccattcctccgcgcaccaactacgagcctccttccgagatggatggatcgcgtcttgcgtacgagcaaatgattggacatggaatagatgcgtcgaaaagcaagagtaggagcaaagcatccaaggcgaagaaacagatccggcttcaggctggaataaagtcggtacaagctctgaggaaaatgcgttgctaccttggtctgcaaccctgccactccctagatcttccaaagcttattgacgaacgatcttgggaggagaagggaaacgacgactgcagaatggcgcaaaggcttgacgaaacaagtgacactgggatccctcgcctcgacctgaataatccaacgatgtttccattctggcaagagccgatcttgattagtgttgacgtcgaatgcaatgagcgttgccccggacaggtcacagaagtaggaatttcaactctggacaccatggagctggttgacacccttccgggtgaagacgcagagaactggacctcccaaatccgttcccgtcacctgcgagtccgagagtatggccacattgttaaccgtcaatacgtgacaggatgcccgggaagctttgaatttggggagagcgaatgggtgtccaaagggaagctggccgatgtggtacaggcctgcttccaacctccctactcattcggggtcgaagacatggacggtgtccaggtcggcagtggcccagagcacaagcaccagaagcgcagcctgattctcgtgggccataacaccgcgatggacgtaaagtatctggcaagtctgggcatcccggtctttgaagatgtcacggccgccttcgtggagcgcattgacaccgccgagttgtaccgtgctatccgaggtgagtttaaccagcactcgctggccagcattctcggcgaactgggaattatcggatggaacctgcacaatgctgggaacgatgctcgctatacgcttgaagcgctggttcgcatgatctgtcgtgatacaggcgaggctagcgctgctgcttcaatggtgggatag

SEQ ID NO: 19083 - DNA, 186 bp, A.fumigatus
gttgatgactctttcatgactggaaggcttacattctccaagatcatgtctcactcaaaacttatctcgggttcactttcgggttccatatatctcatcatttctgggtttagaaacatctctctcgtttttgcagctcttctacgtactcctagcggtttcactgaaatgaatacatttgggtaa

SEQ ID NO: 19084 - DNA, 2361 bp, A.fumigatus
cgcagactctgttcatcttctcatagtgaaagcgacctcgaatcgttcctgctccaagtctcaatcatggcgacctccgatctcgttgaccattctccccgccatcccaccaaagccgcacagctggccagtgcctcgaatgttattctcatagacaattatgattctttcacttggaacgtataccagtatcttgtcttagagggagccacagtcgcggtctttcgcaatgacgagatcaccttggaagagctgattgccaagaagccgactcagctggtcattagccccggcccaggccatccagaaacagatgctggtatcagtaatgcggccattaagtacttcggtggaaaaatacctgtattcggtgtttgtatgggacagcaatgtatgatcacgtcttttggtggaaaggtcgacgttttcggtgaaattctgcatggcaagacatcgatactgaagcatgatggtaaaggtgtatatgaaggcctgcctcctgcggttgaagtgactcgatatcattcgttggctggaacgcacgcgactatccccgactgtctggaagttacatcaaccgtcccattgaacgatggcagcggcaaggacgtgatcatgggaatcagacacaagcaatacgcagtggaaggtgtccagttccacccggaaagtattcttacggagcatggccgcaccatgttcaggaacttcttgaagcttacagcagggacctgggaggccaatggcaaatcctcatctggctcggccacggtgaacggcagtgcaccaaaggtagacaagaagacttccatattgaataagatctatgatcatcgaagagcagccgttgctgttcagaaactgattccatcgcaacgtcccgaagatctccaggctgcctacgacctcaacctcgcgccacctcagatttcatttccttgtcgcctcagacaatctccctattccctctcgttgatggcagagatcaaacgggcttctccgtccaagggtatgattgcggagacagcatgtgctccggctcaggcccgacaatacgccaaggctggagctagtgtcatctcggttctcactgagccagagtggttcaaaggcagcatcgacgatctgagagccgtccgtcagagcctggaaggcttgcccaatcggcccgctgtccttcgaaaagagttcatttttgacgaataccagatcttggaggcacgtctagctggtgctgataccgtcctgctcatcgtgaagatgctgagtgttgagcttcttacgaggctttacaattactcccgcagtcttggaatggagcctctcgtcgaggtcaacaccccagaagagatgaaaattgctgttgaactgggcgccgaggtggtgggcgtcaacaacagggatttgacaagctttgaagttgacctgggcactacgagccggttgatggatctggtgcctgaaagcaccatcgtctgtgctctcagcggtatctctggaccgaaggatgtggaggcttacaaaaatgatggtgtcaaagctatccttgtcggcgaggcgctgatgcgggccccaaacacatctgccttcgttgcagaacttttagggggaaactccgagaataactccaagccggcgccgagctcacggttggtcaagatctgtggaactcggtcggaagagggtgcacgcgctgctatcgaggctggtgcagatctggttggcattatcctcgtggaaggtcgtaaacgatgtgtatccgacgatgtcgctctgcgcattgctcaggtggtgaagtcgacccagcgccctactgtcgagcctgactccacatcacccgccaatactttttcctccgacttctttgaccattctacccgcgtcctgcgtcatccaacgcgggctctgcttgtgggagtgtttcaaaatcagccactggcttacattctggacaaacagcaaaaactaggcttggacgtcgtccagctgcatgggtcagaacccatcgaatgggccagcctaatacctgtgcctgtcattcgtaaatttgcattggatgagtctggtatcgcacgccgagcttaccacagcttgcctttgctcgattctggtgcaggtggctctggtgagcttctcgatcagtcgcatgttcagaaagtccttgatggcgatgatgggctacgagtgattctggcgggtggcttggacacttctaacgttgttgataccatcaggaagcttggagactctggacacaaagtggtcggggtcgatgtgagttctggagtggaatctgatggttcacaagatcctgccaaaattcgcgcttttgtgcaggctgtgaaagcctatgaagcttaa

SEQ ID NO: 19085 - DNA, 3162 bp, A.fumigatus
  unsure (2462): Identity of nucleotide sequences at the above locations are unknown.
ctgttaaagccttgccaaaaccccttggagatactcttaccgctacaggctttcgtcgctctgacaacccttgcgttcatgaagctaccactggccatgccctcgatcatcaacaaatcaacaccaacgtcaccttcccagtcgccatatttcctttccaagggtgaaatcggccaattgaacgaaatatttgtaaccgccgggcttgaatctaaaactgcaaatcccgcagcattctcgtggggtttacttctgcatacattgagagagctggcacttagcgacaaagagattcgggagctggaacagtttcatagcgcggtggattcctttcaatcaaataccccccactcaaattcgggccaagcttcagagctctcattgtacgaggagttgctcgaatgcgcacggtctcccacttgcacagctgaggactcgatcgcccttttgacttcggatgctatgaaggatacgatgtttgaaacgatagtcgctttggccaccaatgttggttcaacatcggccgtcgacgacatccttacagaacggtggacacgagtggtacttttggatctcattcgcgtcgtgaggatttacgttgagtattcccccgagatcgttggctctgtcttagccattctcgaagggcctcccacgaaattactttgttcttcacagtctctctctgtcgctaccgatccgcgatggatcttcatgaacgatgattttctaatggacgaacttttccacctcgcacgctcacggtttccatacgaaacggtgccattcttgaaactctgccgagcgctcattagcaaagacatggtgaacgaggaaggcattccacaaatcctcagcgagatggagaatatggacactttcacacagatagtgccattggaatttcagggatataaaacaattcgggaagatgaaaatgccaaccttgtcaccctcacacagcccctggcgatcttcgagtcgtcgacggcgaggcaaattatggaccatgacccaagcaatgctctggttgtcacaagctcatcacatgtgccttcatcaactttaggacaagtgatatccgaagcaaagccagcagtgattatgtggtatcatgaatattcctgcttgagttatctcgggagttacttagaagaatggaatgaaaacggtgggttctcatccggtgtggaagaagacaacgttgcggagattataggtcttatggcggacctacttgttgccgcatgggttcagccaacgccaaatgaggcaagctctggcgccaaacgtattctggaggttgcgagcgatggtttggctcgcaaaagcgatattatatcgttggtcttcgatatattcgagcgcattctgcacaatattggtccgagggctggattagacagcaaagtagagtccgtcatcgcctgcttacgtttcattcgtgctcttacaatggttttacctggaagggtatggcctctgcttgctcggagcagtctactcgggtcagacggcaagggcggcgtcatgaccgcaatcgtttccgcgactgaagtgacatcgggagattatccattcctgcttgagtgtgtcaaattattccaggatgtcgtggacgacgcagcatcacgcgcgatggtgaggaaatgcccgaataacttgtctggaaaaatgacggctgcctctgaatggacctctggcgtaccaactcatatcatgagaggtatcttattgaattttgtgcggacaatggtagaggtgttcaacagcaacatcgactggcgtttcaacgccccggaacaaaggctcgaaatcaataccactcttgctaagacctttgaaaggatgatctattatacctatgggacgaacgatgctaccaaactggattcgaaggttactggcgttttctcctcatccgcaacatatcttctggatgtgctccgaccacagtccagggcagatttgcctttcaatccaatccttcggttgattgttgacggccttcagacgccggctactttacatcttcgctacctcgtgttgatggagaagcaagtgaggtcgacattggagttaacaaccagactattggaggccgcccggtacctggagcaaccaacttcgctactagaggaccaactattcaaggccagtcccgttctcgtcaaactatattcgttgctcgatgcctaccgcttacctgtcatattactttttgagatcctaatctccggtgcagctctcgactccgcgaatgaacccccatctttggtcggacaccttggggcggaatcatcctgcctcttcctcgacgttctgtcacagttcgacaagccgttgagtgatcagaaattacagctagcggtatggcacttcctatccacgatcgtcagtaagcgacagcagtggctcgcggtgtatatcctcactggatcgtctgcccggcagacaatganacagacagacactaagggtgggcccacgatgaggggaacgccctttctccaaatcgcccttggaatgctttcgaacattgaacacatggatcttcgtgcagcactttccctgttggagtttgtttcgtgtgctcaggaaaattggccctgggccacaccagagctgcgaaaaacccctcagttttttagtagccttgtcaactatgtctcgaaactgaaaattccatcattaccggttcaggatcagatcttcgctacgcgaattgccgctgtcgttgctgacctttgtgctgtctaccttcactcggccaaggatatgcaggatcgaactttttacaagaccttgattccgcttgtgttctggtactcgaaagacgcagtcgatgtctctgcttataatacatcattacacgccaatttgaagaggaatttcgagatgagatattctggctgtaagctcgccgatttcagaaggacatctctgcagcctcgctctttgggccgtgactactattacgacattcaattaggagacaagcttctttcttatgacttcgcttggtcagggactaagaatcaagggtttgccgaggaattcgaacgagccaacatcaatctgtcattggtcgaggcacaggtggtacgtacagtggcgaactttcaccttactaatgagacgattctgatcatttttgtatag

SEQ ID NO: 19086 - DNA, 189 bp, A.fumigatus
tgtggagtcaggctcgacagtagggcgctgggtcgacttcaccacctgagcaatgcgcagagcgacatcgtcggatacacatcgtttacgaccttccacgaggataatgccaaccagatctgcaccagcctcgatagcagcgcgtgcaccctcttccgaccgagttccacagatcttgaccaaccgtga

SEQ ID NO: 19087 - DNA, 2199 bp, A.fumigatus
tctatagtcgccaacagcgcctacaaagtcgacaatatggtcggcgtaaaacgtcccgtcgatgcgggcgatgagcgcaatgggaagcggaccaagaccaagactgtgtccgcgacaacgaaaaagtccaaagctgcgccagtgaagaagtctgccccgcagaagagctcgaagaaggatgtcaagtctggaaagaaagataagaagtctaagaggaaggtagaggaagaggaggactttgacgacgacgacgaggacgactttgatattgacgatattgcggactcggaggatgatgaggatgaggatgtcgagatgggtagtagtgcgagtgacgatgatgaagatggagacattcagcaggagaagaagcagaacaccaaggattctgttgcctcgacgaaagcagagcccctgaagagtatggtgaccccttggaactttatcttcgtcctgaatcacctggctaataatactctctttctagataccaattcctctcgcgaagcacatgcaaagcagaagacccttctacaagagcgcaaagccgcgaagcctaacgctgacatcatcgctcgttcaaagcagctgtgggaacggttgcgccgcaagtctcacgtcccgcttgaggagcggaagaagctcattgccgagctttttgagattatcaacgggagagtcagggacttcgtattcaagcacgatgctgtccgggtcattcagacggctctcaagtacgccaacatcgaccagcggaaacagatcgcgcacgagctcaagggtcactacaatgagctggcgcagagccgctacgccaagttcctagtcggcaaactgcttgttcatggagataccgaggtgcgcgacctgataataccagagttctatggccacgtgaagcggctcattcgccaccctgaaggatcctggattttggacgatatctaccggacggttgcgaccaagcaacaaaaggcaacgcttcttcgggagtggtatggtcctgagttttcgatatttaaggatgaacaggcatctgccgacctgtcggagattttggagaagaaccccgagaaaagattgcctattatgcacttcctacacgagatgatcaaccagctggtgcagaagcggacgactgggtttacaatgctgcacgatgctatgctgcagtactttctcaacacaaaaccaggcagttcagaggccaacgagttcattgagctgctcaagggagatgaagaaggagatcttctgaagaacctggctttcactaagtccggctcgcgagtaatgtgtctgagcttggcctactccaatgccaaggatcggaagctgctcacgcgtgcttaccgcgataccatcaagatgatggccgcggacctccacggtcacatggttctcctggccgcatacgaagtcattgatgacaccaaattgacatcgaagttgattttccccgagctcctcaaccaaggcatggaagaggaggcgcgcaatgaggagcttctgtatcaggtcaacgacctgacggcgcggataccgattctctttccctttgccggagaccgcgtcaagtggcttgtacccgaggtcgaccaggaagtgttgaaggagattcgggagatccgaaaggagacgtcgaagaaggagccggctgttcgtcgccgggagctggtcaaggcggcatctcccactctgctaagtttcatagccgctcgcgcggagtctctcctggagactagcttcggatgccaattcattgccgaggtgctgttcgacgctcacggtgacaagatgcccgccctatcggccgttgccagcgccgccaaagtcaaatcagacatgaaggactcgcctttcttcggacgactgctcaagtccttggtccaagggggtcggttcaacccggcggagaaggtagtggagaaggtgcagccgcctctgaacttccatgctctgctgtacgagcagatcaaggatgagatcatgacgtgggccaccggacccaatacgttcgttgtggttgcgctaacggagtcggacgagtttgctaaaaaggacgagctcttgaagacgctcaagaagggcaagaaggcgctggagcaggcggctgcggagagtggcaaggatgagaagaagaagaaggctggaccgaccagcagcggcgccaaactgctactggagaagattcgatga

SEQ ID NO: 19088 - DNA, 1281 bp, A.fumigatus
  unsure (1271),(1272),(1273),(1277): Identity of nucleotide sequences at the above locations are unknown.
tgtcaattgttaaggagaagggaccagatgacgagttgtcatcggccatcttggaaagtgaagcggagcgcattctcgaaaatgccaagaaaaagctcacggtatgatatccctcttgcgacgatttgtcctgcactaacctggctgcagctcatggaagggaatctctcccgagcccgatcgtcgattcgaatgtcgccctcgctttcacccgcaccgtcgccagcgcctggcactcagccattgggactggggcagcccgtcggaggtttataccagtcaatctcccgagcggaccgcagggtttcggccctgcgcgctcggtcgacgtacacctcggcgcaagactcggccaacaacaggcattcccgggtttacagtgaaaccaacctaccgttaacagcgtcgaccgagcctccgaccaccggacctagtctgtcacgatccatgagcgccatggggtcgagcacttcctccaattttcacaacgatgaacggtcatttcactatgacaccacgcgaccttatctcactcaccgtgcctctgtcttaccaacgccaccaccatccggctcgattcgacgcgcacactccgccaatcagagcggggacaactctgagacgcccaagggactaggcattacaacccccaacgtggaatctgacaacaagcacaaatatgaaaagttcaactcggagcatcccccgcacgaccctccgtctcgcgcacagtcacaacttcaggtgcgggatcttcaggaccagatgaagggcctccacataaagatttccagtctgaaggtcaaagctcaagagggcagtctccggcggcgaagcctgcagagcttgaggacgcccagtccgttcaccgagggggaccagtggtacccgagcgcgttggaactcaagaacagcaatgggagtctccggtcaaatccgggacggggccatcctgccgacgcccaggagagccaccaccaccaggaacgtcaggaaccggagaccgtaagaaatggatttgcatacgaccagagaaaccatcgcaccgaacaaccagaaaccaagctccagcgaaagccgagtgttgcttcgcatgcggtttcactcaatgagagcctatacgaggatgcagaggagggaggctacgacatggacggctccgcgggctcggacattgaccgtgaagctttggaggagatactgcgcgagccgctggacgacgaggacttgggtcttcaccacggggctggaaggatcagcggtggtctaannnaaancccg

SEQ ID NO: 19089 - DNA, 195 bp, A.fumigatus
gttattttacgctgttcagctagtaagtcctgcaccaactatatctgtcccgaatttggatacggtctcatcaaacactctagtgcctcacccacctggtgttggacccgtctatggccgtctattgcctcaggaatgactatgatattggcgccgtgtattcattccaagtcgatatcagtgagccgcttgtga

SEQ ID NO: 19090 - DNA, 183 bp, A.fumigatus
acacaagtgccagcaattattgatgcactgctgctcttcgcccggctattggtaaaagtgggctgtcgtcatttggtctgcatcaataacgtcttgcatgctattgttcctactgacctagagctacatgccgctaaggtctaccatgggttatataaccagcaagctctcatcttgctttga

SEQ ID NO: 19091 - DNA, 600 bp, A.fumigatus
ctccaccgcgttacctgccagccctgtggtgaagacacagacaacagggcgattggtgtttcggtaacaaaagaagcactagttaacgacagtatactaaacccggatgatgcatatcggtgcctaatcaacctcaacatcaatctgcagaacaggctgtacacagataagtttgagtggtccttgttacaccctcccggcatggcagaggaattcgcgcaggtcacctgcgccgacctaggcctgggcggcgagtgggttggagccattgcgcatggtatctacgaagctgtcttgaaattgaagaaggaagtgtgtgagagcggagggatgatcagtggcatgggtgggtatggaaatgagatcgataaccaagctgccaatggcaccgaggctggttggcggtatgatcccgaaggactaggcgatgaatgggaacctaaggtagagactctttcaaaggaagagattgagaagcgagaaggagaccgcgagcgccagatcagacgtctacgacgagaaacagcccggttctcttccaccgcccggcatcacaccagatatgtcgcggcagggcagtggttatttcgacgtcgatag

SEQ ID NO: 19092 - DNA, 402 bp, A.fumigatus
agatatgggattacaagtaagttttcgactcttcctggatttgaagccgacgactgtactaatgactgtacttatagcccggaaagcaagacctacaacctcagccagacattggaaggtcattcggactgggtccgtgacgtcgcctggtcacccagcattctgtccaagtcctatatcgcctctgcgtctcaggataagactgtgcggatctggacctcggatgcatcgaatcccggccaatggaccagccagcagctggaattcgacactgtcctgtggcgggttagctggagccctagtggaaacatccttgctgtcagtggaggagacaacaaggtcagcttgtggaaagagaatttgaagggacaatgggagaaggtaaaggacattgaggagtag

SEQ ID NO: 19093 - DNA, 222 bp, A.fumigatus
gtttggcacgatatctctcatgaaccttccaagaggcaggactccggcgcatactattttgacttcacaatttccagcttaattatctttaccagcattagctgctggccccgttgtctgaaacattgcccttcctcgtggaatcaagcatcatttggtcggatttgtttgaaaaccatttacttctatagctgtattctgcaagagaaccatttcacctga

SEQ ID NO: 19094 - DNA, 438 bp, A.fumigatus
tatgttgtctactctccatttcaggctcatcccaagtttggcacgattcttgcctcctcttcgtacgacggaaaagtgcttatctggcgtgagcaacaccaaaacgcgacgtcccccgttgcaggcagcacctggacaaaagttttcgatttctccctccacactgcctcggtgaatatggtttcctgggctccacacgagagcggatgtctccttgcctgcgcttcttcggacgggcatgtgagtgtcctcgagttccgcgacaacagctggacccatcagatcttccacgctcatggaatgggtgtgaactcgatcagctgggccccagcagcgtctcctggaagcttgatcagctcgaaccctggcccaggtcaacagcggagattcgttaccggtggcagtgataatctgctgaagatatgggattacaagtaa

SEQ ID NO: 19095 - DNA, 843 bp, A.fumigatus
aatatcaaagtactaatgccaagacagcgtcgccgtcatgatttccttgtcaagctcggtaaaacttttgagaagcaggcaaacgcgggagtggatcgattccgggccgcaaacgaagcgtcggtcatagctgaagttcaggcgaaggaaattcaggacgaaaaggaacgcaagaaggacatgcagcggaagcggcggcgtgagaatacggtgcgtttggaaatgcagaagaagcttgaagcggagcgcaaggcaaataaggccaacgatgctgccgagaaggccaaattcctccgcgaagcggaaagggcccagagaaagatcaaatcgaccaagcgagctctcgaaggtgtcacatcgccggaggaaatcggagaggtcacgccgcttgctcctaatctggaaggaggcactaccagctcattccacatcggtcgcagctccccatcgaggcgcaagtctggacgctcggggacctcacggccgaagaaatccaaggagcagaagcaggccgagaaggatgcggccgaagctgcttatgctgccatggagaatgatgagcccctgcctctcgctcccaaggaagatccgagaaaggagaccctcaagaaagaagccaagggtgcacgttccaaagaaaccacgcctgcgcccgtgtccgcattcgaatcgaagggttacaaccaaatatatgaacagatctggcgggatattgcccggaaagacatccccaaggtctatcgcatcaagaccctttctctcagtacgcgtcaagaaaacttgcggaagacagctcagcttgccagcaagcagtctcgcaaatggcaagagcgtacgaaatag

SEQ ID NO: 19096 - DNA, 252 bp, A.fumigatus
ccgtctaccggctcatcacgcgcggcaccatcgaagagcgaatccgcaagcgagccctgcagaaagaagaggtgcagcgcgttgtcatctccggcggtgcggccggccggagttgacttcaacactcgctaccgcgagagtcggaccaaggatatcgccatgtggctggcggatgatgaacaggccgaactgattgagcagtatgagaaagaagcgctacaccgcggtgaggtgtttggcgctggcaaatga

SEQ ID NO: 19097 - DNA, 507 bp, A.fumigatus
ttccgaacccttctcacatcgtacctcttctggttggtgatgccgagcttgccaagaaggcctcggacaagctgctggaggagcacggaatctacgtccaggcgattaactacccgaccgtgcctcggggggaggagcgcctgcgcatcacccccactccgggacacgtcaaggaacaccgcgaccacctggttcacgccgtccaggcggtctggaacgatctgggtatcaagcgcaccagtgactgggcagcccagggtggatttgtcggtgtgggtgtcgaaggcgccgaggagcagaaccagcccatctggaaggacgcacagctcggcctggtcgagtacgagtctctggagcaggccgtcgagcgtgagttccagcaggcgcctcgcatgcaaaccgccactcccatccatcctgctgcggcccctgctgcctccatccccgttggcgtggctgcttaagaccggtcgctgcctcacgatccggtactgtcttcacatataa

SEQ ID NO: 19098 - DNA, 720 bp, A.fumigatus
ctgaagttcaggcgaaggaaattcaggacgaaaaggaacgcaagaaggacatgcagcggaagcggcggcgtgagaatacggtgcgtttggaaatgcagaagaagcttgaagcggagcgcaaggcaaataaggccaacgatgctgccgagaaggccaaattcctccgcgaagcggaaagggcccagagaaagatcaaatcgaccaagcgagctctcgaaggtgtcacatcgccggaggaaatcggagaggtcacgccgcttgctcctaatctggaaggaggcactaccagctcattccacatcggtcgcagctccccatcgaggcgcaagtctggacgctcggggacctcacggccgaagaaatccaaggagcagaagcaggccgagaaggatgcggccgaagctgcttatgctgccatggagaatgatgagcccctgcctctcgctcccaaggaagatccgagaaaggagaccctcaagaaagaagccaagggtgcacgttccaaagaaaccacgcctgcgcccgtgtccgcattcgaatcgaagggttacaaccaaatatatgaacagatctggcgggatattgcccggaaagacatccccaaggtctatcgcatcaagaccctttctctcagtacgcgtcaagaaaacttgcggaagacagctcagcttgccagcaagcagtctcgcaaatggcaagagcgtacgaaatagagtatga

SEQ ID NO: 19099 - DNA, 321 bp, A.fumigatus
gaaacaggagatcgagtcgcccaagaaggcagaaagcagagcgtgaagccattcgtcagaagcggaagctggattttcttgatctcgcagactgaactgtattctcacttcattggtcgaaagattaaaggcgccggaacaaaatcttctggggataccgctgtcgacggctccgatgagactatccagcctggcaaggccgaccacaccattgatctgccgcctaccgtcgccgacgtgggcgccaaagtcaccaattctgaggacctggatttcgacgcggaagatgagacggctctgcggcaaggcagccttggctaa

SEQ ID NO: 19100 - DNA, 2625 bp, A.fumigatus
tctcgcagactgaactgtattctcacttcattggtcgaaagattaaaggcgccggaacaaaatcttctggggataccgctgtcgacggctccgatgagactatccagcctggcaaggccgaccacaccattgatctgccgcctaccgtcgccgacgtgggcgccaaagtcaccaattctgaggacctggatttcgacgcggaagatgagacggctctgcggcaaggcagccttggctaatgcccagaacgccgtcaaagaagctcaggagcgggcacgtgcctttaatgccgaagagaacccaatggctgctctcgacgagggcgaactgaactttcagaaccccacgagtttgggcgatatcgaaatctctcagcccaagatgcttacggccaagctcaaggaataccagctgaaggggctgaactggcttgtcaatttgtacgagcaaggtatcaacggtattttggccgacgagatgggtctgggtaagaccatccagtctatatcggtcatggcatacttggctgaggttcacaacatctgggggccgttcttggtcattgcgccagcatcgacactgcataactggcagcaggaaatcaccaagtttgtacctgatatcaaggtgctgccttactggggttcggcgaaggatcgcaaggttctcaggaagttctgggaccgcaagcacatcacttacaccaaagagtcagagttccatgtccttgtgacatcgtatcagcttgtcgtccttgattcgcagtacttccagaaagtcaagtggcagtacatgattctcgacgaagcccaggccatcaagtcgtctcaaagctcgcggtggaagaacctgctcggatttcactgccgaaaccgtctgttgctcactggtaccccgattcagaataacatgcaggaattgtgggcacttttgcatttcattatgccgaccttgtttgactctcacgatgaattcagcgagtggttctccaaggacatcgagtctcacgctcaaagtaataccaaacttaacgaggaccagctccggcggttgcacatgattctgaaaccatttatgcttcgtcgcgtgaagaaacatgtccagcaagaacttggagacaaagttgagaaggatgtgttctgcgacctgacgtatagacagcgggcctactacaccaacttgcggaaccgcgtcagcatcatggatctcattgagaaggccgccgttggcgatgaagccgacagcacgacactgatgaacttggtcatgcagttccggaaagtctgcaaccaccccgacctgttcgagcgggcagagacaaagtcaccgttctcggttggatattttgcagaaactgcctcgttcgtccgcgagggacagaatgtggatgttcgctactcgacgcgcaatctgattgagtacaacctgccgcgccttttatgcagccccagtggtcgtattgacatggctgggccgggcaatgaacacgctggtttccgaggcaaatacctgcagcacttgatgaatattttcaccccggagaatatcaagcgcagcatcgatgaggatggtgccttttcgttcctgcggttcgccgacacctccatcaatgaggcgtacgagcagtcccatctcggcgtcttcgagcgggcggtgcgccgtcgtggccagagcaacagactgtctcacctgaatgttatctacgatgatgaagaggacgagcaaacatcgaagtttgtgcttcctcattccctcttcaatatcgtccagcggaacgatcgccaggctgtccgcaacgttaccgtagagggctacatgcgggatctgatgaatgtctctgaggctacgtttgaacgcgatggcctaggcgtgattgaacccagcgcgagccctgcggcttcggcgcctccgatcaccatctcctgctctggtcaagtggctctcagggaaacccaggatacctttttcaacgtctccgttcgtcatgccctctttagcacgccttctagacagatggaacagcagatcctcgagaagaagctggaccccgccccgttctcgcttccgcccatgttgccgaagccgatatccaccaagggccgatacacgcatattgaggttccatccatgcggcgtttcgtcaccgattcgggcaagctggccaaactggacgaacttttacgtgagctcaaggcaggcggtcaccgtgtgcttctgtacttccagatgacacgcatgattgatctgatggaagagtatctcacgtaccgcaactacaagtactgccgcttggacggaagcacgaaactcgaggaccgtcgtgacaccgtggccgatttccaacaacggcccgagatctttgtgttcctcttgtcgacccgtgccggtggtctgggtatcaacctgactgcagccgacacggtcattttctacgattcggattggaacccgactattgactcgcaggctatggatcgagcgcatcgtctcggccagacccgacaggtgaccgtctaccggctcatcacgcgcggcaccatcgaagagcgaatccgcaagcgagccctgcagaaagaagaggtgcagcgcgttgtcatctccggcggtgcggccggccggagttga

SEQ ID NO: 19101 - DNA, 576 bp, A.fumigatus
gaaagccacaagattccgctctattatattgctttcgtatttctcttctctcattttcccccttcccccttcccaattcgacttttttcgcccttggtgtccaagcttctctctccaatctctcaacaccaccaaaccaattcctgcctcgacgagtctctctgctcgctcgctgctgtcaccatggagtctcttctccagcagtctcgggcgatgtgcccgttcctcaagcgcacgtctcccaccgctctgcgtactctcgccacggctacccgtcccagcatgagtcccggcggaggtaccatgtcgaacctccaggttatcgctcgtcgttgccctgtgatgagcaaggccctggctgtccagagtgcccgcatggccggtgccaagaggttcacctccactgccgctggtgtgccgggaatgagcagcaagcatttccgtcccgctcagaccagaagagcgctgcacagtactggaggcaatggcgccaatctcagccctgatctatacaagaacaccgacagacgtgcgtactgttctcagccaatggattggagatatatcgctaattga

SEQ ID NO: 19102 - DNA, 1581 bp, A.fumigatus
acagtccaacccacctttggcaccggcaaaggcaagactccacgggccacttctccctccacggttgccggtccccgtcctgaggttcccgcccccgctccattcgactacaatgctttctacctgggtgaactggagaagaaacacaaggacaagtcctaccgctacttcaacaatatcaatcgtctcgccaaggaattcccccgtgctcacaccgcctcgatggaagagcgggtgaccgtgtggtgctcaaatgactatttgggaatgggccgcaacccggaagtgttggccaccatgcacgagactctggatacctacggagccggcgccggtggtactcgcaatatctcgggacacaacaagcatgccgtggctctagagaacacgctcgccaacctgcacggcaaggaagcggcgctggttttcagctcgtgctatgttgccaacgatgccacgctcgcgacactgggaagcaagatgcccgactgtgttatcctgtcggacagcctgaaccatgcatcgatgattcagggtatccgtcactctggcgccaagaagatggtgttcaagcacaacgacctagtcgatttggagcagaagctggcgtctctgccattgcatgtgcccaagatcatcgcgttcgagtccgtttacagtatgtgcgggtccattgccccaattgaagctatctgtgatctcgccgacaagtacggcgccattacctttttggatgaggtccatgccgtgggtatgtacggtcctcacggggctggtgtcgcagaacatctcgactacgagatctatgcctctcaggacacccccaaccctcgctccaccaaggggacggtgatggaccgcgtagacatcatcaccggtactctgggcaaggcgtatgggtgtgtcggaggctacattgccggctcggcggctatggtggataccatccgttccctcgctcccggtttcatcttcaccacctcgctgcctccggcgacaatggccggagccaacacagccatcctgtaccaggcacgccacaagggcgaccgtgtgctgcagcagttgcacactcgggccgtgaagaaggcattgaaggaactggatatccccgtgattccgaacccttctcacatcgtacctcttctggttggtgatgccgagcttgccaagaaggcctcggacaagctgctggaggagcacggaatctacgtccaggcgattaactacccgaccgtgcctcggggggaggagcgcctgcgcatcacccccactccgggacacgtcaaggaacaccgcgaccacctggttcacgccgtccaggcggtctggaacgatctgggtatcaagcgcaccagtgactgggcagcccagggtggatttgtcggtgtgggtgtcgaaggcgccgaggagcagaaccagcccatctggaaggacgcacagctcggcctggtcgagtacgagtctctggagcaggccgtcgagcgtgagttccagcaggcgcctcgcatgcaaaccgccactcccatccatcctgctgcggcccctgctgcctccatccccgttggcgtggctgcttaa

SEQ ID NO: 19103 - DNA, 681 bp, A.fumigatus
  unsure (477): Identity of nucleotide sequences at the above locations are unknown.
acatcgcctccaaggcggccgccgtgcaggcgcaggtgcaagccaataagcctatcccgcaagccaacctggacgcaacgcaccctgccgacgtatacccgatcgacgtgctcgtccccaacgggctggtcaccctccgccagctccccggcgtcaaggagtgggccgacaccgtctccgccggcctccccgtggccacgacctcgcgctacgtctcccgccgcgtcgaggcggtcgtcaagtccggcaacaccacccacctccagatcctccgcttcatcctcctcctgctcgagttcgcccgctccctacgctccggtcgagaccccaaatcgtccgctggaccaggcagcaagcgcctcccgcatagcgagggagtgtgaggcatcctatcctcggcctcgggcaaccccgcctcgaccagcaagcagcaacagcagaatacaagccaatccgacgccggcactctcccggacnccgtcatcgacgccctccgccgcaaattcgccccgcagggctctcacctcaccaagaacgaccttaccttcctgcacaccaccatctgcgcgctctcgctgcatattcccccgcagcccgccaaggacggcggcgccagctccctgggcggcaactcgcccaacgagctggccaccgaccccgccgatctgcgcgacgacctga

SEQ ID NO: 19104 - DNA, 459 bp, A.fumigatus
cgagtgttgaagtcaactccggccggccgcaccgccggagatgacaacgcgctgcacctcttctttctgcagggctcgcttgcggattcgctcttcgatggtgccgcgcgtgatgagccggtagacggtcacctgtcgggtctggccgagacgatgcgctcgatccatagcctgcgagtcaatagtcgggttccaatccgaatcgtagaaaatgaccgtgtcggctgcagtcaggttgatacccagaccaccggcacgggtcgacaagaggaacacaaagatctcgggccgttgttggaaatcggccacggtgtcacgacggtcctcgagtttcgtgcttccgtccaagcggcagtacttgtagttgcggtacgtgagatactcttccatcagatcaatcatgcgtgtcatctggaagtacagaagcacacggtgaccgcctgccttgagctcacgtaa

SEQ ID NO: 19105 - DNA, 384 bp, A.fumigatus
gacatcgcctccaaggcggccgccgtgcaggcgcaggtgcaagccaataagcctatcccgcaagccaacctggacgcaacgcaccctgccgacgtatacccgatcgacgtgctcgtccccaacgggctggtcaccctccgccagctccccggcgtcaaggagtgggccgacaccgtctccgccggcctccccgtggccacgacctcgcgctacgtctcccgccgcgtcgaggcggtcgtcaagtccggcaacaccacccacctccagatcctccgcttcatcctcctcctgctcgagttcgcccgctccctacgctccggtcgagaccccaaatcgtccgctggaccaggcagcaagcgcctcccgcatagcgagggagtgtga

SEQ ID NO: 19106 - DNA, 483 bp, A.fumigatus
  unsure (94): Identity of nucleotide sequences at the above locations are unknown.
ggcatcctatcctcggcctcgggcaaccccgcctcgaccagcaagcagcaacagcagaatacaagccaatccgacgccggcactctcccggacnccgtcatcgacgccctccgccgcaaattcgccccgcagggctctcacctcaccaagaacgaccttaccttcctgcacaccaccatctgcgcgctctcgctgcatattcccccgcagcccgccaaggacggcggcgccagctccctgggcggcaactcgcccaacgagctggccaccgaccccgccgatctgcgcgacgacctgaggctcgagagcgccactatcctgcagtacttccgcgaactgggctgccgcgtcgacaagccgcgcgagagcgagttcgcgaaatggaatatcaagggtggcaaggccgaggcggccgcgagacggattgcccggctcaagatcccagtggaatttcccaaggtgagccgcggtggaaggaggtga

SEQ ID NO: 19107 - DNA, 207 bp, A.fumigatus
atagggaggcagagaaagttggcgcagaaagaattgttattgatcggaaatgactccgctactacgaagtttcttgtatttagaaaggaaaggtcccaatattatgttcgatataagcccgctaagatacttacattagatatcagcgatgtctcagttggacagatgcggactatttcagttggaattgtacctcagacccattga

SEQ ID NO: 19108 - DNA, 1152 bp, A.fumigatus
  unsure (303),(386): Identity of nucleotide sequences at the above locations are unknown.
gtctacaagtccgcaacagttgacgttaatctcctccacttcgcaccttccacacaggcaggaactactacaggtgtaccaatggatccagcaaccgaaaaactctacgtttcagcagaaaacgccaggacatttgtccagtcagtcttaacaggcaacggcgtctcccctgagaatgccactatcatcgccgactgtctagtccgtgccgacctacgcggagtggacacccacggcatcaatcgcatcccatcgtacatggaacgcattcgtcaaggagtgttagacgccaaagccaccccngtggtgaaccaggtcacgccggtcgtggctcaggtagatggacagaatgggttcggcttcatcgcagcgcatcttggaatganacgggcgattgagatggcgcgcgagttcggcattgggtttgtttccgtcaagcattcgaatcatttcgggatgtccgcgtgggtggtgcagcaggcgctcgacgcgggaatgatgagtcttgttttcacgaactcgtcgccggcgttgcctgtttggggtgggagagagaagttgatgggagtgtctcctttggcgagcggtgcgccggcgggaaaggagaagccatttattttggatatggcaccctcgattgcggcgcgaggcaagatctacaaggctgcgaggaggggggagaaaattcccagcgattgggctttggatggtgagggacggcctacggatgatccgcacaaggctcttgagggtgtgatgttgcctatgggagggccaaagggatcggcgctcgcggtcatgatggatgttttctctggagtcctgtctggctcggcattcgcgggtcatgtcactaatccctatgatccttccacaccggctgatgtagggcattttctcgtcgctatcaagcccgatctcttcatgggcttggaggagttcaaggagcggatggattatctttatcagagggtggtgggctccgagaaaatggctggagtagatcgcatctactttcctggggaaattgaacagatcacgcacgaggagagattgaagacgggtattccatatgtccaagcagaaatcgatgcattgaatagggaggcagagaaagttggcgcagaaagaattgttattgatcggaaatga

SEQ ID NO: 19109 - DNA, 921 bp, A.fumigatus
tcccgcctatcctcaaccgttgacgtccgaaccaaacaccacgacacctaccattactgctcaacaaccatcaaaatgaccaccgactacagcaagaagacgaacgcggagctagtggagattctcaaatctcgctcgctccctcacacaggcaagaaggcggagatggtcgctcgcctccaggaagacgaccaaaacaaagccaaggccgcaacggcccctgcccctgcccctgctgcaaagactgacgccgcggacgacgtcattgactgggaagatgatgatgtacctgctgctgatactactgccgtgaagccttcaactgaggctggcgccgctgccattgctgctggcggcaaaggtgcggtcgccaaccccgtcgctgttccgaaccagaaagtcgataccgaccccgctactacgaacgatctgaaggtcgaatcaaagggcgcggcaccatcggccgagagtggggcgcaagggcacgaaggcacggaaggtgcgccagttgaggcagcacctgctgcgccggccgaaaaaaaaccggcaccggactattctatggggctgcccatcaccgagatggaagaggagttgaagaaacgcaaggctcgcgcggagaagtttggtattaccgaggagtctaaggctgcaattgcggaggcggagaagcaactcgaaagggcgaagcggttcggtactgtggttcatcctactcctgctggtggtgtcaaaggcctggacgaagctctcccgacagagaagtctcgcaagagaggccggggtgataatgaccaagcctcacgagggggcaagcgacgtgatattgggggccgaggcaaattccggggaaaacgccgcggaaatcgaaaccagaatcaacggaatgaaggaacccttggaaaccaacggccaagataa

SEQ ID NO: 19110 - DNA, 3417 bp, A.fumigatus
  unsure (2324): Identity of nucleotide sequences at the above locations are unknown.
agatatattactctctacctcatttgcggactactcatagctgccaacatgtctgacggtgggtttcttccacccctaaccgatgacgccgtgctgatcgcctctgcagctgatttcgaagctgttcgcaaactccaagctgagcggaatgccgctacagctgggaagaaaggttctaggacctttgattcgtctagccagcgcactgacaactccaccaaggcctccctgaccgaaacctttgatactactctgtacgaccgcgagggtcccgacaaatacgcaggctataacacgtcgatcgctgttgatggtgatgaagaaatggaagacgaggacggcggtcaccgtctggttggtcagtataccgcaaccagagatcagattgacgagcttgcccacggcaatggcgtcgaggaggaggatatcattactggacgcgaaaaggcggccaggattgcggacagggaaacagactatcaaaagcgtcgattcaatcgaggccctttgacgccaaccagggctgatccctttgcggcgaacactcatgccaacgtggagacagatggccagacataccgtgaaattatggcactccgtgaactagagaaagaagaagagcgtgtccagaagctgatcgcagagaaacaggcacgtggcgagatcggtgtcactgaacatgaggccactctgaagtcagaggataaggataatgccgatgctggctcgacagtctctgtcgccacgggacgaaagcgcaagcagcggtgggatgtatctaacgagcccactgaagctgttcctgaagctcctcagccttccgagacgaaaacaaaaagatcgcgatgggatcaaacacccgcccctgctgtccctggcaccaccggagaggctcccaaacggcgatcaagatgggatcaagctccagcaatcacagccgcaacaccggttggcaatcagggactcgcgacgccaatgcatccgtctcaagtaggtgtacctatgattccaaccagttttggaactgatatctctggtcggaacgcccctctctccgatgaggaacttgatatgatgcttccctcggagggttacaagattctcgagcccccgccgggatacgcaccgatccggacacctgcaaggaagctcatggcaaccccagctcctgttcccgcggctggcggagtaggagggtttatgatgcaggagcctgagagtgcccgcgcattgggcaagcagctgccaactgaaatcccaggtgttggcgatctccagttcttcaagcccgaagatatggcatactttggcaaattgatggaagggggcgatgagagcacgatgtcggtagaggaactgaaagagagaaagattatgaggctgctgctcaaggtcaagaacggcacaccaccaatgagaaagactgctttgcgtcaactcacagataacgcgcggcaattcggcgctggtcctcttttcaaccagattctccccctgctcatggaaaagtcactcgaagatcaagaacgtcacttgttggtcaaggttattgatcgcgtgctttacaagctagatgatcttgttcgcccgtacgtccacaagattcttgtcgtcatcgagcccttgctcatcgaccaggattactatgctcgtgttgaaggtagagaaatcatctccaacttggcaaaggcggccggtcttgctaccatgatcagcaccatgcgtcccgatatcgaccacgtggatgagtacgtccggaacacaactgcccgggcctttgccgtcgttgcctctgcccttggtattccggctctgcttccgttccttcgtgctgtgtgtcgcagtaagaagtcctggcaagcccggcataccggagtcaagatcgtccaacagattcccattctcatgggttgtgccattctacctcacctgaaaggtctcgttgactgcattgcggacaatctgagcgatgaacaggccaaggtccgaaccgtcactgcccttgccgtggctgctctagctgaggctgccaatccttacggtatcgagagtttcgatgagattcttaacccgctctggaccggagccagaaagcagcgtggaaagggtctagctgcttttctgaaagctgtgggctacatcattcctctcatggacgaagaatatgccaactactacaccagtcagatcatggagattctcctacgtgagttttcttctcctgatgaagaaatgaagaaggtcgttctcaaggtggtatcacagtgcgcgagcactgacggcgtgacggctagctatctcaaggaactcgtgttgaacgactntttcaagagtttctgggtcaggcgaatggcgttggacagaaggaactaccgtcaggttgtggacacgactgtcgatcttggacagaaggtcggtgtgggagaaattcttgaacgtgtggtcaataacctgaaggatgagagcgagccttatcgaaagatgaccgttgagactgttgagaagctcattgcagccctcggggctgccgatatatcagagcggcttgaagaaaggctgattgacggtgtcctctatgcgttccaggagcaaagcattgaggacattgtgatcctcaacggtttcggtacggtggttaacgcacttggtactcgctgcaagccctacctcccgcagattgtcagtaccatcctttggcgtctgaacaacaagtccgctacagtccgccagcaagctgccgacctcatctcccgtatcgcaatggtcatgaagcaatgcggagaagatgcgcttatgggcaagcttggcattgtgctctacgaatatctgggtgaggagtatcccgaagttctcggttccatccttggcgctcttcggtccattgtcacagtcgtgggtatcaaccagatgcagccacccattcgcgaccttctgccacggttgactcccatcctccgtaaccgtcatgagaaggtccaagagaacaccattgatctggtcggtcgtattgctgatcgtgggcccgaatccgtcaacgctcgcgagtggatgcgtatctgcttcgaactgctggacatgttgaaagcccacaagaaaggtatccgtcgtgcagcgaataacacttttggcttcatcgccaaagctatcggcccccaggacgtcctggcgactctgcttaacaacctccgtgttcaagaacgtcagtcccgtgtctgtaccgctgtcgccattggtattgtggccgagacctgcgctccgttcactgtccttccggctctgatgaacgaataccgtgttcctgagctgaatgtccaaaatggtgtgctgaaggccatgtcctttttgttcgaatacatcggcgagatggccaaggactatgtgtacgccgttattcctgttttagagacgcggcaggaa

SEQ ID NO: 19111 - DNA, 411 bp, A.fumigatus
tccggtgccggttttttttcggccggcgcagcaggtgctgcctcaactggcgcaccttccgtgccttcgtgcccttgcgccccactctcggccgatggtgccgcgccctttgattcgaccttcagatcgttcgtagtagcggggtcggtatcgactttctggttcggaacagcgacggggttggcgaccgcacctttgccgccagcagcaatggcagcggcgccagcctcagttgaaggcttcacggcagtagtatcagcagcaggtacatcatcatcttcccagtcaatgacgtcgtccgcggcgtcagtctttgcagcaggggcaggggcaggggccgttgcggccttggctttgttttggtcgtcttcctggaggcgagcgaccatctccgccttcttgcctgtgtga

SEQ ID NO: 19112 - DNA, 210 bp, A.fumigatus
atcttgcctcgcgccgcaatcgagggtgccatatccaaaataaatggcttctcctttcccgccggcgcaccgctcgccaaaggagacactcccatcaacttctctctcccaccccaaacaggcaacgccggcgacgagttcgtgaaaacaagactcatcattcccgcgtcgagcgcctgctgcaccacccacgcggacatcccgaaatga

SEQ ID NO: 19113 - DNA, 987 bp, A.fumigatus
atccttgaagtctgctacaaatgtggtgtgaaagttgtgaccatatatgcgtttagcatcgagaatttcaaacgctccaagttcgaggtggatgcattgatggatatggccaaagtgaaattgcaacagatggcacagcacggagatcttttggatcgctacggagcaaaggttcgagtgctgggtcggctggacttgttgaagcccgacgtccttgacgcggtgaatcgagctgtggaaatgaccagccgcaatggtgaacgtgtccttaacatctgttttccatatacatcacgagatgaaatcaccggtgctattcgcgatactgtcgccgattactcaaagcccctgcaatccatccgctcaaactcttccgcgcgaacaccattctccgaggctcaaattgcgctcaaaatccgtgctcaagcacagagtgcgaaggtggaacaagatacaattagtgataacgaatctacctccgtgtcctccataccagaagaagatccaagtgacagaagtgaaggtccagacagagtctacgaagcgggttccgggttctcctcctctacaacactacatctcggtgggcatcaagacgcggcgaatgggaaggctccagagctagggaacgcatcggaatcgggaaagattgtctttccatcaccagacaccatcacccgtcagacactaacagatcatatgttgaccaagggcaaccccccacttgatctgctggtccgaacatctggagtggaacgtcttagtgacttcatgctctggcagtgcgatgaggacaccgaaattgtcttcctggatgttctgtggcccgagtttgatttgtggcatttcctgcctgtccttctcagctggcagaggaggatctctaagtcgaagaagaacccgaggctgaaggaaactttgatggtgacatcagtgaaagttctgatgccgaattccattccggtgggaaacgtcaaaggcttgtaa

SEQ ID NO: 19114 - DNA, 336 bp, A.fumigatus
tttgtagcctgccgaacccttgagagtgcccagaagctctgccaaggtttccccaacaccaaggctattgccctcgatgtgaacgatgccgctgctctggacaaggctttcgagcaggccgaccttgctatttccctgattccttacaccttccacgcccttgttatcaagtctgccatccgcacaaagaagcatgtcgtcaccacctcatatgtctcccctgccatgatggagttggacgaggaatgcaagaaggccggcatcacagtcatgaacgagattggtctggacccggtatgttcagcatccacattgcgtataaatgtcgggatctga

SEQ ID NO: 19115 - DNA, 576 bp, A.fumigatus
ctcctgcccctaccgcgagcggtaccagatccccgaggcccagaccgtcatccgtggtactctgcgctaccagggcttccccgagatgatcaaggtgctggtggacattggtttcctcagcgacgaggccaaggacttcctcaactcccccatcccctggaaagaggccacgcagaagattctcggagccacctcatcggacgagaaggacctggagtgggccattgcctccaagaccaccttcacggacaaagattgggggcaaccgcgtcatctccggcattcgttggatcgcctattattcggacgagcagatcaccccccgcggtaaccccctggacactttttgcgccactctcgagcgcaagatgcagtacggccccggcgagcgggacatggtcatgctgcagcacaagttcggtatcgagcacaaggacggctccaaggagactagaaccagcacccttgttgagtacggtgatcccaacggttactccgccatggccaagaccgtcggtgtcccctgcggagttgcggtcaagctggtcatcgatggcaccatcagccagaaggtga

SEQ ID NO: 19116 - DNA, 309 bp, A.fumigatus
tccacaatggctacatcaatgcacctatcgaagctccgaaattggttcctcgcgtctccgccggccgagttcatcatagccaagctgcgcgagctattgatcggagcgctcaagcaagggccggtcccacagcacattgcatttgttatggacgggaatcggagatttgcaagatcgcatggcattgagaccgtggaggggcataatctgggattcgaggctctggcaagggtaagccgccccttttcgaagatctgcctgttgttgcaaaagcacccacccggttcttggctgttcgtctggtactga

SEQ ID NO: 19117 - DNA, 624 bp, A.fumigatus
ggcatcgaccacttgtacgctgtcaagaccatctccgaggtacacgccgagggtggtaagatcacttctttcctctcctactgtggtggtctccctgcccccgagtgctccgacaacccgttgggttacaagttttcgtggtccagccgcggtgttcttcttgcccttcgcaacgccgccaaattttaccaggacggcaaggagttcagcgtggctgggcccgacctcatggctaccgccaagccctattacatctaccccgggtacgccttcgtcgcctaccccaaccgtgactcctgcccctaccgcgagcggtaccagatccccgaggcccagaccgtcatccgtggtactctgcgctaccagggcttccccgagatgatcaaggtgctggtggacattggtttcctcagcgacgaggccaaggacttcctcaactcccccatcccctggaaagaggccacgcagaagattctcggagccacctcatcggacgagaaggacctggagtgggccattgcctccaagaccaccttcacggacaaagattgggggcaaccgcgtcatctccggcattcgttggatcgcctattattcggacgagcagatcaccccccgcggtaa

SEQ ID NO: 19118 - DNA, 408 bp, A.fumigatus
gttcgttcttctgactctgcttttagggcatcgaccacttgtacgctgtcaagaccatctccgaggtacacgccgagggtggtaagatcacttctttcctctcctactgtggtggtctccctgcccccgagtgctccgacaacccgttgggttacaagttttcgtggtccagccgcggtgttcttcttgcccttcgcaacgccgccaaattttaccaggacggcaaggagttcagcgtggctgggcccgacctcatggctaccgccaagccctattacatctaccccgggtacgccttcgtcgcctaccccaaccgtgactcctgcccctaccgcgagcggtaccagatccccgaggcccagaccgtcatccgtggtactctgcgctaccagggcttccccgagatga

SEQ ID NO: 19119 - DNA, 513 bp, A.fumigatus
tcaaggtgctggtggacattggtttcctcagcgacgaggccaaggacttcctcaactcccccatcccctggaaagaggccacgcagaagattctcggagccacctcatcggacgagaaggacctggagtgggccattgcctccaagaccaccttcacggacaaagattgggggcaaccgcgtcatctccggcattcgttggatcgcctattattcggacgagcagatcaccccccgcggtaaccccctggacactttttgcgccactctcgagcgcaagatgcagtacggccccggcgagcgggacatggtcatgctgcagcacaagttcggtatcgagcacaaggacggctccaaggagactagaaccagcacccttgttgagtacggtgatcccaacggttactccgccatggccaagaccgtcggtgtcccctgcggagttgcggtcaagctggtcatcgatggcaccatcagccagaaggtgagtcatcaacattctttcccgtgttaa

SEQ ID NO: 19120 - DNA, 243 bp, A.fumigatus
caaaatatcatcatggtcctccacaaccccaacaactggcactgggtgaataaggatgcctcggcttgggccaaaacttatttgaaagagaagcttcgtacgctatccgctgaggaggatggcgtctccgtgaagatttcggacctactgactatggacggcgacgtagacgtcagccagagaaagggcaaggtcatcactttgttcgatgtcaagttacagctagagtacgaaggttcgtaa

SEQ ID NO: 19121 - DNA, 834 bp, A.fumigatus
tttgagatcgagaactactctgattccgcctccaagcaaccggtgaaggaccttgttcgttcgaagcttgtcccccaaatcagacaagagcttggcaagcttgctcccgccttgatcgccgaacacggaaaggacattcaacatgctcctggcgttgacccttccagcggtttcgctacaccaccctcctatcctcagacttccaagggtgctagccctgctcctcagacgacgacgaccaccaccaccaccaacaaggtcgctgtcaacaccaccacagtcactgcctcagacgagttccgtaccaccgctgaggagatgtataccacctttactgatcctcaacgtatcgcggctttcacccgtggagcacctcgtcaatttgacggcgcgcaagttggtggaaagttctctatcttcgatggcaatgtgaacggagaatttgtcaagctcgacaagcctaagcagattgtccagaaatggcggctggcgcagtggcctgaaggccacttcagcactctcgagatcaacttcgatcaaaacgacgttgatgccgtcacccagatgcgtgtcacctggaccggcgttcctgtcggccaggaagatgtgaccaaacagaactgggacgtctactacgtccgcagcatcaagcagactttcgggtatgtcattcttccctgttccagcatccaattgcttccttaccatgttcctctcagatctcgtcctacgtcttggagacagctgctgattgctttgtttgttcttttcatcgctataggtttggcactattctctgatcgcatccacggagttctggaaaccacgtattga

SEQ ID NO: 19122 - DNA, 231 bp, A.fumigatus
gctgagggaagaaaaagaggcagaacggaaggtagggagaagacgcaaagctcttcgtggactttctccgttgctgacgatactggtcaggctcaaatacaaaagatcaaggatcggagagctgccaaggaagaaaaggaacgctacgagaaaatggcagagaaaatgcatcgcaaacgtgttgagcggctaaagcgaagggagaagcgtaataagttacttcactcgtga

SEQ ID NO: 19123 - DNA, 864 bp, A.fumigatus
gcagctggaatggctggcaaggtcattgaatatcctttcgacactgtgaaagtgcgcctccaatcacaaccatctcatattccacttcggtaccaaggccctttggactgcttccgccaatcaatacaggcggatggtctacgagggctctatcgaggcatcagtgctccactggcaggtgctgccatagagaatagctgcctctttttcagctaccgcatcattcaagatattttaagggccacctgctaccctacagcggattctatgcctttctcagctctattgttcagtggtgccgcttccggctctatcacctcgctcgcacttacccctattgagctcatcaaatgcaaaatgcaggtgccacttgaagcttctagcagcaagatgcccgggccactgactcttattgccgctatatttcgtcaggacggtattcttggtttctggaggggccagatgggaacgttgatccgtgagaccggaggaggagctgcctggtttggtggctatgaaggagtatccgccttttttcgaaaataccattcaacagtgtcgcctcgcgactctgagtcacttccaatctatcaacagatgatcgcaggggccgcagcgggtataagctacaattttcttttctatccggctgatacagtcaaatcgcgcatgcagaccgaggatatcaatagtccaggaaatagtggccataggcaaactttctggagtgttggcagagctttatggaagcagcaggggctgagggcattgtaccgaggctgcggtattacatgtgcccgttctgcgcccagctcagcgttcatcttcaccatatacgaagggctacggaattgtttctcctga

SEQ ID NO: 19124 - DNA, 216 bp, A.fumigatus
gcaggtccttattccaaattccgcgttggcgcttgtgttctcactaaggcaggcgagtatattgctggtgccaatatcgagaatgtcgcatatcctgttgggacctgtgcggaaagggtagcttttggtaccgcgatcgtaagtacttcttatgatgtctccttatccacatggcttgttagagtcaatgcatacggttggcccgaaacttcgtga

SEQ ID NO: 19125 - DNA, 465 bp, A.fumigatus
agactttcacctatcacgagtagtgagtggccaactgagattcttggtgtagaagcccttagctccaatttgtccgagctatcagtatccgttcgagagcgtgcagccaaagatgccgccaagaaggaagccaaagctgctgctgctgaagcacgcgacgccgagcgaaaggcagcggccaaggttcagatcaagcgtgttgagcgcaacaaacgcaaacatgtcaccgttatcacagggttggaagtacatggtttggaaaacaagaaagtcgcaaaggaactgggaaagaaattcgctactggttcctcggtaacgaagtcacccgcaggggtcgaggaaatcacagtacaaggtgacgttagtgaggacgttaaagagtggcttctggaactatatgggaaggagattcctgaatccaatatcgagcttgtcgaggataagaagaagaagacaagtggctga

SEQ ID NO: 19126 - DNA, 192 bp, A.fumigatus
atcactccggctatgcctgcatctttgatgctaggttcttacgagttttattcgtcggctttatgtgacatttgtcctcgacatgactccacggttctgtccgcctccagacgctggacgacttgcgttgctgccccttattcaccagctttggttaatgacagcgcctttgttaacttcaagatttattga

SEQ ID NO: 19127 - DNA, 309 bp, A.fumigatus
gcaactgatccaggtccgaccatgtcgcgacctctcccagcggtgttccgccccatcttggggcggcggaatttctcagtctccgccaacaagagagccatcaataaagtatgcgcgtctgctcaggaagccatcaaggacatgaagggttcgtctactgtgctgtgcggtgggtttggtttctccggtgtcgccaataccctgatcaatgctgtgcgtgatcgtcccgatatcaaggatctgactgtcgtctccaacaatgctggaatgcctggtgctggtttgggtatgttatctgccatcaggtga

SEQ ID NO: 19128 - DNA, 246 bp, A.fumigatus
catctttcaggccaactcctcgagtctggtcagattaccaaaatgattgcttcgttcatcggtgaaaacaaggtctttgaaaagatgtacctgaacggcgacctcgctctggaacttacccctcaaggcactattgctgagaagtgtgcggctggtgcagctggtatccccgctttctacacccccgcagcttatggaaccattggtaggttagatcgggatttacggcttcaaattcgcagctga

SEQ ID NO: 19129 - DNA, 216 bp, A.fumigatus
gaacctagcatcaaagatgcaggcatagccggagtgatctataactatattgttccccaatcagacatgcagagtcaattattagcccgtgaaatcggggtccataagaccttattcaatatccatgaggacatcactcattatgtgaaggacgtgagagaactttcggacgctccatttcccagagtccttcaggagccccgcgtagtcgagtag

SEQ ID NO: 19130 - DNA, 207 bp, A.fumigatus
agatacggactgtccaagacttatcgtatcaaacactcgctcaatgctggagaatacatttccacctctcatatcgtcatcagcgcgcatataaacaaatctctcgccataaaccaagcatcaagcctaccccccgtcgtggccccatccctggttcctgacgtcaaggatgtggaccggaccagggtggagatagttattccttag

SEQ ID NO: 19131 - DNA, 339 bp, A.fumigatus
gttagatcgggatttacggcttcaaattcgcagctgacgatagcagtccaaacgggtgaactgcccgtccgttacaacaaagatggcaccgtcaaggaatactcgaaacccaaggaagtccggcaattcaacggcaagaactaccttctggaagaatccattttcggcgactacgctttgatccgtgtccacaaggccgacaaactcggtaactgccagttccgcaaggccatgaacaacttcaacgaggccatggctaagaacgccaagtacaccatcgtcgaggccgaccacattgtcgtcttcaccacggggctggaaggatccgcgatggtcaag

SEQ ID NO: 19132 - DNA, 402 bp, A.fumigatus
  unsure (3): Identity of nucleotide sequences at the above locations are unknown.
atngtccacgccatgttgcgctctttctcaggggcaggtaaatgcaagtgccgaataccggtctcgaggcagccagtctgtggtcggtcgctgagaatcagcagcacactcactccatggaatcaatctcggagagctgcgtcgaccgtcactagcttggacagttttccgaatgtcggggagaaacttcatgggtttacagtccaggagaagaaacatgtgccagagttgcaccttacagcagtacggttaaagcacgacaagacagacgcagattaccttcatgtcgctagggaggataagaacaatgtctttggtattgggtttaagacgaaccccccagatgcgactggtgtaccacatattttggagcacaccacgttgtgtggaagtgaaaagtga

SEQ ID NO: 19133 - DNA, 279 bp, A.fumigatus
aatcgtattctaacactacttgttgcagatctccgtctgatccaaacccagctgaacactttgaaacggagcgatccgtctacactaagcatccacggcgtccttgcagaacggctccagtcaggaatacagagtatgcacaccccgccggacaatggacctgattttgcgttcccggcgccgaatatggattattcgtggaccatctttgatcagcagatcatgaatctagccaacccgccttggctttttgatgactcttcccaagcgccgccatga

SEQ ID NO: 19134 - DNA, 3042 bp, A.fumigatus
agcacgacaagacagacgcagattaccttcatgtcgctagggaggataagaacaatgtctttggtattgggtttaagacgaaccccccagatgcgactggtgtaccacatattttggagcacaccacgttgtgtggaagtgaaaagtgagaaagcttcggtccgactcttgcgcgagtataaatgcgcctttcgagacggacttattgctgatatgcctccacattgcagatacccaattcgcgacccgttcttcaagatgcttccgcggtcattgtcgaattttatgaatgctttcacctccgccgaccacactacgtacccattcgccacaacaaatcggcaggactttcaaaacctactatcagtatatttggacgctaccctacacccattgctgaaagaagaagacttcagacaggagggttggcggctgggaccagaggaccctcgttctattctaacccagggagagcaatccaagggaaacctgcagtcagaagatgtggttttcaaaggtgtcgtctacaacgaaatgaagggacagatatcagatgccaattatctctactacatcaaataccgtgaaagtatctgcccgtcgctgaataactctggcggagaccctcagtacatcaccgatttgacgcaccagcagctggtagacttctccaagcggaattaccatcccagtaacgccaagatcttgacatacggagacatgcctctgagcgtacacttgaaacagatcggtgaggtactggatggttttgaaaagggacaggccgatacagatgtcaagctgcccttggacctgagtcgcgggcccctgaatgtcactgttcccggacccatcgacacattcgccagtgaggacaagcagtacaagacctccacctcttggtacatgggcgacactaccgacgtcgtcgagacgttctcggtcggaattctgtcttccttgctcctcgatggctatggttcgccaatgtatcgtgcgttgatcgagggtgggttagggtcttcttttactcccaacacgggccttgattcctctggtagagtgccaatcttttcagtcggtcttactggcgtgagcgaagcggacgcaccaaaggtcaagtcgactatcaaaagggttttcgaggagtctctttcctccgggttcaatgatgagaaagtccaaggcttccttcatcaacttgaactcgcgttgagacacaagacggctaattttggtattggtgtcatggagaaaaccctttcatcatggttcaatggttcgaaccctatgaaggagttgtcttggaatgaagtcatcgatgagttcaagaaaaaatatgaacaaggaggctaccttgagtcattaatgcaaaaatatcttatgaacgataactgcctgacatttacgatggtgggaactccctcgtataacaaagatctcgatgatcaggaaatggtgcgcaaggaaaagaaactaagtgagctcgttgaacgccatggctcagttgagcaggctgtctctgcgcttgctgaagaagagcttcagttgctcaagattcaagaagaggcgcaaaacgccgatttgagctgcttaccctctctacgcgttgaggatatctccagggagaaggaacgcaaacccgtgcgggagtccaagatggatgatatagacgtcgtctggcgcgaagccccaacaaatgggctcacatatttccaagcattgaattctttcgaggagctcccggatgacctgcgattgctattgccgctgttcaacgattgtatcatgcgactaggcactggagacaaaaccatggaacagtgggaagatctgataaagttgaagaccggcggaatcacaacatccactctccacacatcttctcctgcggagttgggtaaattcagggagggcctgcagttctcaggatatgctctggacaacaacattccggatatgctgcagattcttactacactcgtcactgagacagatttcaccagcccgcatgcgcccgccatgatccaggaattaccgcgcatgaccaccaacggcgcgttggacgctgttgccgggtcaggccatcgttacggcgtgaatgcggcagcggctgtttgttctcggagtttttgggttcaggaacagcagtcaggcctggcgcaattgcaagatacggcgaacatcatccgcgacgcggagagttctccagaagttcttgctgagctgatcgataagctccggctgatccagtcatttgctatttccaaaggctcaggcctccgtgttcgcatggtttgtgagcccagcagtgcatcgcagaacgagattgtgctccagaaatggctggcaggactacctcgtaataggtctcccacttcgccacttgatcataccagcgtgaattcagtagctaatcgggtgttatatgacctgccttacaaggtttactactctggacttgatatgcagacggtccctttcattgatccctctagtgcacctctcagcgtcctttctcaacttctgacacacaaatacctgcaccctgaaatccgagagaagggaggtgcgtatggcgcgggggccagcaacggccctatcaagggattcttcgcctttaccagctaccgggatcccaatccagtgaacagtctcaaagtcttccagaacagtgggatctttgctcgggatcgtgcctggtcagaccgcgaacttgctgaggccaagctgggcatcttccagggacttgatgctcctatgagtgtcgatgaggagggtgccaggtatttcatgagtggtgttacccatgaaatggaccaacgttggcgagagcaagtgctcgatgtgactgcaaaggatgtcaacgaggtcgctcagaagttcttggttgaaggctctcggcaatccatctgtctgctcggcgagaagaaggattgggctgattccgacgactgggaagttcggaagctctctatgaatgcctcaggcgagccggtaatcgatcccctgagccaagatggcgccgtggcgtcggcttaa

SEQ ID NO: 19135 - DNA, 267 bp, A.fumigatus
  unsure (24),(45),(198): Identity of nucleotide sequences at the above locations are unknown.
tataccaccttcactccctctgtntctttttcttcttccttttcncgtctccatcgttccagcgcgtctcaagaacaaatctcgaccccgtcttcgatcttgatcgccatggtcggtaaatggctggtcctcctggcctctcaagcctggagtaagcgcaagatcaataagaatgtgaacccacgaggtacactcctngtctccgtttctcagaccctctctgaactgtcagcctacgcagggcggactaaaaacgcgagaacataa

SEQ ID NO: 19136 - DNA, 363 bp, A.fumigatus
gctgcagcggtccaatcaatccctgaacggtcacagagtgtgcagggcgcgctcgtgtatcatccttcgtctcccgatcaggattcttcgtctatcctcgggcgtctggagcggatcgagtcactgctaggcattggtaaagagggaaacaggtcttcattgctgaccatcgaccccgacctggaggaagagtctgacgatgtgtcttcccgtggactttggaaagctgttgagcgtcttaagatcatcaccagtccgcctcaggatcagaatatctggtcatatgcggtcgtcacacgtttatggatctcgtatgtagcccatacttttgtttcccttgtcccttctcggtgtgcgaactga

SEQ ID NO: 19137 - DNA, 315 bp, A.fumigatus
ggagttgacactaaccggcacatacggacagagcgtgaggtcaagaaggctaccagagatttgaaccaattgctcagcaacatcgagtcccccatgaccagactggagactgtgcacaagaagtacaccgaactgttggcggacatgaagaagctggatcgcgactatgccaaaagcaaaaagcgggccgatcaactccagaaggaccaggacaagggcaagtcggaactgaacaagactgtcaccatgaaagataagctggagaaactctgccgagagcttaccaaagagaacaagaaggtcaaggtgggttga

SEQ ID NO: 19138 - DNA, 312 bp, A.fumigatus
cctttgcattacagtctgcgcgccaaaattaagaccatcggcgaaaagttcgaaatgcgagagttgcattataaagcgctcttgcgcagcaaagatgccgagatccagtgcctgactgccaagtacgaagaacagcgccgcgctgccgaaaatgaagcggcccgttgtcgtgcgctcagttcgcaggtgtctactttttcgcataccgaagccgagttgcgtagccaactaaatatctacgttgaaaagttcaagcaggtatgcttcggcgtcctttaccaggcccatcatttctgttacaatagcaggtaa

SEQ ID NO: 19139 - DNA, 189 bp, A.fumigatus
ctaagcaggttgatctgccttcgcatattcctccggtacgtctgcctctatcctggtattcatggccaaccagctactaacgacgatgaacaggggaagtacaacgtccatgccgacgtttatactaaggacggcaagaagattacctgccttgatgcgcacgatatcgagttcaagattcggccatga

SEQ ID NO: 19140 - DNA, 1119 bp, A.fumigatus
  unsure (357): Identity of nucleotide sequences at the above locations are unknown.
tggagtgccgtggatgagctggtttgtatgtcgccgacaattcaaggagcttgccggggggggttcacagaggatgagtcgctaatcggtggctgctggcaggcttccttcattgttcacctacttgcgtgcttcagcgcgtccaatactttctacaccttctctcggaagcgactttatcgtctgtttgaggcttcgatagatcaaccaccggctacaccgtcggctcgccgtgtccgtgtcgattcaaaccctatggcagcttcgccgttgcggtactttgcaaatgtgatagccggatctgctgagtcccgggcgcatcccgacgcgcaacgggatgtgtgggaacttgcagtntgggatcctctgccgatttgccttcgactgttctgcctcttcagccccgggcacgtcctggtgtactgggtatttctgcctacgcaactgtccgatcctcggccaagcgttactatcgtcaccactatcttcattacgactctgctgtctgtgcagatgtcattcctctcttcctcgttcacgcagcaagccaaggattccatggtggttcacaaggaggttcttaacgagtacgacaccaaatttgtccatcctaggacccaacccgtgatgagagatgttggcacccagttctccgacccgaatacctcgcagcctggttccgatgccaagtataacaaggtggacacattcactcctactctagtgatccaccgagggttcaaaaccagccccaatccgaactatgtcacttttgtcgatcccgagggggcgtcccccccgacgtcagatattcactacgccaaatgcttctcacaactatacgtcgctgcaaacaccctgtcatttacgagatgcctccccggttgtacgaggccccgttgcgtccatacgccaaccgcacttccgacccacaccgagtgctacgggcgatggtggcagtttgggaatcttctcgcacgcaaattcccccttgaggcgatctacaccggccaatatcgaccgccgggttccgaaccctccagagttcttattcaaagaccgaggtacccctatgaagaggctatcaagtcccttgaaaaagagcaatgtgcccggtag

SEQ ID NO: 19141 - DNA, 1674 bp, A.fumigatus
agccgaccgcaccaaagtcatcaacaacaagataattgtctcttgcccaaggaatgggtaactgtggaaggtctacctggccttgaagtccagccggtcaacaatcgtcaccttcgatacagtatggatgaggttctgcacttgcaccaggggcacttcatgaacctttcgccccgaaggcgccatgataagcggaaggagttggacgtggaagaagtagaaaatacgcatcaagagagaaatacaccagaccgcagtggaagcccaatgaattcgagagacactgattctggaactggaagtccaactatcgcgcgaagaaccagaccgacgaagctccctctgcccagggagctcgcaagcaaagtcaaggaacaacaaaaagatcaacctgcaacgcctcaagatcaggactatggttctctcaggaacgtccgaccaaagaagccgcctacaaccttattatacagcagtccggacgaggttcgagagcaatattggcgaaaggtcagggataagtttgagaaggaatccccatcggcgaagagccaagagaaggagaaggacaaggataagcacaaggagatttactatggagcttataaaaagatcatctcgctggccagctctccaaagagcgaactggtcaaacagagactgaagtcggccggtggcgacctacgaggaagcccaaagtcgcggatcacgagccccatcatccatcctcggcttcggccaggctacagctcccccagcaaatctgacaaccagttaatcagtcaagggaagcgacagctcagtggagttcaacgaaagaattctgatacggacgagagcattctgcacttttccacggacaagacggataacgctaccgactcgtcgattaactctcactcttctctgtcacccgtgtcgggccccagtagctcattgacggactgggaggacaaattcgttgtcaacatgccatccgccaaagagccaaacccaccgacaatgagtgcacagcagattgcggaattccagcaaagcatcgagcgggtgcacaacgacgggggtgctatgcttgatccagactctttgccgagtccacgtaccgggacgcctgaagacaaggatttgtctgctgtgcagcctgcgaagccgacctcgtttgacggtcaagatctgcctcccccacctccccattcggccgggtttgaggaaagtccgccatcccagccagaacatccgaggtactactgtcccgatgagatcggcaaaaatcgcatcagtacaatatgggaagaatctgcctcgaaatccgagaagaatgtaccaaaggtcaatccggatggctcttttttagggtgcaaggagatcaatgggcccaacgacaagaaccccgacgagatcctactgttttcgcccgtggatcgtccccgggtagtcgacgtgtcgagtcctatgcccagaagccccaaagaaagaaagattccagtggtccgccagaggaatccggacctcggagagaagaccgtcgctcgagaagaatggaaaccaggtactctgaatatgaaacttgtccaatgctcgaagccatcaccgaggaccgtgtgccgcgagaccagctgccagcaaccagaaaagacagcccagaagtcgagcaaagcggaccgggactccccgtaa

SEQ ID NO: 19142 - DNA, 294 bp, A.fumigatus
gtgaagaacggttggctgattcttgaccacagtggccaaactctctctatcaatgccagtggcaacctgaaggaacgggtggaggaaggcgcttatgtcgctcttgaggttaaatatggtctcattaccctgatcaagcagaccgccgatctctgcgaacaaatcaagaatgtggacctcgagtgtcccctggagaaaggcgagatgactctgactaagcaggttgatctgccttcgcatattcctccggtacgtctgcctctatcctggtattcatggccaaccagctactaa

SEQ ID NO: 19143 - DNA, 339 bp, A.fumigatus
cacgtcacagatggcccggacgcccagcggaatttccttgtcgttgactccaagaccgaaacgtctgcgatcgagaaggccttccagaacttcacccaggagaggaaagatattgccgtgctgctgatcaaccaacacgtacgttgtattgcattctacatcaccagggaccagctggctcataggatcagattgccgaacgcatcagacacagcgtcgactccttcgccgacccgttccccgccgtcctcgagattccgagtaaagaccatccctacgaccccgaaaaggacagtgtgctcaagcgcgtgcggcggctatttggtgaatagacggtaa

SEQ ID NO: 19144 - DNA, 2289 bp, A.fumigatus
gtattccagagagtccattctgcaaccaacctcctaatcttgtcctcagatgcaagagtgccagcagaggcaacaccgcgtgcggtagcccgaagcattctgtatcagcttttcgataagcgcatcggaaacgtgcagttgctgcagatcctgagtgtcgcccatgaacgcagcaagaaggccactagtgagcaggattatgacagtctgctgtggaatgctttggaggcagccctcagcgtggctttgcctggtgccaaagagcttgttattgtcgttgatggcgttgacgaggcatcctgcagtgaaacagccatgctcaaccagctggccacagccactgctaaggggagtaacgtgaaactgatcactctcggtgcactcaagcctcccactgcagcaggtcaagcctttgtccagatcaccgaggaactcatcttcgatgatatcgccgctgttgtacgaagtcagttacagcagagtcgtgtcttcttgggcatgtctgagctggaccaggagaccatcgttggccgcattacggaagcgtcccagggctcattcctctgggggaagctcgccgcaaaacgggttcgctacgaggggactgaggaaagcctccacaaggccgtggatgccttgttgagtgccaagcttactcttactgactttgccctccaacttctgcaaggacccaacgtcacggaggatgcaaagaacatgttggtctggcttattacagccgatcggccactttcattcaaagaactcgagcttttggcgtctatacagatcgacaagctcacggtggcggaccgtaagctggacgtattgcaagtcttgaaaccactcaatgttctggtattcgtgcaggatggacaggtttttattcgtcatggcctcttccgagcctcccttttggagatttttagcaaaggcaaactcgtttcgaccgtcaaagaccaccacgccgatctcgtgactcgcctgttgatttacatccgggcgacggtgacgcaggagaacgaactctcccttgtgtcgctggactggcacgataccgaccgccttatcaacagaaatcccctgctcgaattcgccgtccgctactgggtgcaccatgttcggcaaacctcagcgttcacagccaaaggtgaggtcgcagcagcgcaggagtttgccaaggtgctaccggcttcgatcacgaccctgcggcttgagagcacactgtgggaaaacgtacctacacccacgctgctgctctacttgaccactgtcaccaacatctaccgccagatgctgtcagcgaatcacgttgtaactcttcagtccatcatcttcttggctcttttgaaccagcgcctggaatatacctctgacgccattcctctgttctttgaagcggccacgctgagccgcacgcttttgacttcacgtcatatcgtgacaatgcaaatggctagaaccttcatcgagttgacccaacagatgaccacaagcaccaagaccgagattatggtcaagagagaagaggtcctgttgctgttggttgagtgctacaagcgtcactatggagagcgttctgaaactgtggtcactcttctcaggcaattgatcgaccactacaccctgatcaaggaagaggagagggttaaggagatcgccgcttcaattacgtccattaccacccaccatggtcgtcatggttccagcagtgctaacggaggcctggagatccatctcaacaagggcattgacagatcagttgatatcggtgtcgggctttcgctggattatgaagaaggcgatgaaatcatccaagaatccgagtcgtacaacgttaaggaatggatcaaaaaggccgagatctacgtggccgaaggcaaggtcgaactcgccgagcgtacttatgtcgagatctggcagcgggtgagcagagagtaccgcactcattactctgcgtactgggaggagcggaagatgactactgtgctggcgtactccaaattcctcgtgtctcagaagagagcattcgaggcatcctctgtgttgaccagtctgtggcaagagtatgaacaggcaagcatctcgatctccgaaacttccgtgtcctacttccaggaagtcgccaaaatgatgaaggtcgttggtatctacgacgtggcactcttagtctacaagcgttgctccagatactatgagagcatcaattcaacccacagctcgacgtacaaggagattcaggagaacatccgaacgacttcgaaggaagttgtcaagtccttcagttag

SEQ ID NO: 19145 - DNA, 2835 bp, A.fumigatus
tcgaactcggtcatatcagaaaccaccatcgaggagatctttatcggtggctccagctcgaccgagaccgttgaggagtcttcatttacagctctgcatcggtctcttgagctgtatatttctcagcatcgctggcaagatgctacgcgcctgcacaagaaaatcctacgttttgtctggccttctctctttgcgccatcggttcaggatgtcaccctccccgagaagtatgtcgatcattgcgtggaacttgctgcccgtctcagtctatgttatcattcccggcgtcgcttgagcaaggaagaggacatccgcctgagggtgtaccgagcagtccgtgccgagaggaaagtggaagacaagctgcgtgagcgcgctactgccgagttgcttcgtttcttcgagcatacgtcgcagacggagatgatcatcaacctccgacaggagatgctgggcgattatattgaagcctacggggctgagcatgagcgtgttatcaaaattctctgggtcctagccgagctaacgcgtcctcgtccaattttcatcgagtattaccagcaaatcattcgagcgttgaacaaagactcgcaggtctgtcatccagaggccattgagccgatggtcattgtggccaccgagctgtggaatcaaggacgctatgtggacgccctggcctactacaaggtcattttcaatacgttcctgacccagcccaagctcgatcccaagttccaggtccaggaacttgtccaggagcttttcgagcgctacacacgctgcttgcgcagcgtccacgccgagctcactgtgctacacaaggtcactgtggaataccgagctcggtgtacggcagtttttggtgtgactgcatctattaccatccgagccaccctgacccttgcgaagctctgtcaggagtccaagcgcttcttgtctgaggcgatcactctctatgaggagcttctcaagatcgaatccgcggagctggacagggatgagatttccgtcatactggatggtctctctgaagaacaagcagagtcttctagctcttccactcacagtgaacggacttccaaggtcatgcggaagcgcatcactgacgtgcgtgagacgcatggatgggcccatgaggaatctctgactcggatgaaagagatgatctccatctacactgagcggaaggagactgaaactgtggtgcgcgaactcaccgaggcgaccgtgcaaattctcatgtccgaaacttcttccactcgcttgatcgctgccgccagcaccatcgcgtcgtgctatatagaagcgggccagacccagaaagcggtcgagctctcgcacgagatttatcggcagattgtgatgaaagacgtcgtcaacgttgagagtgttcagtttgatctctcctccaaggagcgcacgagtctcacattcttggcgcagctcgagtatagccttcggcgcaacacttctgtcaccgtgacggagatccttgcctcgttgacgacggaatatgtctacttcgaggagttccggaggttgctcacgtcgaagagcagctccatccagactctcaccgtgtctgctgctcgcctgtatcacttcctggttgctaatggccggcaagtcgcggcggcccgggtcttcaatgatttccttagctatttcgctgccacggagggcaagcgtgtggatctgcccgagacgtcgcgggtgaagatcctggtcattactattttggaccacttcagcacccatctttcgcacaactttgtccgttccattggcattgcaagcgtccatcgggtcacggaacttcttaaggaacaacgttatgaagcggcttgtgacctggcactggccagcttcaaatacctgtcagctcacgattcctaccggagccctgttctcgtcaagttcgcgtttatcttgggtatggccattgccgggcgcgatattgtcctctaccccgacgacgccattcgcaagaagctcctcggggtgtccgcagtcatcatccaggacgctctccgtgtcattgacggactgaagatcgacctgtcgcagatcggcctccatcagctgaacaacctcatcggcctgctgggcgagcagcaagactaccaaactctggcttggctcctgaccaagctctggaccagccgcgaagctcagcgtacctggaagccatatatcacactcgcgctgggccgtcgcctcgtcctggcccgctaccttatcggcgacgcgaagacggcgctgcgcttggctgaggacattgtgtacaattgccgccgcgtgcacggcgcctgccaccccgctacactggattcctctgttcttttgtcccagctgtacattggcgtcggcctgcggtaccagtcccacaagaacggacaggagatggccaaccggtactacaagaagagcgcggcgctgcacgaattgctgctgcgcaatttcagcgacccctcgtttgcggaactcgagtgcggtctcgacaacagcatgagcctggatgggtccgcgtacgattttgacctgggtgagccgatcggccacgtcccggacggcgagagtgtgcgtcggcacctgtacctgctgaaacttgccgtgcaacggttgggcgattggcccaaggactacagcgagtatgagcggctgaacgcggacctcttccgggagtttgcgtctgatctgaagggtgtggagggagtggagaagtgggatctgaaggcctatggggcaggcaaggcagaagggaatgcagacattttggatactgagttcaagggatgggagttcctggaagggcctgcgccagtcgaggggtaa

SEQ ID NO: 19146 - DNA, 327 bp, A.fumigatus
ccaaaaacagtgtctgatcccaaggcaatcaagctatggctgagccctgaagatcgtgttctgggtaatgtcgcggagcaaagttcccatctggcccatgaccgggaggaaatgacctgtctttggatggcgccttacttggcgcgctttttgaagagtccgctcaaaactcttgctatcgctggcaagcctggtgccggacgaacggttttggcctctgtgattgttgatcagctgcagcacacgatcggaggtgtttcctacgccacattgttcgttcccatcagtgagtattccagagagtccattctgcaaccaacctcctaa

SEQ ID NO: 19147 - DNA, 249 bp, A.fumigatus
gcctgtcacagatgggatggacttcgtgggccgcgagggctgaagtttgccaagcatgctaatcttttcgtgaagtctctgagtggaagacttggtatgggccttgctagctgtggcgtctgcttctgcctcaatatcatcttgcagctgaacaccccttctaccttcatcaatgtccataccgtcatccagagctggctcctcatccacagcggtatttctgtgtccaccggtctgccgaccaaatga

SEQ ID NO: 19148 - DNA, 342 bp, A.fumigatus
atccttcctatcgcatttgtttacatcaccatggcgcctgccggaccgagggtgcagaagcctgtgggttctgcagcatggatttcaaccgagaaggagaactttgcgcagctggtcaatcaggagatggaagagattgagtatcctgtgcgccatgaaatggattggttgaatgagcacatggcagaggtgttctccagcaatcaattgtgcgttctgatctacatctcaatcaaaccgtcgacccttgctgactgcaagatagcaatcttactgatgtgttcaaaactcctggaaaactccggggtaagacacctcgcacagcacggaagcgaaatgtaa

SEQ ID NO: 19149 - DNA, 2727 bp, A.fumigatus
cagcctttgagtgaaatcttcacaacatcccataatcaaggagaccgcagtcgtaatgtcagccctgcccgttcgcccgtcaaacccaccgccgcgccgatcacaactacgccatcggagccaaaagtctctccagccaagacgagggacaccgcagagaatgccttgcagcctcaataccctgatttaacccagaacttgaactcgttcccccagtataacactgattcgggctaccatggcatgccggacgacgagggggaggatcaggacgatgatgtggttctcacccaagtgcagtcggagacgcagacatctacacaacctctcgaagacgagcccgtaaccaccattgaaaatcaaaatcaaccacagcgacagtctattgatcgtcgtacaacagctgcttcattccactcagctcaggaagacgtacgccaacgcggagagacggctgagcctgtggagaagcctgtgcaagctaccaacaatgagacaacgtcaagacaggaaaaggcggcttcatccacgcctcaacccgagaagaagcagccggaagcaatcgtcgtggcagattcggcatcagatcaggaaccagaggccgagtcaaagtccgagtccaagccacgggcggaaccacaaacatcaccaaccaagtcttcttcaacaaaacagccagcagctccggtggaagaagagatccatgaaaaggacgacacgcctcttgactccctggatgacatcggcacgccttcagataactccactccggaaagacctcccatccgcaagagcagcctgagctttgcatcgctcccagcacgggagccactgttgaagaagagcttgggtggctcgagactctctcgcacaagccacgttgatattgctagagtgaacaatgctgcagggcctagctcatttggtcggcagaccggtggacacagaaataccgctgtggatgaggagccagctctggatgacggtatggacattgatgaaggtagaaggggtgttcagctgcaagatgatattgaggcagaagcagacgccacagctagcaaggcccataccaagtcttccactcagagacttcacgaaaagattagcatgcttggcaaacttcagccctcgcggcccacgaagtccatcccatctgtgacaggcctagcctccgctcatgttgcttatcccgagctcccagcagccagtgcaaagtcagaggtactccatctggaatcccgcgagccggcagcaccggagcctatgacaatcgacgaggatgactggattaagctaatagagtctcccaagaaagcacatgcccccagaagcccgagaacggaagtaaaaataaacaaatccacgaatgagacgagtcgcccatatagtgagaaggtatcgctaccacgagctcaggatcgaagtgacgcgggcgcagcgagagccagcaaccgaaacatcacagaatcgatccgtgaaaagtcctcaacaccagcttattcgtcaccccaacggccttcccatcagaagagtgcgtcagtgtccaatgcgggccaccacgcttccacaacaccagtgggatctcccgccgccgagcgtcatgatggccctctgagtgcatccaagttgaaactccaatccatcatgaaatctgccaagggtctgtttacgaacactggcagtgtggcaactgcagcaagattggaagcgtcctcgcctgatgaactcgggctgcattcgtacaatagtgcaagtggcaatgctgctcgtgaaacacaagaccgtcggcctgtccagatatctagtcctctccctcgacaagaagggcgcagaacgcgaagctcgacggagagggaagaaaaacgcaagcaaaaagagcttgaagatcgtcatcgagaagaggagcaggcggagaaagcactgatagaggaacgccagaaagcccttcaattaaagatagctcaagaacgggcgcggatggaggaagaagaacgtaacgctcctccgtcggcagtcgccgctccagccagctcgaagaaggcacagccactacagagacatcaatccagagagcccgagcccagccatgaggctgtttctcggccacccagccgaatgtccgtctcccaacagcagtcaaaacagaacgatcggcgtcctgttaagcccactcgcgaagttctccagaaacccaggcctcaggccgtctctattcgtgttggcagcgcgctttcgcgccagatcccactgacatccacttctgtggcatctagcgggccggaacccagtgcttctgtcgctgcaccgccctcggcgtccaagccgccaactctcaagaagaaggccagcaattcatctttacatactgcctcttcaaatagcagtttcaagagctcagtctccagccaatcgcagcgcaaggttcagctcgcgaatgagaggaagagggagcaggaagaaagagaggcgcgccgcagggaggagcagagacgtgaggcagaacgcaagcgagctgctcagcagcaagaagaattgcggcgtcaggaaatgcgcagccgagcagaggctgaacgccgggaaaggcttgctgctgaggacgcgaagaaggccgcccagatacaagcgatcgagaagcggagacaggaaaatgcgcggagattggaaagacagggtagtcaacaacctactagcgaacgtgtgagtgagttccatgagtggctttga

SEQ ID NO: 19150 - DNA, 456 bp, A.fumigatus
ccaccattgaaaatcaaaatcaaccacagcgacagtctattgatcgtcgtacaacagctgcttcattccactcagctcaggaagacgtacgccaacgcggagagacggctgagcctgtggagaagcctgtgcaagctaccaacaatgagacaacgtcaagacaggaaaaggcggcttcatccacgcctcaacccgagaagaagcagccggaagcaatcgtcgtggcagattcggcatcagatcaggaaccagaggccgagtcaaagtccgagtccaagccacgggcggaaccacaaacatcaccaaccaagtcttcttcaacaaaacagccagcagctccggtggaagaagagatccatgaaaaggacgacacgcctcttgactccctggatgacatcggcacgccttcagataactccactccggaaagacctcccatccgcaagagcagcctga

SEQ ID NO: 19151 - DNA, 927 bp, A.fumigatus
gcttcaattgtccagctagagagacctctttcgcaggccgccagacccgcatcacggcttggatcgattcaacctttcagtcggacgatcaacccacctcagcccaatccggccaaaccaccaaagagagggctggatgaggaagccagctaccgtccggtagctatgaaatccagtactgtccaaccttccggcgaatccaagcgcaggaagactgaagacgaacacaaccctatgtccgccattcgacccacaatggccccgcccatcagacagtcgggtatccgcaaggtaggtttccaccaatatcaaatcactctggtcgtgtatgctcatctcgcactccaggaatccatgaaacctcccatgtatggccacggacaaacttctacgcatcaacaaggctcttcaatcttcaaaaccgcccagccccaaagaccggctcaccccatggatatggcaaagtacgcaagcggcaaaatacccttcgcagagccaagcagtgccgcgcctcagctgccggggcataagactccaggcgccagctcgtctcaaagggcaccagcgaaaccatctcccaactatcccaacagcgagaacattcatcttcccgagattgctaccgatagtgaggacgaggactccgatgcggagatgctccccgtccccaagtgggctcaacccaaagagctcgagaacatccttcgccagcaggaaggcatggaggcagactctatctttggtcccatcgctccgttctcactggaggagacattcaaggcggacaagaagatcaagaaattccgtgagcgtaccagcagcgccaactggtctggtgctgatggactgacccaagaggagattcggcgtgacctcgccgaacgtcaacggctgaggctcaacggcggctggacctttacctcataa

SEQ ID NO: 19152 - DNA, 1536 bp, A.fumigatus
tgcttcccagctgtttcgcggagctcatccagtgcgcggaaaaatgaccgtctacaggaacgcttggctcgagcaatggctaaatccaatgccgccgggaatggtgtgtcgcagtcccctccgggcacggtctactcgccagccagttccctaccgagtaacggcacacgatcaagtttagatattgaatcgagtattatctcaactacagggatcgcagaagaacgcccggatagcccgcttgtccgagaagcacactcactggaactaccggccgactctaggactagtcacgactccggtgctgtttcgcgaaattttaaggagctcaccgcaccgcatattgacgagatcgtatctacggaagagtctatagccgaaccacgaccttcgcaagaactgggcacagcagaacaacatgagaccggcgatctcgagagcccgcgagtatcgcaagacttgaaacaagctgcgaaagacaccgcatcggatataaatagcgataatccagccattgcgcagctacaggcagagcacaaggcagcggaaacccgctggcaggaggagttacatttgtacattgaacgaatcgatgcgctgcaatctaaattaaagtacctggctaaagaagccgccgaatctgctaggaaggctgcggcgaccgctgagcctgggagtgtcgaaaagcagcttcgggagaaggacgaaaaaattgcgctactacttgaggaagggcaaaagctctccaagtcggagatggaccatcgaacggcgatcaagaagctccgccaacagctggcagataattcgaagatacagatggagactaagaagagaacagagaaactcgaacgggacctggcaaatttagaggccagagcaaagcgtgctgaggctgcggagaaacgggcgagcgagtcgctctcctcccaaacaaaagttgcacgggacctcgaggccgttacgaatgagcggaacgcattgtctcagacagtacaagagatgaagtcacaactcgcccgagcggttgcgcgtgcagaagcagcagagaccaaagccgcatcagatgctctggagaaggagaagcagcgtacggctcaattggaagaggaacttgcgagtgtgaagattgagcgcgagattagtgaggaaaaactgcgaagggaagttgcagatctcaaggaaggcatagcgcaagagaaggagaaggctaggttacttgaggccgagctcaagggagagcagtctgtcctggagagcaaaatggaggcgctgcgcgctaaagcagaagaagcctcgtccggttcgactggtgaaactcaggccaaactgttgcgccagatcgagacattgcaaacgcagtatgcagtcgccagcgagaattggcggaccctcgagggttcgctactttcaaggctagccaatttggaaaaagaacgggacgacgccacaaggcgagaaggggaaatgcgacgaaagatgcgtgaagtggtaagtatggccttcgttgtattgtcaatcttagttgctggctaa

SEQ ID NO: 19153 - DNA, 354 bp, A.fumigatus
acaggcatcatgtcgtcgacgtctctggagcctccgacttatttgagctccttgcagaacaacattcgagctcgcccgattccgtgggagggagctgtccgagctggcaacatcaccgacgaccatcttaagaagatcaaggccgtggacaaggtccgcaaagagcagcgccgccaaacggttgaaggcgatcttcagggctatgttggactgctggctggcaatgccgatagcaagagtgtcttggattcggcttccaagaggaccgatattgtgcagtacattctagtgctggcgacggacttgattagcggtaatgatatactcgcactctacatagaattcttgcgctga

SEQ ID NO: 19154 - DNA, 186 bp, A.fumigatus
  unsure (55): Identity of nucleotide sequences at the above locations are unknown.
aacgagagtgtgtcattatatgcgttttatgacaagcgagaagtgagcgttttcncagtgattcagttttttctgcattatgtacagaacgtcttaggcgtcttggccttgggcggcagtcttttgggaagttcagatatcccggcgttggtggatacttcagtttatcttgtgcttttgaattaa

SEQ ID NO: 19155 - DNA, 1377 bp, A.fumigatus
cccttgttttcctttgcttttggttttctttggctgatcggttgttttcctccagaatactcaccaggtgaatttatctacacaactaaatccccttccgctacgtcgagtacagcgctctctccacgtgtggatccttttgcttctctgtctcctgatcaaaagtcgttgcttcatcattttattcaggatgcgtcgcaaatcacagcatgccactcgagcatgcaaaaggatatctgcaagatgctcgtcccaatggccctccagaccccgtcgttattatatgctacaatggcgctgtcggcgatccacctacaagcactaaacaatcagtcggaaaacgtcaagtctgccccgcatattgcccggttaatggccctcagtctcgagcactttcggaatgaactgcagaccccaagcaccaagagatcggatgcgctgctcgcaacggcacgcacgctctgtttagcggagattcattccggagcaatccatccgaactcgtggcgagcccatgttgagggtgcaaaggctcttatgcttgctacgaatcacaaggggaatgaatcaccgggttcgtcgcagggtttccgtcggtacttggaccggtggtaccaatcgattgtgtccctgactgcactgacggggaatgggccacctatcgaagagtctatgggacagtcagcctccgagatcatccgccaacaagacgcaccggactatctcgacgactactggggtttcacagtaaacttgtcggccgtcttccgtgcaatcggggcggcagcctggcgaagtcagcacgagagacaaagaacagggttgatatcggacgacaccgatatggccagtgcacaggaggcggccatcctcgagtcctctgtccggacgctgatggcccgggacgcaagttcgcagcctacattctacccaggcgtcgctgagggcctctcggccgaatgcgtgcgggaattcatgctctgcaacgaggcgttccagcacagtgcgctcatccaaatcaaccgacgactccggagactgcccgcttcctcccccctcgtacagcactccgtcaagcggattctggagtgcacggcgcagattgggccatctacggggctgagcccgtggacgatgctcacaaccccgttgttcattgcgggctgtgaggcgcagggtgaggatcgcgagagggtccggcagttgctttctttgttgcacgataccatccgtgtgccgaatgtgcttcagtcattgaagttcctggaacagtattgggctgaccagttgaatgaggatgagggctggagtcaatatctaggtaggttgcttctttcttgggatgtgagcgaagctaacatggcccagatcgaatga

SEQ ID NO: 19156 - DNA, 627 bp, A.fumigatus
tatactcgcactctacatagaattcttgcgctgacaattgttccctacaactcagatgtcccgtcgctttcttccgcattgatcgcgcatcctagtccatacaagcccttcctcccgctcctgcgtcattccaccaacgccgaggatcctattccgctgctcacctccacatttttgactagacttgtctctcacagccttgctgcttcaaccaaggcagccgttcgcgatgaagaggcgcttccccagctatacacctatctttccaccctaactcagaacccagacagcgggctgcaggatatcggagttcaggggctgtcggcgctgttacggaattcgaggtcgcgcgaaatgttctggaatcagaggaaggagaccatcgatcccttgatcgagattcttcgtgctgctgcgggaactaaagacagtagtagtgcgagcactctggcgggcagttcaagagccattgagcccggcctctctggtggcgtcggcctgcagctcttgtaccgcgttctcttggtactctggcagctgagcttcgaagggagtcttgttggagaaggcctacagtcgtacgttcaccatctaacataccaaagcatgggagaagtccgcggctaa

SEQ ID NO: 19157 - DNA, 624 bp, A.fumigatus
tcgactttcagggattatgagtttgtccaattatatacccaacttctgcgtctatccccgaaagagaagacgactcgtctacttctcgcaactttgaacaacctcctttccagcaaccgcacgactttacttccagttgctgtatttgtccgccttcctgctctgctatccaacctctcgggccgccacttgaccgacccagacctactggaagatctgaacgcattgtctgagatgctagatgaatacaccaagacccaaacgacatttgatcagtacgccgccgagttacagtcaggtcaccttcgctggtccccgccgcatcgcaacccgacattctgggccgaaaatgcccgtcgaatcctagatgaagggaacggcgcgctgcccaaaaagcttgccgagattctgtccaagagctgggataacgacaagcaggttcttgcaattggttgcaacgatgtcggtcagctggtgaaagaaatgccggagagacgcagtcagctggagaagctgggacttaagactcgggttatggagctaatggctgacaaggacgagtctgtgcggtgggagagcttgcgagccgtcggagaatggctccgttacactttcgagggctga

SEQ ID NO: 19158 - DNA, 351 bp, A.fumigatus
caggagaacccccaccgcagatcactccgaggctaccccgggaaacggaagaaaacgcagattttgagaaccgtgaaaatccagcagcctcgccccaaatccatgtccaggtcatttaatgggtgtaaacggtgcaaagccagacgacagaaatgtgacgaacagcgacctatctgcggtcgttgtcaagcggccggggtgcagtgtcaatatgcgatgcagctacagtggggaggacggactttttcgcggtcgaggttaggagcctgtatgagcaatggagggttgcagaagcttggtatgtgttcaaatgacccttgttttcctttgcttttggttttctttggctga

SEQ ID NO: 19159 - DNA, 465 bp, A.fumigatus
caaccgttagtaatggaagcgggcctcttccctggcctggtctactacctgaccttctggtatcgacactccgagcgctccattcgcgtggccttgattctcgcatccgctaccttagccggtgcctttggcggtgcaattgcatacggcgtgggccacatgaatcaggtccatggactatctgcatggcgatggctatttatcatcgaaggcgcaccctcgtgcgcttcagccgttctagtctggttctttcttcccgattatcctgaatcagcacgttggctcacacgagaggagaaagacctcgctgctcaacggctgcgaacagaaggctccaagggagaagccaaagccatgacttgggaggacgccaaagctgtgctaacagactggcgtctctacgcacattatgcggtccgttgcctgttcttagcgcgctatggtcccacaactaatgcctcttaa

SEQ ID NO: 19160 - DNA, 219 bp, A.fumigatus
cagatctatttcggcatatccgccccgttttccagtctttctctctttacgcccgcaattaccagcgggctcgggtataccaacatacgcgcgcagctcatgacagtacccccatgggcagtagcctatgtcgtgacaacagccgcagcctggtccgccgatcatttcaacaggtacacaagtcctcacctcagcaccatgccacacaacacacactaa

SEQ ID NO: 19161 - DNA, 183 bp, A.fumigatus
ctgtcattgctgattgttaattacaaggacatcaacgagcaacattctgatagatcatgccgcattcaggagaaagcactggtctggaaacaagacttacgcattgttcctctatgtgcagcgatctatcttctctgctatctagatcgatctaacatcggtaagcatgaaaccaactcttga

SEQ ID NO: 19162 - DNA, 321 bp, A.fumigatus
tcttcttcaatttcagaccgcattattgtggctggcaagggaccacgatatcgcgaagaatcgtattctatttcggtcaagcaaaatcacttcaacatggcctcgacgcaaggaaatgttggtcggaaggttgaatggatagagaaacttgagagtatgccccacatgaactacatttttcttgaaggaatcgtcattgtgccgtatgggtttatcgttcgtgcgactaattgcagactgtatcttccttcagagcattgcaaaactgcaggccttggaaccccgatgtacacattgttctccgatcgtcgaggtaactga

SEQ ID NO: 19163 - DNA, 894 bp, A.fumigatus
tatcgacaaccgtcccagctggtctctctcttttctccccagcatgtcactcactcagtcactcattcattttccttgaatcctgttgcttcaaccacaccggtcaagatggggtcggaactgggagtcacgcccgactcgaagccagagcctgtatacagtccggtcagcatctggtgggctacctgggccggcgtttggacagtcctcgtcgccagtggcatcgcctatctcatcgctcgtcgggacactcctattctgcgcatccgtggcctcagcctgtcgctctctgctatcattctccttcatctgtactacaccccagtccagttcggcaccatgatcggccccatcatgccgggcgatgctcagttttggatcatgggcacttttctaccctgcggaatcgctctctttcacgcgtccaacagtcgcttcctttacgtcgccaaactccaggagaaatacgtttacaacgatcttcggcacaatttcccgcccagccaaaggagaagcgggctgctgggccgcttcaagcgtctcgattacaataccagggtcctggttctcgttggaatcgggatgattgcccagatcatgctgaccgttatcatgtggttgatttcgcgcaagtggcatcccacttggggaattccaggcaccgaggtgaccgggcccaagatggctcagttgtcggcgatgggtcgtggctgggagtggtatgaagccaaggactccgatctgggctggcgagctaggctaacatggctaggtggccgagtatcttttggcaactgttttgggcctggatctttgcccctattgttctctggaaatcacgcaatatccgcgatacccatggctggcgagttcagaccatcggctgtgcgatag

SEQ ID NO: 19164 - DNA, 615 bp, A.fumigatus
tggacgcgtaggatttgtctttcgatcctggtcatggaagtcttcaccgttttccttccctgctgggaggtgatgcgccaccaggtgctccagaaggaaacgctcgacgccatcgcgcagtgggaggagaagaataagaagaacagctcggccagcaaatccctcgccgagacggccacgctggtcgaatccatcatgaccggcggcaagtcgaccaacggctccgtccagaccaatcactcgcgcgacagtatcctgaccatgggcgctctcgagtatgcccttgagcgagacccggctcctctccagcgcttttcagctctcagcgacttttccggcgagaacatcgcctttttgaccagcgttgccgaatggaaacagtccttcccgaaggcgatccgggagaacacggcccctcgggacagcaacaccgaggacttgatccgcgagcggttcaatcgcgccttgcgcatctacgccgagttcatcagcgtcacgcacgccgagttcccgatcaacatctcgtcacaggatctcaaaaaactgcaggacgtcttcgagcggcctgctcggatcctgtacggcgacgagggccaggtcgatcccgcgtcttaa

SEQ ID NO: 19165 - DNA, 1584 bp, A.fumigatus
ccgacgatcgaactcatcatgtctttaaccgaggggtctacaatgcttggcagcagaccctctagcaaagaggaagtcgacagacccaacgatctgatgccaggaccaggcggtgccggcgaaccagacgctggaggtcctccatccactttctcatcgaccttccaagaggcggtcttcatctttgtcatcggtctagcacagctcttctccgttggcggtcttggaaatgcagctttctcagggcaagagattggtcgctcgctgaatgccacaagcaatggtcagatgtcctggttccagtccgcatactctctctgcggaggggtctttgttctggtgaccgggcgactgggtgaccactttggccacaagtacgtcttcctgttcggatggatgtggatggccctctggtctctggtcagcggctttgccaaggatgtgattctcttcgacattgcccgcgggatgactggcatcggcaacggcgcactggtgcctaactcattcgccctcctggcacgcgcattcccagcattttcggtcaagaagaacattgcctttgctttcctcgggttctgcgcgccttcggggtacatcttcggaggactcatcggcgcggcttttgccgagaaagtcacctggcgatggggtttctggttctgggccattggctgcctcgtcatcggcgcggtgacgtatttcattgtccctcacagtgtgggctcgccgattccgggactcagcatcaagcaatttgactaccttggatctgttctgggcatctcgggtctcatcctcttctccttcgcctggaaccaagcgtccgtggtgggctgggaagaaccctacgtctacgcgcttctcatcgtcggcattctcttgatcgttgcgtttgccttctcgcagtcgcgtgtccaggctcccgtcctccctaaccctctctggacgcgcaaaggattcgcccccgtcgtgacggccatgtcgttcggctggatgtcgttcggcatcttcctgtactacacgaccatgtacattctcaccattcacaaggcgcaaccgctcacggcggtcgctcagatggtcccgctggtcattggcggtctgttcgcgacggcgtcagtcggtatcttcatcgccaaggtccccgcgcagtacatcttcggagtctcgatgttctccttctttattgggtgcctgctcatgagcttcgccaactactcctccgtctactgggccttcatcttcccctcgtgtctgctcgtcgtcggcgggccggatctgtccttcgcgtcgtcggggattctcatctccaacgcggtcttgcccgaggagcagggtatcgcgggttcattcatttccaccgtggtgcagtactccatctcgatcgggctaggcattgccgctactgtcgaggcgcatgtcaacaacgggggacaggatattgtacgcgggtaccgcggtgcgctctggctcggtattggctttgcggctgtcgccttttttcattgtggttttcttcgtccgggacacgcgcgttcgacaagattttcaccacagcctcgaaggaccgcattcccgctc

SEQ ID NO: 19166 - DNA, 186 bp, A.fumigatus
gattccaccctcgaaagttgctcaagagggcggccaccaagcacgaggatggtctgtgttgccgtgttctcgagcatcgtggctagctgtatgcctgtcacaaccctgcaggaggtcactccgagcctgcgactaaacgattggacctgccttattatggccactacaggcacaccaactatctag

SEQ ID NO: 19167 - DNA, 384 bp, A.fumigatus
aaaggcgggcctcttttctgccgctttttttcatctcaagtgaaaaagatcatcaccgcttccattgatttgcgtcgcaagccacgattcttccacttagcacccttcaggtcaacgctaaaaattatgggccaaaagaggcaacgcgactcgaagaacttgaccttacactctaaaaagcggaagaaggccgagaacgcgacagcaactgattcggacgacggctgggatggtatcgtcggcgcggatgagctgaactggaaggaagtagctctacctgatcgtctcgaggatgctggaggcttttatggtctggaagaaattgaaggtgttgatatagtgcgaggttcgggcaatggggaggttaaatttaaggtacgctga

SEQ ID NO: 19168 - DNA, 2952 bp, A.fumigatus
tcgaccgtcgtcaaggctatggagacccgccagggtgccggtaacatcgccctcggctacctcttctctcaagattttgatttgaagaagcgccatgtccctcagggtatcgttgcttcttcggcaactctcccctacatgcgctcggctctggagcagctatctctcttgtattcagtcgctagccctgttgctgcgcacgttgccgccgtacattacgctggtgagaacggactggtctcggattatgcttccgcgctctctctcgctgaagagcttggcctgggtcttgtttcaagtgcctcagtgcatgaggctcagcatatggcgctgctcacgaccctcctcgcttccgttttgccgtcggttcacatctatgacggtgtccgtgttggccgtgagactacccgtgtcattgatgttctggatcaggctggtgttgctcgtacctacgaagccattcgcaagaccttggatgagtcccgtaaccgtcacctagacacccaagggaaggttttggagcttttcgcttctctgaacggcgaacttggcacagactatggtcttttcgaataccacggtcacgccgaacctgtttccgttctggttgctttcggtaccgttgaggcgtctcttactgcgcaggttgctcgctcgttggcaaacgatggtgtccgcgttggtgttgtcaatgtccgtgtctaccgtcctttcgtcgaggaggaattcctgcgtgttctccctcaatcaaccaagactgtgggtgtccttggccaggtcaccgatgagcaagatgtgcaagagcaaggtgttcgctctgccctttacgaagacgtgcttgcggctttaacctttgcctctggtcgagaacatgcgcctacctgcgtcgatatcaaatacccccgctctcagcgttgggacctgataaacactgccgctgccttccaactcatcttcgaaaagcccattattccggccagcggggaaagcgcgcctcttcagcttatcgaccctgctaccgtgcaggagtacactttctgggatgttgacagctctgtttgcgaatccgctgctgctgtcctttccgaggcccttgctgctgattccgcgagcaatgtaacaacatccaagtcttatgacaaccttattcagggaggagccctccgtatcgacatccgcaagagctccaagattctcgataccccctatgctattactgctgcagacacgacatacgttggagatatcaaacttcttggagatatcgatgttgccgcctccatcaagaacaagggcaaagtcatcatcaacgcccctggcgtcaaagacgatgagttggaaaagaaactaccattgggcttcagacaggctgttgctcagcgtgaaatttctctctacatcgtcgatccatcggcggccggtgcctctgctcctgaatcctctgtcctcgagtcagccttccttagagtggcacttccctctcaggaaggggttggccttaagaagctttcttctatcactggagactccgagactcttgagaccgtcgctaaagatcttgacaagcttctccgccaggtcgagatccctgagtcttggagaatctccgaagagggaactgaggttactcagctttctaaggatatctccatcaacagcttcgttcccttcgataaggacgaagcggagccagctcctctcctcaatgactggcaggcagcggccaagggtctcgcatttaaggaggcttatggcaccaagaaggctcttcgtcccgaaacggccaccaagaccttcactgttcacgtcaaggagaacagacgcttgacccctgtcacttatgatagaaacatcttccatattgagttcgatcttggtgactctgggctcaagtatgatattggcgaagccctaggtgtgcacgctgagaatgacccccaagaagtttcggagttcattacattctacggtctcaaccccgacgatgttgtcggtgttcccagccgcgaggacccagcggtccttgagaaccgcaccgtctaccaggctcttgtccaaaacgtcgacattttcggccggccgcctaagcgcttttatgaggccctcgcagaattcgccaccgacgagaaggagaagaaagaccttctcacactgggtggccctgaaggtgctgtggagttcaagcgccgcgccgaagttgataccatcactttcgctgatgtcctgctggagttcccctcagctcatcctgacttccaagacctgatccgcatcgtcggccccctgaagcgccgcgaatactccatcgcttcctgccagaaggtgacgcccaactcggttgctctcatgatcgttgctgtcaactgggttgatccccgtggccgcgaccgctttggtctcgccactcggtaccttagccgcctccaacccggcactccggtcactgtcagcgtcaagtccagcgtgatgaagctgccacccaagtccactcagcctctcatcatggccggtctcggaacgggtcttgctcccttccgtgcctttgtgcagcaccgtgccctcgagaaggcgcagggcaaggagatcggtgctgtgctcttgtacatgggatcccgccaccagcgtgaggagtactgctacggtgaggaatgggaggcttatcaggaagccggtgtcatcactcttcttggccgtgccttctctcgtgatcagcctgagaagatttatatccaggaccgcatgcgcgagactttgcctgaaatcatccaggcctacatccgggaagagggtgccttctacctttgtggtcccacctggcctgttcctgatgtgactgctgtgctggaggaggccattgccaccgaggccaagaacacaggcaagaaagtcgacactcgcaaggagatcgagaaactcaaggatgaggagagatatgttcttgaagtctactag

SEQ ID NO: 19169 - DNA, 2232 bp, A.fumigatus
tgcgaggttcgggcaatggggaggttaaatttaaggtacgctgaggcgcttgctgactgggtgaagaatgatccattgacacaattaccccaggccgttgctgggaaaccgaagaagtctattctgaaaaagaaggcgctagaggatgagaaccccgaatacgaagaggagtggtcaggcttcagcgacgatgacgcggaccggccagaaaacgcttcttcaactgtcgtagagaaacctgaaaagtcggacaggaaggcggacaagaagagcgagaagaatgccgataagaaggaagccaaggatgcaaagaagaaagaagctaaagctgcgaagaaggaacagaaggagaaaggttcggcaattcagcgcgatatgagcattaatgccggcctttcgtttgccgctcttcaagatacggaagaagatgatggagccgatgtctctgcttgggactcgctgggtctctcccccgagatactcactggcctgtccaagatgaaatttggctctccaacatcagtgcaggaggcttgcatacctcagatattggagggacatgacgttattgggaaggcttctacgggttccggaaagacgctggcattcggtattcccatccttgaacattacctggagaagaaacgcgatgatattagtgcacagaaggaacagatgtccgaaaaagactcgactccgatcgctctgattctgtcacccaccagagagcttgctcatcagttgtcgaagcatatcggggagctgatcgcgcaagctccgggtgttaatgcacgcattgcgcttttgaccggtgggctctcggtgcaaaaacagcaacgtctgctgtccggagctgatatcgtgatcggaaccccgggtcgagtgtgggaaattttgagcactgggcaagggttgattcggaagatgcagcagatcaaattccttgtagtggacgaggccgatcgcctcctgagtgaaggtcacttcaaagaggttgaacagattttaaactctctggaccgtgtcgaggatggcgaggttcctgatggtgaggatcaagcatcggaagaggaatctgatcctagctctgaaagacagacattggttttctccgccacctttcaccgtgatctgcaacagaagttagcgggcaaaaggaagtggaccagaggagatatcatggataagaaagaatccatggactacctcctacagaagctgaacttccgggaagagaagcccaagttcatcgacgtgaaccccatctcgcagatggctgacaacctcaaagagggaattgtcgaatgtggcgccatggaaaaggtgagttttcatatgggttcggtaatttcgagtctacgactaatgacgtttcaggatctcttcctctatacactacttctataccatcccaaacaccggacactcgtcttcaccaactcgatctccgccgtccgtcgtctcaccaaactccttcagactctccaactaccagcccttgcccttcattcgtccatggcccaaaaggcacgactccgctcggtcgagcgtttctcttcaccctcatccgatcccagtaccatcctaatagccactgatgtagcggcccgcggtctcgacatcaaagggatagacctcgtcatccattaccatgcaccccgaacggcagatacctacgttcatcgatccggccgtacagctcgtgcaggcgcatccggtaagagcgtgattatctgcggacccgacgagatggtcggtgttgtccgtctcgctgccaaggtgcatgcgaacatggcaaatggaaaaaagctgccgctggaatcattggagctggaccgtcgcgtcgtgtcgcgcgtcaagccccgggttagcctcgccagccgcatcactgatgctaatatagccaaggagaagatttcagcagaggacaattggctgcgcaacgccgcggaggatctgggcgttgagtacgacagtgaggaattcgatgaatccaacggcaaagggcgtggtcgcggccgtggtcgtcatcagaagcaaaaggaggtagggagcgtcagtaaggccgagctggcagggttgcgagcggagctgaagcagttgctttcccagcgggtgaatgtgggcgttagcgagaggtatctaactgctgggcgtgtggatatcgatgcattgctccgtggagatagcaatacttcgttcctggggccggttgatccactgaacttttaa

SEQ ID NO: 19170 - DNA, 1284 bp, A.fumigatus
aaaatggggaaatcttccaaagataagcgtgacgcctactatcgcctggcgaaagaacaaaactggcgtgcccgttctgctttcaaactgattcagatcgatgaacaatttgatttgttcgaacatgagaaccccgacaaagtgacgcgagtagttgacctttgcgccgctccaggaagttggagtcaagtcctcagtcgagtcctgatcaagggagagagctttggccggcgggcgtggatagagaaaaagcgaaaggagagcgaggctctgaagagaatcgaccatggatcggaaagtgagagtccagctgaagaagagaggaaggacgacattgcgcagttgaagcccagaaggaacgtgaagatcgtctcaattgaccttcaacccatggcgccgttggaaggtatcacaacgctccaagccgacatcacacatccatctacgatccctctgctccttcgtgccctcgatcctgaagcttatgattcagcatcttcccccaccccttcggccatccaacaacctcaccctgttgatctcgtcatctctgatggtgcaccagacgtcaccggcttgcacgatctggacatttacgttcagtcacagcttctctactccgcattgaatctggcagtaggcgtcttaaggccaggaggcaagttcgtcgccaagatcttcagaggccgcgacgtagacctcatctacgcacaactccgcacggtatttgagaaagtgagtgttgcaaagccgagaagcagtcgcgcgagcagcttagaggccttcgtggtctgcgaaggctttattcctccagccatccatgacggctcagtcggaatggacgctttgaagaaccctctctttggaggcgccacaataccaccgcccgtatccccagatggcaacatcgggatcgaagtacccgacgaggatactgcatcacctagagagccactcacagtttcagaagcagcgacggtgtctgcatctgatataaaccaacaaactcaaatccgcatgcttcattcgcaatcttcaatcccgtctctggcaaacaagccccagcgtttcgctgtcgagaaccgatggatccctccattcattgcctgtggcgatctctcgtcctgggattccgatgcttcatactccttgcccccggactatgtcaacttggatcctgttcagccacctacagcaccgccttatcggcgagcgttggagctacggaaggaaaagggtggagcttatggtaagacgaagttgggagctgtgggacgggcgtag

SEQ ID NO: 19171 - DNA, 987 bp, A.fumigatus
aacatttcgagagcctcccgccccagcagtcccccattactcggatcatccatcagcgacataaagacgacgtctggcaaccgtacccgcgctcgaccgacgccggcgtcgccagccatatctcctgcgtgttcaaccggtggtgcgcatcgccatgcatcgccggtggagatttcccgcgcgattttctgcgaggaggaccggaatcctcgagcccagatgctccctttcatcaatgtcatctacccaaagttgcaggactgttacgcagacatgcccgagtgtcttttggttgagaacgtcaccgttccgcatgccttcagtttccagtacgcggtcccccccccccaagtgtccccaaatctgatccaagctcaaccctcactgacccatatgtgcagcttcttttaccacacaaccgtaatgcaaatcttcggcctcctgaaagccaaccacgaacacttcgatcccgccagcatccagcgcgcccgcaacatttgcatcgagagcgcccttcgcatcgccgggctcatcggcatccaccgcgacaaatggggcatcggccgcatggccccctccaccatccagtggctcagcatcggcatgtttaccctcctcgatgcgctggactcgcccgacactcgcaaccgcgccgccttcatcgagatgtgcatcgtggcgcgggcgtttgcgcgccgcttcccgctggccaagggcatcctgcgcatgatccaactctcggcgaaccagatgcaggtcgtcttgcctgccgagacggatgccctgtttaccgactttgagacgcgcagctgggagggcaaggatcggcatacgtttagcaccttctatccgaactttgcgagggtggtgcggcagggggccgcgcgcgaggaggacgtgtcgatggatcggtttttggagaagtgggatagtttggcgatctcggaccctaaggaggagacgcctccagacgagggtggttcatga

SEQ ID NO: 19172 - DNA, 606 bp, A.fumigatus
tcagttggataccgtcatcaatctctgtactccagatcattcattccactgctgaataacatcaataacactgataacatcagatcaatcaaaatgtccaaccccctccaatcccacccgcctcacatcctcgccgtcctggaccgcctccacgccgaatccgccgcccaggaatcctccatcccgagaacagtctacaccacctcgtccaccgactccttccacaccttcatgcgcaataaattcatcgccctcgagcaagacaagtgccacttcatctaccagctggcccgcaccctcaacgcaacctccatcgtcgaagcgggcacctcctacggcgtgagcaccatctacctcgcgcttgcggtggcggataaccttgtctccgcctctgcctcgggccccagcaaagggacggtgatcgcgacggaatacgagcccgccaaggccgcgcaggcgcgcaagcattgggccgagtgcggggaggccgtcagtagcgtgattgatctccgcgagggggatctgcgggagactctgaagacaaacctcccggatcggattgacatgcttctgctcgacagtaagtctttttccttttttacctag

SEQ ID NO: 19173 - DNA, 198 bp, A.fumigatus
tgctgccggaccgtctgcgtcttgaccagctgcgggccgatgatgttccccaccgtgtacgccacaaacaccgtcgccgccatgacggtcttcttggtcgcgcccgcgacattactcgcccccagcgtgatgatcagactgaccaccggcccgaagaaccccgtcagcgcgtacccgaccaccggcgcggcgggctga

SEQ ID NO: 19174 - DNA, 285 bp, A.fumigatus
aagccaaccacgaacacttcgatcccgccagcatccagcgcgcccgcaacatttgcatcgagagcgcccttcgcatcgccgggctcatcggcatccaccgcgacaaatggggcatcggccgcatggccccctccaccatccagtggctcagcatcggcatgtttaccctcctcgatgcgctggactcgcccgacactcgcaaccgcgccgccttcatcgagatgtgcatcgtggcgcgggcgtttgcgcgccgcttcccgctggccaagggcatcctgcgcatga

SEQ ID NO: 19175 - DNA, 312 bp, A.fumigatus
agacaaacctcccggatcggattgacatgcttctgctcgacagtaagtctttttccttttttacctaggcggccagtggcggtggcggtggctgacaatgtagtctggacgccgatggcgctgcccacgctgaagctggtccagcccaagctgcggtatggcgccgttgtggtgtcggataacacgctgagtgcggcggagggatacaaagacctgctggagtatctgcgtgcccctgggagtgggttcagtacgttgacgctgccgtataagggggggctggagatgagtgtgtatcttcctcagcaatag

SEQ ID NO: 19176 - DNA, 726 bp, A.fumigatus
aagtcggtcgcttttccatctcgtagactcttgattcctagttggagacacacaagcttaccctaccagtgtcggggagatcctccatgtcagcattgcgtcagccatggcgtcaaatgcgaggttgacgcaatgtctgatatgcgccggaaaaacgccatggaccgcaaggtggcgaagctggagaaggtagccgacacgttgacgcggttgatcaacgctctgcgcgacagagagagcagacgcgtttcgcagctgttgaatctgatccgaagtaacgcctcgttcgacgaactgcggctgttcctggagcagcagttttcccactacgagttggaatcgacgcctgaattacgcgatatccaaagccagctctcgcagacaacggaccttgcgcccctgggatggcggtacctccgagtcgatcggctggccgacgacccggtatacaaggtccccgcgaagccttggacggcggtgacggacgacagcgagctggtgtcgcatctggtctcgctttggttgacctggacgtatccctggtttaactggctggatgccgactgtttgatcaagcatatgcaggaaggaaagctgaattcccggttctgctcccctttcctggtcaatgccattctcgcggaagcatgcgtatgtgtcctcgcacggatgatgtcggtttttcttttttattttctttgcttttcattactgattcgtgtatag

SEQ ID NO: 19177 - DNA, 225 bp, A.fumigatus
tattactccgactacgaagaagtatttacagtgcccggcgacctgctcactcgaggcgaccaattcttcgacgaggcgcgtcgtctgttcgaggctggagaagacgaaggcgactctcccagcctgcccacgatccaggggctcatgatcctcttcgttcggtcagtcgcatcgtcggatgcgaaacaatggctctcgctgacatggctatcagaacatcgatga

SEQ ID NO: 19178 - DNA, 504 bp, A.fumigatus
gaacgtcaccgttccgcatgccttcagtttccagtacgcggtcccccccccccaagtgtccccaaatctgatccaagctcaaccctcactgacccatatgtgcagcttcttttaccacacaaccgtaatgcaaatcttcggcctcctgaaagccaaccacgaacacttcgatcccgccagcatccagcgcgcccgcaacatttgcatcgagagcgcccttcgcatcgccgggctcatcggcatccaccgcgacaaatggggcatcggccgcatggccccctccaccatccagtggctcagcatcggcatgtttaccctcctcgatgcgctggactcgcccgacactcgcaaccgcgccgccttcatcgagatgtgcatcgtggcgcgggcgtttgcgcgccgcttcccgctggccaagggcatcctgcgcatgatccaactctcggcgaaccagatgcaggtcgtcttgcctgccgagacggatgccctgtttaccgactttga

SEQ ID NO: 19179 - DNA, 243 bp, A.fumigatus
actacggcttcgcgacagatcacgtccggctcgctgaagcgctggcagtacatctacatctttgccggggtgctgaccttcctgtttgggatctggtgcggcgtgatgcccaactcgcctgtctcggcctggttcctcacaccggaagagcgcgtcgttgccgtcgagcgccttcgcatgggccacacgggcgtgcgctgccaccaacatcaagctgtcgcagatcaaagacgctgcgcttga

SEQ ID NO: 19180 - DNA, 330 bp, A.fumigatus
accagggatacgtccaggtcaaccaaagcgagaccagatgcgacaccagctcgctgtcgtccgtcaccgccgtccaaggcttcgcggggaccttgtataccgggtcgtcggccagccgatcgactcggaggtaccgccatcccaggggcgcaaggtccgttgtctgcgagagctggctttggatatcgcgtaattcaggcgtcgattccaactcgtagtgggaaaactgctgctccaggaacagccgcagttcgtcgaacgaggcgttacttcggatcagattcaacagctgcgaaacgcgtctgctctctctgtcgcgcagagcgttga

SEQ ID NO: 19181 - DNA, 1062 bp, A.fumigatus
tttccatgcatggtgtcgcgcggcactcaccctctccagcacggatgcggtgtacgggccgctgaacccgtaccggtccaaggagctgcaggacgcgttttggtatgtttcccggctggttttgtgacgagaggctcactgggtagggactttgaggagaatctcgcgctgctgctgatggatgtcgtgcagagggtcaccgcgcgcacggcatggaaggcacggcggcggctcgtcgcggcgtttctcgactactaccgtgcgggcgggcatctcgactcgtcgcagttgacgtatgcgcggtgggagacgcagcagaaaggtggtgccacgctggaggatattgcccgcctggagacggctgcggccctggggaccttgtcgaacaccgttccggctatgttctggttcatgtttaacattttctctcgcccggagttactaaacgaagtgcgcgacgaagtggctcggcgcgcagttcaggtcgatgcgcagggcgtgcatactgtggacctcgccgagatcaaggagaagtgcccgctgctgatgtcggcgttccaggagacgctacggctacgctctaacaccgtccctatccgggttatctttgaggacatgatcctagatgaccgatatcttctgaaaaaaggtggaatcctacagatgccggcacacgcgatcaaccgcgaccggacaatctggggcagcgacgcggacgactacgaccctcgccggtttgtcaaaatcaaccagtctgacagccgcaagaaagccaacggatttctgtccttcgggacatccccgcacgtttgtccgggcagacactttgccacgggggagatcctggctctgatcgccatgcttgtgcttcgatatgacattgtccctgctggcggcgtgtggaaagagcccaggaccagcaaatcagccattacgtcttcaaccgggcctcctgcagaagaattcaaggtgcttgctacagcaagaaaggagtatgagggagtagaatgggcgttccgtgtgacggagggcaaggggaagtacggactgatcatcggctag

SEQ ID NO: 19182 - DNA, 513 bp, A.fumigatus
cagaagatgattcaagttcccagtgcaacaggcgaccctgagcggcttcgcgccgacggcgagctcttcgacaaagatgccgcactggcggtcgtcagcgatgtagcaatggagattgacccagaggtcgagaagcgcgtcctgcgcaagatcgacctcttcttcatgccggccatgctagtcgggtacggactggtctactgggacaaggcgattctcggcagcgcgacgctgttcggcatgaccaacgacctgcacttagtggtcatcgattcgagcacgacgcccccgtcgaaagacacgtcccggctcagctgggcgacgtccattttctatttcggtatgctggccggcctctacccgatgacctttttcctgcagcgcttcaaaatccagcatgtgtttgggccgattgtcatgctgtgggctgtcacctgtgccgctaccgcgggggtcacaacctggcagggactgtttgctcagcgatttttcctcggtacgttcatcctgtag

SEQ ID NO: 19183 - DNA, 675 bp, A.fumigatus
gtcctatccaccgacccctggaactgcaaacctgataatcccaagctacccaaattaattggcgcaatctccgggttcggcccccttattgtctccaccttccgctaccacaccctcgactcgattctatttcagttccccgtcggcgggatctgcgtcatcttcatcccgttgtgcgggtacgtcgcgtcgcgcgtgccccacacccgcatccccatgctcatcgcctgctgtctgcccgtcatcgcggggtgcgcgctcatctggaagtccccgtgggggtatcagcccgccgcgccggtggtcgggtacgcgctgacggggttcttcgggccggtggtcagtctgatcatcacgctgggggcgagtaatgtcgcgggcgcgaccaagaagaccgtcatggcggcgacggtgtttgtggcgtacacggtggggaacatcatcggcccgcagctggtcaagacgcagacggtccggcagcattatcccgagttatggacggggctgatcatctgctacggtgtgacgattgcggcggcgggcgtgctgtacgggattctacggcgggagaatcggcggcgggaggcgatggagctggacgagagccagcgggataagatggcgtttaacgatttgacggacaaggagaatccgttctttcgatatgttctatag

SEQ ID NO: 19184 - DNA, 456 bp, A.fumigatus
aagggaaaaaaaaaaaaaacaataaaggataaaagtctaaccagtacaggcttcgtggaaagcgtggtccccaccggcttcatgaccatcgtcagcgggtactacacgcaaaaagagcagtccctgcgccaggcatggtggttctccggcacaggatggttcaccatcatcggcggcgcaatgaactacggcttcgcgacagatcacgtccggctcgctgaagcgctggcagtacatctacatctttgccggggtgctgaccttcctgtttgggatctggtgcggcgtgatgcccaactcgcctgtctcggcctggttcctcacaccggaagagcgcgtcgttgccgtcgagcgccttcgcatgggccacacgggcgtgcgctgccaccaacatcaagctgtcgcagatcaaagacgctgcgcttgatatcaacctgtacctcatcgccatcatga

SEQ ID NO: 19185 - DNA, 879 bp, A.fumigatus
caggccggaaaagaacggggcggatatgggatcgcaggcaagaatttctccggcatcgtcggagacgttttggtaggacccgaacgggcaccacgccggcggccaccagccaattcaaacgcggcgatcaggtctttggaatggccacatgccgatcggggctccgcgtggcccgaatacacgattgtgcatgagcacgagaccgccctcaagcccgacaccctgccgtgggagcaggctgcttgtctgccgctcagcgggctgacggcgttccaggctctgtttgagcatgcgggactccccttcccggcggatgccgtcgggggaggatcagaagcgaggattgggaagcgggtcctgattaccgggagttcgggcggggtggggatctatctggtgcagctggctgcgatggcaggcctgcatgtggtggctgcgtctagctctgccgagcgcaacggggggtttctgaaggggctgggggctgatgaggtggtcgagtacgcggccttgggggagaatgtggacgggtcgtttgatctgattgtcgatactgttggggggaagattctccgccgatgctgggcttgggtcgccgggcatgggacgttgatatcagtggattcggcgagttttgattttgtgaatgagcatagcaagtgtgggctgaacaaggggaaggaggatgtgagagctctgtttttcattgttcgaagtgatgctgaagcgctgaggaagctggcgaccttggcggattcgggccggctgaagctgtttgtgctgcagacgtatgatctctcgcaggctcaggcagcgtatgaacaggcgagttcaaaggcttcgggctacgggaaggttgttattcagataggagactag

SEQ ID NO: 19186 - DNA, 1209 bp, A.fumigatus
tcagttgggtcttcgggtttgctccaggattcgaatacaatgcttagggtatactgtctgtgttggtggctcgccgtatgcaagcacgtatccggccaagtccagacctttactcctgcagcagaaacggcaatagcatacagcgtaaatgtccctgcatcaactgccgggtccggctcctccggctccgggcccattttcattcagatgcggtctaccaaagaagtgcaatggttcgcatggggtcaaggagctgtaatgcaaggggccaatatattcgtcgtctatgcggatgggaccggtatcaccgtctcgccgcggttgggagtcgagcacgtggagccgctgcacaatccgcaagctcgattctcgatcctcaatggtagtggaatcagcaatggaatcctcacggcgaacatacggtgcgatagctgtatcacctggccagggggccacgaggatgtgacaagcacctcgagcccatggatatgggccgtgaagcacggtcccatgctagattcagacagcgtctcggcgacgatcactatccatgacttctcaggtgttgcaaccgtcaatatgaagcaggcaaccggtggcagctccgagaatccatttgtcggtggatcgatgtcgtcgagttccagctccgcgtcggccgccctgacgatcaactcggaatccgtcaggaagaaaagaatcgcacacgccgttctcatgatagtcacttttgttctcctcttccccctaatcgcccttggaatccctctcttcccgtccgccaggacggtggtcatccacgcctcgctgcagctctgcacccttgcgctggtcctcgcggggttcggcctcggcatctcaatggccagaagcctaaatttcgtcggctcctaccatcccattattggcattatagttgttgcatccctagttctatttcagccagcgatggggctcgtccagcattggtatttccgccgcacggggaagaagagtctcgccgcctatgcacaccggtggcttggtcgtacggccatcaccctggggatgatcaatgcggggcttggctttcgtctcacgggcattgggacttctgtcgctcctacgggggcggtgattgcttatggcgtggttgctgggctcgtctgggttggttatgtgttgacggttagcttcctctcctacaggaagcgtcactcgcgagcgtag

SEQ ID NO: 19187 - DNA, 405 bp, A.fumigatus
actgaaaccaactcgcacagccgccccaggtcaacccttagcgtggtgtacgcctacaagctcgtcaattgccccggcaagaccatcgttggattacgggtggaattcccccccaacgcatcgacccctccccaccggcatggcggcgcctcggtctcggcatatgtcctccgcggcacggtgctcaacaaaatgaacgacgacccgatgcaggtgatcgagacgggaggcacctggtatgaagctccgggctgccatcaccgcatcagcgacaacgctagtgcggcggagccggccaccctgatggtgagcatggtcctggactcggatgtgtatgaccgtgatggagtggatgcgttgatccagatcgatgaggagtatcgggagattgaaccgagaaagtag

SEQ ID NO: 19188 - DNA, 237 bp, A.fumigatus
gcatcacaaacaatcaaccacttcagtacaatgaaggctttcaacattctcagcttctctctcctcctcactatcgctagcgccgcagctgtcccagacgttgatggcaccattaccaaggacgcgggtaataacaaacgcgctcgcttctgcggccagatctgcctcaacaacactgggtgcggtggtaaatgtcctaagtgtgatatgaaatctctcacctgcaagaaggcttag

SEQ ID NO: 19189 - DNA, 957 bp, A.fumigatus
tgtggtgtaaatgacttcactttcacagatctgaccaagcctacgcatgatcgactggtcaaaatattctcctatctcatcaactttgtcagattccgggagtcgcagacccaagtcattgatgagcatttcaacaaaacagaaaagacaaaggcacgcatcgatacactgtttatggaaaatcaagagatggagcaacgtcttgaagagatgcgccggagtttgaaagccaatgaagcacaagttaaggaaaaggtcagaagaaacgacgagctgaaagcgcgacttctggaattgcggcgaaatcaggaaaggattgctgagacccttgagcgggtcaaggcggataaagctcgacgacaagcacaattggaagagaagacagagagaagcgtacgcaccagacaggaagtcgaaaagctccgcccctatgcgatgcagagtccggtgtcgctacagtctgccttgaccgagctctctgaaaacctgcttcgagagaaggctcaaatcgatgccatggagaaaagagcaagagcactgcagacctcttctgacacatttaccgtcgttggaaatgacgtccaggcctgcatcaagctgctcgaagatatatctgttgaactacaaaaggaggaagaggaagaatcgcgagcgtcaagaaacaaagaagctatctccgagagggggaacaacgtcagggaggtggagcagaccgagaaactgctgcagcggcagctcgcgcggtggaacgaaaggattgaagccctccgaaagaatgcccaagaaaaagcagaggtcgctcaagcccggatggatgagcttcgcgatgtccagaagaagcttcgtgaagagcgagcggagaagcagcgtgatatggagagacgacgaattaggattgagcagaccgagaaaaaggtaagactccgtgcccggcagcatgtggttctcttatgctaa

SEQ ID NO: 19190 - DNA, 282 bp, A.fumigatus
cctgataaggaaatcgcaggttgcatcaacgatatcgggattcctttcacagctgccgacttgatcaagccgaatcctcaacagatccagatggtgttcgaatggttcgcagagcttctcatgaatacgaccaaggagacagtagagccagcaatgcgcgccgcagcagaagatatatgcggtgactatcccgacattgtcccattagagactcgcaatctcatgggtttcttcatcagcctgcgaaggctgatgatggaggtatgtcgaatgagtgtgtga

SEQ ID NO: 19191 - DNA, 798 bp, A.fumigatus
cctctggctggcagcattgtcgcaacatacaatgaattattacgctctgatccagacctgaccatgcccatcgccgctattgaggctttggtcctactgctcacccactcgccctcatccacgatatcagagactctcgatctgctggagaaatccaccgcacacttgaagaagtcgatccctaaccctatcggtctttcggccggaaccgatctattccaaagatatctgattacgactctacaaaggcctggacagctgggaccggcgggagacttcaacgcgatcagggcgcatctattgtccaacggtcggttattcattcggcgagccaaggaaagtcgagacaaaattgctgcgttcggtagagggtttattcgggacggatgtacagttcttacaaacggtggatcgagagtcgtcgcttctttgttacagaaggcagccgacgagaagggcgggccctctgctgtccgtttccgtgtcatctacgtcctttcgtcggccaatggagatgtggagaacactcgtgccgagccagagggtatggagacagtacgcgcgctcagggccaagggtgtacctgtggccacaatttctgagtcggcagtggcatactctcttggcaaagccgacatggtgattgtaggtgccgaaggtgtggtcgagaatggaggaattgtctcgcggatgggaacatatcagattgggtcttcttgcaaaggcaatgggaaaacctttgtacgtggttgccgagagccacaagtttgtccgatcttaccctcttggacagtatga

SEQ ID NO: 19192 - DNA, 402 bp, A.fumigatus
gtgccgaaggtgtggtcgagaatggaggaattgtctcgcggatgggaacatatcagattgggtcttcttgcaaaggcaatgggaaaacctttgtacgtggttgccgagagccacaagtttgtccgatcttaccctcttggacagtatgaccttcctatcgagcaacatgttatcaacttcaagacggaggaagatatcgcagatgaagccaagcaacaatcggccgaatcacagaaaacaacagaagttgactctctggaggcgaatccgggctcgaaaggcgggggccgttctgatgtggtcgacttcacaccgccgcatctgatttccgccttgatcacggatagcggcgtgttaacaccgagcgcggttagcgaagaactgattaagatatggttttga

SEQ ID NO: 19193 - DNA, 186 bp, A.fumigatus
tgggacggtgaacccccttacctccaccaatcctcgccggaaagaagtgacaccttctccgtcagggacatcctctggaccaaatcttccacagaagcggtcatgaaggacctatccattcccttgttcgccattttgcgatatctgcccggctttggaactttggaacgggatggcgagtggtag

SEQ ID NO: 19194 - DNA, 561 bp, A.fumigatus
tacatacaccagctaatagatgtacatagggctgtgagtcgattgtccactattgctttgcgtcacccgcttactcagatgctgctagatgatgctggcctcctcaacgggttacaggctgtgacctcgtggaacgagttctttgaccacccgaaaggcacaatcttgggactctacgctgcctctttgtacctcccatcgattgtgacggcttacctgggtgatttcctatctcagcgcttcgggcgccgaatcaccctggctctgggatctttcattgtccttgccggtggtttcatcaacgcctttgctagtagtgctgggatgtgggttgctggtaatttatctgtccccctttggtgcctttggtattatgttctgaaactcgaatcctgctcaggtcgcgccatcatcggcggaggtggcggtctcgccaaggtggccgccccagcgctcattcaggagatcgcccaccctcggttacgaccgatgttggcttcctgctattatcctttcttctactttggcgctctgctatcagcgttgctttgttgtgagtga

SEQ ID NO: 19195 - DNA, 600 bp, A.fumigatus
ttacgttctcggttacgaagggcaaggtctggaaatgagtcgttcccccgtctatcgtaccagtcactcacgttcaatcaggtctacaaattccgtctcttgcacgactccagaaaaccgccgctggctccgggtcaggacagccagccattacagctcatcggcatgaaactgggctctttccccgctgtcaatgaggaccaaacgatcgatgaggccgtagagctcgccaaagagtctgacatcgccttgttgatggttgggttagaccaggattgggagtcggagagctatgaccgacccgacttgtctctcccgctccgtatgaacgacctcatccgtcgcgtcgcgactgaagcaccagacaccaagaaggtcgtcatcttgcaggcaggctccgccgtatccatgccatggctggaacatgtcgacgccgtcttgtggccctggtacggcgggaacgaggctggaaatgccattgcggatgtcgtatacggaacggtcaatccttccggtcgattgcccatcaccttaccgaaaacgggagcttggacattgcggcaaacctcaactttaagtcgggcacgaaccaagacttag

SEQ ID NO: 19196 - DNA, 363 bp, A.fumigatus
tacgaggaagggatctgggtcggctaccgtcacttcaacgcccggggcatcgaacccctgtatcccttcggtcacggcctctcatatactacctttgattattccgacctcaccgtggggccgtccgcatcatcttctcctgactcatggcgcatctcggtttccgccagagtcaccaatactggcacggtacctggtgctcattccgtccacttctacacgagcccgcccccaccaacaatgacttccctcacgcatccggctgtcactctgcaagcgttcgcaaagaccgctgtacttcggcccggtcagtccgagagagtcaccgtggagatggacaaatgtaagtatactgggccctga

SEQ ID NO: 19197 - DNA, 1389 bp, A.fumigatus
gcccccgccgtggttcttcccaacgccaccggccttgctgctacattctctcccaccctccccgcagaagccggtcgtctcctggccgccgagaccaaagcacgaggggctgtcggcctattggccccgaccatcaatatctgccgcagtcctcttggaggcaggaccttcgagtcattcggggaagatccgaccctcagcggtatcatggctgccaagtatgtgagtgccctccaggatgaagggatcagcgcagcgatcaagcactttgtcgccaatgaccaggagcatgaacgaatgggtcaagactccatcattgcgcccagagcgcttcgggagatttatcttcgaccatttcacattgctcaggcgttagccaagccctggtcatacatgacgtcgtacaacaagctcaacggcacccattgctccgagcatgagtggttgttgagcggccttctccgaaccgaatgggggtttgacggactcgtcatgtccgactggatggggacatattctgtcgccgaggcgatcaacgccgggcttgatttggagatgccggggaagccccgatggcgtcaactgtcgctcgtgcggcagttgatgaatgctcacaagatctcgccagtgacaatcgacgagcgcgtcagaaccatcttgaaatgggtccaaaaacttgtcgtgctcaaccctgacactgtttacgggcgcgatgactcgatagaatggacgcgaacggaagaccaggcggcagacgcggcgctgatacggcgcatcggcaacgaggcaatcgtaatgctgaagaacgaatcgtcagtgcttcctgtccgacggggcaaagtagcagtcattggtccccacgccaagactgccgtcattacaggcggcggcagtgcgaggcttcgaccagcctggtgtgtcacaccatggcagggattagttgacaacaagccggaccaagtggacttacgatacgccctgggctgcaagggcgccaaattcctacccgtctttggtgaggagtttaccagcatggatggtaccacccgcggctttgatatgcttcactacgctattgtcgacggcaagcaggccagccagccagccgtctctgaggtctggaccaactcagacatcatgctcgctgactttagccacccggaccttggtgatgactacttcaccgagatccgggccctgtttaccgcaccgatcaccggagaatggcaattcgagatcagcgtcaccggtcaagcttgggtttatatcgacgacagactgttggccgatctatcgaaggagcagaagcggacctcatcattctttggcaacggaggcaatggtaccgtgattacgttctcggttacgaagggcaaggtctggaaatga

SEQ ID NO: 19198 - DNA, 3696 bp, A.fumigatus
  unsure (212): Identity of nucleotide sequences at the above locations are unknown.
acaactctgggtcggactcacatgaaacacaccactacccaatcactagcggctatcaactcatttagtcaagatccaacgaatcagatgtcactacggcctcttagggctctccagaaccctactagtatgaggggttatgccctaatctttcaggcttacctagcctttctcctcaattctttcaggcatctaactgggggtggccctancagttacctagggctctataccctaaatgatccggagaggtatgatctcgaagccttagaagccttccttcttagggcttctaagcctgaggcatctatttcatctgattctgactcccctgattcagatgattctgctcatgctagcccttctcagcagatgcctgaggctgatccagatgatgatctagattatgatctagattcagatgaggaagatgaggccctgccacaggccccccagctgcccaatgaatccctagatgaacagctagtccagaaaggggttagtctaatcatgaatctcaccctccaattggctaggcgccaggtcattcaccagagagaggtcccactatatgcctttttagcctgctttagccgaaattattcacatgactgtttcaaaaccctgtctttgattggtcattcatattcagctattatcaaatcacaccaattcattctgcttcattggctgcacaccgaaccattcaccataccagagaggcagccagaatctatggctgttttcatccgaaattggatgaccaatcacttcactggccaatcagcatcacctctaggtcatgtgttagttctgcgaatgctagcactatacctgattcggactagtgcctcactaggcagaattcaccctgtggccccacacacattgaaatatggtcaggtgactatctctcagggccacctgaggcacttcctagcccagagggtccagcagctagccctagccctatctaatgatctatttttggaattcagctattttcgtgagattcagcacacactagatcttgatagggctgcccagcatgaagatattagtcagcaggctaatagctggtcatttctgcaggcctacctagatcagggagcacatgacgatctactccagaaggttctccctgattctgattggttcattcaggtggacggccctagtggacccactctgaagctagttagggctagggctaaggcctttctagattcttctagtgcctggctgaagcagctactagctatctgtcatatgactagtggtgcacctgctaggggtactgagatcaatcaggtgatctggcagaatacccctatcaaccctaggaatctgtttctggatccagtgagcaagctattcctaattaggctagcttattctaaaacattccgtcatactggccaagagaaagaggcagttagggctttgccccagtccctttcctatttagtactagcctatcttgcctatatccgaccatttgaagaggccctgcttattaagctgaatcagaagctacctgaggcccattttcttctattctgtgatcaccggacctgcaaacccctatcttctaaggttctatctagaaccctgaagaatatgacatcagagagcctagctcaaccaatcagcttatctccctggcgccatctcatgcagggtttcattcgccatggtctaggccttcatgatccactagccgaattaggaaatgatgacctagatgatgaggccctaggggctgaccagatgcaccattctagggagactggcctgagaatctatggcagagtgattgctagcttccagggggttagggctgacatccagatagccctagttacctttagtcagcgatggcatgcctatctaggcctagctcctgaccagttaatcattcactctctattctataatagggaggtctggcagcctcaggcagattattcacctaattcacctcagcctcagcctactaggggtatggaatttcctctagatcagccaatcattcaattccattaccctcagaagcctaaggcatcacctccagctagaaaggtttctattggccagttcaatgaatttatcagcctttatggattgcctcaggctagtgatcaagccctcaggcagcaagatctatatctagatctagatctagatcagggtcagctagctaggcagctagatctatcaagatcaaatctagcatctcaccagcagctagatgagggtctgctagatcacatgctcaaagagtttatgcaagatgatcaggtgacctttagaagccctgagcagcgccaggcttttcatcttattgtgaaacaggtgccctatctatttttagtgcttcctactgctgctggcaaaaccacactattcctttttggggctagtctaaccactagtcaggttactatagtaatagtgccattgatttccctaaagctagacctctctacgaaagctgctgccttaggccttcagcctactatctgggaacctggtcaggtcatgccgctagccagttctagggtgatcttagtgcaaattgaacatctagatcaccctaggttcaatgagctagcagatgagctgattacccaaaagagactagcacgaatcatttgggatgaatgtcacctgattccactagctaaaagctatcggccaattatgttgcgtgcctggcatgccctagccctacctgtgcctatggtattcagctcagcaaccttgcctcaccacctccaggctgagctagttgatatgatgaagctagggtccctgcctgaggttccaatagttagggctgacctaaccctaccaaatatggcatatatggttgagaaggtccctgaccgcctgcctgaatcagaatatgccccctatctccggcagttcatcaagacctttgagatgaaacatggcccatttgggtctagtactactgctcaggctagtgctcaggctactgctagtgctagaactagggctaatgtgatcatcttctgccgaacaaagcggctagtagatgccttatctgatcaaatggatcctgaggcagccagattccattctgatctatctgaccaggctaagctagatcagctggatcaatttcaatctagcagatatatcttagtggctactggggccattggggcagggtttgatttccatgacattgacttagtcatccattttctgcctggtgaatatgagatgactagtttcatgcaagaatctggtcgcgcaggcaggtcacctgaccagcctggatggtcatattgcctagtaagggcataccagctgcgggctaggcctaatcaggaagggaaagccctaaaggtctccaccttcctagattatctaggtgagcaggtctgccggcggcgtatcatatctagggtgtttgattctagggctattgagtcatgtgaccctagttgggccctctgtgatctatgtgatcacaggcaatccaggctaggcctagttaggcaggtggttaggcaggaagaagggcagaatctcattcagatgaatatctttgcctgggcggtgaggttttggcatgagagatactgcctgatctgctttatctcaggtaagctatctatcttatctattaaatctattgatctattgattctattaatctattga

SEQ ID NO: 19199 - DNA, 462 bp, A.fumigatus
aactccagcaggatgatgcagtccaacccacagcgtacagatccatacaagcccccatcgctcattccgcagacagaaaaagaggatgaccaattaataaaaatcatcgcaccccttttttactccatgacaaccttagcacccacggccttcagggtctcgatgatcttctccgcctcctccttgggcacagactccttcatcatcttgggtaccgactcaacgaacttcttgctgtcaacgagggaaaggccgagcagacccttgatctccttgatgaccttagccttggaggcagcatccactgtctcaagcttcaggttgaaaagagtcttctcctgcgcggcgggggcagcctcttcttcctcagcagcggcgggagcggcagcagcaccaccacctggaccggcagcaacggcgaagccaccaacggggaggtcagggatattcaggcgggactag

SEQ ID NO: 19200 - DNA, 1386 bp, A.fumigatus
agggtgcgttgtttggtcttgcctttttctcacaccgtttttcaggggctatccaatgtgcctcgcttccgagcgcattttgttcatctactgaccgaaattgtgttgtcagacctcgaagttgatcgcttgaaggaactacgctctcaggaagaactctgcaaggctcttcgtacagtcgtcgccagcaagcagttcggaacagaggatctcttgtcatcgttagtcgccgaagcggttctcgctgttttgcccaagaatcccgtcaatttcaatgtcgacaatgttcgcgtcgtcaagatcatgggcggtagcttggaacaatcccgcgtgatcaagggtatggtcttcgggcgggagcctgagggtactataaagaaggcccgcaaggcaaaggttggcgttttcagctgccctattgatatttctcagaccgaaaccaagggcaccgtgctcttgaagaatgcacaggatatgctcaacttctcaaagggagaggaggaccgcctggaggcgaccatcaaggagctttacgactccggactccgtgttgtcgttgctggctcctccgtaggtgacttggctctacactacctcaaccgattcaacattcttgtcatcaagatcctttccaaattcgagcttcgccgtctctgccgtgtcgttggcgctacgcctctggctcgtcttggcgctcccatgcccgacgagatgggcagcgttgacgttgtcgagaccaccgagattggcggtgaccgtgtgaccgttttccgtcaggaagaagccaacgctgtaacacgtactgccaccattgtcctgcgtggagcgactcagaaccacctagacgacgtcgagcgtgccattgatgacggcgtcaatgctgtcaaggctatcacaaaagatcctcgacttgttcctggcgctggcgctactgagattcagctcgtggagaagatctcggctttcgctgacaagacccccggtctgcctcagtatgccattcgcaaatatgccgaggccttcgaggtcattcctcgtactctcgcggagtccgctggcttagacgccacggaggttctctcacgtctctacacagcacaccaccgcacgaccaaggcttccgagtcggaggaatccgaagagggcagctctgaggaagaagaggcgtactggactacaggtgttgatctgcaggctggttcttcgaccggtaccttggatgcagttgatgaaggtattctggatctcctggcatcaaagagctgggccatccgtctggccagtgagtccgctcggacagtcctcagtgttgatcagatcattgtggcccgacaggcgggtggtccaaagcccccaggccctaaccccaactgggatgaagattaa

SEQ ID NO: 19201 - DNA, 756 bp, A.fumigatus
ccctccagcacacacatagacccagacctcatcttccaaatcggctacatcgtctctggcggtaacccatccttccgagaatggctcctcgcctccaccacccacgcaggcgcccgcgtgcccctcctcatgtctgctgccagatacctgaactccctgggtaacaccgccccagtccgcaccccagccctcgagaaagtcgagcatctcgccctccatgaccgcgaccctcgagccatgactctccacgctaaggtcctcggcctccggaaacgctacacggatgccctccgcctcatcgagcaggtcatggccctcatctacccgtccaaggtacccgtcgcgaaagacggggggttcgggatggcgcgcatcgagccgccctggcgcgtgtacgcgtggctgaatgacaaagcacaagcccaagcgaacgcagatacgaaaacgggcgaggttggaaccaagacagatgatctcctgcgctctgcagccctggactaccaggaccccgagtcgctggtccagtatgccacagcgcggatgcgagcgggcgatctggccatgtacgaggattgcatgagccggggccgcgacggcagggaaggccgaggcgtgccgtcgactcgcgaacttctactatctcacttcgctgggacggtacccgcggcgaggggtgcacgagaccgaggccaagaccagtgcccccgtggaagtagccgcaaagccagcctcaagcgcatcctcgcgaacgagtga

SEQ ID NO: 19202 - DNA, 303 bp, A.fumigatus
cgccttctctcccagatgaccggccgccgacgattcaactgcgtctcctctcaccaggaactaagaatgggccaacagagctatgaggaggttttgagatcaacgcgcgggaagattctccccgaaaatcatccgctgaccatcatggtgaatggcgtgctccgcagattgataccacaagcgccaattgaaggtgcagattggagagttcatgtcatcaaggatgacggtatggtcaatgcttttgttttgcctgggtatgcatatcctttaacatcacggcctgctgtcgtatgccactga

SEQ ID NO: 19203 - DNA, 339 bp, A.fumigatus
tcccgcctgaatatccctgacctccccgttggtggcttcgccgttgctgccggtccaggtggtggtgctgctgccgctcccgccgctgctgaggaagaagaggctgcccccgccgcgcaggagaagactcttttcaacctgaagcttgagacagtggatgctgcctccaaggctaaggtcatcaaggagatcaagggtctgctcggcctttccctcgttgacagcaagaagttcgttgagtcggtacccaagatgatgaaggagtctgtgcccaaggaggaggcggagaagatcatcgagaccctgaaggccgtgggtgctaaggttgtcatggagtaa

SEQ ID NO: 19204 - DNA, 312 bp, A.fumigatus
catcacggcctgctgtcgtatgccactgaccgtacacacagtgggaaagtgtttgtctacacaggcattctgccaatctgtaaagatgaggacgggcttgcagctgtattgggccacgaaatcgcccacgtcgtcgcgcatcatccggcagagcgcatgagcaacaacatcctgaaagttggagcggtattacttatttctatgctatttgacatttcaggccagattccgtcgctactgctcaacctaatgtacagcttgcctaattcaagaacgcaagaggtaagacttgcttccttgctccgcagatga

SEQ ID NO: 19205 - DNA, 510 bp, A.fumigatus
caccgcgattgctacagtcacgatgctgaggacggcgccatcattcgcaatatcgaggcctgccaggcgatctcaaagaccgtccaaacatcgctcggtccctacggccgcaataagatcgtcatcaaccacctgcagaagatggtacttacgtccgacgccgctacgattcttcgcgagttggatgtcgtgcacccggctgccaagctgcttgtcatggcaagtcagcagcaggatgcggagatgggtgacggtactaacatggtcatcattctggcgggagagctgttgaaaaaggccgaggaattgctacggatgggcttgaagacgagtgatatcacccagggatacgaaaaggcacagaattatgctctgaaagtactagagggtgcgttgtttggtcttgcctttttctcacaccgtttttcaggggctatccaatgtgcctcgcttccgagcgcattttgttcatctactgaccgaaattgtgttgtcagacctcgaagttga

SEQ ID NO: 19206 - DNA, 768 bp, A.fumigatus
ccccccgcattgcggggcatccttcgggctccctgtggtgaagacagtttagccaggtcggctggcgtgagaattcgagtggtcgcaagattcgtcttcttcgtctcgggtttggcagtctcggacttggccttgccctcttcctcatcgccttgcttggcctttttcgcaggcggggattcgtcatcatctgagtcgctcagctcgatttccgcgtcgctctccacgtcaatccatccaccggaatcatcgctatcctcgtcctcttcaatgttccatcgttcccaggccgcatcgtcttctgcctcatcgacctcatcatcttccgcatcagaaggcaggcccttctcgattctccgttttcggcgctcttcctccttccacttctccagaagctcaagaccttcgatctcgccagtctgttgctcaccgaagcggcgctccttcttctctccagctcgcaagctcatagaagcctccttaccgcggtcccgtctcttgagcatatccgcgccgacatctctgtacagactaagtaatcctctggcagccatgaccacgcccttgtctttactcttcctgtacataacgagatcctgcaacaaggtttcgttcatcgctaaaggctgtcgggcgcaaatctctcgaatggcattgaggccggcagtagccacctccgacgctgctgcttctgagacaaactcatttgcgatcttctgcacgagaggctccaggacatcaggtggaaccaagtcatgtgatgcttga

SEQ ID NO: 19207 - DNA, 1122 bp, A.fumigatus
gaactgccattgtctgttcattcgcaccaaggactaactctccatagttaccagaaacggcgcacgctactcctttcgcaatttctcggtccaaacaagccgcttgagatcaatgcgtcttcagaaaatccgtcgtcgccaataagcagcgcaaacattgctccaccggccattctgagtgttcggccccctacggcggattctgcgagccaaaatgcatcgtcgcaatcctttgcacagaataacgtacctggaaacggaagcttcggatacgaccggcgagtgagcatgggcacacagggctctatccaagatgatagtgcgtttcaatacaatagagatagtatggcattacagccccctgagcggatgccctcctctacttcatacgattcccttttccttccgaagccgcaagcgcctccaatcgcgcaggaggactcccgaaccgcaacacttttgagccagaactatgcctttaaccctggtgcttccgaccatgtagatgaatctgccggagcttacgacatgacacccggcgcggtcacgcgacaatccacgatgctcgattcccagcaagcatacttctctgactttgcgggccagcagcagggtgactatagagacagctatgggggtggattccatcgctactctcaatcggacacgttttctccaacggcaaatatggcgccaccgttaattcctgcctctgaattacctcacggggcgactatcaaccacctgcttcccctcgagcctcgcgatataccttttgcggtacacgacccgcacgacaagaacactctaatgtccacttttgacaacatccctgcagtacttcggcatcgcgctagagttcatcctaagcagcccgcttactgggtcctagaccagaaaggcaaggaaattgcttccatcacctgggagaaacttgccagtcgcgcggaaaaagtcgcacaagtcgttcgtgacaagagtaatttgtaccgtggtgaccgcgtggctctgatttaccgtgattcagagatcattgagtttgctgttgcccttatgggatgcttcattgctggggttgttgctgtgcccattaataatctcgaagactaccagagtctaaac

SEQ ID NO: 19208 - DNA, 456 bp, A.fumigatus
cgtaggtgtttgattccaaaatccctgcgactcagacgtgctgcgaaaggaaaaacttatttggtcgggttgggttccaatttcgatgggagacattcgactcgtacaaaaatggaaatatccgcgcacacaagactaggaatagatgcattggacaggatcgggttgacagacgcgaatttgctgactcggatttacaaatatagcgactacatccagatccgcaaccccgtctacatccctcacactgccggtcgttatgccgctaagcgtttccgcaaggctcagtgccccatcattgagcgcctgaccaactctctcatgatgaacggtcgcaacaacggcaagaagctcatggctgtccgcatcgtcgcccacgctttcgagatcgtacgtgcattttccgcgagaacctggaactcagccaggcaacgtctgccagggacaaattactga

SEQ ID NO: 19209 - DNA, 468 bp, A.fumigatus
acggtcgcaacaacggcaagaagctcatggctgtccgcatcgtcgcccacgctttcgagatcgtacgtgcattttccgcgagaacctggaactcagccaggcaacgtctgccagggacaaattactgatgcttcgtctttattttcacagatccacatcatgaccgaccagaaccctctccaggtcgctgttgacgctattgtcaactgcggtcctcgtgaagacagcactcgtatcggttccgccggtaccgtccgtcgtcaggccgtcgatgtttctcctctccgccgtgtcaaccaggccatcgctctcctgaccatcggtgctcgtgaggcctctttccgtaacatcaagagcattgccgagtgcctggctgaagagctcatcaacgctgccaagggaagctccaactcttacgccatcaagaagaaggacgagctcgagcgtgttgccaagagcaaccggtaa

SEQ ID NO: 19210 - DNA, 312 bp, A.fumigatus
catgagagcgcggtattcaggtcgtatatcgaggactttcgggctcagcactaccaatatgagagccatcgagagatttttatggcagcgccaacggctgccactgataccggaatcatttcgctgcgagaattgatcgattttatcgctcacgttgccgattgctatccaactataacgaaggaatttccgcagcagctcatggatatccttacccagcaccatctggttttggaacccgaactgcgtgaaaaaattgtcggaagcttagtgctgcttcgaaagaaagagttgcttgattctgcgacgtaa

SEQ ID NO: 19211 - DNA, 222 bp, A.fumigatus
aggttcacccaacgacaccgtccgtcaccttcacgaatccctccctcgacaacaggtgcatacggcgtcacaatgtctgatcacggggaagtcgaggtcgaaaacccttctggggctttccaggctctgcctaaggacgctcttgccgagatgggcaccatcaagctgttcaacaagtggagctacgaggatgttgagatccgggatatctctttgacgtag

SEQ ID NO: 19212 - DNA, 1512 bp, A.fumigatus
  unsure (47),(61),(100),(108),(134): Identity of nucleotide sequences at the above locations are unknown.
gctgctacagacattgttccctattctgatcacaacacccaagcaanactttccggccccntcattttccaaaagattttgatggacctgcgctcatcgnacgccaanacaacgaatcacaagcttaaccggantatgcagactgtcctgttcaacttagttacgtccgaccgcacctcttccaaaggcttgtgggcaatcaagctcacgcgcgaactatggaaacggcagatctggaccgatgctaaagctgttgaagtcatgaaggaggcctgtctgtcagaaaatgagaaagtgatagttggtggtgtccgtttcttcttgggcggcgacaaggaacgagaggagatggaagacgagagcagtgatgaggagaccatcgacctcgcgcgagtgaagcatcaggttgggattaacaagaagacccggaagaagtcccgcgcagtcgagaaggcaaaggccatagtcaagaagcgagaacgcaagaagaaccaaccgcatcctctgaacttctcagcccttcatcttctgcacgatccccaaggattcgcggaggcgttgttcgcgaaacaccttcagaatacgaagtcgaacttgaacttggagcaaaagctcctggttctacaacttgtctctcgtctcgtcgggttgcacagactgcatatcatgcatctctactcttactttcagaaatatctcacaccacgtcaggcctctgtgacatcgttcctggcttcccttgctcaagcatcacatgacttggttccacctgatgtcctggagcctctcgtgcagaagatcgcaaatgagtttgtctcagaagcagcagcgtcggaggtggctactgccggcctcaatgccattcgagagatttgcgcccgacagcctttagcgatgaacgaaaccttgttgcaggatctcgttatgtacaggaagagtaaagacaagggcgtggtcatggctgccagaggattacttagtctgtacagagatgtcggcgcggatatgctcaagagacgggaccgcggtaaggaggcttctatgagcttgcgagctggagagaagaaggagcgccgcttcggtgagcaacagactggcgagatcgaaggtcttgagcttctggagaagtggaaggaggaagagcgccgaaaacggagaatcgagaagggcctgccttctgatgcggaagatgatgaggtcgatgaggcagaagacgatgcggcctgggaacgatggaacattgaagaggacgaggatagcgatgattccggtggatggattgacgtggagagcgacgcggaaatcgagctgagcgactcagatgatgacgaatccccgcctgcgaaaaaggccaagcaaggcgatgaggaagagggcaaggccaagtccgagactgccaaacccgagacgaagaagacgaatcttgcgaccactcgaattctcacgccagccgacctggctaaactgtcttcaccacagggagcccgaaggatgccccgcaatgcgggggga

SEQ ID NO: 19213 - DNA, 183 bp, A.fumigatus
tatgtcaatcacacacatggtatttgcgaggacgctgatgattccgccgaagtcttttacaaacatcacaacttcctcctctctcggatgctgaagggtgaagaggaagtggaatggaccaaaacacaccttttcgagcatttatgcgaaaagtttcctgtgagcagatccatcagtacctag

SEQ ID NO: 19214 - DNA, 291 bp, A.fumigatus
  unsure (104): Identity of nucleotide sequences at the above locations are unknown.
ttgtacttgattgatgctttgatgcatacgttaatgatctttcctctcccattagatgaggacaagaagttcaatatcctgatctcacgtgtggtttgtatcgntaagatacaacacaagaatatcggttattcagggcccctaagcaggcaattgctctgttaccgctctcttatttctgaggtccgctccacattaagaaacctgatcgaagttgttttagctagtctgcttctcagcggagatgctagcagagatcggaatgactggactgagatgagtatcaagtaa

SEQ ID NO: 19215 - DNA, 603 bp, A.fumigatus
tatgactccgtgattacagactgcaagaacctcgcccctacttgggagaccctcgccaatgacttcgctctcgagcccaacgttgtgatcgccaaggttgacgctgaggcagagaattccaaagccctcgctaaagaacaaggcgtcaccggataccccaccatcaagtttttccccaagggctcgactgagcccatcacttacagcggtgctcgttccgaagaagccttcatcgagttcctgaacgccaacgctggtactaaccgtgttgttggtggaggtctcaacgagaaggccggcacagtcgccgttttggacgagttcattaataagtacatctcgtcgcgcaacgccgaggagctggttgcggaggttaagaaggctgccaagggtcttcaggacaagtatgctcagtactatgtcaaggttgccgagaagatcagccagaacgaggagtatgccagcaaggagttagctcgtctcaagaagatccttgagaagggtggctcggcccccgagaagcttgacgatattgtttctcgcagcaacatcctgcgcaagtttgttggcgagaaagacactgatgccaaggacgagctataa

SEQ ID NO: 19216 - DNA, 897 bp, A.fumigatus
tcaaggccgcagagaagagaaaagcgacaaagaagacgaattcaggagatggtgagaataaggaagagggtactgttgaaacaaatggcaaggtatgtcggcggtgccacagaagcgttaaaatcaagattgctaaatcaatcgctcgcgtgcgcacaggctcaatcggagaatttgaaatccaagaagcgcaacgattctgaagatgaagtcggatcaagcaacaatgcggatggagagtcggataaagaggctaccgtagaagcggaagacagcgaggaagatgaaattgacgaggaggaggagggagaagaagaagaagaagaagacattcctctatccgacttgtccgaagacgaaagagaggatgtggttcctcaccagcgcctcacgatcaataactctgctgctatcaacacatctattaaacgcatttcgttcatcacctcccagacgccgttttcagagcacaattcgctagtctcgaaagagccgatcgaagtccccgaccccaacgacgacctgaaccgcgagctggctttctacaaggtttgccaggctgccgcttcagaggcacgccgcctgttgaagaaggagggtgttccgttcactcggcccggcgactattttgcggagatggtcaagaccgatgagcacatgagcaagataaagaagaagctttacgacgaagctgctgccaagaaggctgccgcggaagctcgcaagcagcgggatctgaagaagttcggaaagcaggttcaagttgccaagttgcaacagagacagaaggagaagcgcgagacacttgagaagatcaatgagctgaagaagagtaggttacccgttcttttcacacaggtccctgaacaattactgacatgttctctcgtctcctag

SEQ ID NO: 19217 - DNA, 204 bp, A.fumigatus
tatgcagcagttctctcaagactcagtttgaccgctggctccgttctccatgagcgaaagcccagtgtcaaggttccccatctcccgaatccgttcgagaagattatcaacgcgtatattaatattcaacctttgttctgcaaaaacaaggtcaagtttggccttggtgtcgtccgcatgcgccaaggaatgatcttggattaa

SEQ ID NO: 19218 - DNA, 405 bp, A.fumigatus
gatgagtatcaagtaaggcttatattatgcttcacaaagatctacggcgctgaccttcatagacttccgttcattgacgacaatgactgcggtctcggcattgcagtgcgcacatatctcgatgacctgcccctgcaggcggacccaacttcgccggaggcacggttagaggtaaagtccaagggtaaagagtggtttcagcacagtgacagctttacgagcaacctggaaaaggctttcaagctctgggatgcggtgagtgccaaagaatcgaaccaattttcaccacacgagctgatctttttcttctaccaggtctacaagggcacacagaacgccagtaaagaatttaaagacgttcaattgtggaaggaggcaaatgaatggttgtcggcgaggcgatag

SEQ ID NO: 19219 - DNA, 651 bp, A.fumigatus
tatttccaatatcttgtgtttttgattgaggataatccagctcccgcttcttctaagacgcaagccaccatggctcggttgagcttcctgcttgtgagctgcctcacactgctcgtcggtattgccagcgccacttccgccgtcattgatctacttcccaagaacttcgacgatgtcgtcctcaagtccggaaagcccgctcttgttgaattcttcgccccttggtgtggccactgcaagaacctcgcacccgtctatgaggagctcgctcaggctttcgagttcgccaaggacaaggtgactgtggctaaggttgatgcggacgaacatagagatcttggaaagagatttggtgtccagggattcccgaccctgaagtggttcgatggcaagagtgacaagcccgaggactacaaaggtggtcgggatctggagagcctgtctgcgttcattgcggagaagacgggcattaagcctcgtggaccaaagaaggagcctagtaaggtcgagatgctgactgagtcttcgtggaagtctaccattggtggcgacaagaatgtgttggttgctttcactgcgccttggtgcggacgtgagtccttccatcaattttttcccttttcctggctttgtcggactgatctaatatga

SEQ ID NO: 19220 - DNA, 330 bp, A.fumigatus
acaattactgacatgttctctcgtctcctagagcgcaaggctgataagtctggcattacggacaaggataacgatctattcgatattgccatcgaagactctggcaaatccaacagccgcaagcgcagtcgcggcaatgagagcggcggaccctcactgaagcgccagaagaagaatgaaaaatacggcttcggtggtaagaaacggcacgccaagagtggtgacgctatctctagcggagacctgcgtaacttctcagtcaagaagatgaaaggtggctccaagagacctgggaaaagtaagagagcggcggcaaagggcaggtcctaa

SEQ ID NO: 19221 - DNA, 2175 bp, A.fumigatus
gtcgggaggacgggggcgcagtacctctccatggtaatccatcatttagtggtggatctagtctcatggcgcatcatcctggccgacctcgaggctatgcttaggggagaaaatcccatggccaaccattcgacccctttccaaacatggtgccgactacaggcggagtatgctcggcaatatctctccccacagcacgcttttcctacggatcttcccgaccactaccatcaggatccgtcagtcttctggggtcttgctggacaaccgaatcttgtccgcgatagccggcgccaagtgttcaccctcgacgagcacacaaccagacagcttctaggcgccgcaaatgctgcattcgccacccggaccgacgaggttctgcatgctgttcttctttactcatttctcaaggttttcccgcatcgcatagcgccgctcacgtttagcgaaggtcatggaagagagccatgggactcggccattgacctatcacagacagtcggctggttcacgaccatgtggccagttgttgccgagctgcagcagaattatagtttcctggaagttgtgtgccgcgtcaaagatgctcgccgggcggttccttgtaacggatgggcgtactttgtgtctcgctatctgaatcccagcggccggcaggcattccagcagttccatcctgtcgagttggtctttaattatgctggtgagtaccaacaattcaaccaagcgggtgcattcttcattccagatatgcccgagtaccaaggatcactggatgctggagagcagattcagcggtttggcatctttgaagtgtttgcgtccgtggtgcgaggctgcttgcagtttcagtgcatgtacaatcgttacatgaagcaccaactcgagattcagaagtggatagagtcatgccggcaaacgctcatcgaagggtgtagcacattgattgcagccaagccgagccgtactctttcggattttccccttcttccattgacgtattcgacgctccgggaactcctcgatgtgactctccctactgcgggcgtgtcggttgagaacgtcgaagacatctacccctgctcgcccagtcagcgcggcatgctgattgcacaggctaaagccgcgcacaactacaatgccagcgtgacctggagtattcgatcgcgcattgactctcggccgaatgttgcgcgtctcaaagccgcctggtgtgaggtagtgaaacggcacgcgattctgcgcaccgtttttgtggagagcccgtggcctgaatcctacatggatcaagttgtattgcaaaccgtctcaccagaattcgtgttctccaggggctcggattctttgccccagtcgatatccagcccagggcagacgaagtggtcgaagggacagtgccagcacataatgcgggtctgggagagggacaatggagatattctctgccgtcttgatttgagccatgctattatggatcggaccacgctagccatcattcagaaggatctctcactggcatatgatgagcgtctactcccaggccgagcacctctgtaccgtgattacgtctcttacatctaccagcaagactctgagagcgcgagacagtactggcaaggttacctagagggcgtcgaaccatgcgaattcccgacgctgaaccccgttgatccatccattaccaacgaatggggtaatctgtaccggacgctcgaggacagaagaagactggaagagttctgccgaacgcacagtgtcactccatggaacgtggcaggactcgcttgggcaatggtgcttcgcagctttaccaggaccgacagtgtgtgctttggctatgtaaaatcaggtcgtgatcttccgatcgacgggattgccggtactgctggtccggttttcaatcctcttccatgccgcgtgcatctgaccgagagactgacagccagggagactattggcaggcttcaagaagaatatttgcagagccttgcccatcagtcgttccctctgtctgatatccatcgcctggccggagtaactagtggcgtgctcttcaacacatcagttgcggttcaaacagaggtagcgtcagaggcagaagaggccaagaggagcctggagttcaccaccgtcgccatggaggacgggacagaggtaagttgggtcgaactgtaa

SEQ ID NO: 19222 - DNA, 3477 bp, A.fumigatus
cttgcccaggatgatatggtcattaccctcgttccaaggggcggcgaactagtgctgcatctgaggcacagatcgcgcacactcacaaccgaccaagcctcaacggtccttgcgacatttgaaaaggcactgtgctccatattggcgaacgccgaagctccaatgacgtccatcgatgtgtttagtgaccatgacaaggcgatcctttggtcacgtaatagacgcgtccccgatgcagtggaatcttgcgtacatgagctcatccagaagcactgtgtagagcgcccgcactcccctgctgtcaatgcttgggatggggcattcacatacgggcaattggacgagttgtcctcccggcttgcagtctatctagctgcccaaggcgttggccccaatgtcgttgttcctctttgttttgaaaagacgcggtggacgccgattgccatgatgggtgtcatgaaggccggcggtgcctttcttcttctggacccctcatacccccttcagcgcctcaaggacatctgcgcggatatcgactgcagactggtggtgtcttcaacaacccatgaagccatgagcagggaactagcctccacggtggtcgtcgtgggcgaggatcgtcatcactggcagctggagaatacctcacatactattaccatgccgaaggttcgaccagccgacgcgctgtacgttgtgtttacgtctggctccacgggcaagccaaaaggtgttgtcatcgagcaccggtcctattgctccggtgctctagatcatattcgatcatacaatcttactcctcagtcccgggtcctgcagttctcgtcatacgcctttgacatcagtattgtggaacagctgagcgtgctcatcgcaggtggttgtatctgtgtgatctcggagtctcaacggaagaacagtctgggcgaggccgccactgctttgcaggccaaccacgccatgctcattccttccgtggctcgcttagtccgacacgaggacttgagcaccatcacaagcctatctttggctggcgagtgcatgcaggaaacagatgtgtcctactgggcacaacacgttcgtctcatgaacgggtacggcccggccgagtgttctgcattgtcgctggtccaaccctgcgtcctcccgcatagcgacccgcacgatattgggtaccccgttgggtctgttgcttgggtggtagaccctcacgatcaccacaaactagttccaaatggtgctgttggggaattgctgattgaaggccccatcgttggccgggggtacatcaacaacgccgagaagacagcggaagtcttcatcgagcccccaacctggctacgtactcttcgaggacactgtacctcgcgtctgtacaagacaggcgacctggtgcgggcaaaccccagtggctctctcagcatccttgggcgcaaggatcgtcaggtcaaattgcgcggccaacggttagagcttggggaggtcgaggctaacgtgcagcattgcttccctggggcgctggatgtagtggcagacttgttaccttcttccaggggcggaaaaccgcagttagtcgccatggttttccaaaatgcagagcgagcagcgcgtattgctcccgaaagcgacagcaagctcatcgcagaaccctcggtggacttcatgcagagcgccacaaccgcagaaaccaggcttcgacaaacggtgcccaacttcatggtgccgtccatgttcttgccgctggcccaaatccctcgaactcattcagacaaggttgacaggaacagcctcctgaaagccgtcgctgctatgtcttcaatcgaactacaggcgtataaagcttcggttgatgctgggcactgttcgacgcgggctccgtcgaccgaggaagagaagaagctggcggaaatatgggcggatgtcctcaaagtgccagtagaacatattggagccgacgataatttcctactcagcggcggtgactccatcgacgccatgaaggctgccgcattctgccgtgctgcgggtatggctttgagcgtcgccgatatctttgctcatcctgtcttgtcggatctcgcaaaggtggccgtccccaagtccctcaatggctcctcgacctcccatcagccattttcgttgagtccggtagacagccccaaggacctgcacatgtcattgatggagcagggtctcgtccctcctggatctgcactggcagacttactaccgggtacacaagctcaacaatttttcattgaacgaggtactttccactcttataacttttctatccgcggccctctggacagatgccggcttcaaaagacgtgtacagcgatcctgtctcgacacagcattctccgaacaaagttcctacaatacgagggccgtctgatacagattgtcctcgataacctggagacccctttcacccattatacgactgatggagatcttctcgagttctgcaagtcgctctgggaaagggatctggcagcgttagatggactgggaagactcccgtgcaagttcactctcgtgtcccgctcagagcaggagcacgtttttacgatccaaatctcccatgcccagtgggatggggtatctattccacgtcttttcagtgatatagccgccatatataaccagataccactgccatcaaccacccactttgccgattacgtctatcatcgttcctcgcgagacgagcgacctgcctttgatttctggaagaaatatctccgaggctcctctatgcccgtgccgttccccgcaacgaactgccaggaccgcgagcacaagactcagtggaccttccaaggcataaagaatccccgtctgcccgcgggcatcacaatggcctccctcgtcaaggcggcgtgcggattccacctctgccagcttctatcccagaacgatgtggtttttgggcacaccgtgaacggccggaacctggcccttgataatgtcgaagctctcctgggatgttgcctcaacttcataccattgcgggtgatgctgcagccctcgtggacggtcctggatctgctcgcccacgtgcaggaacagtacacccgagcgctgccacacgagcacctcgagctccgggatatcttcagacattcgaccccttggcccgcggatacccagctcagcttcattgtccaacatcagaatatcgagctgcaccacaacatcgccttggacggtctgcaggtgcaatactccaagttcgcacagttcgatccgttgacggaagtttggatcttttccgaacctcacccagaccgactggagatccaagtgtgcgccaatacccgggtcttatctgaggaccaggcaagagctttgtgtcggcggctctgtgacctgatcgaattcttctctgcttcaccagactgcccgctgagcaaagtagtcgatcacatggaccgcccagggctactcgcagaagagaaagtgctaaactga

SEQ ID NO: 19223 - DNA, 2583 bp, A.fumigatus
  unsure (1143),(1155): Identity of nucleotide sequences at the above locations are unknown.
gatgcagagggtggctgcgcggcgtacgctctctcgatgatctgtcagctggtgggatccagtcagatcgatgtgaggacagagttcgatcccaaagtcatccaggcccctattatgcagcgaatcgttcaccacttcgtgtacacgctgcaataccttctggcgcatcccgatgctcgcgtagcggagattccagtggttagtcctggggaaaagcagttactgcgccaatggaacggcatcgtgccgcccgcctctcaccaatgtgtccatgaaatcatacagcagcgtcagatcgagcgtcctacctctaccgccgtgtgggcctgggatggccagttgacctatgcagaacttggggagctgtccgatcgcctagcggaatacttggccaccaaaggggtccagccagaagtcatcgttcccgtctgcctggagaagtcatactggaccaccgtcgccatgctgggaatcagcaaggctggcggggcatttgcccttctagacccctctcaaccggaacaaaggttgcagagtatctgccaccaacttaactccgctgtaatcttgacctccgagaaaaatcgcgatctggccggcaagctggcatctcatcccattgtgctgagcctgcagagctcccgccgctggggtcatgggccagcaaaacaggcaccggctacagccaggccggaccacacgttatatgttgccttcacatcaggatccactggaacacccaagggggtggtcatcgagcatcgatcattctgcacgagtgcactggcgctgaaccgaatcactggcgtcaacagtgagtcgagaatgctgcaatttgccggatattcctttgacggcagcataatggagatgctcagcgccctgatggccggtgcttgtgtctgtgtgccctcggaatttcagcgacggaatgaattggtggcagcggctgcgaagttcgagctcactcatgcccatctcactccttctgtagcacgccacctcctgagaggaaatcccgagtttacaaagaccttggtgagcgtgggagagcccatgacagcgtctgacgttgccgactgggccagtaatggacagtgtaaggtgatgaatgggtacgggcctgcggagtgcgcggtgtcnaccacgatccangcggcggtgacatccgcctccgacccgaaaaacattggatttccagtggcaggtgtctgctgggtggtgcatcctgaaaaccatgatattctgctgccgcctggcgctgtgggagagcttctgatcgaagggcccactctcgctcgcggctatctcaacgagccggacaagacagccgccgcatttatccctctaccagcatggataaaggatattcggcctgaacaacctcacgggcgactgtacaagtctggtgacttggtacgatataacgcggacggctcctttcagtatatcggccgtcgggacagccaaatcaagctacgtggccagcggattgagttggatgaagtcgagaaacatgtctatcaatgctggccgggggttatcgcagtcgttgccgttgagatggtcagcttcactcctgccacgcaaactctcgtggcctttgtcgtggtggaggagcatgtcgataccaccggggacatcctagcggcaccaacccaggagttcactggacaagtcgctgtagcgcaggctcggttgcgcgaagctattcccgcattcatggtgcccgagatctttatccctcttcttgttctgccgcaaagtgcgtctggcaagacggatcgccgccggttgaggagtatagccacggcctgtacacgggagaagctggcggcgtatggcgccgtaggaaccggtacgaaacgagaacccacatcagtcgcggagcgggagatgcaggcaatctgggcacaggcattaaacttacctctagctgagattggaatggatgatagcttctatcaactgggaggtgactccatcacggctatgcaggtagtcgctcacgcacggtccaaagggttggccgtaacaatggatagtattctgcgcctcaagtccatctccaaaattatgtcccatgagagttcattgtcaccggcaatcgtgcacatagacgaagaggaggatgtgtggtttgccctctccccgattcaacagatgttctttgaccggcaacccagtggctgggaccgatttagccaggtctttctgcttcgtgtctcacagcctgtcactgcgagccagctgcaaatggccctgcataccctagtctcgaagcatcccatgctccgcgcgcggtttgcgaaacagcacgatggaagttggcgccaagtcatcacctcgaaaatccaagaatcctaccgctgccgttctcatcgattgaaccgtcggtccagcgtggatggcgttgtctcatccggcgcctgttcactcagtatccagaaagggccactgattgcagtcgacttgatgagtcgggaggacgggggcgcagtacctctccatggtaatccatcatttagtggtggatctagtctcatggcgcatcatcctggccgacctcgaggctatgcttag

SEQ ID NO: 19224 - DNA, 285 bp, A.fumigatus
gggattattccaacgaaggctcagggatccttggggttctccgatttaaagtccaaagtctacagcattttacagatgaatgagtattccctttctctatcatatgattactggcagattgatatgttctcgtttcctactctggagtactcccccggtgctatgactacctatctggtgctcgattgtttacaccaggtgcatggttacctcagtagctttgaccgccatctggtgactgcactcgctacttgcatttcgcctcggagtgttgatcttctgtga

SEQ ID NO: 19225 - DNA, 183 bp, A.fumigatus
aggttgattatttgttatgaccctttcgcggtcgacgcgccctcgtggttcgtgtctttcgattcaggggtaaagagacgttacgaaccacggttctcttactctgtgctccctccgtactctgacgactccgtggctctacactattacaatagcttactcatcaagttgtgcatgaaatag

SEQ ID NO: 19226 - DNA, 195 bp, A.fumigatus
caattcgcattcgaccgttccattggtaccatcctacgcatctccaaaagtgtcgaatcgctcggcctccagatcccctggcccgcagcaaccccccaggaccaacagcgtcaccccgaatcccccagcgactgccctcccaacgctcccaaaattgcgtggggcttgggagtcatccacatcgtccccggataa

SEQ ID NO: 19227 - DNA, 1215 bp, A.fumigatus
tcgattcttctcttgatagatttagatccgctcgtttcttccgccaattcggcgtcttgtccgccgccgttcatcctgatacccaacgacaatcctgacaattcgcattcgaccgttccattggtaccatcctacgcatctccaaaagtgtcgaatcgctcggcctccagatcccctggcccgcagcaaccccccaggaccaacagcgtcaccccgaatcccccagcgactgccctcccaacgctcccaaaattgcgtggggcttgggagtcatccacatcgtccccggataaccgagagaaggagagtagtgtttattatacaactgcttggggctcaccttatgcggcaccaagcccgcggaggctttcttggtctttaagtcagttcgcgggtattgatcgcgcctctggagacagctctccagcgtcgatgcgaagtggtatacaccacgatccggagataaataatacagacttactaaagccttctgctgcggagacatcggcgcgtcatctctacagcaaccttctcagtcattctcctggacgagacctgcttagcaggaaaggaggtaaatccatcaaggattttacgcaggactggatcaaccaatatctctcagggcaaccacgaacggagcgaagcaactggttgagcgacgactccggtagcgaggccccctcgttctttaccgcgcaaaaccattttgccgacgacgcttcggacgactggcttggtctggaggaggatagacctggcgaggacctgcttagaaccccaacactcgccgactttgtgagccgacgagcactcgctgctaacggcgagaatagcctgggccgcccgaaactcaaggattctctacataaacgaactgacacgcttcggcaagaagacttttgggggttcgcttacgacaaggatccccagtcacttaccatgacagaattaaaagatacacaacattcagcggagatggagaccggcaaggcgccgtcgccggctgagaagccgctgcctcctccgcctccagcagacgctgatagcgagccccaatcattatcgcacccctctgagagctcatccactccggtaccagtcaaaaagccagccctggacaaggagctgcctacgccaacgccaacgcccaggcccaggaatgatactcgtctggcgcgggaaggcctgcattattgccatccctgtcgatga

SEQ ID NO: 19228 - DNA, 5718 bp, A.fumigatus
  unsure (409): Identity of nucleotide sequences at the above locations are unknown.
aagatacacaacattcagcggagatggagaccggcaaggcgccgtcgccggctgagaagccgctgcctcctccgcctccagcagacgctgatagcgagccccaatcattatcgcacccctctgagagctcatccactccggtaccagtcaaaaagccagccctggacaaggagctgcctacgccaacgccaacgcccaggcccaggaatgatactcgtctggcgcgggaaggcctgcattattgccatccctgtcgatgacaaaagaggcacggaggagtttgggtaccgtttactgtcagtcgaagacgtgcaacagcggctgagagagtgggaagacgagggctatgatatccgtggcttcactgtcggcgcgcctgaggacttgtcagatcttgaactgggtgggntaagccgccggccattccccgactctagggatgtccaggaggagtgggaggccggaaaatacactgtcagcattccagataaagccgaatgggatgcgtatgtcagctggcttcaggaggagaagctgcgggctctcggagtctcccttggagatgaggagatgccaccatccatctcccctgcttctgctgctcttagccagatggcccctttccccggacttatcgcatcgccgccgattcctacggcttcagcaaccagcaacccgctatcgattccccaccatttctcgccccacttcaatcagtcggcgaatgtaagtaatggcatcggttcgttggcgtctccggcctcccagttcagtgtacagacgccattcttcggggtggaacagaatcttttgccggggtatcttccgttccaacccacaccccctgctcaaggcgctcttactccccagggtttcttcaatgtacgccaaggaaatgttacctcgactataggtggcaaccttcccaatctgacgtcgattatgtcgccagtttctcctttgcatgaccaaggcgcattccatccaggtctggaggagctatcactcccatcaaaggattctcagcatggacactccgatcatggtccgcaggaagctgtgccgggaggcacccacccacgggcagaaacgccggatcacttccacgcgtcaaacgtcgaaatcgctcagccgacaccgcgcggtcacagtcggggccataatctcagcgaaacccttcagaaaggcctggaccaggttggcccctctgattaccacctggaggaatcaatagaacggcaacttgatgaggatgatcgagagccaatccgaaacaatcttcacaactctgagctcttccactcacgatgggcattgccggataacgaccaccatggaatgcaacgtgtacctcaacatctccaacaattttacggcgagaactacgtgcaagttcacgccaacgaaggatcggatattgacacaaatccgagtctttctggtgctcctcagggacatgggtcacttaccaacaacatcccctggcatgaacccaagccaagctcaggttcattcgtcggcggacacaagtcaaagctctcaacctcgactctcaatgtggaggcaagggagtttgatcccagcggcgcgtcaaccgcgcagaactatccaccccaaggcagtgcattccaattctcaggcatgggaggccctgcatttacttttgaggctggagcaaacttcatacctgccggtggtttcaacgttgctgctcccgccttcaatccagccggcaaccttggcccctcaacatctgcccagttttcggccggccgagcgaagatctttggcgacatcgatctttcccagattactaaacctcctaagaaatccaaagccattccaatcgtccgtcccgatgacaacgcccaggatagcaaaaacaaagccaacgccgaagacgaccatggtcgggtttcagcggatcgtcacaagcgtgttcgtcgtggccagagtcttgagggagatgctcaatatgctgtacccagccatcctctgacagaaacgactaatgctcaagggtctaaagcgtcaaatgttcctcgagacgtgcctgcggagggcaaagagaatgaggtaccgggacaaattgcacacggcctgaaccagaaagaggctgttgacgaggagaaaaagtctgtggaacgaaacgacacgcccgtcagtgaagcgtcaacatggactccttttgacaccaaggaagaaagggcagatgtacagccagagtcccaagaacaaaagcaagagggtgacaaggccacgcagaaacctgccccttcagtggctggagccgcggttaacgacgaaggcccgacgaagaagaccgcagagaccagcgccaagagctcgtttctcaaaccgactgcaaaaccattcgaattcaaacctgccgtccctgaatttgtgccgactgttttcgagcaacccacttctgcacctgcccctgcccctgagaagccgcggaatgatctcatggcgtcacgttatgctgttgcaagccgtcctgcttctcccaagcgggattcagtaccctctgagtctgccgagcctgtggctcatgcagccgatgacgtccctacagtcgcagcggatgtgccggaggatgacctctcagggcctgtttctgaggtggactcgccgaatgatgaggaattgaatgctgtcatggagcagctcaatgacggctctgacgttggcatcgagaggttgagcacccctcggcctgcatatcagccgccagagtcagcattggaaccgtccaaagagaaaagacacgtccatgcagacatccgaagcgaagcacccagcccaagcccgggacggggccctgtggttcaagcccttgaggttcctaaacttgatttcgacgcagattcccaggcgtccatgtctccgtctaggggtgtcattggcggcagccattcacccgttcggcagctgatcagtcgcaacgaacatatcagtgactgggatgatgtgatctcctctggcgaggatgagaagttggtcaacagaagccggttctttgaccgccgcgtcaacgatctcatcggctcggtcttagaagagcgccttttgcctctggaacgtgcgttggaagccattcaggaatcggttacgatggttacggctggtgcgcatgaaaaatggctaagcagaagcgtgtctgcccaaattgaagaaagcgatgccgacgacgaagacgatgagtacgatgagcacggttcgtatcgagcgaggtcgcctttcgctcggagagatcgcaagctcgagagactgaagaacgttattttggaagctctcgccactcgcgaacagcagcagctcccagaacccaccgaaaatccggagttgacgaaactgcatgacatggtcatggagctccattccttaactgcacaaaagttttcagaagatcccatggccaatctgagggagatgatgcaagaggtcgtttcaagccagctggttcagtaccaacctcgaccttctgatgcagaggagattggtgccgacagtctcatgctgcagatcgatggcttgaagaatatgctacgcctaaccgatgagagagccgagcaggagtacaaactgcgcagagaggcacaggactctgtggcggagcttcagcgacttctgaagcttgcggaggaggaagccgctcgtcatagcgaggccgctgaatctgctgaagctcgtctgctccagttcaaggaggaaaagatcccctattttgaacagatccagttccgattcgacactctggaacaggaacatgccacgctcaagcttacccttgccgaagtctcctcaaagaatatctctcttgagggtactctggatgagtaccggttttccagcgacaactggaagcgcgagagtgaccaagcgaagagcgagctcgaaaaaacgaaggcagaaaacgagaaactccggggcaccattgatcacctcaaaactcggattgaggatggcctgagtatccggcagaatctgagtgagaagttcgaccgtcttcaggacgagatggtggctgtgactagggatatcaccagagaccaggctttatggcggagacgggaagaggagcacatcgcgaaatataacgagctacggacggcttatagccgagaggtcaagctacgtgaaaagcttgaaaacgacatcagcgagttggagcaacaggagagggaagcggccaagctgaagtttatttttggacaatctcaacaagaaaacgctaggctggaggagctggttgctaacctgaggctggagaaccatgagctacagaacaaggctgctcgttatgagcgcgagtttaacgaagcacgtgaaaccagtcgcaccgaaatccagcggactaggacttacctggaggcagacctcgaagccgctaatagtcaagtcaacattgttcgtgctgagctggaggcacaaattatccgccttcagagtcagttggataatgtccgcctagacactgacacggcgcgggagcgctatgagttgttgctggaggaagccagcgaaaccaaggccagtgctttggcggccgcagctgaagctaaggaacgtgccatggaggagcagcggagaacgcatgaacgcgttctgaacgatctacgggagcgtcacgctcgtgctctgcacaactccactgaggataggcagcgggccgagtcccatttgatggaacgactggcattggctgatgacaaggtgcatcatcttgaagaccgtgttaagcatctcgaagagaagctagagattgcgaatgcggccgcgcgggcggcggctgaagcggctcagacagtcaaggcagagtccagtcaatcccctgttgcgcacttgacctcaccgtccatgaccttcagcaagaattccatggtcccagagaagatttcccctcaggcactgcgcgagtctatccttgttctgcaggatcaactgcagcagcgcgaggcacgcattgaggagctggagcaagaactctccggcgtggacaaggacgcgccaaacaagctcaaggagaaggacactgagatcacctggctgcgagagcttctcggtgttcgtattgacgatctccaggacatcatcaacacactgtcgagcccatcttttaaccagcacgctgtgcgcgatgcggctatccgtctgaaggccaacctgcaaatgcagctccaggaacgcgaacgagctcagtcgggccagaacttccctagtctcccaagactcgctgatttggctgcctcgccgcgttctctgcctctcgccgccgcagcggcgtgggggaactggcgcaaaggcagggagaatgcaaactctgcctctgagcagacgccatccaagtcaagtaatgcaggctcatttctttcgggactcctcacgcctccgagctccaacttccgacaagctccttcaaatccgggtggcgctgccaccacaggctggaggcgctcgtcggagactcggccgctgagtaacatcaacacgacgcctagaccgctatcttcacgccagactgcttctttgccggagcctccaagtacacctccacttctgcgacgggccagctacgaccatgacgcagagccggctgattatgcagacgcttcctttggggaagacgtcgagagcactgcggatggacttgtctctgcgtcgcccaaggggacagaggagggaccctttggacctcaccttacttcttaa

SEQ ID NO: 19229 - DNA, 456 bp, A.fumigatus
cgcggatgcgtcgacccccgtggtagaagacggctggatgcgacgagtgaggagctttcaagcagccgaacgattcgtgagctctccaagccatgtccgagctgcgaggcgcagacagagcgagctgggggatgcaaattcatgcgttgtaagcagagtttctttcccctttggtatatccgttggctaatggttgtacaggttacttatgtcgtcagaactggtgttgggactgtgggattcggtggcagccgggccatcttgagattgactgtctttaccaggaaaaatagagtagaataccaaggctccaaaacgtcttcattgtcaccgctggacagaatagtatccaacttccgtctcactgcatctatgcctacgaacattatcagcctcatttcacatttttcactgtgtaattcaaagctgacagcgttgaatttagcccacccatga

SEQ ID NO: 19230 - DNA, 2316 bp, A.fumigatus
  unsure (1623): Identity of nucleotide sequences at the above locations are unknown.
aatgccctaatcgctcatcgggggatcctttcattgagtcacaggaccattctccccttctctgagagcgcaggttcaagtcattcgttgcgcacagaaaacgcaacatgcagatacaatggggatacagtggcttcactggcgaagcgtatcattatacctacgaccgcatttaccacccctgctgaagtcgcagagcgtcaacgagacccatggtctcaatccggcaaatatggccagggttgggtctacttctccgttatcctacttgctcttgcaaccatcatccggttctaccatgtttggagcgataagatgagaatcgcattgtacaaggaagatctggcgggcgcaatgcagggcaactctctccaggacgagtatgaacttcccagtgccgccaccgacagctccactgcacaattctttccagccggtggccctctacccgggatgaagaaacagcagtcatcgatctcaacaattgctccgttgaataatacagctgccttcctgagatggatattctaccggcctctcccggtgctgcggattggagacctgcgcattgttttcccgtcgctgggaacttctgctgtcgtgctcgcagcgtttgtcttcgtaacgctctatacttttgtaccacagccgctgtactattcatccattactgttggatctccgccgttggccattcgcgccggcatgatcgccgtagccatggtgccgtggattgtcgcactcagtaccagggcgaatttcatcagcatgctcactggtttcggtcatgaacgccttaacgtgctccatcggtggtcaggctacctgtgtctgttcttgagtttggtacacacaatcccattcttcgtcacgccgatctgggaagatggggcgctcatatggtaccaacaataccttccgcgccacgtttggatctacggcacgggtctggctgcgctcgtaccactggtattcctatgcattcattcacttccggcccttcgaagacgaatgtacgagctcttcctgtttatccacatgcccgtctctgtcgtctttgttgccatgcttttctggcattgcaaggactttctggcatcgtggaactatttgtgggccactatcgccatctgggtcatgtcgtatgccatgcggctcttttatctcaattggacgaacccttttcgcatgtctttcatgataggggaggagtcagcggtgaccatcctccctcataatgccatcaaggtcaccgttgctaccacgatgcgatggaagcctggccaatacgtgtacctccgcatgccaggcatttctcttcttggtcgacatcctttcacgattgcgtctttgtgcagtgatgactttccctcagagtacggagaaaactaccgcgacctcgcccttgtcttccgtccctttggcggcttcacacgaaaggttctgctgaaagcctttgagtacgggccgtacaagacgtggacagcattcctagaaggtccctacggaggaatgcgtcgggagatggccgcgttcgacgacgtgattttcttcgctggcggaagtggtatcacggcaatcgcgagccaactcttggatttgatcaagaagatgcgtgacggnaaagcgttcacgaagcgggtgcgtgtaatatgggccctgagaagtccagaggctatcgagtggttccgagaagaattgcggatttgcagagaacacgctcccccaaacacggtgcactgccacttcttcctgacgggaccggcgcaggacggccccggagagcagcctggccatgacatcgtccaggaaaagatatacaacgtcctttccggcatggataagcggaactcggcatacatccgcgaagaagcagccggtgatctcgagcgtgagaaggagctccgtcgcgaaaatgaagacgccatcacgtccttgccccgaatctacacctcccccgtcatcggcagtcggcagttcacggcattgcccggcttgcaaagcggccctggcaatgttcctttcgattttggattctcaaacgccccttctccaccgcagaaacagacgccacgatttgcatcacttcccttgcagagacgggacggctggcgaattgaccatgtccgaccagatatcccgcgcatgctcacagaatactcgcagacatttggccgccggacgtgcgtctttgtctgtgggcctccgagcatgcgtattgaggtcacgaaaaccgtggcacatctccagcagcaggtgatgatggactcgcgtcgagatgagatctttctgcatgccgagaactacaatatatga

SEQ ID NO: 19231 - DNA, 915 bp, A.fumigatus
ccaggtcagacctgcgacattctcaatgagacattctacaacatcatccatgatatcgttgctcaagttcatcgcgatgaaaaagtcgctcgcatgcgctccgcggtggttgttgcccggcagaaagccgaagaagaagtagccaggcgtcgtgaagatgcaggcggcaaggctacgggatccgtggattcagaagacctcaagggcatccgagtagaaacggatggcgccgtgttcgaggacggcaaggtctatctgaaaggcaatcctctccagaccacaaaggaaatcatctgtcctgattgtcgcttgccacgtctgctatatccagtaaccggagtcggcgcccgtccacctccagatccgtatcgcgaatactgtcagaatcagccactgatcacgaagcctggacacgatgtgcacgggaatcccttcgctacggacaaattgaacccaaagaagaaaaaacagactaacgcttccaacactcccgcgtccagccctccgaccactcctgatagttctttcaataagacccaggagaaggtgtcatatcccactgtgaaatgccccaattgtccgagatactttgtggtcacgcgagttgctcagcatctggatcgttgcatgggtctatcgggccgacaggccaatcgtaacaaaacgcccatggagaatggcaacggctctccaagcactgggcctccgaagcgtccactagcagacgatgacgcaccaccgactctgacgaaaaagaaaaagctcaatacacacaaaaagctatctgggaagaaaccacccctacctccaagcagcaaattgagaaacggtctgactcccgatatggctgcagccgcggatgcggcggcctctggggatgttgacgtcaaacgcgaggccaaagacaacgcatga

SEQ ID NO: 19232 - DNA, 612 bp, A.fumigatus
attctgggacaaagggccggagccaaaaggggcaaaaaggccaaagcgcctcttcacagcgcggggcctgtacgccggcctgagaatttcgggaatgtggcgggaggctacaggaaagaggatcaggatgaggagtatatgtcggctggaacggctcggcaggtgaggcaggatacagctgctttacgatcaaagggttcagcttcttcgctgcaggttccgcagcggcaaagcgctttgtcttcgcttgaatcgtccgccgcgtcgtcacgtacgcaatcccccgcgccgaggtcgtcgggtacccctaagaacccgccgtccgcatcgggaccagtgctctcagacctcctgcccaacgtcaagtcgaaagctgccaagccatctacccgacaacagggaggcggaagctcatctaaaggagcgcttacaacaaacaacatctccgacctgacggccgcgattgcggccctcgaagtctctacgaatccgacgctaggaaatggcaggcaaaaatgcaactgctacgctacaatccatccgctcttcgaaccggctccaaactgccgtcttctcccacagggaggccgaaggatcagcgcaatgcgtata

SEQ ID NO: 19233 - DNA, 207 bp, A.fumigatus
atccacggatcccgtagccttgccgcctgcatcttcacgacgcctggctacttcttcttcggctttctgccgggcaacaaccaccgcggagcgcatgcgagcgactttttcatcgcgatgaacttgagcaacgatatcatggatgatgttgtagaatgtctcattgagaatgtcgcaggtctgacctggtcagctaatgtgctttga

SEQ ID NO: 19234 - DNA, 1164 bp, A.fumigatus
attttgatctttttagccatggcatatcagttctttgccaaagcgcatcagtccaacaaggcgccctcttctccgcccctctcccctcccgcgtcctccccctcccccaggcactccagacctcctatgcagcctccctcactactagttcttccacagtcttcgagcccttctgctacaccaaacatagcgtcgcgtctcaaaccgccagcggcgagggatccattgtttcaacctcccgcgtaccctcacgccatctccccaggctaccagacccctcatcctcacgttaccatcgacccagtcagcaccgcgcatatcccctcgttgactcgcatcacgggtctcctcctacctatccgctatcccaactcattttacacggcgacaatcaccgaccccgtcatcgcgtcggtttcgcgcgtcgcgatctaccatgatcatcccgtagccgcggcaccgtccaccaccccgtcacccgccgcatcgggcttaggagcaagcactggaacagacaaagttattggaggcatcagatgccgccttgaacgcttgtctgtagggagcgaaacgagttcccattcgcagaagccggagccaacgaatctctacatccagactctccatctgctctccccgtatcgatgctgtgggatcgcggcctccctgctcaattctatactcttcgcttccccaccgtcgccttcctcctcatcttcttcctcatccttttcttcctacaatgtgtcagagttggtgaaacattacaacatccgcactgtcacggcgcacgtccatgaagccaacgaggagggcctgagatggtacattgcccggggatttcaggtacaggagggcttggtggagaactactaccggcgactgaagccttctggagcgaaaatcgttaaattggttctgcagtggagtgacgatgacggtagcgacgcagacggaacctctcagagcggctcggagcaggctcagccgggccaaaatgatgcgagggaccaggacgaagacgatgactgggaaaaagtcgaggccgaggatagcgatgacccggatgcccaaggagtccagtttacggagtccaggatcctggaggggggtgatggccccccaaggaaaaggaaagcagatgatgagccccaaagacattga

SEQ ID NO: 19235 - DNA, 189 bp, A.fumigatus
atgctccttcgcactatcaatggcatctcgaccagtggctttcagcccatgccctgcaacctctgcgacttgagtgacttccttgcggagttcctcacccgacacggctctaccgtcatcggcaccggcgcctttaaccgcaccccgttcctcctcagacggcttaagcttctctccgacctgttttga

SEQ ID NO: 19236 - DNA, 192 bp, A.fumigatus
aatccacaaaaccggtgtatgtctaccccaaagaaactttctggcgttctgctgcagggatctaaatccttggaatttaggtctcgctccatttgggccctcaagccaaactgcccatataaaaaattcttcctaccttcaaccaccctcctcgcaaaaaacaatttttccccctctttttcaccgttttaa

SEQ ID NO: 19237 - DNA, 213 bp, A.fumigatus
gccgctgaaacatccttcttcacctcaattcatctcagggacgattcttctcatcagttcagcttcaacaaggcactcacctccctcgtggtgatccttatccctagctccaaggttacagaaagtatcgagctgccgggtccccagtaccacaacaaccgttatcatgtctggaggagaaacggagccactcctgcctcgctacgacgatga

SEQ ID NO: 19238 - DNA, 1827 bp, A.fumigatus
acagcatatgacagtctccgcaccgtgggcagcctgctcctcaccaatgccgactttcgtctcttcgtcgaggatctcactactgttggacgggagatcttctccgaaacagcgctggctctgtccgatacctcaaaacaggtcggagagaagcttaagccgtctgaggaggaacggggtgcggttaaaggcgccggtgccgatgacggtagagccgtgtcgggtgaggaactccgcaaggaagtcactcaagtcgcagaggttgcagggcatgggctgaaagccactggtcgagatgccattgatagtgcgaaggagcatctaacgggacaagagcgagatacgctgctgcatcggcttaaacgggccgttatcaagctgcgagagcgatcggattattcggactcggtggccactctgtcacacttggtgcagcgatatgcacagctgtacgccaatgccgcctcagaggtcgtctccacggccgaggaagaggccgatgtcaatgaagatctccaacaggcaatggagcagctttggaagctgcttcagtcctatggagatgtcgaagagtggaagaagctggaggaaagattcaaggatgtcatcaagcacgccaacaaagacccagagttcgagaaaatcatgtcggagattgggtcggcgctccaggaaatgctaacggaccccaagttctttgacaaggctcctcaaaaagtagacgagctgaaggagaaatcgaagaatgtcggcaccgaaactaccctgcgtcgggacgtcgacgccttcctagttcaggcgaagcgcacactgcggactgtacctgaggacactcaagtctcaaaacttgtcgacgtgactcgcaagatctactgggatgcatggaatggctaccaagaccgaaaaagccagctgccctcagacatggcagaaatcttttttcccgttatcattcgcagtatccagtacattccaatcccgcggctggagatctccgcgccagagatggatttgttgattgagaacctaattcttgagcccggtcacactgtcaatttctcatcgttcctgccctaccgcatgcacctcaccacgcgcaacgacattgacgttctgaagaagcattcgaagagaacatcaactgacctcaaaaccacatttaccgcgacggtctttggcctcaacatcagtgcctccgagtttggctactggattcgcacccatgcatggccattgttccgcataaaagacgaaggcattgccagcttctatctcgacagacggggcatcgacatttcgctcgatgtggaagtgggccgggaacgcctggagcagatctttacccttcgcggtgtgcgcgttcgcatccacaagctcgactacaaaatacacaagagcaagtggaagttcctcctgtggctgaccaagcccttcttgaagcatcttgtgcgccgcgtgttggagaagaagatcgccgagtccattgtccaggcggcctttgccctcaaccgggagctggtattcgcccgcgaacgacttcgggctgcgcgcatagctagtccgcaagacctggcaacctttgtccgggccgtactggctcggttgaggctgccagagtcggatgtcgaaacccgggtcggcttcagggccccccgcagcggtgccttcaaggatgtctatgcgcctggaagtattgtcaaagtgtggcaggaggagggattgcgggctcaagaggccattgaggagggagatcagagccaatgtcttggacgaacatggcggaatgagattttcgatgttgttggtcggtcttggggaagtacttag

SEQ ID NO: 19239 - DNA, 843 bp, A.fumigatus
gcgctgccgctgcgggatttctacacggggcgggagatccggtttgggattgagaagcagcagatctgcgatgcgtgcgaggggacggggtcggcggaccggcaggtggtgacgtgccccaagtgcaatgggcgtgggcgggtgatccagaagcacatgcttgcgccgggcatgtaccagcaagtgcagatgacgtgcgacgcgtgccacggccagggcaagacgatcaagaagccgtgtcctgtatgtgcggggcagcgggttgtgcggcgcgaggtggagacggttgcgacggtggaaccgggcatggacaaggggacgcggctggtgtttgagaatgaaggcgacgagagcccggactgggtggcgggcgatctgatcctggtgttggaggagaaggagcccgagctggcggccgacgaggcgcgccgcaccgacggcacattctttcgccgcaagggcaggcacctgttctggcgggaggtgctgtcgttgcgtgaggcgtggatgggcgattggacgcgcaatattacacatctggacgggcatgtcgtgcagctgagccgcaagcgcggcgaggtggtccagccgctttccgtcgagacggtcaagggcgagggcatgcccttctactccgagggtcatttgcacgagcaccacgaccacgattcggagccgggcaacctgtacgtcgagtacaccgtcatcctgccggaccagatggagagcgggatggagaaggacttctgggccatgtgggagaaatggcgcaagaagcacggggtcgatctcggcaaggacagtggccggcctatacctttagagggcaaagacgaattataa

SEQ ID NO: 19240 - DNA, 435 bp, A.fumigatus
gatagactcctccgaaaggtcgacttcatcaactacaaatccgacggcggccaccgcgaacaccaaatccggcaacgctaccacctccaaaacgacacagactacaagtcctacaacgcgctcgccggctccctccgccagctcgcccacaagctctcccagctcgacccggactcggatccgctgcgcaagaagatcgagtccgaggtgctggataagctgtggcggatgggattgctgaagcagtcgcgcgagcaaggggcggggttgtcaagggtggagcgcgaggtgacagtttcggcgttttgtaggaggaggttggctgttgtgatggtgaggacggggatggtggagacgatcaaggctgtatgtttttccacccttttttttctttcctttggactgaagaaaaagaaaaagagaggtgggtgctga

SEQ ID NO: 19241 - DNA, 357 bp, A.fumigatus
catatagtcatcaaaatggtcccgccgctcaaatattacgagaaaaagtccggttcggttaattctcccttcctttttaccccgacccccagaaagcaagtttctaacaacaatgagatagactcctccgaaaggtcgacttcatcaactacaaatccgacggcggccaccgcgaacaccaaatccggcaacgctaccacctccaaaacgacacagactacaagtcctacaacgcgctcgccggctccctccgccagctcgcccacaagctctcccagctcgacccggactcggatccgctgcgcaagaagatcgagtccgaggtgctggataagctgtggcggatgggattgctga

SEQ ID NO: 19242 - DNA, 264 bp, A.fumigatus
caatacaccaccttggcgttgaccattgaaggaaggcctcgaccaattgctacgtgtaagcgcagctgtgatgcagcttgcgtaccaatcatcacaatgcgtctaattacaattctgctcgtgattgcactttgtctggttctggcattggccaaggaagattactacaagatactggggctggaccgctcggcctcggagcgggatatcaagcgcgcgtaccggacgctgagcaagaagttccatcccgataagaatccgtaa

SEQ ID NO: 19243 - DNA, 339 bp, A.fumigatus
cgagagaggttcatgggctcattcaagtatgacggtagaggcgacgagacggcgcgggagagattcgtcgaaatcgcagacgcgtacgatgtcctctctacacctgccacgcggaaaatctacgaccagtacggacacgagggaatcgagcagcatcggcagggcgggacggcaggacgccccgcgaacgaccccttcgatctattctcgcggtttttcggcggcggcggacacttcgggcatgccccgggccaccggcgcggaccggacatggaaatgcgcgtaggcgctgccgctgcgggatttctacacggggcgggagatccggtttgggattga

SEQ ID NO: 19244 - DNA, 255 bp, A.fumigatus
cgtgaatatgtgattgcagaacatgatgcctttgcagacgagccgtggatcatcaaattgacaaactatacccgagagttatacgaaaaacacaagaagcctatcattgggatctgcttcggtcatcagataattgcgcgtgcactgggagcccgcgtgggccgcagcgacagaggatgggagattgctgttgagccgattatactgactgatactgggagggtcctattctcaaagaatgttctggtaagttaa

SEQ ID NO: 19245 - DNA, 336 bp, A.fumigatus
tggcagctcaggaagaatcatctactgtctccaaaatcgtcaatttcattgtccctcatggcgcgccttcttcgtgcagcaatcctcgagtgtgacacccccattcagcccgtcaaggaccgctatgggacgtatggagatctttttgagaacctcctcaaagcaagtctaaaagcgcagggacttgacccgcaggtggacttgcaaatcaccaaatgggatgtggtgaacggttctgtctatcctgaaccggatgactgtgatgcgatactcttgactggaagcagtacggtttccctggcaggtccttccgcaacagctaacgtgaatatgtga

SEQ ID NO: 19246 - DNA, 486 bp, A.fumigatus
caggcacagtacccctacctcattacgatcaacacgctcgttccagccctcctggccggaaacacggtcatcctccgtccctccccgcaaacccccctcatcggcgaacgcctcctctcatacttcacccaagccggtctgccgcccaacgtcctccaactcatccacgttggctccctggacgtcctcgacgagatcgtcaagctcccccaaatcaagcttgtctcgttcaccggctccacagcaggcggcgtccgcatccgtgaagcgactgcccgccgcattgtcccagtgaacctcgaactagggggcaaggatccggcgtacgtgcgcgccgacgcagacatcccctacgtcgcggcgcagatcgtcgatggcgcggtcttcaactcggggcagagctgctgctccatcgaacgggtatatgtccacgcggacgtccacgatgattttgtcgcggaggtgcagaaggagcttcagacgtaa

SEQ ID NO: 19247 - DNA, 312 bp, A.fumigatus
  unsure (309): Identity of nucleotide sequences at the above locations are unknown.
tcactccaccagatgcaccgtgatatcgcatacgaggtacctgagggttgtgttaacttggggtcgagcgccatctgcgagatacacggtctctacagggccggaaggatttttagtgtccaaggccatccggaatacgatgagtttgtggtcagcaagctgattgagacacgacatgccatgggggtcttcgatgaccagctctccaaggacggtttatcacgggccggaaaaccgcatgatggattagttgtcggcgaggcgatttgcaagttccttcttgatgatccgggagtcaatcgtgtatantaa

SEQ ID NO: 19248 - DNA, 798 bp, A.fumigatus
acagtgaacaggcaagttgattgtgaaaccatccatcatcacatattcaatccaaccaaaatggccaaccagattcgcaccttgtctccctccaccaacgaggttatcttcgaacaccagggaacctctctagaagaggctcgcaagattgcacaagcctcttatgaagcattcaaattatacaagaagatcactctctctgagcgcaaagatattatcgtcaaagccctcgaattgatcgcggccaacatcgacaccctaagcaatgagctcaccacgcaaatgggccgtccgattgcctacagcgcaaaagagatcgagaccatgcgcaaacgcgccgattatctcttgtcaatcgcggaggatagcctgcaggaacacccaggacagctagagaagggatttagacgcagcgtgaagaaggaaccagttggaccgacattgatcgcgacagcgtggaatgtacgttcagttcgaacatcgcctcattttcgcatatctaacaggcacagtacccctacctcattacgatcaacacgctcgttccagccctcctggccggaaacacggtcatcctccgtccctccccgcaaacccccctcatcggcgaacgcctcctctcatacttcacccaagccggtctgccgcccaacgtcctccaactcatccacgttggctccctggacgtcctcgacgagatcgtcaagctcccccaaatcaagcttgtctcgttcaccggctccacagcaggcggcgtccgcatccgtgaagcgactgcccgccgcattgtcccagtga

SEQ ID NO: 19249 - DNA, 507 bp, A.fumigatus
cctaacacctgcaatgacaacgctaggtacaaacttggcgatccaaccgacaactccacaaccaccggccccgtcatttcccgccacgcagtgaaaactatccagtcgcacatcgacgacgcactctccaagggggccatcaacgcaactccccccaatgaatccttcctttctgtcccctctcagaaaccccaggggaactacatcgcccccactgtgctcacgaacgtcacgcacgacatgaccgtcatgaaagacgagaccttcggccccgtgctccccatcatgaaggtctccagtgacgaagaggcggttgcgctcatgaacgatagcgagtacgggctgactgctagcgtgtggacgagggatatcgcgcgcggagaggagttgatcgcggagattgaggccgggaccgtgttcatcaatcggtgtgactatcctagtccggtatgtacatcaccccaattctctttccaaaaaaaaaaatccggatttacagggtgctaa

SEQ ID NO: 19250 - DNA, 696 bp, A.fumigatus
tcagacacaatggttggaagactcgctggaaagaacgctatcgtgaccggcgctgctgggtatgtttatcatgttcctgaactttgccttgtagatcaaggacagagagaacagctgacaaggaatgatagtggtatcgggcttgaaactacaatcctcatgctccgcgagggcgcctccgtccttatgaccgatatctctgcggcaggcctcgaaagggccattgccaaggttcacgaggtggtgccacagcacgacggccgggtggaataccgcgtcgtcgacgtatccaaggagtccgaggtagaggctgcggtggcacatctcgatgcctggggcggtctggatgtcatgttcaacaacgcggggatcatgcatcccaagggatggagactcggaggagacaccggaggaaatctgggacttgacaatgaatatcaatgtcaagggggtgtggtacgggtcgaaacacgcggtcaagagcctgcgcagacacggcaagaagaaggcagcatcatcaacacagcgagtatggttgccctggttggtgcggctacgcctcagcttgcgtacaccgccagcaagggtgctgttctggccatgacccgtgaactggccattgtccacgctcgtgagggattccgttttaactcgctgtgcccggctcctctcaagtatgtcattctaatcccctga

SEQ ID NO: 19251 - DNA, 267 bp, A.fumigatus
tcgtgggtaaaggctaacggattcagcaccccgcttctgcaggattggcttggagacgacaaggagaagcgattcaggcgtgaggtccattttcccaccggccggttcggtgaggcgatcgagcaggctcatgctgtcatcttcctggctagcgatgaaagcagctttgttaatgccgcagacttcgtggtggacggcggcttgaccaaggcttatgtgactccggagggtcctgccacggaagcgcctaagaaccttggctcgtaa

SEQ ID NO: 19252 - DNA, 891 bp, A.fumigatus
agtcgtcctttggtcctgctccccactttcttggtcgtgatgccgctcaataaacgcccacggacagagccaatagttcgcgttcgaaccggctgctggacctgcagacgccggaagaagaaatgcgatgaaaatcggcccgtctgtggtggttgcacacgaaacaaactcagctgtcactggcctgctcacgtatcatcaagacctgttgaaaatgacaggggtgcgataccggtgcagacggatcagcactcacgcggaagtggtcagatggacgaggagaacattatcatcccgcatggcagcccacagtccgttcgaagctcaatctcacatggtgcctcttcgcattcgcccttctcgcctgcagtctctccaacctcacctgcgcagtcagtgtgcctgccaactgtatccccgacaggggcgattggactggaagatcttgacgctgcgtctctagtgcctatgggctattctcatcctagaagcaacagccaggcctcaatcagagatgtaatgccgcgtagtctgtcaatgctccctgggtacagtccggagtcctaccagctattgagtcattacttggctaccactgccgactgcatggctaatggatcgactccggtgaatccatttctggtccaaatcgttccactggcattcacaagtgaccttctgctacagctggttctgacgcagagtgcggctcaccgagcatttcgttgtcgcaatgactcggatgaggtggcccagagtcactataccaaagcgctacagctgttccgcaagggtgttacggattttattgatgggaaggagtcgaatccgctgatgctaacagttggagctttgttgatgtgtttcaccgaggtaggtgggctttcatga

SEQ ID NO: 19253 - DNA, 654 bp, A.fumigatus
tgtcattggccaatggctattttcccgcgaagctgcggccccatgatgcgggcgcagtccggcatgtccagcaagctccacaataagcatcgatgtcggtcaacttttaagaagctcttcgagacttttttcctcgtctcaatcatatttctcctgatttctgggttaatacttctcaatatgtcacaagatacaatcacagtagaggatcttcctgcccttcttgaacacgacatcagcgtcaaagtcgctggcattgactgcgatggcatcctacgcggcaaggtgatggccaaggaaaagttcctcggcattgcgcagaagggctttggcttcagctccgcagtgtttggatgggacatgcaggacgtgctctacactacagatgcaaagatcgcacctccagaatcaggatatgtcgatttcatcgctgtgccagatctcagctcctaccgacgcataccgtgggaggacaacatccctttcttcttggtgcgatttgttcagaatgagaaaccagtcgctgcagacggtcggagcatgttaagagcaataacagacaagctagcggaagcgaattgccaggccatggctggaggtaagtttcctggtatcggcccgagtgtgtcagctaatgagtgtagtggaacttga

SEQ ID NO: 19254 - DNA, 600 bp, A.fumigatus
tgtacataccggactaggatagtcacaccgattgatgaacacggtcccggcctcaatctccgcgatcaactcctctccgcgcgcgatatccctcgtccacacgctagcagtcagcccgtactcgctatcgttcatgagcgcaaccgcctcttcgtcactggagaccttcatgatggggagcacggggccgaaggtctcgtctttcatgacggtcatgtcgtgcgtgacgttcgtgagcacagtgggggcgatgtagttcccctggggtttctgagaggggacagaaaggaaggattcattggggggagttgcgttgatggcccccttggagagtgcgtcgtcgatgtgcgactggatagttttcactgcgtggcgggaaatgacggggccggtggttgtggagttgtcggttggatcgccaagtttgtacctagcgttgtcattgcaggtgttaggttactgtttcgctgtggagttagaacgagggagagtttgagacttacgtctgaagctccttctgcacctccgcgacaaaatcatcgtggacgtccgcgtggacatatacccgttcgatggagcagcagctctgccccgagttga

SEQ ID NO: 19255 - DNA, 483 bp, A.fumigatus
cggaagcgaattgccaggccatggctggaggtaagtttcctggtatcggcccgagtgtgtcagctaatgagtgtagtggaacttgaatttatgaacttccaaaccccttcgcaggacggatactccaatggctcgcagacccgcgatatcgccgcttttctagaaagaaacgcacccagcgcccttcgccccatgaccgccggcagtttctcatacagcgcgacacgaccggtagccttcaagaagtacttttgggatatcttcaacactagtgcacggttcaactgtggcattgagggatggcatacggagggagggccgggtgtctacgaagcggttagtgaactacatttctatgacaggaacgttgctaatcagcccaggccctcaaagtgtgtaatgttgccgaaatggcagaccgggtgtccctgtttaagtaagtcatcatcgaggccattcgtcgctcaaaccctcatttgctaa

SEQ ID NO: 19256 - DNA, 945 bp, A.fumigatus
agacctgccggtggtgataccttcggcatggacaacgataacttcaaccaggtccctgcgaacgtctctaccattgctgacctgttcgacaccaagaacatcgcctggggagaatatcaggagcaccttccctaccccggctaccagggtttccggtaccccgagtccggccccaacgattacgtacgcaagcacaatcctgcaatcctgtttgactctgtcactcaggatgccaccagactccgtcagatcaaaaactttaccagcttctatgatgatctgaagaaccaccgtctgccccagcacatgttcatcactcccaacatgaccaacgatgctcacgacaccaatattacctttgccgctacctggtcctggaactttctgtctgagctgcttgagaacgattatttcaccaaggacactctgatcctcctcacctttgatgagaacgggacttacaagcttggcaacaagatctacagcattctgcttggcggtgctgtgcccaagcacctgattggcaaggaggacaacacctactacaaccactactccgtgatcgcttccctgtctgccaactggggtctgccctcccttggtcgctgggactgcggtgccaacctgctcagctttattgctgagaagaccggctatgtcaactgggaggtcgataccagcaacctctacctcaaccacagctaccccggtcccctctccaccagtagtcacactcccaactggcccgtgcccctcaccaagggttcatgctctgccggtcacggtattctgaaggctgttcgcaagacctacaaggacatggctcctacctacaactacaccagccctgtcccttacgatgcggcgagcaagaccaacgttggtgtcaagtacactcgcaagctggtaagtcttctcgatcagtcactgacgcatgagtactaa

SEQ ID NO: 19257 - DNA, 498 bp, A.fumigatus
ccagtctcctctcctacctaccccctttcgaggggcttctgcccaaatggctcgtcttggtatgtgtgtttactgttcgactcctttgtaaacaagaccccaacaaaatcacaactgaccgtccttgctgaacaggtctccgtggtctctgcaatcaacagcctccaatgctaccgttcagacgaatacgccgcacagctctacaatgccagaaccgctgatggccgctcgttcgcaacccctctgtcctcccgcacttttggcacctggaccttcctttcggccgtcgtccggatgtacgcggcttatcacatcaccactcccgctgtatacgaccttgcagtttggagctttggccttgcccttgcccattttgtcggcgagtggttggctttcggtagtgcgcagctcaaggggcggtttgtgagcccgttgattgttgcgtcggtgacgttgacctggatgttgacgcagagggaagcttatctctctgcgtag

SEQ ID NO: 19258 - DNA, 855 bp, A.fumigatus
acccggcctacagactgtgggcgccgcggtcctgctgaccacggggaccttgtttattgcttcgcgagttttgacatttgtcagggtgctcttgagtctgtttgtgcttccagggaaaccggtacgtttgatattattatgctgttattgagtaaagtcaactctcgtactgacagtagtcagctccgctcgttcgggcccaagggtagctgggcagtggtaacaggtgcctcggatggattaggcaaggaattttctctgcagctcgctcgcgctggattcaacattgtactcgtatcccggactgcctccaagctcaccacgcttgccgaggagatcaccaccaaacactccgtgcagaccaagacgttggccatggactatgccgccaacaacgatgcagactacgaggaactcaaagccatagtagatggactggacgtcgccgtcctgatcaacaacgtcggcaagagccatgacattcctaccccgttcgcgctgacccccgaggacgagatgacggatattgtgaccatcaactgcctgggcaccctgcgcactacgcagttgatcatccccggcatgatgcaacgcaagcgcggtctcgtgctgacgatgggatccttcgggggtttgctccctacccctctactggctacgtactctggcagcaaggctttcctgcagcagtggtcgacgtcccttggctctgagctcgagccgtacggcatcacggtcgagctggtgcaggcgtaccttattacctcggccatgtcgaaagtgcgccggaccagcgccacgatcccagacccgcgggcttttgtcaaggccgtgctgtccttgggtctcgcgact

SEQ ID NO: 19259 - DNA, 213 bp, A.fumigatus
accatctctctacacagttttccctgttctttccctttcgtcttttatttctttaaggtcgcttggtctgttcagtctttcgtcggaaaattctctcaattagctacaatggtggaaagcgttctcgacgacatctcgcatcggaggttcaaccccctccggggatcttacgtcttagtttctcctcacaggactaagcgcccttggcagtaa

SEQ ID NO: 19260 - DNA, 360 bp, A.fumigatus
gaacgagaaggcccagctggccgaggccatcgccgagatcaccagacggtacgacaacctcttcgaaacgcactttccttacagcatgggcatccaccaggcgccgctcgagggcaccgacgaggagatcgaagcttcgtacctgcacctgcatttctaccctccgctgctgcgcagcgcaaccgtgcggaaattcttggtcgggtaggtcctctacaattcgcgcctttgacatatacgctaaccaaccccagctatgagatgatggccgagccccagcgtgacattacccctgaacaagcggctgcgagattacgtgcttgcggaggagagctgtacaggaagaagatggacgcatga

SEQ ID NO: 19261 - DNA, 303 bp, A.fumigatus
tttctcctcacaggactaagcgcccttggcagtaagttgaaaaagatattcttgggagatgacacatcattgataagtgatcccgtaaacagaggacagcaggagagcccctccaagaccaccttgcccgcttatgaccctgcttgttatctctgccctggcaacaagcgcgcacagggcgacaccaatcccaagtatgagaagacctttgtctttgtcaacgattacagtgccgtcaaggaggagcaggctccttatagccctgagagcggagatagtgcgttctcaaattcagagacgtga

SEQ ID NO: 19262 - DNA, 786 bp, A.fumigatus
tgcgcaatcctcctaggtgtcgagtcattctttctcaaggcggaaccggtgacgggcaaatgctatgtgttgaccttttccgcggcccataacctcaccttggcagacctgtcgccagccgagatcatccctgttattgatgcatggaccgagatctactcagcccatctctcgcccaagtctcctctcgccgctgtggctcctgcgaccacactacctcccaactcccccatcgccaacatggccaagcccaaggagcaataccggtacatgcagatcttcgagaacaagggcgctgctatgggctgctcgaacccccatccccacggtcaggtctggactaccagctcgctgcctgaggagcccgcaatggaactggagcagatgaagaaataccgacgggagcaccaaaacaagcatttgctggaagactatgccgccctggaaagccggaagcaggagcgcgtcgtgtttgagaaccaagcgttcttggtcgtctgcccgtggtgggcaacctggccgttcgaaaccatgatcgtcagcaagaagcacaagcgcgcgcttgttgacctcaatgagaacgagaaggcccagctggccgaggccatcgccgagatcaccagacggtacgacaacctcttcgaaacgcactttccttacagcatgggcatccaccaggcgccgctcgagggcaccgacgaggagatcgaagcttcgtacctgcacctgcatttctaccctccgctgctgcgcagcgcaaccgtgcggaaattcttggtcgggtag

SEQ ID NO: 19263 - DNA, 819 bp, A.fumigatus
gttcccacaagccacactcacatggttagaactgactggcagctagacttcacgccgtcaaacattctcctgaaatttgagggcctggacggattaccagaggatgaagtcctcaaagtcctgggagagcccgttaaggtcgaagttttcactgagtccggggagactccttctgatccaaccgcgcctaaatatctcgtccgcccagtcaagtttcgcaatgttccgctgccgtacgttgtagatgagattcttgtgatcgacttcggagagtcgtacgatgtcacaaacccaccgcaggagcttggtatccctgggagttatcgttcccccgagcttgtcttgaagaatacaccaggattcgggagtgacctctgggcactcggctgcaccctcttcgagatacgaacgggccgaaaactcttcgacatgtttgacgacgatgacgacagttacctctttcacatggttgagatgctgggcgcactgccagaaccgtggtggtctacgacttggacgcacagaaaggagttcttcaaagatgaagcggactcacttggtcgagcggtcctggttgacgcgttggccagggaaaagtcaaatctgtcggtcgagagcccgtcgatagacttagcgctacgacgaggattacattattgggacttggggcctggcgaagagtttagcagagagattcctccggatgagattgaacaattggcagacctcttgaagaagatgttaccatatgtgcccaaccggcggttgactgcgacagaagttctagaatacgaatggtttcgtcgtgatgagaattga

SEQ ID NO: 19264 - DNA, 210 bp, A.fumigatus
tgcaagcaaaggtttgatccacactggttggctcgcggtacagaagtgccaagtgtaactgtctatttctgttcaagcagcacaaccggggtcattatttgtgtcatgaatatagccgctgtcaatgacaaaagtcctgccgggtacgatcgccttatgctggcctcgaccaatactgaggtactaaaaacacgcatcctagcaggataa

SEQ ID NO: 19265 - DNA, 402 bp, A.fumigatus
gcagtgggggggttcgccaacgtttggttgtgccaggtcctgcgcaatggggtaccccattatgtggcgctcaagatacttatggccgattactctaaagacgactgcccggagcttcgagtggaacgacttcgcgcagtcgggttagaaaagcacatctgcctcccgttcgaccactttcgaattgagggtccaaacgggtcacacctttgcttcgtgtatcctgtggcgggaccgcgggtctctctgatagctcatgaatttgaagaccaggacagaagcttacggaaaatggctcgacaagctacagaggtcatggccgcattgcatagtcatggtatatgtcacggaggtaagttcccacaagccacactcacatggttagaactgactggcagctag

SEQ ID NO: 19266 - DNA, 543 bp, A.fumigatus
tcggaaccggtgtcttttctacccgtatgtgctccgtctcctgcgatccaattcctcgcattgacagccacagcatcaactgtcctcaaaggcgccgggtccgttggcctggcattgttctactgggtcattggattcctcatggccggcagctcactggccgtctacctggagttctcgtcctatttccccagtcggtccggctcagaggtcgtctatctcgaacaggcgtatccgcgaccaaagtacttccttccgactgtttttgcaatgcaatcggtgttgttctcgtttagcagtagtaatgcgattggtatgtgcaccggttcctgggagaatatatctgaccgattagtcctcgcgcagtatcttttccgacttgcggaggcgcagtccacaccgtggaagctcaagggcgttgctgtcgcttcgtatagcgttgcagtgctaggtgagattgcattctttatcgtagtaaggatgctaacggtacagtcctggcattcaacactaaagtcttcaccacggcgtgagaatccacgt

SEQ ID NO: 19267 - DNA, 417 bp, A.fumigatus
gcaatggaaggttatggaaatgccctactacgacgtcgacattattcggtatgtcagcattcaccgtcgcataacgatgaaactaacaatcaaagccgtgtctttaagaacgccgaacgagtccgaacctgcaactcgctcgtcaccaagacccccggcatgttcgcctccgtcaacaacatcaccgatccagcaaccggcgacgtgaccgggtatatctccaacaccggcgtcccatccatctccttccttccgcagcaggagctggacgtcattactccgtacagtgtgttcccaaccgtcctcttcgacaagggagttggccttgcctggtggaggaacatggtggtggccaagaagatgcaaagtaatctccctccagctcttacctctagatcaatactaataaaagcatag

SEQ ID NO: 19268 - DNA, 741 bp, A.fumigatus
gtcgacgcttgtcggcccatccccgtggtgaatacccgcgccgctgccttgtacaacagagagttccggtctgtccaacagggcaagatagggatctcgttgaacggagactactatgagccttggaatgccgaagacgagcgggatcacgctgctgcagagcgtcgcatggaatttcacattggctggttcgccaatcctgtctttctggcacgagactacccagcatgcatgcgagagcaacttggagctcgcctaccgaagttttccccctctgattttgcactccttcgcgaggccgagagcgatttctacgggatgaactactatacatcccagtttgctcgccatcgcgatcaaccagcatccgaaacagattatattggcaatgtagatgagttacaggagaacagtaaggggacctcagttggcgaaccaagtggtatccattggctccgctcgtgcccggacaagtttcgcaagcacctcacgagagtttatcgcctgtacggaaaaccaattttcatcaccgagaacggatgtccatgtcctggagaggatcggatgacatgcgaggagtcagtcaatgacatgtatcgaatccggtattttgaggatcatctagaggctgtgggcctgtctgtcaaccaagacggtgctgatatcagaggctactttgcatggtcgttgctggataatttaggtgagttcctggcgaaaattgaagagaatatcggctga

SEQ ID NO: 19269 - DNA, 189 bp, A.fumigatus
ctgtatctcgcagaatggtccgatggttatggacctcgattcggtgtgacattcaccgattatcagactctgaagagaacacccaagaaatccgctctgctgctgagacgcatttttgaagagcgaataggcatcagcaccaaaggacaggccccgtcagcccctggggtgttccgagcggagttgtga

SEQ ID NO: 19270 - DNA, 345 bp, A.fumigatus
aggttgaaactcagtatgcgcgtaagcaagctttcatatcttgctctgtcctggactgccttgacagatgctctgcctcaaaaaccgaacgagccatcctgcaggttcgctcgccagtacacacagagggaaatcgtgaaggatcccagcaattttatcagcgatctattgtactgggagggtaaattccaccagaacaatgtctcgtacaactcggggaatgggatgtcctacgacgggaccaacatcgactttaccactggcgaaagtacagtcaagcatccttttagcgccgcaagtaaagaggtcagtcatcttcaggcttgttgttgccgttgttgctaa

SEQ ID NO: 19271 - DNA, 321 bp, A.fumigatus
catctcaagattttctatgaagggaaaggtcaagtgtgcgccgtaacgaccatcaagaaccagtccctgcctgtggatcatcctgaccaaggatacgcctgtgaaggcagtggtcggctcaacgatccttacgagggtgagctatttacgttctggctccagttcttcggtggtctgtccgacgaagacgtagaacagctctgggctgtgaagaagcccatgctgcagagtgttgactaccatatgggccacgtaggacccattactgtgcagaagggtacgtctgtcgatgctggcaaaggaagtcccgctcatggatga

SEQ ID NO: 19272 - DNA, 252 bp, A.fumigatus
atcaatactaataaaagcatagatccctacggcagcaccgaatccacccgcgttgatggaaagggcgtctcggccctccttacctgggacagcaaagtaaccacggtggctgccctcctcggcggagtcaccgatcttgtccgccagcggatgaaggccgagggtatatacgaggagttcatcagttacgccgaggtatgccatgtcctcttcaacatgccatgtccccttttaatgggatcactgtactaa

SEQ ID NO: 19273 - DNA, 381 bp, A.fumigatus
ggatctctacccgtggtgaacaaggttgatacggacttttatctcgcgcttctcatgcaaagctattttctaaacaatccaatcggacgaaccaggtggcaggcgttttcgaggtttgtccccgggtttatagttttcgatcacttggctgacggacgtagcacccctgccggtgccattaatgctgcaaacaagaatcacacttggggccagttggcccttcgcaccgccgagaagatcatgggtcaggctgcattgttcgcgcacaatcctcgcaaagagaacctggtccatttgaaaccggatcaggtcgttggcgagtggagagatagcacatacggtatgccacttcaaacaagtaaactacagcccccattctaa

SEQ ID NO: 19274 - DNA, 1917 bp, A.fumigatus
gctatagttaatcaagcatgcatcagacgactggcccccgttgcgcgatcaatcggactaactgacaactgtcccaagtgtgacggagaagcagcattatccacttgcacaagctgtcgacgggctggagagcattgcacttttgatttacccgttgggagacggggacctaagagcaacaaatcaagacgacatgcatcactgtccgccgatgctcatggccagaatgtcactctgtcaagctcactccacacgggacaacctgtcacaactttgcaattctccactgtttcccctacgccgggccccgtcgtctctctcaatccccgcactccgagaccgagctctctgacaagctcgccctcttggaataccggcctggtggacccggcactgtcccttccggaagagcagccgtctctgtcctcgttacagcgatggcaccaattggccggtgctcttcacttgcgcgaccctgcagcagatctggagcagacggtgaatcggtgctttgacctcttctttgagtacttgtttcccctgattccgcttgtgcatgagcccagtctacgtgacggcttgcgtttctttgtatcccaagcagctagatcaggtattggcgtcactgggccagagctgtggtcatctttcgttcgcggcaatcctataggtgcggacagtatcctcgaccgggcaaatagcttgaaatatccggaactctggcccgattcaaccttcacgctaatcacggccgtctgcgcagaagcggcgtttctcttgcccaaggacattttccccgagggcgagaggattgcggacttattcctcaaggcgtctcggagttgtttacacgggtaccttgaggaggatctggagtacccaaatgcaaactctgtggctatccgctacttccactccaattgcctacatgcagccggcaagccacgattctcatggcacatttttggggaagccaccagactggcgcaggtcatgcagatgcatgatgagatgtcactgcagaacctgtccgcggtggaggcagagctccgccgacgtgcgttctggatcgtttacatcggagataagtccgccgcaatccttaacaatcgtccaatcaccattcacaagttctcgttcgacactggcattacaactgcatacccttctgggattgaggatggaacaggagtttcctcacccagtggtaccgaaccggatttgtccccacggatgagcttcattgcggggttcaacgcgaatctacgtctatggcagacagcttcagacctcattctcgagatgcgacttctggagagccagaaggaggtggggatgctcactccacgattattgaccgtcgaagaacgccacagactcggcaacctatacgtctccttcattacgtcgttggacaagttgccgcagtatttacagaccgacacgctattagcaccaaccaacaacaacaacatcagtagtcatcgccgaaagcaatacgttatccaatgggcgaatctcaatgtttcacttcactgcttgagattggtcatcgatcagaagctagaagacctgggctactatgcatcggggatcgaacatcccgatatgccattactcaggaagacggaaatagcgcgcgacatgctgcgagtgattagagaagcgcccttttggtcgctacaagtaaatggggagccatgtgtatgtttctattgcttatttatctgctgtatcttgctaaaagccccgcaggtcgaaaaaatcaggctaattggcgccagtctgctggagataatagaccagtatgaggcttctccattgtcggtacgagcacgcaatgatctttcgatccttctagacatcctcactcgcctggattctaaagcctcagacacccttagaaggccatcgtga

SEQ ID NO: 19275 - DNA, 687 bp, A.fumigatus
gtcaccgtccccgccgaaacagcgaaacaacgtcttacttcctacacccaagccggctacttccccggccccagcgcaggagaatcaatcgactccgacgtcgtcttccatgccctcgccctcgatggctacaataacctctctcaagtccaagtcatgaactcggacgactgcttccgccacttcctcctgaacacaaccaaccagcagcagctcacctccttcatcaaccaaaccgccaccaacatccgccgcacattccccgccggcctcaacactcccgtcggcatgctcatcgccaacccggccttcggccccaacgaagtctacgcccgcaactggacaacgggcgcctaccacggcacggtagtctggtcctggcaactcgcaatgatggccaagggcctcgaacggcaactcggccgctgtgacgcgggccatcagcacgcgcagccagacttttgcgccgacaaggtcgtgtacaacaatcttaggacagcgtataataccctctgggacggcatcgagaccaatcaggcgctgctgagcgaggaggtttggtcgtttgtctacagcgatgggcgattcaatcccgcaccgctggggaatatccctcctcctccgggggttggtgcgcaaaccggtaagccacgcgagcccatccttttgtatctcaagaggctctga

SEQ ID NO: 19276 - DNA, 186 bp, A.fumigatus
tggtctaccttagatggtattcacattgacatgaaccacttgaacaccggagaggtcaagtacgtctttgaattgctactcatactagtcctcagtaacaaactactaaccaccgtgctcttacagcctaggtacctcgatgtgaatgagctgatttcacattgcagattttggctggtatattga

SEQ ID NO: 19277 - DNA, 366 bp, A.fumigatus
aatagcagaaacttactgaccgggtttgacggtagtgctggtatcatcatcgcaggatacgacccacgccatggcggtcaggtgtactcgatacctttgggcgggtctctacacaagcaaccctacgccattggcgggtcaggatcaacttatatctacggttattgcgatgctcactggaaggagaacatgacggaagaagaaggcatcaaattcgtgcgtgacgccttgcaggaggcgatcaagtgggatggcagctccggaggtgtgattcgattggtggtgctgacgtctaggggatctgaaagacatttgtatttgccagacacggagtacactggacccggcttaaccaacagatcatga

SEQ ID NO: 19278 - DNA, 1545 bp, A.fumigatus
  unsure (1049): Identity of nucleotide sequences at the above locations are unknown.
atttttgttcataatagaatagtaatcaacctctctttgctccttagcccatcaagccctctatctcccagtcttgcgatcgagactcgatgccctgatgttccccacttcgcttgttctcaatgctttcttgaggctgattgttgttccgccactgttgctctaggattcgccattacgcgcgcgatttcttttcaatctcgccctctattttctcttcggcttgacatgggatcggtcgttctgaatcaaccgcggtcggatcgaattgatagctcctacacgatgctgggaggctccatcaatccatcggaatctgtttatcggacctcgtctcaccatacgtcgtcacagttggagaccggaagctccaggtctacgtccgcgaccactacccccacctcgtccacggccccgccgtcaacgtctgccgctggctctgctcgcctgcactcccacccaccaccatatgatgtgccggcctacatctcccgtcaatctcacatcaactccgttccttccacccgggcgtcttcaactaccccagggccaacccgcacccctccccattcggtctcaatgagctcgaccacctccaacaacgcacaccatcccgaagcttccttccagtcgactccatacacctccaaccgattcggacatgccagccagacagctacggagccgacactggtcgcttcgtatagtcactcatcacccgcgtcaccgcggctgaggccgacgttccagtcgctacgctctcttggaggctccgaagctagttcgccgagtcgcatcaaagttcgtgaccttactcatatccagagcttcgctagcgaagagtttttggcgaagtcgcagaggagccaggcgcccgggtcttggtaccaagagcgccagtatgaaatcagttccatgccggtcacggatatcattgagatggtcgcggggctcctgacaaaaatcaccaccaccaacgacctacaccacgagcatgtccatcgacatattccgccacccgatagcaccgctaacctcagcccacaagntaccagcgtccttgcctttcatggcaaaaacgtaccgagtatcactattctcagttacttaacgcgtatccacaaatactgtcccaccacctacgaagtgtttctcagcctgttggtatatttcgatcgcatgacggagttggtgaataagtgccaacttgagcgcctgcagcgccactgggaccgcggagcaaccgtgcacactgacccatccaggtcgagattttctgattcgtcgatcggtcatcatacacaagcatccccaatggtcactccgccatcatcagccgggataccagcgcaggatccaaagagtccatcctgcatttcaccttctctttaccctcaggacgagaatgagagcctcgctcattttttcgtcgtcgatagttttaacattcatcggctggtcatcgcgggtgtaacttgtgccagtaaattcttctctgatgttttctatactaattctcgatacgcaaaggttcgctacccttga

SEQ ID NO: 19279 - DNA, 357 bp, A.fumigatus
gctgatttcacattgcagattttggctggtatattgattgcatatagtatggctatcaacttcaaggacggtgttatcctgggagcagatagtcggacaactactggagcttacatcgccaaccgagtcaccgataaactcacacaggtccacgataccatctggtgctgtcgatcgggatctgcggcggacacacaggctgttgcagacattgtctcctatcatctcaacatgtacggcatcgtgaacaatgagcctcccagcacccaggtggccgcagctctattccaggagttgtgctatgagaacaaggatatgctaaggttgataatccccccgagcttgctgatagaatag

SEQ ID NO: 19280 - DNA, 207 bp, A.fumigatus
gtgctcggatggcccctgcacagcatcattaccactgacgaatgcttcccccgcagcgaccacatttacgaaactcaacaataccaagccgaagcagcctttcttcttcctgaaggctccgtcttctatttcttctgccgcgcgaaggttccgttctgctccccaagggagtttgcctgcactatgacgtggaattggcgctggtga

SEQ ID NO: 19281 - DNA, 642 bp, A.fumigatus
  unsure (609): Identity of nucleotide sequences at the above locations are unknown.
cagcaggttagcatacattcaatcaaggctaatatccacatggttgaacttaccagcaacgttcatgggcatctcctcgatctgggtgctgtagaactgctcgatctcacgcatcatgcggacatcgtcagcagtgacgaagttgatggcaacacccttacgaccgaaacgaccaccacgaccgatacggtgaatgtagttctcacggttggcgggcaagtcgtagttgatgaccagggaaacctgctgaacgtcgataccacgagccagaagatcggtggcgatcaggacacgggaagaaccagagcggaactccttcatgataacatcacgctgggcctgctccatatcaccgtgcatggcggagacagtgaagtcacgggcagtcagcttatcagtgagccagtcgaccttgcggcgggtgttgcagaagatgacagcctgggtgatggtgacagtctcgtagagatcggacagggtgtcgagcttccactcttccttctcgacggcgatgtagaactgcttgataccttccagggtgagttcctgcttcttcaccaggatacggacggggtcgcgcatgaacttggtgtaacctcaaggacatcnctgggcatggtagcaaacagcaggacgacctga

SEQ ID NO: 19282 - DNA, 1206 bp, A.fumigatus
gaggcaatcttcaggtcgcccccttcgtggttcacatggagaggaacatggcgctcgacatacctcaacatccctccttccaaagttgccatattggactgctcaagtctgttttctgatgctcttcatcgtccattttattgcacacacatctccttagacacttatgtgagcaatattccctcgagaaatcagatcacccgtcttccggacctttccccagaggaattccaggcagagtggtccagcaagcctttcattttgacacagccggtgaagcagtggccggcttacaagaactggtccgtagactcactgcttgccaaatacggagacacagtctttcgtgccgaggctgtggattggaaattgagcacctacgtggattacatgaggaacaacgcagacgagagtcctttgtatctatttgaccgggcctttgtgtcgaaaatggggctcaaggttggtccgccagaggaggaacctgatgcgacgtactggcctcctccgtgctttggggaagacttcttctccgtgctggggaatgaccgcccggacaggcaatggctcattattggccctgagagatctggtagtacgttccacaaggaccccaatgcgaccagtgcctggaacgcggtcattcgcggctccaagtactggatcatgtttccctcgtcgtccaaactgccacccccgcctggtgtctttgtttcggacgatcagagcgaagtcacatcgcctctgagcattgcagaatggctgctttgcttccatgcagaggcgcggcgcacacctggctgcattgaaggtatttgtggtgaaggggaaattcttcatgtgccttcaggatggtggcatttggtcgtgaatctcgaaccttccattgctattacgcagaatttcaccccgcgtgcgcatctgactgccactcttgacttcttgtctaacaaagccaatcaggtttcgggtttcaggaaagatgtgcataacccctacgagcggtttgtggaaaacatgcgcaagactcatccggagttactccagcaggcgctggacgagttgcagaaaaagtcagatggcaggaaacgcaagtgggatgagctggttcacggaaaggtggcccaggaggacgccggagacgcctctgaaggagggggatttagtttcggctttggagatgatagcgacatagaagtcccctga

SEQ ID NO: 19283 - DNA, 441 bp, A.fumigatus
tcctcgtatcaagctaactcctcgccattgaacttaacgggcggaacgtccaagacgaggcaaaagaagaagggcctcccctggtccatcgccaagggttttgacactttcctgcccatttccgaagagattcccaaggcgcgcattcccgatccacataatgctttcttgcgcctcagcgttgggtcccagcttcgtcaggcagattccaccggcctcatgctctaccggatccccaggcagctagcagagatctcgcgcgtcatgacgctggagaagggcgatcttgttcttactggtacccccaagggagttggagaggtcaaggccggtgacgtgatgaaggcgtccatcgaggtggacgggaaggagatcgaggagggtagaatcgaggtggaggtgaaagatcgggagggcagatatgtgtacagtgagacgtga

SEQ ID NO: 19284 - DNA, 300 bp, A.fumigatus
accctccttctctctcctaaaccaagcccgaacctcattcagaacctgcctctgtatcgacttccccaattcagccagtcccgtctgctccctgcatttccgttcgatactatcgaggctctctctcaagtggccattctcacgctcaatgacatcaagcctactagacatcccctccaacctagtttcaagtctgtccgtgatgtccttcagcctctgggcgcatatatcgtgattggtgttggctgtctgtgcctgttctcgtacttcattcagttgctgcttcagttcagcgattga

SEQ ID NO: 19285 - DNA, 213 bp, A.fumigatus
atgcctgatattacatctttgcagagtcacccactggaggagaccgattctcattctttctcaccggatgacagcttccaggaagatctaactggtcatgatgcaatcccctgtcatccggctaggcgtaaaagccgagtggcaacgctcttcttgccaatgagaatctccgtcatgcgactgggacgttcaatcttctgccggatgagctga

SEQ ID NO: 19286 - DNA, 516 bp, A.fumigatus
  unsure (464),(466): Identity of nucleotide sequences at the above locations are unknown.
caagtattgacgatatcttcccaggtgtctacgcctacggtttcgagcgtccctctgctatccagcagcgtgctatccttcccatcatcaagggtaggtcttcctattacggcctatgaaagtaccgtcattaatctgggaatcacaggtaacgatgtcatcgcccaggctcagtccggtaccggaaagactgccactttctccatctccgctctccagaagctcgaccccaacgtcaagggatgccaggctctcatccttgctcccacccgtgagttggctcagcagatccagaaggtcgttgttgccatcggtgacttcatgaacattgagtgccacgcttgcattggtggtaccaacgtccgtgaggaacatgaagctcttcaggagggtcccaaggtcgttgtcggtactcccggccgggtcaaggacatgatccagcgccgtgtccttcgcccgacaancntgaagatgttcatcctcgacgaggcgaatgagatgctttctgtgagttag

SEQ ID NO: 19287 - DNA, 579 bp, A.fumigatus
ggttacaccaagttcatgcgcgaccccgtccgtatcctggtgaagaagcaggaactcaccctggaaggtatcaagcagttctacatcgccgtcgagaaggaagagtggaagctcgacaccctgtccgatctctacgagactgtcaccatcacccaggctgtcatcttctgcaacacccgccgcaaggtcgactggctcactgataagctgactgcccgtgacttcactgtctccgccatgcacggtgatatggagcaggcccagcgtgatgttatcatgaaggagttccgctctggttcttcccgtgtcctgatcgccaccgatcttctggctcgtggtatcgacgttcagcaggtttccctggtcatcaactacgacttgcccgccaaccgtgagaactacattcaccgtatcggtcgtggtggtcgtttcggtcgtaagggtgttgccatcaacttcgtcactgctgacgatgtccgcatgatgcgtgagatcgagcagttctacagcacccagatcgaggagatgcccatgaacgttgctggtaagttcaaccatgtggatattagccttgattga

SEQ ID NO: 19288 - DNA, 255 bp, A.fumigatus
tcggcccgacatgacctccgaggtacgggcacctttagggccacgaacgcaatttggagcatcatcatcgcaatcgcacgcgttcttcctttatgttcagtaacttttctggctgtaccgcgagctgtcacagctcgtccagcaaatatgacttccagcgtagatgccaaattacttaaacagaccaagttccctcccgagttcaatcggaaggtggatatgaaaaaggtcaatattgaggttatgaagaagtga

SEQ ID NO: 19289 - DNA, 279 bp, A.fumigatus
ccagatatcaaatctctacaaatccagcttactggctttctggataaggatacgcccaagttctgtaaagatctctggtcactatgtctcagcgctcaagagaacccccaaggcgtcccgaaggagctgctggaagctaagaagctcgagcttatacaagagaaggtagcgctgatacattgtttgaatggttttaaacctggtgctgatactgtttctgctagatcgcggccgagaaagcagcggaagaagcccgccgcaagagggagcaagagctag

SEQ ID NO: 19290 - DNA, 195 bp, A.fumigatus
gccgcgagcgatttcgcgatccgccctcaagacgagaatttgattcttacgttccctccggttcgcgccggggccgtcggccttcaagatcgcccagtgcctctccctcccgctctcgttccgtttcctcatctcgatcgccaccccgtcgacgcctacctagcagagacagatacaaacgtcgccgctccgtga

SEQ ID NO: 19291 - DNA, 195 bp, A.fumigatus
  unsure (14),(28),(89),(141): Identity of nucleotide sequences at the above locations are unknown.
gttagctttgttgncacatgtttcgccnggcatcttttctacgcgggtatacagcgtggtttcaccgagcaaatttacgacatcttcangctccttcctcagtctactcaggtcgtcctgctgtttgctaccatgcccagngatgtccttgaggttacaccaagttcatgcgcgaccccgtccgtatcctggtga

SEQ ID NO: 19292 - DNA, 210 bp, A.fumigatus
gaaatctctctcgtgagagtcgtggttctagtctctaaaagtatctctaaggggctttcattactctcagatctctgcgactacaacccccactgggacctgttgtcgctaagaaaacttccaagttcacaaccaacaccccactgtttcatcgatcgcagcttttcgcctgtgatcaccacctacttcagtcgcaatcatggcttctaa

SEQ ID NO: 19293 - DNA, 213 bp, A.fumigatus
gatcaccgactccttcgatgctatggacctgaagcccgagcttcttcgcggtatgtttcactcgtctcaacgagatggcggggtatgtgtgtagcaagtattgacgatatcttcccaggtgtctacgcctacggtttcgagcgtccctctgctatccagcagcgtgctatccttcccatcatcaagggtaggtcttcctattacggcctatga

SEQ ID NO: 19294 - DNA, 549 bp, A.fumigatus
  unsure (473): Identity of nucleotide sequences at the above locations are unknown.
atcgcggccgagaaagcagcggaagaagcccgccgcaagagggagcaagagctagcacgcgaaagggagctggaagagatccggcgaagagaacgtttcgatcgcaatcggggcaggcgaggcggtggtcgtggaggccgagactttgatagacggccatacagggacaaccgatcgccacccaggcgactaagccgcgagcgatttcgcgatccgccctcaagacgagaatttgattcttacgttccctccggttcgcgccggggccgtcggccttcaagatcgcccagtgcctctccctcccgctctcgttccgtttcctcatctcgatcgccaccccgtcgacgcctacctagcagagacagatacaaacgtcgccgctccgtgagtggctctgtttctccagaaagaggagactacaggcgaccgagaagacgcaacccagactacggtgatcgagctagatgcatttnccgcagtgattcatcgcgctcacgtactcgcagaaggtcttcaccacggggctggaaggatcgagaggggctctag

SEQ ID NO: 19295 - DNA, 270 bp, A.fumigatus
ataggagttacctgtcaggatcgtcacaaagcccaaccacatctagccaactgcctagattacaaaaaagttctgcccaactgggttaatcgatacaaccctggcgcgcagagaagtaaaaatagtatctcgattcgtaaggtgtcagatgtccagggagcgtctatgagcaccgtctattgcagaaccaacaccttagactccattaaccagcctgagtatcagtcgcaacacactaccatctgcacctccaagccagtgatgagatag

SEQ ID NO: 19296 - DNA, 189 bp, A.fumigatus
gcagtggcagatctacgacataagtacgtcaagaaccaggcggcctacaacacccgagctactgatgttttgagtaccatgggtctgactcgcgcagaatatcgagtgcagagccatttattgccttgcccaagtctctgcgcaagagttcgacccgccaactcgccttgcagcagtggcttcgcataa

SEQ ID NO: 19297 - DNA, 261 bp, A.fumigatus
atgtggttgggctttgtgacgatcctgacaggtaactcctatttatgttactttgttgttggatgggatatatatcttgttttcactccaggctcgaggcacaccagtgtctattatgcacagttgcacgggcatctggatcgttcaaggagcgtattattgcttattctatctaacctgttcatgcccatgcctttaacagctggtattaaaatctattcagtttccgctgatcaatcaaagaacgaagcgccaaaatga

SEQ ID NO: 19298 - DNA, 957 bp, A.fumigatus
cagatgctcaacgatgcctcccttttcagcttgtggagaggggatatgatgtctggcttggaaacaatcgcggcaacaaatattccaagaagtctatccaccactctcccttgtccgcccaagttctggggcttttcgatggacgagtttgcgttctacgatatccctgacagcattacctacatcctcaatgcgacaggacaggcgtccttgtcgtacatcgggttctcgcaaggaacagcacaggcgtttgcgactctgtcgattcatccgttgctcaatcagcaaatagacgtctttgtggcccttgcacctgcaatggccccttcgggactgcggaatcgtatcgtggactcgctcatgaaggcttcaccgaactttctgtttctcctctttggtagacgcagcatcctcagttccaccactatgtggcagacaattctctacccgcccatctttgttcgcataatcgacacatctctttcaattcttttcggttgggagggcaagaacattagttggtatcagaaactggcaggttacctgcatctctattcgttcactagcacaaagtcggtggtgcattggtttcaaatcatgcggcacaggaccttccaaatgtacgatgatgaagttcatgctccgttcagcgttgtggccagtcaacggttttacaaaccggtcaagtaccccaccaggaacatcaagaccccgattgttcttctttatggtggaagtgacagtctgatcgatatcggggcgatgttgcgagagctccctcgggggacggtggccaagtcaattccatgctatgagcatttggatttcctctgggcaagagacgtggaccaacaggtgtttggacacgttttcgaggctcttgagcggtacggtccgggagaatatagcgggaagaaagggcacagagcagccaaaccgaccaacggcttgatataa

SEQ ID NO: 19299 - DNA, 186 bp, A.fumigatus
gtagccagcttaggccttcatctctatactcccgtcatttccctcacgttccctccacccggtgtatcagaggggttccctgtcaaggtcaatttgaacgtcacggatgagtttccatcagtaatgatcaatctggcattcccatggttttcttgccgccgtctgtttcctatcctcacggtgtaa

SEQ ID NO: 19300 - DNA, 825 bp, A.fumigatus
acatgtccatatgctctgctttgtacatctcaattgacctcttggccaggctatggaccctcccttacccccaagaatatcattgatttcatgaacaaggacggtaacgtcctcctcgccttgtcgggcaagtccacaaccgccagcgctatcagctcgctgctattggagctcgatctccatctccctgtcgatcgttcctctgtcaccgtcgatcacttcaactacgatacactttctgcctccgataagcatgatgttctgctactccaccgaccaggcaagttgaggtccgataccaaggctttcttagatggcgagggcgttgtagcatttcccagagccgtcccccacaccctgggcgatgcaaaccctctcattgcgcctattctgcgagcgcccgccactgcgtatagttacaaccccaaggaggacgcgtcgtcagttgaggatgttgcagctacgggttcgcagttggctctggtctcggccatgcaggctagaaactccgctcggttcactctactgggatccgtggagagtctgcaggatcagtggttttctgcgactgtcaaggctcctggtgatgggaagcagatgaagacggtcaaccaggaattcgccaagcagcttactgcgtggacattcaaggaaaccggagtcctcaaggtcggaaagatcgagcatcatctggctgaagatggtgaaatcactcccgagaagctgaaccctaagatctatcgagtaaagaatgaaactgtaagtgacagccatctgaggttccattgcctatttgcatgctcacccttctcaacaggtctttag

SEQ ID NO: 19301 - DNA, 465 bp, A.fumigatus
ggttccattgcctatttgcatgctcacccttctcaacaggtctttagcattgaactttccgaatacaactatgatcgttacgcgcccttcgaggttccaactggcgatgccgtccagctcgagtttaccatgctgtctcccttccatcgcctgaacttggaacccgtccgtcgaacagataacagtacagtttacagcacacgattcaccacccccgatcagcatggaatcttctccttccgagtgaactacaagcgcccgttcctcacgaacatcgaagaaaaacttgaggtgaccgttcgtcatttcgctcataacgagtacccccgaagctggaaaatcagcggtggatgggtctggattgcgggtctgtggtccgtcatcgctggcttcttagtattcgttgttgcatggctttactcagcgccttctgccgccgcactgaacacaaagaagacacaataa

SEQ ID NO: 19302 - DNA, 516 bp, A.fumigatus
cctgaagcagcggagccaataatcgaattctgtcacgatcgttctaaggccttattcaatcttctgagcccgggagagagactatacaagcgtggtaaggaggagcagatcgccgcacaggttgcgcaggcctccaactttgcagacatttgtgccattttcggatatgaggcggaggagcacatcgtgcagacaaaagatggctttctgataggactacaccgcctggcctatcgcagaggcgaggagggtcgtctcgtcaatcgaggcgagggaaccctcgaaaagaaggttgtctatctccaccacggtcttttgatgtgcagcgaagtctgggtgtgtttgacagatgctcaacgatgcctcccttttcagcttgtggagaggggatatgatgtctggcttggaaacaatcgcggcaacaaatattccaagaagtctatccaccactctcccttgtccgcccaagttctggggcttttcgatggacgagtttgcgttctacgatatccctga

SEQ ID NO: 19303 - DNA, 189 bp, A.fumigatus
gcctggcgactttctccaggagatgcactggcgcaatgcttgcaagaatcagattgcatcatggtccagcggcacaccccgcgtgaatgcttgagcactcccctcgtcgatgaactgcctatgaaatgccaacagttgcggaaaggattcagcgagtgcaagtgggtggaacggatatgcgtgctttaa

SEQ ID NO: 19304 - DNA, 198 bp, A.fumigatus
gtggttctcagtttacttacacccattggggcgcttccacggagcacgttccacatcccttccacgaccctcacctacaatgtaacatatttggatgctaatgagcctggcgactttctccaggagatgcactggcgcaatgcttgcaagaatcagattgcatcatggtccagcggcacaccccgcgtgaatgcttga

SEQ ID NO: 19305 - DNA, 369 bp, A.fumigatus
atccttgatccaatccatctgtcgcgctcacaactctcaatcaagtcccgcaaaaatccttctgaaccgtcgacctttcgtctcataaccatgactactccccagttctggtcaactcctctccgataccttcgctgggcctctcatgagaagccagcgatcttctactccttggtcgtcggagcgacaggtcctctcatgctggtcacccttccccccatcagacggttcttcggtgatgttgacccggaacccattccattgacctatccccgtaaggctccgatcttttttttttctttctcatgctctccctgctctcttatctgtgtcttgtgcctctcgcatgctaacatattcattccctaa

SEQ ID NO: 19306 - DNA, 204 bp, A.fumigatus
gactacataaccgttcaaaccacccacattaggttttcaaggataccttctgaacggttgaagtacgtatgcgattctcatatcaaatacgaaccatgggccacgattaactcatccacgagcgcctgtcaagcttgcgacaatgctcggtgtaattacattaccatttacatacatacctacaagtggagggagaactcttaa

SEQ ID NO: 19307 - DNA, 471 bp, A.fumigatus
attttcaccatgggtgaccgttcgagaagcagatcaccgagacggcgatatgatgaggatcgcagccggcctcgcaggacgggaggaggattccggtggaaagacaaacgtcacgaaggtgacagacttggagcagaagatagcaggctgagccggggttacagagacagaggagaccggccacgatcaccacgaagggaccgagactcagatcgatacagagatagttacagggacggcgatcgcgagcgaagacgaccagacgataatcagaaagatgagcgtcgggagaaaaaggagaagccggaaaagaaggcggttgtcgcaccccaatcctcagaacctatgattgtggggcatgtcaccgatcgtctcggaactaaaggctgcaataccatgcctggcatcagatcctatcagttcgtttcttatgctgtgtctcaccttccaaatgtggtcacactggactaa

SEQ ID NO: 19308 - DNA, 1995 bp, A.fumigatus
aggaaacaatacacctcgcccagcatcgttcgggggatgtggagaaccccagggaggcccctgtctactttgagtcgcatcacagactccattgcagtcagaattcactgtcgatatccccatacccgatctgtgaagcgtggtcgcgcaaaagcaaacaccatgcctggccccgcggatgcgcctcccgaaggccaaccagactattcgacctggacgacccccagcctaatcgcgcggatcacagagcttgagcgccaacttcactcacgaaacaccgaatacgctaccctaccgtccaagggcgttaatgaggtcggcgtaacgagttccgctccccggccgtctgagcatccagtgacagacacacaagagcttgtccccgccaaagcaggaaagcagaagagacctctatcgcctgacgatgatatcacgcacacaagagcgcctacccgccctccgaagcaacctcgagagatcgatccttccaaatacaatactcgcttcatagcgcttaaatttgcatatctgggacagcgctacaatggtctggagcacgcgaatgggaacgttacgcctctacccaccattgaagaggagctgtggaaggccatgcggaggactcggctgattttccctaagaacgcagaggccttcgatgattcccgggggccgagggaattgaaaccttacgcaatcagctgggagggttgcgattactctaaggccgggcggactgatcgaggtgtgagtgcctttggtcaagtcattggaattagagtacgaagcgccaggcccaaacggccggatgcggagacaacgtccgatgttgagatgacgtccggcggccatgctgatgacacttgggatgatattgcagatgagataccctatataagtatactaaacagggtgctcccagacgacatccggattctagcctggtgccccaatccacctccgggttttgacgctcgtttctcgtgccgagaacgtcagtacaaatatttttttacccagcctgctttctctccaactccagggccgttgggttttgctatgagaggatcgggtgacaagaatgcctctacacatttacgggaaggctggttggatatcgatgccatgcgagaagctgccaggtacttcgaaggagtgcacgactttcggaatttctgcaaacttgacacaagcaagcagatcgagaactttgaaagaatcatctaccatgcagacatcgagctcctcgatccaaaggatcaccctttgggctatgtgaaccagcccggctttcaagctctccaagatgcacctgccagaacgagctccgaatcaggaacattcactagtccggcggctgctaaggtgtatgtattcaatctgcacgggtctgccttcctgtggcatcaagtacggcacatggtgagcattcttttccttgtaggccagggactggagcctccaactattgtacgcgatctgctggatgtgtcgaaaaatccttgcaaaccaacgtacgaaatggcgtctgatgccccactagtcctctgggactgtatcttcccagacgaggcaagcggcagccgtaaagatgcattgaactgggtttacgctggagaccccaggcagtccaagagtcaactaggcaagggcagtggcaagttcggtgttggaggagtagtagacggactttggtctgtttggcgtcagcggaagatggacgaaattctggcaggcgcgctgctagacctagctgttagccagggtgaccaaagtgttgtccggggtgaaggatctcatgatcctatatcggagaaagataatcgggggcaaaaggttttctatggcgccaatgaacccagaatgggcggcaaatatgttcccgtcatgcagaagcggaggacagaacccgtggaggttcagaacgccaggtggcttgcatcaaagcagcgaaaagttgataaggcttcggagccagcgcatggggacgattag

SEQ ID NO: 19309 - DNA, 222 bp, A.fumigatus
gttgcagactgcaatgggcaaactgttattcagattactgatatactgaaaaagcaaaacatccttcagccaactcccggttacaaacaaaagggatttctgaagaaaggcttgcctaaattcaagatctcgccctcggaggaaatccagcagaagttgaaagaagaaatactcaacccaatggcaaagattgggcaccacgtgagtgtcttcatgccatga

SEQ ID NO: 19310 - DNA, 207 bp, A.fumigatus
  unsure (136): Identity of nucleotide sequences at the above locations are unknown.
gcattcatcgatctagccaagttgatcttcgaggcatacatcaagtaccatgttgcctttagcgctcgtcggggctgttggggcccttgtctttctggtgtttcgtttactatccataggccgacggcccaagaantaccctccgggacctcctaccttacctatcattggcaacattcatcaggtgagtttacatactgttcatag

SEQ ID NO: 19311 - DNA, 1266 bp, A.fumigatus
agaccttggatcgtgtcgcatgcaggcaacgtccacatcagccccaagggctcatttagtttcccctacggagccgccgctttgacacacagactcaatcaactgcggaaggggaagagtccagacgaggcacatcgggcggaggaggcattccgccgcgagatggagagcaatttccgcatggccctggagcagctcgagattcctgataggctggtggaaaaggctcggaccgagggaggcttccccctctatctgtccgggggaggatttcgtggctggggatacctcctgctttacctgcatcaggttcgcgggcagtattaccctatctccatcatcaatggctactccgctcccaaggaggactttgagaacaccgaggttctcaaaaaggtcgctcggaccgcccgggacatcttccgagtctccgatcgccgtcgtgaacaggtcccctcggtcgcattcctggtcaatgtattggccaaagcggtgccatatggcatcaaagaagcgcacttctgccagggcggcgttcgcgagggtcttctcttccgcgagattcctccctttgttcgacagcaggatccgctggaggtagcgaccaccgcgtttgcccggccctccgcgcaggtgatcgcctttctgatgtttggcgccatccccgcacgcaccgaagagaggactttccccccatcgatccgcgggaccctgatccaggcctttgccaattcattgtttgtgcacgccgccatgtcaaaggagtcgtcgtcgactgccgcactgtacagcaccagcgccggtctcctcgcctccactcacggtatcccccactcggaccgcgctcgcctggcgttgatgctgcaggagcgatatggcggggaactgcccccgcgggagaaagatttcaagtcccggttgcgggaactgctgacaccggaggaggtctggtggatccgatacttggggaagctcggactggtgctcgcccgactctatcccattgggatcattgacccggcccggccgcgcatcacaaccgaggcacgatgggccagcaacctgggcaaacatggaaataagacaggcattgagctgaaggtctttgtgcagaaagtggcgtatgacccgacgcagttgaagtccgaactggagcgggatgttcgcaagattcacaaggtaggcaagaggaagaactggatcggggggagagacggctgggggatgaaagtcaaggccgttgtagccgaggaggtgatgttgtga

SEQ ID NO: 19312 - DNA, 1575 bp, A.fumigatus
tgcacatcatgccccaaatttcatttaacacggaccaaaacccatgagagtccttccaaggacatcgtgcaagctctcgatatggaattagtcgcccccactttactggccatcgttctcgtatgttgctgtcttcatctgctacgctctcgagcatcccgactccctttgcctccgggtcccacccttctctccagaccatttcgcgaaaaagatatcgcgaccacatttcagaaatggaaccaaagatacggtcctgttattagcttcagagttgggagccgtacgtttgtcgtcctcggaactcggcaagccgcacaggacctgctggaaaagcgaggcagcatctacagctctcggccaccctcggtatggatggaaaagtacctcaataagggactggcagcagcattcatgccgtatggccatgagtggaggttgaaccgacgcttgcatggctccctactgagtgctcatcacaccaatgcatatcgttctttgcaagacatccaaagcaagcagctcctgcacgactttctctcgaccaatgatttctcccactgttttcatcaatatacgtcgaatgtgatgtttactctggtgtacggaaaaggaagaggaaaggatgacaatgaccacagaagattggagcaaattaacgaattggccgggtttgtgttgcaaggggcgtctttctggaccttcctgatggacttgttccctattctcgactacgtgccgcggatcttctggaaatggaggacagaagccgcccgactccacgacaggactatggttgtgtatcgcgaatgctgcgaagaggctcttacagcagaatgctggaactggagcaaagaagtcacacagaaaccggacatcatgcagctcccttgggacaacgtctgctactcgctcggggagctgtatgtggcaggcattcacacgaccaaaatggtgttggagctgtgtgtcatggtgagcatcttgtatcccgacgtggtatgcaaggcacagcaggagctggactcgatggtgggtgcagatcgaatgccgtcattcgacgacatgaaaaggctgccgttcatcaatgcgatcatctcggagctcctgcgatggcggccaatatcccctattgccgtgccgcacgcggccatacaagacgatgagtacatgggctatttcatccccaagggggcaaccgtcattgccaatcaattcggcatgaacatggacgacgcattcttctatgacccttccagcttccacccggaacggtatgtagagaatccggatcttcctgtctcggcctttggctttggccggagagcgtgtcccggtcaccgcctggctcggtcaagcttgttcattgtcatctcgcgtttgctttgggctttccatattacatccgccaacaaggaaccattgaccgaggaatcgtcgccggctgctgtcaaggccacattccgggtccgcagccctcacagacaaaagattatcgaaagggactgggctttggcagagaaggatgaacgcattgttctgtcacagattgaatctagaattcgtggtaaataa

SEQ ID NO: 19313 - DNA, 525 bp, A.fumigatus
ttaggtactgtgcccgaaacggacgtacagagattgcaagttaactctcctgctaggacttttatctgggtctttctgatggataccgcatttgtcaccttcaacaatttgccgccacggatggttgtcaaggaaatgaagatgcatgtggccgcccccgagtcctgtttccaggcacctacggccgatcagtgctacgatgcaattcgggactggatgccttctgcgagcctctgttggaagttttccttccgggccctgttcgagaccctgtgcatcgacgacctgacagtgaagatgcaacaagccgtggcagccctgggtcccttgaatctgtttacgatcatctctggtcggtgccctttccacaacggactcttcggactcgtcatctcccgaatcactgacattctcaggtatccactcgttggtcttccactaccagagtttcttcagcgcagggaacctgctctcacggacccacactgcgctgcaaaacttcaagcatatttggcacctccatga

SEQ ID NO: 19314 - DNA, 1275 bp, A.fumigatus
ttggccacaggtgagttatgccaagtcgttattatgcatgtattacataatcggccagtctccccgcaaaagtttccccacaaactccagatcctctgcccgggatctgctgtacctctcctgcatcggatcagatctcaagagaaaaatgaaacctgtgcactcagaatgaagacctcaccagcgtatgccaatctagccaccagtcctcaccagtgttccatctgcttcaagtcctacaagcgacgggagcatctccagcgacatcgcaattcccactccgcagaccggccccatcggtgtccagcctgtccgagtacgttccagcgagccgacgtcttgcgccggcacctcagaacctgcgaccgcattatttctagcgcttatcagggagccactcgtaaacgtgcttgcgatcgctgtgcgcgtcaaaagaaagcttgcaacagtgcccgaccgtgccagaactgttccaagaggggagtggagtgcgcgtattccacacccaagaacgatacctcggcgggcacggagatagcttctccgtcgatttcgctgggtgctgatagtagtaatgcggcgccagcagcagcaacaagtgttgatctgtggaccccccgcacggggaacgacgagcggccggacagcactggatttgacgctttcgcctgtcctgatcttggtctcctgcaatattgcgaccagtcatggcaagacttgttcaatgtaggctcggaggacctgtctccgacgagcggcgaccgcaactacttcttccatttcctcgacaccttcaccagtcgcactggctttgtctcgtcctttgaatgcggaacattggagcagagatttatggttctgtatagcatcgaggagaaagaacggctatcagacgctttttggaccattgacatggaccaatgcagtaatcaggagagtaacaactcgtacggcgtctcatcgcaatggctcaacgacccgctggccttacagacccatcagattctccttctgataaaggaggtcgtcatgataaagccgcgcaacagctgcgtgaccatctcgtggtctcaggacatcgagcaacggtgtctgcagttcttctctcctacgagtctccggaagtatattgaactctactggttgatctggtctccaaacgtgaacttcctccatcgaccgagtttccacccggcgagctccaagccaattcttctggcttcgatggccatcattggtaagacagaaaagacaaactctttcacaccacagtag

SEQ ID NO: 19315 - DNA, 279 bp, A.fumigatus
ctgaagtacataggcgcctgtgtttcgccaaaccttgaagataacgacaatgctcggatgtggttcaattgtgtcgaagaggctgtctttgccgatgaggacttcaaccgcgatccagtgtcaccgttcagccctgttcgtgacagacagaagatgcaagcactgcaggccgcttatatggtctgcttgtatcagaattgggaaggcactgatgccagcaagaagcgtatccgtcgccatcgctttagcaccgtcgtttcggtaggccccccagattga

SEQ ID NO: 19316 - DNA, 291 bp, A.fumigatus
gtttacatactgttcatagtctccgaatgccaaactcacagccagcagatgcccacccgcgatgcccatctgcagctccagaagtgggcccaagagtacgggcccgtttacagcctgattttagggaccaaacccctgatcgtcctgtcaagcgatcaggctgtcaaagccctgttggataagcggagtgcgttgtactcgcaccgacaggagatgtacatcggccaaacgctatgcagcggaggccttcgcatgcttatgatggtaggttttcaatgtccgaacagctag

SEQ ID NO: 19317 - DNA, 189 bp, A.fumigatus
agtcatggggctgacagattccagtttcgaaaaatggtccatggtctcctcaatgtgaccgctgccaaatcttatgttccctaccagatgctcgagaacaaacagatgatgtacgagtttctcacgcagcccgagcggttcctgtcttcaccacggggctcgaaggatccgcgctatgcgtatagcgca

SEQ ID NO: 19318 - DNA, 4260 bp, A.fumigatus
gtggatgagatttacagttgcgattgctttcgtgcatgtcctgtcatctctgtagcgtctttattcactggatgggagaggggtcaccatcaataccagtttcccatattgttgtgttcattgtgttccagcaaatttctcattctttttgtcttcgtgttttccgtctcctcttctctgttacaacatcttccacctgaaaagttctccaactcgcagtcttccatagcaaatcttcggcttcctgtctgtcttctccaacctgaatttgtaactgacaacattggcagaattaaggatattcggagacgaacccgcccgagtaccaccacttcaagcactactggaactacattcagtccgttcaattctatcgatcccaatactgtctcgggctcccagcctgcgacgaacggcttctctttcggccaatcccagtctctcagtttcccaggagccagttcaaatccaagccagcccgctcagaacggagggtcaccgtttgcctttggctcaggtggtgctggttcatcgtcatttagtttttctacatcctttggtgggtcagggtcatcggggaatccttttgcgactctgaacacccctacgcccagccaaccgtctgagaatactgggttttcgggcttcaaaggcagtatgttcaacgtaccacccgccggaagcactactccaggtcagcagtctctgcctgcgggcggtctctttggaactggctcgcagcaaaccactgctcctggaggcatatttggaagcacttccactagtgcacatccaaaccagcctgtgacaacggcaccctccactggcagcattttcggccagaataacgccactagcactgctccatctacaagtctgttcggccagtccacatcagacaagccttctccctttggccaatccacagcgttcggtggcgattcgatgcagacatctcctgacccgaaggccaatgctgccgtttcaaagccagtcatcttcggaggaagtgcttctcagcctacatttggtgcatccacaggcttcggcagcccagcgggaggctccgtttttggaggtgctgcaccggcagctcaacaaactccggctaaaccactttttgggacaaagccgacagagcaagctactccaacttcgacgcctctctttggcactacttcccagcaacccacagcaggcgctacggcacctacgcccgcatcgacctctgctactcccaccacaccgacagccacgacgctatttggtactgcttcgccggccaagcctgcaacgccgttccagaatcctttccagtcttcaaatcttttctcaggcacgccctctccatcagctacaccaaagcctgctgaagaaaaaggtcatgaacagaaggcaggcgaggcagctccaaccaagaccggcttccaattctcctcctccacagccggaggcaatctcttctccaagagcgaaaccgctgctgccgctccttcaactacttcatcagctggcctgttccaggcaccggccacgggcagcctgtttgcgccaaagcctgcttctgcagagacttctaagcccgaaactcccaaggcaaatcctttcagcagcctttttgctcctaagccatccactaccaaccaggccacgccagaacagaagccttcgcccgccgctgccccgtttggctcactcttttctcccaagcctagcacacctaatgaagcagcggagcagccggccgcgtctacaccggctgtttcatctgcacctgcaccatcacctagtctcttcacgccgcagtcttcatctctgtcaaccacctctatggagagtaaaatccagacaccttcgtccgccactcctgcgtctcaaggcattttcaaagccaatggtgcagcacccgctcagccaacaccttcagcgaagcctcccgcagtccaattcgccgagagcttgcggccgagcaaattgcctactcaactgagcgaacaacagaagaaagattttgatctcgtgtatagtcttcgcatgttgaatgaatgctttcaacgcgagatcgctcgactgaatcctgcaacggacgacttcgacgctgccgtgctcttttacatgcgcgttcgtgaagtgatcggtgcaccaaccggaccgatgtcacataagcggaaggctaccgacgatgaaagtgctgatcttgagcaatcagcgaagaaagccaagcccttcggcacccccagcaccaacatctcgtcaccttctcagaagatgaacatcggacccagctccattacgaaaacaccgtctaagctttttgatactaacccgaccccaccaactaccaatggcaaattggctgaggaaaaggccgaaactggtgtttcggtctctctggctggaaaccgttccgacagtgactctgccacagcgagcatattcgctaagtctttctcgaaatcgaaagctgatgattcggagcccacaagtgcagtgtctcccagaccagctacgccagaaaccaatcagcctgctctattctctaccaccccgtcggcatctccggcaaagcccatattttcttcatccactactgccaaggagaatgcgacatccagctcgatcttctctcaatctacctcaaaccctgggctcacatcatcaacaaccagtgtcagcacgtctgcccagaatctgttcgccccgaagcccacaggtgatgggaaaaccgaggcgccagccccccccaaattcactgccggcactgcgacgaacttttttgctcagttcaaatccatcgccgataagagtgctgagaaggaaaaggagaagcgcaaagcagaggagttcgactccgaggaagaagacgaagctgaatgggaacggaaagacgccgaaaagcagcgcaaaaaacgtgaggagttggaggctcagtctaaaaagcgagccaaatttgttccaggcaaggggttcgtcctcgaggatgagagcagcgatactacggaacccaagaaaccagcagagacatctacttcgactgccagttcatccgtcttcgaagcaaagcgagacactgtggccaaagcgaacaatatctttggtcatctctctgcgaccccatcagaggtagaagaggataacgatgcggacgatacggaagaggcgtcagctgctggggaagatgctgatgaagagtccaaagggtcctccgaggtaccggccagcgaccgcgacggtagtcgggatgcggagacaagtgaagcagactccaaagcagtttcagtcagcggagctgagttctctgccaatgagagcagtgacgacggcgatttttccaaagctctgacaaagtcaaaacaagcctcgagcggtagtaaaagtctattcgatcgggttcagccgaagcggcaaaccgatgaggaaccaaagaattctttctcttccctttttagcccttcgtccaagctctcttcttccatgacgacccctggaacatccacaccgaatccgtttggctcacccagtaccgctgcgcccggccaaggtgattctgtcgaaagtaagccatcgtctagtctcttcaaatcatcgaataacacaccaagcggtggcctttttacttccggaccggcaagtactggaacgagcacgccgtccatttttggccagagctcgtcgaaaccagcaggggacaagacctggaagccggattctcccatcaaattcgccgactcgactggcacagcaccctcgaccatgtcgaaacctgattccggtcccaccactcaatcaaccgactcctcaaagccattctctgctctcttcggcgcgccagccgccggggcgaaggcgtctggcagtggacagtcggcgctagggttctcctttggcggcccatcacagcagagctcttccctcctagctccttccaccgtcacttccgctactggaagtcgcgcatcgactcccggaatgacctccgatactggcgcagaggagtctggagatggagaggctgccgaatctctaccacaagttgatcttgctcgcagcagagcgggcgaagaggacgaagacattgtgatagagacacgggcgcgcgcattgaagatcaagcctggcgcaggctgggaaagccagggtgttggttatctccgtgttctcaagaatcgcaacacttctcggtcttgtatcatcctgcgaggcgaccccagtggcaaggttgtcctgaacgcaaactggttgaaggatattaagtccacc

SEQ ID NO: 19319 - DNA, 261 bp, A.fumigatus
accactttttgggacaaagccgacagagcaagctactccaacttcgacgcctctctttggcactacttcccagcaacccacagcaggcgctacggcacctacgcccgcatcgacctctgctactcccaccacaccgacagccacgacgctatttggtactgcttcgccggccaagcctgcaacgccgttccagaatcctttccagtcttcaaatcttttctcaggcacgccctctccatcagctacaccaaagcctgctga

SEQ ID NO: 19320 - DNA, 246 bp, A.fumigatus
ttcggagcccacaagtgcagtgtctcccagaccagctacgccagaaaccaatcagcctgctctattctctaccaccccgtcggcatctccggcaaagcccatattttcttcatccactactgccaaggagaatgcgacatccagctcgatcttctctcaatctacctcaaaccctgggctcacatcatcaacaaccagtgtcagcacgtctgcccagaatctgttcgccccgaagcccacaggtga

SEQ ID NO: 19321 - DNA, 225 bp, A.fumigatus
tcattcagttccgatcaaccttacctgtcgagcaagctgatgcaagcaacgggatactgtatcctctctcttacaaaaaagagactatccatcgttgctgagtctaaattccctacgcagcctcctgtcaactcgaagattcctcctttaatacaaactgtattgggatatgatatcgaatcggcattatcatcgcgtctcctacggaagacaaagatatcctga

SEQ ID NO: 19322 - DNA, 240 bp, A.fumigatus
atcgaacctatggagtatgctgagcagatatctactctgtacacgttcgcagattgcggaggaaaatggataaatctccttccttgccccagtcttctccgttctccgcatttcggcaagtcgactgtccctgactccgtggacctgcagcgagacacatctgaaaatttagctattgctctgtttgaaactccagcattcaagcttgttttagacggccggcgctggaaaatatggagc

SEQ ID NO: 19323 - DNA, 291 bp, A.fumigatus
ggaccaaagaatctaagaagctgtcggaacgctgggcgactcattaattatccccttcaaagagcgtttcagatcaacacaagggtcaggaaagggatgaactcaatcactcggcagcttaaaaaggctgcgcgtatcatcctcattggtgcgcctggtgtagggaagggaactcagacagaaaggctccttgcacgatatccagagctatcctcaatcagctcaggggacctgttgcgcgaaaatgtgcggaagaagaccccgttaggtaaatcagatcgatgctattga

SEQ ID NO: 19324 - DNA, 216 bp, A.fumigatus
aaagctgaacgagatgtatctgcagctacttctcaaaggcaagccttagaggctgccattgacgtcgctgagcattatatgaaagctctgtctctggcagcaaccactaacgacaagcagtcgttggatgcgaaatgcaaggaatggctctccagagcagagaaaatcaaagaagtcttcaccacggggctggacggatccccgctcaacggacta

SEQ ID NO: 19325 - DNA, 591 bp, A.fumigatus
ccgtcttgtccgctcaaaggtatcaaagcagaggccgcaatgcaggctggaaacctcgttcccgactccatgatcctcgagctcatctcctccgaattcaggtccaagggctggctccctgtgacagcgcctctcgcaacagccacatcaaatcacacatctcgcccgtccacaccgctatcgccctccgcctctttcattctcgacggatttcctcggaccgccgcccaagcactgagtttggacaccattgtccccgtaaattttgtcgttcaccttgtcacaccaccatccgtcattctctcgcgaatcgcatcgcgctgggtccacgaaccatccgggagagtatacaataccgatttcaacgtccccaaagtccccggcaaggacgacgtgacaggggagcctctgacacaaaggcaggacgactcggttgatacatggaaacagcggctgcacaagtttgaagagaccagcaaggctttgctgcagtattatgagcggaagggctgcctgtggcgtgtggaaggcgactctagcgatgagattagcccaaagctctttgcagagattgagcggagattctgttga

SEQ ID NO: 19326 - DNA, 543 bp, A.fumigatus
gacggtgcgtttggccccagttttatgactgctgtcgtctcttgccaaagagccttacgaactatatctcattctaaaattcaggtccacattcgtctagctggcatcgacgcccccgagctcgcacatttcggccgtcccgaacagccgttcgcccgtgaagcacaccagtggctgacctcgtatctcctcggccgtcgagtccgtgcctacatccatcgtccagaccagtatcagcgtgcggttgccagtgtgtacgtgcgcaggcttctaaactttccgccctttcgtcgtcgggacgtgtcatatgagatgctgaagcgggggctcgcgactgtatatgaagcgaaaataggtgcggagttcggtggtgaggccatggagcgtaagtataagaaggcagagtggtgggcgaagttgaggggcgttgggctgtggaaagactatcgtcgcaacaagacaaagtgggagagtcccagagagtacaagacgcgtatgggactggaggaggctgcgcagcccggggttgaaatcaagaaataa

SEQ ID NO: 19327 - DNA, 381 bp, A.fumigatus
agactaactggtatcgcagtccttggtgcactttcaaaggcccttgccaccatcgcaactcagccattaattgttgcgaaggttggtcttcagtctaggccccctccaggtcgcggcgggaagcccttcaagacctttggcgaagtcatgcgttatatcattgaaaaagaaggagctctctccttattcaagggcattggacctcaaattaccaagggccttttggtacaaggtctcctgatgatgaccaaggagagaatggaacttatgtttgttcttctcttcgcatacctgcgcaagatcaggcaagaaaaacttcgaaaggccgttgacgccgctgcgtccaaggccaagacgagccttcctgcgactctcaaatag

SEQ ID NO: 19328 - DNA, 462 bp, A.fumigatus
gccgtcatgcgatggccgccatgggcttccgacacgcaggcccagcaacaaagcaggaaaagctcatccgaagacgatgaaagacaagctgcagcgagctcgaccaccacttcgaaaaagaaggactgggagtcctcggtaacagcgatagactgggctgcctttacagaagcaagaacaatcatcccgaccctgatcttgacgagcggtttcctgggcgcattctacatccatcgccgctatctgcgccggttccccgacgcagtgagcatcacgccatcgtatttccgtcgcaggagtctgctgggccaggtcacgagtgttggcgatggagataactttcggatatatcacacacctggcggaagacttgcggggtggggttggctgccatggaagaagattccgacgtcgaagaaggaattgagagataagacggtgcgtttggccccagttttatga

SEQ ID NO: 19329 - DNA, 246 bp, A.fumigatus
tcgcgctatagattcgtatgtcataccggactgcaagtcaaaatgattcggcaagatttccagagaattgatccaaagaggagagcgaccttggaccacaagaaaaagcagttcgcatcgccagtatacaagcagcaagattacccgcaccgtctgaatttctacgatattccgccaaccgcagaaatcacactcgagcagtttgagcaatgggccatcgatagactcaagggtatgaatgggtga

SEQ ID NO: 19330 - DNA, 612 bp, A.fumigatus
cgcatggatgatttgacgggcagagtcaagacgagactgcaggtgcaggtgaagagcgacaaaaccgatggatcggatggaacgatgcactatgaatcgactttggatgccatcaacaaaattgtggagagtgaaggaattgagggtctatattcgggaatcgttgggtccttgatcggtgttgcatctaccaacttcgcctacttctactggtacagcgtcgttcgctccctctatatggcatctgaccgggtgccgaagcctcctggcaccgctgtcgagctgagtctgggtgctgtcgcgggtgctgttgctcagatctttactattccggtcgcggtcatcacaacaagacaacaaacacaaccaaagggggagaagaaaggcctgattgaaactggtagagaggttgtcaacagcgaggatggctggactggtttgtggagaggtctcaaggccagtctgatcctcgtcgtcaacccagcaatcacgtacggggcctatcagcgcctgaaggacataatttttccagggaagaacagtctcaaaccttgggaagctttccgtaagttgcgccacgttattcaactgtggtcgccgcttgaagactaa

SEQ ID NO: 19331 - DNA, 1047 bp, A.fumigatus
gtcagaaaatggcgctgctccaggttgtccaccgtcgcgaagggagtcgaccccgagcgctggcagagtcggatgcaagcgatcccaacatcagtacaaggtgaatggactaaaacacgatcatctccctgtacatgtgcgagacgaccaacggcgtataaagcggtgagcaaggcgattggcagcgtcgcagcctgctcaaacgacatggcatcaggcaaaggaaaggtggctttgcatgagacggtgactcggttcgcaaagcagcctttgccaaacactgccacccgctggccaacacagcgagcgctgacacaggcgcctacgcggacgaccacgccagcaccttccaagccgagtccatccaaatccccagagatatcgcccatagccacatcaatgtctctggagttgcaaccagcggcgaagatctcgacctcaacatcatccggtcccatatcttgcctactgcacacatctcgaccttgctcggcgaaatgcagcgcctccaaactaccaggtctgcttgccatcaagcgaatggtagactttgaatcatgcagattggttagcacaggtggtgcgcctcctgcgttgtcttccaccttgcgtttattcacgccagcatccggccatatccggctgacatgcaacagaccacctcgttccgcaatctcgcactcaatggggagggacgatctgtccgctaaagttatctctctcagagccatattgatggccgacgcgtttgtgcccaaactctcagttgtggctgactcgacgtccagagtcactatgcgcatcatgggtacctcggcgcggacagtacgaaagatcccatgcgcaacggccttgagcggcgcagtaggcctaacttgcgagccctcagtcacccaaagtaagttacattctgactgtattatcgcctggagcgccgtccattcttggtcggtcgcggtggtcagcaaaggccggtccaattcgtcgagaacgagcaccgttgatttgggaggaagtcgtggaagcccagtgccggatgcattgtag

SEQ ID NO: 19332 - DNA, 564 bp, A.fumigatus
ttggtccagttcaacacccccaaggagatcttgttaccggatgttgccgtctggttccagcaacagggagtaacggtcctcttgtatgataatcgttgcattggtgccagtgatggcgaaccgcgcaatgatgtcaagccggccaagctggtggaggactttcacgatgctctgacctttatggctcgtcatcccatggtcgatgaggacaagatcattctctatggctactccttcagtgccatgacggcgcttgttgcggctggtctcgaccaccgtgttggagccgccatctcggtgaccccaattgccaactacgactttcgagagaaggaaaagaacaacgtcatggcgctggcaatgcaggatcgtgtctccactctcgcgggcaacgacccggtatacatcccgtttgtcggggatgacggctacaaccccgctggttggggcaatcagtacaacatggagcagttccgagcattcctggggacctcgttctttaccaaccggacgaccgtgcagagctactaccatgtgctggcgttgcagccgtacggagcgatg

SEQ ID NO: 19333 - DNA, 684 bp, A.fumigatus
ttgccggttgttacgttctcatcgagaccattctcgaaccattcaccccgttcccctccaccccagaaacagaagatgaccctcacatatggccataagcgcctccaggatgccccagagcctatcgcgatcgtttctgcagcgtgtcgattaccggggcatgtgaatggcccgcacaaactatgggaactccttcagtcgggaggcactgccgtttccaatgaggtgccccaatctcgatttagttccgagggccatttcgacgggtcaggccggccgggcaccatgaaagcgctgagcggcatgttcatcgaggatatcgatcctgccgcctttgatgcggcctttttcaacctcacccgggctgacgcgattgccatggacccccagcagcgtcagcttcttgaagtggtatacgagtgctttgaaaacggcggcataccgattgagaaagtgagggggaaacaaatcggctgctacgttggcagtctcaacggcggtaagagcctctggatgtcgcggtggtccgttgcagacataattcggattctcattgatgcagattaccacgacatgcagatgcgagacccggagcaaagggtgtcgggtcatgcagttggcacgggtcgagccatactgagtaacagaattagccacttcttcgacctaagaggatcgaggtga

SEQ ID NO: 19334 - DNA, 3717 bp, A.fumigatus
gcggagctggaagggaccatcaaagccgctggacactttgcccgaatgttgcgagtggaggtcgcgtaccactcgcctcacatggccaagatagccaaccgttacgaagagctgctgaaggagcacggaaggctggacgatggcagtaaaaccaataagagatcgaatcgtatgatctccaccgtgaccgaagatgaggttactggagctcaagtctgtgacgcggcatattggaaagcgaacatgctgtcgcccgttcgattcgacggcgcatgcaacaagctgttaacgaacacgcaactcgctcccaatttcctcatagaactggggcccagcaacacgctcgcaggaccagtcactcagattgccagagcagccaaggtggacaacctcacgtatgctgccgcgaataagcgtggccccgacgagagctcccgcgcaatcttcgacgttgcaggccacctgttcctgcagaatgccgacatctcacttgacaaggtgaacctcggcgacaatacaccagataaggcgaagcccgcggtgatcgttgatctgcccaactatcagtggaagcattctacccactactggcacgagagtctggccagcaaggattggagattcaagaagttcccgtcccatgacttgcttgggagcaaggttatcggcacgctgtggcagagcccgtcctggcacaagatgctgcgtctgtccgacgtgccctggctgcgggaccaccggattggatcagagatactctttcccgctgctggctatctggccatggccatggaagctgttcgccaagccgctttgtcgactgcaacagctgaagctcgagagctcctgaagacgagacactaccgctactgcctccgggatgtacaatttccgcgaggactggtgctcgaggatgatgccgaagttcatattatgcttttactggtacccatggcaaagctcgggcagggatggtgggaatataagatcacctctctggcggaatcggattcagtagcatcgtcatcatcgtcaaccttgtccccggagaagtggaacatcaactccaccggattggttcgactagagacaatcctagaggcatcatcgtctcgagcaccagagcacacctgcagcttgcctttggataacccgacacctggacagatgtggtacaagtctctcagggacgccggatactcttacggtccaagtttccagagactggtagccgtcgagagcacggagggaaagtcagccacgcgctctcttatctctttggaaccgccacgatccaagtgggagccgcagtcagaatacccactgcacccagctcctctggacagcgtcctccagagcatgttcccctcgcttcatcgcggaaatcgaactaaactagaccagctactcgtcccaagaggaatcggtgagctgaccgtctctggagacatctggaagtccggagaagcaatttctgtgaccacctggaacaaggtgtccggagacgcgtctttgtacgatcctgccagtcgatcgctaatcatgcagctcaacagcgtgtcgttctctcccatgctggatggtcgagacagtctttacatgtcccacgtctatactcaattgacgtggaagccagatttccaacttctggatactgatgagaagctccaacaggccctcagcggtggtgatggcgctgcgtcttcccttgtccaggatcttctcgacctcgccgctcacaaggcgcctaatttgagggttctcgagttcaatctcgttcccggaagctcggaatccctgtggcttgccggacatccaacaccgcgtgctgttcgcacggcccttactgaattccactttgctgccaacagcgctgatactgcgctcgccgcccaagaggaatatgcagagtggccggcggcacgaaccgcccgcttcagtgtgcttgatcctttcagcaaagcccttgctgtacccgcaggaagttcccagttcgatcttgtgataatcaggcggcctcagcatgcagacttgggcgagctcgacattctcgtcggcaacttgcgccgtctgacttccgacggcggcagtgtaatattctatgattccaaacagtccagtctgtcagggggtcgaggtttggcgaatgggcacaaccatttccccgctgcactgcaacgctttggtctcactaaggttcgccagacgagggatgggagctgcattgtggcagaggtcagcccagcacagaatctctctctccgcaatgatttcagagtcgttattgtgcggttctcaactgcgcggtccactattatcgatcacaccatttcgcagctgcgccaatttgggtggacctcgacggagatttgcatctacaatgcatccggcactgggcttccacgacttcctcccaaatcaacggtgctcgttctcgacgaattggaccggcctttgctgaccaccgcgaccgaccaagaatggacggcgctccaggcgataatacagtcagaatgtaacttactttgggtgactgagggctcgcaagttaggcctactgcgccgctcaaggccgttgcgcatgggatctttcgtactgtccgcgccgaggtacccatgatgcgcatagtgactctggacgtcgagtcagccacaactgagagtttgggcacaaacgcgtcggccatcaatatggctctgagagagataactttagcggacagatcgtccctccccattgagtgcgagattgcggaacgaggtggtctgttgcatgtcagccggatatggccggatgctggcgtgaataaacgcaaggtggaagacaacgcaggaggcgcaccacctgtgctaaccaatctgcatgattcaaagtctaccattcgcttgatggcaagcagacctggtagtttggaggcgctgcatttcgccgagcaaggtcgagatgtgtgcagtaggcaagatatgggaccggatgatgttgaggtcgagatcttcgccgctggttgcaactccagagacattgatgtggctatgggcgatatctctggggatttggatggactcggcttggaaggtgctggcgtggtcgtccgcgtaggcgcctgtgtcagcgctcgctgtgttggccagcgggtggcagtgtttggcaaaggctgctttgcgaaccgagtcaccgtctcatgcaaagccacctttcctttgcctgatgccatgtcgtttgagcaggctgcgacgctgccaatcgccttgctcaccgctttatacgccgttggtcgtctcgcacatgtacagggagatgatcgtgttttagtccattcaccttgtactgatgttgggatcgcttgcatccgactctgccagcgctcggggtcgactcccttcgcgacggtggacaacctggagcagcgccattttctgactcacgagcttggactaccggaagatcatatcttcatgtcggagcctgcagcatttcctcgcgctctccgccacgcaaccaagggccatgggcttgacgtgattatcagtcagcctgcaaatcgcaatctcgacaatgaaaacatgcggctacttgcccctggtggacgacttatcgggatagcaaacggaggcgccgatgttggaaatttgctgcccacgggatctctcgctcccaactgttctttccagaggttggatgtaacagctttaccggagaaaaccattgaatcgtaa

SEQ ID NO: 19335 - DNA, 372 bp, A.fumigatus
cctgtccagacccgacctgcaaccaccctggcacagagtatgattagccctagccactgttatctcttggtgggtggtttgaaagggatctgcggtagtcttgccatccatttagcctcccacggggccaagaacattgccgtcatgtcccgcagtggtggtggagaccaggtgtctcagggcatcgctcgaaacatcagagcactggggtgttctcttgacctgcttcaaggcgatgtcacttctatcagcgacgtcaggcgggcctttagccagatctcggttcctctgggtggaatcatccaaggagccgccgtattccgagtaagacagcactcccgaagccattctctgctattcatttcgttctga

SEQ ID NO: 19336 - DNA, 282 bp, A.fumigatus
ttcatgacaatggccggcccacgaattgtcccagggtacagccagcctcgcaatatcaacccatcacaggtcggaaactcgacatcctcgcggttcattgtcgagagctgtgttctctacagtagcatccaccaatatccaacaatgtgtttacaatgtgtacgaaaatgtggaacaagaccagccgctccgtcgtctcatatcaacatcatcctgtcatccgaacctagcctaatttcggtatggactcggcaaccgacctaccagacactcgagatgtag

SEQ ID NO: 19337 - DNA, 1503 bp, A.fumigatus
ctgagatcgactccatgcagtttcacaattgacacagcgtgctcgagcggccttgtgggagtagacgtcgcctgcaagaatctccgcgcgggaacactgaccggagcagtcgtggctggtgtcaatctgtggctatcaccagaacacaccgaagaaaggggcaccatgcgggcagcgtactcagcgagcggcaagtgtcacaccttcgatgctaaggctgacggatactgccgcgcggaggccgttaatgctgtgtacctgaagcgtctatcagatgctgtgagggacggcgatcctatccgcgcagtgattcggggaaccgcgagtaacagcgacgggtggacccccgggatcaacagccctagcgcccaagctcaagcggcgatgattcgcgaagcttatgcaaatgctggtatcgacagcagcgagtacgccgagacgggatacctcgagtgtcatggaacgggtaccccggcgggagaccctactgaagtcaaaggcgcggcgtcagtgcttgctcacatgcgcccaccggcgagccccttgatcatcggatcggtgaagagcaacattgggcactcggagccaggagcaggtctctctggcctcatcaaggcgatgctggtggtcgaggagggcgaaatccccggcaatcccacgtttctcaacccaaatccagccatcgatttcgataacctccgggtatatgccacccggataaggattccatggcccaaagaatcaagccactacagacgtgcaagcgtcaactcgtttggctttggaggctccaatgcacatgctgtactagacaatgcggagcactaccttgggaagtactgggcatccctcgagataccccgatctcacctcagctcatatatcaatctgtccgacatgctgtccttgtttgacggacggcgatcatccaaaacagtcactcggcggccccaagtactggttttctcggccaacgacatggattcgctcaaacgccagatatcgacgctttcagcccatctcctcaacccccgagtcaaagtcaagctttcagatctcagctatacactctcggagcggcgatcccgtcatttttgccgcgcattcctgctaagctaccccgcgaagagtggacatgccagtaagatcgccgtggaggaggctcagttttccaagatctcgcaagaggcaaccagaatcggctttgttttcaccggccaaggcgcgcagtggtcacaaatggggctggagctggtcagaacgttcccaggggtagtgaagcccattctggagcagctcgacaacgtgctacaggagctgccagcagacctcaagccagagtggtcgctgctgcaagagcttacggaagctcgctcgtctgagcatctgagcagggccgaaatctcgcaacctctcgtgaccgcgcttcagctggcacaactagcggtattgcagtccctgggtgtgcgggcagaagccgtgataggtcattctttcaggtga

SEQ ID NO: 19338 - DNA, 432 bp, A.fumigatus
ctagttgcaatctctgttcagcttttggcatgggctgttggtgattttgagtacgttgaagctatgactcaacgcaaatacagcggaaagagcataccagtccgtgtctacactacgaaagggctcaaagaacaggcacgctttgccttggaatgtgctcatcgcaccgtcgattatttctcggaagtattcgaaattgaatatcctttgcccaaggctgatcttcttgccgttcatgagtttgtaagtggtgcaacaatgcctcctgaaggtcctacttcaactgattatattgcctcaggccatgggtgccatggagaattggggtctggtcacgtatcgtacgaccgcagttctattcgaagagggaaaatccgacacccgctacaagaaccgcatagcatacgtcgtcgctcatggtgcgtttcttag

SEQ ID NO: 19339 - DNA, 351 bp, A.fumigatus
ctctttcaaaaggatccgtggatccgaaagattggctttcctgttctcaccgtggcagaagagccagggcaaatcagcattcgccagaacaggtttctttcaactggggacgccaagcctgaagaggacgagacgacatggtggattccgctaggcatcaaatcaggaccccggctggccgacgtaaatacacgcgctcttgtctcgaaatccgacactaatgccgggcgtcggtcaagattcattctacaaaatcaacaaagatctgtcaggcttctaccgcacgaattatcctgccgaccgtctagcgaagctgggccaatctttggacctgttaagtaccgaagataa

SEQ ID NO: 19340 - DNA, 939 bp, A.fumigatus
gagggaggaaaactacttgtcagtgccgagcatattttaagttttcgaactgctactcattatatttattccagggtttggtcacagatttcgtcttctgtcgcaaatctgcgctctgtcttttcgcagaatgactcagtagctgcgggattgaagaaattcacactcgcattggcatctcccgccgccgaaaagataggctgggaattcaaggccgacgaagattatctcactgtgcagcttcgtaagcttctaatcggcatggctgggtttgcgggtcatgaaaggtgggttccgatattgccagtttgtggggaaaggaagctcagctcactgttttctagcatcgttactgaagcgaaacagcgtttcgatctttgggcttcaggcaaggacaagagcgcagtgcacacgaacctgcgctcggcaatctttggtatcacgatagctgaaggtggacgcgacaaatatgattccgtcaaggaagagtatatcaagaccgactcggtcgatggcaaggagatttgcctcgccgcgcttgggcgtgtcacagatgctgatctcgtctacgactatctggactttgttttctctgacaaagtggcaatccaggatgtgcacaatggtgcagtggctttggctgctaactctaaagtccgccatcttctgtgggagtacatgaagagaaattgggatgccgttgaagcccgactttcggcgaacaacgtcgtcttcgagcgctttgtgcgaatgggtctgtcgaaattcgcagaccataacattggggcggatatcgcttccttcttcaaggacaaggatacaagtccctatgaccgcgccttggtgatcgttgctgattccatacgaacaaatgcaaactacaaagaaagggacgaaaggctggttttggagtggcttcagtctcatggttatgcttga

SEQ ID NO: 19341 - DNA, 216 bp, A.fumigatus
aaagacaactccaactcacttggatctgtggatagatacgactatctcttcaaactccttctcatcggagactctggcgtcggaaagtcttgcttgttgcttcgattcgccgatgatacgtatacagagagttatatctccaccatcggggtcgattttgtatgtacccgtcgcaaaggcataccgttgagcatacaggcaccttcgcagtactga

SEQ ID NO: 19342 - DNA, 279 bp, A.fumigatus
tgggacacagcaggtcaagaacgtttccggaccatcacatcgtcttattatcgtggcgcccatggcatctgtgttgtttacgacgtgactgacatggactctttcaacaacgtgaagcagtggcttcaggaaatcgatcgctacgcaacagaaggggtcaacaagctgctcgttggtaacaagagcgatatggaagacaagaaagtcgtggagtacaccgtagccaaggttcgcgtccaaccatgcctcagtccgtttagctttctcatcctaacatga

SEQ ID NO: 19343 - DNA, 495 bp, A.fumigatus
aatccactgacggcgatcgccaaatttcttactttaggtacggaatccgcgaaggcgtctaaaatcacgtatgacaaaaagtcagagcgagtgtcttttattttctctcaagaaatatcgccttcagacattgtgctatctattggcttcaccggcactatgaacaatgccatggctggtttctaccgctcaaagtacaaacctgccgtgcagcccacggctgatacacccaaagaaggtgacttctactacatgcttagtactcaatttgagtcctgtgacgcacgaagagccttcccttgctttgatgaaccaaatcttaagtccactttcgactttgagattgaggttcccaaaggccaaactgccttgagtaatatgccgatcaagtcagaacgagacggtagtaagcccgacctcaagtttgtgtcctttgaaaggaccccagtcatgagcacctatgtcagtacaaataccttagtccttatctgctaa

SEQ ID NO: 19344 - DNA, 267 bp, A.fumigatus
gtggtgcaacaatgcctcctgaaggtcctacttcaactgattatattgcctcaggccatgggtgccatggagaattggggtctggtcacgtatcgtacgaccgcagttctattcgaagagggaaaatccgacacccgctacaagaaccgcatagcatacgtcgtcgctcatggtgcgtttcttagtttgaggcataatgattgcgtgtggctattttctaagactgaaccgcagaattggcccaccagtggtttggcaatcttgtga

SEQ ID NO: 19345 - DNA, 270 bp, A.fumigatus
gctgaaggggtgcaacaagcgtttcagctcgattccttgcgcgcatctcaccccattgaagtccccgtaaggaacgctctagaagtagaccagatttttgaccatatcagctatctgaagggaagctcggtaattcgcatgctgagtgatcatcttggtcaagaaactttcctccgtggtgtggccgactacttgaagaagcatgcgtatggtaagtcaggcttgagggtccgtctgcagaagaaagctgctgagaacgatgtcaggtaa

SEQ ID NO: 19346 - DNA, 291 bp, A.fumigatus
atacacgcgctcttgtctcgaaatccgacactaatgccgggcgtcggtcaagattcattctacaaaatcaacaaagatctgtcaggcttctaccgcacgaattatcctgccgaccgtctagcgaagctgggccaatctttggacctgttaagtaccgaagataagattggcctcatcggtgatgctgctgctctcgctgtatccggagagggaactagtgctgcattattaactctactggaaggatttaagagggaggaaaactacttgtcagtgccgagcatattttaa

SEQ ID NO: 19347 - DNA, 195 bp, A.fumigatus
gaattcgccgatagtcttggaattcctttccttgaaacctcagccaagaatgcttccaatgttgagcaggctttcttgaccatggctcggcagatcaaggagcgcatgggacctgccactgttaacaacaagccgactgtgcaggtcggtcagggtcagggtgttcaatctggatccgcaggcggttgctgctaa

SEQ ID NO: 19348 - DNA, 201 bp, A.fumigatus
catcgtattgtacgagtacagtatttctgctactattgttatctaggtaccttaggtagacactttctgatcaagctttgtatggttgacactgatactatcatcgtaccttacttgactaacaatgcctctgagaatcacccatatccatctcttgacggctctgtacctgatcagctattgactgatctagtattctga

SEQ ID NO: 19349 - DNA, 357 bp, A.fumigatus
tcattgtcgccttatagacttctaagagatacaactccattgcaacgtggtataatccgacatctcatcttgattttggatttgtcccagtctatggccgagaaagatctaaggccgacgcgataccttctttccctgagatatgcacaagaattcgtgcgggaattttttgagcagaatcccatatcccagcttggtgtgcttggcttgagggatggtcttgcaatccgggtcagtgatatgagtggcaaccctacggagcacatcagtgctatacaagctctgagggatcatgaccccaagggccttcctagcttgcagaacgggcttgaaatggcgcgtggtgctttattgtga

SEQ ID NO: 19350 - DNA, 819 bp, A.fumigatus
cctggtgtcgatagtcatactcctagtcatggaacccgagaagtatttgtgatcttcggatctatcctttcctctgatccgggcgatatacatcagacgatcaccacgttgataaatgacaagatcagtgtcaggattgctggtttggccgctcaggtggctatctgtcgtgaactctgctctaggactaatgcaggcgacgacaccacatatggcgtggcgctcaacgagcaacacttccgtgaattaatgatggatgtaacgacaccccctgtgacatattcccaaaaaaaagccacgagctcccttttgatgatggggtttccgtctcgtactgtggagacgtgtccctctctgtgtgcgtgtcattctgaaccttcttgtggagggtacttatgttcacgatgcaatagcaaagtctgtgggctccctgctgaatgcccctcttgcggtcttacacttatactttcaacacatcttgcacgatcttatcatcacctgtttccgctcatgaactggattgaggttccatggcaacgtgcctcacggagtttgacatgctttgcctgcggcatatatttccctacggtacctcctaaagatcagtggcaagctacggagtcccaggcaaaagggatgagtgtcagcagtcgctatgagtgtacagtctgcaaaaatcacttctgtattgattgtgatctctttgctcatgaaattgtgcacaattgcccaggctgccaaagcgggattagtgggctagccattgctgaccggcctaggggtcagactggcacagaggaaatggacacctcaacataa

SEQ ID NO: 19351 - DNA, 228 bp, A.fumigatus
agtcgcagtgtatatcgacacagtagcaaaggatcctctcttaccgggataaaaatgatcaacagccaaccagccaacccaggttgcaaagccttcgttcagccaaagctcgttccaccagtccatagtcacaagattgccaaaccactggtgggccaattctgcggttcagtcttagaaaatagccacacgcaatcattatgcctcaaactaagaaacgcaccatga

SEQ ID NO: 19352 - DNA, 309 bp, A.fumigatus
ttgacccaatacccctatcatcatcacagacttacaaaccgacacagttactccagtcaactcttcgaggagaccatggctgattctgacgaagagtacgttggcgaagtttctgacgaagagaacgatgtcaacggtatccgatatgcccgggaaacggtgcctgcatcccgtcctaaacggagaaggcagcgccggggtgctgaatgggaggtttcgaggacttgggagaccttggttgagggtgctgatggcacaatcagctctactgttgaaggacttttagaagctgggaaaaggaagaggtaa

SEQ ID NO: 19353 - DNA, 198 bp, A.fumigatus
tggggtttccgtctcgtactgtggagacgtgtccctctctgtgtgcgtgtcattctgaaccttcttgtggagggtacttatgttcacgatgcaatagcaaagtctgtgggctccctgctgaatgcccctcttgcggtcttacacttatactttcaacacatcttgcacgatcttatcatcacctgtttccgctcatga

SEQ ID NO: 19354 - DNA, 411 bp, A.fumigatus
actgtaacggcaactgtcaatgctgccttctacagcttccagaacgctcgacgcattcgagagcccctgggaaccagggcgctatcgcaaaatcacctgtgtccaaaaatatcaatgccttcgtcttcatcatcgtcttcttctgggtctccagaatcggcttcgtcgcttgccattgattcgccatctgttgaatcgtcgctgtcatctccttcaccctcaacctccgaggttccctcggttgattctgttcctcggtcgaggaagccgtatttgtacttaatattcgttccccacaaacgaagattaccaccggcatggtcattactatattttccagcaagatcgccgaaaaaaggtagagtcgacttcgatctgttggattcgcggtctggaggcagtccgaaataa

SEQ ID NO: 19355 - DNA, 198 bp, A.fumigatus
gtccttccttccccgagaagcattgtacctctcagtcatcaattcgtggatcatacgtgctttttcctcattgctacattggaggtcccgaatagcgtggatcttctttctcaaaactcccattccgtcgtcctccggaagcaagaactggtcaccaatgtcatcaagattgtcatgactggcagaataatgatgtga

SEQ ID NO: 19356 - DNA, 363 bp, A.fumigatus
attagatataatgcaggacaccttgtagaggctgcgctcgcccaccgtctcctttacagaaacgacgacttgttgtcacctattctgaaatatgttgcgctacttgcagctacctttggaaacaaggaaggacaaaaggctggctatcctggtcatccagaaattgaactggcccttctgcgcctgtataaagtgacacaagaccctgagcaccttcgtctggcccgtttctttcttgaggagcgtggtaatccctctggcggaaaggaacggcggcattactacgacgtggaggctgaggtccgaggcgagcgtaagcatgaagtgcccgaagcctatccagccgcgagaagctattggtaa

SEQ ID NO: 19357 - DNA, 375 bp, A.fumigatus
aagcagacgtgtagtgtatgtttgcctatttcgatagaaaacacccatcgatgcatcgagcgctccactcaatgtgactgtccgatctgtggagattatatgtttacgtctcctgaaactgttgtcttcatgcgctgtggacatagtattcatcaaaaatgcctttctgagtactccaagagttcttaccgatgtcccatatgcagcaaaaccattgccaatatggaatcgactttccggaacctggatcgcacaatccagagtcagcccatgcccgcagaattcaaggatactagcgcactgattcactgcaatgattgtggtgcgaaatcagttgtccgatatcactggttaggtttgaaatgtgacatgtaa

SEQ ID NO: 19358 - DNA, 630 bp, A.fumigatus
atgataaccaggtgtgaatcatacaatactgcccagatccgcctgctacatggcgaagcctcggactctcttgatcgggccggtggagataacagggatgcgtctgcttctccgatgccatccacctttcacggtacggaagaagaagcctccatttcattgcctctggcccagttgcgggttgatacgagctctccctctggagcagattcgagtccacgatttattgcgtcgtcatctgcagagcaaaatggacgattctcctcgtacagcctgactcgaggtcgtgctgtctcaccagtcatcagtaattatttcggactgcctccagaccgcgaatccaacagatcgaagtcgactctaccttttttcggcgatcttgctggaaaatatagtaatgaccatgccggtggtaatcttcgtttgtggggaacgaatattaagtacaaatacggcttcctcgaccgaggaacagaatcaaccgagggaacctcggaggttgagggtgaaggagatgacagcgacgattcaacagatggcgaatcaatggcaagcgacgaagccgattctggagacccagaagaagacgatgatgaagacgaaggcattgatatttttggacacaggtga

SEQ ID NO: 19359 - DNA, 471 bp, A.fumigatus
gataaaacagtcctcgaatatagtgaccgctgctcaacaatgcctgatactgtattcaatatggaatatccgcaggaaagcttcagagccacgactttcgctccggactccttttgggcccagcgccgacaagttgttcgatcccagacactgcggcaccagctgcagatgctgaaggacactggacggtatgacgcattcaagttgaagtggcatccgagctactcggatccatgcacggtgtggccggtgccaaatcacctgttttgggattcagatgtggccaaatggatcgaaggtgcttgctattttctgatggattaccccgacgaagaaatagatgcggccatcagggagcttgtggaaatgatccagaacgctcagcagtcggacgggtatctcaatatccactacacggtagttgaacctgggaagaggtttactaaccttcgagacatgcatgaactgtaa

SEQ ID NO: 19360 - DNA, 354 bp, A.fumigatus
cctaggattgccaggtatcaacaagcccatgtcccaattgcccaacagcaaacgattgaggggcacgctgttcgtgccatgtacctcctaacctcagttgcggaccttgtgcgcatctgcgagccaagcagtgatgttgcgaacaagttcgttcccgctttgcatcgactctggtcgaacatgattgagaaaaaatcctatgtgactggcggtattggcgccatgaaacagtgggagggttttggtattgattatttcttaccccatggaacggacgagggtgggtgttatgcggaaacttgcgcagcaattggggtgatgatgctggctgaacggttactaaaggtatcgtag

SEQ ID NO: 19361 - DNA, 1314 bp, A.fumigatus
gtggaatttcaaacgattgcttccaacgtcagatgttgtctcgggcccttcatgagtgggctcatttcttctttactgatcgaaaccatcgttcggcaagcccgtcgtctctcaaatcagacagattctcatccaccttacgatgacgacctagccgattcgctaccaattacacaaagcagcagctcatcagcgacctacgacgggaatgaccacgccgaggtatcaagtaggaatggtgatcatgagacttcggcgaggggtactccttccgtaccttccccaccgccgccgtctgaactgagcagttggcgtcatgatatgtcaccaaaccagtctcgttctggaacagcaattgtatcaccccagagccttcgtggcctgtatgagaacgaacatgttgatggtgtccgaacgtacactgcacctgaagtaacgggagctgactctccgtctgtctccctgcgaaatatggtcctcgagacaaatccaagtgcgcaagagtcacatcattattctgccagtcatgacaatcttgatgacattggtgaccagttcttgcttccggaggacgacggaatgggagttttgagaaagaagatccacgctattcgggacctccaatgtagcaatgaggaaaaagcacgtatgatccacgaattgatgactgagaggtacaatgcttctcggggaaggaaggacttaataccgacatcaccgaggacactgtcatcatctagtcctcaactatccgagcgatctgtgactccgatttctcgctgcggcagcctgtcctccgaccatgcgcccaccaatccagcttcaagagctccgaccagccaccaaattgaggacacatacaaattaaccgcggaagacctgaaacccaccttttttcctaagtccgaatcggactcgcccgtgtgcgattttgaggatgcggatgctgaggacgtcgaggtggcctgcttaggctgtcgacattatagaaggaacgtcaaactacaatgctttgcttgcaaaaaatggtatacttgtcgcttctgccacgatgaggtagaagatcatcacctcgatcgaccgaagacggagaacatgctgtgcatgctttgtggacatgctcagcctgccgcagcagtctgtcggcaatgcggtaaacttgctgcgcaatactattgcaacatctgcaaactctgggataacgattcgaacaaaagtatttaccattgcaatgattgtggtatctgccgtatcggtcagggtcttggaaaggatttctttcactgcagggtaagaaagcctcggatagactaa

SEQ ID NO: 19362 - DNA, 318 bp, A.fumigatus
ggtttgtcgcacccaccaccggcgggagcgcaggctaagcgaaaatttccctcagcacatcgtgagctcgagactcgatcttcaactccgaaaacgacgacaacgaccagctcaccgtcgacaacaatggcgtcccgccctaccgtcactatcgccacggctgatggcaagcccagcggggctactctgcccttgcctgctgtcttcactgcgcccatccgtcctgatattgttcagtatgcctaccgcaatccagaaattccagggagaagagaggcgcgagaaaggggaatggaggagagaacatcatcgggctga

SEQ ID NO: 19363 - DNA, 183 bp, A.fumigatus
ctctgtgattgtaggcaggttcacaccggtatggcgaagaacaagagacagccttatgccgtgagcgagaaggctggtgaacagacttccgccgagtcctggggtaccggtatgttgaatttgcttgattggggggagggggagcgattgggatgggaggttttcacaaaatacttatactaa

SEQ ID NO: 19364 - DNA, 1287 bp, A.fumigatus
aagtccgacaaccgacactcccttgtcaaaatgatgttctccaaatctggtctcgtggctgttgccatgctcggtgcctctgcagtcgaagctcatatgaagatgaggcaacccactccctacagcgactcgagtctcaacaattcccctctcgctgctgacggaagtgacttcccgtgcaagctccgggacaacgccttcgtgcctccttcgcaggagaccatcgctcagatcggtgaggttatgcctttgaccttcaccggcagcgccacgcacggcggtggttcttgccaggtcagtttgaccaccgacctcaagccttccaaggactccaagtggatggttatcaagtctattgaaggtggatgtcccgccaacgtggacggcaatatgtcgggtggtgctgacgtcccggatccgttcgaattcaactacaccatccctgctggcattgagcctggcaaatatactctggcttggacctggttcaaccgcatcggcaatcgtgaaatgtacatgaactgtgctcccatcacggtcaccgccggctccagcaagcgtgatgcagcccctgtcgctgagaaagtcgaggttgagaagcgctccgccaacttccccgccatgttcgtcgccaacatcaacggttgcactaccaaagagggcgttgacattcgcttccccgacccgggagatgttgtcgaacacgacggaaacccgagcaacctccagcccgctggtgaagctgcatgctctggtactcccgcgtggaccgtcagcggcggctctggctctccgtccaccccttcaacctcttcttccacccctgctggtaccagtgccggcgtcagcgtcagcgtcggcgcaactgtcggtgctactcccaccgctgagcctgaatccagcagcagcgagcctgccgagtctgaaggtgctcccggagtcttcgctcccacttcggctactgtcttcccttcgacgcctacggcgtccgcagcacccacgtcttcctcttccggtgctggctccgagtccgattcctcttcctcaagcaacggagctttaactggcccttgcagcaccgagggtctctggaactgcatcgatggctcttctttccagcgctgcgccaatggtcaatggaccacggcccagcagatggcggctggtactgagtgcactgtcggccagaacgcgcaattcaccatctcagccacagctgtgaagcctcgcatgatcaacgccatgcgccacaggaagcgcgctcacggtggccaccgccacgcttaa

SEQ ID NO: 19365 - DNA, 780 bp, A.fumigatus
cgtcaaatctacaggcgcttcgctaccgcctccgcccttgctgcttcttccgttccttctctcctgtttgctcgcggtcaccgcattgccaacgttcctgaggttcctctagtcgttgagtccaagaccttcgagaatgccgccattaccaagaccaaggccgccattgccctgctcaaggctctcggtgccggcgccgacctcgtcaaggtccagaagtccaagaagatgcgcgccggtaagggtaagctgaggaatcgccgcttccgccagcgccgtggtcccctcgtcgtttacaaccccgaggttgacggcaaggagcttgtccgtgcttttcgcaacattcccggtgttgagacctcttccgtcttctccctgaacctcctccagctcgcccccggtggccacctcggtcgcttcatcgtctggacctccgccgccttcgaggcccttgaccaggtctacggcagcaccaccacccccgctgctctcaagaaggactacgtcctgccccagaacctcgttgccaacgccgatctggcccgcctgatcaactcctctgaaatccagtccgtgctgcgcgctcccaagggcgaggctcgcaccaagcgtgccgttgtgcagaagaagaaccctctgcgcaacaagcaggtcatgctccgcctcaacccttacgccgctgctttctccaaggagaagctgggccagaagcctgttgagtctaaggagaagcctgctcgtcccgcccaggagttcattaacaccctccgcgaggagtaa

SEQ ID NO: 19366 - DNA, 543 bp, A.fumigatus
actgtgctcccatcacggtcaccgccggctccagcaagcgtgatgcagcccctgtcgctgagaaagtcgaggttgagaagcgctccgccaacttccccgccatgttcgtcgccaacatcaacggttgcactaccaaagagggcgttgacattcgcttccccgacccgggagatgttgtcgaacacgacggaaacccgagcaacctccagcccgctggtgaagctgcatgctctggtactcccgcgtggaccgtcagcggcggctctggctctccgtccaccccttcaacctcttcttccacccctgctggtaccagtgccggcgtcagcgtcagcgtcggcgcaactgtcggtgctactcccaccgctgagcctgaatccagcagcagcgagcctgccgagtctgaaggtgctcccggagtcttcgctcccacttcggctactgtcttcccttcgacgcctacggcgtccgcagcacccacgtcttcctcttccggtgctggctccgagtccgattcctcttcctcaagcaacggagctttaa

SEQ ID NO: 19367 - DNA, 279 bp, A.fumigatus
ttggggggagggggagcgattgggatgggaggttttcacaaaatacttatactaagtgcaggtcgtgccgtcgctcgtatcccccgtgtctctggtggtggtactcaccgtgctggtcaggctgcgttcggtaaccagtgccgttccggtcgtatgttcgctcccaccaaggtctggagaaagtggcaccagaaggtcaacctgggacagaagtatgcaattctttctacgagtcgagcggttggagaaaagacgctcgacggagatagttgggagtga

SEQ ID NO: 19368 - DNA, 501 bp, A.fumigatus
cagatgccttttttgacttcctctaatatgtttcaatactttacaggacacactgctactctttatcaaggcgacaaactcatcgtcttcgggggagaaaacgaacatcgcgagtacctctctgatatcgtcatcctcgatattcccacttcgacctggactcaaccggaaattcgtggacaaatcccgcggggaagggctcgtcatgctgctgtcattcatgacgagaagcttttcattataggtggtgttactggagagaacaatgtgattctcgatgacctatgctacctcgacctgaaaacatggacctggtcccggagttggagattcacagctcgtttcgaccacactgcctgggtttggggggaccgtctttggatattcggaggccttgacccggatatggaacgcacaacagatatttggtggcttgatctcaagggctcgccgtttcttggaactccgtcttcacaaggtaccgtggattccctggaataa

SEQ ID NO: 19369 - DNA, 1134 bp, A.fumigatus
  unsure (137): Identity of nucleotide sequences at the above locations are unknown.
tctcaagggctcgccgtttcttggaactccgtcttcacaaggtaccgtggattccctggaataatcaacagaatgactcatagtccagacccggtatatagtattccaacccagcagctgcctggccggtccggtanctacgcggcgaattctgggagtgtacaagttcgcaactccggtcgaaagaagcccattgccccaggagctatctcttgtcataagttccgatccggtccttatgtacctgccttgtttgctggaacccacttccaggctcacgcatctggtgttctcctccgactgatcactccttccgaaacagtccggacgtatgagtgcaagttatcggctttggagcttgacactcttcgttggcagaaactagctgatgggcaagagattttcaagcccgggtaccgctggcattattgtacagtcgacgctagtggcaccaaagcctggctgctgggatgcagccttgacgttggcgccgctcctggcaacagtgatgagaatcatatgagcgaagttctttgcattgacctggagaaatacgggttgcttggcaatgaactggcgaccctgtctcctgatcaaagcagggctttggtatcagaaaggtcaggactgccgcccatttctgggcttggtgccgatctctccgctgtcttcgaccaacctccagaatccggcagtgatgctgactttatcatcaccgcaaatcctgatgacatcgaatctccggacgatgtggcagaggacgttgctccaacagagtctcggccggcgttcctgcccgcgaatgctcctacctcgcctcctattcacgtacatcgcatcatcctgcagctccgatggccgcatttcaagcgactgtattctgcgcaaatggcggagtatcactctaagagaatgcacattcctgaaccatactctgtcgtccgtgctttcctctactatctttacacagacagcatatcagggcaccctgaatattgctccagcatcatcgatgttgcaggtatgctcgtcatggccaacctgtatgacatgccaaagctgcgcctgctcttgcgtaaattttccccgccctttttgggaaaaaaccccccgggcccgcgaaaaaaaattttt

SEQ ID NO: 19370 - DNA, 1893 bp, A.fumigatus
tataccattcgttgggttttgcacattacaaacatggctaccccgttgatatcgactccggtgaagtcccatcacggactgttttcatccaagaccgctggcggtcgcatgcctctcacaccatctcctcacgcaagaagagcgagtgtggcatcgaatcattcatctcccttcacgcctcctcgtcaatcggcagatgctacgaaagacaacggtcgcttggtctacggcggcaatctctcctcatattttgctaaatcggtcgcgaagacatcaaaaacttaccgagaatctcccaaatcaaacattgcgaggacgcgcaagtcaccaaggcatcttgagcttggtgtctcggactggtctttaaccggcacaggcccttcctcagggcagtctccgtcatcaagagaacgagcccggaaagaagtttctgctcgcacaaggtcgggcaagacaaccgttcgcatcccccacaatgctggtgacagattcattcccaacaggtccgcaagcgaaggactgacaacaactggaactgccaaacccgaggagaaccagcggcctaagtcgggcagcagtgaaggatccgccgttcttgcaagtgctgcgagcgccttcgacatcggaggccgaggagtagatgatgatctgactgctgctcttgaaaacctcggtcttgaggacaatgacaactcaacgacgtcgtacaccaagccagcgcccgatgccgtcgcctacgaatcgtcgctcgctgacgcctgcggcgtcaatttgaacactcgcatcctcgccttcaagccattgcctccagaatcgtcaaagccaattgacttgagagcacagtacaatcgtccattaaaatcgagcaaagccaaaggttctcaattccgccgcagagttcagaccgctcctgagcgtgtattggacgcccctggtcttcttgatgattactatctcaatctgctggactggagctctggaaaccaggtcgctattggtcttgagcgcaatgtctatgtgtggtcggcggattctggatctgtcaattgcctgctagagacttctcctgatacatatgtcagtagtgtcaaatggagcggcgatggcgcatatgttggagtgggtcttggcacgggagaggtgcagatctgggacgtggaggaaggcaccaagcttcgaagcatgtttggccatgactcccgtgttggtgtgatgggctggtccaagcacacattgtcgaccggtgcgcgcagcggtctcgtcttcaaccacgatgttcgcatcgctcaacacaaggtcgcagagctcgtctcccatacgtcagaagtctgtggtctggaatggcgacccgatggcgctcaactcgccacgggcggtaatgacaaccttgtcaacatctgggacgcgcggtctctgagtgctcccaagtttaccaagacaaaccaccgcgcggctgtgaaagctttgagttggtgcccttggcagttgaacctgctcgcgacgggtggcggttcgtatgaccgtcacatccacttctggaataccaccaccggtgcccggaccaacagtatcgatactggctcacaggtcaccagcttgagatggagcaaccactaccgggagattgtcagctcaagcggatttcctgacaattctctgagtatctggagctatcccaccctggtccgtaacgtagagattccggctcatgagacacgagttcttcacagctgcctgagccccgacggtcaattgctggccactgccgctgctgatgagagtttgaaattctggaagatcttcgagcgcaagcctggtaccagtgcttcggcgtcccgggaaggtggcgttggaagcaaagctcagatgaccaagtctatgaccattcggtag

SEQ ID NO: 19371 - DNA, 450 bp, A.fumigatus
aactatatcccattacagagctggcagaaaaaactctcgtcgcttggtgtcgcccatttcccttgggatcctgcgccaccacagcccgcccctcctcagactcaaaaccaaatactccctcctactgctcctgtgccttcaaacgctcctcgacctgctcctccacaacagacacagcaacaacatgttccgccccaacaacatcttccccaatccctaccggggacgatacctccgatgcaagcgcctgcgcccgcgcacatggggcagcaatctcacatcaagagcgaaccgggcctcaatgggcaaccgggaatgcctcacatgagcaacatgatgtcggctccttcctcaaatcctcagtcggcacgcgaacgtgctgccaatatgcttcatcagagatacggtgccgcagcaggtcttcaccacggggctggaaggacccgcgct

SEQ ID NO: 19372 - DNA, 231 bp, A.fumigatus
taccaaagccctgctttgatcaggagacagggtcgccagttcattgccaagcaacccgtatttctccaggtcaatgcaaagaacttcgctcatatgattctcatcactgttgccaggagcggcgccaacgtcaaggctgcatcccagcagccaggctttggtgccactagcgtcgactgtacaataatgccagcggtacccgggcttgaaaatctcttgcccatcagctag

SEQ ID NO: 19373 - DNA, 489 bp, A.fumigatus
tgctgtttccctcattaccctctccgtgacattttactgaaactatatcccattacagagctggcagaaaaaactctcgtcgcttggtgtcgcccatttcccttgggatcctgcgccaccacagcccgcccctcctcagactcaaaaccaaatactccctcctactgctcctgtgccttcaaacgctcctcgacctgctcctccacaacagacacagcaacaacatgttccgccccaacaacatcttccccaatccctaccggggacgatacctccgatgcaagcgcctgcgcccgcgcacatggggcagcaatctcacatcaagagcgaaccgggcctcaatgggcaaccgggaatgcctcacatgagcaacatgatgtcggctccttcctcaaatcctcagtcggcacgcgaacgtgctgccaatatgcttcatcagagatacggtgccgcagcaggtcttcaccacggggctggaaggacccgcgc

SEQ ID NO: 19374 - DNA, 717 bp, A.fumigatus
tccggctattgtcgattctcttggccattgagggcgaacactgaattactctgggccaactctcttctatcccctacatatcctcagatcaccatgagatctacgtttcgattgctggccaacgtcaagtcggcccggtacttggagccctttgctcctaccggcttgaccggccttgtcacccaccccagccctcgtcccaccctaatccacctctacaggaccaccttggagaacttgaagaggttcccagagtcctccgtctaccggcaatccaccgaagcactgacacgccaccgtctgcagatcgttgagtccgttaagcccccaggttatgatgcttggctagagcgcgtgaagaaggctgtcagtgccgaacccgagcgcttcgcttctctccggctcgccgatggaacttatgcgggatttatgcgcaatgatggaaccgacaatccccgtggtgaagagtgggatggtgaagccttggagccaaccacggagggacctgctcgtacggcagaagaagaagcacggtggcacaaagccattgaagaagcgactgccacaacacaggcgaaagattcagactttgctaccgaacaaatgaagtgggagaatgagccagccctcgaggcagaacagtacgtcgacctacgcccttattctgcggtcactagcagggcaactgaccatagatcgcaggattgccgagattga

SEQ ID NO: 19375 - DNA, 204 bp, A.fumigatus
agtgggagaatgagccagccctcgaggcagaacagtacgtcgacctacgcccttattctgcggtcactagcagggcaactgaccatagatcgcaggattgccgagattgagaagcagattggtgctggtctgattgaagaggtcatccaggtcgccgaaaatgagctgaaacttgtcgacgaaatgtacaagtctaaagtgtaa

SEQ ID NO: 19376 - DNA, 1299 bp, A.fumigatus
ccgatattcttccccaagtcaatcatcaaaacttttgaactcaccgacgtccccgtacgagcgggacgattcattgcccgcaagaactggatcgtctgtggctccgatgatttccaactccgcgtctacaactacaatacgtctgagaagatcgcatcgttcgaagctcacccggactatattcgatcgatcgctgttcaccccacccaaccatttgttctcaccgcctccgatgacatgacgattaaactctgggactgggagaaaggctggaagtgtgttcaagtttatgaaggtcacagtcactatgtgatgggcctggccattaatccgaaggacacgaacacatttgcttctgcatgcttagatcgtactgtcaagatctggagcctaggctctccccatgctaacttcactctggaagctcacgagaccaagggtgtgaaccacgttgattactacccacaagccgacaagccataccttctcacaacttctgatgacagaactgtcaaagtctgggactacacgaccaaggcactcattgcgaccttggaaggccacacgagcaatgtctcattcgcctgttaccaccctgaattgccggttatcatctccggatctgaggacggcaccatcaagctatggcacgcaaacacatacagactggagcaatcattgagctacggtctggagagagcgtggtgtgttgcgtatcaacgtggccgacaaggtattgccatgggtttcgatgacggtgcggtggtcgtgaagatggggcgagaagagcctgctgtctcgatggacgggtctggcaagattgtttgggcaagacataacgaagtcgtatcgacagttatcaagggtggtgactccagcattaaagatggaacaccgctttccctacccacgaaggaattgggctcgtgcgaaatctatcctcagacactatcccactctcctaatgggagatttgtttcagtttgcggggatggagagtacatcatctatactgctcttgcctggagaaataaggctttcggtcaggctttagacttcgcctggggctcaaaggacaacagcaacgactatgccattcgagagtcaccgacgagtgtcaagatcttcaagaatttcaaggaagtaacaggtggtctcgatgtgggcttccaggccgaagggctcacgggcggcgtgcttctgggtgtgaagggacagggaggaattggcatgttcgactgggagacagggaatcttgttcgtcgcatcgaagtcgagcccaaagctgtaagtctgtga

SEQ ID NO: 19377 - DNA, 267 bp, A.fumigatus
aagagaagcctcgcccgggccagtgggtctatttcgatcgtgtccccccttcttcgccttaatagacttctgacgtcgcatattatgtgttcgaatgaaaattacttgtatttattagccaacgtggccctacatttgaatgggcacccattcgagacaattacattccgtttctatgaatttgaggatccactattggttatagttgcgccgcatgggtcctacacgctggctcctgcctgtggaacgagcctgtatatggagtga

SEQ ID NO: 19378 - DNA, 1218 bp, A.fumigatus
gtctgtgattggaagttctgttataatatcgcattgtcttaccaaagttcacaggtctactggtctgagtccggagagctggtcactcttgcgtgtgaggacaccttctacgttctgcgattttcaaaggagaactacatcaatgggctgaatgctggtgaagccgatgaagacggagttgagtctgcttttgaggttgtcaccgacgtcaatgaatctgtcaggacaggccaatgggttggagactgcttcatttacaccaactcgacaaatcgcctcaattaccttgtcggtgaccagacctacactatctctcattttgaccagggcatgtatgtcttgggttatctgccgcgcgacggtcgtatctaccttgccgacaaggatgtcaatattgtttccttcggcctgtcgctgagcatggttgagtaccagacagtggtgctgcgtggcgacatggatatggccgcggagctgctcaaggatgttcctcgggaccagatgaacaaggttgcacgcttccttgagggtcaaggctataaagaaatggccctagaggtggccaccgatccagagcaccgcttcgagcttgccctgtcgctgaacaacctcgatactgctctcgagattgcccgtgaagccaacgtggagcacaaatggaagatcgttggcgatgccgccatggcagcatggaaccttgctttggccgaggagtgtttcacgaatgccaaggatcttgggtcgctgctccttctgcacactgctagcggcaaccgcgctggtctccgccagctggccgagcaagcttcggaagctggtctccaaaacgttgctttctctagcctgtggtcactcggcgatgtcgacggctgtatcgatctcctggtgcggaccaaccgcctcgcggaagccgttctgttcgcacagacctacaaaccgtcccgtgctcctaagctcgttgttcagtggaaggcttcgctggagcaatctggaaaatcgaaggtcgctcgccttatcggcgttccccccggtgctcctgatgccgtagcgacagacgacgatctgttcccagagtgggacgagtacctgcgcttggagaaggaaggcgtcgtccctgaaccaccatcgtccgagtctctgatcgacatcaacgcagacgacgaggcagtcaccaggagtgcagagaacggaactgcggaggtgcaaacggaggcctag

SEQ ID NO: 19379 - DNA, 1650 bp, A.fumigatus
acatctaaaccgatatcttcctcttccgagccgtctgatactcaatcccttaactccttccaaaatttctacaactttcacttcgcttcgatgaactgtcttgcattttcggatttctgcaagaggctggatgtcaaatggtttccgacattttccctttaccataatggcaaattgattgaacagttcgagggtgcgaagaccatggaaggtctaagtgagttcattgaaggcaagctagaatcaatccgacctggttctcgtcctccgaagggcgtaaagcttcccaaaccgggcgacaaacaggtagacacggaagctgcgccggacgttccagccgccaaggacaaggaccgtgtggcgggagtcaaggctggtgagaagcataatgaacaagtcgctcagctcgccagcgcagaggctccggtgaaatctgctacccctaaggtgaactcgaaaccatccgcgcctgcgaaccctcaaggtatctccgttcctcttacagcagagagctttcaaaagctggtcacaactaccagagatccctggttcgtcaagttctatgctccgtggtgccatcactgccaagcactggcgcctgtttggcagggaatggcccgggagatgcagcatgtcctcaacgttggagaggtgaattgcgatgcagagcccaggctttgcaaggacgctcgggtgaacgcctacccgacaatgtacttcttccgtggtggcgaacgcgttgaatacaccggtttacgcggtcttggcgatttggtcaactacgcaaagaaggctgtagacattggatctggtgttcaagatgtcgacgcagctcaattcaagcagctggaagaaaaggaagaagtgatatttctgtacttttacgaccacgcaacgacatctgaagattttgaggccttggaacgtttgactctcagcctggtgggtcacgccagattggtcaagacaagcagtgcggctctcgccgagcggttcaagatcacaacctggcctcgtctcttagtctcccgagatggacgtcccagttactataatgctctggctcccaaggatatgcgggacgtccgccagattctgaactggatgcgctctgtttggctgcctattgtccctgaactcacggtctctaacgcccgcgagatcatggacgggaaatatgttgttcttgggattctgagcaggcgtcgctcggatgatttcatccttgccaagagagaattaaagagcgccgctctggagtggatggacaaacaaacccagttgttccgattggagaggcaagaacttagggatgctaagcagctacgtatcgaggaggcagaagaccgcaatgaccaacgtgccttgcgggctgctaagaacatgcgcatttccatccgggaagatgacaagaagcaagttggatttgcctgggttgatggcgagttctgggaacggtggctgaggaccacttttggtatcgatatcgagaacggagaacgggtcatcattaacgaccaggatgtaagtatcattcaagaactactgtgtttgccattgctgaccacatctccacagaatcgacgctactgggacgccacttctcagtggagctccgatttactacacgacgggactggaaggagacgc

SEQ ID NO: 19380 - DNA, 549 bp, A.fumigatus
acgcctgccagtatgaggtcctctttgctggcgtggtcgttcctttcgcttctctctatcccaacttttgccattccttccggcggcatcgcgaatgatcttaatcttgcgaacaatcgcctcgtcaaaagagcggaaccggttgaaaagactgagtcggagccggtgtcgacaacattcaatggcgtcgaagtgccgcccctgaaagagttgacaccagagaactttgaggagcttaccaaaaacggttactggtttgtggctactgtacccgtagcattcaccgttgatatagtattattaacaggaaacaggtttgtgaagcactattctccgtcatgtccccattgcaaggcgatcgctcccacatggcagactctatacgaatactactatgtgagtgctcaatccacgttcggcatgttcgtactgggtcactgtctaacatgtgctagacatctaaaccgatatcttcctcttccgagccgtctgatactcaatcccttaactccttccaaaatttctacaactttcacttcgcttcgatga

SEQ ID NO: 19381 - DNA, 192 bp, A.fumigatus
actatcccattatttaggtattattattattattacttggtaccagtctctgacaaaatactcccaactcttatgagtagctataacgggttccacaccaggttcctagatgctttaatcaaagccttctctagcggtcaaacctctcagaacgtccgagcccgggtttttggtttggatgactgggtttaa

SEQ ID NO: 19382 - DNA, 261 bp, A.fumigatus
  unsure (178),(197): Identity of nucleotide sequences at the above locations are unknown.
aaaagtacttgggaaatcgtctgtcttgcttgccgattcttttgtgcaccaatatattatgatgaatctgaaggacgatctaagctacctaagcgagtcggtgacaatcagatcccggtattctatggactactgagtctgctgtttgctgcgttccagtggagcattgaggctaaanataagcgaggaaagcgatntaaaacgccaatagtcagggagtactcatcaaactctgtatcctacaatcaggatcaactatga

SEQ ID NO: 19383 - DNA, 216 bp, A.fumigatus
tttaaaattgattttgaccgtgacatcaacgagaggcacctattcatttcccttcatttcgctaccgagggatcaggtaaaaaagtacttgggaaatcgtctgtcttgcttgccgattcttttgtgcaccaatatattatgatgaatctgaaggacgatctaagctacctaagcgagtcggtgacaatcagatcccggtattctatggactactga

SEQ ID NO: 19384 - DNA, 1293 bp, A.fumigatus
ctcagctctccaccgcccgtttctgccactgcacccctcaccgcctctccgctcctccaatatcgagctatctttgcttcatttctagatctcatcatctacaggagttacgagatcatttgtttagagcccattctgtgttccattgcttcagcaatcactactcctgtaccaatcagatataccggcgtcctacaacaaatctatccatcatgcaggctgcacagcagtcctggggttcgtactcaaatgacccacttggcatcgctttccgatgagctactgacaccgcggctttctgcccctccctcagagctcgaaaacaccatcagcctcatcgatcctcaacgggatgcgctctatcgatacgatgaagaaacacacaaggccctgagcgctgcccggccatgggccaaagacccccactacttcaagtcgatacgcatctccgccgtagcattaatcaaaatgaccatgcatgctcgctcaggcggctccctcgaggttatgggtctgatgcaagggtacatccttcctgagacgtttgtcgtaacagatgccttccgcctccccgtcgaaggcaccgagacccgcgtcaacgcccaggaagaagcgaacgagtacatggtgtcgtatctccaatcctgccgcgatgcgggccgcatggagaacgcagtggggtggtatcacagtcatcccgggtatggatgctggctgtccgggatcgatgttacgacgcaagatatgcagcagctcggcgggccgttcgttgctgtcgtcattgacccggaacgcaccatctccgtcggcaaggttgacattggggccttccgcactttccccaaggattatacccctccaaaagaaggaaatgaggatgaagattaccagactattcccctcagcaaggcggaggatttcggcgcatacgcgcaccagtattactcgcttgaggtgtcattcttcaagagcagtctcgacacggaacttctgtcgcagctctggaacaaatactgggtggctacgctgagtcaaagtcccctgttcacaactcgggattacggcagtaggcagatgatggatctcagtcagaaagtccggcgggctgcgcggggaattgaatccagcgggtcacgaggtggtgccactacacctaaagatcagcagctggagaagatagtacgggacggacagcggattgtctctgaggaggtaaaaggtctcttggcagctgaggttaagatgaagctcttccagggaatcggggaggggacgcaaacgggtgcctcatga

SEQ ID NO: 19385 - DNA, 216 bp, A.fumigatus
agagctacacgttttgatcaattaacatccaccattcaagacaacaagcgcaggaatgagacaccatacctccgcctctcgtgtttcgcgctcatggctcggaactccaatatcatcaaatatggcatgcagctgcgtaacgatagtgttgacctgagtggtcaagtaactcgtgtcgaccgtcatcgggatcatgagccccaggtatggggttga

SEQ ID NO: 19386 - DNA, 2733 bp, A.fumigatus
cgtcgcgcggatccatcggcccccgtggtgccagacgaatatgaggaagagcatgggcacgagcacgatgaagatgaggtcgactccgctggaaacccgcgcgattcgcaaccactactccctatcgaaggcgtagcagcccccaaggagcaggaagaagccgccttctggatcccacaagcaaccccggatggccgtttattctacttcaacactctcacaggctacagcaccatggaattgccgtttgagaatccgtctgcgaacgaaagcggacccttcgaccgaaacaactttttcgtgccggatcagactcgaccaccacccgaattgatggctcgcggtttcgagcgcgacgaggatgattatgatggctcggcatctgaggcggagggagagtctctaatgctggcctcccacgattccatgtctcgtcgtcgtcgctcatatatcgatggtgtatctcctgctacctccttggactcattgcatcctccatcggccaccaaatcgatcaatgaaggcaagatctcgcaccaatccagtcgggatctgcagaagacaaccaccgccggtagcaatgcgtccgcggccattcactttcacagaccgtccgtctcttctcaagctccttcccgcttcgtcgatgacggcctcacggctcctgtcacttggccgatgctcgttgacaatatgcgtcacgctatcgaagtgtatcggcagacgctgctgaatggagatcgctccgagtatgtgaggaaggcggaagacatatcagatcacctccgcatgcttcttgctgctggctcggacaccacagacaatcactctgggaacccgtcgattatttcgcagaacaagccactctatccccacttcagagaaatgatgtctaaattctcgaaactcgtcctctcgtcccacgttgcagctgccgattggccagggccggattccgtcaacaagtgcttgcatgaggcggatggcgttatgcaaggagtctacggctatgtcgaagttgcaagacaacagcggggtgaaaacattcggcggatcgttcctggattcgtcgtcggaagctcttcgggaggcggctggcaaaacaatggtgtatctttagatgattcgggcccgacatcttttctggaccaggatggcgctgatcctcgcgtcgaaccatcggtgcctatggactcctccctcctggaccatatcgacattctcagaaggtcatttgttgggactattcggcgactagaggagcgattgacactcaaccagaagaagattgttacttacgcggaacaacgcgaaattagtgattcagttgtggcagctgcaatcaaggtcgtggaacaatttcgaccttggatttctgctgttgaatccatcaatctcgcgccactaggaacaagtttccagaaccctcagttggtcgatttcagtctacagaagcagcgagcctacgatgccatcgcagattttgtcattagctgccaggccgtttccgcgcccctcggcgatgagtgggcagagcttcgcggagattctcttgaagaccgtctgaatgccgtgagaagtatcgccaggcagcttgagaactttgtctctcagattggtttctccctgtcgcttcttctcgaacagattcccgagccctctaccacctttaggagtgaaagtcgtctggagggcgacaaggaagcttacaagggcatccatagtcgcggtgattccctggcaagaatcccaacagagacgattggaataccatcctcgtattccgttgatctgccatctgaaaaagttcgtcgcaacatggataaggctcagaggttcttcggccaagctccaccagtcgctatcactcgggaacctattcgggagcctgtccgggaaccggaggagacgccttggttcttgaagatggatcacgaaggggaagtgttttacgataccaaggctgatgtgcccaccttgaaatgtggaacattggctggtttggtggagcacttgactcgccatgataaactggacgcctcattcaataacactttcctcctcacatatcgatccttcacgactgcgtcggagctcttcgaaatgctcgccgagcgcttcaacatccagcctccatttggactgaatccagatgaaatgcagatgtggatagacaggaagcaaaagcctatccgattccgagtcgttaatatcctcaaaagctggtttgagcatttctggatggagccgaatgatgaggcgcatatgaatcttttggctcgcgttcacgcctttaccaaggattccattgcgacgacaaagacacctggttcgcctcaactgatggcagttatcgagcagcgccttaaaggtcaagatacgacagtaaagcgcctcgtccctacacaggccaccgccgctccatcccccattcttcctaaaaacatgaagaagctcaaattcctggacattgatcccacagaattcgccaggcagcttaccattattgaatcacgcctctactctaaaatcaggcccattgagtgtctgaataagacctggcaaaggaaggttggccccgacgaaccagagcctgctacgaatgtgaaggctctgattctccattcaaaccaattgacgaattgggttgcggagatgattctcacgcagtcagatgtcaagaagcgagttgtcgtcataaagcatttcgtgaatgtggcagatgtatgctga

SEQ ID NO: 19387 - DNA, 240 bp, A.fumigatus
ctttgcgcacagaggtgccgcgcgctcaacaattactctacgctcacatccattatctctgctctcgggacagcgccgatccatcgactcggtcggacttggtctcaagttagtggccgtacgtccgccattctggagcaaatgcgcagacttatggccagcacgaagaactttggcgagtatcgggaaactctgcatctcgcaaaccccccttgcatccctttctttggtacgaaatag

SEQ ID NO: 19388 - DNA, 369 bp, A.fumigatus
caagtggctaaacttcaaccaggcgtttacctaacggacctgactttcatcgaagacggtatcccgtctctgacgccatcagagctcatcaatttcaacaaacgcgccaagactgctgaagtcattcgggacattcaacagtatcaaaatgtcccgtatctccttcagccagtcccggaactacaggactacatactcagtaatcttcaagcggcgggtgacgtccatgatatgtacgatcggagtttggaggtggagccgagagaacgtgaggatgagaaaatagcgaggtatgctgctgcatcgagtagagacttaagaagtcatagtactatggccatcgcgagcatcgttatcgcatcgcgatga

SEQ ID NO: 19389 - DNA, 255 bp, A.fumigatus
tcgcgcatttctctgctaatagcattctgcagtgagagaaccagcatgacagaggaggcggaacgacttattactgccattcaacaaatggaagaatccctagtggatgagaaagccaacggacagtatcaactgaatcatgacgatctgcgcgtcacgtaccccctcaatcgctgtctctcttttctgcgcgaaaagcatggagcaatgagcaaaatgcaccgggagcgctttgaacaggtgaagagtaagtga

SEQ ID NO: 19390 - DNA, 738 bp, A.fumigatus
caggcagtagaacttgttgcagcgctcgaatcatactcttcccatctagagtcctcttttgtgaccatcgaacttcccccaacagcacctggctcatccatttcgccgagctttgacctttccccaacttatgttaccgcgctagataatgaatttacgagagtgtatgaagaataccaccgtcgccttgagtttgtcaagacgacttgcgaagagatcatcaaactttgggcagaacttggaacacctcaggtgcagacggataccaatatcgtcaagcattaccgcgagtctcccgagcagttgggcctccacgagtcggatttggcgaacctgacggcaaagcgcgagaagttgctggaagagaagaggtctcgcgagcgcaagttgaaggagcttcgaacagctgtggagtcgttgtgggagcgctttggtgtcgaggaatgtgatagaaaggccttcctcgcggccaatcgcgggtgcggattgcggacgatcaatgaatttgaagaggaactggcacgtcttaatgagcttaaaagacagaatctgcaccttttcgtagaggacgcgcgctgccggctgcaagaactctgggatgggctctatttctccgaagaagaaatgcttgactttacacctgccttctctgacgtctacagcgacgcgcttcttgaagcacacgaggcagcaattgcccggctggagttatatcacgcggcggctggaaggatctag

SEQ ID NO: 19391 - DNA, 267 bp, A.fumigatus
tcagatgagactgctttgatgatttttgttgacatgacaaggggccttgatgctcgttacatgataagtcgtctaagaccgaagaagttcaaggtcttgtctttgacgacaattgcgactcctcatcgtggtatgctgcgtccttggaataatccacggttatttactcagacaattcaggttctacggttgcagattatgtccttgagcgaattggtggttcgttccatgattactctatacaaagaaccaaactcatgcctataa

SEQ ID NO: 19392 - DNA, 279 bp, A.fumigatus
ctgacatggctcaagttccctttcaacaattcatgcagttcacacaacagtatgctcaccaacttgaactttaccgggttgaaggttgaggtggccaaggatacaaatcgacacgttaagaagaccttgcctccttctttgagtggttttccaggcatggcagagatcaaatactatgtgaaagcaacagtcattcgtccacagttctacaaggagaatctgagagccgtatgtactagaatcttcagcgtagaaaatatcgtcatgaacagctgctga

SEQ ID NO: 19393 - DNA, 1317 bp, A.fumigatus
accctccagggcacggttccctcaggactaagaagagcaatcaacgcaacaaattgcgacggaggctctcgaagctcaaggagcttgggcgctctgcctgccgaagccgactttgcagccctccgagaatgggaagctaagaatggggtatggtacgagccacctgagcacaaggcgaatgagaagcgccgaaccaacgaagaggaacaggcggagtttgaagcaaaaagacaaaagttgctccatgctctggcaacaggcggagtagacgtcgacgccatcatggagaaagagaatgagccccccgaaacaaagacgacgaacgggtcagcggaggaggatgcggagtgcaatggggcggttgtggaatctgctaacaaacgacgtactctggatgtcgcaagctccagacggttgctttttgggtctctaggagtgcgagccccacggtccaaggaagatgaagagatcactcgaaagaaactcgcgggaaaagtcaacaactcccggatcaaggtgtcagaagagcaagcccccacggaggggagcgatagtgaagcggaagaaaactggcaggagaaactggtcctcaaagctactgaatgtgtttttgatgacatcgagctttctacacctcctttcccgtttgaacaacgctgggatgccgaggctcatcaaatcataaagaagcgcaaaggctgggggcgcaagaggaagagaagacagcaactgcacgtcttcgaggcagacgagtacgaagattacgcggaggaatctaataaacattataccgaagaagacatgcagctcaattacgatgatccagagcagcagccgagcaccgagcccacgaatggagtcgagtcggcaggcgaagagccatcagaaaacacggaggacgatcttcctcctctaccagcagatctgagctctgtcccggatctgacggaaggcgatttgaagcaaggatccgtgatcgctttcaagcagcttgttgtgtccaaggagacgaactggcaacctaccgtgtccgattatcttgtggcgaggatagacgacgttttcgaagacaacgtactcaagctgcagcttgccaagcgcgatcggcgacaagtcgagcaacccgacaaggatgacgaagaagatggcacacgaggatatgacaagttcgaaatgcccggcatggacgacgatcaagccgaagacgacggcttccgagagatatcattcgccaatctgtttgatgcgaagctcgttcaagctgcggatgtggcagacgttggggtggtcgacaaagtcagcaagtcagtacattga

SEQ ID NO: 19394 - DNA, 327 bp, A.fumigatus
tcgaccttcgtcatcacatcagaaaccccaaagtatccagttgtccttgcgcatgggctcctaggttttgatgagttacgcctcgctggccctctccttcctggagttcagtactggcgaggaatcaaggaagctttgacccagaaaggagtgcaagtcatcactgcaacagtacctccttcggggtccattgagatgcgtgcggaggagctggtgaaggatatagatgagggcgcccaggggaaagctgtaaatattattgcgtatgtattctctactttaataggttcaagggtagctttcagactgaccaatgtacagacatag

SEQ ID NO: 19395 - DNA, 279 bp, A.fumigatus
gcgttgtgcagttacttcagctacggcgcagcgatgcaaccaagcttttggtctatgttccgcttgtcccatcgcgttcttcaagaggtggaaggatataacgatgggctagtcagcgtcgctagcagcaaatggggaaaatacaaaggcaccctggaaggggccagccacctggatttgatcaactggaccaacaggctgaagtggcttgcgggcgagataactggaaacaggcaaaggtttgtaaaatctatctctggcttcgaggtcgtccactaa

SEQ ID NO: 19396 - DNA, 1179 bp, A.fumigatus
atcttcagcatccgtgcccttcaaatcgcagatctcagagcgagacggctctccggccgccaccagatttcaagtgacggcaaacatcttattgatggggttccctttggtcgacctttcctcaaacggcagacgtcctccagaccggcgattgcgattccaccaaggaagaaacggcgcactatgcttgcgacttgggacggtgttgtggatgatggtgatgatgaggtgcaatggactcttcctgggcgagtaagctcaatgaaggagctatcgagactcaaggctcatgacgatgatggcatccacgatgaatatacggattatcatcatgacgacgattatgaagactaccatgagagtcaagatgaatctggggacgggacagtcatccgtcattccctcggtgagggagaggaggacgaagcttcggagagcgacgcggacgattcagacttcgaggccgaagacttggcggaagaactggaggctcttaaggaagaccgggagaccgtgggcttgtcttcagcggaagtgctagaagaaaagcccaccgggcctggaggctatcccctgcggaccagggccagtatcttacgcaatgcttccgggcaccacgctgaccatcaagctgcgaccaaaagtccatctgaagcaggttcatcgcgacgagactccaaagccgtgcggttcaaggaggcccagcggcagacgtcaccttgtccctctcagagtgagagcgattctcacttgagccaggctgagcaggtttctgagggctcgccctccatatacaagagcttcagcagcagttcctcgagtgacaccgacaattcgacatcggatgaggaagactcgacttctccttccgagacaacaacctctgcgtcggaggtctcgtcgtctgagtccgaggcagaagatgcagaatctgaagatgaggattcatcctctgagtcagacaaatcctcaacatccgaatcagaagacgagtcccttcccactcccgcaccgaacagacaactacagcccaagatgaaccctccagggcacggttccctcaggactaagaagagcaatcaacgcaacaaattgcgacggaggctctcgaagctcaaggagcttgggcgctctgcctgccgaagccgactttgcagccctccgagaatgggaagctaa

SEQ ID NO: 19397 - DNA, 447 bp, A.fumigatus
acgcatgaaaaagctcacctgggtttcctacacccaggccttcctactctgggtctcgatcaacctggcagcaaacaacataactctgggaatgttgggccctgttgtttatgggctcagcttcctcgattcggcgttgtgttctgtactgggtgcgttgcttggttccattgtatcgtcgtggatggctactcgaggacctctctctggaatccgcaccatggtatgttctcgtctcgcttaagggatttgcgcgataagcacctttctctgacagtgatgcaggctttcggccgttatgcgatgggatggtggcccagcaagatcgtcgtgattttgaacttgattcaaatgctcgggtattgcctcattgactgcgtagttggaggacagatcttgtccgctgtttcaccaaatgggaatctgtcagttgcagttggtgagtaa

SEQ ID NO: 19398 - DNA, 780 bp, A.fumigatus
caagactttgttcgcgcgtctgacgccattaggctatcattcttttcgatttgcgtgagtgctgccatcacctatgctcccctggcggcagacttttttgtctactatccagaaggaacctccaagttagccatcttctccctatccttgtccggcctgatggtttccttcaccctggccttcctcgccggtattggactcgcctccggtataccttcccacctagaatacagcgcagcatacgccaagggtgcaggtgccctcatcgtcgaaggattcggccctctgcacggattcggcaagttctgctccgtggttgtcgccctcggcttgatcgccaacaccgttgcgccgacatactctgccggggtcgacttccagatccttggccgatacgcggagatggttcctcgcgctatctggaacaccattggcgtagtcatctacatcgtctgcgggctggcagggcggagccacttatccgagattttcaccaacttcctggcgcttatgggatactgggtcgcgatctggttcgccatcattctcgaagagcggtgcatcttccgcttgcgcagcggatacaactggtacgcctggaacgatccgtccaagttgcccatgggcattgcagcctttatcgcatttctggtgggctgggccggtgcagtcctctgcatggcgcagctgtggtacattggaccgcttgccaagttggtcggggaatatggtgcagatgtaagtgctatcatcgttcccgttccagtaaattccccctga

SEQ ID NO: 19399 - DNA, 501 bp, A.fumigatus
agactaactcaggataacagcatgtcgtctgaaatcgcaaatccatcgctagggatgcactccgaaaaggagccttcgggcttccgttccgaggagcaaccgactcctcgtcctcacaagactggtgaaaccaatagcgagagccccagtggccgcgttatcccgtctcgcgtgggtatgtatcttaggagattcgagcaacagctcgtcgagtataacttcgaggctcgcggcatcgaacgagtgcatgagggtgaacgcatgaaaaagctcacctgggtttcctacacccaggccttcctactctgggtctcgatcaacctggcagcaaacaacataactctgggaatgttgggccctgttgtttatgggctcagcttcctcgattcggcgttgtgttctgtactgggtgcgttgcttggttccattgtatcgtcgtggatggctactcgaggacctctctctggaatccgcaccatggtatgttctcgtctcgcttaa

SEQ ID NO: 19400 - DNA, 258 bp, A.fumigatus
gtatctcgtgatcgtcctatcgagcgctgcggcgagtgtggtaatgtcgtcaagctcgagtatattggacctgatgaggacccccatgctcgtaagttcccttcacttggatcatatcgctccttgccttccttttctcggttagtttttcggcttcttacatatccattcacagacgagcatcacagccaccacccccctcacgaggaacccaagaccttcgccgactacgtcaagcctgagtactggtaccggtaa

SEQ ID NO: 19401 - DNA, 969 bp, A.fumigatus
tgtatgtctgtgacgctggcggatccgtaccgagattatgctcttgattatgcccaacatgctaaaccggaggggcatgagaacgcactcgcctaccaaacgcagcattcgcatcttcaacgtcataaagaggccaaccctccgttcccgcagggtagtccacacaacacggcatacgagcaacatcatgcaagcacgaccgttctcccagcagcaaatcctgacatctcgcagtccgttgttctcacagcagcgcacatgctccctagacagcttccaatgcagtacacccctaccaccttcgagatcccaccagttcaacgcggcaagaaacgaccccattccgaggcggagggcgagggtgactacggggaccatggagttcgcccgcgcttgtcagcgcttcccacgcaggcatctacagagacagcacaatccccagggatgctcttttctgtccaaggcgattcctcacagcaacaagcacaccatcaacagcagcagcgacagccacaacaacaccaccatcatcagccgatgccgagccatgggttcgggccacctgagtcgatggcgctccctcaacaacatcaccaccaccgtctacccccgcaggcatcgcttcactctgcagagcggcatggcacgaatgcagaaacgtctcctataccttcaggactaccaagcgtggtgggccaaccaggcatgcctgatccggctcccaggccacgaggcccaaaacttaaatttacgcaagaggaggacgccttactggttgagttgaaagagaacaagaatctgacgtggaagcaaattgccgatttctttcctggtcgaacgagtggcacgctgcaagttcgttattgtaccaagctgaaggccaaggatgtgacatggacagatgagatggtaagtattgctctatgggggcgttccgtcaacttaccaagggaaccattgacgtactaa

SEQ ID NO: 19402 - DNA, 462 bp, A.fumigatus
aggttggtgataactcgatcgtccggtctcctatctatcatgcaacattacgagaacgccgcagaataccaatcggtgtctctgtcgagaagtacctatttatgctatgcgatgtgccactgggctcgttcttggtctcgttcttacattttcgtcatgcgggatcccattgactttccctcggctacaacacccctgtgtatcaggcattgtgctgacctttatgattgctttgcagaaatcaagactgaagaagacctcattgctcccggtgctaagcccggtaccgtccccacggacgttgagcaggccaccggtcttgagcgtctggaacttatcggaaagatgcagggcattgacatcttcgacatgagacccctcgacgcctccagaaagggtatgcggatctccttgcaggaaataaggcgtgggagcagcaaatgtcacgcgtttgaatcgtga

SEQ ID NO: 19403 - DNA, 345 bp, A.fumigatus
ctaacgaagcttgcgtcattaggaacccttgacaaccccatcattgtcaagagcgctggtgacgagcagtacgccggttgcactggataccccgctgactctcaccacactgtctggctgacggtaagtattgcatgctttgtggctctgtgcccccaaattgcgcagatggctaaaacatatctcttctctcaccataggtatctcgtgatcgtcctatcgagcgctgcggcgagtgtggtaatgtcgtcaagctcgagtatattggacctgatgaggacccccatgctcgtaagttcccttcacttggatcatatcgctccttgccttccttttctcggttag

SEQ ID NO: 19404 - DNA, 198 bp, A.fumigatus
tttttcggcttcttacatatccattcacagacgagcatcacagccaccacccccctcacgaggaacccaagaccttcgccgactacgtcaagcctgagtactggtaccggtaaatattccatgctacgaatattgtgcgattgtcctttggcctcttcctccacgaaaaacgatttaggagaaaagaacggacgataa

SEQ ID NO: 19405 - DNA, 276 bp, A.fumigatus
tgcctcatgaggttatccagaagtggaagcagcacccgctaccgggccggttcaggccttcctccttcctcatttcatacaaaaaacaatacccagcggcagcttttgtatccttcctctcccaggtacaatctggttttttactttaacctattcttctaccacctctctgctcagattgaattcagctcgctcttcactctcctctggctctcctcgaagcggttcctcaagggcaagtatcaatcttcattgctatccggttgtctggattga

SEQ ID NO: 19406 - DNA, 198 bp, A.fumigatus
tccactcagccttgcgtacagcacctgatgcacgaagcgacatctctcctccagcggaacatagaagccaccgaccatcaaaggacaattttctacctcggccctgaaatggacaataccacctgcgtgacttcggttgctcccatccggcgcaatgtcctgcccgaaatcaggctggagttgcatatgatcgtgtaa

SEQ ID NO: 19407 - DNA, 378 bp, A.fumigatus
caggtcgcagcagcactttcagttgcctggtacggcgcactgatagaaagcaaacccccactgaacatcgcgctggcccttgtgctcctcatctcattctgcatcacggctgcatacaacgtgatgaacgtcctcatcgtggatctgtactacaccacgccggcgaccgccatggcggccaataacctcgtgcgatgcttcctgggcgcagccgccacggccgtcatccacccgatgatactaaaatggggtaatcggactacgtacttggctgtggcgggagcgatgttgagtgtgagtccgttgctggggatggtctattggaaaggactggtatggagacgcaggaggattgcaggaattgcaattgctggatga

SEQ ID NO: 19408 - DNA, 249 bp, A.fumigatus
actgtactcatcatgaacacgctcatctcactcatcctattcacagccatatcctcagcacagtgggctctaccccagggaacccccactctccagatgcgatacccctcgaccccctggatctcccccggcgatacgatcaaacaaccaggtacgtccatcacgattctagtgactgatatgaacaatgaagctcatgctagtggagacaaacagacgccctcccaattccgtgcatcagaactttga

SEQ ID NO: 19409 - DNA, 651 bp, A.fumigatus
  unsure (7),(8): Identity of nucleotide sequences at the above locations are unknown.
ggagcannttttttacagagccaccgtcgatccttccagccccgtggtgaagactttccggagacttgtcgcacgattgtcggagacgggtcaatcccagctacaggatggaatcagtcagtctggaaccggtggcacaaacaacagaccattgctacttccaactctgaccccgaaggcacccgagacacctgccgcgactcccatccacggcttcaaaaaacaaacatcgccatcccaaatcccctgtccaccatcagcctcctcttccaactccccacaggccccctcgtccttgccaacggcatagtcttcgcaagctactactccgtcacagccggcattccctcccaattcaaagcaacctacggactaagcgacttaggcatcggcctcagcttcattccagcaggcctaggttccctcctcagcgcaaccttgaacggcctaatcgttgactggaactacatccgcctccgtcgcaaaacaggcgacatcatctctaaagaccagaagcaagaccatggtgcatttcccatcgagaggacacggttgcagatcgggcttcctatgacggtacgttgcgttgcaccttctgacctcctatacttcaccagggttgtagttgtagttggaattgcaacgtgctga

SEQ ID NO: 19410 - DNA, 705 bp, A.fumigatus
tctcagctgaagggaaatgagaatagcaagagatgtcctagtccatcgacatatggaagaccgtcagtgccaactttcaatcaactcgtatatacaaagcacggtaagagaatgaattggctcgaacaggaacacacctgctaccctgaacagtatctacattctcggtcgttcctttccttcgtcgggatgaacagagacaaacaacccaagccatcgcccgatcgacttcctaagagcgtcaaggtgcgttcgacctgcaacgcatgtcaacaggccaagatacgctgcagtcatgaaaagccatcttgccgacggtgcctgaagcataacatcgagtgcatctacagcatgtctcgacggctgggaagacctgcgaagaggagggagtctcaatacgccggccttccgccggatacgcaacgcgtcgacgctcgatgtcaccaacaagacaagaaggggccggcttccaagaaaaaagcaaaggaaggccaggatcgtaggaaggacgatgaagacgacttcccacagagacttgctgaaacagtagcttatgacaccatggccgtcgaccagactgtgctagatgatatctccctcaatgacactaatctgagtacgtcgacctttagcgaaagggaccaaccgccatcatttgcaggtagtttacgctctctcagagatataatcaggccaagtcattga

SEQ ID NO: 19411 - DNA, 267 bp, A.fumigatus
gctattggctctagcttgcagcttaagcctagtgttctatttttgtctatttcaggctctgactgtaggattgagataggcatctctgatctcggggcccctcaactcctgacggctgacttcacatttccatcaacaaatcagaggttcgcttttgaaatgcaactctctatgtacctaattatagacttcgacagttcgtttccatcactaaatttggatctcccagcgcttcccttgccaatacaatccatccgtgacgaatga

SEQ ID NO: 19412 - DNA, 750 bp, A.fumigatus
gctgccgtcaaagttgagagaggttatcggatgctgaccatcatagatgaacctgtcctcacgctcaatctatcagtcagcgagcttccttgcttctaccttcgcttccagagccgaaacgaattggagatctggcgtcgagctcttcgcgatcttcatacctctgatgcgttgtcccgacataccgactatgacctggatcattctggagctgaggaggaggactaccgggccagccagatcaagcgacaggcgtcaatcaactcatcttacggtgccggacggtctaacaatacagccatcacggattataccaccggtgcagataatctgcccacgtcgagtgtccatatacctctcgatgttgtggttgttattcctgtttcttcgtccatgcaggggttgaagatcaccctcttgcgcgacgcactcaaattcctcgtgcaaaacctcggaccccgagatcgcatgggcttggtaactttcggttccagcggtggcggcgtgccccttgttggaatgaccaccaagtcgtggggtggatggaacaagatcctcagctccattcgaccagtcggacagaagagccttcgtgcggatgttgtcgagggcgccaatgttgctatggacttgctgatgcagcgcaagtccagcaaccccatttctacaatcctcctgatcagcgactcgtccacttccgaccccgaaagtgttgatttcgtggtgtctagggccgaagctgccaagtga

SEQ ID NO: 19413 - DNA, 249 bp, A.fumigatus
tatataatttttactacatcggaaccttattcccctttttctttcctcgtctgctttactccctccatccttttgtcccctgcgttgtcaatcccaactatattcgacacggataaatcaagcagtaaaaaaatagtggcatcaccagaccctcaattgtcgttattgcccattggtgtccttactgaaagtcggaccagcggaccgtttctaccacttactgacgagcatctgcaaccttttgcgtga

SEQ ID NO: 19414 - DNA, 1272 bp, A.fumigatus
cctgcagatttcccctcccggccagagtccccctcgcgttcacctctcaagggcttccgttccttttcccgttctcacgcagatcggccggggaccagtacatctggtcaaacgcacacttctcgatctcgtgctccttccactattagcacttcgcttcaatccgaccatcctggcttgggctggcattcgaccatcggcacaaactcttcgcgagcatcgttcaactctagatccggaagaccaatggcgggcctgatggacgttgaccgtagccgtgcccggagggatagaacgtttgtcggtactgaatgcgccgtatgcgaggagccgctagagcatacccttcgcggagagcgggtcctccagttctcctgcacacacgtggcgcacgaagcctgtttctacgagtatatcaaggagtttgagggccaatattgtcccacctgtgatgcccccttagggctagacaccagccgcgggggtcatgtacttgacatcggtaagcgaaagatgcacttccgggcaacacagcgacgtgccattgctgggatactaaccatcgtcgttgtagaaaaactaagcaacattgtacgttctgtgactagcgatgcagccacgcagcgcagtgggttaaccactccaactccgtgggatcagccgtcagctcgtgggcgagcacccagcgagacgggaggccggtcttacaataatcgcgagagtcgggacatctgggcgagaagggatagccgcgatacgggcaatgcgggcagccatcgtgagcgcgagcgagtggagcggatgactacaggctcacggcaacagcattccagaaatggaagtgctgcaggatcgtctggcgagtacgatgctcagcagcagagcaacggcaggcggcatgactatgacgttcaggccatggaatccgatcttagccctcgcgcggctcccatgaagaaccccatacccgcccccacggtgaccatccgcagtgaattcccaacgctcaaccggtccagacaacaacaggctttgacttgcttggtcacggtggaagttcctgaaggagtatggcgtccggattcagaggacttgcgacagacttcgtcgggtgcgtcgcagccgcaggatgagccttatggcggcgtggttcgctttcctactgcggatgctcgatcaatccaatacgaaccccaggagaaccttgacgaaatcgccgaggacttgcgaacgcgggtcgacaactggcacggccttgaattttcgcggtag

SEQ ID NO: 19415 - DNA, 273 bp, A.fumigatus
atgatctccaggtcgggaaaactccgcttgcatggacacatgcgagtgggcaaggatcgcgaatcatggcaggatctggagtgctatcttttcgcagaaatgcttatctgtatcaaggaaaagaagacaaatactcatcagtatgatgaccagatcaagcgcaagactcggagctcgctgaaaggctcgattcttataaagaagcatctcaggtctattgaagcgtcgcctggtaagctgccgtcaaagttgagagaggttatcggatgctga

SEQ ID NO: 19416 - DNA, 513 bp, A.fumigatus
ctgactatttgcagagtgagtatccactcgttcggccttggcctgactcacaagcccgacacaatgatcgagttgtccactcggacgaaaggctcgtacttatacgtcaaagattggatgatgcttcgagaatgtgttgccggctgcttgggcgcactgcaaaccacttcgcaccagaacgtcaaactgaagcttcgtctcccagagggttcgcctgcgaaatttgttaagattagcggcgctctccatacaaccaagcgcgctacaggcagagatgccgaggccgctctcggagacctgcgatttggggacaagcgcgacgtgctggtgcagttggtcatccaaccagacaattccacacaggaaagcatgccgcaggacccctgggaaagcctggtgtctggattggaagctctcggaggtggctccgatgcagatgagcaacgtgtgccgagcgttgaggaggttcctttgatccaggcggatctcacttacggtgatctcctcccgtga

SEQ ID NO: 19417 - DNA, 198 bp, A.fumigatus
ccgaggagtagtcagtttttttggataattgtctcttctttgtttacctttccccttattctactgtttgattattcacttaccccatgttcaaccccgttataccttattttcgttcttctctctggttacccggctgagttggcaggcttttcttgttatgataccactttgttcgacaatgacggcgcagcatga

SEQ ID NO: 19418 - DNA, 705 bp, A.fumigatus
catccctctgggatgaatgtcgagaacaagcaatacattcctgaaagcaaaaaactgtcccattcagctagctttatcgccagacttagtcatatactcccgttactgacaagatgtcataacagctaccaattcaaccctcacctcctccagcccgaaaccgttaccaacatcctcgccaaggcgctcaccgtctttccctcgcctgccttctccctctgccttgccctcctccccgcccacacccagcccttccccaccgccgacaccgacgcctcccagacctccgacttcgtggaatccatccagaagctcgcccgcctgtccactctcctcgagtccgcccagtacgcccagttctggtcgaccctgaactccgatgacctgtacgcggacctggtcgccgatgtcgccggcttcgaggagctcgtgcgtattcgtatcgccatcgaagtgggcaaggccttccgggagatcaacgccgaggtgttggagcagtggcttgacctgcgcagccgcgaggcgctcgagaagttcgtcaccgaggtctgcagctgggaggtggacaagactggccccaacgggactgttgtcaaggtgcccacgaacaaggagaacgaggcgcgcagcgaggtcaagagcgagcgcgtgggtgtggagatgttcggccgtgtgatcagacggggtttcgagcaggccgcatga

SEQ ID NO: 19419 - DNA, 387 bp, A.fumigatus
tcaggcctcctccaacaggaaaaagagattcagcgccagcgcgagtccatcctcctgattgcctctgagaacgtcacttcccgtgccgttttcgatgctctcggctctcccatgagcaacaagtactccgagggttaccccggtgctcgttactacggtggtaaccagcacattgatgccattgagctcacctgccaggctcgtgccctgaaggctttcaacctcgaccccgagaagtggggtgtcaacgttcagtgcctcagtggtagccctgccaacctggaggtctaccaggctctcatgcgcccccatgaccgtctcatgggtctggatcttcctcacggcggtcacctgagtcacggttaccagactccctccagaaagtag

SEQ ID NO: 19420 - DNA, 213 bp, A.fumigatus
ggcaccgatcccgcccaccggctccccccaccatcaccagattttcctgtgctcttttcttcaccttcgttcgcccaaccttttttcctcctctctccccttctctcttcatccctatcatctcactttaccctcctgtccattgttttctttcatttggacaataccatcacccataatggccacctacgctttgtcgcaggctcaccgtga

SEQ ID NO: 19421 - DNA, 1044 bp, A.fumigatus
gtcacggttaccagactccctccagaaagtaggtctccatcgttaccttctgtcgtcgaacactgtgttaacttgcccaggatttccgctgtttctacctactttgagaccttcccctaccgtgttaacactgagaccggcatcattgactacgatactctcgaggccaacgctgagctctaccgtcccaagtgcttggttgctgggacttctgcctactgccgtctcattgactacggtcgtatgcgcaagattgccgacaaggttggcgcctacctaatcgtcgacatggcccacatctccggtctagttgccgctggtgtcattccttctcccttcgagtacgccgacgtcgtcaccaccaccacccacaagtctctccgtggtcctcgtggtgccatgatcttcttccgcaagggtgtgcgtagcactgaccccaagactggcaaggaaatcatgtatgaccttgagggtcctatcaacttctccgtcttccctggtcaccagggtggtccccacaaccacaccatcactgctttggctgttgccctcaagcaggccgccactcctgagttccgtcagtaccaggaacaggttctcaagaacgccaaggctcttgaggttgagttcaaggctctcggccacaagctcgtctctgacggtactgacagccacatggtcctgctggaccttcgccccaagggtcttgacggtgctcgtgtcgaggctgtcctcgagcagatcaacattgcctgcaacaaaaactccattcctggcgacaagtctgccctgaccccctgcggtatccgcattggtactcccgctatgaccagccgtggtatgagcgaggaggacttcaagcgcgtcgctcgctacattgaccaggtcatcaacctttgcaagagcatccaggctgacctgcccaaggaggccaataagctcaaggacttcaaggccaaggttgcctccggctctgttcccgagatcctcgctctccgcaaggaggtcgccgagtgggccagcacataccccctgcctgtttaa

SEQ ID NO: 19422 - DNA, 1041 bp, A.fumigatus
ggggatcatatcgcgcacctcgccagggaactgcttctcgatacctccgttgaagaagaacgtaacgtgcgcgtacttttcggtctcagcgacgtggcactgctggatgtccttcttgctgagccactcggccagcacgttgcccatgtgctgaggagggaacgcaacggggaaggtgtagtcggtcttgtactgggtcatggtggtgatttggatgttcttggggtaagggaagtcgggcttaggagagcggtcatagtcgcccagcagctgggtgatctcacggacacggtccgaacggtagttgaagaagaagagggtatcgttgtctgcaagacacggttagtcttcgagcgagctgttctccgggttccttcaaaacataccctgcacgcgcctttccttgccgccaacaatgatgggcttgaggaactcatcgttctcacccttctcatagcgctccttgatagtcttaacgggatcagagctctcttcgccctcaccgctgacaatacccttcatggcaacttcgactctgtcccaacgcttgtcacggtccatagcgtagtagcggccaaccaccgtggcgatctcaccgatgccgatctccttggtgtgatcgagcaagtcctgcatatacttgatggcgctcttggggtcggtatcacggccatcaccgaagaagtgaatgaagacctgagggatctccatttccttggcgaccttcaacaaaccgaccaggtgagtgatgttggagtgaacaccgccatcggagaccagacccagcaagtgcagacgaccattgccctccttggcgcgagtgaaggacttgacgacgttgtcgaccttgttcaattcgcccttcttgagggtctgatcgatgcgaacgctgtcctgccagacgacacggccagcaccaatgttcagatggccaacctcactgttgcccatcaaaccctctggcagaccgacggccagcgacgaggcatccagctctgtatatccttgagccgtcttcgagttctcttcggcaaagcctga

SEQ ID NO: 19423 - DNA, 621 bp, A.fumigatus
accgatgaaaaccccacttcatgcggcctgctcgaaaccccgtctgatcacacggccgaacatctccacacccacgcgctcgctcttgacctcgctgcgcgcctcgttctccttgttcgtgggcaccttgacaacagtcccgttggggccagtcttgtccacctcccagctgcagacctcggtgacgaacttctcgagcgcctcgcggctgcgcaggtcaagccactgctccaacacctcggcgttgatctcccggaaggccttgcccacttcgatggcgatacgaatacgcacgagctcctcgaagccggcgacatcggcgaccaggtccgcgtacaggtcatcggagttcagggtcgaccagaactgggcgtactgggcggactcgaggagagtggacaggcgggcgagcttctggatggattccacgaagtcggaggtctgggaggcgtcggtgtcggcggtggggaagggctgggtgtgggcggggaggagggcaaggcagagggagaaggcaggcgagggaaagacggtgagcgccttggcgaggatgttggtaacggtttcgggctggaggaggtgagggttgaattggtagctgttatgacatcttgtcagtaa

SEQ ID NO: 19424 - DNA, 324 bp, A.fumigatus
gaggagaaggcaaaatcagagatcacttcactgattggtatctcgttgatgtcgtccgacagggctcggtcgtttatcaggtccgagattccctcgtggaggctcactgacaccgtcaaagacgccgttgagcaatggaataaggaggtcctcagcaagacccaggtgccccttgaccgtactgcaaacatggcccacgtgcggctgctctacagctcgctgtatttcatgcatccgatgccctctaaccggactggggacaatccgctctggcgcaaggtatctgaatgggtcagcggggtggcagacactctggaatcctga

SEQ ID NO: 19425 - DNA, 753 bp, A.fumigatus
gtagtcgtcatcgacggctggggtatcccaggccccgactctcccaaagacggagatgcgatcgctgctgccgagacaccctacatgtcaggctttgccgaagagaactcgaagacggctcaaggatatacagagctggatgcctcgtcgctggccgtcggtctgccagagggtttgatgggcaacagtgaggttggccatctgaacattggtgctggccgtgtcgtctggcaggacagcgttcgcatcgatcagaccctcaagaagggcgaattgaacaaggtcgacaacgtcgtcaagtccttcactcgcgccaaggagggcaatggtcgtctgcacttgctgggtctggtctccgatggcggtgttcactccaacatcactcacctggtcggtttgttgaaggtcgccaaggaaatggagatccctcaggtcttcattcacttcttcggtgatggccgtgataccgaccccaagagcgccatcaagtatatgcaggacttgctcgatcacaccaaggagatcggcatcggtgagatcgccacggtggttggccgctactacgctatggaccgtgacaagcgttgggacagagtcgaagttgccatgaagggtattgtcagcggtgagggcgaagagagctctgatcccgttaagactatcaaggagcgctatgagaagggtgagaacgatgagttcctcaagcccatcattgttggcggcaaggaaaggcgcgtgcagggtatgttttga

SEQ ID NO: 19426 - DNA, 600 bp, A.fumigatus
ccgtgtcttgcagacaacgataccctcttcttcttcaactaccgttcggaccgtgtccgtgagatcacccagctgctgggcgactatgaccgctctcctaagcccgacttcccttaccccaagaacatccaaatcaccaccatgacccagtacaagaccgactacaccttccccgttgcgttccctcctcagcacatgggcaacgtgctggccgagtggctcagcaagaaggacatccagcagtgccacgtcgctgagaccgaaaagtacgcgcacgttacgttcttcttcaacggaggtatcgagaagcagttccctggcgaggtgcgcgatatgatcccctcacccaaggttcctacctacgaccatgagcccgagatgagcgccgaagccgtcggcaagaagatggccgagcgcattgccgagggaaaattcgagttcgtcatgaacaacttcgctcctcccgacatggtcggtcacaccggtgtgtacgaggccgccatcaagggtgtcgccgccaccgacaaggccattggtgaaatctaccaggcttgcaagaagcatggatacattctgttcatcaccgccgatcacgggtag

SEQ ID NO: 19427 - DNA, 270 bp, A.fumigatus
gttggggtcgtttctgtcttgggcttttatctctccaggctaacatatctgcttcccagtaacgcggaggagatgctcaccgagaagggcactcctaagacctcccacacaactaacaaggttcccttcgtccttgccaatgcccccgagggctggagcctcaagaaggaggagggtgtcctcggagacgttgcacccaccgtcctcgccgccatgggcatcgaacaacccgaggagatgtcgggtaaaagtcttctggtcaaggcctag

SEQ ID NO: 19428 - DNA, 633 bp, A.fumigatus
gatgagaaaaaggagcaagaaaaagaattaaggaaaaatccccattttaaaccgatgaaaaccccacttcatgcggcctgctcgaaaccccgtctgatcacacggccgaacatctccacacccacgcgctcgctcttgacctcgctgcgcgcctcgttctccttgttcgtgggcaccttgacaacagtcccgttggggccagtcttgtccacctcccagctgcagacctcggtgacgaacttctcgagcgcctcgcggctgcgcaggtcaagccactgctccaacacctcggcgttgatctcccggaaggccttgcccacttcgatggcgatacgaatacgcacgagctcctcgaagccggcgacatcggcgaccaggtccgcgtacaggtcatcggagttcagggtcgaccagaactgggcgtactgggcggactcgaggagagtggacaggcgggcgagcttctggatggattccacgaagtcggaggtctgggaggcgtcggtgtcggcggtggggaagggctgggtgtgggcggggaggagggcaaggcagagggagaaggcaggcgagggaaagacggtgagcgccttggcgaggatgttggtaacggtttcgggctggaggaggtga

SEQ ID NO: 19429 - DNA, 468 bp, A.fumigatus
gtgccgccgtgcttttcaccctccttttcattggcacaactgggtatcatgcttttcaaatgtttaagactcgaacgtggtttttcattccctttgttattggtggcatatgtgggtgcaccttctgcaatccttaggcccagaacactgctaacctactcagtcgaaatcattggatacatcggacgtgcaatgtccagcaaagagaccccagattggactcttggaccgtatatcgtgcagacgctctttcttttgctggctccagcccttctagcggcctcggtatatatgcttcttggtcgcatcattctgttgctgcaagccgaatctcatgccctgttggggaggaaatggttaactaagatttttgtaacgggcgatgtgctctcattcttacttcaaggagctggtaagcatctcatagcaaaacatcggaacatggaatggcaagctgatataatctag

SEQ ID NO: 19430 - DNA, 246 bp, A.fumigatus
ccaatgtttgtttcattttgcttttttcataggtggactccgccctttttcctccccgctaaatatgtatacgaaaacgagtgggtctgtggccactactccgtcccttggcgggcttggcgaaactatctggcgactatcgaatccgcctgtttagccgaattctggctgggccaatcagaatgctccattgtaccatggatccaacatgccgaattgaaagtattttacagagtttttatttag

SEQ ID NO: 19431 - DNA, 201 bp, A.fumigatus
ccgaatcataatgaggaagttgactgcatagaggatccacaggtgtttacgccaggcgctgttcaattctattgctttctctgtctgacccttgatcagacgccagtggaagatcgcgcaggtaacaatgaagaggccgaaaaaaagaatctgtataagaaggcctgcgataacaatcttctcaccattgtgtacggctga

SEQ ID NO: 19432 - DNA, 393 bp, A.fumigatus
atatccagagcggagcgtaatacttctggaggcagaatcttcctttgtcagttaggaaccttctgcttccttctcttcaactctcttcaactctcttcaactcttttctcttcaacttcctttctattttatttgctcatcatttattttgagcctgttgttattgttacaattcatacccttcacatgaaaatgccggatacaggggattctgaggaggccttctttgccttctatcgctacgaccctagcatgagtgccgccgtgcttttcaccctccttttcattggcacaactgggtatcatgcttttcaaatgtttaagactcgaacgtggtttttcattccctttgttattggtggcatatgtgggtgcaccttctgcaatccttag

SEQ ID NO: 19433 - DNA, 471 bp, A.fumigatus
tataatctaggtgggggcattcagagcagtggaaatttagacaacttgaagaacggcgagcgcatcatcgtcgtcggcctcttcgtccaaatcttcttctttggttttttcatcatcacagcaagtcatttttactggaagatcaagaaatatcccatcccacgctcttgtacaccggaaattccctggggcaaacacctacatgttctttatctgacgagcttcttgatcatgatccgctccgttttccgactggccgaataccttcaaggaaataacggttacctcttacaccatgagatctacttatatattttcgatgcccttctgatgttcatcacgatggtcaccttcaatgttgtacacccttgcgaggttgggcgcctactgagaagtaccgtcaattacgaattgacacacaggccacagacatgtgctaataagccatatgcaagctccctggtgaggtga

SEQ ID NO: 19434 - DNA, 252 bp, A.fumigatus
caagcaggcagattgcccattctcgacgttcattccacaatgtctctctgggctcgcgaaccgacgacaggagcagatgccagctaccaaactgcagtgtgggcatactatcgatactatccgtccaaggcagccgccatcctcttcactattctgtttctgatcactacctttgtccatctatatcagctgtttcgtcgccggacttggtttttcattccctttgtgattgggggcttctgtgagtgctaa

SEQ ID NO: 19435 - DNA, 324 bp, A.fumigatus
ctgagtggaacgcgagcatggattgttgcgaattctaataaaagtacagttgaatgggttggatatcttggccgtatcctgtccagtcaggaaagccccaactggtcaatggggccctatatccaacaaaccctcttgctcttgttggccccagcgctattcgcagcttcggtttacatgatgcttggacggattgtggtgctactagatgctgagcacctttgcataatcaagaaaaagtggctcacaaaatttttcgtgtgtggtgacgttttatctttcactgtccaggctgctggtgagcatacttctcccctcctttag

SEQ ID NO: 19436 - DNA, 300 bp, A.fumigatus
aggttaacggccatgtccctgactcagactgagaaagacacggaagtcttcaccgaggacaaatcctctactctatccttgacctccactctgacatgtgacacgcttgatgaaaagcactttgccttcttccacccctctcgtaccctacatattgccgcgcagggcatcgctgccttccgtctcccttttccctctagggagcttgaaatcccaatctacgacaccgcagaaggtaccatcgcttacgtctcaacgcgttcatccatctgctcgggaaacgccattctttcagatcct

SEQ ID NO: 19437 - DNA, 333 bp, A.fumigatus
gtacgcgtttccttccagccccgtggtgatgacataccggaagtgattacggatatagtccactcctacaaggctctcgtgctggaagtatccatcgctgaaatggatgtccacacgcttaacaccacactccacaccgatatctacagcgccgttatcactgaggctcttgatgctagaatcaccgatatcagtttctggggatttacagataagtatgcttacacctggctagagggtgcgaagccattgatgttcgacgagtactataatcctaagggcgcgttctatgctacccacactgccctgacaagcttggacaatgagccctaa

SEQ ID NO: 19438 - DNA, 429 bp, A.fumigatus
caacagacaacaggtggcggtgttatggccagtggttctctctcagccgtacacaatggtgagaagattgttatcgcaggccttcttatacagattctttttttcggcctcttcattgttacctgcgcgatcttccactggcgtctgatcaagggtcagacagagaaagcaatagaattgaacagcgcctggcgtaaacacctgtggatcctctatgcagtcaacttcctcattatgattcggtcagtgtttcggctcattgagtatgcaatgggtaacaacggctatctgctgcggcacgaggcattcctctatgtatttgatggagttcttatgctagcggccatgatcctgtttaatatcgtccatcccagcagtctgataccgagcaggaggaaaagcctcgagcaggattcctccgcagcctaa

SEQ ID NO: 19439 - DNA, 228 bp, A.fumigatus
tttgctatgcttcattccaaggggacagaagaaccgggagattacaaaaccagcggaactaatggccatcatgcctcagtttccgttctaggactgttgcgattgcgcgacgtctatcgtacccctgcatatatctcttgccgctttgtaacagtctgggcacacagcgtcttgcctgtattgactattgctgaactgcttctcctgcaactttcttctgtcaagtaa

SEQ ID NO: 19440 - DNA, 462 bp, A.fumigatus
cgcgacaattttcgcttcatcttcagcaggctggggttgtgcagtgtcgataatgacaggcgcctcggcttgggtagcggcttcagtcgtagcaggttccgcttggggagcttcagccttgggggcttcaatttggggagcttcggcctggggagcttcggcctggggagctttggcttggggggcttcggcctggggagcttcggcctgaggggcttcggccgcaggcgcagcttccacctgagatgcagcctcaaccggaggagtggtgggctgaggtgcaggtgcaggtgccactacactgggcccacgataatcagtctcagccgaaggtttttgttcagtgtctcgcgttcgcttcgactttctccaccaggaccatgtcttttcttctgtagtcttctccttcatctgccgcttttgaatctctgcgtctgtgtgagcttgtctgaactcaagtag

SEQ ID NO: 19441 - DNA, 414 bp, A.fumigatus
gatccgagtgccgcaccgcgtgaatctgtccccgccagcgccgcacctccggcgaaccctgttcttgccccctcgccttctccctctcgtagagactcatgttccgcgccattagatcggcgacccacccggcctttgaaccaactcttgagtctagattcccgtctctcaagccgatgttcttcctctccggcagtccctagcgcgacaattttcgcttcatcttcagcaggctggggttgtgcagtgtcgataatgacaggcgcctcggcttgggtagcggcttcagtcgtagcaggttccgcttggggagcttcagccttgggggcttcaatttggggagcttcggcctggggagcttcggcctggggagctttggcttggggggcttcggcctggggagcttcggcctga

SEQ ID NO: 19442 - DNA, 330 bp, A.fumigatus
tctcggctgcaccctggcgcaattggcgaggcaactatgcgaatcttcagcttcctgtttctgctcctcctgggaatcttgactggccagggtttggtgtcagggacggataatggcaagactaccgatgtgacgtgggacaagtacagtctgtccgtcaagggacagcgattgtttgtcttctcaggtgaatttcactaccagagacttcctgtgccggagctgtggttggatgtctttcagaaattgcgggccaatggcttcaatgccatctcaggtatgatatgtcttatcctgcattatgcgtgggtgagtccgacggggaactaa

SEQ ID NO: 19443 - DNA, 1128 bp, A.fumigatus
  unsure (425),(479),(505): Identity of nucleotide sequences at the above locations are unknown.
gtgagtaaactgaacggttatgcctcctttgtcatgagagacactgaccgtaagggcagagtgtacactggtaactcccaggtcaagaaaatcaagtggaatgggaagacaatcgagaccagaaagactgcgtacggaagtctgatcggaacagcgcctggagcggaagatgttaagattcaacttccttcgttggactcctggaaggcccaagacacccttccggagatccagccggattacgacgattccaaatggactgtttgcaacaagaccacctcagtaaatgcgatcgctccgctttctctccccgttctctactccggtgactacggctaccatgcgggcaccaaggtctaccgtggccgtttcgacggacgcaacgtgaccggcgcgaatgtgactgtgcagaacggcgcagccgntgggtgggcagcgtgggtgaacgggcagtatgctggcggatccgcgggcagccntaaccttgctgcgacgtcggcggtcntcactttcaacagctcatctctcaaggatcaagacaacgtcttaacggtggtcactgattataccggccatgatcagaacagcgtgaggccgaagggaactcaaaacccgcgagggatcctgggtgccaccttgattggagggggcaactttacgtcttggcgcattcaaggtaacgccggcggcgagaagaacattgaccccgtccgtggaccgatgaatgagggcggactgtatggtgagcgcatgggctggcatttgcccgggtacaaggtacccaaatccgcgtcgaagagcagccctctagacggggtatcgggagccgagggtcgtttctacaccaccacgttcaaactgaagctcgataaagatctggacgtccccatcggactccagttaggcgcgcccgaaggcacaaaagcggtagtgcaggtcttcatgaacggatatcagtttggtcattacctcccccacaccggaccgcagagtctcttccccttcccgccaggtgtgatcaacaaccgcggggagaacacgctggcgatcagcatgtgggcattgacggatgcgggtgcgaagctggacaaggtggagctggtggcggcaggaagtcttcacgaaacg

SEQ ID NO: 19444 - DNA, 1452 bp, A.fumigatus
cgccatagtttccatatgacaggagatccgaaagcgacgggctcgctcaacctcagccatgcatcagcgagcgctgctcttgcccaagcgagaagtcatcacaaaaacttaacaaccgacaggcccggcggagtaggatatcagacccaggacagacgaactgctgagtctcccgtggctcgacccagcccggaagggtacaaagccgccattaccgcagttagagaccggagagccatcacgagtcttcctccggtagccactggctttaaatatgacatctcgacgacatccgaccaggcctatgatgtccagcgggagagctcagacagggacaaggcacttcgtgctgctaccggcgcgtaccgactcagcaggaagagggccgactccgcacccagcaaacctacaatggctcgtgaagcgccttatgctgcttcagcagctggcagtgcgaagcctgcgccagaagtggaagacccacttgcacgtattgacagctcaatggaagccagcaggattcatcacatgtccaatgtcaacgcgcaactttacactgagcaccctcctattggtctcgaggagcaagaccgaaaggacgtgcttcgagctgctgttatctcgatggcacacgatatgtacgaaatcacggagaaaagagaggaagtacctactggagagcccagcgcagccctctatggtgctcagcgtggcctcagccgcatgcgctcccagcgagccgttccaaagtccgatccagcggcccttaagcaggctgttaaagtgcaagaagcggctcaacagcgggctgcggagaaattggctaaaatcaatgaaccaacttatcaggaatattatggggttgaaccgcatgttcagcggcccaccctgtctatccgtcgcaggagagcgtccgtcgactcggagacatcagctgctgatgccgagcgatcaagggagatcaggcaccagatgtccagccttcgatcgcgactcgatgctgtggatgaacaaagaaccaaagaccgtgccaacttgatggaggccgcaaggcgaaacgtcactgcgaccatccaagatatggagatgcgtgtctaccacgaaacaggccggcctccgccatcgatgcagaaagaatgggaggaggccgcacttgagcgcgcacaacgcgaggtccaggaacaagagccctacagaccgtacaacaaagtcaatatcggcactgaaagatacatagatatggccgacgttgaggcagtcgcccgttcaaggcttcagccaaccttcgatgagattacggatcgtgccgagaagcagagggccagggaattggaagctcgcctggatgccgaagaaagggagcgatatgaggccattacacgtgagcgggagcgtgaaacgagggctgaagagaaacgccagctaggtatgttcagccgcttgactacttga

SEQ ID NO: 19445 - DNA, 1149 bp, A.fumigatus
gtccgacggggaactaaaagggcgagggtagtgtacttcttttggagcttccacagcgcctcggagggcgagttcgactttgaaaatggagcccatgacatccagcggttgttcgattatgccaaagaagcgggtttgtatgtgattgcacgcgccggcccgtactgcaacgcagaaacctccgctggcggttttgccctttgggcagccaacggccagatggggaacgagcggacgagcgacgaggcatactacgaaaaatggcggccgtggatattggaggtcggcaagatcattgcgaagaaccagatcaccaacggtgggcctgtgattctcaatcaacacgagaatgagctcgttgagacgacgtacgatccgaaccataccctggttgtctacatgaaacagattgcgcaggtgtttgaggaagctgggattgttgttccaagctctcacaatgagaagggcatgcgaggcgtcagctggtcgacagactaccacaacgtaggaggtgcagtcaatatatatgggctggactcgtaccctggtggtctctcgtgcaccaatcccaactctggtttcaatctcgtccggacataccatcaatggttccagaactactccttcacgcaaccgagttatctgcccgagttcgagggtgggtggttccagccttggggcggatctttctatgacacctgcgctacggagctgtcgccggagttccctgatgtctactacaagaacaacatcggctctcgggtgacattgcatagcatctacatgacttacggcgggaccaactggggccatagcgccgctccagtcgtgtacacctcctacgactatgccgctcctctccgcgagactcgcgagattcgcgacaagctgaaacaaaccaagcttattggactcttcacccgtgtgtcgaaagacctcttgaagacctatatggaaggtaatggtactggttatacgagcgacagtagcatctacacctggtcgcttagaaatcccgacacaaacgccggattctacgtgcttgcacacagcaccagctcaactcgcgatgtgacaacctttaccctcaacgtcaccacctccgccggtatggcgctcgcgtgcagtttctccctgacttgttgctaa

SEQ ID NO: 19446 - DNA, 513 bp, A.fumigatus
ccggacctaggtgccatctccatcccagacatcgagctcaatggtcgccagagcaagattatagtgaccgactacaatttcgggaccaactcgactctcctgttttcatccgctgaagtcctgacatacgccaacctcgatgtaaatgtccttgtcttctacttaaatgtcggccagaaggggaccttcgtgttcaaggatgaaccgaagctcgccttccaaacatacggcaatagcaacctcactacctcggaatcgagctacggtacgcagtattcctacacgcagggaaagggtgtcactgccgtgaagttctccaacggtgtgctggcctactttcttgacaaagagtctgcctggaatttctttgcgcctccgaccacatcaagcccgcaggtcgcccccaacgagcatatactggttcaaggaccgtacctggttcgcggggcttccgtcaaccacggtactgtggagatcactggtgacaacgcaaacaccacatctattgagtga

SEQ ID NO: 19447 - DNA, 306 bp, A.fumigatus
catccgtggatttgccctctgcaaccgacgtcacagacgacacactcggtactcaactctcttcccttaagcttccggctggttcatcccactggccgtcaccactattatctcttttctctcccatcatcttctttcccaccttctttcttttcctttgacttgcttccatcaggaatgcctatacccgccgttctttcatactccccgcatcacggcgcagaccttatcttatcatggctactactgagtctcatcctggagtccatagcgtctccatccagcgttcccggtctgcccagctag

SEQ ID NO: 19448 - DNA, 1068 bp, A.fumigatus
ctacttgagttcagacaagctcacacagacgcagagattcaaaagcggcagatgaaggagaagactacagaagaaaagacatggtcctggtggagaaagtcgaagcgaacgcgagacactgaacaaaaaccttcggctgagactgattatcgtgggcccagtgtagtggcacctgcacctgcacctcagcccaccactcctccggttgaggctgcatctcaggtggaagctgcgcctgcggccgaagcccctcaggccgaagctccccaggccgaagccccccaagccaaagctccccaggccgaagctccccaggccgaagctccccaaattgaagcccccaaggctgaagctccccaagcggaacctgctacgactgaagccgctacccaagccgaggcgcctgtcattatcgacactgcacaaccccagcctgctgaagatgaagcgaaaattgtcgcgctagggactgccggagaggaagaacatcggcttgagagacgggaatctagactcaagagttggttcaaaggccgggtgggtcgccgatctaatggcgcggaacatgagtctctacgagagggagaaggcgagggggcaagaacagggttcgccggaggtgcggcgctggcggggacagattcacgcggtgcggcactcggatctcaccctgtcacaggcaatgatcttgccacagtgcagcagagaatgtcagttgacgaaggcagtctaggaaacgacgccacgcggcgaggctcaagcggcgtagctgagcagactggtgagaacaggaagccatcacgcctgagatccagcttcatgaagattgtctctggcggttcccaggataacaagactaacggtgtatcgaagccgagtgatgatcaccggaccgcttcagaacctgcagagattggcgttcgcaaccctgaaggctccaacgcatccactgccacaaaagaagaactgcgagagagtgccgctgaacacgggctgcctgcgcccccagccattggtaagcatgccaccaacggtagtcgtgagtcgcggttctccgaggacttgtga

SEQ ID NO: 19449 - DNA, 3186 bp, A.fumigatus
atcctgctattaaggccgtcgagtggcttgtcagacgtttcaggtgcgaaagcggcaatctcaatgttcaagtactcggtttctcggacgtgtttggctaacgaagcatacagaattcacgaatataacacgtcatttacgattctcacattcctaccatactacaccaccccattattcttgaatctcctggccatccttcccgaagacctgacgccgaccttcaaagtcctgattccctacaaaaaaagctcgatcaatccacctcgccatccgcttgtgcacagtgctactacgaataagcccttcttggcggcattgaacagctatgtcctccaggtgagccggcagcaagcgcatcatcatgcgcttctggcattctgggccggcgtctacactgaggccgtcgcgggaatgctggatgcatcgcgctccggacgccgagaaatcgagaaacagaagcacgaagatatcgtcataagtgttctcccaattctgaacgatggtttcgctatgaagaacgtctcggagctgatcattggctgctacatggtttccgtggtgcttgcacaaaaggcgtctcttcaggacaaggtccttgacagtttgatggaggccgttgccggatcgtggacagaagagactgtcgaatcaggcctagtgtgcctggctgttctggcacagcaaaagcctgaaacaaagttaccaagacgtgctttgaaggcaatcttgcgattggacgatattttcaagcggttgaccgaattagcgacacaatacaagacctctcaccttcttctcggggtagttgccggctgccttgacgatcttccaagacaaaaggacacagcacgccttgatctcttgtcgcagattttccagaaccagctcttgggtgagccggaaatgagcaaggctatggccttggtcctggaagccacgagcagtgtgcataaggatggtgccatgtccttggatgctcaggcacgtcttgcagatctagttcaagtgttcagccagtccgagtctctgcggcctactttccagaagacaatcgcggagtcatctttcgacattgctgcgctggaacacaacctccagacagtgattgataccgcgcctgcgcctcgtactgtggaagatgtcgagatggaagatgtggagaaggaagaagagcaagatcacttctcatcgactgtggagtctttgagcggggagaagttattcaagggctctttcctcagcacacaatccatccccttgttcgaaaaacttgcccaagcctttacactggcaattggctcgaaagagaaatgtcagaccttctccgacctggcggctcttgggaagaacgaggctgaaaagtctcctcaatatctttccttcttcatcagagtcttctctggtccatattcaatgggcacgcgggtcacggctttgaatatgatcacctctttcctcacatccaccgagagcacgaatctagacttccaggcgcttttgccattcctgctagttactctcacagatccgtcggaacgtgttcgccgtgaggcagctgcagctcttgctgctgtcggtagtctctacaagaagaataggaagggagaagacatctgggctcgcgacaacctctatggccaaccgaaggacattaaatggctccccactcgcgacgcacagaaggttttcgagcgtgcagtgcttcccagtttggaggaatgcatcttcgatgcgactcacattggcaaggttttggagaacactcttcggggagtgtcggtcgatgcgaatgcgtccgaactcaagaaacctctgcgactggcatttttcaccttcctgtgctcccatgctatcgagcttccgttgttcacacctaaacttggcttgctcaacattctcaaccgtatcgacaaggctggtggaaccactcgcacgaaggagcttgagcctctgctgaagacttggcgtggatttagtgagcgtgaagtccaggatatctgcgagaaagagcgagttcctgtttctgatgtagagcgtcagatggtggcgattgtgacacccaaggagaaggactccattatgattcttttgtcgaatgtgagctctcactcggagtctctgcggccttctttcattgcagctgtctttggccgcataaaagacatctgggctcgggtggcggaggatcgtcagactgtggctgcggagcagctgttcgatatctcgcttggcctttccgacttgcctcttgtaaataatagcagagatcttctccgcagcgttcagctcccaggctctgtactcgcccaatttctggaaagaatacctgtctctcttactgacatggaagctcttgggcctgcaccaaagagaagacgcactagtcagaacaacatgattgcgatgactgtgaaggatgaggctgagtttggcaaggtcatggagaagatgactttcatcctggagcttgttgacagctcatcaccggagactcaccctgagctcgccgacggtctcttccagacgctggctgctctccatcacttcaagtctcagattcagtctggaatgagctatttgctgagcttgactttgggtagtctgctggccattgtcaaccggtcaaaggagagcgcaaaggcacagttcgatacctcagttattcgcgccgacctggtcgtagattgcgtgcggaccacagagagccctcaagtgcagaatgcagctttgcttctcgtggccgggctttccgtcatcgccccagagttggttcttcacagcgtgatgcccattttcacgttcatgggctccagtgttctcaggaaagatgatgattactcggtttctgttattgaccagactatcgaccaggttgtgcccgctcttatccagtccctgcgtgatcagaagcgtgacgtggtatctggaacatccgaactgctgctaagctttacagctgcgtttgagcacatcccttcacaccgtcgtctgcggctcttccatgctctaatcacgaagctaggaacgcaggacttcttatttgctgttttggcaatgctcgccaacagatatgccatggacaaggatgttctcgttttgatgacaggtctcgtttctgatgccagtgctcctgtcgagcttaccgtacgtgttgtcatcccgcgtttctggactatttactga

SEQ ID NO: 19450 - DNA, 1296 bp, A.fumigatus
caggtctcgtttctgatgccagtgctcctgtcgagcttaccgtacgtgttgtcatcccgcgtttctggactatttactgactctaaacagacatacagcaaattcctgggattggtcagcgactcgctcaagccaaaacctggcatctcgcaagttctccttggaattggtagtgatgatgggcgcgagccgcagaaagttgcggttgacctgcttcgtgacttggcatatctcttcagacattgttctctcaaggtcaagatggccaagacatttgcctcggaggacgaagaggctatcagacagctccgttccactttctctcagatcctggaacaggtcctgaccattggtgattccgtgcagagcatgaagctcgtcagccaggcgaacggtgacgttctggccgcgttgttcggcacactgacactggtcgacttcctcgacactatcgaagtgctgcttgagcggcctaacgatgaactccgtcggaaagtgctccggctcctcgagggacgccttcggcagaacccagaacgcgacagcgcctctcagatccgggtgcttgacttcttgcctacccttgttgacattatccgcaactcgacggatatcctgctcaagcacgccgcggttgcctgtatcgatcgcattgccgagaagtacggcaagaaggatccgtcaagagttattggtgctgctcaggttgtggctagcgaggcctgcattggccagacggacgaccgcattcgtatcatgggtgtcttgtgccttgcatccatggctgagacccttggccaagtcatgattccagcacttccagaggccctcagccgctcgctggctctgcttgaactgagcttggaggagggcaaggagaactcccggttacacgatgccgtcttctcgttgttctcggcgctctttgttcatattccgtatatgatctcaggccctcatctcgataagatccttctgctctctttcaagtcagccaacgctgaagaatgcgaggacgatagccgacaagaagcattgaagatgatggcccggaaggttgacatggctgcgacgttgggggctgttgatcgtaactggcagtacgcggtgcaggccgggccggtcgccaccaaggagacgctggaggtggttagccttgctgtggagaagcatcccaagtccgcgactggcaagaatatcggggtcttgtcgagcatcctgttcaaggcattcgatctacgccgggagcagcttgcactgggagcgaacgccacctttgacgcggccgacgttgat

SEQ ID NO: 19451 - DNA, 471 bp, A.fumigatus
tctgattgcccgataaagtacaaaattctatcaacaatggcttcgtccctcgccgcgcagctgtcgcagattgcggcaaaatcgacaaaccagctcgatctcaaggctcagagaatagcgcattcgcagtccctgatttttgacaggaaagttgctagcattcaggattttgacacggtctaccaaatatgctacgagggtttccaggagctatgccagctggattcacgattcacagcattcgagcgcacaattttcagcgagcagagcaaggctgaagatcgcacacagctgactgcagctcagaataaggaactcgatgtggccttggaggcttttcttgctctggttggaggacgattactgttgaatcctgctattaaggccgtcgagtggcttgtcagacgtttcaggtgcgaaagcggcaatctcaatgttcaagtactcggtttctcggacgtgtttggctaa

SEQ ID NO: 19452 - DNA, 447 bp, A.fumigatus
tgttcgccgaaggagaaaaagtccatcccgcggtttgccagtttcaagcccccaccagcacctccgcccaaagctgatcggccctccgatcgccgaagtcacgagctcgcccatcgcgacgaaaagtccaagcaccactcgagacatagaagccaccgggatcggtcgcggtctcgagagcgtcgaagagaacggaaggagcatcatccgacccgaagggatgccgaacaacgagatttggagcctacccgcgaacctgtgcgcgcaccgaaaaccatcgtgaaagagggagaagacgaggcgtctgatctgtatgttatcgatcgcaaaggcgacaaatacaacttgatttacgggacattacatcgctataatgttcccctttatcaccgagttcggcgaggaaacgtgcttggtcttcctacaagctaccgaatcgaccgttga

SEQ ID NO: 19453 - DNA, 387 bp, A.fumigatus
gagggacgaggctctgtcggctccgcctttgagcgacccgaagaggaattcacccccggcctttccactagtagcgtacttcggcgaatcgagctgtctgtcctcttcctcctcttcttctccccccaaattattctgatcatcactgtcatcattgcccgtcaagcacgagcattgacttccctttcgtgctcgttcctcctctctcctcactcttccttcttctcccctctttctcttgatcacgtttcctctcaattgtctttttatctatcctcatccccgctaattggtaatgcactttctctttacctcttagcctccacagatcgatacttttcttctccagacattttggatacaatatttggcaaccaatatcattag

SEQ ID NO: 19454 - DNA, 453 bp, A.fumigatus
cgatatttgatgatggcttctcaagtgcagagcagcgacgttaacggtggggccaagtcccttgcggccatgctggaggaggagcatgctcgcaatgaggcgcataaggtgactgtggaggataccgtggacgaagaggatttgctgcatccccctccatcattgggaaaggaccagcagactgttcccgcccaacccacagctgcaatcgaggaagcagtcgccactacaccctcggcttccaatgcggctcctaaaaggtcgcctgcttttgatgtccgctccgaagagctgtttcccgccttgggaagtggtcctaagcccaaagcacctgctgcagcgacctggggtgccaggccctctgccgctgctgctcttgctaacggtgccgctggacgcccacaatcgagtatgtttgtcctgtcgacctttctgtactgcggcttgctctaa

SEQ ID NO: 19455 - DNA, 1206 bp, A.fumigatus
  unsure (975): Identity of nucleotide sequences at the above locations are unknown.
caatcggtccgcattcccatcccaacatccgctcgcgcccacatcattggccgtcaaggtgcaattgtgcaagacattcaacaacggacgggtgcacgcgtccaagtgccccgcgccgatgactcggccgcaaaggatgacgaagacgacaacgacacgatagacgtcctgattgagggcgacgccgttgcggcagagatggcacgccgggagattgaagctatcgtcaaggagcgggcctccaacatgagcctgcgactcaagtcgattccagcggaatttttccccttcattgcgggtgcgcataatgcgaacctgaaagctatcgaggaacgtaccaaggctcaagtgcatgtgcctcggtatgatacatggcagagccagcctcccccgcaggaggctgagcccggacgggtgcagtttgtcccagctcctgataagcacattcagatcactggagagcgcactgctgcacaggaagcccgcgccgaaatcgagaggcttgccgccgatcttcagaggcgactaacccttcggcagttggccatcaaccgcgggcagcaccagttcatcctcggggacggagccaatgctcttcatgacttccttgctgataccggctgtgctatcgtgttaccaccggcatccgatgatagtgaatttctcactattaccggaccgcaggactgcatcgaggctggtatcaatcgtgcaatggagcttgctacgagcatgcaaatggccagcattgacttgtcccgtcaacatcccaatgctccatccggacctcatgcacacgcacgtgccctaacccggtaccttcagcaacgacagatcattcggcaattggagcagatgtacgatgctcgtattgcactccctcctagcgctgacggccctgtgacctgggaggtttactcgcgggacggcaagaatactatccgtgcccggtctgacatcatgaacttggtccangctcaccctcctgcacggcttcgctatgtctctgtcgatccttactaccacccctatcttgagtcccatggtctcggcaagctccggaatgaatatggtgtccatcttctcgttccggatgagctggataactccgatgttgttctcgttcaagaaggaacgtccgccgccaactcgctgcctgaaatcccgcgccagaggccatccccggccgaagtgggttgcctttga

SEQ ID NO: 19456 - DNA, 726 bp, A.fumigatus
gggtggtgcgcgactatgggccccggtactggtcttcgccaggttgcgatctctagatattctttaggattctatccttcatccattatcgctgcgttgaacgtgatcgagcaactcggttgggcatctgtcaactgcatcactggcggtcttgccctcagcgccgtttccgatggccgcgtgtcgattgccgtgggcgtggtcattgttgcgtgtgtcagttttctcttcagtttcgtcggtctcaggggagtcctgatgtatgagcaatacgcgtggatcctattcttcatcattttcatgatcatctacggcgagtctgcacatcgggctaacctagccgctcctgctacagtcaccggcctcaccaggtcaggaaatgctctgaccttgatcggtgtggtgtatggctccagcgcatcctggagctccattgtctcggacttttacgttcattaccctgccaacaccccaaagatcaagatcttcttatacaccactctgggcatcacgattccaacctgtatcggaatgcttcttggtgcctgcatcagctcggctttggatacgaatcctgaatgggctgcggcctacgagaacggcatcggggaaattctcaagacaattatctacccaagaggatttgctagatttctcttggtccttctggttctgtctgggagtatgtgttatttctttagagaactctattccgctccagcatga

SEQ ID NO: 19457 - DNA, 507 bp, A.fumigatus
tatagctctttagttggcgtcaactgtattgctatctactcaggtgcgctgtccgcgcagcttcttgccaagccctttgcaaaactcccacgggcagtctggtcgttcctcgtgttcgtctgcattctccttctcggtatcgctggtcgagaccacctgttagacgttctggagaacttcttgtcactgctgggctactggaacacctctttcttcgtgatcttgttcaccgagcactatctattccgcgggggtagcctgtccaattacgatctcgacgcgtggaatacaccatcaagaatgcctgtcggctatgccggacttactgctttcctttgcggtgccgctggatggatcgtcggaatggtcgaaacctactatgtaggtgctattgcgaagatgataggtcaggatggaggagacgttgccaatgagttagcgttcgtcttcacctcagttacttatatccctctaagaaaactggaactcaaatacgttgggaggtag

SEQ ID NO: 19458 - DNA, 258 bp, A.fumigatus
tcaagtcacagcgcagctgtatctgaagcaatccatagcaaccaggatcgatcaatggatgtccccaaagaccgattgtgccataaatctgctgccagattgatacagattgttctctctctctctgtcttttacttctctttcgctggaaagcctcaatctcttaagggtctctcccaaacattgaagagtaccgcgaatggtatctccgattttcgagggcattatgtggtaggtagcagtttacagcacatgtga

SEQ ID NO: 19459 - DNA, 234 bp, A.fumigatus
gttcacgatactcgccctcaagccgcacggcccaatttcaatgatttgtcctctgtggagaaatatgtccttccctcagccacgtatgagtcacttccaaactcggttctagcctggaaaaaaacccagaaactcggcaggttcgaccccaaggccctgtcaccgaaggagtcgatgcagaagcaggcagagaaagataccgaggatgttcgcgttcggggtaggtcacgataa

SEQ ID NO: 19460 - DNA, 330 bp, A.fumigatus
cttgaaggcccactgttgttctctgtcctcaccttgtccctcaacgaagatctggtacgttataggggatcaagaccatggtcgcttctgaagcctattgtctggttccagtgtagcaataccacttattatcttcacatatctctggcactctacgagaatacctccctcgttttctcttgctcgagcatctggaagattccccatacaagactttatgattctcatggcgttttatcttcgcgttgcctgcaattcgcctgccaccatgtgactgataggcgtgtacatgacttcaattgggattccttcattgtgaatagtatataa

SEQ ID NO: 19461 - DNA, 297 bp, A.fumigatus
tctactttagccacattagtgatggcattccaacccccgccgacagatgtctctgtcatcgtcaccacgcctggtacagcaactggttccgaaccgcgcttcctgacagagcgtcgagtcactccgacatggactgtcctgcagctgaaatctaagttggagacgatgactggcatccccacgaactgtcaacgtctactactgaaggcacccgggcgtgctgatcagtgtgtagatggagatgacagtatcatcggcaactggggtctaacgaagggctgcgagattgaggtatga

SEQ ID NO: 19462 - DNA, 372 bp, A.fumigatus
agattattcagattatttactgaccgagggatggcaggcatcgccgtctcccgacgtgctattatccttccgtcatcgcctccacacgttaggcgaggcacaatacgctatgttgggcctgtgcctacgatacctttccctggagtggacgtcacatctgaagaaacttccgaccttggtccccaacctatctgggtaggaattgaactcgacgagcctactggaaagaacgacggtagcgtaggtggcagacgctattttacttgtcctaacaaaacgggcgtctttgtgaagcccgaaaaggtggaagtcggagactttcccccattagacttgtttgatgacctggacgacgagatggaggaaatatga

SEQ ID NO: 19463 - DNA, 1149 bp, A.fumigatus
ataaatctacctgttcttgaacttatttcttctctagactttgtccctgctgcgaatatgggagaatccggcttgagtgtcgccggtactccagatgcatggacctccgcgggctctttcatccctcccagtatagatcgcgctcgactgctatctggagagtcctacgcttactattctccatttcctctcgcaagtacaggaaggtcttcgcaggtcactggtgacaatcatacaatcacagcagatttttccacgccatccacatcctcgtcaccaagctattttgtactgggtgtcgacgaagcgggacgtggtccagttttgggccccatggtatacagtgccttttatattccgcatactctccatcactccctcctggctcgcgactatagcttcaacgatagtaaagttctcactcctggtgtgcgcgcgaacttgatgcggctgctctgcaccgctggaaatcctctccatgcatcatgtgggtgggcgaccaaggtcttatctgcgcgagatatctctgcaggcatgatgcggcctacatctggtgcatataatttgaacgcacaggcgatggatgccactgttgaaataatacgcggcattgtggaggagcgcagagtagacattagagaggtctacattgacacaatcgggaatccagcgacctatcaacagaaactggaacgtattttccctacattgaagatcacagtcgcgaagaaagccgacgctctatacccttgcgtaagcgctgcaagtgtggtcgccaaagtcacgagagacatggcactggagttctgtcacgaagccgtatacggactacagcgatatgaagcgccatcgatggaggtggccacagacagctggggaagcgggtatccctcagattccaagtgcgtcagctggctcagaaaccatatggaccccattttcggatggggcaacgagtgccgatttagctggggaactgcaaaagaaatgcttgaactcaagggaggaactagagtcgattggccggtcgaagaggagggcgctgcaccgatcaaagactttctacttaccaccgcaagaaatgcaaagagaactgaacaggatgagttgcgggaatggtttggtcgccgatcaacggaggttctttga

SEQ ID NO: 19464 - DNA, 192 bp, A.fumigatus
gcagtccattctggcgttcagctcctttcgctctatcatgatagcttcgtctccccgggtcattgcgagacttccttcaacagttccgcggccggctccaacacctcattctcgatatacaaaatattggatatctcattcggctctttatcatcaggtggctcttacgcttcagatggtacgatacactga

SEQ ID NO: 19465 - DNA, 243 bp, A.fumigatus
agctgggaggtaagtaatgcaggggcatatctcctgaggaatcctccgtcatttcggcaagggaaccctgaccatggcacgggatgtagacgaacgggagtcaccttaaaagaaggcaagcgcgacgagcatggaatggaggagattgatgggattttctcgtctcccgaaaagtcacccgaagcatatggcaacaacacaacgattgggtccgatggaatgtccatggatgaaggtgtgtga

SEQ ID NO: 19466 - DNA, 1287 bp, A.fumigatus
tctacttcttccgatttgtccccgaccatgctgatcttgtgcctggtcacaggcaacgggctggggcccgctgacttcttgggtggaacgaacggagggcgcgcatccttcctcccgccgccggttgcgcgatctcctatgaaatccggcttgagtggatcaccccggcggactcccggcttgcgatcttctgcaagcccgcaacgtgacattctctcttccagtccatcagatggtaagggacttgggagtgctaagggcgaaacacggcgtgatgtatcccctcttaccaaccgttccatcaatgcgccctctctaaaccatgtcaatggcctgcggaataataaaggaatcaacaagacggcagacaccacggtcacagttgacttttcagacagtgacgctaatagtcaaatgaacggagacgaaaatgcgaatgcatttgagcatatgcgaaacgattatgacgacattaccgacgctggcgacgacactttggcggaagatcaacaggatgattctgagcgcgttaatcgtgtcgacattggtatttcgtcgtacacagctgccggttcgcgcaaaacagagcgatcaagaatcgccccaaagactaaaaaacttgcacaaactgagaaaactgggtcccaagatgtcactcagaaaagtgagacgagcgagcaaggaaatgtacagaaacgaaagcgccctgggagacccccaaaatcgcaaaagatgaacaatgatgaagatgataccgtgggacaacgaccttccaagaaatcaaagactgccagtcagactgggcaggggttgaagagctctggaaatccaatgttagacaaagttgtggaaaattatgtcaatcgtacgggacctctaaagggtcggagcctatacatactaaagcgggaaatacccactgatggcagcgcaacccacactcgttcggggcgagtgtctgttagaccgcttgcctactggaaaaatgagaggtgcgtttatggagacggcgaggccgccgaaggccatcgctatccgctttcgactatcaaagagatcatccgaacagaggagctggaaccggagaagaggaaagtcagtaaacggcggtcatccaagaaatctaagtcgcggaagggtcgagacgatgattcggacaatgaagacgacgattacgtcgatccatgggagaaagaaggcggcgtcttgcatggttatgttaggaaatgggatccagatacccaagccggttctatcgaagaggaggtcctcggtaagtacttgtga

SEQ ID NO: 19467 - DNA, 933 bp, A.fumigatus
  unsure (41): Identity of nucleotide sequences at the above locations are unknown.
agcatcttagcaaatatccatatgctcacaatcttcttctntgagcagtccattctggcgttcagctcctttcgctctatcatgatagcttcgtctccccgggtcattgcgagacttccttcaacagttccgcggccggctccaacacctcattctcgatatacaaaatattggatatctcattcggctctttatcatcaggtggctcttacgcttcagatggtacgatacactgaattgctctgggagatgatcgcgcgacgtcgaggtgaaaaagtacgctggcgcgtcgttgttctcatcgagatcatcaaagcgacatgtcgcttgcttctactgcgcctcacaaattctaggccactggtcagcccaccgttacctgagcgcgaggtagatcctaggtctacggaggaagaagcaagtgattggaatgggatgcagacacccgtcagtgagcggtccgcggacttgagctggactatgccgcgcactggattatcgcttccttctctacccgatgccaacgacatttccaacttcctcatatcaaaagtcttaacagctgatgatatcaagccgccgaagtcgctgttgcaccgtgtcagtggtcagggccaattggcagaagtgctgcacatcctgcggccggtcatctatgcactagcgctacaaagatggcggcaggacaagagaagctggaggccctggttgatcgggtttgctatggagtatggttgtcgtcagcttgccaaatccgatttccgcgagcgggtagcaggtggccttcgtggcctcacagggcttgaacgggaggaactgagaaagcgaggctgggctatgggatggtggcttatgcgcagtgcattctatgagaacattaccaagtatgcaatccctggcctttcatttggggtgaaggaaacgacgagctaa

SEQ ID NO: 19468 - DNA, 336 bp, A.fumigatus
cccagggtaattgtagatatcgcctatgctccgtccggtatcgagacgagagatgtcaaagactctaccttccgctttgctaagctgctgagctccccattcatcggctctggaatcgtcgaactgccgccagggggtgtcaagaaacccaagaattcaaaaaagatgcacatggtcttctacgtgtgtcacggacgggtccaggtagatatatctggtgtgcaattcagcgccggaaagggctgtgtatttcaagtgccaagaggtaaggagcctcttcagggcgtgctcgccttgtgtctagctcctttgcagttcattgcgcatgctgattag

SEQ ID NO: 19469 - DNA, 348 bp, A.fumigatus
ggttgccatcattgcgcggaggattcggggattgggacctatgcaaagtctcagaatcttgacggcaatgcttcatcagaacaaggccaacctacctctgcggtccttcctcacctcggtaatctcctccatctcaccactgggaagggcaagctgggtgttacggatcttttcgtctcgttcacttatctccaatcgtctgagctcgcgaagatcatcgtcactgtctcgagggcgcacgacgatggcaagagggccggtatccctcttgtcaaaatcgacctgatcatcatatcgctccaccatccgtactggagaggagagtccgcgacggcgcccatggactga

SEQ ID NO: 19470 - DNA, 1320 bp, A.fumigatus
cctctattggtggtactgcaaacaagacatgatccaggccttcatcgggggcggcggacttatgttagtgactgccctctttcgatcattggccatttaacatgctcatcgtcaactagattacctttttcccgttggggccagtgcccaccacgagccggtatcggccgtttggacgctgtctacggctcagcggaccatctatggctactgctcgcccggctcactgatttcgggtaccgagacagaaaacgaaagttgcatgtagctagaaccactggtcaagattggagaccaggcccgagtcttcacaaattcatgtctcgctttgccaagggcagtgcgaccgtaccaagagggcctcctccgggatctgcgcaaaaccgtgggccggaacctaaccgccagtcacccgtggatggtcccagtgcagggagagaaaattcacctcccatgtatggcatggttccaccgagaggaccgacacgtctcccttcggcgtttgctagcacagcacatcgaagcctgtcgccgggtaaggatgaagagggagatgtcatgtcatataaagatgcagagagcgaatgggaagatattcgggctgcctttgataccttcgccggtgccctcggtccagatttccttcctctgccagctgacactatccctcctatagcgacccctttcgggccagcgctacagtatcgtacgcatacggttgcggtgttgtggggattttactatgcaggccgaattctattgcacagactgcatccatcaatgccacccgccatgatggttgctgcaggcgtggcagcgcccacgactgctgattacgctcagattatcgggaaagtggccgctggtatatatttcccccagtggttcaacgtggaggcggggaaattgagccctaccttgggggcctgcttgattgagatgactgtgcctattttctttgcagccgttcagttcgttgacgctgcccagcgcagctggactatttcgaagctacgggatgtctcacgcttaactggctggaaatcgtctgaagctatagcccttggctgcgaaaacgcatgggccgtcgccgcaaagcaagggcgcggtcctccgtatgagcgcacgcaagagaatctccgcaaacgacccaaggaggacccttcacccaatgaaggcgtcagtgaagaacaccatgcaggcgtcaacacagagaggagactcgttactattagtaaatcgatgcatgttcactgggcaatggggctcttgagcctggaagacgacgtcctgatcatggaaacagacgaccggagatag

SEQ ID NO: 19471 - DNA, 675 bp, A.fumigatus
cccttcctgctgtacagttcacagtactccaacgaggcctacgactacccgcccaacatccgcgaatccttcaatgacctaggccgcactatcagcgaaaaggtccagcttctgtcgcaggcttcttctcctgccgaggcccaggcggccctggtcgctcctccatcggccaaaccgcagcccaagacgtttaaccatgccatcgcgcgcgcctctctggctggatctcagaccctggcacaggtccatcccggcgaggacccgctggcgaccgcgctcgagaagtacgcgctcgcttccgagaaggtgggcgaggcccgtctggcgcaggacgctcagatccagtcgcgcttcctggctggctggaacaccaccctgaacaccaacctgatgtttgcggccaaggcgcgcaagaacgtggagaatgcccggctcatgctcgactcgatcaaggccaggaggaaggcggctgccggcggtgatctggacaacctgagcgaggaggcgcgtgcggagattgagcaggcggaggatgaatttgtcggccagactgaggaggccgtgagcgtgatgaagaatgtatgtttcgttcctcatctgcatgagagtacacccgcactcacacggtctaggtccttgacacccctgagcctctgcggaacttggcagacttga

SEQ ID NO: 19472 - DNA, 1551 bp, A.fumigatus
  unsure (8): Identity of nucleotide sequences at the above locations are unknown.
ttgcaccnccgcggatcctttcagccccgtggtgaagaccaagaaactaacatagatacattgcaacctcgaccgcagcagtatgaatctgcacgtcttgtcgccgttcccagcgcacctggaacattgccgtatggatttccgcagctccaactggatatccaaaatcacgactatttgcgacatggaacgagtgcgccaacttacaatgtcgttccggcaagagatcagcagtttccgccccagcaggcttcagcgtggcctgaacctccagtgccggtcatgaatccgcaagggacgtcgatggatcccaccccagcatttgcaactgcaccaattcctcaggtatgtgaccacatcttaatcgggcttgtcacttcctactcaacgttgtaccagaagtttcatcaagctggcccagcaaccactaccgcgttcgcttccggtacgcgacaggaacaacaaccagtgcatgagcctaccgccatcccgctgatgacatcttcaaaggaattcatctacgtggacgacgaaagcgaagagtactatgatgtcgaatctgatgaagaaatggaggagcaaacatcggccgaggacttcaaccaactcagcctcattgtggcctctgctaatcaagatgaacggcagctgcggtctttcacgacctacctgaacgaacccaacatgcttgcttcttatcaccccactcttggctcgtctcccttgaataatccaaaaacagctcgaatatttgtccacttcatccattcaactgggccatctttatcaatcttcgagcgacatcctgcagattctgcacacacgcttggctcacctgtgccagcagctcagcaaggcctgtggacacatacaatgcctctcaaggcattagagcaccaagcattgcttcaagccatacttgctctcagcagcttacatatctcgtatctgcaacaagctcctccgactgtttcgttgaagcactatcattatgcgctcaagagagtcggccatgcggtaggtctgccccaaaggcgcaaacaggttggcaccctggctgctactctcctgttggcatattacgaagtgatgacagccgagcattcgaagtggaacagccatgtcgcaggatcagcccagttggtacgtgagattgacttcgccaccctcacgcgtgatattcgatctcaccggcggagggtgtgggctcaacggcagcgactgttggaagcccaatcggcttatgccggttactatgcgtttgacgaagagtttttggagatgacctatttgctgaaaaaaaaaagcagcattgatgagaatttcataggttctcttctgggtcgagcggttaattttgatcagtttggccaggtagaggatggacgtactcgccagcgagaaagacatttcacccggaaagacattgagacctacagaatccattgtgacctctattggtggtactgcaaacaagacatgatccaggccttcatcgggggcggcggacttatgttagtgactgccctctttcgatcattggccatttaa

SEQ ID NO: 19473 - DNA, 183 bp, A.fumigatus
catgacggtgtcatttcccacagtgcgagcttcaccccctttgctgcgcgcacacagcagttgatcaaggagcagttgggtcaggctgaagacaagacccaactccctgatgaatacatcgagctcgagaagcgcgtggatgcgctgaagctggtacaccagaagctgctccaggtgacgtag

SEQ ID NO: 19474 - DNA, 720 bp, A.fumigatus
aaattggctgacgatcttccatttgctgatcacaggaagtctaatcgactcgaattctactctcccacgccagatggattggatcttgtggcctcgtgcgccatctatgcgaaggtgacaatgctggctcgccttccggctccggctaattcccctacggaccatctattcgtcggcaccgatcgatacacctacttcacattatcttgggacagttcagaaaagcgagtccgcacggaacgtgactatgtcgacatgtcggatccatcatcgcgggagtcgcaaacgggaaaccgatgcttgatcgacccaagcggacggttcatgaccttggaaatatatgaaggtgttattgcagtcataccgattattcaactaccaagcaagaaaagaaggagggctgtggccttgccctcaggcccggatgctcctcgggtgggggagttgggcgagccgacaacagcaagaattgaggagttgttcgtccgctcgtcggcgttcttgcatgtgcaagaaggccttccgcgcctggctctactgtacgaagataaccagaagaaagtcagactgagggtgagggaattacaataccatgcggcgaccgggagcaacagcactgccgacgctacattcggggaaccggcggactttacccaagacctggaactcgggtcttcccacctgatcccagtgcctgctcctttaggtaacttaccataa

SEQ ID NO: 19475 - DNA, 801 bp, A.fumigatus
  unsure (776): Identity of nucleotide sequences at the above locations are unknown.
acaggtgggcttctcatcctcggggaaatgtcaatcaagtacgtcgacgcagataataacgaaattatatcccgtcccttggatgaagcgaccattttcgtggcctgggaacaggtggatagccagcgatggctacttgctgacgattatgggaggctcttctttctaatgttggtcttggactctgacagccaagtcgagagctggaagttagaccatctgggcaatacatcccgtgcatccgtcttagtgtaccttggcggtggtatcctgttcctgggttcgcatcagggggactctcaagtgctgcgcatcagcaatggaccattggaagtggtacaaaccctatcaaacatagcgccgatattggatttcacgataatggatcttggcaaccgctcgagtgaaagtcagacccacgaattttcgtcaggccaagcaaggattgtcactggctccggcgcctttgacgacggaacactcaggagcgtccgcagcggagttggaatggaggagctgggtgtccttggtgacatggatcatatcacagacctgtggggcttacaggtaggaagcagcggcgatttcttggacacacttttggtcacttttgtcgatgaaaccagagtattccgtttcagttccgacggcgaggtggaagagatggaccattttcttgggttgagcctttcagaaagcactcttctggcgaccaatctgcccggtgggcgaatattgcaggtcactgagcagagggtcctcattgcaaaaaatangggccggaatgtaattctcgaatga

SEQ ID NO: 19476 - DNA, 1215 bp, A.fumigatus
actccaccgacccagttcattataactgccgcttctgccaacgatgattccatcgttcttgttgcaggcggcgagcttgtgacagtcttgaatattaccaacgaagtccaggtcgtaacgcagaaggactttggggcagatagtcagatttctggtgtcacagtaccctcatccccgactggggtctgcattgccggatttccccagctggcaaaagtttcagtactaaagcttcaggatctgtccgagcttcatacgacgtcagtgggcatggctggtgaagcttttcctcgttcggttctcgtggcgaatgtgctcacagacagcccgcctactctctttgtttctatggcggatggcagtgtgatcacttactcatttaacacgaataacttctcattgactggaatgaccaagctaatattgggctctgagcaacctactttcaagaaattaccaagaggctctggcttgttcaacgtcttcgctacatgcgagaaccctagcatgatctacggctcagaagggcggattatatactctgcagtgaactccgaaggcgcctcccggatatgccattttaactcggaggcctatccagagtcgatagcagtcgcaacatctcatgacttgaaaatcgctctggtggacaaggaaagaacaacacaaatccaaacgcttccaatcggggcaacggtcagacgtgtagcatactcgccttctgagaaggctttcggtattggtaccatcgagcggaagcttgtcgacggaactgagatcgtcaaaagcagatttgtgcttgctgacgagatattgttccgtcgccttgacgctttcgagttgcggcctgaggagttagtggaaagcgtcatccgtgcggagttcccggcgggcaaaggtgcaaatgacagagatgaggtcaaagatcgattcattgttgggacagcgtacttggacgatgaaggagacgagtcaatccgtggtcgtatcctgatctttgaggttgacaatggccgaaaactgactcaggttgctgagctacccgtcaaaggagcttgccgagcattggccatgctaggagacaaaatagtggctgcactcgtcaagactgtaagcgttcattctccactggtctaccttcttctacgctaccctactaacgctccaccaaggtcgtcgtatataaggtcatcaacaacaatttcggcgccatga

SEQ ID NO: 19477 - DNA, 270 bp, A.fumigatus
gaatcatatggctctctcgtaaatatttcatcggtctcattgcacaaggaaattgtgagaagcctgcttcgggatgttcttttactttacaaggatggttcggtggttgagcctatatattccctcgctgctttggagtacggagtacattatattgctccatcctcctacgtagatggaatcggacccttaatcttaagttatctctctatcgttatcaaatcagccaaacaaaacatgactctctgttgcctaggaggaagccaatga

SEQ ID NO: 19478 - DNA, 1881 bp, A.fumigatus
ggacaagtctgcttatttgaacgacaacaatccaacatggcgcaacttgacacgctcgatattgttgtcctggtagtgctcttggtgggtagcgttgcctacttcaccaagggctcctactgggccgttcctaaagacccctatgccgcagcgaattccgcaatgaatggcgccgccaaaacaggtaaaactcgggacatcatccaaaagatggaagaaaccgggaagaattgtgttattttctacggttctcagactggaactgccgaagattacgcgtcccggctagcaaaggaaggttcccagcgtttcggcttgaagaccatggtcgctgatctcgaagattacgactatgaaaatcttgataagttccccgaggataagatcgctttctttgttttggctacctacggtgagggcgagccaaccgataacgccgtcgagttttaccagtttatcaccggtgaggacgtcgctttcgagagtggtgcctccgctgaggaaaagccactctcctccctcaagtatgttgctttcggccttggtaacaacacctacgagcactacaatgctatggttcgccacgtcgatgctgctcttacaaagcttggtgcgcaacgcatcggaaccgctggtgagggtgatgacggcgctggtacaatggaggaggacttcttggcatggaaggagcccatgtgggccgcgctgtcggaatctatgaacctgcaagagcgcgaggctgtctatgaacctgttttctctgtgattgaagatgaatctttgagccccgaggacgatagcgtctaccttggcgagccgactcagggtcatctcagcggcagccccaagggtccctactcggcacacaatccttacatcgctcccatcgttgagtcccgtgaattgtttacggccaaggatcgtaattgccttcacatggagatcggcattgctggcagtaacctcacttatcagactggtgaccacatcgctatctggcctaccaacgcgggtgttgaagtcgatcgtttcctcgaggtctttggcattgaaaagaatcgccatacagttattaacatcaaaggtcttgatgtcactgccaaggttcccattccgaccccaaccacatacgacgcggccgttcgcttctacatggaaatttgcgcacctgtttcgcgtcagttcgtgtcctctttggtgccattcgcccccgacgaagaaagcaaagccgagatcgtgcgccttggtaatgataaggattactttcacgagaagatcagcaaccaatgcttcaacatcgctcaggctcttcagaatatcacctcgaagccgttctctgctgtcccgtgttcgctccttatcgaaggcctcaacaggcttcagcctcgttactactccatctcgtcttcctcccttgttcaaaaggataagattagtatcacagctgtcgttgaatctgtccgcttgcctggtgcgtcccatatcgtcaagggcgtgaccacgaattacctactcgccctcaagcagaagcagaacggtgatccctcacccgatccccatggtttgacatatgctattactggtcctcgcaacaagtacgatggaattcacgtcccagtccatgttcgccactccaatttcaagttgccttctgatccttccaaacccatcatcatggtcggacccggtactggcgttgcgcctttccgtggcttcatccaggaacgagctgctctggctgaaagtggcaaggacgttggacctacgattctgttctttggttgccgtaatagaaatgaggacttcttgtacaaggaggagtggaaggtatgtttgcagtcttcttatgagcacattcggagccgtttgtctgactcttaa

SEQ ID NO: 19479 - DNA, 297 bp, A.fumigatus
gtctatcaagagaaacttggagacaagctcaagatcatcactgccttctctcgtgagaccgccaagaaagtatacgtccagcaccgactgcaagagcatgccgaccttgttagcgatctcctcaagcagaaggctaccttttacgtctgtggagatgcagccaacatggctcgggaagtcaatcttgtccttggtcaaatcattgccaagtctcgtggcttgcccgctgagaagggtgaggaaatggtgaagcacatgcggagcagcggcagctaccaggaggatgtctggtcgtga

SEQ ID NO: 19480 - DNA, 192 bp, A.fumigatus
cacatgttgagagggaaaaaattcaggagatcgttgatatcacgaataggttctaggttgtacgttcaagtcaatactcttatgctttttagtaggttgttgcatgagactgttctagtttcccgcatgatacaactctacttctatttctacagactactcggtatacccaaggaagaagacatctgctga

SEQ ID NO: 19481 - DNA, 189 bp, A.fumigatus
gtgttctttcgcgtcctcaccgaggctgtatcctttaaatttctcccttctgtgttcctcatcacgagtgagcagatcttcactgctcaatttttttttaccttaggatcgcccgccactatcaccagagccgtcccccggaagtccggcgagtatcccccgagaggccacgcttactcgaattgttaa

SEQ ID NO: 19482 - DNA, 585 bp, A.fumigatus
cgctccaccaaggtcgtcgtatataaggtcatcaacaacaatttcggcgccatgagactggagaagctggccagttataggacctcaactgcaccagtggacgtaacggtgacgggcaatttgatcgccgtctctgatcttatgaagagcatgtgcctcgtggagtataaggagggcgagaacggcacgccagatacaatgacagaagttgcgcgccactttcagactgtatgggccactggtgttgccaacattgcaccggatactttcctggagagtgacgccgaaggtaatttgattgtccttcatcgtaacaccactggagttgaggaggatgataagcgtcgcttggaagtgacgggtgaaatctcgctgggtgagatggtcaaccgcatcagaccggtcaatatccaacaattggctagtgtggctgttactccacgagcattcttaggcactgtgagtttctctcttttccttctcacgaattctgcgagaccgactgaccgaaccaatcacgaccacaggtggaaggttctatttacctatttgctatcatcaatcccgatcaccaggacttcttga

SEQ ID NO: 19483 - DNA, 279 bp, A.fumigatus
  unsure (194): Identity of nucleotide sequences at the above locations are unknown.
gggtactgtgacaccagaaatctgactatctgccccaaagtccttctgcgttacgacctggacttcgttggtaatattcaagactgtcacaagctcgccgcctgcaacaagaacgatggaatcatcgttggcagaagcggcagttataatgaactgggtcggtggagttcattcgagaattacattccggcccntattttttgcaatgaggaccctctgctcagtgacctgcaatattcgcccaccgggcagattggtcgccagaagagtgctttctga

SEQ ID NO: 19484 - DNA, 591 bp, A.fumigatus
tcattaccatccaccatggcgacctccgaatcctcctccgtcgtatccgacgccctaaacgacttcttcagccaactctacaccttcatcgaaacagttttcagacgcttcttcaagaatctgtacagatcattcgttgaaatgagcgccaagcgctggacgaaaatcatcgtcattgtcgttgtttacatcctcatccgtccttacatcgaagcttggttccgcaaaatggccgaaaaagaccgcaagaagcaattggagaaggaaaaggcagagcgggaagccaagagaaagaataaggccaagatttcagctaatgcactgcgtggtggcgccaccggtggcggcaaagtgctaggcgaggttgagaatacggacgatgagatcgagagcggcgaggactttgctaccgccagtggtgtgccagagtgggggaagaacgcaagaaagcgccagaagaagtatatgaaggagctgcagcgggaagcggagcagcggacggataaactgtccgatgagcagctccttgaattgcttgattggagtgaatcagaggatgagaagaagcaggaggaaacgaaagaggagtga

SEQ ID NO: 19485 - DNA, 258 bp, A.fumigatus
atcagccttggatcaagtgcagaagatacagcaataataagctgcatcgcttttcaggttaatgatactgatgctcgaatgctggcttggctggtgatgcaggaagatggaaaagctcacttgagctactacttaagctgccagggtcattattgggtccgaacgtcgacctacggaatgacgattacttgcgggttccaattaattcctgaatttttattatctccgactctagggccgatccgcacacttcagtaa

SEQ ID NO: 19486 - DNA, 1224 bp, A.fumigatus
gtaattcgtggtcacgcccttgacgatatgggacgcaccaggcaagcggacagattcaacgacagctgtgatactaatcttatccttttgaacaagggaggaagacgagatggagtagtaacgaggctgaagcctgttgaggccttcgataaggagcgaacacgggacagcagagaacggcttcgaggtgatattctgaagagcctgagcgatgttgaagcattggttgctgatcttctcgtgaaagtaatccttatcattaccaaggcgcacgatctcggctttgctttcttcgtcgggggcgaatggcaccaaagaggacacgaactgacgcgaaacaggtgcgcaaatttccatgtagaagcgaacggccgcgtcgtatgtggttggggtcggaatgggaaccttggcagtgacatcaagacctttgatgttaataactgtatggcgattcttttcaatgccaaagacctcgaggaaacgatcgacttcaacacccgcgttggtaggccagatagcgatgtggtcaccagtctgataagtgaggttactgccagcaatgccgatctccatgtgaaggcaattacgatccttggccgtaaacaattcacgggactcaacgatgggagcgatgtaaggattgtgtgccgagtagggacccttggggctgccgctgagatgaccctgagtcggctcgccaaggtagacgctatcgtcctcggggctcaaagattcatcttcaatcacagagaaaacaggttcatagacagcctcgcgctcttgcaggttcatagattccgacagcgcggcccacatgggctccttccatgccaagaagtcctcctccattgtaccagcgccgtcatcaccctcaccagcggttccgatgcgttgcgcaccaagctttgtaagagcagcatcgacgtggcgaaccatagcattgtagtgctcgtaggtgttgttaccaaggccgaaagcaacatacttgagggaggagagtggcttttcctcagcggaggcaccactctcgaaagcgacgtcctcaccggtgataaactggtaaaactcgacggcgttatcggttggctcgccctcaccgtaggtagccaaaacaaagaaagcgatcttatcctcggggaacttatcaagattttcatagtcgtaatcttcgagatcagcgaccatggtcttcaagccgaaacgctgggaaccttcctttgctag

SEQ ID NO: 19487 - DNA, 702 bp, A.fumigatus
agctatcgatcgccaaccgaacatttatcctatcccaagtccccaacctcacatcttaccgggggattttggcttggcttattacatttcaacatgtccgccacaacagcagccaccgacctggtgagcaagctccctctccgcctacgcaatttcttcgcccgctatcctccgcaaatctactccgcggccgtacgccctccgatcactgaacccgaaactgcggccgaggaatcccttccatcgccatacacgcccaacagagacgcaaagggcttcaaaaagcccgacccaaaagccttctccccgtccaaagcgctcctctactccaacccggaacatcccaaccctttcctccctcgcaagaacttccgcaatggcaagtggatcggcccgcccatcgggctgaggagacaggcggagctggtcaagttggctatcaagtataatgtggaggctttgctgccgcctgggcgcaagtcgaccgagtataaggagacaagacgggcggagcgcggactggcgatcaagggtaccggtgttggacagaaggtcaagggtcacaaatgggagcggacgatggaagctcgtttggaggacagacgcaaggctatgatggagatgccggagatgatccggttgtggaagcaggtaagcattcagttgatgtttgagtgtccggttggaatgtgtcgaggctaa

SEQ ID NO: 19488 - DNA, 744 bp, A.fumigatus
ggggtttggatagtgaagcggagtttgttcgtagggaaggagattttgaccggtgtcgtaaccttgagagccgcctggatattcgagaacagccagacaaaggatgctcttatggccttccagcgctcgcttgttagtagcaaggcacaggagctcggctgggaattctctgacaaggacggccatattctgcaacagttcaaggctcttatgttcggtagcgcaggaatggccgaagatcctgttgtcgtcaaggccgctcaggacatgttccagcgatttgctggtggtgacctgggtgccatccaccctaacatccgcggtagtgtcttctccatcgtcctcaaacacggcggagagaaggaatacaatgtcgtactggaccgtttccgcaacgctcctacctctgatgagaagacaaccgcgctgcgctgcctcggttctgccgaagatcccgctctgattcagcgtactctgggcctggccagcagtgatgaggttaagaaccaggatatctacatgcctctcggaggactccgtggctcgcctgctgccattgaagcccgttgggactggatgaagacgaactgggacgccctttacaagcgtctgccccctgcacttggtatgctgggcacagttgttcagctctgcactgctagcttctgcaccgaggagcagttgaaggatgtgcagacattctttgagaacaaggataccaaggtgagttttgacgcctgttag

SEQ ID NO: 19489 - DNA, 810 bp, A.fumigatus
atagaaaagtctgcataccatatcctcctaataattctgagacgggaagaaagcaaaaatggggggggaatggacatacatgacgtctgcatcctcgttgccgaggaaagtgatagccacaccactcttacctgcacgaccggtacgaccgatacgatgcgtgtagctctcgatggagttggccatattgaagttgacgacgagactgacgtcggggacgtcgataccacgacctgcgagatccgtggcgacaaggacgtccgtcgagccgttacgcacggaggcaagcgcagcttcacgctgttcctgggtcttgcttccgtgcagggtaacggaggagaagcccatttgtttgatctcacgggcgatggcgtcgcagttgcgcttgatgttgacgaagacgatgatcgggggtcggaactcgcccgaggagaggatgtcggcgagccgtttcttgcgtttgtcttcaccggcgatcatctcgacgcgctgctcgacggtgtcgaccgcctcgccggcgctgccgatcgtcacgatggcgggccggcggaggtatttgcgggcgatgcgctcgacggccgagggcatggtggccgtgtacatcattgtctggcggtagcggtgactcctcatggcggcggagttctcggcttcttccgtgtcgggcttctcgttggtgacgggaagggcgtcgaggattttgttcacgggctcctcgaagccgagatcgatcatccggtcagcttcgtccatgatgacgtagcagcactggctaagcacgaggagacggcgctcaatgcagtcaactag

SEQ ID NO: 19490 - DNA, 285 bp, A.fumigatus
gaaattccacagcccggggtgcggctaagccacatcagtttaggcttggcagcgagaaaaggcggcagatgtgtggctggtgagagtggcttcttcctcaacttggtgaagttctacctgtgtctctcccgcaaccgtctcacttgtgttattcaggagtctttgtctcctccgttcattgcattccctctttctcaagtctctccatttatcgcgtattactccttctcgcctgtccttgcgctgcttgcacctttgagtgattgccattatggcggactttaa

SEQ ID NO: 19491 - DNA, 243 bp, A.fumigatus
ctaacagatgtacatctcaggccgatgaccctgacaacttcgagacgtgggagaagcttgttcgcgctgccgaggcgctggaaggtggaatcaatcgcaactccaatccgccaggccataacaactgtcagaaacgtctacgatcggttcttggctaaatttcccttgttgttcggatactggaagaaatatgccgacctagagttctccatcacgggtacagaagcagcggacatggtatga

SEQ ID NO: 19492 - DNA, 1488 bp, A.fumigatus
tgtttgccatccttgccatcccccctttccgtataccctcctttaccccgtttctgctcaaacaatgtgctagttgctggggctaacatacttttctgcaggttgttcgagcgaggagctagcagcgtcggattagatttcctggcgcatcccttctgggataaatatatcgagttcgaagaacgagtcgaagctcctgaaaagatttttgccattcttggccgcgttattcacattccaatgcatcaatatgctcggtacttcgaaagatatcgccagcttgcgcaaactcgtccattatcagaattggcgcctgcggagactttgtctcaattccgcgccgagcttgaagcagccgctggccagataccccccggcgcaaaggcagaagcagaaatcgagagggatctccggctccgtgtcgacgcttaccatcttgaaattttctcaaagacacagacagagaccaccaagcgatggacctacgagtcggagattaaacgcccatatttccatgtcacagagctggacgaaggtcagctaaccaactggaaaaagtacctggatttcgaagaggcagagggatcatatcctcgaattcagttcttatacgagcggtgtctcgtgacatgcgctcattacgacgagttctggcagcgctatgcgagatggatgtctgcccagcctggcaaggaggaagaggtgcggaatatctatcaacgtgcaagctgcttctatgttcccattgcaaaccccgccacgcgccttcagtacgcatattttgaagaaatgagcggccgggtggacgttgctaaggatatccacgatgcgatacttgccaccctaccaaaccacgtggagactattatctccttggctaacatgtgtcgtcgtcatggtggccttgaggctgcgattgaagtatacaagaatcagttggattcacctcagtgcgacctggctaccaaggctgctcttgttgccgagtgggctcgcctcctatggaagattaagggctcagccgaggatgcgcgtcaagtcttccagaagaatcagcagtactacctggacagccgtccattctggaacagctatctcatgtttgagttagaccagcccacgagtgctgctacagagaacgtccaatacgaacggatcaagcaggtggttaatgacattcgttctaagagtgccctttctcccgacgtcgtgagagacctcgttcagatctatatggtctacttgcttgaacggggaaccaaggacgcggcgaaggagtacatgactcttgatcgcgaggtccatggtcctgcctctgtggctcataccaagactggaggcgcagtgcaagccccgcagaacagcagtcaggcggcacctgtggctactgttgtggacccaacagttgctgccgccggcgctgctcctcaaaccagcccatatccttactatcaacaaactccggtcaatggtggtgtaagtgcttag

SEQ ID NO: 19493 - DNA, 2010 bp, A.fumigatus
cttactgcgcagccgaaattcttatccaaagctgagcgcgagcggattgctctagagaagcgcgccaaggaggtggaagcagggcgacgattgaaattggacccattcaccgacggtacagaccgaagcgggacgcaatcaccgtcagtttaccccgagactcccaacggcgatgagaggtcgatacctaccggcccccgagcgatgcgaaactcagaagtcccgaccggcccggccgcgatgcgcaacaagacttacgacatgtcgccgccgcctccgccaaaagctatgtcgtttagtctgacggatgggaaaggagacagcaagcgccaggcggaggaggacgaggcggcggcccaagctgccttgatcaagcaaaagtacatgggaacggagaagacgtcgagtttctcagcgaagaagaagcgcaagaggacgactgatcggaagttcaatttcgagtggaacgcggaggaagatacgagcggggactataacccgttgtatcaacagcggcatgaggccaacttctacgggcgtggccggttggctggtttcggagacgacgtggccgatacgttagcgcagaagtatgccagggctctggaagaccgcgatcgggaagctggaagcatccgagcgcgagagatactggagatggagcggagacgaagggaggagagtacgcggaaccagctcgacaaacactggagcgagaagaagttggaacacatgcgcgagagggactggcgtatctttaaagaagatttcaacatcagtaccaagggcggtagtgtgccgaatcccatgcggtcatgggaggaatctggccttcccaagcggctcctggagcttgtggaccaggttggctacaaggagcccacaccgattcagagagctgctatccctatcgctctgcaatcacgagacctgattggtgttgccgttacaggttctgggaaaaccgcgtcattcttgctcccgctgctggtatacatctcagagctgccccggattgacgaattcgaatggaggaagaacgacggtccatacgccatcgtcctagctcctacccgagaactggcacagcaaatcgagatcgaagccaggaagttcacacaaccactcgggttcaacgtcgtcagtatcgtcggtggtcactctttcgaagaacaagcgtacagtctccgaaacggcgcggagatcatcatcgcgacgccaggccgtctagttgactgcattgagcgccgtctcctcgtgcttagccagtgctgctacgtcatcatggacgaagctgaccggatgatcgatctcggcttcgaggagcccgtgaacaaaatcctcgacgcccttcccgtcaccaacgagaagcccgacacggaagaagccgagaactccgccgccatgaggagtcaccgctaccgccagacaatgatgtacacggccaccatgccctcggccgtcgagcgcatcgcccgcaaatacctccgccggcccgccatcgtgacgatcggcagcgccggcgaggcggtcgacaccgtcgagcagcgcgtcgagatgatcgccggtgaagacaaacgcaagaaacggctcgccgacatcctctcctcgggcgagttccgacccccgatcatcgtcttcgtcaacatcaagcgcaactgcgacgccatcgcccgtgagatcaaacaaatgggcttctcctccgttaccctgcacggaagcaagacccaggaacagcgtgaagctgcgcttgcctccgtgcgtaacggctcgacggacgtccttgtcgccacggatctcgcaggtcgtggtatcgacgtccccgacgtcagtctcgtcgtcaacttcaatatggccaactccatcgagagctacacgcatcgtatcggtcgtaccggtcgtgcaggtaagagtggtgtggctatcactttcctcggcaacgaggatgcagacgtcatgtatgtccattccccccccatttttgctttcttcccgtctcagaattattag

SEQ ID NO: 19494 - DNA, 639 bp, A.fumigatus
tcgccggtgaagacaaacgcaagaaacggctcgccgacatcctctcctcgggcgagttccgacccccgatcatcgtcttcgtcaacatcaagcgcaactgcgacgccatcgcccgtgagatcaaacaaatgggcttctcctccgttaccctgcacggaagcaagacccaggaacagcgtgaagctgcgcttgcctccgtgcgtaacggctcgacggacgtccttgtcgccacggatctcgcaggtcgtggtatcgacgtccccgacgtcagtctcgtcgtcaacttcaatatggccaactccatcgagagctacacgcatcgtatcggtcgtaccggtcgtgcaggtaagagtggtgtggctatcactttcctcggcaacgaggatgcagacgtcatgtatgtccattccccccccatttttgctttcttcccgtctcagaattattaggaggatatggtatgcagacttttctatttactacaggtatgatctcaagcagatgctcatgaagtcgcccatctctcgcgtccccgaagaactacgcaagcacgaagccgcccagtctaagcctaaccggggactggcgaaaaagagtgacgacagctcaggatttgggactaaaagtgggtggcagtag

SEQ ID NO: 19495 - DNA, 1608 bp, A.fumigatus
ttggctctttgtcagtgttccggagcttggctgacgttcgttttcagggtatctcgtcgtttccatgcacttgctggggattcagagctttggaaaaggcaatattactcgcgatgggttcgacctcgagcacgccgagtggccaatattcggcatgctacactttgtgcgtcaaaggcaacgtactcgccacacgtttcaacatggttgggccattctcatttagctgagggaaaggtgacgaattggaagagacagtatcgccttaggcataattggtccaagggaatctgtcaagtaactgaagtcgaacttccacaacccccgcactccccaatgctgattaggttctgcgcgggctttgtcttcacagcagactgtgagcatgggctgaggtgttggcgtgctagccatcaaatatcatgcactgctagactcccccttgtgcagtccgaattagaaacttcagcattccctacagcgttggcggtgagccgctgcctagcgcagaatcttatcaaagtaacagtgggatttgcagacggtcgtttcggcgtctacgatatggatactaaatcgttatatctgagattacgctcttccaatgctgcttctgctgatggggcaatcaccgcaatggccatatcgaattcttacctcctaatggtctcagagcacaaggttttatcactgtatgagatgtttctagcggaacctgagcattcaactagatccaacgcagcgaatacgagcaaacaatccgcagccgaagatgtgaaactactcgaatctctcaaggcagacagtattttatccccgatgtccttgtcaattcgattggcacattcgaaaatcattgcatctattgtttacagctttttccatattggctgtggctggtcattggggatccaagaactgcattttggcaagaatggcgagcagattggttctcgacttgcaaccactgttaacgctcagtatggagcaatgccgctgcatcatcttactcgttcgaggagaggttattcttcatcttttcaatccgaaccatcaagcggggagtctctcgtggaactgacagagccgtccatattacaccaagaaacgccaacctccatttcctattcccacccgtatctcttgacgtcgcatgcagataacactttgacagtgtatctcgtcgtttccactggtgcaaagctcttcatcaagggaggtcagaggctctggggtcatacttcgtcagtatctgcagtgcaagtgagcgaccacggaaaggcgatttccgtgagctctcgcggcgacgaaattagagtgtgggagcttgagagtttgattccgtctcttgggtcttcaaaggaagcaagggtggagaatagcatccaagtcaatcctgagaacaagctgtgcaaaatacatgggggcggggctcccctagcattgtttcttgcttgccagcattgtgggccacaattagcctctgggcagatgtctcgtgaatacgctcggatgggagattgtgttgggtttgatgatgagcgtctacttctttccagtcgaaaggaaactggggcgcatttaatagcaatgtatgatttcacatga

SEQ ID NO: 19496 - DNA, 420 bp, A.fumigatus
aaaaaaatttccctgcgaaacagaatcaatcaacctctgatcaacctcttttctgaaaaggaaaaagaaattcaatacaacaaaatcactctccctgttttcgcccacatactatcaaaatggaatatcaagctggaggtcgtggatgcttcaactgtgagtccttgcaaacctaacaagaaaatctctgcgattgtcaatttgtgcgtactgcgctctcacccatatctatctcactgtcgatgctttcctctttattgtgctgtttgcatcagtcgctttcaatgtatccaaagaagtcgctggtcgcgccagccttctattaacacattatgtctcctcgcccgtgttctttattttttgcgtctcactataatgcgcagttttgaaattttggccatttgttcctttggaaaatga

SEQ ID NO: 19497 - DNA, 375 bp, A.fumigatus
ctggttgaccaatggcatctccttcctttaggccgcgagtgtacagtagctcctaaggagaagtcgtgctaccgctgcggtgttgctggacacatttctcgcgagtgttcccaggccggttcgggcgataactacaatggtgctcccagcggcggccaagaatgctacaaatgcggccaagtcggccatattgcgcgcaactgctcccagggcggtaactatggaggcggtttcggtcacggaggatacggtggtcgccagcaaacttgttactcgtgtggtggctttggccacatggcccgcgactgcactcatggtcagaagtgctacaactgtgagtttctcgtcaatcttcgtttcgcacttgttgagtaa

SEQ ID NO: 19498 - DNA, 1278 bp, A.fumigatus
ctcatggtcttcctagcgttatctgcccttggtgttcctagcactcgagctttggcaatcactctacttccaaagtcaaaggttctgcgtgagcggattgagcctggtgctatcgttgctcgcttcgcggagacttggctcagaattgggagctttgatctgccgcattcgcgtggcaaccgagacctcatcagaaagctagcgacgtttaccgccgaggacgtttttggaggatgggaaacgctgccaggtgttgtatccttaggttcggatcaatccgcagatgccgtcgataatcctgccagaggcattccccgagaccatgcagaggaacaccagggtgtaactgaaaatcgatttgcacgactataccgtgagatagtgcgtcgcaacgcgaagaccgtggcagcctggcaagcgtatggttttatgaatggcgtactcaacacggataacacctcgatcttgggactgtctctcgattttggcccattcgcctttatggacaattttgacccacagtataccccgaaccatgacgaccacctgttgcgatactcctataagaatcaaccaaccgtcatctggtggaacctggttcgtctcggagaggctttgggggaattaattggtgctggggacaaggttgacgaagagtggttcttgaaagatgggttaaccgaagaaaccgcaccacctgttgtgaaacgcgctgaggccatcattgaacggaccggtgatgaatacaggagcgtgtttctgaacgaatataaacgcttgatgagccgcaggctaggattgaagacccaaaaggagtctgatttccacgaactgttctcggagatgttggatacattggaagctctagagcttgatttcaatcactttttcaggcgactctccaacgtagcacttgctgatatcgagactgaccagcaacgaatggacacagcacccatcttctttcacagcgaagggttcggcggtattggctacacagaacggtctgcaaaagagcgcatagctaagtggctcgcggcttggaggattcgaatccttgaagattggggcatcgaaaacgacgcagatcgacagaaagatatgaatgcggtcaacccgaaggtgagtctcaagcgtttccttttcctcacgtcaagtttgttcatcttatgctgcctgtaccttgctcacaccctcgccatggtatcgactcatgatgcctcgctgacgtgtacatgctacagtttataccacgcggatggattctcgatgaagtga

SEQ ID NO: 19499 - DNA, 471 bp, A.fumigatus
agacgctgttttatgtctttgcggagtagactcagccgattaaggtctatgcgatatcctctgggccacatggcaaaccaactctcgactagggcagcaggagtttcccttgcagaacttccgaaatctaatgtgtttacaacaaagctccccccagatcctgctttcgagaccccggagtcttctcacaaggcgcccagagagactctcggtccccgtctggtgaaaggagctctatacacgtttgttcggccggagccagcaggggaaaccgaattgttgagcgtcagccctaaggcgatgaaggaccttggtctgaaaatgggcgaggaacttacgcctcaatttcaagcattagtatccggaaatgagatctggtggaacgcaaaggatggaggaatttacccgtgggctcagtgctatggaggtatgacgaactcgcggctcgaaagcatacgaagcgattgttaa

SEQ ID NO: 19500 - DNA, 192 bp, A.fumigatus
aatgagcctccggcgagagaaattgacccgtatcagcgagcaattagcctgttcgagtgcatcaatcctcaaacgaagcgccgatttgaattacaattgaagggagcggaaaagacgccatattcacgcttcgctgatgggcaaggctgttcttcggtcgagtatccgcgagtacgttgtgtcagaaggtaa

SEQ ID NO: 19501 - DNA, 228 bp, A.fumigatus
tgcctcgctgacgtgtacatgctacagtttataccacgcggatggattctcgatgaagtgatcgaacgtgtagagaaaagaggagaccggaaaattcttgaccgtgtcatgcaaatggctcttgaccctttcagagattcatggggcttggacaaagatgaagaggaacgtttttgcggcgatgttcccagatataaaagagccatgatgtgtagctgcagctcatga

SEQ ID NO: 19502 - DNA, 207 bp, A.fumigatus
cgcgatactgaagacagacgacccgagatgtctcaactagttagggcaagcggcctggacgtgtccaggttgcttgcacttgtagcaaactctttcacccttggcttcagtggggcagtcgcgggatacatgtccaacatctccacctacgaccattgttactcaacaagtgcgaaacgaagattgacgagaaactcacagttgtag

SEQ ID NO: 19503 - DNA, 672 bp, A.fumigatus
  unsure (77): Identity of nucleotide sequences at the above locations are unknown.
gtggtggcgagcacggcaaacgtcacattctatgtagtagaagaccactcgttggaagatggtgtacagtctcagtntaaaagaaacatcttggcctatttttccaagggagatatcctgattgggtttatcggtgacagtcaactggtcggctggttatcgcacacacccgccctggcagaatccattggtgcattttctgtttcatgccgccgtcggctacatctcgatctcccccaagttgtgtgttccagattcaaagacaagatggcatccgaacccgcggctactgtggccgacttggactttgataacgagcagtacgactccgcggaagatgaagatttccagctcgatcctgatcaagaagatgccgacttgactggctccgatagcgacgatgaggcgacagaaccagcagcgaaaaggcgcaaaacagggcctaccaaggcagccaccgaagaccaagaactagactctggcgatgaggccatgattgaaaaagtgaaggccagaaaggagggcaagcaaaaagggaagaagtcacaaggcactgccagcgatgaggacgaggatgacgtggattttgatgacgatgatgaaggcggtccagggggctttgtacggacgcgagcaatgaggatgcgaatgtgcgttgagcctttgtactga

SEQ ID NO: 19504 - DNA, 771 bp, A.fumigatus
ggatgcgaatgtgcgttgagcctttgtactgacttgtccctacatccggaggaccagtatttacttcttcacaggcaggaagagcgaaaaccactggccaagattgacggtgctacggttgacgttgatgcaatatgggcgcagatgaatgctcctgactctagtgcaggcattctgccttcacagacccaagcaaaggatgccacccctgcgaaggacgaaaacaagaatgccgataccgccgaggaacaggtgctttcgcctgattcaaaacctcagtacaaggaggagatggtaaagatcaaacggacctacaaattcgccggcgaagtcatcaccgaagagaaaatcgtccctaaggactccgccgaagcaaagcttttcctggctaaaggcgagagcgtcgagaccgtcacagacgccgatgtcgaacacgccgcgaacgcaaaggacgcgctcaagctgcgcagacccctccgcaagatctcgcgctttgaccctaaccccaccgggacgatcaagaagagctgggagaagcaacccacggccgggatcaccggtcagacagagaacattagcggaccgaagatcaacaccgtagaaaagtctcggctggactgggctgcgtatgtggaccaggccggcatcaaagacgagctcaaggaacacagcaaagccaaggaagggttccttggccgcatggatttcttgaatcgcgttgttgccaagcgggaggaggaacgaagaaatgcgcggttgaagggattatga

SEQ ID NO: 19505 - DNA, 483 bp, A.fumigatus
agtacccgcgttcttccctattctttcgcttctggtacggtctctccgctattgaaaggaagtgaagagggactaacgctgtgtcgacagccccaacgagcactcacatacattaagcgcaagcaagcgcacaaactcgtccctgctttcctcgcctgtttcgagacgatgtggaatggtcagttggatatttccaagccggagaatctgtccaaggctttatcaaaggcattctcaggcactgaggttgaggagatactggctgcagcagcgagtcctgagatcaagcacgagcttactgcgacgacagagagggttgtcaaggagctgggggcgtttggatgcccgtggttctgggtgactaatggcgaggggaagtcggaaccgttctttgggagtgatcgtttccatttcatgtgggatttcttggagttgccgcatgaggatttgagattgaaggttgacgaaaaggcgaagctgtag

SEQ ID NO: 19506 - DNA, 348 bp, A.fumigatus
cctctgttcgttctcacacctaacttcttccgtttgtgtcaacctgtccaccctgcgaagatgcccgcaacccatttcccgtcgatgggcaaactcgccctgggtgcaatgcaccttgcctctggctttcataaccacaatcttcagagctgcccaggggacatcccagtgagttgcagcaacacgaccgcagtgcctgactcttgctgcttcaattatcctggaggatcgctcctcttgactcaattctgggacaccaatccggccactggtccttcagattcctggactgttcatggtctttggtatgcccgagcagagggaaataataaaaaatatggccactaa

SEQ ID NO: 19507 - DNA, 249 bp, A.fumigatus
acgatcttctccgacgctattctgggtattttgaacagccccaccgacgttgtgaacggccaattgctcctcgatgaggactttttgcgcgaccattgcggtgtttcggatttctccaagtacgctgttatccctgggtctcagccacggcgaatcatgcctaaggagttgcctgtccttgaggtggcggagcaggatgatgaaggtatgcgggtggatagtacgatgttgagaaaggccaagctgtga

SEQ ID NO: 19508 - DNA, 207 bp, A.fumigatus
ctgtggagtcaacgaaatccagatcagcaatcgtcaaagattaacaaaatcgttcctggccactccttaacggttcctcaattctaccccgatggcctcccgtcggctaagcgacagtcctgcaactacaaattcgagacagatcatatgattggacagactctatctgatcgactccccgcctcgacaaggatggcaacaaaataa

SEQ ID NO: 19509 - DNA, 762 bp, A.fumigatus
ctcaattctgggacaccaatccggccactggtccttcagattcctggactgttcatggtctttggtatgcccgagcagagggaaataataaaaaatatggccactaacaatcaacgcaggccggacaactgcgacggcacctacgagcagttctgcgattcttctcgcgagtattcgaacatcacagagatcctccaggcgcagggcaggaccgagctgctgtcctacatgcaaacctactggaaggactaccaaggtgatgacgagagcttctgggagcacgagtggaacaagcatggttcgtttgtgccgatctggcaatcccgaccaggcactaatgatgatataggcacttgcatcaacaccatcgagcctagctgctacaccgactacaagccccaggaagaagtcggtgattatttccagaaggctgttgatcttttcaagggcctcgatacgtacaaggtatgcattagacatggattattgatcattctgcggctaacgggccaggctcttgccgctgccggcatcactcccagttcgtccaagacatataaattgagcgacatcctgtctgctctgtctgcaatcaccggccatgaaccttcggtcggctgcagtaacggcgagctgaacgaagcttggtactttttcaatatcaaaggcaatctcatcaatggcaaatacgttcctattgatccgcgtatgttgtctgtttatcctcagccccatagacaacagctaacctcaaataactag

SEQ ID NO: 19510 - DNA, 444 bp, A.fumigatus
gatctaatccaattcaatcgcagtgagaactacgtaacactgtctgctacgaagaggaggatctggaagcggatatggtggacactgtacacgcgggatcgatcggttgctgcagcattcggccgccctcttcacatcaattccgaagattgcactgtggaagacctgaaagaaagtgactttattgagtatgatgaggaaaatgacagtgcaacagaccgtacagcaatcgtcttttttatgcagtacgtgaaactctgccagctaatggaccttggtctgtgcttgaagctgtcttccaggtcgacagaggacagtcggatgaagggggctgcgcaatgcgaacttggtctgaatgactggcttgtctcttgtccctccgagctgcagtggagacagtcacgtcataacttttggtcagcgatattgtattcgaccttctag

SEQ ID NO: 19511 - DNA, 426 bp, A.fumigatus
acagttgatcacttggatcctcttgacgtggacatactgcatcagcgacatgcctttgatttaccctcgcaggctgtctgtgatgctcttgtggacgtgttcttcaagtggattgcaccagtgttgcccgtgatcaatcggcacgacttcatgcgtcgttatcgtaaccctcaggaccctccgtcaatcctcttacttcaagccgtactcatggtagcttcaagattccattatgatgcccagagctctggaaatggcataatctctccgcgcatcttatacaagaaagtgaaagctttatatgatgctggatacgaaagagaccctaccacagtcctccaagctgtagtgttactaggcgtgtactgggatggccctgatggtaggacattgctcaacgcattgatgtgtattgtgttgtgctaa

SEQ ID NO: 19512 - DNA, 546 bp, A.fumigatus
acctggccaagaatggctacaaaggtatgctcgaatcacacgcacatcttcaagcatgtcactgacactattctagtcgtcgtggcggcaaagaccacctccaacgcctatgctactgttcccttcccaccagatccgaactcctcgcaatcgaccatcaacaccgttgagcgagagatcaaagaatccggtggcgaagcgttcgctctcccagttgacgtccgcgacgtgaagcaggtcgagaacctggttcacgaggcagttcgcctgacaggccgtctcgatgtcctggtctacaactccggggctatctggtggtcttccgtcgcgaatacgcccacgaaacggttccaactcatgcagagagtgaatccagagggtctgtatgcgagcgtgcaggcagcattgccatactttgagaaaaatgggtggaagggacggattattgttgtctcgccgccaatctactcgcggttctttcgggggaagaccgcttatgcgatgggtatctcttctgtgctcccttcacacagaagtttgggctaa

SEQ ID NO: 19513 - DNA, 210 bp, A.fumigatus
ccttcgcgaaatttcgccggctactcgccgttggcgtggctggtatctgcaccgctcttggttttgtggtcccgcaatacatcgcttaccgggatttctgcatcaattacccctttacgggccatgatgaaccaaggatatggtgtcgtaggacccttccgagtatctccagcttcgtccaggaccattattggtatgttttcaacttag

SEQ ID NO: 19514 - DNA, 261 bp, A.fumigatus
tcccataggaacaatggttttcttcggtattggactgtgtccaatatccccctgttcgccttggccagtccaatgctggcaatcatgacttattctgccctttggactctcaacgttgaatcaggcaggctgacaggagcaggccgcctgttgcgtagcctggcggctccccagctcatcatggctgcattgacattttcaacacatcatgttcagatcattacccgcatgtcttgggggtatccggtgtggtatttataa

SEQ ID NO: 19515 - DNA, 423 bp, A.fumigatus
  unsure (183): Identity of nucleotide sequences at the above locations are unknown.
acagatacccagacccgtaagctcagcgatttccgcggtcgcatgcaaacgcaacccatttgtactgacatgatgtacgatcgcagacaccagatcgaattgaagaagttgttttgcaagtttcgcaacacccacgttcacacacaaaaggacctggggccggagaacatgttcgtgggcgtncggtccgacgaggccattgacgctcttttgagatgtttctgtgctcccgggaaaggacaagatccttacgtgtcctcctacgtatggcatgtatgcggtcagcgcggaagtcaacgatgtcgagattgtgaaggtgcccctggacgtcaacaatggcttccagctgcagccggacaagatcaacgaggcgttgtctgcggacccgacgatcaaaatggcatatatctgctcccctggtaa

SEQ ID NO: 19516 - DNA, 936 bp, A.fumigatus
gatgtttctgtgctcccgggaaaggacaagatccttacgtgtcctcctacgtatggcatgtatgcggtcagcgcggaagtcaacgatgtcgagattgtgaaggtgcccctggacgtcaacaatggcttccagctgcagccggacaagatcaacgaggcgttgtctgcggacccgacgatcaaaatggcatatatctgctcccctggtaaccccaccgcgaacctgatcaggaaggaagacatccagaaggtgctggagcaccctacatggaacggggtggtcatcgtggacgaggcatacattgactttgcgcccgagggctccagtcttgccgagtgggtgaccgaatggcccaacctggtcgtgatgcaaactttgagcaaggcctttggattagcaggtatccgacttggcgttgcgttcaccagcccggaaattgcccggctcctgaacagtctcaaagccccctacaacatctccagcccgacgagtgcgatcgcgaccgccgccctgtcacccgagaacatggccgtgatgcgcaactatcgcgaacagatcatcgctcagcgcaaacgcatgttacaagagctccccaagatcccaggtgtaggtcgtttccttggtggacaggaatccaacttcctcctcgtagagatgctggacaaacctgccagtgaaggcggaaagcccagtaacgccgtagccttggcagcgtacgaggctatggctgagaagcggggcgttgttgtccggttccggggcaaggaactcggttgtgagggctgtttgcgaatcactgtaggaacagagcaagaagtcactcggttcctacgggagttgagggccgtgctagatggtctcctgaaaggggtggaaatcaaatcagtcagggacgaggtgaacaaggagaatcaggccaatcaggttgttggctga

SEQ ID NO: 19517 - DNA, 1113 bp, A.fumigatus
cgctacgctacgcacctcgaagcaggtaccgacatgacgatcactatcacacaggtatataacaacaacatcaccctcactccctctcaatttcaatccccaatccatgatgcctccaaaatggtcccccaactcttcccaccccgccatgtctacttcccctccaacccctctcacacctccactgtcatcctcctacacgacacaaacagcacaggcgccgagctggccgccgcgctggacgtctcaacaacaccagcaacagaaacagcgacagctggaaatcccaaatctatcttcgagcactttccctcctgccgctgggtgtttccctccgctcagccccggcagatagatatctgctacgcaagcagggggaattggatcaatgtcgatgtcgacgtcgccgtcgctgtcgacaccgatgcgaacgaagacacagacccaggcgcaaattcccttcaacaaccacaaccacagctcagcccctccacaaaagacgtcgacaacaattacaacaacaacgcagaccaaaacgatgatctagaaacctgcgtagagtacatcctgcaagtagtagaagaggaaatcatccggctggacggcgacagtcgtcgcgtggtgctgggtgggttcgggcaggggatggccgttgcgattgctgcattactcgctgcgcagagacgactgggtgggtttgtgggtgtgagcgggtgggttcctcacccagagaggatcgggagcttagctggtcggggccgggggctgcttgttgaaaacgaggcgaggatgggagcgtccgagggttcggcaggagcggacggggtggaggtggatccgggggccgattcgatgttagagactccggtccttctgagctatctggaggatgatccatgtgtggatattcaaacagcgttgacagtcgacgagacattgaaccgcttggggttcgtcaaggtggtttgggatgcttgtccaagttcgccgcagggcgagggttcgctcttacatttgcaccatctagatacaattatgggcttcttgacacaggtgtttgatcacgaaggcagcaatctcccccaatatgatatgttaggatactctacttga

SEQ ID NO: 19518 - DNA, 597 bp, A.fumigatus
gtacgcgactaccctggacctctttgggagccccgttcaactcgtctaacgcactttctccaaccatacagccgcaccaagatgaaaatcagcgctcgtcccacagcagccatgcaagccaaatacacacctttgcccacccccgccaacccagaccctcaacctgactgtggtactatctatgttgagttctgtgccgattccaccggtgtcggtactaagcaagttcgagcattcaatcactttgttgatgagaacaacttccacaccggagtcttcatcactcagacgccaatctccccatctgccgtgcgcctactgagtggtattcccggtcgtatctgtgagcatttccaggagcaggatttactagtcaacatcacccgtcacgaattggttcccaaacatgtcctgctgagcccagaggagaagaagaatttgctccaacggtatcgactgaaggagtcgcaactgcctcgtatccaggtctctgatcctgttgcgaggtacttgggtttgcgacggggacaggtcgtcaagattatccgaaagagtgaaaccgccggtcgctatgccagttatcgctgggtaatttaa

SEQ ID NO: 19519 - DNA, 1560 bp, A.fumigatus
  unsure (953): Identity of nucleotide sequences at the above locations are unknown.
caagatgctaatccaatgatccgccaggctctttttgcaaagactcagtcgggttcttacatgcgtttacggtctctttacccgtcaatcccgcgatggtcccaagcccggcattctttacgctctttttccaatgagtctcgttcgcgttcatcaatcgataccttcttaccctccggttaccaagattccttaacaagaagctccaatcatcccggccatggtccctggacgccgtcgcaatctacagcgtcgttctctacctcctcctcgctctctgagccagcggattgggacgagaatccaaatctttcaatctctaccttttcagaattaccgtctaaagactttggcgtcaaccagcatatgatcattaatcaagagttcaaagaggccttgcgtcagattctgtggcagttccgcgctccgatccgatatgctttcgcctatggttccggtgtcttccctcagtccggcagtgcagccgggtccagtcaatgtcacccatcggccccggcagcgattcagaatatgcagcagggcaagggcaagatgattgattttatctttggagtatcatatactcagcattggcacgcactgaacctgagtcaacaccgtgaccattactctgcattggggtctaccgggtcttatatggtttcccaggtacaagacagatttggggcaggcgtatacttcaatccttacgtgacggttaatggtacgctgatcaaatacggagtcgtgaacctcgataccctgtgtagggatcttagtcaatgggacacattgtatctcgccggacggttacagaaaccagtgaagatcctgcgcgaccaccccagggtgcgcttagccaaccagattaacctcctgtctgcggtccgggtagcgctgctgctattgccagccgagttcagcgaattcgagctctacaccactatcgcggngatcagctatatgggagaccttcgtatgtcactaccggcggaggacccccggaaagtgcggaatatcgtctcgggccaaatggcgcacttccggcggctatatgcacctctcattgagaatcttcccaacgtcacattcaacgacaggcgctgcacggaagaagattggatcgacgaccccaatgcgaatgtccgtcttacacaggacatggacccagtgaagcggggcaatatggtacgccggttacccgaatcattcaagcagaagttgtacttccagtatcagtctcgatttgaaataccccaagtcgagttcaacaaaatgatgaaggagagcagcgacagcgactcggaagtagtgcgacggaggcagggcggtccattcgaacaacggatcgcggctgatgagaacctcaaaaaggaaatacaggcgtcaataacgaaaacgatacgttggccaagtaccgttcagaccatcaagggtttgtttacttcagggatcagcagaacctggcgctatttgagcgaaaagcaaagcaagtacagaacctcaggccggaaagctaaagcttcatccgaggagtctccttcttcgaagcacgaatag

SEQ ID NO: 19520 - DNA, 207 bp, A.fumigatus
gtttctctcactcatttcccctttcttctcccccctcttcaattctcaaaagtcatggctgccgccgccaatgccgctcctgccacggagcagaaagccaggccgaccaagcccaacgaggaggctttcaaggctgatctcgctcaggctgaaaaggagcatgctgctgtccaggagaaattggtatgtgaggtctccgtcaattga

SEQ ID NO: 19521 - DNA, 285 bp, A.fumigatus
  unsure (232): Identity of nucleotide sequences at the above locations are unknown.
gacccggggggtgagttaacacagcgatttcaatgctggcaatttaaatgcgctaacctgtttgatagaacatcaagaggcttcaggaggagatcaggcgtctggaagaggaagaggcgaactttgacagccaacgtgcttaccgaccatgccaagaaggtcggttatgagaacagcggtgtgaatggcaaagtctccgccgaagctgagctgaagcaggagaacgatgccnccgcagatgtctctgaggagcttcagaaggcttcaattgaggatacggcatga

SEQ ID NO: 19522 - DNA, 249 bp, A.fumigatus
gaaccgagtgacttcttgctctgttcctacagtgattcgcaaacagccctcacaaccgagttccttgccccggaaccggacaacaacgccccgcttctcagccatagcctcgtacgctgccaaggctacggcgttactgggctttccgccttcactggcaggtttgtccagcatctctacgaggaggaagttggattcctgtccaccaaggaaacgacctacacctgggatcttggggagctcttgtaa

SEQ ID NO: 19523 - DNA, 1260 bp, A.fumigatus
cgatatgtgtttacaactagttgcaaactgcgtaacatatataaagatactaactatgcgcagaaccaaatcaaggccaagatcgagagcgccaagcctaacaaccaggactcaccctcagccaagagacaacaggaacttcgtgctgagctttcctccattcgtcaaaagcagcagggatttaaggcctcaagaacgagcacccaggagaagatcaatgctctggagttgaccctcaaggcccggatcaccgaacagaataactcccgcactcgcatgccattcaagaatgtcgaggacattgaccgtgaaatcgcccgtctcgagaagcaagtcgactctggtactctccgcttggtggacgagcgcaaggccctctccgacatctcaactcttcgtaagcagcgcaagaactttgctggcttggatgagcagcagaaggttatcaacgacctgaaggcgcagattgctaccctcaagaagactctcgacaaccccgaagccaaggctctgagcgacaagtacactgagatccagaaggagctcgatgccatcaaggccgagcacgacagtgccttcaagaatctgaacgctctgagagacgagcgcactaagctgcatgctgagcagcagaagaagtggaatgccatccgtgagatcaaggacaactactacaaggcccgcaaggcgtacaaggagtatgaggatgaggcctggaggatccgccgggagaagcaaaaggcccagcgtgaggcctttgagcgcgaaaagaagaagaagattgcggacaagaagcttgaggaggcttcccgtcccgcttacaccgacgagatcctcatcgcgcaaggtcttatccgccacttcaacccgtcctacgacttctccacccttggtcttgatgacaagaaggatcagtcttccgctttccgtgctcaagtcggtcgtaccgttgacgactccaacatcaagggcatgaaggtcttgaagaaggaggaccgtgaggaagactactttgtcggcactggcggcaagaagagcaagaagggtaagaagggcaccgccaatggcagccctgctcccggaactcctgccgaacccaccaagttcaacctcaacgtcggtgtcatcgaggactttgccaaagtcaagatcgaccctcctatgaaccagtccgatgttcctgctgttatcgagaagcttccccccaagatcaccgagtggaaggcgaaccaggccgctaagacccggggggtgagttaa

SEQ ID NO: 19524 - DNA, 1839 bp, A.fumigatus
gtgacacttgctccttctttctcaatggccaaagacgagcttcaggaagctaaccagcagtcacatcaagtaggagaccgtccaaacaagactgacagcattggatccgacgaagtcgtcatgaatcgaggggccaatttcaaaggtcgcaatcaaagacagctttggggcggaagcgtacatctgaacagcgattcccggtatagggctcgtccaagaacaacacagcagataccaaggcagaatgccaatgggacaccaaacagacctgctgcgatggaaaatcacactactgaggacgatgttcgctgccaaatcaaaggtccgcccagcgcgcaaaagactgcaaacaaggctccatctctagaggccctagacgagttaaagcgtcttcagaaagagattgttttgcaagcccacctgaatcgctacaaagaccatgaagacgacacagcaaatccagagagccttgcaaaatgcagggacggtccaggcaccgatccaaaatcagatgtctacaaaagcatcgcaaggtgtaggctcacagccaatccaaatgcaacttcttcccatccaggctctagtccagaggacaagttcgaaggagacgtgaatgatagatacttcgttgatgaaatcaggtctcgcgtccagaagttttacgctgcgaaacttgatgctcagcgtgaatcttatcataacagcgtgtccgtgtatccggccattgttgacggccagatctttctttcacgctacccaagtgcggagcatgaacgtcctgagaaaactctatcaaatactgagcggcagactggcagtcaggacggcagtcataagccagagcactgctccatggttaaatgggaggataggtgggagctgcgtcctcgtgcttgctctacctatgaaggctttcgtgattggttccgtcattggttagagatggaaacaggcgatagccccaacattgacatacaccaccaaaccttttttgacgggacggcgcatatggatgggatcaaatctttctacattcttgacttgggagacgtcccaactcgtttggacatgacgagtgaagcaacacgtctccattatcatgaaacggccgaaggctactgccacaaccttgcattacatatgagagcggcggaagaggaggcgaagacgcgcagaaaacaagctcgagatgccttcatagaaggtctgaaggtctgttctccaaaggatccgaatagtcctagagcaaacgtctatcttcgcagtgtggaagacggtgatgtaccaggactgctcatgattatgaattggtacggccaaaagtcaaacttgagttcaaacttaggaacacttgacgaacaagacgtgcgtcagcaaattgaggatagcaggcgtgcgaaattgccatttattgtggctgcagagcgcagacgaggaccatccgtccacgacaccccggagaacattttcggatatgctttggctagagattccttggggcttcagaccacaggtcgatacacagcggagctagaaatttttatcaaaccggaccaaaaacgccgaggcatcggaaaatgtctcttggacaaactgattgaagtttgtgacgttacttacgttcccaaaaggggcatcttctacgatgccggttgcgatgacaagactggcttttacccgggcggttcccgaactctcaaacgccttgtttttattatcagctattccgttcctgagaggtcccagatcaagtggctcatcgactggctggaaagggattaccactttgaacagcaaggcgtgctcaagggggcccgagtcaagttcgagcgattgtaa

SEQ ID NO: 19525 - DNA, 228 bp, A.fumigatus
  unsure (135): Identity of nucleotide sequences at the above locations are unknown.
tcggcactgcagcgtattaaaagtgtcgagaacttccgagaaggcaaagtagccttcctacttgctactgatttggcgtcccgtggtctggacatcaagggtgtcgaaacggtcatcaactacaaaacggctcanaaccatgagatctacctgcctcgtgttggtcgaacagctcgtgctggccgttccggacgcgcatgcaccattgcaactgagccggaacgctag

SEQ ID NO: 19526 - DNA, 1989 bp, A.fumigatus
acttttttcttcctttccgctcaagagatactagatagaagcagaaggcctgggaggaaaaacaggagtggtctgagtccctctacatcgttatcacttgctttgcgtgaattcctacagtcttgtgctcccctcttcgcattcagacggccaaacaacggtcggtctcctagaaaaatggctcccaacgctgcgacaaaaaagcgggctgccgccagagatgacgatttcgtgctcacactatcggacgacgagaacgatatcttcgagaacggtgttgaggaagacggcgacaatgcccaggaagacactctttccagctcgaagaaacgcaagcgagaggcggcggaggccccgaaaggaaagaacaagaagcagaagcaattgaagaaaagcaagaagggcgagagcgctgctggcgcagtatctgacgaccaatccagcgaagaggatgaggctgaggctatggatgctggtgaggacgatggggctttggactcggagttcgagttcgacgttggcggcaatgctaataccggtgtgattgagggatttgatgggtgggaagctcggaatggagccagtcttgcggatgcgcccaagaatggggataagaaagctgtggatattgatgatatcatatccaggaggaaagcgaagaaagaggctgaactgaaaaagaagcagcagaaggagaaaaagaggagggaggaggaaggagaggaggagagtgaaggtgaagatgccgactctgatggcggtatgtcagtggactttcaggacgacgaattgcttgctgcagacggatttggtatgggtgccgatggtgcagatgagagtgacgacgatgtggagaacggctccaatgacagcgacgattcggagggaaagggcagcgaggacgaggagagtggtgatgaatataatgatgatgatgctgcttccgataacgactcagttgccactccagtacaccatcctgatgacgaagcagcgtctgacgaggaatctgaagccgagagcgaggttgatgctgaggaagcagagaagcgcaaggctttctttgcacctgaagaaaagtccacagccgtgtcgacttttaatcgatcgtttcaggacttcaatctgtctcgacccatcctccgtggtttggcatctgtcaatttcaccacgccgactcccatccagcaaaagacgatccccgtggctctccttggaaaagacatcgtgggtagtgctgtcactggctcaggaaagactgctgcgttcgttgttcccattctcgagcgtctgctgttccgccctcgaaaagttcccaccagtcgtgttgctatccttatgcccactcgtgaattggccgttcagtgttacaatgtggctacaaaactggctactcatactgatattaccttttgtcaacttgtcggtggtttcagtcttcgcgagcaggagaacatcttgaaaaagcgccccgacgtgatcattgctactcctggtcgttttatcgaccacatgcggaattcccccagcttcactgtcgacacactggagattttggttctcgatgaagctgatcggatgttggaagatggtttcgctgacgaacttaacgaaatcttaacaaccattcccaagtcgcggcaaacaatgctcttttcggctacaatgacagactccgtggacaagctcattcgggttggtctcaaccgtccagttcgcttgatggtcgactcgaagaaaaatacatccatgaatctgacccaggagttcgtccggttacggccaggtagggaggacaagcgcttgggatatcttctttacctgtgcaacgaaatctacactggacgggttatcgtcttcttccggcagaagcgcgaagcccatcgggttcgcattgtctttggattattgggacttaaagcggcagagctacatggtagtatgagccaagaacaggtatgccaacttatcaaccagatagttacttga

SEQ ID NO: 19527 - DNA, 402 bp, A.fumigatus
agaagatatcccaagcgcttgtcctccctacctggccgtaaccggacgaactcctgggtcagattcatggatgtatttttcttcgagtcgaccatcaagcgaactggacggttgagaccaacccgaatgagcttgtccacggagtctgtcattgtagccgaaaagagcattgtttgccgcgacttgggaatggttgttaagatttcgttaagttcgtcagcgaaaccatcttccaacatccgatcagcttcatcgagaaccaaaatctccagtgtgtcgacagtgaagctgggggaattccgcatgtggtcgataaaacgaccaggagtagcaatgatcacgtcggggcgctttttcaagatgttctcctgctcgcgaagactgaaaccaccgacaagttga

SEQ ID NO: 19528 - DNA, 195 bp, A.fumigatus
agtaagttggcgcaacttgatatatttgatgagctctacggacatctactgacatctctccagcggcttcgcctggattcaataaagacccataaatggactatattgccctgtagtgccatgacaggcaagaatctatatgaaggcttacaatgggtagtgcaggatgcaaaagacagacttttcctctactga

SEQ ID NO: 19529 - DNA, 462 bp, A.fumigatus
aagtcgacacggctgtggacttttcttcaggtgcaaagaaagccttgcgcttctctgcttcctcagcatcaacctcgctctcggcttcagattcctcgtcagacgctgcttcgtcatcaggatggtgtactggagtggcaactgagtcgttatcggaagcagcatcatcatcattatattcatcaccactctcctcgtcctcgctgccctttccctccgaatcgtcgctgtcattggagccgttctccacatcgtcgtcactctcatctgcaccatcggcacccataccaaatccgtctgcagcaagcaattcgtcgtcctgaaagtccactgacataccgccatcagagtcggcatcttcaccttcactctcctcctctccttcctcctccctcctctttttctccttctgctgcttctttttcagttcagcctctttcttcgctttcctcctggatatga

SEQ ID NO: 19530 - DNA, 249 bp, A.fumigatus
aaggacaaatttagccaaaatgctgtcaatattgagaaaagctcgcttaaaggacaaggagatgagaattttgatgctgtaagtcttttaacaactgagaaacaacccatctggatgctcacgtttgatgttagtggtcttgataatgctgggaagacaacgattgtgaagcagatcatgaacgaagatgtcagaactgtcagccctacactgggcttcattattaaaacaatagattttgaagggtaa

SEQ ID NO: 19531 - DNA, 246 bp, A.fumigatus
gagaagccaacagccagaactccacaaggaacttcgattgacttttgcccgccaggggacgtcggggggcagaaaacccttcggtcatattggaaaaactactttgagaagaccgacacacttgtctgggtggtagatgcaacagaccgtcttcgagttgatgattgccgggatgaactcgcgggcctactcctcgaagaggtacgggttgccaatgtccccgctcgcctgcaaaattttcgttga

SEQ ID NO: 19532 - DNA, 297 bp, A.fumigatus
ctgtggatgggaacacacccctcactcccttcgaaagatctcgagactcagcgcaccttactggatatggttcaggacaatcaggcattgatctctcaggaggtcagtgaacgatatggggggaagcttcctttcctgttcaaggtgctgtcgatcaggaaggcgctcagcattcaggcccatccgaacaagaagctggcggaaaagcttcatgccagggatcctcgcaactatccgggtgagtacacagccttcaagcggacttttgtggtctacttccaaactgcatttcactga

SEQ ID NO: 19533 - DNA, 999 bp, A.fumigatus
cttttctcagatgacaaccacaaaccggagatgaccatcgccatcaccccctttgaaggcctttgcggcttccgtcctctggttgaaatcatccacttcctcaaagcggtcgcgcctcttcgtcagttggtaggagagcgggccgccagcgaatttgagaacacagtcaagggctcggaggaatcggaggaccccgcggtgaccgagaaaaacaagcaggctctccgcactctcttcacgtctctaatgaggtcctctcctgaaagtatcgaggccgcaacaaaggaacttgtcgcgattgcccagaactcgcccgagacctttacgacttcatccagtacaccggagaccaaccccactaatcctgcggaactggccgccatcacggtgcgcctcaatggacagtttcccaatgacatcggctccttcgtgttcttcttcctcaactttgtcaagctggaaccgggtgaggctatgttcctcaaggcggatgatatccatgcatacatctccggtgacatcattgagtgcatggcttcgtcggataacgttgtgcgagcaggcttcacacctaagttcaaagacgtggatacgctggttgacatgctgacgtactcctacgcgcccatcgctgagcagaaacttgagccgaccgactatccctatgcggtcctcaatgcccctgcttactctagcggctcctcctgcatcctgtacgatccccccattgaggaattcagtgtggtcaagacagatctcaagcggcaaggtgctaaggcgacatttgatggaatttcgggcccgagcattgtaatctgcaccgccggagcgggtaagataacagtcggtcccaagacggaggaggtcaatgagggatatgtgttctttgttggagccaatgcagaatgtatcattgagagcacgggagaagatacctttactacgtttaaagcgttctgtgacttgaccgggaaggaggacatggtaaacggaaactag

SEQ ID NO: 19534 - DNA, 306 bp, A.fumigatus
ttcaagatggcggaccacccggatgatgttcgtctcacactgctggagaaggctgacctcattcccggctacctctctgtcctagcgactgcgctctacagcgctgtcgctggcatttttcgtgggaacaccggtgcaaaagaatatggtgtccatgtcggccatgcaatagtgaggaagatggtgacgaggttctcgatgcggcaaatgcagtacgtagaccaacatccgccactccgatctgtgaataccgttgctgatgtccaggaacaggtcaatttcctactcaacgagcaaagcgtatga

SEQ ID NO: 19535 - DNA, 393 bp, A.fumigatus
acagcgccttgttcgccattctcatttggttcggggtcttgcacgtcgtatctagaggtaaacgggtcaattttcttgcactcagaaagggcaagcgatggagacagacctcttcttaggaccttcaccggagattcccttgatgatacactggatcccctccccttcaacgccctgtttgttcttattatgtttgaaaaccacttcggcgccaatgacaagctgcccgttgcgctccgcgatcgtgcctctgatactttctgccgtttcttcaattttgaccatgacaccgtcacgaatttcgcggccgtcacgcgtctgaggactggaagcactggtgctacgttgtacgcctttgatgcggccaatcttgtccgatacagacggacctga

SEQ ID NO: 19536 - DNA, 645 bp, A.fumigatus
gagcaatcaggtggcggattcgccatcggcggcgcacccggccacttcgacctctactcgcacatcgtagccgacctcaacgcaaacggccatgacgtcgccatcttcttcctggcatacacccttactccacacgccgcctacccgacccaattgcgccaggctgccgaagccctccgctacatcgtcacggagacgaaccgctcgccatccaacgtgatcgtcggcggcgactccgcaggagggaacctcgctctcgcactgctgctgcacctctcccatccacatcccgagatcgagcccgtcgcgctctccaccaacctcgccggagtgttcgggttcgcgccgtgggtcagcttccgcacagacgggacctcgatggacgcgaacaagtacagggatgtgatcccctcagacgcgctgaagagatggtcgagtgcgtatctcgctggtgcgaagagcaatgcctggagcgagccagcgctcgcgcctgtggagtggtgggcggatgcaaagaccgagcaggtcctgatccttgcgggtcagcatgagatcttgtcgtcggtgattgatgactttgtggagaggatcaaggtatttattctccgtcatattttaggaagtcgattgtgtctcggttgctga

SEQ ID NO: 19537 - DNA, 270 bp, A.fumigatus
cagggtggtgagaaatatcagtctgccttttacgtttacgaagaacttgcgtccgcgcctggtacgtcggcacctttgtctattgtcggacaggctgtcgcggagattcatctgggccggctacccgaggccgaagctgcgctgtcggctgcgctggagaaataccctgaggaggcggagttgattgctaatgccattgtgctgaatgtattggctgggaagcctacggaggaattggagaggtatattttgctctcaaacatgatatga

SEQ ID NO: 19538 - DNA, 741 bp, A.fumigatus
cgaggagaaaggttgaagaggcccgccagtccggaagctggcggcgctgtatccagtccgcacacactgccgcgaagtagcctcaaggaggcacttcttgtgagaatccattcggagtgctacactggtgagacggcttggtctgcacgctgcgactgcggcgagcagctcgatgaagcagctcgcctcatgtcgctgcctatggaaacgttggcagaggctgcgtcaccgccggatggggcggtaccgtcaaatgctgctggaggtgtaattgtgtacctgcgccaagaaggacgaggcattgggctgggcgagaaactgaaagcgtacaatcttcaggatctgggatcagacacggtggaagccaatctcctgcttcgccaccctgcggatgcaagaagttatggattagctacggcgatcctggtggatcttggtctagggattgactcgaatccgcacggcatccgactactcacgaataacccggacaagattcgagcggttgagggacccaaccgagaagtggtggtgaaagagcgggtgccgatggtgccattggcatggagatcgggtggaaagatgggaatcaagagttccgaggtcgaagggtatctgagaacgaaggtatgtcgacaatctatctcttgcaagctagcttattttctcatcattcttgaacaatgtctcattctttcgtcgcagatatcgggctctccacggggacggaaggaccgcact

SEQ ID NO: 19539 - DNA, 741 bp, A.fumigatus
ccgcgcttcgtcaagcatctgaagcagaagctccattcaaccgcgccgcttctctggtcaagtcacgaaagaagagaagtgatgtggatggatcagcaacagactcgcccggtccctcaggtccgtctgtatcggacaagattggccgcatcaaaggcgtacaacgtagcaccagtgcttccagtcctcagacgcgtgacggccgcgaaattcgtgacggtgtcatggtcaaaattgaagaaacggcagaaagtatcagaggcacgatcgcggagcgcaacgggcagcttgtcattggcgccgaagtggttttcaaacataataagaacaaacagggcgttgaaggggaggggatccagtgtatcatcaagggaatctccggtgaaggtcctaagaagaggtctgtctccatcgcttgccctttctgagtgcaagaaaattgacccgtttacctctagatacgacgtgcaagaccccgaaccaaatgagaatggcgaacaaggcgctgtctacaagaccacggccgcatctctgatccctattccccaagtcggctccacactgccggttttccctgtggggaagcaagttctagcacgataccccgacacgactacattctaccgtgctgaagtgatgggcacgaaaaaggacacctaccgcctcaaattcgagggcgaagaggatgacaaggaaatggaggtcgatcgacgatttgtcctagacattccgggaaaatga

SEQ ID NO: 19540 - DNA, 645 bp, A.fumigatus
aattgtactttcgcctccctcctccctctcaagtccgtcatcgcaatgtcgaatttaccgtcccatgcttctccgtcttttggggcgcaaacgcctaccacgccgcagcccgtcgacgagctttctctcaagtcgaacatcacatcagcccctgcgttacactccagattagacgaactccgagatgagacttccagccagatcagcagcatagacactgaccgcggggacatgacccctgcggttcccgcatcattactctccccatccttcactcctccagcaacccccgggggctcgatcaataccgcggagctgcttcaacagacccaattagctggcgcacggcaagggtcaacacatactaagccccccaggttgctttctcgtcttcccaatgtcgaatgtatcgtccgcgctcggatacccacgacaactggcgcggagatgtttcttcacctgtaccacaatgacttagacaacaaagagcatttggcgattgtgtttggaaatacaattcgaagcagaagcttggacaagatccggcctggagagacggagatggatcgcatgatccgtggcgcgtatgtcgggaaactccgaccgggccgtgtgagcagctggtatgacgaggagaaaggttga

SEQ ID NO: 19541 - DNA, 213 bp, A.fumigatus
aaatgtccacatgcggcggacttcttgagtttgatgagaaccatccacacccactatatctcggatagcccacctccaacagtttccatgtctatcacgttcggaatgaacccatttttcaacctttcgcctccacttctcttcctcgacacgttggcgtctcacgaattctgggccaacatcaaactcctctgtcatgggccactcgtctga

SEQ ID NO: 19542 - DNA, 207 bp, A.fumigatus
ccacagcgcggaacacccagcatacacactgtcattatgccctctagcacactcgatctctctcagaggatcctccgcatttccaggagtgatgatacccaaggttacgtgctcctccaggtctcccccatcagctctagtgccctggatctggatattgttgcgactgaaggggagaacccctatactggcactggtatgttctga

SEQ ID NO: 19543 - DNA, 264 bp, A.fumigatus
ttccagatccagaggaccctctggaattacaagcccatcaagcccttcatcctcgctctcgcctgtccggcaactggaggcactaggactaacaaccgagactgcagagcttggaatcgaacggtggtctctctttgtgccaccgaaacgaatccctatactaccttcggaccaatccaggtcgaaatcgtctgcagcagtgctagtggcctccgtaacgtctttgcgaagagaaagatgacgaagaaaatcttctgctggtaa

SEQ ID NO: 19544 - DNA, 495 bp, A.fumigatus
ctcatggcactcaataaagcatcagagattcggtcagcaatcacgggcacacttcctctctctagcccgtccaattccaaaacaaagcgatccgctcaagagatgttagacagtgaatctgatagtgaggacagatttgagaggatggaagtagatcactctgggcgaaacgatggtcgctcagacgatcaggaaacagaagatgaagaaacttctacgccccagccccttgaagatgacgaatacacaaacacaggcgaatcacttgtgtcaccatcaatagaacacaagcgcgaagacaacaagcaggcatcagacgaaacacctcataacaggactatagtaacaaattcagccgtcccgccaccccgaagagagctttcatttgctaagaagccacagatgaatcatatgtcacaaagatcaaacgaatccgttgctgcaggggaggatgctgaagaaacggcaggggagactgatgacgatgagttgtaa

SEQ ID NO: 19545 - DNA, 339 bp, A.fumigatus
cagcaacggctgggttctgtgaccctaagacaggatgatgaacaagccattcaactatttgattggtcgggtgcggctgttgcaagggcagatgttctcgaggaacgtctttccactttaaccgatcgttatcgcgccgccgaaaacacaatccaacgactcaaccagcagttggaagaattcatgcgcgccaagacccagcacgatgagttactgatgaccaatttcgtgcaattgttgaatgagaagaaactcaagattcgcaatcaacaacgcctcttggcctctgcaaaggtagactctgaaaaaggtatgattttgtcgtggcaattgcattga

SEQ ID NO: 19546 - DNA, 258 bp, A.fumigatus
gcaaagtacaactggttgaccagaacaagggcgttcagccaactaatacacctttcaagaaggttatcgaggacttctattttactaattccattgctcggaggtcagtctatttctcaaatatgcgtcatgcctaccgctaatcgagaatctagttccccgaccatggcccgctgttcagcagctaaggccactggaaatccagagacaaactttatggctgctggtgaaatgtctccccaggctctgtacggctag

SEQ ID NO: 19547 - DNA, 702 bp, A.fumigatus
ggaagggctcccaggaaccgaagtgtacgtgttgtccccatacatatgagttgttttaaagttgacaatttttttctaggtgtgaacggaatgcaatacaatccggactctttccaatgggagggaaacgagacttccgttattgggtttgattctctaagatcgccaaagtcccccaaaccggcacctgcgttgatcaccaatgtgagtgcgatgcagaatgtgcaggtcgttggtgggatggttttcgatccacgacgcatgtgctggttgaagctggcgtcatctcagccgggcgcacaggggatggtggcagtgcaggttgaagacgatgtctttgccggacttgatgacctcgaggaaaaaagtcagagaaagcctccaggtggcccaggttctggtagttacgatgtcgtcgaacgtactgtgagtggtgatgagccgagttgcggcgactcctcagacgagtggcccatgacagaggagtttgatgttggcccagaattcgtgagacgccaacgtgtcgaggaagagaagtggaggcgaaaggttgaaaaatgggttcattccgaacgtgatagacatggaaactgttggaggtgggctatccgagatatagtgggtgtggatggttctcatcaaactcaagaagtccgccgcatgtggacattttcaacatacttcgtctttcggagggcataa

SEQ ID NO: 19548 - DNA, 1500 bp, A.fumigatus
  unsure (71),(77),(227): Identity of nucleotide sequences at the above locations are unknown.
attgggagctcttccggggaaataattgacctttgccccggtgggtgctctaacatcggaaacctatgccntcccgngctcgtcccatgggaactgaagcacaccgagtctattgatgttcacgatgctatgggctccaatgtccggatagataccagaggcatggaagtcatgcgagtgcttccgagactgaatgacgacatcaatgaagaatggatcgacgatanatctcggtttgcatgtgacggtttgaagacccagagactgacgacgccattgattcgaagagacggaaaatttgtccccgcaacctgggagcaagccttaactgagatatctagcgctcagcagaaactgcagctgaaggagaatgaattcaaggctgtcgcagggcatctagtcgatgccgagtcacttgtggcgatgaaagacttagccaacaagcttggatccgataacctagctctggatcagccgagaggagactcccccattgcccatggaattgacatacgctcaaactacctcttcaattccaaaatctacggaattgaggaagccgatgtcatccttctggtggctacgaatcctcgccatgaagcagctgttctcaatgcgcgcatacgcaagcagtatcttcgctcagacctccaaattgggttggttggagaggagtttgaaagcacctttgaatacgaacaccttggctcaaacatctcttcgttgaaggccgctttgtctggaaaattcggggagaaacttgcttctgctaagcggccgatgatcattgtcggaagcgccgcagctgaacatcaggatgcgaaatccgtcttcgaaactgttggcagcttcgttgaaaaacatcgaaacaacttcaacacccctgaatggcaaggctacaacgttcttcaacgtgctgcatcccgtgccgctgcctatgaagttggtttcactacgccatcttcagaagtagcgcagaccaaaccgaaaatgatctggctcttaggagcagatgaagttagtcaaagcgaaattccgagcgatgcgtttgtcatttatcagggtcatcacggtgatcgtggtgctcagttggccgacgttgttctccccggtgcagcatatacggagaagtcgggcacatatattaacactgaaggacgtgtccaggttactcgagcggccacctccttgcctggtgccgcacgtgacgactggaagattatccgtgctgccagtgaattcctcaacaagccgcttccctacgacgacattgaggcactccgcgatcgcatggaggagataagtcctgtcatgcgccggtacgatgtcgttgagccaacttccctgagctcactgagcaaagtacaactggttgaccagaacaagggcgttcagccaactaatacacctttcaagaaggttatcgaggacttctattttactaattccattgctcggaggtcagtctatttctcaaatatgcgtcatgcctaccgctaa

SEQ ID NO: 19549 - DNA, 2490 bp, A.fumigatus
tctctcctgtcgccaccggttcttcgagaagctgtccgtaacatggagtcatcgacctgtcaggtcccacatggggacgaagagacgatcgagtgctgggacgacgacggggatctacactgttacgaagacatccatatccgtacggcgtcaactgctacatccgtaacgaatgtatccactcgtcggtcaggtcatcgagactctatatcatcccgtcggtctactcgctctgatctggactcaaacgcggcagaagatgaggatttgcaggttcaacttccggatgacgacgaagatttgagcgaagacgccattgcatctgccaagaatgcagggattcccttgccagtcaacgttcccaaatcggctctcattgggggaacgatcaagcgacttgggcgaagaaaaccgaggaagaactttatagacgattggtctgacgatgttgagcttccaggtcctgatgctgcgcttgagctcaaaaagtttaaggacacggtttttccggagaccctcaggcagctcagttcagccacaaacagtccggtgaaaagatctccttctcctttatgggaagatgatctttcgacgcgattgcagtcagccctgacaaatctaagtccaatttaccggatgataacaatcacagcttgggcgggaatattgaccagggcccctaccatcaaagttgcgaaaccctcgatcacccaaaattggaccaaatcaattacgaagcacaacgttacaaagatcgatgcgctgttcgaaaatgttgaggacgacttcgaattaccagcagaagattttcttcgtcatctttctcttcgcaaagacgttacggaggccactagcactgctgcagacgatttcgacctggattggtccgaaggtagtatagggattcgtttcggtggcacaaagagagaccaccgttcgattccaagctctgcagtctcggttgttagtcctagtgcctccagttgccggacaggcgagagcgaggatgaagggcttgatgggcttgtaattccagagggtcctctggatctggaatcaatgttgaagaaacgccagagtacctgctctactgataagccacgcttctcgccatcaggccaggccgaatatgagctgactagctcggatgatttttttgcgggtctcgaaattgaaagcggcgatgctttcgatttgaagaagctttccctcaacccaaacgtaaaatacaaggttgagcgtcccagcagtccggcgcgccgctcaacaacctccatcacattcacaaatactgcggtctctcccaggtctcggattccgcgcctctttggtcatgaccgtcattcaacacatctcgagaccgtttcagaaagtggagctccgctgtcaaaatttccgggcttacgatcttgggcgaggggccatgtaaaccatgcctccatctctagcctgccttcaagaccaatatcgacatctccaacgccttcgacaccagcccggcgatctgtgacgtctcgatctcccaaaaccccattgagcagcgaccgcgccactagcggcacacaacccctcaggaacaaacgatccatgccgactattcgaagtgtaccgcaatctgcacacttgtcatactcacagggttctctttctcgtgaagatgaatcagcccgctcgtccatttctcacgttcgagcaaggatgccaggggaatgcgcagaaaatgactcaagatttttgagtcgcaaggcccaaacgccatttattccagctggggcttccgaaactcaatctcatcacgtcaatgtaaagggtcctcgacactttcgtcggacaaattccgatggttctagcgaaatatttagttcacgagtccctgtatctcgatactctcgatcaggccgacattcgatttcgaacagcgttactgatgaatctcagtgtaaaaatttgattacagctgcgaagcagactatcactagacctacgcggaggcgtaatttcggcgatgggactgagctggaattatttgatgatctccctacgtcctcccttgcagagagcaagttcatcaagcacccaattggacgtggtgtcccgaggtccctccgcagcagactcggtcataatcagactcgtccctcacgaacagaagttctgaaaccgccgtcgacttcaagtactgtccctacatcatgcgaccttactcctcggtttgcgcgggatacaaacgcctcaagaaatgcaagggaacaacgtatcgcttcgatggcatttagcctgaaaagtcgtgagagcaatccacttggccttctcagctcaaactcgaaaaatcctaacatcgctcgtgctccttcgaacccggcgacgcttggcagaaaaactagaggtgtcacagcatccggtggtaagcccttcctgatcaagtcaatagggaagggctcccaggaaccgaagtgtacgtgttgtccccatacatatgagttgttttaa

SEQ ID NO: 19550 - DNA, 231 bp, A.fumigatus
gacaggatgtctgtttatatacaagaattggacaacactgtccgggccttctatgagggcaaaggggatttggtgagacaccataatgattccgccaatatgtacgatttttcttttaaagcttgggttgctaacttcacaatgcgactctccgttcagcaaaagcaagcccagcagactctaacagaagtgagtatttctaaaccccagcactcaatgcagggtcactga

SEQ ID NO: 19551 - DNA, 834 bp, A.fumigatus
ccctgtgcccagctcattgagaagttaccgaatcgtgactatctcacacacgcccatttttaccttattcgtattagtcagatcgacgacagagaggtcttcaaaatttgtctggagtactggacaagactagtgcaggagttgtacgaggagatgcaacaactcccaatcacagatatcaaccccttggttagcatgggtgttagtgggttgtcaaacggaggggcaccacatcctagcactcttgccaattatccccttcgcaagcataagtacgaggaagtcttgtcgaaccttcgcactgtgatgatcgagaaaatggtcaggccagaagaagtcttgattgtcgaaaacgacgagggcgaaattgttcgcgaattcgtcaaagaaagcgacacgattcagctctataagacaatacgggagtgtttggtttatctgacacatcttgacgtcgtcgacacagaaaatatcatgatcgagaagttggctaaacaggtggacgggtctgagtggtcatgggctaattgcaatactttatgttgggcaattgggtcaatctcgggggccatgaatgaggagactgaaaagcgcttccttgtcactgtgatcaaggaccttctgggtctcacagaaatgaagcgaggaaaagacaacaaagcggtcgtcgccagtaacattatgtatattgtagggcagtatccgcgattcttgaaggcccattggaaattcctgaagacggttgtcaacaaattgtttgaatttatgcacgaaacacatgaaggtcagttacgcatgctgatttacagtgcgtctctttctgacacacactag

SEQ ID NO: 19552 - DNA, 387 bp, A.fumigatus
caaccgcgaagtggaaaatactggccttacaatgtgcctcgaactgatgaacaatatggccgagaccgatacgcaaacatcgagcattttctttcgccaatttttcatccctatcctccaagacgtcttctttgttcttaccgacagcgatcacaaagcaggttcgtacacatccatggtactagaggagctcacacttaccttttggcagggttcaaatctcaagcaatgctactgtcccgtatgttctacttcatcgaatccgggaaggtccaagaacccatctattcccccgaacaagcgccgctcgggacatccaacaaagacttcttgcaagaatacgttgccaacctcttacaaaatgctttcaagaatcttcaggagtaa

SEQ ID NO: 19553 - DNA, 756 bp, A.fumigatus
cattcccaggcaagcatggcttttgagaatgctatcgaagctgacttacttcaccagagccttatggaagacaaggttcctttaatcatggagagtgtgttcgaatgcaccctcgagatgatcaacaaagacttccatgagtatccagagcaccgtgtgcagttctttaaattgctccaagcgatcaatctatactgttttccggcgttactcaaacttgatgccacacaattcaagtttgtgatcgactcttgcatgtgggccagtaaacatgacaaccgcgaagtggaaaatactggccttacaatgtgcctcgaactgatgaacaatatggccgagaccgatacgcaaacatcgagcattttctttcgccaatttttcatccctatcctccaagacgtcttctttgttcttaccgacagcgatcacaaagcaggttcgtacacatccatggtactagaggagctcacacttaccttttggcagggttcaaatctcaagcaatgctactgtcccgtatgttctacttcatcgaatccgggaaggtccaagaacccatctattcccccgaacaagcgccgctcgggacatccaacaaagacttcttgcaagaatacgttgccaacctcttacaaaatgctttcaagaatcttcaggagtaagttggctgctagcccagtctcgattgaaagagtgctaattctgtctcaggatacaaatcaagcagtttgtagttggcttgtttaccttcaatga

SEQ ID NO: 19554 - DNA, 741 bp, A.fumigatus
gactacttaggcatacgaaatttcatcgtcaacttcattatcgaaaactccaagtcagaagagaagctcaggagtgaacgcgcgtttttgaataagctcaacctggtcctcgtttctatcctgaagcaagagtggcctcataattggcctactttcatcaatgaaataatctcgtcttgtcatacgagtctctctatctgcgaaaacaacatggccatccttcgcttgttatcagaggaagtatttgacttttcgcaggatcagatgacttctatcaaggccagaaatctcaagacttccatgactcaggaattctcatccatcttccagctgtgctccgaagttttgaatacagcaaaccagccgagtctaatcaaagccacattagagactctccttcggttcctcaattggatacccctgggatacatatttgagacccccatcatcaacaccctcttaactcgtttcctggacgttccggattttcggaatgtgacattgaagtgtctcaccgagattggaggattgcaaatcggcaacccttacaattacgatgaaagattggttcaaatgttcactgagacattgaccatagtctcgaaaaccattccactctccatggatttaaagcagacatatgccaaaagcaattcgagggatcaggagtttgtcctcaacttagcactgttcctctccagctttttcagtgctcatctaactgtgagtgttacaaaatag

SEQ ID NO: 19555 - DNA, 489 bp, A.fumigatus
cacacactaggtgtccaagacatggcgtgcgatacatttatcaagatcgcaaacaagtgcagacgccattttgtcgcccttcagcctggggagaacgagccattcattgaggaaattgttcggaacatgagaaagatcacctgtgacctttcaccacaacaagttcacactttctacgaagcgtgcggatatatgatttctgcccaaggccaaaaaagcctccaggatcgtttgatcgagaacttgatgtcccttcctaactcggcgtgggatgctattatagcccaggcgaatcaagatccgtccatactccaggatggagaaacgataaagatcatcggcaacattatgaagacgaatgttgcagcatgttcctcgattggcacatacttttattcccagattggccgcatctaccatgatatgctgaacatgtatcgggcttctagtcaactcattaacgatgctgttgcgcacgatggtaaataa

SEQ ID NO: 19556 - DNA, 333 bp, A.fumigatus
cgtcgaacaggcaacatcgccaccaaaaccccgaaagtccgaggacttcgtaccatcaagaaggaaattcttaagctgatcgatacctatgtgcaaaaagctgatgatctggagatggtcaacgcaaacatggttccacctctcctggaggccgttctggtggattataaccgaaatgttcccgacgcacgggaagcagaggtgctgaacgtcatgaccacaatcgttcataaattacatgtatgtaacattcccaggcaagcatggcttttgagaatgctatcgaagctgacttacttcaccagagccttatggaagacaaggttcctttaa

SEQ ID NO: 19557 - DNA, 252 bp, A.fumigatus
ttctgtctcaggatacaaatcaagcagtttgtagttggcttgtttaccttcaatgatgacttcaacaagttcaagacccatttgcgggatttcttgatttctttgaaagaattcgcaggtgataatgcagaactttatgcagaggaaagagagcaggctctgcgggatgcgcaggcagcagaacgagaccgggcaatgagagttggaggacttttaaagccgtctgaaatggatcaggaggatgagctctga

SEQ ID NO: 19558 - DNA, 1158 bp, A.fumigatus
atcacagagaatggcaaccttagcatcacctcagatgaacaaccccctaccacaacccatgatggcacgagcaagaaatcacaaagacagaaagggcctctcaatctagtagagcctggagaagaatcaatatgccagcaacagggtaactttggaaattccttcagccaatgttcaaatgacaatgagcggaaagaaactaatgctcacgaaatagtcgcgcttccaaacaagaagggacagaaatcagaatcattgtcccctgcaaaaactgtatctatatttcaaggtgcctctggaatgacttcttcaatattaaacgccccgccgtcacgtccgtcaagacgtcaaagatctgttgtgagctatgccgaaccgaatttgagagacaaaatgcgtcgacacacaaacgaatttgttcccgctgtcgggggggagaggcagaccaagacattgaacacagctgcgcttcccaagtctaccgatgagggagacgtggggttacaaaccgatatcagccgagcaaaaaaaccggagaattcgccagggacgacccgggaccacatatcaatattggaaaaggcttcgggtcacacatcacgttctaccgtaaacatggtttcactcagaaaaaaaaagaacattctggcgaatattgtgaccgctggcgaagaggaccatgatactctacaaagcgagctgtcatcgggcgctagtgagagacccaacttctctgttgaaaacagcaagcccagaggatgcgaggaccagaatacgctccgcatttcaaatgccgcgagaaataatgagctggactcacaatctacagatgatactgactccttgcaaagacatattgcagaagaatcagcgccaacttctgatagacgcaaacaaccccgacgccactcttcacactccaaaacatccacccagcatacccaaggcgaattaaggacggacctgcaatcaactcggaagttgtcgacatcgggtgctccttccaaggtactgaggccaacgatgcaggccgagaacgctgacaccgatagcgcagtattggacgaagaaacgggatctctttcaaaagcaatggtgggagggcggctgaaacgtggacatcgggcggtcgcacgaagaaaaagtatggtgctatga

SEQ ID NO: 19559 - DNA, 1752 bp, A.fumigatus
aacttttcgaatctcccattgtcggcttcagagacaatgtcgagtgccagaaatctttcagttgccctccgacgggctcgtatacccacgcctcagtgttggttgcgccccatcatcgccaaccgtgctgctgtgccggccgcaagatctttcagtgtcagctccgttgtcggagggaatacaacaagagaaatcaagtacaccaccaacgcctaccccgaactgaaacgcaaccccaatttcgccgagatcacggaacaggatgtaaagtacttcaaggatctgcttggcgctcagtcggctgtgattgatggcgtgacagcagacgctacggacgatatcgaaccctttaatgccgactggatgcgcaaataccgcggtcacacaaagctagtcctcaagccgcagaacaaggaggaggttagccaggtcttaaaatactgcaatgagaagaagctggctgttgttccccagggaggtaatacagggttggtggggggttccgtgcctgtattcgacgagatcgttatcaatacctcacgcatgaacaagattcgctctttcgatgaggcctctggtgtgctggtcgtcgatgcgggtgttatcctcgaggtagccgatcaataccttgcggagcgcgaccacttgttccccttggatttgggtgcaaagggttcgtgccatgtcggagggaacgtcgcgaccaacgcgggaggactccgtctgctgcgttacggcagtcttcacggcaacgtgcttggtcttgaagcggtcctggcggatggcactatcgtcgactccctctccaccttgcgaaagaacaacacaggctatgatctgaagcagttgttcatcggctctgaaggtacaattggcattatcaccggcgtcgccatcttgtgcccccctcggcccaaggcagtcaatgtggcctacttcggtctcgaaagctatgaccaggtccgccaggcttacaaggaggccaagggtcatctctccgagatcttgtccgcctttgagctgatggacggacgcagtcagaaactcgttcacgagtcgaccggttcaaagtacccgctagaaggggagtaccctttctactgcctcgtcgagaccagtggttccaatgccgagcatgacatggagaaattggaaggcttcttggagcatatcatgggtgagggaatcgtcgccgatggtgttctggcccaagacgagacgcaattccagtctatctggcggtggcgcgagggcatcacggaagctctgagccacctcggcggtacctacaagtatgacgtctctattcccctgcccgaattgtaccagctagtggaagactgccgtgagcgcttgacgacgatgggattcgtgggcgatgatgattcgttcccggtccgagccgttgttggctatggccatatgggcgactcaaatctccacttgaacatttctgtcaggcagtacaacaaggaggttgagaaggccattgagccttgggtatatgagtggatccagaagcgcaatggcagcatcagcgctgagcatggattgggccttgccaagaaggagttcatcgggtacagccaaaatgacaccatgctcaagttgatgaagcagctgaagaccttgtacgatccggtaagtctagctcacttcagcacatccttcgagggtactaataatgttctagcatgggatcatgaacccttacaagtacatttaggcatcaagcgcctgcatggcgtttaa

SEQ ID NO: 19560 - DNA, 183 bp, A.fumigatus
acaatcgcaattggccttttactgacgggaaaattgttggtggcaggtgggagctttgggactgtgtacaaggctattgaaaaatctaccggggagattgtcgcgatcaaacacgtacgctctcaccactcagtgatttgttttcatttctttattgaccgtttgggattggatttagattga

SEQ ID NO: 19561 - DNA, 606 bp, A.fumigatus
ctgaaacccggtgtcttcagcgaagcgcatgttgctattatctgtcaacagctgctgcaaggcatggactatctacacagcgaaggcaaaattcaccgcgacatcaaagccgccaatgtgcttctctctcacacaggaaaggtcaagttggccgactttggggttgcggcccagcttaccaacatcaaatcgcaacgcaatacctttgttggaaccccgttttggatggcacctgaagtaattcaacaagctggatacgattataaagcggacatttggtccctggggatcactgcgatcgagatgatcaatggagagccgccccatgcgagtacgcacccgatgaaagttctcttcctcattccaaaagagccggcccctcgactagaaggaaacgagtatagcagcgctttcaaggactttatcgcgcaatgcttgaccaaggacccggagcggagacccagtgcgaaggagcttttgagacacaagttcattcgcaatgcagggaagaccgaggcgttgcaggaactcatccaacggaagcaggattgggatgctggcaaaggcgtgagacagaacgtcaaatactatgcggagtccctgtga

SEQ ID NO: 19562 - DNA, 225 bp, A.fumigatus
tgctgcttggctagacctctctgcataatttctccgaatctttcttccttctctccttccgtcacttatttcttcgtttcttctcatcagtccatcgctattcattggctgggcaaatcctcacgctcattttgtcatgatcgattcactcccttaagtaccacaatcgctaagttctacgctttattctgccccgaagatggggggctccccgggaacgggtga

SEQ ID NO: 19563 - DNA, 216 bp, A.fumigatus
attgatctcgaatcgagcgaagatgatattcaggaaatacagcaggaaatctccgtcctagccacatgcgcaagtccctacgtgacgcagtacaaggcgagttttcttcggggacacaagctatggattgtcatggaatacctgggcggaggatcttgtctcgacttggtaaatatatcgattggtcaagtatcattggaactttgcgatcgctaa

SEQ ID NO: 19564 - DNA, 924 bp, A.fumigatus
cagcgctttcaaggactttatcgcgcaatgcttgaccaaggacccggagcggagacccagtgcgaaggagcttttgagacacaagttcattcgcaatgcagggaagaccgaggcgttgcaggaactcatccaacggaagcaggattgggatgctggcaaaggcgtgagacagaacgtcaaatactatgcggagtccctgtgagttctgatgctttgggctttgagttgtctctttcgctaatctatattcacagcaatacgattacgcggctggaagacgacgacggctgggtgttcgacactgtcaaagcgcctcccacgtcgataccagaggatccgcacgacctagtatctgaacgggatacacgagaccgtctgtacgacgaagcctcggagttgatggacaatctgcacatgtccagcccacctgtcccgccgaaacatagctcaaactcaaccgtgcgacgaaatccagcagctgacaggagtccctctgtgcgacggccaaagcgacgatcaagtggtgtgaagcagcccctgggcgtcgacttgacttttggcaacagcccgtcaactgttcgccagttccgtcgggtgtcggataagaccgggcccgactcctcgtacaataaccagtaccagatcgccgtcgatgagaacgcaagcccgaagacagtgtattcggattcgaacagcaaggaggctcagctagggcgtcgggcttatagcaaggctgtcggccttgcttgccaggaggtccttggcactactgcagaccaggaaaagcgagaagccatctcaagactggcagaggcctggagcgacctggagatggtcgaccctgagggcctataccatattctcaaatctataaacgaaaaacttcagaggtcggtaattacagattcgcgtgtccgtcactag

SEQ ID NO: 19565 - DNA, 528 bp, A.fumigatus
accggtcgactcgtgaacgagtttctgactgcgtccgtccatcagctcaaaggcggacaagatctcggagagatgacccttggcctccttgtaagcctggcggacctggtcatagctttcgagaccgaagtaggccacattgactgccttgggccgaggggggcacaagatggcgacgccggtgataatgccaattgtaccttcagagccgatgaacaactgcttcagatcatagcctgtgttgttctttcgcaaggtggagagggagtcgacgatagtgccatccgccaggaccgcttcaagaccaagcacgttgccgtgaagactgccgtaacgcagcagacggagtcctcccgcgttggtcgcgacgttccctccgacatggcacgaaccctttgcacccaaatccaaggggaacaagtggtcgcgctccgcaaggtattgatcggctacctcgaggataacacccgcatcgacgaccagcacaccagaggcctcatcgaaagagcgaatcttgttcatgcgtga

SEQ ID NO: 19566 - DNA, 240 bp, A.fumigatus
tcggctacctcgaggataacacccgcatcgacgaccagcacaccagaggcctcatcgaaagagcgaatcttgttcatgcgtgaggtattgataacgatctcgtcgaatacaggcacggaaccccccaccaaccctgtattacctccctggggaacaacagccagcttcttctcattgcagtattttaagacctggctaacctcctccttgttctgcggcttgaggactagctttgtgtga

SEQ ID NO: 19567 - DNA, 186 bp, A.fumigatus
acgaaagtacaaattaaaatgtcgactactgttctgattactggagctaccggcttgctgggccgtcaggttttcaatacattcaagcattctggctgttttgttgttggtcaaggctactctaaagctaccccgcccacgatcctcaaggcggacctggagaaaccggaggatatcaagaatctg

SEQ ID NO: 19568 - DNA, 2262 bp, A.fumigatus
tctccctcctccaagccttcggtttccgcctctgaattgaaaacaccaaccataatcttcctttcaacaacgccctttctaccctgctcggcttctcattcgattccgtgcagctaccacacccccccaaccaatgtcctccccatgtcaaggccaccatctgcgtctgagaacaccttgcctgacaccctggtgacacctgctgcgtctgcccaacatgattgctctgcacagcctgagctctcttccggcaagcagcgtcgccacaacgctcgcgaccagcagctcatgcatcaggatgttcagcaagctccttctccatcccgcgctgaatccccgaccgctcatcaatggtctaaacctgcatctacccttaccctaaaaagggcattgactcttcccctggagaggctctcccaccctgatcggtctcacagtccccagctttccgaaagggattccatcttcgcaacccactacctcccttcagataacgaagccagcaacacaccgcaactgggccctgtacaagatgttgatagtgccttgacgaccgacttgtctccgggactcgataatgctcccgcttcgcccatttcctctgtgaaaatccccttccgtcgcccttccgttgatcgctcccccatggaagtcgaaattcgcaggactcacccgctgcgctcctctacctacgtttcgccatccctccccgcccatacctcgtcactacgacccgttgcttcagatgtagcttgggacgcacctcacaaggaatcggacaggaaactaaacgctcccctccgtgagagtttgcatctccccggaaaagtcctctcggatggtattggcactaaacacacccccttagaggatcccgttcccaatttcagtttgatatctgcgtctttgagagacccgtcttcgccatcccatcaccctgaatatccggaacaaacccgagaccggaattacgaaactaaagttgagcggagtgcgagtcggtcccgatgtggcagggttgagaactccattgaggccaatctcacaaatgcggagcctacctctcacgtacgcagtcgaaagtctagtcattacctcggcttgttcaaggagaatacgacctcgcctgaccgcaaaagaagggaggatcgagacgggaagcacggggagtttccgacgggggatgaaacgtcggacgtcactgttctttcagagcctgaacaaattcgggatcgtttccacacacaagcgggagatttgctgttggaagaagttggtcctcgaacttccaagagctcacctcagctcttactttctgccgctccgtcgatagggccgaccgcacggcaagagaatcgtccgcatcccctgagtgatgatatctccaaacgcccgctcaagtctctacctcgcagtttgctggaggaaattcgatcgttccacttgactccaggaggtggccggggttcctcattctccaagagtattccgacgcagtatgccgaaggtggcagagactattttgcagagattccacctagtgatgggctctcgccaccaaatacaattcgagaagaacgtcgggactcggggccattcgatgatgaagaggaggaacagatctcgtctgctgtatactttccgcatgagcgtgtcgctgtctccgaagaagtcgaccaagtcgagccttttcttgaaaatgagccagacgtggagaggttcgatgagtcggcgccaaagagtagtcttgctctggtgccgaaagtacataccgtgcctattgggcaggaaagcagtcatgtggatatatcgcttcggtctaaaaacgagaataggatcctccatggcgagctacaagagttacactcctctacactaaaagaatttgatcgcaaacctcttggcgccatttcagaacgcagcggcgaatactctacatgtgagtccgagtttgcctctgcggatgacagcagtatgtctgctcgagaggaggaatcgagcttgaccgacgatgctgacgtgaccccaaccgctactccgactcagcgggctcgcttcccgcgtccacggcggaaacacagttcgacagcgcccgtaggggcggttgaactgaagccttatcgacaccaagtgggtggccataccacggtcttccgtttctcaagacgtgctgtctgtaaacagctcaacaaccgggagaatgaattctacgagcgaattgagcgcagacaccctgaaatgctcatgtttctacccaggtaa

SEQ ID NO: 19569 - DNA, 252 bp, A.fumigatus
atagggcgctcgagaattactggcgttctccttgcacctttactatttattccgcatcacaataataatctgttatttcacctgacgggtctgcagggagaactgactttcgttaccagttggtcaattgcttatcccagctggcctggggaactgtccatttctatacaacctgctatatatataaacatacagcataacaacttctcagccgtcttcaccacggggctggaaggtccgcgccatattgaa

SEQ ID NO: 19570 - DNA, 297 bp, A.fumigatus
ttccctctatttagatatattggtgtcctgaatgtgacttattcaaagaattcgaaacgccccacagcttcgtcaggaaacaatgctgaacccacagataccgaacatagcaaggagctcacacaagatgagataggctcaaggaaaacaagtatcagcaagcctaagtcgggagacgcagagccggaacgaattttcagtcaaaaacaagtgaccggtgtgattcccaaggtgatactcgagaacaaccgccacattattccggctgatctgtttatgcgctggccaaagacctag

SEQ ID NO: 19571 - DNA, 273 bp, A.fumigatus
gcccgctctaacgccaggtatgggcaatggacgaagagaaaaccatggcagttcttggcagaagagacgccatatgtcaattatattgcgccagccctgagcgtctacatctgtctgagccacctaatgcaatttcagccaggaagcactacgggtatctgtagcaccgcagtgattgatcaaagtagtatgctacgacaaagtcttgattaccttctcgacgaagtttcaagaacccgaatgtacgattgcatgcggaagagctccagataa

SEQ ID NO: 19572 - DNA, 1746 bp, A.fumigatus
  unsure (191): Identity of nucleotide sequences at the above locations are unknown.
tactcgagaacaaccgccacattattccggctgatctgtttatgcgctggccaaagacctaggacagctgattgtgccgcgtctggtagtcggcgggctttgaacggcaatgaaacgtcagctgggaagcaatcggtcggtggatctaccgcaggcagtgtttctgctccaacgttggacaagcccatcgntagatggggtgccacaacggtgaacaggaagttgcaggagcaggtccttcgagaggtctttagccttcccgccatccatcatcaccggcgccatgcccgcggtcacttgaatctgccaaggacgtcttcggactgtggccgtcgacgggccaatttatctgaggaccagagtgttagtctgaatcggtacgcatcggaccgcgttgaagcagcgtccagttctttgggcattgatgcttcgaagccgtccaaggaaagcccagctctgtcatcttccgcctcaacggcgcttgacgcaggtcacggccgcctcgagaaggtccggactgaagaaccacaacctcgtgccagctcgctcagtcgaacccggcgggtcaggagacgccattcaggcagtggtctccaaagacggggaagcatcagctctaataaaggtgtcggtcaactcatgtttttcgaggatgatggctacggtggcgataaagaagatggtatatttccgatggaacgcgacgcctccttgctttcatcgagcgatcccaatgtgaacagctccactagtgcgctgatttataaggatgacatgtccaaagatgtaccatctgcacccttggccacccgcgatagcccccccaagtctttgcgccttcaggcaaaggatgaatctcagatgattgtcccttctaatcctaaggaggctcaaactagacgagacgaaagggttcaatttttcctattgctggaggatctcacagctggtatgaacaagccctgcgtgttggacttaaagatggggactcgccaatacggtatagaagccagcgagaagaagcgaaagtctcaaaggcgcaagtgccagtccaccacctctcagcagctgggtgtccgactttgcggcatgcagacttggaatgtgaggaagcaggaatacacgtttgaggacaagtacttcgggcgggatctcaagtctgggcgtgaattccaggatgccctcacacgctttctctacgacggcatttcttacaggagtgtggcgaagaaaatccccatcattctggataagttggcaaagttggagagtatgattcgaaagctcaaacgttatcgcctgtatgctagcagcttactgattctttacgatggcgagcaaaatcctaccgaaaaatctcaagtcgatgaagctcacaacgccgacaagcggccacctcttcaccttcaccgccgtgcctccgaggacgggcacaacaataccgaagtacatctaaagatcgtcgactttgcaaactgcgtcacgggcgaagacgaacttcctccagatgctccctgcccgccccagcacccagatgatattgaccgtgggtatctccgtggacttcgctcacttcgaatgtactttcaacgcattctcaaggaagtgactcaagatgaatttgttgagcggggtgaaggcgaagctgtcgctctccgatctcgtgattccggtcgcgaggaatcaacggaccggttctgggacgagagcgtgttggaggaggatcccggtgaagtcagcttctga

SEQ ID NO: 19573 - DNA, 486 bp, A.fumigatus
atgatgcgccgaaaatgcaaaagaaacagtctagagaatcctctccttcctcgtcttcctcatcctcttcctcttccagttccagctctgacagcgatgccgatgatgaagaggatgacgatgccgcccccgcgcctgctccagcgccgaagaccaccggcaccaagcgcaaggctgaatccagctcatctgaatcgtcttcggaatcagaatccgaggacgaagcaccgaaggccaaaaaggctaagctctcgacgaagtccgattcatcctcatcttccgagtcgtcggattctgaggacgaggaatccgactcctccgacagtgagagcagtgcttcatcctccgattccgactctgattccggctccgactccgactcctctgacagtgagagcgtttcatcgtctgattccagctcagactccgattccgactccgaatccgagaaggaacccgccaagaaggctgctaagaagatcctga

SEQ ID NO: 19574 - DNA, 1257 bp, A.fumigatus
gccaaaactgtcggtcctccaccagagttagttgcgtcggttgccgctttcttatctcaatttggcttcaaaagtacaagcgaggctctttccaaggagcagtctaaaaaggcaattgccaaggtcgactcgaaggaagtcccttcactgctggacatcttccggagctggcaggaccggaagagtgagagcagctctgacagcgaaagcagctcgagcagcagtgaggatgagtctagtgactctgatgtagagatgaatgatgcgccgaaaatgcaaaagaaacagtctagagaatcctctccttcctcgtcttcctcatcctcttcctcttccagttccagctctgacagcgatgccgatgatgaagaggatgacgatgccgcccccgcgcctgctccagcgccgaagaccaccggcaccaagcgcaaggctgaatccagctcatctgaatcgtcttcggaatcagaatccgaggacgaagcaccgaaggccaaaaaggctaagctctcgacgaagtccgattcatcctcatcttccgagtcgtcggattctgaggacgaggaatccgactcctccgacagtgagagcagtgcttcatcctccgattccgactctgattccggctccgactccgactcctctgacagtgagagcgtttcatcgtctgattccagctcagactccgattccgactccgaatccgagaaggaacccgccaagaaggctgctaagaagatcctgaagactgctgccaagacacccttgcctgaatcaagctccagctcgtccagcgactctgattcatcctcctccgacgagtcctccgatgagtcttcgtcagatgaggatcagaataccaatagccgcagctcctcgtcttctcagaactcatccggcagcagcaaaactgttcagccctccgattccgatgcgaaggagcccataaacaagactacaaagcaggctcaagagaccagttcgtccagcgccagtccggctcccggaaatggcccagcgacgaagaagaagcacactggagctcgtcccacacccctggcgcaacttagtgagttgccacacaaccacccctcgaacgcatacgtcccatatgcctacgccgagaaggcttggaaggatctgtctgtcactcgtggcaagggcttcacaaaagaaaagaacaagaagaagcgtggctcctaccgcggtggccccattgacatctccggagggaagtctttcaagttcgaggactaa

SEQ ID NO: 19575 - DNA, 1170 bp, A.fumigatus
aaagactgcgctgagatcgacttcgaaatgctgctgtccgatttaccgtcggacataatatacgtgatagcaacatatcttccgtctgccagctcattggccgccctcgctcagacctgtcaacgcctgcacaaggtcatcgctgctgaagattggcgggtattccatgcacatttcaagaacagattcccctttgttgagacgcctcccttttggaaggatgcaacccaggcgctcacggcgcgtgcccgagcattggacagactcggactgctttgtcgtttcgtcctccccccacgagatgcggtgaaggttggatcccatcggggcacacggcaggacaatcctacacatgggtatcgaccctcgattgattcatatgaatcttggccgggtggttcctggtcggaaagaaaggaggtgctcgtctggggcgctgcagatgagttagttttgcgcattcggcagcccacgtataacggcggagagacgtggttcatgtttaacgatgtgaagacgaagatcagcagctaccatgacatttgtggtgtacatctcctcaaacaagaacatcataccagaaagtcaggcgacgagcacatcatatttggtcgcctaaacggtgacctatgtcatgttgccatttcgccggactcggcgtctcacaaatactaccaacgtttcatgactaacggccatggacttgagcgtacagacttaagcggaggtgacgagcctattttggcggctcatttgaacaatgggtccattgtgttctatcagacgacaacgggagaacccgaagttgagccgtttgcgcattgcaagatcactccagacggcacggcccgtaacaagtattctaagtttctgtcaccggagtgtattgcgtatggaactggacgccaggagaatgccctgactatcgccacgatatcgaacgaacgactatcagttagccgcgagatcagtgtgacctccctggatatcggggaaagtatcggcttacgtcgaaaggccaatgtgagcgcaatcgcgcctcttactgctcaatccacggcagaatcctccggacaagtgtttcttgctgcctggggtgatcgctgcatcaggtacctttctaccttacgttgctcggttatttacatctcttctaattctccaaactag

SEQ ID NO: 19576 - DNA, 240 bp, A.fumigatus
ttttccagccccgtggtgaagactacgaaaagtagcaaaatcacaattgaaagtgacgtgtatatggagaccaccatcttcgcgggttgggtcgaagtaacaagccaactcaggttacttagggtcctcaagatgccgcatcaaccaaagtggcggcaagaaaagctcataaacaacttatccgcagacacttatacacctatatacctgtatcagttgactccagtccgtaggaattag

SEQ ID NO: 19577 - DNA, 1428 bp, A.fumigatus
  unsure (1418): Identity of nucleotide sequences at the above locations are unknown.
tgttctggacattttagactgacaatctctacgggaacagtggtcgaatcgtacataacccatgttcgcattacggaagacgccgcgcatccgtcgacccctgcccctcccaattcacctcctgagaacaagaaacctcgggttattatcgttgctgttaggagatcaggaagggtgcgcatgcataaagctcgagagaataacgatggcacattttctatcgggaagacatggatgctcgatgatttgtcctcaattcaatcatataccgggtttgttccgtcaacgccactggaacaacaacataagcaatgggctgccactgttggctttgtagttactgtgggaaaaccgtactactggcatgctaggagctccaaggaaaaggattttttcatcggcagtctcgtcaagatctatcggaaatacaccggcggaaaagtgccgaacctcattgggttcgatgatcgcgagagacaactgctcgttggaagcccttctcctgctcctccgggctcgcgaggcatggggcaaggacctgccacccgctccccctcctcgcagggcagccggcctcagtcgccatacaccggtcgcgcgcccagccgcgatggcccgcgcgatattccccgtgagttcaaacgacagccctctgaagagcaggctctacgagcgcaaagaagtcgagatcagatgcaaaggccgtccacaagccagtcaggacgagtggccgctccttcgccgttgggccaaacttcccaaccgctgggagcagtttcccctgacccacgaggtgaacctcctccgcggtcaaacgaacgtctgcccaaggcacccgtgctaccgccgccggaaccaagaaccaaagaggttactgatagtctggctgctgctaagccagtatcacatacaccaagcagtcaagcagatcttgggtcagaccctcgaccgtcacccttcctacaggatggaaaagctgtcctagaccccagccctgtgcctcggactgaggacttaagctcgagtctacacgaggttggacacgataaggacgcccgtcctagcacagctgtgtctgggtctgccgagaacctggatgttatgcagaccccggcaagcagcatggaagcaaataagactgtgggcgagagcagggaaaatctgtcacttccagagacgcaggtggagcctcagattattgataaacctgccggccccgtcaagatgcagcctcctgacataccacctgcactaaggccagcttcttcgagaagtaacaatgtgcctacaccgtctgtggccgctgcgcctccggaaacaacacgatccgtgactcctcccaccgcagctgaaccgagcgaaacaccacgcgagagatcaccgagcccgccactggccaactctcccgaatcctccangccgggttga

SEQ ID NO: 19578 - DNA, 795 bp, A.fumigatus
tcctcatctgacgaagactcatcggaggactcgtcggaggaggatgaatcagagtcgctggacgagctggagcttgattcaggcaagggtgtcttggcagcagtcttcaggatcttcttagcagccttcttggcgggttccttctcggattcggagtcggaatcggagtctgagctggaatcagacgatgaaacgctctcactgtcagaggagtcggagtcggagccggaatcagagtcggaatcggaggatgaagcactgctctcactgtcggaggagtcggattcctcgtcctcagaatccgacgactcggaagatgaggatgaatcggacttcgtcgagagcttagcctttttggccttcggtgcttcgtcctcggattctgattccgaagacgattcagatgagctggattcagccttgcgcttggtgccggtggtcttcggcgctggagcaggcgcgggggcggcatcgtcatcctcttcatcatcggcatcgctgtcagagctggaactggaagaggaagaggatgaggaagacgaggaaggagaggattctctagactgtttcttttgcattttcggcgcatcattcatctctacatcagagtcactagactcatcctcactgctgctcgagctgctttcgctgtcagagctgctctcactcttccggtcctgccagctccggaagatgtccagcagtgaagggacttccttcgagtcgaccttggcaattgcctttttagactgctccttggaaagagcctcgcttgtacttttgaagccaaattga

SEQ ID NO: 19579 - DNA, 717 bp, A.fumigatus
catgctaaccatgccgctatcaacagaacaaggcaagtcgcaaaaccatacttcagagaatggtccaacatgcgctatcacgagggtaaaaccttcaaatcaaacccccgattgttcaaacgagacaaagccctctacttccctaacatgtacggcatcacgcttgcgtcgccgaaacaaccgcaaaacaccacctcaattctccgcggcaaagtgtccgttgtcaatgtcttctccagtgtctgggcggagtcgcaggttgcgacatttacgggtccaaagcagaaccccggtctatgggaggcgatgaagagcggaagcgagcttgtgcagaaggtcgatatcaacctggaagaaaatgcgatgaaggcttggctcgtgcgtatgttcatgtggcggatgagggcaaacctgcccaaggagcagcacgaacggtatttccttgtgcgcaaaggtcttacggatgggttgaaagaagcaatcggaatgatgaacagtaaagttggttatgtctatctgctggacgagaactgtcgcatccgatgggcgggtagcgggccggcagaggaaggcgagctaaacggattgaacaacggggttcgcaaattaatccaggagagaagaatcagtctagagtcgaagctaccggctgaggaatgggcgggaagaaaccaaggtgaatccgcaagtccgaaaccaagagtgatcatgcggtga

SEQ ID NO: 19580 - DNA, 495 bp, A.fumigatus
actcgaaacccttccttgtgcatctgcaattttacctcgaaaaatgaaacccctcatggcacggaaatttactggaaagacaacggaacgacacactgggaagaatcgggcctaccagaatcgcagattgcgcaatatacacaagatgcaatgtttggggacaggaatgctgatttgctgcggttctacagccacgacgttcgcaagtcgatcgctcgcgttctcaccgtcatcaacgccaaccagcgcgcccagctccgtctgttctacaagaacaagaagtacactcctcttgacctcagaccccgcctcacccgtgccctccgccgcagactcaccaagcacgaggccaccctcaagacggagaagcagcgcaagaaggagatccacttcccccagcggaagtacgccgtcaaggtatgtttcctactgcatcacaccatgcggaacaaaaaccccgcaatcgttcaagcatttccaattttggccagttga

SEQ ID NO: 19581 - DNA, 606 bp, A.fumigatus
agaccgagctctcccagctccgtgtccagaagatcgctgccggtgcctcgtcgaagactcagagaatgtgcgtttgaactcgaaacccttccttgtgcatctgcaattttacctcgaaaaatgaaacccctcatggcacggaaatttactggaaagacaacggaacgacacactgggaagaatcgggcctaccagaatcgcagattgcgcaatatacacaagatgcaatgtttggggacaggaatgctgatttgctgcggttctacagccacgacgttcgcaagtcgatcgctcgcgttctcaccgtcatcaacgccaaccagcgcgcccagctccgtctgttctacaagaacaagaagtacactcctcttgacctcagaccccgcctcacccgtgccctccgccgcagactcaccaagcacgaggccaccctcaagacggagaagcagcgcaagaaggagatccacttcccccagcggaagtacgccgtcaaggtatgtttcctactgcatcacaccatgcggaacaaaaaccccgcaatcgttcaagcatttccaattttggccagttgagtccctaatgaggagtttctacaggcctaaatga

SEQ ID NO: 19582 - DNA, 219 bp, A.fumigatus
attgcggtaggcatcaatgtcggagcggacgttagacagaagattggctcggtcgcgggactcggcgattgcggcgttcaggcgctgcaattcgcggcgatgatcctggaggacttcgcgattgcgggcaagattgctctgtttcagggcagatgcggtaagagtggcttcggagtcaaggagacgggagagctgggagatgagggcttcacgctatga

SEQ ID NO: 19583 - DNA, 504 bp, A.fumigatus
cgtgaagccctcatctcccagctctcccgtctccttgactccgaagccactcttaccgcatctgccctgaaacagagcaatcttgcccgcaatcgcgaagtcctccaggatcatcgccgcgaattgcagcgcctgaacgccgcaatcgccgagtcccgcgaccgagccaatcttctgtctaacgtccgctccgacattgatgcctaccgcaattcaaaccccgccgcggctgaggcagactacatgctcgaggagcggggtcgtatagatgaaagccataacatgatagatggtgtcctaagccaggcgtatgcaatcaacgagagttttgggctacaacgtgaaaccctggccagcatcaatcgccgtatcgtcggtgctgccaataaggtaccaggaatgaatgcattgattggtaagattgggacgaagaggagacgtgacgcaatcatcttgggggctttcatcggcttttgtttcttgatggtgttcttcttccgatga

SEQ ID NO: 19584 - DNA, 234 bp, A.fumigatus
tggtgttcttcttccgatgagatgctggtgctccgtataccgccgatcttcctgtgttataattccttgctcaacgttatctacatcggataccgcacggagttcgggtgttttcatgtactccttttctgcatgcaagcactaatcacaatggtcatggcgtttcaggttgtctatttcacatttatgtacatacagggtcatactgctgtagccctacggctcaccgcatga

SEQ ID NO: 19585 - DNA, 1173 bp, A.fumigatus
atgcagcctttggaccctctggaggaagactccgtcggagtcaatgatacggagacctcggacgcgtccgatacagaatcggttgggaagaaagaaagtcatctgtctgaagaggacaagatgatagaggcttggcagcagaaatttgcttgcatgcagaaacatgattcaagttccaaccttgacaatccgaactgtaagaccatcgaagtcctccagcaaatgctagactattatactaggacgtcggatcagtggcgtacgttggcctatcgaaaagcgatagctgcccttcgcagacaaccgcgaaaaatcgtcaccagagcgcaggcgcttgctatccccggcatcggcccgcgcttagcagacaagattgaggagatcgtgtttaccaaccggctacgtcgcttggagagcacaaacaataggccggaagatctcatacttcaggaattcttgggggtctacggtgccggtatatcacaggcctctcgatggattgctcagggttacagaacgctggatgatctcaagacaaaagccgcattgacgagatcacagcggattggagtggaacactaccacgattttgcccagcggattccgcgccgtgaagtcgaggcccacggagaaatcgtccgaaaggcggtccagaaggcggaccctgggatgcaagtcatcatcggtggttcttaccggcgcggggcgtctgactcaggtgacatcgatctgctaatcaccaaagacgatgctactattgagcagatcacgacgatgatgatggacactgtaattccccgactctttcaagacggatttcttcaggtcagtctcgccagtacttcgcgaggcgacggatccaaatggcatggagcgtctgtattgcctggcagcaaaatttggcgccgcattgatcttctatttgtacctggatctgaaataggggccgcgctgatttacttcacgggaaatgacatatttaaccggagcatgagactactggcaagcaagaaggggatgcgcctgaaccaacgaggcctttatgcagatgtacaatgtggggagcaacgaaggaagctaagcgaaggccggctgcttgagggacgcaatgagagacgaatttttgagatcttgggggttccatggcgacctcccgagcaccgcatatgctga

SEQ ID NO: 19586 - DNA, 243 bp, A.fumigatus
acctacggcagatctccttggcaagattggtcgaatgaaattcgtgcgacccttgtaagccatttccacaggtgctactttccagcaatttgtcctgaagctaatcttcggtgcaggtatcggaaattggcaaagtttgaccgtaagcgtgcccttgacacgtttgagaagcataaaggtttctaccatcctatttgccgtgccatggttgaaaaggaccttttcggtaagaaagacgaatag

SEQ ID NO: 19587 - DNA, 1188 bp, A.fumigatus
tttttggggagaggggaacagcctgctaatccggctcgacagggctctttgtcaacagcggtgtccctctcaggcctcggagccgctgggcaatttaacagtggctcaagtcgatcaaccttgttaaagcttgccttgcaaaacacaaatgagaacaaagtgaatgcgatgcataccggctcatcccctctcaagggagctcagagcacattggcgcatcgtgacacagatgagaatggagaatcgcgacacacgacaccattatacgagcagcccggccccaaaaaattacatctgggaatgtttgagatcggcaagccattgggaaaggggaaatttggtagggtttacctggccaaagagcgatcatccggcttcgtttgtgctcttaaagtcctgcacaaatccgagctgcagcaggggggagtgcagaagcaagttagacgcgagattgagatacagagcaacctacgtcatcccaacgttctcaggctttacggccacttccatgatagcaaacgaattttcttgattttggagttcgccggtcgaggtgagttgtacaagcacctccggaaggagcatcgctttcccgagtggaaggcagctcaatatattgcgcagatggctgccgcattgaagtacttgcataagaagcacgtcatgcatcgcgacatcaagccggagaacatactcgtgggaatccacggggaaatcaagatcagtgactttgggtggagtgtccatgcgcccaataacagaaggcagacgatgtgtggaacactggattatcttcccccagaaatgctcaaacccaactcgcaagacaattactatagcgaaaaggtcgatttatggagcttgggcgtcttaacttatgaattcttggttggggaagcgccctttgaagacactcccgtcatgacacaaagacggattgcgagagcggacatgacggtgccttcatttgtcagccccgaagcaaaagatctcatcaagagagtatgcgaaccctaccgctcaaggcaagtacactttctaacgtttaagcagttgctcgttctcgacccagacaagcgtatttcccttgatgagatccagcgacatccctggatccttaaacattgcttgaaggatgaccgggtcacgaaacagagttctggttcttcaaaggaagtcaaagcatga

SEQ ID NO: 19588 - DNA, 198 bp, A.fumigatus
agagtgtctgagcgtcagctgactcctgaattgtctaagctgatgggcgaaatttacgggcttgcggcgagccagaatatcgaggtggccaacctttacttccaagtcggtctgcaggcaggcgatgcaagtgttgttgaacctacggcagatctccttggcaagattggtcgaatgaaattcgtgcgacccttgtaa

SEQ ID NO: 19589 - DNA, 669 bp, A.fumigatus
gtactggaaccactcgaagttttcatactgacttcacacggaattgctatccatagttgtccacttgtcatcagcccctctgaactgggtccctatggaaatcgtctgacaaacatatgctgtccaggtccgatcatacggttcttgagcgacaatattcgacaactagggggcgatctttccagtcacaatatctattgccgacgctgtacgagcagaaaggctgggggttttgatccggaatatggcatcttactttgcgcgaacgagatgaaggaccaagggcatctggaggacacaatggcacatgagatggttcatgcatacgaccacctgagatttaaggtggactggacggataatttgaggcatgcggcttgcacagaggtattaaagtctctcgctagacccaagccagcatcaactactgactcattgcagatccgagcaagctccctcagtggtgagtgcagatgggcgcgagaattcttcagacgtggtcagtggaaattcactcagcaacatcaggaatgtgtaagaagaagggccatcttgtcagtaagagctagacctggatgcaaggatgaagcccatgcggagaaagtggtcaatgaggtttgggacagctgtttcagagacacgcggcccttcgacgagatttaccgttga

SEQ ID NO: 19590 - DNA, 537 bp, A.fumigatus
cgcgctggatcgtgtcgacaagacgggcacctctatgctcagagtcgcgcattcaaaggaatggcaaaagagcaggtgagccagttccgtatagtgcaactgtccctcatctacctgacacgaaacagggagaaagcacacgaaggtatcaaggacgttgtcaaaccattcgattggtcctacaccacagattatacgggcactgttcatcccaacagtcgaccctttgagacaaccacaaagcccatacctatcgagttactgaagcgcccagatccgatacttttctttgatgaggtcatcctgtacgaagatgaactggctgacaacggcattgctatgctgtcctgcaagattcgcgtaatgccagacaggcttctgctgctctcaagatttttcatgaggctcgataacgtactcttccggcttcgagataccagattatatgtcgactttgagagtaaggaggtcattagagagtatcaatccaaggaatgcgattacgaaagagtccgccaggtactgtgctctaaataa

SEQ ID NO: 19591 - DNA, 528 bp, A.fumigatus
gtacgtccagaattgggattgattccgaccttctcgacttggtcgcaggttacgtttctgcacatgtaccttctcactgtccgactacgcgctttgccgtcatatgaaagcctgcaaacgtactcacggcacttgatagaccacttctcacataatgcggagcatcgcatggatgttctacacggtctgacaagtcgcgccatccggaacaagtttctcaaagacctttttattcaatggcgaggcgtccttgctgcgtacgacgaaggcctggtgaaaggtgacgcagtgttaggagctgctgtgtggagaaatctctggaaagcaagccacaccgggccgcatggtgaagatatggattggactaaagtagcacgggtcgttgcatatatgcgccgcgttatatcagagctttcccaaattaacgaggctgatctaatcttacatatcggccccaggcctggtggaaagcccggcatctttagttattcggaattggataagcagttggtcgatgggaagagatga

SEQ ID NO: 19592 - DNA, 378 bp, A.fumigatus
aggggttcaacaatcaaatctcattttttagtacttgagagaaaccagagaatggcctcagcaggctccacatccactatgaatgccgccgcagtttccccaggcgtccagagacccaacgttatctcggtgaaaggattcagaataataactcagaagctccctattttgaaagctgagcctatcgaggagatgacgagaaggttgggtattgcaccgccggaaatgatcttcggcgacaaccatgtcaccatcgaatctgaaaataaggactggggcattaccttcaatgcatttgacgcgctggatcgtgtcgacaagacgggcacctctatgctcagagtcgcgcattcaaaggaatggcaaaagagcaggtga

SEQ ID NO: 19593 - DNA, 522 bp, A.fumigatus
ccagataaccacagacaagcctctcgcgctcttcagggaaagacattctatcgtaaccccgacactatcatggatgacgagcaccatagtactgacgaatacattgctttcttaaacacgaatgccagtaacgctgatcgtcctcgggatatctattggggcttagctatgataccccttttcttatatggacatcatacgaaggtgatagagacgggaatgtcgatgatggacacgattcctaggctctggtctgctcgcgttggatatgttgtctacttttacttagctctatctctattgacactccacaacgattatcccgcaggtggatatatggacggcgacaacctgaaaacagtgttgaagtataaggcggaggttgatttcgcccgaagcgcctgcgatgcaaattacggcatgtggtcattgattcttgaagccctgatctccgaagtccgaaatgaccatacatccgccattcaagctttcgaggtgagtttgcagaggaatgacacatga

SEQ ID NO: 19594 - DNA, 2004 bp, A.fumigatus
gctacttcagccagaagttttcatgttactaatggctcgctagatatcatcgatttgtctagcatccttgagtcgagccaagtgatgtcctctgaacttcagattgataaactcctaaccaagatgattgagatcgtgttggaatcctgcaacggatctgattttgccgccattgcgacggattttgacgataatggcttcgccgtcgccgcaactggtgacctggagacaggacagaggtccttcgtcgatggtcttcccctgtcggagttcgacgataaaatggcacagcagatctgtcactatgtgattcgcacgaaagaagaggttcttgtccacaatctcctcgaggacgaccgattttccaacaccagcgaggcctatcagaacaaatatcccatgggaaggtctgtcattgcgctgcctattatgcaggcagaccaccttctgggcgtcattcatattgaaggcaagccgaactctttcactcaacgcaatgttgtggtgcttcatctgctctgcaaccagattggcatctctttggccaatgcgctgctcttccgtgaagtccgcagggttagcgccacaaacgcagctatgattgaagcgcagaagcgtgccctcgcgcaggctcgtgaggcggaacataaagccaaggtggcagaagcagaagccaagcacaacgtgaaactgaaggaggatgcagccagagccaagtccatcttcctagccaacatctcccatgatctccggacgccaatgaacggtgttattggtttgtcggaactcctcaagggaacaatcttgagcaaggaacaggatgaatacgtcgagtctatacgagtctgtgccgatacactccttacactcatcaacgacattttagatttctcgaagttggaggcagggaaaatgaagatctcgactgttcctctcaacgtcaaagagaccatctccgaggtcgtgcgcgctttacgctacacgcaccgggaccgcggccttgtgactatcgaagacctggacaaagttccgccagatctcgtggtattgggggatcctgtccgtttacaccaaatattcatgaatctcttgagcaacagctataagttcacacccaagggatccatcaccgtccgagccaaggtctcacgggagggcaagaatcgcgtacgcctggagtgcgcagtgtctgatactggaattggtatccctgaggagcaaaagtcgcgtcttttcaagcccttttcacaggccgacagttccacggcaaggtcgtacggtggtagtggactaggacttagcatatgcaaggccatcatcgaggatgtcctcggcggagcgatttggctggattcgactcctggtgttggcaccacagtgacctttcacctgtccttcaacaaagcgaaggagtctctggcaaaagcgccgtggtcaaacggctctgccgatggggagaaccaggtggcacctcgaccgatggcgcgtgatttaaccatgatccctcgcgatcagatccgtgtttgtattgctgaagataatcccatcaaccaaaagatcgccgtgaaatttgttaccggccttaacttgcaatgcgaagcgtacagcgatggacgccaggcagttgaagctctgcggacacgctctcaagagggcaatccgttccacgtggtgctgatggacgtgcagatgcctactctggatggctacaatgcgactcgtgaaatccgcaaagacccagatcccaacgtgaacgaggttctcgtgatcgctatgaccgccagtgccattgaaggggatcgcgagaagtgccttgaggccggaatgaacaattacttaccgaagccggtccgctctaccgttcttagtgagatgcttgacaactatctcgctcctgcgcccacgtacaccaagacccgcctggcaatgcgtgcgcgggggagcattaaccccctaaatcgggaactccaaattatgcgtcgtcatccggttcggggccggtga

SEQ ID NO: 19595 - DNA, 3021 bp, A.fumigatus
ttggttgagatggaggaggataaccacattctcggggaagacctaccgctcccaccagcacgactgttcgagacgcttgcgcagctccccggttatatctgggatcaatccgttgagccattccattcaacttacaaccattggcatgtcctcggtcttcgtcattgtgcagaatctgacgtctcaactcccgccgcaacctcctcagggccatctagcctagcccgcaactccccgcgcgccgagccccgtccctttttccgccatcactggaggagtagcctgagcgaatcgagtagcgaactgtcattgtctcgcgcagaccatgaaccagtatgggcgccagtagttgctcgagtctcgtcccatgtcgtgagactcgagcgggagtttcacatgttgagatcgatcgtgcagacatcggatccagactgcaatcacacaattcgaccgattgatcttatccggctgccaccagatccaggcgatataggaccgctgttggttgccatattcgaatcgccaggcccgaacttcttgcgtgagctagtcgcattcggacctgcgtggtttgcagctggtgtcaagagtgataacatacccactccggacgagcaggtctcgcttcctgtatttctcgattttgccatcggcgcatgtgattgtctggaactactacactacggtctcaagacggtgcatggcgaaatcagaggggatgcttttcacttcgaccgagagacagggtcagtaaagcttctcagcacggggaatggcgcaagatcatttgaaaatatactcagcgacggctggtcctcgctctctcgagaactcggtgtcaagaacaagctgcaattcgttgcacccgagcagacagggaggatgcctactgaaccggacagtcgcacagacatatatgcgcttggtgtgctattctggaccatgttgatagggaagccagccttcaccggagctgatccggttgaggttgtgcagaacgtcttcggaaagaaactaccacctgtctcatcaaagagaatggatgttcctgacgcaatatcggctgtcattcagaaaatgacccagaaggccgtcaatgagcgctaccatactatatcatcggtgaagagggatttgacacagatttcgcagcttcttggcgacggcgatagcgaagcgctgaaagactttcagattgctcagcgcgacgtgtcatctttctttacgcttccgaccgggatgtttggccgacgggaggaatatgacaaagtgattagtgtcgttgagagagtttacagaaggcaacagtctgcgcacgcccgggcggctgctcagagttccagtggagtggggtccaactcttcggtgtcggacggccgtgttgacagctttgagattgcgtcgggctcaagcgactctggctcatttcaattggcgccgaggaccaactcatacaacacccagtacaactttgggcgtgtctcaacgcatgaatctttgcacagcacagagtcgtccctttcaaccactatacacggatatgcctccaacaaggccaaaattcctgtcgaacctcgtgcttctgtggatagcacagagcgtgacactcattctccatcggttgcgaacgcacagacctatacggatcccgttgtccccgacgccagacagaaggccgcaaacaaactccgaaagaacgggaaatgtgaggtaatcacgatcagtggccctgctggcattggaaagacagaccttgtgaatcgggtccagccggcaatacgtaagcttggctacatcggaatcgctcgcctggaccgcgccagacgaatcccttttgagccttttgccaaaattctggcttctctcctgcgtcagattttctctgagcgtgatgtgacaacggattaccataatagcgttcgcatggccttgagaccgatgtggaccactctccacagagtcttggagcttccagaacagttgatgtccgcgggaggcaaagatttggaattttcaccgaagctctcagtagctcagcacattttcagggatgtctctaacagaggctccgatccctcaaagcgcctcgcgatgcctcgtcttgatcatgggcaaagctctgtggagttcttcctgtcgaacgccgcatcaaaaaacatgcgattgatggagacgttcctagagatcctcaggactctatctcagttcaaattgatatgtgtttgtgtggatgatttgcactacgcagacgacgagacccttgagttgattctgaatatactccgggccaagattccctgtgtgctgatcgtcacaagtcggaaggctgagctggaatccgaggctattaaatcactctttgagtccgaggaccataatgtgaccagaatagagcttagctctctgggggagaatgagatcatgcaatatgtagcggttacaatgcaccaggatccaaatccagggttgactccccttgctgctgtcatccaggaaaagagcttaggcaatcctttctacgtcagattgatgcttgagacctgctacagcaaaaattgtatttggtattcctggaagaactcaaggtgggagtttgacttggatcgtattttcaccgagtttgtcgctccaaggtacggcgaggggcttggccttggattcatcgcaaaacgcctccaggaaatcccagtagctgcccggtccatcctgatatggggagctttgttgggaagtccctttccgttttctcttgttcagaaactgcttaccagcgagttcctgtattccagcgaagacgatgatgaggctgtcgacttgacatgcccacaaagtgccagtatgatccgacagtctgaggctgatatagtagttggacttcaatatcttgtccaagcgaacttgattgtcccaggaaagacagacgacgagtttaggtgtgctctttccattctatcgttctatttgctcttctttcttcctttccttttcttcgaactgtgcttccgcgatcccacccgatag

SEQ ID NO: 19596 - DNA, 1209 bp, A.fumigatus
ttactaacattgaccagatttgccaatgatcgacttgcacaagcggcaacctcgttgaccgagggccgtaacgtcgacaagatgcatttcattatatcgcaggcgatgatgaaatactaccacgatagccgcagtcgctatgcgattgctcggcacattggccttgcttcccggatcgtcaggtctcgcgtcattcaaagagtcgactacaggaagatcttatgggatgccgcacagactgcttctcaatccggtgctagaccaaccgcgctatggtactttcaccactgtattgctttgcttcaggataacccctgggacgacaacaataccgatgtatactacgatgagacattacgcctgcatatcgcgacggcggagatgctctggtctcagggccatcataccgaggctctgcgacttctcgacgaggtttttgcccatggcaagagtgccgtctgcaaggcaagggcttggattgtgaaagccaagatatatgctcagatgggcaatcattacaagtctatggactcgctactcacatgcctggaggaattgggcgtccaccttcgggagcctactacctacgaagcttgcgatgctgcgtacggcaatctgaaggcgtacattgagaacgccgacttggaagtcattgttcgcaaacctaagagtaaggatatcaacatggtcaccattggggctgtcatggcggaggcaatggccgtgacctattgggatgatgcgttgacattctaccggatggctatcgagatgatgaacctccatctcttcaagggcgggttcgtgcaaatctcgattggctgttcccatctctcgatgatttcctttagtcgtttcagagacctcgagtttgctgccaaactcaatgagtgtgcattgaccctcttggactgttgtccggagccatggactcagcgtaggggcacaatcgtccacaatctctacatcagccacttgcgagtcccaatgccctccacacttccagtgctcgagaggtcagttgaggtttccttcacgatgggcgacccttacatcacactgatcagtctgtcatcgatggcgatgaccagactgtggctgggtcacgatgtgggtcaagttgaacagttctgcaccgaaagtcctgacgatattccggactggtccaaagacacacggggaggcgccagtcttttagctgtccggtaa

SEQ ID NO: 19597 - DNA, 1221 bp, A.fumigatus
ttacaagaaaaagtgaattgcagctttcaatcgcgcactcaattgatcttcttcaatccagcaataccagtgagaaaacctcgacccagctatctcatcaccggcaccatgacgtcctccgagaaggtcacctatgtccccgctggggagatcgataaggtcttcgcgcacaccacgaacctggcctcgtcgggtctgaataccaaaatccttgcctgctccgacgagttcttcgccgcagcctcgaatctgctcaccccgactcctcccatcaaccgtcccggtgtcttcgtgcacaccggcgcctggtacgatggctgggagactcgccggcacaaccctgaaccctacgactgggtcgtgatcaagctgggtgttgccagcggcgccatccaaggcgtcgaagtggacacaggtttcttccatggcaactatggcgagaaggccgagctgcagggaacctacgcccccgtcgacagcggcgtcacagacgaacagatcgccgatcccagcttcaacggctggaccactattctaccccctcagccctgcggaccgtcgcagcgtcgcgcctggaaactcaacgactacgacccctccaaccccaagccctacacccatgtccgtctgctgatgtaccccgatggcgggttcgcccgtctccgtctctacggccatgcgatccctcccccggctcccgagcacatcaactccgctgaagcccccgtcgaggaactctcctccgcgctcctgggcggtctggccctgtcggcatccaatcagcactacacgcccatctctaacctgatacttcccggccggggcaaggacatgggcgacggctgggagaccgcgcggtcgcgcatcccaggctacactgactgggccatcttccagctgggtctgcccggctcggttgccaagattgtcgtcgacaccaaggatttccgcggtaacttcccccgcgccgtgcgggtgcacggcctgctcgagggcagcgtggcggccggtgaggtgccagcgcatgatcatccggattggatccccctgcttagcggcgacaagttctgcaaggccgatactgagcacgtgtacgagggtgctgaactcgctgctggtggcgaggacacccgcaccttcacacacatgaagttgacgctgatccccgatggtggtgtcaagcgattccgtatcttcggccgtagagccaaccgcgcctag

SEQ ID NO: 19598 - DNA, 468 bp, A.fumigatus
cgtaaagcgcgcacgacctcggagatggtctctttgacgttgagaggaacagtcgagatcttcattttccctgcctccaacttcgagaaatctaaaatgtcgttgatgagtgtaaggagtgtatcggcacagactcgtatagactcgacgtattcatcctgttccttgctcaagattgttcccttgaggagttccgacaaaccaataacaccgttcattggcgtccggagatcatgggagatgttggctaggaagatggacttggctctggctgcatcctccttcagtttcacgttgtgcttggcttctgcttctgccaccttggctttatgttccgcctcacgagcctgcgcgagggcacgcttctgcgcttcaatcatagctgcgtttgtggcgctaaccctgcggacttcacggaagagcagcgcattggccaaagagatgccaatctggttgcagagcagatga

SEQ ID NO: 19599 - DNA, 369 bp, A.fumigatus
aatggaaagagcacacctaaactcgtcgtctgtctttcctgggacaatcaagttcgcttggacaagatattgaagtccaactactatatcagcctcagactgtcggatcatactggcactttgtgggcatgtcaagtcgacagcctcatcatcgtcttcgctggaatacaggaactcgctggtaagcagtttctgaacaagagaaaacggaaagggacttcccaacaaagctccccatatcaggatggaccgggcagctactgggatttcctggaggcgttttgcgatgaatccaaggccaagcccctcgccgtaccttggagcgacaaactcggtgaaaatacgatccaagtcaaactcccaccttga

SEQ ID NO: 19600 - DNA, 270 bp, A.fumigatus
tcaagctgggtgttgccagcggcgccatccaaggcgtcgaagtggacacaggtttcttccatggcaactatggcgagaaggccgagctgcagggaacctacgcccccgtcgacagcggcgtcacagacgaacagatcgccgatcccagcttcaacggctggaccactattctaccccctcagccctgcggaccgtcgcagcgtcgcgcctggaaactcaacgactacgacccctccaaccccaagccctacacccatgtccgtctgctga

SEQ ID NO: 19601 - DNA, 528 bp, A.fumigatus
ataacctccaagaaccatcacaaaatctctcaagccaaaatgccgtcgatacccctccatcctcacgcgtccagctctccccatcatccccacaacccacttccccaaatcttacaaacgccgtcgggcctggcaatcctcgaactacaaggcacgattaacctcccatctctcgacgatcagggcgcggttcctcgctccgccgatgccgacgatcccaacgctgccataaccacgttcgagacaccaattggcaaactcatgttccctgactactcgccgcaaaacacgtcactggacgacacgaaatggatgaagcgagtctacctatacgttggccggtatcagcggatgacgggggaagtgaagaagctggcgcagccacttgcattggtgcagaagcgtaagaagcgtcccgacgacaacaacgggatcgccgagtccgagggcgaggagttggagattgtggagatcatcaagtataaactgcttttcaagaatcggccggagccagtcaacgatagttga

SEQ ID NO: 19602 - DNA, 561 bp, A.fumigatus
tcagaactgtcaacagctcgcaacatcgccactctcaccacctcccttgtagacctggtggcattttgcgtctccgcaggtgacacctttctcccagatccggcatcttatgacgacttgttctacaaactcgtcgaaacgggtcccatcatcacccgatttcgagatgtctattccctcaagcccccaactccgtcagcctcgaagattcctgaccccacaacaattgccagcaaggacatccacgtcgctgccatcgacacactgatctccgtctcgacccatttctatgctttactttttaacccagacaggaacgtcgacgtgagcttgaaacccggtggagaagcttcgaatcctgtgccgatcccggctaaccggaagaagaatctttcgccccgggaggttcacaggatcatcaagcagggctacgacacgttgagtattcagcctcctgaggggctgagtgcgtggacgagatggcgtgaggcggactggaagacagaattgaagcgggcggccaggtgcgccgtggaggatgcccggcagttggttgcgtag

SEQ ID NO: 19603 - DNA, 837 bp, A.fumigatus
agctatctaccaagcgttattcaggaattctctcatcaatctgaagacacgtcttggcttcaccatcctattcgccaagcatcctattgtgctggagttaaagaccaacacagaagacaggaatataattgtcggagactagcaaatagactaggcgagcctgaatacctttccggccctaaacacgcaaaggaaggaagagtctcattggcactattattgtgctcccatcacttcagtatggcaccatctgaggcatccattctgagcaattttctgctgtctcctgcttcattgccaacaatcatttccttgcaacaattcacagaactttttccgaagaaactgcgtgctcatcctcatatccgagtcctttaccgagagctccaacaattgcgggagcaagacatggatacggtcaatgggaacattgaccaggaagtccgtcaagcagagacacaaaaggccgaacttcgaaaaaaaatcatgaaaaacggcgttgacggcatggaggagaatgaccgccgggagatggacatggatgtccagctctttggtcagggggttaatgctgcttccagtgaataccactccatttctagccttttgtccgcaatggagacggcatgctcaaacatcgagcatgagatttcccaggtggaccaagaggcagcaaatgtgttaactggactcagcgccacagttggcgaactgagtgatttgcgttacggcaaaatgcaagggcctgcagggtcatctggggaagagatggtaaaggaggctatagatggtctcgagcatctcgagcaagcctgcaatcgtaagacatcgcagtga

SEQ ID NO: 19604 - DNA, 591 bp, A.fumigatus
ctacaggaagaacatttctatacacggccatccgtgaggattgtaatgccggacaatttgaaatcccttctcgtagatgactgggaaaatgtgacgaaaaatcaacaggttgttgctttgccggccaaagcatcagtcaaccagatcttggaagattttgtagcggaagagaagcccaagcgcacgagctcggctgacctggatgtcctcgaagaagtcatcatgggtatcaaggagtatttcgacaaagcccttgacaagattctactctaccgtttcgagcgcgagcagtacaaagctctccgcaagaagtgggaggcagggtccggtgaatattcggagaaggggccccttgatgtctacggggccgagcatttgacgagactttttggtatgcttcttgataatttgttttcggaagaccacttacttacttactcgtcaagcaactatgccggagctcattgcgcagacaaacatggatctccagtccacgaacagactccgggaggagctgtcgaaattcacgctctggctcagcaagaactcagacaaatattttgccacgaggtacatgactgcaacaaatga

SEQ ID NO: 19605 - DNA, 6996 bp, A.fumigatus
  unsure (3393): Identity of nucleotide sequences at the above locations are unknown.
cgtgacaggctccatcgcgccattcgtgagtggatccactccttcaatgaagccaaggagcaacagagtgcttcacaactgtcgattggcacccagcatccggccgcaggcgagccagaggctgtatcgtacaaaatagagttccccgagctagtccatgaaatctccatgcgcaaccaggttcttcatcttgatccacctttacaatatgctcgagcaagctggttctcccacttcgacaactggcttggcgtgatctgccacttggagaagatcaaatcatcccggtatcagatatcgatcgatgtacagaaagtccagttgtccgaagcttgcttcgctgatcttccgcagcactgcactgaagatcttagccatgtgtatagtgttgtggagggcagactcaaggaagtgtcagagtatgtcgataaatggttacagttccaatccctctgggacttacgatccgaacaagtgtacgacattctaggcgatgacctagcgcagtggctccagttgcttcaggaaattcgtaagagccgagccacattcgacacttccgaggttagtcggtcatttggcaacatcaagatagactatgagcaggtccagacaagggtcaatgccaaatacgatcagtggcaacacgagattctgttgaaatttggatcgaagctcggagcccgaatgagagaagtgcattcagagattgccgcggcccgtagggacctggaaggacaaaccctcgaggcttcttcaaccgcccacgcggtttccttcatcacgattgtccaacaatgcaagcgcaaggccaaggtctgggagccggaagttaatatcttccggcagggccaagctaccctagcgcgccagcgataccagttccctagtgactggctccacgtggagaacgtcgacggcgagtgggcagccctgaacgaattgcttgcacggaagagcaagattgtccatgaccagacggaagggctgcgcgcgaaaatcacggctgaggacaaagtcatcggtgataagattaccgaagttattgctcagtggaatgaagagaagcccgtatctggaacaattccgcctgaggaggcctctcggaccttgagctccttccagtcccgccttgaagcccttcaggccgaattcgagatggtgtccaaggctaaagaggctctcgatcttccggctagcgtggaatcttcgttaccagcaattcttgaagaggtacaggatttcatgtcagtttgggcagctctgtcaacaatctggaagagtctcaatgacttgagggacatgctgtggactagcgtgcaaccccgaaagctccgtcagtcaatcgatggcttgatcaagatgaccaaggaaatgcccagtcgtatgcgccagtatgcggctttcgagcacatacaaaacgtcctgcggcagcttctgaaggtcaatcccctgctttccgatatgaaatccgaagctgttcgagaaagacattggcagaaaatttacaaggccctgaagcctggaaagagattttcgctcgtttcccttacactgggagatgtatgggatctccaacttgcgaccagtgagagcgtcatccgcgacatcatcgcccaggcccagggtgaaatggctctagaggagttcttgaaatcagtccgagaaacatggcaaaactattctttggatctcgtcaactaccagaataaatgccgtctgattcgtggatttgatgacctattcgccaaatgcagtgagaatttgaactccttgcaggccatgagacattcgccatactataaagagttcgaggaggaagctgcttcctgggaagacaagctaaacagagttcatgtgctcttcgatgtgtggatcgatgttcaaagacagtgggtgtaccttgagggagtgtttaccggtaatgccgatatcaagcatcttcttccccttgaatcgagccgcttccaaaacattaattccgaattctttgcggtgatgaaaaaagtgtacaagtccccatttgttctcgatgtgcttgccatcaacggtgtgcagaaatcattggagagattggccgagctgcttaacaagatccaaaaggccctgggtgaatatctcgaacgtgagcgtatctcattccctcgtttctacttcgtcggtgatgaggacctactggaaattatcggtaacagcaatgacatcttccgcgtcgctaagcatttcaagaagatgtttgctggcttgtcaggcgtcctcatggatgacgagaataacatcgttggcatcacttcgaaagagggcgaggaggtccgcttgaaacgcgaaatcagccttgttaaaacccctaggatcaatgattggctcactgcactggaaaccagcatgaagctaacactggcggaactcctcggagaggcgattgagcagttcgagacaatctacaatgcgcccgaggtcgaccgcactgctttcaatgactatttggccaactatcctgcgcagattgtcgttcttgccagtcaagtcgtctggaccaacgctgtgcagaaatccctggaaaatgggggggcgaatctcaaagagctgtatgatgcgcaagtccgagtgctggagttgcttgctgttactgtgcttggggacctcgatgcgattagtagaaagaagtgcgaacacatgatcactgaattcgtacaccaacgcgatgttatctccaaactcatgacggccaatgccaatatcccaacacattatttgtggttgctgcagatgcgctatgtttaccatgccgaaggcgatttcctccagcggttacacgtccatatggcaaacgctaagctcagttacggcttcgagtacctcggagtacctgaacgcctcgtccgcacgccacttaccgatcgctgtttcctcacgctcactcaagctctgtgccaaagactaggtggctctccgtacggccctgctggtacaggaaagacggaatcagtcaaggcgctgggtcttcagcttggccgtttcactcttgtgttctgctgtgacgatacttttgatttccaggcaatgggccgaatcttccttggtatttgccaggtcggtgcatggggctgttttgacgagttcaaccgtcttgaagagagaatcctgtccgccgtctcacagcaaattcaaaatatccagcttggcttgaaaactggagttgataatgagaaggcacagatcgagctggtcggaagacgcctcagtgtaaatcccaatactggaatcttcattaccatgaaccccggctatgcaggccgttcgaatctgcctgacaacttgaagaagctgttccggagtgttgccatgtcgaaaccagacaaggagttgattgcagaagtgatgctcttttcncagggcttcaagcaagcaaagcgtttgtccaagcagacagtgcctttcttcgatcactgtgcctcgcagctgtcaaagcaagcccactatgacttcggtctacgtgctcttaaaagcgttttggtcagctctggaggtctcaagcgtgcgagacttgctaataccgacggcgatctgggcccagacgagatcattgaaccccaaattatcgttcaaagtctgcgggaaacaattgccccgaagcttgtccgtgaagatgtagacaagatgctcgagatccaagcccacaacttctctggagtggagtatgtgcccgcaaattacgagaagcttacgcaggcgattcgggacatcgctcacgagcaacactacgtggacagtgagatgtggatcgcaaaaatcctccagctctaccaaattcagagcatccatcatggtgttatgatggttggcaggtctggatccggtaaatcggccgcttggaagatcttgctccaggccttgcaacggattgaaggggttgaaggtgtctcccatatcatagactccaaggtcatgtccaaggaagctctctatggtaatcttgatagcaccaccagagaatggacggatggtttgttcacgggcatcctgagaaagatcgtggataacctccgaggcgaagatacaaagagacactggattgtgtttgatggtgatgtcgaccccgaatgggttgagaatctgaacagtgttctcgatgataacaagctcctcacccttccaaacggagagcgtctaaatctccctcctaatgtgcgcataatgtttgaagttgagagcctaaagtacgctacgctagctacagtcagtcgttgtggtatggtatggttcaacgacgacactgtcactcctctgatgatgatttccaactacgttgagtcgctcagaacgaagaccttcgaggatttggatgatgacagtgcccctgcaggacaagctgcggccaaaactcaggatgcacaaaacatgctttccacaattctcaagcaacttctggagaccgatcagcttgttctgaagtctcttgatgaagctaagaagtataatcatatcatggagttcactgatatccgtgccttgaatactctgttcagcttgttgaacaaggcttgccggaatgttctcgagtataacatccagcatgtcgatttcccgctcgaccatgagcagattcagtcgtacatttccaagaagcttctcctcgctctcgtctggtccttcaccggagactgccctttggcagatcgccaggccttcgggcaatttgtgtcgggtatgtcgacaacggaactgccgcctgatggagcatcctccctcatcgactttgacatcacattacccaagtcggagtggatgagttggcagtctcaggtcccgtcaattgagatcaatacccactccattacacaaaccgatgtggtcattcccaccgtggatactgttcgtcacgaagacgttctctactcctggctcgccgagcacaagccactgcttctctgtggcccaccaggttctggtaagaccatgacgctatttgcagcactccgaaagttgccaaacatggaagtggtgggcctaaatttctcaagcgccactactccggatcttctgatcaaaactttcgaacagtactgtgaatataagaagactttgaatggtgttgttatgtctcccaatcaaataggtcgttggctggtcattttctgtgatgaaatcaaccttccggcaccagaccgttacggaacacaacgggcgattaccttcctgagacagcttgtggagcaaaacggtttctggaggacatcggacaagacttgggtcaccctggatagaatccagtttgtaggagcttgcaatcctccaactgacgcgggccgtacccctctggccgaacgcttcctacgccactctcctctgattatggtcgattaccctggagaaatctcgctcatgcaaatttatggaacattcaactcggctgtgctcaaaatcatcccattgttacgcggatactccgaggcactcaccaaagccatggtgcagttctacttggaatctcaacgcagattcactcctcaaatccaaccgcattacgtatactctcctcgtgagcttacacgatgggttcgtggtgtatatgaggccattaaaccacttgagacactctccgtcgagggcctggtgcgtatatgggcacatgaagctttgcgtctgttccaggatcgactagtccccgaagaagagaggagttggacagcggatgcagtccgccgcattgcactagacaacttccctacgattgacgaggagcaagcgctgaaggggccgatcctgttctcaaattggttgtctaagaactatgtccctgttgaacgagagcgactacgcgacttcgtcaaggctcgcttgaagaccttctgtgaggaggaggttgatgttcctctcgtgcttttcaacgatgtcttggagcatgcactgcgcatcgaccgggtgttccgccagcctcagggccatctcatcctcattggggtcagtggaagtggtaaaacgacattgtctcgctttgtggcttggatgaatggtttgaaggtcttccagatcaaagtacatggaaagtattcttcggaggacttcgatgacgacttacgaaccgttcttcgacgcgcgggctgcaagggcgagcaaatctgctttattatggatgagtccaatgtccttgactctggcttccttgagcgcatgaacacactgctcgccaatgccgaagttcccggcctgtttgaaggagatgaattctcgtctctgatgactgcttgcaaggagggcgctcaacgtcaaggccttctcctcgactctcaggaagagctctataagtggttcacacagcagattgtcaagaaccttcacgttgtgttcacgatgaatccccctgaggagggtctatcttccaaggctgccacaagccccgccctgtttaaccgttgtgtactcaactggatgggtgattggtctgatcaagcacttttccaggtgggctctgaactcactcagtcactcgacttggacaagccaaactttgttgcacctgacagcattcctgtcgcttatcgcgatctcagccttcctgcgtctcatagagacgcggttgtcaactcgatggtttatatccattattcactgcaaaggttcaaccaacgtttgcagaagcaacaaggaaagaccacattcctcactccccgtcactaccttgactttgtcgctcagtatgtcaagctgttcaatgagaagcgggaggaccttgaagagcaacagcggcacttgaacgtcggtctagagaaacttagggatactgtcgacaaggtcagcgatctgcgtgctagtctcgcccaaaagaaaatgcagttagagaagaaggatgcggaagcaaacgaaaagttgcaacgcatggttgccgaccaaagggaggcagagcaacgaaaggctgtgtctcttgaggtccaggcagccctgggagaaacaggagaaagaagtagctctgcgcaaggaagttgtgctcaatga

SEQ ID NO: 19606 - DNA, 1047 bp, A.fumigatus
agaagaaggatgcggaagcaaacgaaaagttgcaacgcatggttgccgaccaaagggaggcagagcaacgaaaggctgtgtctcttgaggtccaggcagccctgggagaaacaggagaaagaagtagctctgcgcaaggaagttgtgctcaatgacttggctcgagccgagcccgcagttcttgaggcccagaaaagcgttcaaaacatcaaacgtcagcatcttacggaagttcgctctatgggcaatccgcccgctagcgttcggcttgctctcgaagccgtgtgcactctgcttggtcacaaagtagacagctggaagacgatccagggcattgtcagaagagatgacttcatcgccagtattgtcaattacgacaacgaaaagcagatgacgaaaaatcaccgtctcaagatgcagaacgaattcctgtcaaaggaggatttcacttacgagcgtgtcaaccgagccagcagagcctgtggtcccctagtccagtgggtcgaggctcaagtcaactactccgagattctcgaccgtgttggaccgctgcgtgaggaagtcggccaacttgaagagcaagccctgcagaccaaggcagaggctcaggccattgaaaataccgtacagaaccttgagcgcagcatcgccacttacaaagccgaatatgctgccctcattagtgagacgcaggccatcaaggcagaaatgtcaagggtacagtttaaggtcgaccgaagtgtgcgcttacttgatagcttggcgtccgagcgtacacgttgggaggagggaagtaaatcattcgaaacacagatcagcacccttgtgggtgatgttctgatcgctgcagctttcctggcttatgctggtttatacgatcaacaattccggaaggccatgatcgatgactgggtgaaccaactggcgcaatcaggcattaacttcaagccacacaatccgattacagagtacctgtcgaatgctgatgaacgcttgacttggcaagttttcaccacggggtggcggatccgcccttactggagggag

SEQ ID NO: 19607 - DNA, 639 bp, A.fumigatus
atggaagagcatgctcaagaaccgtcccgacaagatgttactggatacgcaccaatacaccattttcaatacagggcaaataggcctcaaccataccgcgaaagtcaacctaatctgcaacgactggtacaacatgatcaaagagatcaactctacaagcacagggtttgtcttcatcgttcttcctcatctctttatctcaccatactgacccttctctatagctggggcccaacgatctgcggcgaatggtcccaagccgatacagactgcgccaaatacctcaacaacgtcggtcgcggcacccgttgggaaggaaccttctccctcacagactcaacccaatactgtccaaccgccgacactgggcctccttgcagctgcgccaacgccaacgcagatgtcagcaagtactcagccgactacaagaagttcctgcagacatacgcagaggcgcagatgtctgcgttcgagaccggacagggttggttctactggacctggcgcacagagtctgcggcacagtggagctacaggaccgcttggaagaatggcttcatgccagccaaggcatatgcgccatcattcaggtgcggagatgcagtgcctgatttcggagacttgctggagtactattga

SEQ ID NO: 19608 - DNA, 207 bp, A.fumigatus
tgcgaaaagctgttctggcttgtagccaaggacttcttcggtgttcttgctcgcaatctggacgatgagattccctttggattcttgcagcactatgagtgcaccaagcccatgaatgtgcctgaagtttggttcattcttcatgttttgtacccaggctgctgtttcagcttggtcgatccaggaccctgctccggcgaagtatga

SEQ ID NO: 19609 - DNA, 915 bp, A.fumigatus
agaccggagggggcggccgatgaggaattgctaggtaatgagcgagacccggggccgcgagcgagcagatcttacggtgatgactatgatgcgcgacgaagggaacactcgcgggcgagggaggctccaaggagaagcgagcggcatcgcgacagggatcgagagggccggagcaggcgcagggcgtatgaagatgatgggcgacatcggacgagagacggccgccgggacagaggtcgcgagtcggatggtgaggcgcggagatctagaccaagggaagcggggcgcgagacagccgcgaggaagcatcggagcagtgactcgaccaatagtgcgtcgcatttgctgagcgcagatgcgttggctaagcttggggctcaatatgagaaggaggagcgtcggaaacgcgagatcgccaaggacgccgccaaagcggagagaaaacgtcagaagaagctagcagtcgtgggagaagaaacccgcgccttacgtgatccgcctggcgagtcacacagagatcggacgaaggcgagggtcgcatctggggcgtaccttgaagaaggccgcagccccgagatgcgagtccgccatcgtggaggtggtggcccagcaatggaagctagatggcggaaagaaggtagctggggaggcactatggacgattcaggcggcggaaggccattttggaaacgaaagagatggattggcctgggcgctttgatcatcatactggtcattgtgattcccgtcgccgtcgtcgtgtctaagaaacatgacaacaagtctgacccggcagattcacaaggaacctctcctggtaaatcgaatctggacgggttgagtcatgacagcattccagtacgtctgatcagtaagcggatttacacactgggtcttatactgatgttattctag

SEQ ID NO: 19610 - DNA, 1059 bp, A.fumigatus
  unsure (678): Identity of nucleotide sequences at the above locations are unknown.
gcttacgctcagggaacatatctggacccttggacatggtatgatacgactgacttcaatgtcactttcactaatgaaacggttggtggtttgtctatcatgggcttgaactcgacctgggacgactcggctagaccgaacgacaatgttcctcctttgaacgaaccgttcccgtatggatcacagccaatccgcggcgttaacctaggaggctggctgtcaatcgagccgttcattgttccttcattgttcgactcttactcctcggtctcagggatcattgatgaatggacactgtccaagagactcggcagctccgcagccagcacgcttgagaaacactatgctacattcatcactgaacaagattttgcagacatccgagacgcaggtctcgaccacgtccgcattcaatattcctactgggcggtagcaacgtacgacgacgacccttatgtggcgaagatttcgtggcgatatctcctccgagcaatcgagtactgcagaaaatacgggctcagagtcaatctcgacccgcatgggattcctggaagtcagaatggctggaatcacagcggtcgtgagggtgtcattggctggctcaatgggacagatggcgagctcaaccgcaatcggtctctggctgttcacgacagcgtgtccaagttcttcgcgcangaccgatacaagaacatcgtcacgatctacgggctcgtgaatgagccactgatgctctcgctctcaatcgaggatgtccttgattggacaaccgaggctacgaagctcgtgcagaagaacggcatcactgcgtacgttgctttgcacgatggcttcctgaacctgagtaaatggaagagcatgctcaagaaccgtcccgacaagatgttactggatacgcaccaatacaccattttcaatacagggcaaataggcctcaaccataccgcgaaagtcaacctaatctgcaacgactggtacaacatgatcaaagagatcaactctacaagcacagggtttgtcttcatcgttcttcctcatctctttatctcaccatactga

SEQ ID NO: 19611 - DNA, 531 bp, A.fumigatus
cccttctctatagctggggcccaacgatctgcggcgaatggtcccaagccgatacagactgcgccaaatacctcaacaacgtcggtcgcggcacccgttgggaaggaaccttctccctcacagactcaacccaatactgtccaaccgccgacactgggcctccttgcagctgcgccaacgccaacgcagatgtcagcaagtactcagccgactacaagaagttcctgcagacatacgcagaggcgcagatgtctgcgttcgagaccggacagggttggttctactggacctggcgcacagagtctgcggcacagtggagctacaggaccgcttggaagaatggcttcatgccagccaaggcatatgcgccatcattcaggtgcggagatgcagtgcctgatttcggagacttgctggagtactattgatctgcctatgagtgaaagattggttttgcggttgtggtttgcgttttctcttccttgggtcaaatcacctgcatcttgtcggcgttgtacatcatattcatag

SEQ ID NO: 19612 - DNA, 3516 bp, A.fumigatus
acattgaaatggaaccagcctctgcgtctgcacagcgacaagatgagaagcaacagaatattgagatctcgaaaaccgcgagcccccagaaataccccagacgagcacggctctaatccggaaccactgcgagttctcaattttgcaaacgacgatgaaccttctccatcagcgccgggaatatttgtcctgaaactgccaaaccttagtcccgaatcaaccgagcgaatttttcccatcagctcagtcgtgtcggtcgattcctccactccgccaacaccggcagtggagaaccctgaggagcaaaactccccttgggctgaaagtctccgttcagaaattactggtggcaagcaatcaccaggccagtcagctacgccatcgcccgatgaccgcaaggacgcaccctcgatccagagcacagtagaagcctatggcagttctttgaacgtgattactgcaagcaggaaacgaaaccctttaaaaattggtttggccagaggaatttccgacatatcattcggggatgcgaatgcgtcttcccaggggacctctggcctcccatcctctgctgaggccccggactcatacttcgccggagcagggtcctggatcgaccaagctgaaacagcagcctgggtacaaaacatgaagaatgaaccaaacttcaggcacattcatgggcttggtgcactcatagtgctgcaagaatccaaagggaatctcatcgtccagattgcgagcaagaacaccgaagaagtccttggctacaagccagaacagcttttcgcactaccgaccttttgcgatatcgtgcagaatgatcaaaaagaaaattttcttggccgttttaaccttgtccgaggcaaatggtatgatgtcgagcagcacggtcctgatatccacgaagtcgatgtccgccaaagttgcggggcaacaaggagactctggtgtacgatacatgctacaaaggcaaacactgatcatattgtatgtgaattcgagctgaagggagccgttcttgaatcctggaggaactcaaggccatcgaaatcggtctacgcggtctatgacaacacaagctcggatgggagatctgatgagaagaacagcactccgagcatgcctcctgagatgcaaaacatgctgagaggaatcagaggaaagatccggtcctcggatatgttgtgtgccttgtcactcattatccaactggctgcgagcgcctcctccctgagcatgcttttcaactattttactggcatcattagggaattgaccggtttcagccgagtgacggtcttttattttgatcgtgacgggaatgcgattcctatgaacgatgccgttgactcgcatattattgctaatttcccggaagaccttcattacccgaaaccgctttctccaagagacttggaaagatttcatttgggcagcaaagtctgtctcgaatacagtcataggcagtttcatactgagctggtttatcgtgattctgagaatttgcccagcgagtttgacctagaccactcttacatgttggcgaggtcaccgtacattttagatcctgtcactggaatgcccgtctttgcttgcatgtctatcaatataaatgccctcggacgtgcatgggggcttataatgtgccagtcatacgaggaagagatgcgattaccccctccagtgcagaagttcttctggctagttagcgacacactttcaagcaatattgaacgtctttcgaacacgatgactgctcagatgcagggcccttttacttcttcacatgacggagatgagaaaggcgatagctttcaggtaaaagacttactgaccttgttcaaggcggattatgctgcatccttaatgttaggcgaaaccaggatccttggaaagccccacgatgcgcaggaagtgctcgctttagtggaatacttgaaactgaaggaactcagtgctgttttgtgttcaacggacattactcgagattttccagacctcaactatacccctggattcaagtatctatccaacctgctgtatgtgcccttgtcgacggatggtcgagagttcattgttttcttcaaggagtcacaacgcggagacacgtttcatgctgggactgatgacaatgctcgatgcttgaatcaaggacggccaacagagcttggttcagaggcgaagctggtcgatcgtgagactgctatatggaatgctggagacttacagaagggcccctttctatccttgatatacagggccatgctgaaagaggtgtggcagcaaaaggaaacaacaatgcaaagcacccagctcatgcgactacttctggcaaactgcgctcacgagtttcggacaccgctgaacgcgattatcaactatcttgaaattgcattggatggagatctcactcaagagactcgagagagtctttccagatcgcattccgcttcaaaatccctcatttacataatcaacgacctcttggacctcacaaacgcggagaacggcatcagcttgatcaaagacgagaattttgatctcgtggagaccattcatgaagcctcacgcattttcaatgaagaagcgaggcaaaagggtgttgagctccatgttgtacgatacaccggcattcctcctgtgctgggagaccaacggcgagtacgacaagtcattacgaacctcatcagcaatgctgtccagcatacaacttcgtccggaacggtgactgtcgaatcttgcttgttgcccgactataccgagactgggaaagttggaattgaggtagctatccatgacactggaactggcatgtctcagaatgatattgaagcacttttctgtgaattggaacaagtttcgaacaaagattatatacgaagtcgaggccctcaacgctgcgacaatgtgataacgagcgacggtagcggctcggggaacatactcgggttaggcttagccctagttgctcgcatagttcgcaatatgaatggtcaactaagcgtgaaatcagaggaaggccatgggagttgcttcaggatcaagatgcagttccctttacctttcgacgaggccaacgacgagaaccttgattctaacagagcattgccggttggcaaaggaaaaggaagggaaagtgaacctgaagacgaccgaaacgtgcctcccaagccagatgaaactcagtgcagcgaagacgacggagcttgggcagggaaaaatcctgccttttcagattcggcaggttccacaaaaaatgatagtcatacatcagacgacacagtcaccgcggatgttgctcaacatgactctgcctcgaagcaagaagagtcaaccttacgtcctgacataaggaacaaacccccgtctaccgaggaggtcaggcaagctcatcaagcgcattctaggcccgcggagcaatgctaccagagttctatccgatcaaccgacaaagccaatcggggaagcaacgtcggagtcctcagagaggacggcagaacagagtcaaattaa

SEQ ID NO: 19613 - DNA, 438 bp, A.fumigatus
ggaacaaacccccgtctaccgaggaggtcaggcaagctcatcaagcgcattctaggcccgcggagcaatgctaccagagttctatccgatcaaccgacaaagccaatcggggaagcaacgtcggagtcctcagagaggacggcagaacagagtcaaattaaagcaaaaacccagtcagatattccacccaaagagggtgcaactactgcgtctgagggctcttccaaaaagaatctccacatcttagtagccgaggacgatccgacgaacagcgcaatcttacgcaaaagactggaaaagtcggcacataccgttcatataactgagaatggaaaggaatgtgcttctgcatttcgcgacaatgcgcactcatttgacgccgtgctgatggatatacaggtcagtcacagaactcctgtaggtagcgatcaatcgtga

SEQ ID NO: 19614 - DNA, 333 bp, A.fumigatus
actgaccttcagcagatgccgatcgtcgatgggatgggatcaaccaagatgatacgagaatatgaagcgctgacagcctctccgacttctgtttcagcgacttgtcggcgtcagcggattccgatattcgctgtctccgcatctctggtcgagaaggaccgtcagacgtatatcgacgcggggttcgatgggtggatcatgaaaccgattgatttcaaacgtgttgctcatcttctggacggagtgtacaaggaagatgtgcgcgaggacagtctctacaagcctggcatgtgggagaagggaggctggttcgataagggaggtgagagctaa

SEQ ID NO: 19615 - DNA, 192 bp, A.fumigatus
attgcgttcgcctgcaccggtgcatggcctcaacgcgcatcagactaccaaatttacgctctgttctgtctattcttgtttagtctaatattattcttgcggtttctcccctttcttccttcctttccccttcccatcactaccgtggcttctacactggacgtgtcgcaaagtttccgccacccgacctga

SEQ ID NO: 19616 - DNA, 2214 bp, A.fumigatus
catatcaatatcctggcgtccgaccatatttcgcatggcatgtttcggctgcttccttggtcctctgctctcggaggaaataaggtgatggcggaggagctcaagatgcttgcgatttcgccacactgcgcttcaccaggcctcaacagtatcggattgccccagctgaagcgcaaacgctccgactccagtgatgcggccgcggtcgaagatgcacctgtcgcgacaaaattacgatctgatgacgcgtcgagtaattcgctttccggcaagaagaccctttcttcgactgtgaacggtgaacctgtggcgtcgcgaatgtcggcatccctcggagagagttcttcgaatagtgccatatcaaaatcatccaagtcgccccgtcgtcgccagagttcgagctcgtcgggttccatcgtcgccgataaaagggccgccccgcacaagattgacgtggacacgctaagagaaacattagaagcgcagctgagcttggaggtgctgttaaagcacaatgaactacgcttgatcgaccaggagatcgcaaaatgccagattgcgctggaacaattgcgccggtgcgccgagataccctatcccggatctcatgtcgctggcgtatcgcaggctgtgagtaacggcactggtatggcagtacgtgctccgggaaatggtgtggcgccgatatccccagctccatggggtgtcacagacggtccttatacgcgacattatgcgcgatggctcattcccgacccgcgcttcgacggaggcgaattcgactcaggcaatccgctgactccgggcgctctaggcaccccgctcgtggagggtcgttcgactcgtggcaatcccatcgatggaggctatctcgccagcaaaactcgtccccaaagaggcacagctggagccaaactgcagtcccttcccagtggatatcccacacccaaagaaaaggctggtcctatgattatccggcgaaagtcggacggtgtacttgtcaagcttatctgcttggattgtcggagggataatttctcgagcactcagggcttcatcaaccactgtcgcatcgctcataaccgaaattttgccagtcacgatgccgctgcgatggcctcaggcgagccagtcgaggttgatgaggcaggtgcagtggtccctggaaagaacgaaactcctagcgcgactgcggctggcttcgtccacccgcttattcgatctgcgcatgtaatcgagccatcgaccaagacgccgtcattggttccggagggtaccggtgacactacgacgccgcgaagacacactgtcgccagccgacaggcatcgtctgctgtggagacaccggctatgcatttccaagcaggcaagcgtaccacatccgtaggggggaaagcctcccatcgcaactcgttcacagggtcgtctgatacccctcatctttcctctcttatgcaacgcaggggggtaggggtagacctggataaattagtgggcgaagcgaaaacgacgatggatctcgaagcctattcttctgacgcggagtcagaagatgacccagctgagacatctgtagacgctgcgacgcaagctcagaaacccctagggaatcgcgccgttaggcagtcgatgcgaacaacgggttctaaaatcgcatcgcagcggcccggaagcggcaagggttttgataataaaaatcaccactctccatctccgaatggatactttcagtcttcctatggaccggcgtcttccgtgtctaggtcaactgccatggaggacttgcgggaagaattgagtccaaccactttggagtcaaatcaagccccaagtctggtgagcgacgatgatgattacggagcagcctcagaacctgacagcccggaaccgagctcatctgaggccggtgaccgcgatgaagagttcagccatattgatgtagaagacgacgaagatgctgcggcctcgccggcaactacggggtccaagtcagatcccgacatggctagcggtgcggcccatccttcgaaatccctgtcgagatcgctccgacgaagtagcacaaagaagaaggatcgagtcatatccgcttcgattgcccccgtgaaacggagcaaagatgagaagcgggtgagctttgtcagtccgaacagcaaatccgctaaaggcaaaagaaatgcctcaaagaaatccagtggaggacgcaagcaatag

SEQ ID NO: 19617 - DNA, 213 bp, A.fumigatus
cggtcgcagaacgcaatcgacgtccaaattcaagaaatcattcctattatccctttaatccgcaacatccgtccccccatctccaccattcacttttacccttttaccttgttccctcttatctatctaaattgcgttcgcctgcaccggtgcatggcctcaacgcgcatcagactaccaaatttacgctctgttctgtctattcttgtttag

SEQ ID NO: 19618 - DNA, 366 bp, A.fumigatus
tgttcggagacagtgtggttgaaatatatttcggtagatcccacaacgcctggttatctgcttgatgacgacgacgacaacaacagcatggccctctcagaacgtaaagactccccaagtgatccaggaatagaaccccgaggccaacttgaaggcctctccaaattctcaccttcacacatcactattgacatgttcaataacctccttgcacgctaccctaacaccgtcaagacagtgatacgacgcaaggagaccgcaagggccaccaaagccgccacagcccgagaggaggaaaacaagaggaaaggggaagaaacacgcggcagattctgctacctcgaagcatacattgacacccgatga

SEQ ID NO: 19619 - DNA, 285 bp, A.fumigatus
cgcaaaagatgctacaacaactgccccggacaccccgacagcttcggcgccgaacagagcaaaacgtcctactgcaatgcggcccaggcttactcgccttcgagcacttcgacgaccggcacggctaccagggcgtcttctgcgacccagacaacggagacggcggctaccacgaccaccacctcgtctggattttcccctaccccgtctggtgcggctgcggggttggctgttgagggtggaagtgtgttggctgctatcttggctgggtttgttgccttgtaa

SEQ ID NO: 19620 - DNA, 300 bp, A.fumigatus
ccaggcgttgtgggatctaccgaaatatatttcaaccacactgtctccgaacatcacgacatgagctcaacccaatccgtcaagtctgactctattgctgtattaatcctacaattgatcaccagattggctctgaacttcgcaatggctggactaatctacgcagtgatgaccagagcaaactgtcttcgtctattgattcaagctccatcggctaaagcatactataatcgtatcaacacacctgaaaggttacgagaaacattaaatcacaggcacatgtggagacatgattgttaa

SEQ ID NO: 19621 - DNA, 246 bp, A.fumigatus
tctttgcattcttgcccacacaacgtcatcagtgatggcgagtcagccgatctctccacgacgtacacagaccgatcatccgcaacatacctcgagcccgctccgacatggctcgactgcatccacaagttcatctatctattctctctcgtcaaattcgcaagctcccagtcgaaccagtaccatctcgtcaaatgcgtccatggggtctgctccccggattggccaccgacgaggcaagagtga

SEQ ID NO: 19622 - DNA, 906 bp, A.fumigatus
cggaaaaacctcccagaccccgaagcagatgtcaaagcgcttttcatggaaacgaaacgatgtgtcctctatattattagggttcagacgggcgccaatctcatggaaattatggtcaaaccacccaccaaggaggacgaagagcgatggatgacgttagtacgcgacgagttaaccacgaataccagccagcgaagcgcatactctgaggcgagcactctggtcgatattgcatccatgacatactccgagctgaaacggactgcacttgagaacattctccagctcgagcggactggcaagattcgccgtgacaaccactatcaagatctcctcaacgctattgctattgatatccgcactaagcaccgccgtagaattcagcggcagcgagagttggaaagcgcacgtcttaccctgggccgtctcaacgatcaagccgcttggctggaacagcagctcaaaacctacaacgactacatcgagcaggcaatggtgaccttgcagaacaagaagggcaagaagcgattcctcatgccatttaccaaacaatgggaccaccaacgcgagcttcaaaagtccggcaaagtgttcaagttcggctcctacaagtactcggcccggaacctcgcagacaaaggcgttctggtctactggaagggctactcggagcgccagtgggaccgcgtcgacctcacaatatctagcaatgaagtcggcgtgttcaccctcgacggcagcagtggccccatgatggtcccaggggcaaacgctcaggtgcccttggacgatttgttgcaagcacagttcaacaacatgcagttcatggatttcttcgatggacacttacgagtcaacgtgaatcttttcttgcatctgattatgagaaagttctataacgaatga

SEQ ID NO: 19623 - DNA, 210 bp, A.fumigatus
tcagttattccctcgctccatacttgtcgcgatgtcgattactcgatgggtctgggctcgatgctaacctccgtggctaacagccagctgttaaacgaaattatgccgatgatctacaagcgattcacagacaagagcgcggaggaatggcgacagatctacaaggtacgattgcgcgggctggcgtctaccagagaccggctagactga

SEQ ID NO: 19624 - DNA, 4197 bp, A.fumigatus
agttcgaaatttcccatttctcttgatctttgcattcttgcccacacaacgtcatcagtgatggcgagtcagccgatctctccacgacgtacacagaccgatcatccgcaacatacctcgagcccgctccgacatggctcgactgcatccacaagttcatctatctattctctctcgtcaaattcgcaagctcccagtcgaaccagtaccatctcgtcaaatgcgtccatggggtctgctccccggattggccaccgacgaggcaagagtgaactaaactcaattacattgggagcgatggcgaaagacacctctggaggggaaagctggacgagcgcggcgacgacatatgaaaatgttcggcgttccttacgaccacttccccaggctccaaatgcggaccctccgacgagcaaaacatccatatatcgacatacaagaagtcaaaccgtcgataatccacattattggaaggaaaaccgccccggaactcccgattcacgccatccacacagtttggagaccggcggactgagcgaacgacaatcactcaattcgcagacccctccgaaaaaaaactccatacagccaggatctcttcatgccgtttcacctcattctcgaccacatatccgaccacatcactcacatagtctgtctagtccacttccaccgccgcttacgacgactctctcaacaccagaactagagactttcaagaagtcatcgacaggccacctccgtactttgtccaaattcgccaaatcgggcgagactgaggagtttgctctcgaagcctatagtccttccgtagtgggcttgcagggacgacggcgactgaagcgcgcgggttccgttgcgggcgcgcagggctccagggttgctcgaaagcagaatgcatcggcatgggcggctggtaattggatggacaaacaacgtcaatttttgcaggcgtatgagtatctttgccacatcggagaagccaaggaatggatcgaagaggtcattcagaagcaaatcccgccaatcgtccaactggaggaagccctcagagatggcgtcactctcgcagaagtcgtgcaggcgatgtatcctaaccgaacattccgaatcttcaggcacccgaaattgcagtaccgacactccgacaatatagctttgttctttcgatttttggacgaagtcgagctacccgagctattcaggttcgaactcattgatttgtacgaaaagaagaacattccgaaggtcatccactgcgtgcacgctttgtcatggttgctcttcaagaaaggcctggtagattttcgcatgggaaaccttgtcggccaacttgagttcgagcaccatgagctcgaacaaacgcaaaaggggctcgacaagtcaggagtaagcatgcccagcttctcaggcatggctgcgaactttggtgcagagcctgagccagaaccagagccagaacctgaaactgaagaagagcgaatcgagcgcgaactgcacgagaatgaaacctcaattgccgaattccaggctcagatcaagggcgcgatgttacggctgaaacttggcaatgtcatgaatgaactgtgggatttcgaacctttcctcatcgatctccagtccagactccgtggcgactgggcccgccaggtcattcagtaccggttgaacatgcggtcttttgcagtgaatttgcaggcggcctgcaggggtttcattgtacgctcccgccagcaaggtgatagggaatggtgccgagctcaggagcttgatgttctgcggcttcaggctctcatcagaggtgcaaaggcaaggactcaagtccagtatctccggagacagtcgcgaaaagaagaatcgggaatcaagcaatttcaagcagctattcgaggcgccctgcaacggaagacagtttacgccgtgtacgaagataccagggccatagagcctcaagtcatcgtcttgcaagctgctgtgcgaggcgctctttgtcgcagaatgatctcggagcaacacgaagagacgcaatgcgctgaagacggaattacgcaactccaatcgctgattcgaggtgctcatttccggcggcaattgagcgctcaacaagacgacatcaagaacactggaaataatgtgcaacaattgcaggctgcgattcgaggaacgttgacacgtaaagccgtcattcagctgaagagctcactcgctgaagcgacgccaaccgtgatatcaatccaggccggtgttagagctctggcgaccagagaacgttattttcaactgatcgacggactggcaaagaaaaaaaatgaatgcatatccctccaggcttttgtccgtggtggagctgtgaggggtcacctgaattcacttcgacaagcgttagaggagcacactctgtcaatcattgggcttcagagtattcttcgagaaaaagctgtacgggtcgctctggacgcacagagagcggcgttggtgcaagaagaaaggtcaattctacagctacagtccgcggcccgagcggttattctaagaaggcgactggaagccgacgcagaagccctccgagcacaagaacacatcatcgtggatcttcaagctctctccagagcggcaattctgagaatcaaagttggagctgttcttgatgagctggaagattgtgaggatgaggttagccagctgcaggcgcatatccgtgcgatgatcgttcgggtcgacgtcggccaggatttggctgatctagctgccgaagaggaactgatcacggacctacagtctcgtatgcgcgggcatatcattcgatcaaagttcgaagaaaagcgccaatattatcgggctaacatggaaaaggtcatcaaggcgcagagcatcgtgcgaggcagaatccagggtcaggcatacaagagcctcacgaccggaaaaaatccaccagtcaataccgtcaaaggattcgtgcatctattgaacgacagcgagttcgattttgatgaggagatcgaatttgagcggctcaggaaattggtcgtgcaacaggtccggcaaaatgagctggcggaacaatatatcagtcaactggacatcaagattgctctgttagtaaagaacaagattacgctggacgaagtcgtcaaacatcaaaagcattttggaggccatgttggcagcctcttgtccaatgcagacatctcgtcaaaagacccatttgatctcaaagctttgaataagacatcaaggaaaaagttggagcactatcaagtgctcttctttctcctgcaaacacaatcacagtacctcgccaagctattccgcagactgcgagagctgaacaccccggaaaaggagtatgagagaataaggcacttgatgatggggctcttcggttattctcagaagagacgcgaagaatactacctcattaagttgctatcccgctcagcgaaggaggagattgagagtttcgattcgttgcatgaatatctgcgctgtaactcgttctggaacaagctattcgcatcctacatcaagtctcccagagatcggaaattcatgcgcgacgtccttggaccacttatcaaagaaaatgtggtcgagaatccagagctggatctggaaagcgatcccatccaaatctaccgctcggcaatcaataacgaagaactgcgtaccggcaggagaagtcggcggccactggaccttcccagagaagaggccatcagagatcctgaaacgagagcaacatttatccaaaatctgcaggatcttcgtgacattgcagaccaattcttcactgcgctcaaagaactcctctatcgcatgccctttggaattcgttatatctcgcaacagatgtatgagtgcctcctttcccggttcccaggagaggatcctggcttcattctccaggccgtcggtcattgggtctggagaaactacttccagcctgccatggttgaaccagaaaaatttggtgtcatagaacgtggtctcacgcaagagcagaagagaaatctgtctgaaattgccaaggttgtggcccaggtcgcctccggaagactgtttggcgcggagaatgtctatctgcagccactgaacagctatgttgccgattcaattcagcgactcggccgaatttggggcgacagtaagcttgctgcttttctaagtacatggttatatcacgcagaagctaactag

SEQ ID NO: 19625 - DNA, 306 bp, A.fumigatus
aatatagtggtctcggtacaagatgcggaaacgtatttcgacattgatgaattcaatgacctttacgcgaagactaagcccaccctgtacatcaagatgtccgacattttttcaatccaccaacttgttgcgtctgagatcaactatatttgtccacaccccgacgatattctaagggagataatccgcgacctcggaaatgtgaagaccaacgaaaacgaactgatgagcgtcaattcctcggaaatcaatttgacattaaatcccaagcttgcgcaagtagaaggtaagctgtgctgttattaa

SEQ ID NO: 19626 - DNA, 210 bp, A.fumigatus
gtagcgccttctcatcccactccatgctcatctattctctaccttaaccctgctctctttttctctccccctccccctcttgcgttcacatatcccaagcggtcgaatcgcttttttattgttgttgatttctcttttaatctttcccagcttacgctttctctcctgctttcgattctttcacagtcctcttctacaaaaagagagtga

SEQ ID NO: 19627 - DNA, 300 bp, A.fumigatus
gtctgcgccatggatttcagcagtctgaaagagcaggtcagcaacttgaccttgtatgatatcaaggcgggagtccgcaaggtgcagaatggtaggtactccaatccagcatcttccggcatcccgtcttcctctcccgactccttcagccctgaaccaactgtctacaatggcgtacgagctaataacttttcctgtttcttagctgtcatgaactacacggagatggagtccaaggtttgctgtcaccgccctgccaatcgcattggccgcttcgctcttgtcctgagagagcgatga

SEQ ID NO: 19628 - DNA, 303 bp, A.fumigatus
cagccagctgttaaacgaaattatgccgatgatctacaagcgattcacagacaagagcgcggaggaatggcgacagatctacaaggtacgattgcgcgggctggcgtctaccagagaccggctagactgatttgtcttttttttgacatacagagtcttcaactgctggaatttctgatcaagaatggttcggagcgcgttgtcgatgacgcccggtctcacctgtccttaatccggatgctccgccaatttcattacatcgaccagaacggaaaggaccaaggtgtgaacgtgcgcacccga

SEQ ID NO: 19629 - DNA, 213 bp, A.fumigatus
atcagccaaatcctggccgacgtcgacccgaacgatcatcgcacggatatgcgcctgcagctggctaacctcatcctcacaatcttccagctcatcaagaacagctccaactttgattctcagaattgccgctctggagagagcttgaagatccacgatgatgtgttcttgtgctcggagggcttctgcgtcggcttccagtcgccttcttag

SEQ ID NO: 19630 - DNA, 1896 bp, A.fumigatus
  unsure (1567),(1586): Identity of nucleotide sequences at the above locations are unknown.
gagagcgtaagttttgttcgtgcttggtacgttcgacatagagctctcttcgctgaactgtcgctgcttctagatacaacgcgatttgtcgatgagctgttcgccacctttggcccgaagcagcaggctcctcccgccgtctcgcacactcaggcccagccgccgctcactcatgatttgccacagcctgtgtccctcccccagcaagcgttcccgtataatgtgccctccggtccttctacagatgcttacggagcgccgatgggcggcgcagccccggcgcacacaggtcatgatggcttgaattttaataggaagcgtacctaccatgagggcttccagacggagcaggaacgtgaagatgtgccccacaatcggacttataagacgcctcgtcgagggcgcggaggcggtcgcggcgactggatggggcgcgatggtcgggcaccccagggtgcgcctggtcagttccctcctactggcgctgggttcccggtcatgcccccatcattcccggcgatcgatcaaaatgatccgatggcggcgatgatggctctacagagcatgggattccctcagatgcctggcatgcctccaatgccgatggcggctcacggtggtgctggtcaaccccaggagcaaatgatggccaagtcctctgagcggtgcccgttctacgagacgcaaggcatctgctaccttggggcagcctgcccataccagcatgatacgggtccctcggcaaaggaagacggtaagcgattagcatcttgctttcagcgcaggctattgctaatcagtgatactacagaatatgatcctaaatcagcttccatcatggtggaccttcaaagacgggacggaggcccaatgcgcggcggtgaccgaggtcgtggccgtggccgcggtggcgatcgaggtggttttggaggccgagggcgtcggtctgagttttctgccgctggtcccagcgacgacccctcaatgaagacgattgtcgtggaacaaattcctgatgaaaagcttgacgaggcaacggtgcgcgacttctttgcccaatacggcgagattgttgagatctctctacaaccgcataggaaactggccttgatcacgtacgatagccacgcagcagccaagcgggcatggtcaagtcccaaggtcatcttcgacaaccgcttcgtcaaggtttattggcataagcccaaagcggagagaaacggtgatcaacgacccaggggagacgcaatggacgaaagccccgccttcgatcctcaagaattccaaagacaacaggaagaagcacagaaggcgtacgaagagaagatgcgaaagcgaaaggagaccgaagaggccaaacagaggctggagaaacagcgagaagaacttctcaagaagcagcaggaggagaaggagcggctcttacggaaacttggcgccagagctacaagcaacggcacgagccccgatggcgaagctcgtcagtcccccgccgacgagaacgtaagcgagcagacgaagcagcttcgcgcgcagctggcagcttttgaggctgaagccaaaaccnttggaatcgaccccaacgnttcggaagcaggcgcgacactgttttcctaccgtggtcggggacgaggatatacaggctaccggggagggttcgctccacgggctcgcgggtacgctcctccattccgcggaagcttccgtgggcgaggtgctgcccgtggccgcggcggtgttctccgtctcgacaaccggcccaagagaatcgctgtctcgggtgtcgaattgaatacggaaaaggatgaagcgctgagacagttcctcattgtgagcatattccccccccccctctctcttttcttttttaagtttacccgcatagataattactga

SEQ ID NO: 19631 - DNA, 366 bp, A.fumigatus
caattgccttttcagggcgtcggcgagtacgagtccatcgaatctcaccctgaacaaccaaacactgtcgtcgtggccttcaaggagcgctaccaagccgaaaaattcatgcgcgggccgtggaacatcccgtccgttggagaggtccagcttagctgggtccccaaccctgccgtcagcgctgctacgtctgctcagatctcgggccctggctcggatactaagccgacttcggacgaagatacggtcatggagtctacggcgggctcgtcgcaacctgcggaccagctcaactctcgcaaggatggaagccatgatgttgattacgatgttgcggagatggatgacagctggggtgtggagtag

SEQ ID NO: 19632 - DNA, 333 bp, A.fumigatus
ttcttcgtcttctccactttcgaacccttcgtcctcatccaacagctcttgttgatcgtgctctccttccataattctcacttttcttctctcttttctgccaacattatcaccctcatcatcttccgccttttccaacacctcaccaccgctgaagagacggacaccaccctctgcctcaccgagcaatttgcgctcaccctgcaaaccgacaaccaactgctctcccaagccgcgatcttgattgtcatcatcttcacctcgttcgaaattcgatgtcttgacgtcaatgtaaacggcatccttatcgaccaaaacaccaccgacatctga

SEQ ID NO: 19633 - DNA, 510 bp, A.fumigatus
gttccggctctgaagccttctgctctggccctcgaggcagggtcaagagtttcaaattcagcacggttgatgtcctgctgcttttgcagcttcgccttttgcagctcataccattggtcctcgccgaattcttcttcgcctacacctccctgtcgcgcattgtctttcgagttggcaaaaccttcgcggtcttcttcctcaaatcgcagtcggagttcttctttctttttggcgttgcgttcacgctcggcctctaggtccactggaccttcctccttcttaggctcctctccgtcttcgttgtcggagagtccattgaacacctcaccggtctcgagatcctcaaaagcgccgtctccctcgtcatcttcgtcaaaagcatcatcgaggtcatcgtcatccacgtcgtcatcatcgtcatgcccaccagagagtttagcggtagcgaaacggctccgcagagcctcgatcatatcactatcttgccatttctgttccagtttctcataa

SEQ ID NO: 19634 - DNA, 3300 bp, A.fumigatus
  unsure (16): Identity of nucleotide sequences at the above locations are unknown.
ttcgtcgttataccanacagacacttagtacaccccaaaggcctttggacggtggtgacggccaaacgccgacggctcacgatcatcgaatgtccttccgactccttcgctagcatgatcgatatctccaagattgcggatattgttcttctgatgatcgatggtaattatgggtttgagatggagaccatggagtttctcaatgtcttggcctccagtggtatgcctggaaatgtgttcggcattttgacgcacctggatcttttcaagaagcaaagcacacttcgggcggcgaaaaaacggttgaagcaccgtttctggagtgaactctacaacggtgcaaagcttttctacctctctggcgtggtgaacggccgctatcctgaccgcgaaattcataatctctcccgcttcctgtccgtcatgaagaatcctcggccgttggtttggcgaaactctcacccttatgcgcttgcagatcgatttctagatatcacacctccaacccagattgaagagaaccccaagtgcgaccggaccgtcgcgctgtacggatatttgagaggaacgaacttccccgctcaaggggcacgagtccacgttcctggtgttggtgacttgacagttgcgggcattgaggccctcccggacccgtgtccaaccccgtatatggaccagcaacttgccaagacatctggcaagtcaagtaaacgcagactaggcgagaagcaaaaacttctatttgctcccatgtcagatgtcggtggtgttttggtcgataaggatgccgtttacattgacgtcaagacatcgaatttcgaacgaggtgaagatgatgacaatcaagatcgcggcttgggagagcagttggttgtcggtttgcagggtgagcgcaaattgctcggtgaggcagagggtggtgtccgtctcttcagcggtggtgaggtgttggaaaaggcggaagatgatgagggtgataatgttggcagaaaagagagaagaaaagtgagaattatggaaggagagcacgatcaacaagagctgttggatgaggacgaagggttcgaaagtggagaagacgaagaattagatgaggatggagaagacgatgatctcagtgatgaagaggatggtgacctggaagatgtttccgccccaccagattttgaagagaatttcaaagcaaggcagaatggcagtgcccatcgtgaagagggagatcttgcctttgcggacagcgattctgacctgggttccatttcgtcagttgaggatcaagagctggaaagcgatgtcgacgaggacgaggtggaggaggatgatgacggcgcgcttcgttggaaagaaaacatgattgccaatgcgaaggctcttcacggcaagcgacccaagttccgtgttgctgacctttcccggatgatgtacgacgagtctattgcgccagcggatgtggtgaagagatggcggggcgaagacgatgaggacgaacaacctgaagctgaagagcaccaagaagatgaagatgatttcttcaagaagaccaacacagagaaggaagaacaatcggattatcgtgctgttcctgaatatgattatgagaaactggaacagaaatggcaagatagtgatatgatcgaggctctgcggagccgtttcgctaccgctaaactctctggtgggcatgacgatgatgacgacgtggatgacgatgacctcgatgatgcttttgacgaagatgacgagggagacggcgcttttgaggatctcgagaccggtgaggtgttcaatggactctccgacaacgaagacggagaggagcctaagaaggaggaaggtccagtggacctagaggccgagcgtgaacgcaacgccaaaaagaaagaagaactccgactgcgatttgaggaagaagaccgcgaaggttttgccaactcgaaagacaatgcgcgacagggaggtgtaggcgaagaagaattcggcgaggaccaatggtatgagctgcaaaaggcgaagctgcaaaagcagcaggacatcaaccgtgctgaatttgaaactcttgaccctgcctcgagggccagagcagaaggcttcagagccggaacctatgcccggatagtcctcgagaaagtgccctgcgaattcgccacgaagttcaaccctcgattcccagtgattgttggcggcctggcgccaaccgaagatcgattcggttacgtgcaggtccgaattaagaggcatcgctggcacaaaaagatcttgaagaccaacgatcctctgattttctccctgggttggcgtcgcttccaaaccctgcccatgtacagtacatccgacaaccggacacgaaaccgcatgcttaaatacacccctgagcacatgcattgctttgctaccttctacggcccgcttgtcgcgccaaacacaggtttcagctgcgtacagtccctctcgaacaagacgccaggcttccgcattgcggccactggtgtggtcttgagtgtggacgaacacacggagatcgtcaagaagttgaagcttaccggtgtgccttacaagatcttcaagaacaccgccttcatcaaagatatgttcaactcgtcacttgaaattgccaagttcgagggtgcttcgatccgaaccgtctccggcatccgtggtcagatcaagcgagccctcgccaaacccgaaggatgcttccgtgccacttttgaggataagatcctgatgagcgacatcgtcttcctgcgtgcatggtatcctatcaagccacatcgcttctacaacccggtgacgaatctactcgatttggacgaagaaggtaagggtgatagcggttggctgggtatgcgtttgaccggtgaggtgcgtcgcgagaagggtatccccactccgcagaacaaagactcagcctatcgtccgatcgagcggcctactcgtcatttcaaccctctccgtgtcccacggcagctggccgcagacctccccttcaaatcccagatcacccaaatgaaggcacataaagacaagacctacatgcagaaacgcgcggtggtgcttggtggagaggagaagaaggcgcgcgacctcatgcagaaactcaccactctgcggaatgagaagcaggccaaacgagccgcgaagcaagaggagcgtcgtaaggtataccgcgccaaggtcgcggagagtctcgaaaagaaagctgagcgagagaagcgggagcgtgacgaatactggcgacgggaagggaggaagcggaagaaccaggatgcagaaggtggagggggcaagaaacgcaagtga

SEQ ID NO: 19635 - DNA, 1851 bp, A.fumigatus
gagactctccggctggaagacttgttcgagccaatcgctctccatcttgtctgctttccgcttcgcaccagctttgctgcattcctgtgccaacctagctctctatcgcgggcagtgataccgtcactcgtgtcacttaaggttggcgattgtcctggctggtcctggaaattgtctgtctgtcgcagaaccatccttgaccgacttccaatattgggttttcttttagacccgaaattaagagctgcaaaacaggccttgtcggggttggggtcattggaggtttcaactcagaaaagccccgttgttggctaccgcctggtcgctatgagcgggtcgaatattgacgtgccgttacctgagcattctacggcgcattcgacctgtctaaatgacagcttttctgctgctggcgaggacaatcaccctgtctctgaaagcgacaaagctcacgaggtcgctaagcaaacatcacattcccctctgggtctaacattgcagtccccagtagctcgaggagagccggttggatcaggaagcaatctcgatttttctcatgtatccaggggtcaattgcctgaagtggggactctccccggaggaagcactgcaggctcgctgccctcattgagctcgcaaaggagtaacttgactcgaggcctttcctcgcgtaatccttccagtgggcaagaacatgatgttgcatcaagttcagggactgagcgctccccccagttagcccgcagtcacaaaagaacagctactggcgagattaagccctcgaacacatcagtagcacctcctagccccggaacgattagcgcggaagggcatccagctgagagtatcggctggcgctcgcgtggaagtaggatcgctgcggtaaattggccttgtaattctatattctgcattatcctgctggtgctgatatctaagactctgttgtccgttcaccttcgtactcgtttgtcgtacgctgcagccaagatagagaaaagcaggcaatctctcaacacgcaggagaaactgccattggatttgctaaaagaaagctcctccactcccccggtcattgtcaaaggtgcaccaaacactgatggttcgcgccggcgagacaaggactctccaaacggttcgccagtctccgcgccagatatacctatccagtccaatttcttctctccacacacacgggtctcacctgctgcgcggtcagacgatctatcatctgtttcccaatcaaaatactctcccggatcaccattctcatctaaaagaatgtcggcaacaccgacactcgcacctcccgcagacattgttccaagtggtagtagcagctcccgccgcaggcggccgaatccaaatcaagcacttgaagcttcacgctacatcgcatcgtttgatgacaggcagcatcgtttccagcatgaatctactaatggttcacagaagattctcgtgccgggaacacctcccctccaatcgttatctcagcagacgtcgacgccatataacggcctgtcgaggcagtcaacgcattcgcaaaatgcatcaatggaacaagacgccattgaaaccttattattcatgtccagtcctggtaattcagcttaccacccgagttcccagagacagcaaagtacttcgcacatcagccaaacgtcactaagcacggaatcgagcacccgcgggagtcagctgcaagactctcaggcagctggggaagatcatcgtcgggcaggtcaagctcgctacttggaagcgcaagcgggggacgagattgatcgcatgcttgaccagatggaagatagcgacagcgataacgaaagtaaacctatataccgttga

SEQ ID NO: 19636 - DNA, 480 bp, A.fumigatus
gcgttctgcaataccaatctagcaatcaggatgaatgcagaccaaggctcaaactcatccgcatcaacgtcctcttctctttttgatcctggcgtttttctccccggcggccacaacaatgaccccccgcttccggaaaacagccccacggttgggtacaaactgaatcacttcatgctccgtatccgcgagccgcagcggtcactccacttctacatcaacctcatgggcatgcgcacagtcttcaccatgaatgccggccctttcacactatactacctaggctaccctcccacatccgaagaccgagccgacctgccctcctggtccgcacgggttgccaaacccccagttctcacgcaaaccccagggttgctggaactgtaccatgtccatgggacagaaaaagcggacgcagagggcggcttcaacatgtccactggcaatacggcgcctcatctcggctttggacacttatga

SEQ ID NO: 19637 - DNA, 231 bp, A.fumigatus
ataccctgtggcaagattattgacaaatctagcagaatgcagcttcgacagtctaagattctctcgtgttggttttcttacagcctcagtcatcatcacctaagggaatgttcggtctttcggaaagattcgatagtgacgaggacacacatttatcctgtatccgtctgcatccagaagcgcccgcaggcgactaaggaacataattctcgaggcatgcttcgacgttga

SEQ ID NO: 19638 - DNA, 198 bp, A.fumigatus
tcaatttctttcatagattctactcgcttttacattatttttcaaagaggcaccattgctcaattagctgatgcggttcaaggtcttccagtgaacaacaaggcggtgttccttttcatctatactcaggggcgaaagtgtctcctttggttgtactactttgtattcacacatcaaatcttgaacatcttcatctga

SEQ ID NO: 19639 - DNA, 207 bp, A.fumigatus
cccgtatctcatgggggttccgcggggtccggcgaacgaatgaccgactccaagacttccgatacccgaatgttccgcccgttggacgtgttcccgaaattagaaaattgtcatcaaagtgccgaattcatgatttatcagtactccgtatggccaattgatcccaaacgttgccgccttagccctgaggcgcgagtcttgatttga

SEQ ID NO: 19640 - DNA, 186 bp, A.fumigatus
ctcttgatactacaaggccattccgatcagcctatcgtacacatcttctctggtttcagcaccaaccgtctgctcatctacccatttctcctgtcctcctttgccctgcacgaacttctcgtgaaagatctggaaatgaaccggtggccctccaaaagatgtgaatcccagatgccatgttcgtag

SEQ ID NO: 19641 - DNA, 1269 bp, A.fumigatus
ttccccttaagagttctaggcagaccgggagccgggtgctcaacgttccttcgaacagttgctggctaccactcttctttcttaggggtgaccgggcacatcgattactcaggccttactttggaacatgtgacgaaacactaccgcggtgaggtggtctatgtgccagaggacgatgcgcattttcccactcttaacgtccagcaaacactggaattcgctcttcagagtaagacgcccaaaaggtatcgagagcgaattccacgatatctcgagatctacggcagggttttcggtatgtctcataccatgaagaccctcgtggggaacgagtatattcgtggggtatctggaggagaacgaaaacgaatctctataattgaatcacttgcaaccgattcctcagtcatgtgctgggataactctactagaggcctagatgcctcgtcggcgctggactacgtccgcagtcttcgaattatgactgacacatgcggaaaggcgaccatactgaccttgtaccaagcgtctgacgccatttttgatttggttgataaggttctgctcattgacgaagggcgaatgctctaccagggtccagcgcaagaagcgaaaggttactttgagaatctgggctaccaatgtgcggagatgcaaaccgtatccgattttttgaccagcattacaatccctgagcgacggaggttccagcctggttgggaaaaccgcgctccaaagggagcgattgaactagaggatgcgtttcgaaaaagtgcagctttccatcaaatactggaagaccttcggaactatgaggaaaagcaggctggcattcaaggattgagaacatcgcagtcggattgcgatcgtaggagcctgaaggcgttcaagagcacggtacaagccgaaaagtctcgctttgtctccgccaagtctccgtataccatctccctgtttcgccaagtagttctgtgtggcaagcggcaaatgtggcaggtgaaaggccatatttcgccattattgatcaagctcgtctcctgtgtgatttatggtctgctgattggctcaatgttctatgagctaccagagaacaccgatggcatgtactcgcgtggaggggtgatattctactcctctattttgctcgcttggcttcaaatgtccgagctagaagaagccatgcaaggccgggatatactcagtcgccaaaagaaatttgcattcgtacgaccaaggtcttcaccacggggctcgaaggatccgcgctaa

SEQ ID NO: 19642 - DNA, 288 bp, A.fumigatus
gttgtccttatcatctgcgatccattcatgctcttcctccatgcgcgcaaccgtttgggcagctgcctgctggtctttttgcagcttctcaagctgatgaccaagcttctgcatctcaagtccctcttcggtgatccgggagttcttcgatttgattgcctcctcgagttcacgcaattcctcgtcaaaaccggtcagtttagctctctcgtcctcaagctgcgcttgggcaatgtcatgagcatcctaaggaacggcattagatcaacacagatgatacatgggtaa

SEQ ID NO: 19643 - DNA, 444 bp, A.fumigatus
accgctctatcgtatttcttatactcgcttttcaacttcaccaaaatgtccaagtcagactacatccagaatatgttccagaccaagagctttgttgaccgctacaagtacaccgaaaagctcacgggactatatgctcaaaccttggttgactactctggcgtggccaataccagccagaagccgctggttgtcctagacaatgcctgtgggatcggagctgtctccagcgtactcaaccacacacttcaagatgaagcaaagaaaacttggaaattgacctgcggcgatctgtcagaaggcatgttggagaccaccaagcggagactccaagatgaaggatgggtcaatgctgaaacgaagatcgtgaatgcgttagacactggtcttccagatggacattatacgcacgtttttgtcgcttttggtatgcttatcaactaa

SEQ ID NO: 19644 - DNA, 399 bp, A.fumigatus
gtgcaacatatagtcaactggattccaattatgaaagccgccattgagaccatacccggaaatctcccgtttccaacacagaaagagttcatcgctcttcacaacgccggctgggactcggaatcctacatccagtctgaactggagaagctaggatttcgagacgtcaaagtcatccctgtgccgaaagagacttccatccctatcgatgaattcttcgaagtctgcatgatgataatcccttacctgcttcccaaattctggaccgaggaacagcgagaatcgcacgagaaggatgttccaatggttctgcgacaatatctgcaagacacctatggggcgaatggacaggttcctttggaggcggtggctctcatcacaaccggcctcaagccctag

SEQ ID NO: 19645 - DNA, 975 bp, A.fumigatus
ctgctttctcagccatcggaacctcacgctcacccgttaaccaaggagcaaatggagttccaggatcggaaaaggaggttaggagtctctgcaactcgcgcccattcacattcccttactaaatttggtatacaggacttgaacgttactacaatggcgaatcagcataatttcacagagcaacagcaggcgcagcaacctcaggctgcagccggcgaagcacaagacgtgactgcagccgcgcaaagcactgaacagcaaccacttgctcagatgagcgagctcgacaggtttggactcgcaggcttgctccggatgatccacagtgacagtcccgacgttgcgagtcttgcagtgggtcaagatctgatgactcttggtttggatttgaatcagcctgagtacgttgttgccgttatggcacagaagctttcctttgctttactaacatctgtggttcgaaggcctcttcacacctcttttgcgtcacctttcgttgcatcgatgtcggccgttcctatggagcagaatttctccttgcctgcatgttacaatgttgccaatatccagcctctacaaacccgtatacccagcttcagcgatgagacattgttttatattttctacagcatgcctcgtgacattatgcaagagctagctgcagaagagttgatgggccgcaagtggagatatcataagattgaaaggtgctggcttacacgcgacgaaacgtatcccggtcctgtggatgttgaacctcgcgtcagcgaacgtggtgtttatctgatttgggatcccactacctggaagaagattcgggtttgtatccttggccctatcttgaatccatcttggaatgctaacacatggtatcaacagcgtgagtttattcttcgctacgaggacctggacaacagactggatcacaacaggggtcttgcacgccctcttggattccctcatcaagcttcatga

SEQ ID NO: 19646 - DNA, 807 bp, A.fumigatus
tcagagtcgtttatggctgacttcgttgctgatagggcttcaaatcgtacgctgtgcgtacagtcatctcaggatggtatgcgcttctcctgtgatggttttatggattgcaggctgttgtttacggctatttttggatgtttaaggttttgtgccacagtcgctggaagggagctgaccgtgatgcgcagggacgaatcattcaactccatcactgggctgaacggcagtggtaaatcgaatatcctagatgccatctgctttgttttgggaattacaaatatgtcgaccgttcgtgcgcaaaaccttcaggacctcatttacaagagaggccaggctggtgtcaccaaggctagtgtgaccatcgttttcgataaccgggataccgccaaatcgcccataggcttcgaagagtatgcgaccatttcagttactcgccagatcgtcctcggaggcaccagtaaatacctgatcaacggccatcgtgctcagcagcaaacagtacagaacctcttccagagcgtccaactgaacatcaacaacccaaacttcctgatcatgcagggccggattacgaaggtcttgaatatgaaacccgtggaaatcttgtcgatgattgaggaagcagctggaacgcgtatgttcgaagatcgacgagagaaggcggtcaaaacaatgtccaagaaggaattaaaactgcgggaaatcgaaggtttattgaaggaggagattgagcctaagttggagaaacttagagctgagaagcgagcttttctcgattttcaacaaacacagaacgacctgtag

SEQ ID NO: 19647 - DNA, 1566 bp, A.fumigatus
cggttgacccggctggtggttgctcatgactaccttcgaagcggagagcggttgcgagtgacgggcgaggaatgcgagagcaaacgaagaaggatgcaagcgctcgaggagaacgccgccaagctcaagaatgagatctcccatttggaagaggatatgaaacgggtcagagctgctcgtgacaaggaattgcgaaaaggaggcaaattccaggctctagagaacgaggtcaagtcgcattcgcacgagctagtccggctgaccacgcaattggaccttaagaacgccagcgtctcagaagaacaagagaagcgagaaacagttagaaagaccgtcaaggatcttgagaaagttctcaaggagaagagggaggtctacgataaactacaggcagaatatgatgccgcaaaagctgaactcgacgcccaaacagccgaggtcgaacaaaaggaggaactgcttcagacattacagaccggcgttgcatccaaggaaggtcaagaaagtgggtatcaagggcagctacaagatgcccgtaatcgcgccagtgcagcggcaaccgaacaagagcaggccaaacttaagatcgctcacctggaaaagagaatcaaagaggacgagcctcgtgccaaaaaggcaaagcaacaaaactccgggctccttgatgaactggaaggcttaagggctcaagcgaagaggctggaagcagagctcacaagactcggctttgagcctggaaaagaagaggcgatctaccaagagcagtcggaactgcaaagagacattcgagatttgcgcgagagagccgacgggctcaagagaaaagtggcaaatgtcgacttcacttacgcagacccccacccgaatttcgatcgatccaaggttaagggcttggttgcccagctcttcactttggacaaggacaaggttcaggccgctactgccctggaaatttgtgccggaggccgtctttacaacgtcgttgtcgacactgcggagactggtacacagctccttcagaatggcaaattgcgcaagcgtgtgactatcattcctctcaacaagatctcctctttcagagcttctgcggagaagatcgcggcagcgcaaaatatcgcgccaggcaaagtggacctcgctctgtctttaatcggttacgacgaggaagtcacggcggcgatgaactatgtctttggcaataccttgatatgcgaggacgcggataccgccaagagagtgacgttcgacccggctgtccgaatcatgagtgtcacgctggagggagacgtctacgacccatccggaacgctgtctggtggtagctcgcccaattccagtggtgtccttgtcaccctgcagaagctgaatgagattacacgggaaatgagaagcaaggaacggcgtcttgcagccttagaagacaccatgaggaaggaaaagaagaagctcgatactgtccgggccgtcaaacaggagttggacctcaagagccacgaaatcaagctgacagaggaacaaatcagtaataactcgtcctcatcggtaggtggtccaacagggatctga

SEQ ID NO: 19648 - DNA, 408 bp, A.fumigatus
ctctggagttcttctgactttgggcagattattcaagctgtcgaagaaatgaaatcaaacatcgagcagctgaaaaaggacatctctgacgcaaaaactcgtcaggccgaggcaatgaaggatatcaaacggatcgaaaaggatatgagtgagtttaataacaacaaggatagcaagctggcggaattgcaagctactctggattctctcaagaagaagcttgccaagaactcgaattcagtcaaggccctgcaaaaagagcttcagatctcgaggctcgaatctgaacaggttggcagcgatttgtcggcggcagaggaacagtatgccgaggccgagaatactctgaaagctcagatggaagagatccagtccatgaagcgcgaacaggcccgagtcaaggtttga

SEQ ID NO: 19649 - DNA, 612 bp, A.fumigatus
ttcttcagagacttcccttcgctatcaggagcgcctcagcaatcccagaccccaaacccagggctagtgtggggtcagcgtgccttgcagcagactccacagaggcagcagcacccgacatcccaagcaccctcacgcgcccctcagacacagtcgcatcatccgcaacaacaatcgcagccatcacacgatgatgtatttctctctggtgctcaattcgcaaaccgtctagacgactttcgaaatggtggacagggtatcagcggtcaattaggtggttctgcacagccacagacaggcaacattgacgagttcccccctctgggacgtaatgtcgctgcggatctcggccaagatcgcagagaatctctgatgcaaagtgctggactcggtaattttggcggcacaatgcccttcactggcgcaaaccagaaccagtctgctcaaaatcgcaccatgattggagggtcgatcaatggacaagatacctcgagaatgatgtcacctacaaatgctgggtcgacgggtatgtttttctttctaattttctttgatggagaacagggtgctgactgctttctcagccatcggaacctcacgctcacccgttaa

SEQ ID NO: 19650 - DNA, 246 bp, A.fumigatus
gatgctcatgacattgcccaagcgcagcttgaggacgagagagctaaactgaccggttttgacgaggaattgcgtgaactcgaggaggcaatcaaatcgaagaactcccggatcaccgaagagggacttgagatgcagaagcttggtcatcagcttgagaagctgcaaaaagaccagcaggcagctgcccaaacggttgcgcgcatggaggaagagcatgaatggatcgcagatgataaggacaac

SEQ ID NO: 19651 - DNA, 603 bp, A.fumigatus
cgaattccttcatcgcagttgcactcgaaccggcttaagaaggaagctgcacgcgcggaggcaacattcaagtcagaaaaggcaaaagcggacaaggctatgaagaatcgcgagtttcaaattgcccgtatccacgcggcctctgctgtacgagagaaacgacgacaagtaaccctcagagccgaggctgcgcgggcggacgtcattataaatgaactgaaagccgctcagagcactcgcgatacatcccgaaccctcgctctggcctcaaggggcctggatgcggcgtcgaagagtgtcaatctcgaaaacctggtgtctcatgcaaataacttcctggcgcgatcggaagatttcaaaatcgctagtagtgcgatagaggatgtcgctcaaggtgtctctatgcaagagtatggtgccgagggtgaggccgaagttgatcgtcttatggaacagcttgcagacgaggcgggtgtggacatgcgcctagcgttggatgctgatgcagcacccaaggaagacgtcaaagagcagaagcaggccgactcggagctggaggacggcttgggagcgagactacgtgctctcagagctgcaagctga

SEQ ID NO: 19652 - DNA, 225 bp, A.fumigatus
  unsure (26),(44),(116),(146),(181),(183),(223): Identity of nucleotide sequences at the above locations are unknown.
tacatgcttacatccgcttgtagcanacgcaaaggactggacanagcgttacaccaaatagaggaggcgattaagcgccccaagactgatgcagcaggatctgatgctgctcgganacttatctcggatctgcaagatctccttangaggacacaagggcattctgcgcggagtgaggtcnangagacatcagatgaccctgaccagtcacggacgaaatctncg

SEQ ID NO: 19653 - DNA, 1332 bp, A.fumigatus
agtccttgtctgggtacatcagcacccgctctcccgctactcacagtctcgcctgcggatacatcgttgaaggcgccagagaccatagtgcaggagacaaagacagaggagaagaaccacctaagaaaaggaagtcatggggacaggagctacccattccaaagaccaacttgcctccaaggtatgttctatcgcgtccgacgaagtcagttgggtcagctgacttacacttcccaaagaaaacgggccaagacagaagatgaaaaggaacagcggcgcatcgagcgtgttctccgaaaccgtgcggcggcacagacgtctcgcgagcgcaagagacttgaaatggaaaagttggagaacgagaagattcagatggaacagcaaaatcaattccttctccagcgtctatcgcagatggaagctgagaacaatcgattgagccaacaactcgcccagttgactgccgaggttcgaaactctcgtaacagcactccgaagcctggttctcctgccacagcatctccaactctcacaccaaccttgttcaagcaagaaggtgatgaacttcctcttgaacgaattccatttcccactccctcaatcactgattactcgccaactctaaagccttccagtctggctgagtcctccgacgtgacacaacatcctgcagcggtgttgtgcgacctgcagtgtcagttggcggactcgaaggacctggaagtgccctcccgctttttgacctcggctctggcgtggaacatgacgctgcaaatgacattgcagctcctctttctgacgatgacttccaccgcctattcaacggtgattcatccactgagccagattcttcggtcattgaagacgggttctcctttgacattctcgactcaggagatctatcagcatttccatttgattctatggttaatttcgactccgagcctgtcgccctcgaaggcatcgaaccggcccacggtcttccgaatgagactccttaccagacttctggcttgcaacccagccttggcgcgtccacttcgcgatgcgacgggcagggcattgcagctggctgttagtgagaatgtctctcggggaacttggtccgctggtgatgacgcaggccgactgcactgggagtcgttgttgactttggtttgggcgatagatcgttttgagcgaacgagaggtcgaggacggattctcttcgcgaaattcgagcgaggtgcgcggcgtgatactttgggcaaccgccacaggagtccacggagttcatggagttcaaagcgattgagcgagacgttgacgtctctgatggataaggaacgatga

SEQ ID NO: 19654 - DNA, 1401 bp, A.fumigatus
gtctcgttccctcgttcgaccctctgggagcacagttcccaagtacagccaaaaaaaatggcaccttcacactcatttccacttgcatctctgtcactcattttgcatcaaacttcttgcgctttcgctgccccgtggatagtcaccaaggtgtacgagcaagatgtctacaccgaggattacggctacaggaccacaacaaggactctcattgatgaaatcacaccgacagcatcaccgatgcctgctgccctttcaacagcaactcatgtaacaagcgacagttatgacgatgctgtcacagttgttcaagtgctttatccatctggtgcagggatcgagtcaacctacaagtactacatttaccaagactcaaatattatcacgcagtactttgtggacatggtacttacagcgccaacgtcgtgctcttcgcagtggaccgtgaccactgcggttccagtctatgttcctaacgctattgaagacgctctgctagcgacgtccatgtcaacgagctactccgtggacgatagacaaccctttcagccaaccacatacaccagggctcttgcattcattgaccctacacaattgcccgcatcgagtctgaacaggctcagtaactcctaccagcacaccatttaccacgagtacgggtgctatgacagtagcgccgatagcggtagcagctactcctactatgatggtagtgacggcggcagctggctctacgaccgctattattacggggttatctctccactcggtattctgcttgcttgcattttgggatggttcggagtatggctcatcatcggcctcatcgagagttggtttcagtttcaacgcttgatgaggggttggcaggctcgccgaggattcccaatttcttggtgcatgctcgctcctattgtctcctgtctgctccttttattctgccgcaaaggctttcaagctcgtactttcgaggaggcgcaggtgcttcaagagaaatggcaacaaatgggattctggaggaaagtcggcctgtggcttcggtggggtttcggattcagttatccacctatgctgggtccagctccagtcaaggtcgaaaggccttccaagcgacctgttgctgccaccgctcctctccttggcgtatccccgccacggagtgtcatgtcagatgtccattccgattctggaagcaatcgcggagacagtgctgcgtctggtccagcaatggcctatattccaacgccaggccagacgctgcaagttccgccttcaataccgtcaaacagacaacagcaggcccccgatcagcccatacctgaagttccatcaacgactagcggtgctcttcctgctaacacacatgcaaccgaaacggctagtgagccgcggacttcatag

SEQ ID NO: 19655 - DNA, 258 bp, A.fumigatus
attagcacacacattccttttctcttgccttcttcctttttctttttctttttctttttccttttccttttccttttcttttctttctttttttttttggccccccgcaagtatcaagtttgcactactccgtacattgctgatctccccggcctggctgacctgaatggggcttatgtggatgccgaaatcccaggcaatggtagaccacataattccctaatggaaaatatcgtggttgactactttcgacaataa

SEQ ID NO: 19656 - DNA, 183 bp, A.fumigatus
cgtcctaatgaccgtcgcgacctgacaggtgatttccatattttggatgtcagcaaggaagaagccagggtgacttttatccaggggtcatttgtctggctcgcaagacatgatcatcagatagcagaatattcgtctccccgtctagaaattatccagtatgtcacccatgttagactatga

SEQ ID NO: 19657 - DNA, 1047 bp, A.fumigatus
ttgtcctggatgaagtatcagcgatggctgcttacccgcaataacctgtgggctcccaagcgaccgtcagttgtcgccagcaccaatcaaccggggtcgatatcgttaatcagctccagggatggacgttcggtatctacgacctctcagagtcgatttcatcccctgaaacccctccgcgaggtgaagattgatgaattccgccgtagctacttccacccggaacttcctgtccttcttccttatcggcactttcgcgatctccccgcatgtgagcgctggttccaagtggtcccttcatccaacggccatgaccgcagattaaacacggcatatctacaagagcatggcggggatgcattcgtccccctcgaactcacgcaatcgcccgcagataccacggcgccggatgcaactgtacctgaatcgaacgagctgagcttccagcagttccacgctccattgagtctgttcctagattggatgcgaaccgcagaattgcagtcgcaggctacgcgactctatctagcgcaatgccagctacttgatcttccaccagttctccgcgatgactttcccacccccgaactcgtgctaaaggcgggcaaaggcgacatctacgatacaaacgtatggatcgggcacccgcctacatatacccctttgcaccgtgacccgaacccgaatctcttcgtgcaaattgccggacacaaggttgtgcgactcctggcccccgatgccgggaagagggtgttcgcgtcggtcaggcgccgattgggccggagtggggatcgcgaggcagctgctttccggggcgaggagatgatgcaggggcaggaaaggactttgctggagcatgccgtgtgggatgatgcagactcggacggtaccaataatgtgctagattttggatacgaagctcacttggaaaccggcgacgggttatttataccaaagggatggtggcatagcatcaaaggtgttggagagggcgtcactgcgtcggtgagtttcgtctaccctccggttgggtacgcgctgctctaa

SEQ ID NO: 19658 - DNA, 282 bp, A.fumigatus
tcaggcaagatgccctcttcggtggcaaggatccataaacgccattcatatggcaaagatgctcacacctactccccggttctcgtgattggtgcaggggtgtctggcattgctacaggatgtcgactcaaggaagctcttggctttgatcaattcagaatctttgaaaggcaatcgggcatcggaggtacttggtggataaaccgctacccaggagccgcatgcgatgtgtatgggcatctcaaggcatttatgctctgtcgaagcgactctttttgctga

SEQ ID NO: 19659 - DNA, 1008 bp, A.fumigatus
gtgtttattagtcccgcgctgttgtactctttttcatttgctccaaagaaagactggactaccctacatccccccggaccggagattgttcagtacctggctgatgtctgcgaaaaataccagatagtcgacaagattcaactcaacacagctgtcaaagaaatgcgatggttagaagatgcggaagagtggcaagtcacgttattgcatcttgttcctggtaccggagacttatccgaaggggaaagaaatgcgcgaatatccaaggaaggcgagcgcagtgtctatgttaaaacagagattgtgcgagcaaagattgttgtcagcggggtgggtgtgcttgtcgagcctaaaaaatggcctgaaactgtacccgggattgagacgttcgaaggcgaggtcgttcatacagctcgatggaagagcgatcttgatctatgtggtaaagacgttgtcatcattggctctggctgcagtgcgacccaggtagtctctgagctgacgaaacccgagtacaagatcaggtcaatcacgcagctcatgaggtcacctgcctggttcatgcccgatttcctgacgccgaagtcgctcaagaaatgggagaagtacacaccgccattgtttaaaaacgtccctggccttgcttttgctgcgagggccctgctgttccttctcttggaatgggattttctcacgatcttcaaggacaataagtattcccgccggaatcgttccagaatagagaggaaattcctggagcacatgcgagcgactgctccagagaaatatcacgacatactcattcccaactacagcctgggctgtaagcgacgaattgtggagtccaactattatgccagcattcatgcgcccaattttgagctgacgacgaagcccttgataggcgtccaagccagaagcgtgttactaggccctgatcgacattatcccgccggaaagtcaggagtcaacggatggggtgagacagatagcggcggatgtcattaa

SEQ ID NO: 19660 - DNA, 405 bp, A.fumigatus
ttctggcccaacggatacgagactaataaattccttcatcctctcccggttttcggtcggcgcgggaaaacccttgacgagatttgggaggaacgtggaggagcgcaggcttacctgggcattgccatggaccatatgccgaatctcttcctttcgtttggtccgaacacagcgaccggccatagcagcgtcattttcgcggtcgagaatgccgtcaattactctctgaacttcatcaaacccattctggaggggcgtgtcagctggttcgaggtgaaagagaatgctgagcgcgactggacggacaaagtacagaggagccttcagggcaccgtctttcgacgcggagcttgcacaagctggtaccaaactgatgaaggttggaactcgtccacctatccgtga

SEQ ID NO: 19661 - DNA, 297 bp, A.fumigatus
caggcaacttaccatttccacacggatgacgatgcgatggcctaccgagtgataggattcgctgcacgtatgtgccttgaactgggtctgcaccgacgggaggcgttgatgaaatcctttccgaacgaggatcaatgggccgacgtcaccaaggtcttctggacgatctacagtttggatagacgctggagtcttggtaccgggctaccctttgtcattcaagatgaggatgtcgaccctaacctccccgagcctgtaagtcaaaagccaggaacgacacgcgtcacgcatgtctga

SEQ ID NO: 19662 - DNA, 1152 bp, A.fumigatus
cgtcggttttgctatagcaatgaatgtaagcgacgcaagatcaagtgcaacggtcaagtgccatgccagcgctgtggccatttgaaactcgagtgtcagtactatgtctcatctggctgttttcgtcggtctatgacgtttgagtttttatggagagaaaatgactgtgcgataggccgatacgcccccaattgctgcaacaataacttcaaggattccgagtatgttctatctcccttgtctctgatatggcttaccttgctgtcggtaaggcagctgacaagtgtggtacgggacagggagttccgttcgatgaaagaccagatcacaactctgcaggaacaggtgaacagtctcttcactagtttgaatgatcttcggaatcaaagatcatctttggactcgccgaatctggaggacctctctcgggatggctcacagtcggtctttacgtcgatgcacgcggctaccgtcagacctcgcgtaagacatctgcggtttcacggtcccactagctccgccttcaattttgatgtcgctagatccagtcttcagaccatgggcattgcacccgccgaagaggtcatgaacgacgacatgacaacggcccaagccacgccggccgcatcgccgcctgctcagcaggctgtattcacacagtccatacatccaaccaaagatccaatatgggcaatcaaacgggaggaagctctacgactctgccatgtctatgaggaagaagtcggtattatgtatccgcttgtggatattgagaaggttaccaatcaagtcaacctgctctatactttcatggaggctgcattgcgaactggcttcgcgcagcgagcattcccgggcccagactctctccttgatgataatacaattctcctcaagatgattctcgccataacgttgattgtggaggggagcgggcgaagtgatctgggtcaacgtttattcttgagtgtcaaaccaatcattgaggctaagctttggggaccgatcgacatcaagaccatccagctctttggcatggtggtatgtattgtcattctgatgatatccgacccgcccgggaccctgactaaatgttctgacaggcaacttaccatttccacacggatgacgatgcgatggcctaccgagtga

SEQ ID NO: 19663 - DNA, 210 bp, A.fumigatus
  unsure (5): Identity of nucleotide sequences at the above locations are unknown.
ctgcntggacaagcatcagtcttccactggtactgcttgcttgttggtcagttcgccgttctatcggcacctttatataacttctttcatatccctttgattatcaagatgtaccctgtttactcgatctcttctgttccgatcaccagctttgcagactcctcagccccagatcttcaagcctccgacaagactgtcatgtttgcttaa

SEQ ID NO: 19664 - DNA, 1692 bp, A.fumigatus
atgctcttgccctacgaagacaccgcctcgcagattgtggagataatctggcccttgtcagcagtggcatctcgcagcgactctaccacaggctgcaaaggtgttttacccctccgtactttcattcaggagactctccgtcggtcgcgcaccagctacagcactctgcaggttgccctgtattatttgatcaagatcaaggagcacgtgcctcgctacaatgcggaacaggagcaaccaccccggagcaagccggtctgccgtgccatgcaatgtggccgtcgcatgtttcttgccgcgttgattcttgcatcaaagtaccttcaggaccgcaactactctgcccgtgcgtggagcaaaatctccggcctgaataccgcggaaatcaatcagaacgagttgatgtttcttgaagcgattggttggagactacatgttacagaagccacctttcagcgttggacggacatcgttctgaagtacaccccgggagctggtgggccttttactggagaaggccagtgctggcgaacggtcatccccaagctcactcctgaactggacacagtggacgtagagctttccacaccctcttctatggtaggatttgaatctggccttgtgtcggactcaccttctcctcgttccccgtcgacgggtgagcaccccagcccgtcatccatcttcaatcagggatcggcgtatcagcggtactcgcccgtgtctgctggagcatcgtctcttccatccatgccacgaccacctatgctgccaacacctcagttgacgcctcagacggtcgttgctaccgctcctgctgcgagtggtagcaccttctgtgcccgccgggcttccatctgcgctgctatgtcacaagtgcaaaatgtgtgcatggcgcggtcgactctcgatctacgcccgtcgcttgcgttttgccaaaaggctaacacgtttgatggatacccgaccgtggttcgcagatcgtctctggctcgctcgacgtcttcggcgtcatcgcctgaatcgatgatttccgatgtctccacgctgtcgtcgtcgagtttgtcatcttgctcttccgggtcgggccctgtctccatcctgggcactagcgcctctaccaagcctcgcttggccatgaaggcaacgcatcgatgcaccagcaactcactcaaggaaggtcggaaggctttggccatcgcgtctcctatcgatgagggcccgcttggtgagatctacagctcgcctgagacctacttgggcgcagcgggccaggtcccagatctatccaatatctcgctgggcacccctgttgatcatgaggcagctcaaagcctttgtgaactgtcgggggctatttcccgctctgcacagacgttcgagcaaggaacgactactcagcggcaatgccggaaacgtggccgcacaggctccgaggatattctgtggcaaaaccatgtccgccacctgatgaaccccaatgcgcggaacgagggcaaggcttcggattgttccatgagcgatactcgttcttatccgaaacattctcagtctctttccgctgctcaactcagtctcctggctgttagcgctcctctgtctggaccagctggcatgaagcgtgcttgctgtggcagtgaagcgaggaagatcgcgctgaacccgagtgtgcgatcggagtacttgggctag

SEQ ID NO: 19665 - DNA, 396 bp, A.fumigatus
attacactgcacaccgtgcctaccttaccaatcggtcaaagactagaaccctcggtcaaagaaaaaaagagggggggaaaaaatttcaaactgtcacgagatatgagagcccgactcctccaatttttcagcaaagcccccgccggtcccaccataacaagaacctttgcttctagacgagcagccgccaacaacgcacgcgataccaaccataccaccgccgagccagacgaaaaggacctcaccgcagcccgggagtggcttaacaagttcaattcaaagacagtcactatccctcgtgacatctgcgagatttcctttagccggtccgggggtcctggcggtcaaaatgtcaacaagtccgttcctctgccctgtagttttatcctgcactaa

SEQ ID NO: 19666 - DNA, 522 bp, A.fumigatus
gcagtagcaagcattattcttgtgacttgggctgttggattcccaaagtcgagtcaaatgatgatgagagtcagaagacaacttgaagctgtcccagcaaatgttagcgccacaaccaacaagccacgcggagccaccagtgcggaatccccagtggaattgaagacatccatttcctaccttcagatcacattcgcgacgattctacttctcactattcttccgctgtatccatattcccattcaaatctcatctattataccttgatcaaaatgggctggctcccttggtcctccgacgactccaccaaagcctccgacggcggccgcatagcccccgaccggagctctcgcgaaaagtgctgggaaggccgggatctgttcttctcctgtctggacaaaagcaacatcatcgactcgatcaaagaagataaggaggcgcggcgtcaatgcgggaaggaactggcgcagtttgaggggtcgtgtgcgaaagcttgggtatgtatctcctcccaggcttga

SEQ ID NO: 19667 - DNA, 183 bp, A.fumigatus
gagtccgataccgtctgtctcttccatatggtgaccgagaacggcgtctctcacgacgatcgtaccgttcaggagttctatcccgagatctgtacccatctcttcctcggaacggacgtggagatggcgatcgtggagggggtcgataatcgtcgcgtctgcggtggttcggctcatctctaa

SEQ ID NO: 19668 - DNA, 543 bp, A.fumigatus
gtccacattactgacatctccgcagaccccgttctcaaagaccatttctggatgaacccgttcgcgaagcatttctcgaccatcaaggcttctgacctggttctggtcgatagcgagggctacgtgacagagggaggggcacagcttcccatcaacgaggcggggttcatgattcattctgagattcataaggcccgtccagatgtggtggctgcggcgcatacgcattcgattcatggaaagacgtggagtgcgtttgggcgaccggttgaaatgcttactcagggtttgtgttatagatataccatgaaaggttgtggttggagaacgctgactcttccggtagacgcctgtaacttctacggaaagctgagcgtatatgatgatcatggtgggattgcactagcccgggaagagggtgagcagattgcaaaggctctaggcgagaagaatatcgcctgtattctgcagaaccatgggtatgggaatcttcttgtaacgcaccgcgcttcagcaagagctgactgtcttttagtctgctga

SEQ ID NO: 19669 - DNA, 879 bp, A.fumigatus
gccttcccttccatcaaatcaatccgcagtagcagacgaggatcctctactgcgccggccatagcagcaaactcatctctaactgttcttccttcgtcagatcctgctgcccctctaactcaccctaaccccgatgtccctccctctgcctcctctcaggctgcccagatcctgcccgtcgcgaacgaggtaaatcacgccgtggccagctgggctgcgcagtcggcaccgcatgatcgcttagattaccaagccaaacccgaagataatactggtgagggtggtgtggacttccaaaacctcctcgataatcttcctcctccctctaccgccgctccgtctcctcccctaccctcagagactgccccttcgtctgcggacgacgtctctgaagctcctcaaggcctcccccctcgtcccccgccccaggagaagccctctatccatcctaattaccatcccaccgatgatatccgctcgtatcatcaactccaccctcaccctgccagcacttccactacctacccttcccagcaaagtaattatcagtccaacctaggacttccttccttggccgcttccggcgctcctggaaccgcctcgggtgccagctcgttgcctccaccacctggtcccagcttccagcaaccggccccctcaaccgccgaatcgtctcaggagccccccgcaacggcagcttctccgaatggtcgcatcgagaagccggtcggccgtgtcgtcaaacccggagacgaagatgttccgtggggcccagacgtacagaagaaatatgaccaatttctacatgatgagagagtgtacgtaactgagggactttgggatcgcttcccagcggggtcccggttgttcgtgggttag

SEQ ID NO: 19670 - DNA, 762 bp, A.fumigatus
tcttatctaatccttgctggcaatccaggtaatctaccgacggagagggtcacaaaacgggatttgtttcatatctttcaccaatacggcaaactggcccagatatcgattaagcaagcctacggttttatccaattcgtcgacgcctccgcctgcaagcatgcgctcgattgtgagcaaggagctgtggtaaggggtaggaaaattcgtaagttggcactgcggtccctgcgaatattcgggcctgggttgactctgccttacgcagaccttgagatttcaaaaccacagaggaatactcgggcaggaccaccgccacctgaaccatctcgtggtgctccaccccggcggtccaggtccccggaatacagcagaggcggacctcccagcagccgtaatacgagggcttcgggagatcgctatgatcgaccttacgagtcaggtagagtcccatttagtgactttagagatgagccgaaccaccgcagacgcgacgattatcgaccccctccacgatcgccatctccacgtccgttccgaggaagagatgggtacagatctcgggatagaactcctgaacggtacgatcgtcgtgagagacgccgttctcggtcaccatatggaagagacagacggtatcggactcctagccccaggggccgcagcgcatacgacagtgattcggacttgccagtgcccaggagagccccgcgagacgtcccggaagtgcagattttggttcttgaagaagttgaccggtag

SEQ ID NO: 19671 - DNA, 306 bp, A.fumigatus
ttcatgcccccgcgccgacgggctcctgcggggtcccgaacagatcttccgccactgaagattgttcgaaagatcattctcctgcaaactgcctactatgtctccgctacagccctgatcctgttcacgactttggtttacgggacggggttctcgctcgatttcgttttcagctgggatgccttaaggggggacacaacaatagggtggatgctggggctagtatggatgttaaacagtttactcgggtattgtatacgcctttcgctcctacaaatgcttggttcgctgaccaaatatgattga

SEQ ID NO: 19672 - DNA, 408 bp, A.fumigatus
ccaaatatgattgacagcgtgatcttcctactgctcctcgtgtcccgctcaaagctcatccccgacttcgctataacaattcacttcctccatctcatcgcgacatcgttctacacccgctcaataccccgcaacttgctttggtggtgtctccaatgtgccagcgcagctctgatgacctttctgggtatctgggcctgccagtggcgtgaactcagacctatcacgtttggaatagcaggcggtagaggcacggcacaatcgtcttctagtgcatcccaaccacagactgacgatgttgaaaacgaaccgttcttgccatcacgcggacgcggccgagggcgacatctgggtgaggggagtggcgagtacgaactgacggagatgaaaggtgagcaggctgtataa

SEQ ID NO: 19673 - DNA, 357 bp, A.fumigatus
  unsure (113): Identity of nucleotide sequences at the above locations are unknown.
ccgtgctcattgctaaaatccgatctctgtctacttttttacgtatcatccaagatgtcgaccacgacgattactgaatctgcgaagcagacacttgtcgtcaccccagatanaatcactcctgccgcggcagacgagaagttccaggccatcgcacgcggcaatcgcgaaggcactctcaagctccagggcatcccaaccttctccgacccctacgagcagcgcaaatggatgaaagaacatatggcggctgcgttccgcttcttcgggaagcagggctatggagagggagtgtctggtcatatctcgatgagaggtaaggaaagtctatacacagacatgagtccacattactga

SEQ ID NO: 19674 - DNA, 198 bp, A.fumigatus
ctgtcttttagtctgctgacggttggccacaccgtcgatgaagcggcgttcctgttcttcagtttggataatgcgtgtcgttcgcagttgatggctgatgccgcggctgcgaatggagttcctaaaaagattatcaaccatgaagtggcgcagtatacagccgacgccgtccagaaccctgtatgttttccctgttga

SEQ ID NO: 19675 - DNA, 405 bp, A.fumigatus
tattcttgcattcccaactgtgctcaaccctatctaaaagtctcaattgatatcgaaaaatgcctccccgactcccacgcctcgcacccgctctctccagcccccctcgcatcgtctcgctccgcgtcaccatctcccgctacagcaccagcaccaacaccgacgacgccgtcatccaaacccaacaagtccccgccccaggctccggcagcatccgcgtcctcctcctcaaccgccccaaagctcgtaacgccctctcgcgacacctcctcgacaccctttccaagcaaatccactccatcgccgccgagggcggcaccggcccaacccgcgccctggtcatcgccagcaacatcgacgccgccttttgcgccggcgcagacctcaaagagcgcgccaagatga

SEQ ID NO: 19676 - DNA, 645 bp, A.fumigatus
caaaggaggagtaagaaaccccctaccccctgtggcgaccgccagcgtaccgcatcttttgttgaccagggtaggacgaacgaattcctcaccaaactccgcggcacattccacgacctcgccgcgctgcagatccccaccatctccgcgatctcctccacagcgctgggcggcggcctcgagctggcgctgtgcacgcacctgcgcgtgtttgggtcgtctgctatcgtcggtctcccagagacccggctggcgattatccccggcgcgggcggcacgtatcgtctcccggcgctgattggggtgaaccgcgcgcgggacttgatcttgaccgggcgacgggtgtctggtcccgaggcgtacttcctgggtctttgtgatcggttggtggagatcttgcccgaggaggaggggaaggaaggggtggcgagggagaaggtgctgcgggagagtatcaagcttgcgctggatatctgtgaggggggtcccattgccctcaagcaggcgattcaggccgttgcggggttccaccggggcgaagcggcggagaatgaggcgtacaatggggtgattgagacggaggaccggtatgaggcgcttcgggcttttgcggagaagaggaagcctgcgtttcgggggaggtag

SEQ ID NO: 19677 - DNA, 3276 bp, A.fumigatus
gaccgcttctccagaaatttttcgcgtcctacacatcatgtgaagtggcatctcaatggcttcttatgttctgcgggggtgttccgggaatacagatatatcagcactgccagtcctacagagactgactcgccgattgatacaaatggcgaggaagatcgttggcatgacttttggtgcagagtccgaaatcagtctcgattgagccggtcgctttcaccctccggctcgaatcacctgtgcggacataaccagagctccggcgaatcggacaattcaccgtcaattgtcgatgtatattcgagcgagcacgatgcaactttgaccgcatactccgaaacgaaagcgatgtcttctcgaaaggccacgaaagtgaaggggaaacaatcttctatcgtgacgcctacgcagtatctactcgatgttctccgtgattctgcacgcagtaccggggatggactcggccagacgcagcctgtgaattccattgtgaatgatttcgggaaacggcagaaaaaagcgccgcgcaaacaaccgagattatcgttgcagactattcttgcgcattggatacagtgtgtggatccagtcttgggtcgggcacaaagagcacatcatgataccgaagcgacggccgagctggagatcgtattgcaacaggcgtttccgccaaaaatcatcgagtatctgacggcccgacattacagccccagcgatgtgttgctttggtcatggattctcaagggcaacactcacgaggctgctctccgaattttgatggccgagtctgcagagggagctagacccggctcccaacgtcgactcatacctccgttcattcctctacttctcttgcgcagaccaagccttgacgcgaagagttttcgcttgcttcttatttattccctgcacctcatcactggccgaaaaattccgcctttggacgccttcaagcgcgtacaacgcactgctcaggagctcgaggatagcctcggctcacgacagacagaagccctcatcgacactactacctgcttcgtgctcgttacccgtctgcttcgtcatgctcgggaagtatggccacaggcccagctcaccatcgcgcgtgccttcgcatcctatctaactctgctaagaaacgaccaagaaatttcgcagattgccagacaccgtaggaatcaattcatggctgacaagttcaatgcatgtctctggctgctctcgttgccttgcaaagcaggccctttcaagtttgtttcggtacagcaacaagctcaattcgaacttctcaaggctatggcaggacatagtcctgtccttccggttacgcggcagggctaccaaggtatcattgctgttcaattggcccacaagaagacctccgccgaacggcaatcggcagaactaaaggcaccatcatggccaccgtggaaggaagaaaagcttggaatagactctcaacgcggaaacgaaggaatgaagagtcgcgccatgcgcgtgatggctcagatgagagaggctggctactctcacactcgctgggaggaggtctctgcaatcttggccggttgggacacggacaaaagcccgacggtccaaaccagggccttgatgcgtcgaccgcaactgctacgtgggcctgcaggaagcaagccggatcatcatgctgtctgggtggcccgaatccgcgccacacggacggttagggaggcttgggcctgctttctgtcatatcaagatcaaggcctaccgccgcgcgcgagtatatatgtcgctatggctgagaaattgatattccggagaaaagcgcttgagaatgacttcgaccatatcagtcattctctaccaggtgatggcctggaagtcttcccggaacctgcctccgcccgcgatttgatctatgtacacacggagcctcctaccctagaagagcttctcaaacagatgcttgcccaagggatccgtccatccgggagattcttggctttgcttctgcggtctgcgccgacattcaattgcggattggactatcttagttgcagtgacttgtcgaacgaacaaatccaagctttgtgcactgtgagggaaagtacatcagattatgatgtgttggattcaacggttttggatgaactgcccgactacctcttttcctctttcgtaggctttctttgcaactattcgagtcttgactccttgcacctggaacgacacgatatacgcactgccgatctattccccattattatgagcagtatgagcaggacccatccgaacgagccgaaaacctcgacgctgttttccaatattcaaacatcaggagaaagcggtaccttgcagcatccgaaaaccctgtcgcatgcgatccagttgttgaagcttcgaaagtcccggttcacccctccttggattcatctcttgacagcgctgagcaaggatcgcatcagaacgccgtatcgcagaatgagccgcagtgcacaacgggtgcttgcttggtatgagatggtcgaggtcatcggttggatgaaagaacgtgccatcgaccctggtctgcaggggcatcaggtcctttgcgccagcttctcaaaggcggtgatggcaggtttaaaacatccaaatgccgccgaagagggcctggcgcttgttcatgaagcagcgcggcgaggaaacatcaaacactccaaggtactccgcccccattttgaggacatggttcggggtggacttgccattctcaaagaactctttagccagcttgtcctttcggatccgaaaaacgcccctttcggtgagcgttcggagggcccgttcgagagtgctacaagttcgccagtggctattccttctatgcttcacgtcccttctccagccgctctacatgcattcgtcagagctctcgggctggctgcggagcatgacggcctgttgaacttgcttcgatggatgagccagaatgccaccacgctcaaagagacggctgatgagcatctgaacggcgatcgcatgatgcggcgtactctggttgcacttcgcgtgttccttgaaggataccgagggaagcgaccccggggagaatccgacaatttgccgtcggagtcaatggctgcgggagaacctctccccagcgatgtctcagccccagccgcgaacgggtccaattcgaagctgcaagaggcgtatgagattgtcgcggcgactccgctgtggggttcatggccaagcgatgatgaggtctgggagtatttacagtgggaacctcagcagtctgtacattag

SEQ ID NO: 19678 - DNA, 369 bp, A.fumigatus
tatcgaaaaatgcctccccgactcccacgcctcgcacccgctctctccagcccccctcgcatcgtctcgctccgcgtcaccatctcccgctacagcaccagcaccaacaccgacgacgccgtcatccaaacccaacaagtccccgccccaggctccggcagcatccgcgtcctcctcctcaaccgccccaaagctcgtaacgccctctcgcgacacctcctcgacaccctttccaagcaaatccactccatcgccgccgagggcggcaccggcccaacccgcgccctggtcatcgccagcaacatcgacgccgccttttgcgccggcgcagacctcaaagagcgcgccaagatgacaaaggaggagtaa

SEQ ID NO: 19679 - DNA, 717 bp, A.fumigatus
ttatcattacaacaaagaaagatgccaccacctcgtagacatattagctatctacctcccccgaaacgcaggcttcctcttctccgcaaaagcccgaagcgcctcataccggtcctccgtctcaatcaccccattgtacgcctcattctccgccgcttcgccccggtggaaccccgcaacggcctgaatcgcctgcttgagggcaatgggacccccctcacagatatccagcgcaagcttgatactctcccgcagcaccttctccctcgccaccccttccttcccctcctcctcgggcaagatctccaccaaccgatcacaaagacccaggaagtacgcctcgggaccagacacccgtcgcccggtcaagatcaagtcccgcgcgcggttcaccccaatcagcgccgggagacgatacgtgccgcccgcgccggggataatcgccagccgggtctctgggagaccgacgatagcagacgacccaaacacgcgcaggtgcgtgcacagcgccagctcgaggccgccgcccagcgctgtggaggagatcgcggagatggtggggatctgcagcgcggcgaggtcgtggaatgtgccgcggagtttggtgaggaattcgttcgtcctaccctggtcaacaaaagatgcggtacgctggcggtcgccacagggggtagggggtttcttactcctcctttgtcatcttggcgcgctctttga

SEQ ID NO: 19680 - DNA, 885 bp, A.fumigatus
atcgcctgcttgagggcaatgggacccccctcacagatatccagcgcaagcttgatactctcccgcagcaccttctccctcgccaccccttccttcccctcctcctcgggcaagatctccaccaaccgatcacaaagacccaggaagtacgcctcgggaccagacacccgtcgcccggtcaagatcaagtcccgcgcgcggttcaccccaatcagcgccgggagacgatacgtgccgcccgcgccggggataatcgccagccgggtctctgggagaccgacgatagcagacgacccaaacacgcgcaggtgcgtgcacagcgccagctcgaggccgccgcccagcgctgtggaggagatcgcggagatggtggggatctgcagcgcggcgaggtcgtggaatgtgccgcggagtttggtgaggaattcgttcgtcctaccctggtcaacaaaagatgcggtacgctggcggtcgccacagggggtagggggtttcttactcctcctttgtcatcttggcgcgctctttgaggtctgcgccggcgcaaaaggcggcgtcgatgttgctggcgatgaccagggcgcgggttgggccggtgccgccctcggcggcgatggagtggatttgcttggaaagggtgtcgaggaggtgtcgcgagagggcgttacgagctttggggcggttgaggaggaggacgcggatgctgccggagcctggggcggggacttgttgggtttggatgacggcgtcgtcggtgttggtgctggtgctgtagcgggagatggtgacgcggagcgagacgatgcgaggggggctggagagagcgggtgcgaggcgtgggagtcggggaggcatttttcgatatcaattgagacttttagatag

SEQ ID NO: 19681 - DNA, 2415 bp, A.fumigatus
gtggtactgacctgttccaggaatgataccgaactccagctactctcatgtccactgccgtcgtcacctgcgaagccgcgttccaaacgcgcaaaagtatcaggagagaaagacgaaagcactagcatacaagcgagagttgcgtcggatcgctacaatactctctctgagtttctgagtgatatcgacagggcctccacagctgtgattgagcggagcaaagctcaaagcggtgagggcgaagccaccgacggaaaccgcctaacagagacggtcaatcggattgcggcgttcaaaaagcttttgaatagtcttgtgcgtcaggcttctgtgggccaggccagcttcaagaaggagagcacggaagacagctcggaggctccagagaaatcaacaccctctaccaatgaagctcgaagcgacaatgtggttctcacgattctcggtaatccgtccaatccgaaacagttatattccagcttgcaaaaatcggtcaaagtttctctgccttctggtgaatcagccgtagagaagtatgtggaagtacaaacacctctgcgtgagattggcttgcccaacggtatcacgaccaccaaagttgcggcttaccatacagacaacaagcccaaagagtccaagcgaacctttggcgaggtgttcacacctcgtccaacactaccgcagttagagccgccccgcagagccaggtcgtcttctcgtactgctcctggaggctggattgacccatttgaagcagtcacaaactacaagactttccctggcgagcgaaacaactattgccttgcacctcttccttccggccaatggctccagtacggcggaatcacatcatccccctctttctgggatcgacggcaaaagcaacaatccgctcagccgcacggagacgaaagatataatgaggaccctgctctgtggacagatgacgacgcgtctttgttgcagggcgtgtattattcattcgcaccttcctttgacagctcaggagctattgttcaagctgattcaaaggacatggtatggtgggggaaacgagggacgaaacgcttgtacaccctccttaccaagacctactccgaggagcatcaagaagtatcagatgtatctgcgacagaacaacctggcaacattggtgaattggacgaaagcactttggaagagatggtcaaatcattcaaccctgaagactttgctgaccatgtctcacttaccaatactttggagaaagacaaggaagaagcagagtcgaagagcatggatgacctattacgcgatgtctctgaattgctagagactttgagctcttatcagaagatccgcaacctggaactaccagctccaggcgctgaacccaaagagacagcagcagaccaaggtactccatctcgcgcgtctgcagcagaacagggtatctacgagacactcaagtccagccttgccgttctcgtctcaaacctaccgccatacgccgtcgccaagctagatggtgaccaactagccgaattgaacatcagcaccaagattgtggtcgataatcccgactatcacggcgttatggagaaggatgacttcacactgcagcaggagcgggctgcagcgctggcaccgatggctactgggacaaaccgaacatctacacccagccgctctggaagctatcaggcaggttacaaccagcgggcctatacagctaacgctcgggtacaacaaccgcaagctggttttcaggcgccccagccgtattacggcggaagacagccgtcaacctcagggccttataccccaggccctccacagcactatgctaatgttcgccctccggcaacgccttctcagcgacccgcttttgtgcctggatatcaacaacctactccgcaatacaaccaggccaatcttcagcagttccagcggccgggccaaaacggctacagcccctatgcggcaccgcaagctttaccgcctgctcaagcttctccgcaggcgtacgcgcccaggcccgcacagcctggagcatacgctccgcagtatgctgcagggcgtagtggctcaccgcagaagcagccagcatatgcctcgcctcggacacgggcaccatatatggcaccaagctctgcaaccccccagcagcggtatgtcccgcagcagcaaccatccaattacaactacccttccaaccaagctccccttgcaccaaacacctactccaactctgccgctgcaatgacttatgctcggagtgctgctgaacaggccgcattgatggaccggaataaagcgcaattagcgcaacaaacccgacagagctcaacccctcagcccgctacagatgccagctcccaagaccgaagtataacgccagctatcaagcaaaatggtactcctgtgccctcgtga

SEQ ID NO: 19682 - DNA, 327 bp, A.fumigatus
gacgaagtcaattctcgtcctcgcgttcaaggagcaaaaaatcaactgcaacaacggcgcatctccgaacttgaagccatgagcgcagacgaaggcggagagacgctttcgattcccgccaccaacggtgaacctcaatctgcgactccagatccgcctgtactgtcgacacctggaaagcgaaagcgtggatcgagccacgatgttcatgctgcccaggatgccggtgcttctgagtcgcaggtccaggaaagggtcaaactacacgaaaccctgagtaatctcgtggatatcctcagcaagtgcgcatcccccatgttctgttga

SEQ ID NO: 19683 - DNA, 204 bp, A.fumigatus
ggcgagatacgaggcttcaaaggagctgtgagttgtcctccggaggtttggaagcccacgaatctgatgacacctaggattgagcagcctgatcagtctattgaggcagaggtgctcaaggctgagacacaggcggcgatggatactttgcaggaattacaggctcagtttgaagtcgtgagtgctgaagctaggtccagatga

SEQ ID NO: 19684 - DNA, 837 bp, A.fumigatus
cctgcgcttccccggtccgttactctcggcggaggggttgtgtttccggtaccagcgggatgcaccgccgatactgaacgggatcgaactggtaatgcacatgggcgatcgggtcgggatcatggggctgaatggttctggcaaatctacgctcatccgcctattgacgggcaatctacagccaacgcaggggaaggtatccacccactccaggctgaaactaggatactacgcgcagcattcgatcgaggagctccacgaacaaggtcgcaccgatcctacactgaccgcattaggtttcatggccaaggagatcaatacttcactcggcgagggcgagatccgtggtttgctgtcgtcactgggtctgcagggcaggatagtctcagacgtgcccattgcacgattatcgggaggccaactggtacgttttgcaagtctgagaagcgatctgcagctgttgacaatgtccaggtccgtcttgcaattgccaaggtaatctggaacgcgcctcatttgctggttcttgatgaaatcacaacgcatctggacttccataccgtcacggctcttgcgactgcgctgtcgtcgttcaacggtgcaatcctcctggtctctcacgatcggttcctggtccgatcagtcattgaagggaaacgcgacgacgaccatagcctggatgaagagtttgagggggttgaccaagaagtcgaagagcagagtcgacgaaggtcggtctatgtgatgaaaggcggcaagcttattgagcagcccaacggggtggagcagtttgagcagagtttggtgaagagggtcaagaagatgctttcacaatag

SEQ ID NO: 19685 - DNA, 915 bp, A.fumigatus
caagtgaagacccccaaatcatgcggtgaatcgcccgctacacttgcactgagcagcggcccatatgacaattatttttattccgactgcaatgttgccgctcaagtggttgtcacttccccattaccagacagcaacctgagtttgatcgggcctcggctgatcgtcgcctggccggcgggcaacagcggcatctgcacttactttgctcctgagaatggagtcaacggcacccttgggatttcggtcgtcaactctaccgtggggagtcccctgtccctcaattacacggctaaagagccaaaccccggggtcggggtgcaaggcacgctccgcttcaactcgtcggcggttctgactgtccccattctgggcagcattcgcacgatccgggatttcgtcgaagggccaagtctcctgcagcctaagatccaggatgctatccagttgatcagctctcctgacggaagcgtgatgctccagcgtctgtggctggacaatgtcaccacgagcgcaatcaagtttactcctgtcaacagcacatccaaggccgccgtctctggcaagacggtcagatttgacgcgggtgattacgtcttctcggcagagattgactatccgcagctgacccagctgcctccggccaaggtgctaaacaatgcctctgcagaccttgtgactaaaatgcccgttcaggccacggcgctctcgtttctctcctactcggagaaacttctggctggtgcatggcgttttctgacctactttggacgggatctgatgatatccgccttgcttatggatccggtcatgagctatggcaatgctagtgccatcgaggcggtgctgggctctgtttgtgagcgcatcaacgccaccgatggcagtacctgtcatgaagagacaatcgggtag

SEQ ID NO: 19686 - DNA, 1179 bp, A.fumigatus
gcatggcagatgaaattggtcgagattgagaagcaagctcgacagatccttatcggactggggtttgacgaagccatgctcagcaaacccttcctgactttatccgggggctggcgcatgcgttgcctgttggctagtgttcttatccagaacccggacatcatgatccttgacgaaccgacaaacttcctagacctgcttggggtcgtctggctggagaattacctacagcggttacgcgactcgtcccagacgaccatcttgctggtatctcacgaccgagactttgtcaatgcggtctgcgaggagatcgtcatcctgcgcgaccagaaactgacctacttcaggggcaacctttccgcctacgagaaagactttgaagcgcagaaactctactggggccgcatgaaggaggcacaagagcgccagattgcgcacatgaaagcgacgattcgagagaacatcaagctgggcaagaagaccaacgacgacaataagctgcgcatggccaagtcccggcagaagaaagtcgacgaccggatgggcgttcaggtcaacgctaatggcggtcgctttaaactgaacagggacctggcgggctaccatctcaccgcgcgagctgaaattgaagtaccaacggacgaaagatgtatatcaattatcctgcccgatgccagtgacctgcgcttccccggtccgttactctcggcggaggggttgtgtttccggtaccagcgggatgcaccgccgatactgaacgggatcgaactggtaatgcacatgggcgatcgggtcgggatcatggggctgaatggttctggcaaatctacgctcatccgcctattgacgggcaatctacagccaacgcaggggaaggtatccacccactccaggctgaaactaggatactacgcgcagcattcgatcgaggagctccacgaacaaggtcgcaccgatcctacactgaccgcattaggtttcatggccaaggagatcaatacttcactcggcgagggcgagatccgtggtttgctgtcgtcactgggtctgcagggcaggatagtctcagacgtgcccattgcacgattatcgggaggccaactggtacgttttgcaagtctgagaagcgatctgcagctgttgacaatgtccaggtccgtcttgcaattgccaaggtaa

SEQ ID NO: 19687 - DNA, 213 bp, A.fumigatus
ctaatgatcgcttcatggtggcgaaatcgctacgagagaaacgcgagtatggcaggcatcacaagcatcatcaaggaaaagcgctccttatatcttttcgtcctcactggtttgtccacactcgatatcattatgatcgtcaaggaggcccaatatggcaggaggaaaagcgctatgccgtcagtggaggtggctccagtacaagaaatttga

SEQ ID NO: 19688 - DNA, 207 bp, A.fumigatus
tttctgtcccagggatacgtaaatacctctctaaggtacatccaagattcttggttgaagcatagactgttcagtcttaagtttcatgtctcagcaacatatcactcaaatatgctaacatccggcatttatccatttaatttccagggaaaacagtttttcttcacatttaagcaaaactcatgtattattggctcagaattctga

SEQ ID NO: 19689 - DNA, 636 bp, A.fumigatus
tctctcgtcaaactgaataatgtcgaatatgccctctcgcagctcgataggcttgagcgtgagatcaatgttgacggttgtgcggaagtgattgcgcagcatgcaggcccgcagctacagaaaattcgcagatcaacaacctacgttttcacaatcaagatcgtggaagctgaagatctcaaagcatgcgatatgaatggcagcagcgatccttacgttgttctcacagatgaatatcagaagcgaattgcgaaaactcgaattatctacaacaacctgaatccgcgatgggatgatgctgtcgacataacaacacaaggaccactaaatatcattgcgaccatctgggactgggatgcagttggtgatcacgactatgttggtcgcacttcgatcaaactcgatcccttgcatttcagtgattttcttccgagggagtactggcttgatctagacacccaaggcagattgctactccgtgtcagcatggaaggggagcgtgacgacatccagttctattttggcaaagcgtttcggacattaaaacgtactgaaagagatatgactcgcaagatcaccgaaaaggtaagtcatccttccatagccgaccgacaggtcaggtcttcaggacattga

SEQ ID NO: 19690 - DNA, 324 bp, A.fumigatus
aacggaggttatcagaatccccctcgtgtgaagcgtgctttcagagacccctacggcgactggtgggataagcaggagagaaggaattttggcgagcccgttcacgaggagaatgaaatcctcggcgtcttcagtcccgagcaatatacacatgtcacaccccgcaaaggcctgttccagattggagctttcatcgcaaccttccttactctctgtggtgtcgtgagcctgtactaccctgacaagcccagcgtgcctcagacttatcccggcggcttggagaaggagcttggaggtgcgcgtgctgttccggtacgtttatga

SEQ ID NO: 19691 - DNA, 1995 bp, A.fumigatus
atagtgagaagagggagagagaaagagaatctccccatgtcgacatcatcgactcagtcccgaggcatcaaccgacggattaacagtcttcagaatgaagttcgccattcccgcaatctgtctgcatcacgcaggcgcccagtgaactcttcggccgcctacagttatgctctacgagtcgcatatctcacatatcttttgaatccccgttctcgtcgcatacagaatgtctctgccgctccacaaccgcgcccaaaacgggcgtcaacctccttccatgatttgatgagcgatttctcgctagttagagactcgaagagcacgaggttccccagtggattcgtgtctgagcttgagaagcggctgacaggggttcttatgggaaaggaaagaaggaaggaatatcaggatcacctggtcgttaggacattcgccgcgtttctcaacactttaaaggatcaatcattcaagaagcggatggagaaggaccgccgagcggaggatcttgtccttattttctactcaaatgcgacaaaagagctgagtaaggggaaagattcagatgatgatagttggaaatttatggtggacagacatgtcgcccttttcgttcgactgtttgcgctgatcctgaaagaccatgactgggacaaggacaggcctgaactggcaaacaggttgtcggttctagagaacaaacttctttcccaagaccatgatcttatgcaagcgagcgggcctacggcaacggttgagaccacaacttccctcacctacgatgttagagacatgcctctcgtgcagcatgtcgcgaagatattcggcataagtattcaccaggtccaatccgacattgacaagaacagaggcgtatggaccggaaaggcagcccttcaggacctgaaaacttatcaggctcacctgaacctccagacacggaagacgttatccagggaagattttgataacgaggaagcttatgaacactggaaaaagagcgagggcccggatttgtcacaaatgatgctggcaatcgtacagtcaaatccagagctcgcaaaaagtacgccaggcggtgcacttccgcagttcaatgtgaatgccgctgaccagagcaacgatccaagcgctgcaccgctatctcgaacaatgtctgaccgaccggtctcctatgtgattgaccaacctatcgacctgagttctctgtcgttatcagacgacccaaataataattccgaggaatctgatacgtacaccttcataccgtcggacccaaggtcaatgtacaaattcattctgggtctgacactgagtcacgacctaaaggatcgcgagatcgaagctacggcagcgacctcggaaacaacgtcaatgaaactgctctccaaacaatccacggaactgctgaatgaattatgtcttcgctggcgaatacctaacttttctagggttgtattgttcctggatatcatcagaacaaagtttgtggacaacgagattgatcttgacactcttgattctgcctttacgtttgttaaagaaacacctccgtcagatggcaagaaacgacaaagttatatggcctctgttgtatttgacaggagcaaatggacaatccaggatcttctgttgatacaagagctgctatcctccctccacgaagctttactccgggaactgtacgatgtaatgatggattgttttgaagctaagcctcgtcctattggcccggtgatgtacgtcttggagaaccacatacagctcgacccgaactacaccgaagacttggaagatatcgatcggttccgctcctatgtgcaggatgggctggcgcaaaaggcaactgagaagtatcaagaacttttagggcagattgtcccagtgcaggcagaaacctgggagccacaccacgtcatccagctcggcgatgccatcatgaaactcgctcagaagatacggaagcgatatcgaaataatcctgaaatcatggggtaa

SEQ ID NO: 19692 - DNA, 558 bp, A.fumigatus
cgctgggacagtgtcactttccctttccatgtggaaagtcttctggaagactttgtatggcgctggattcgcttaactgatcagaaagtcatggactgggttgaacaggcagtcagacaggatcccttcactgtccgggccggtgactggacagatgtggttcctgaagaccaccgacacagcgtatcggtaatcgacatattccgctccttcaatcaagtggttgaacagatggttcaacttgggtgggatgatgacttgcagtatgcaaaattcatgactgccctttctaagtctatcgggaaaggggtggcacgatactgcgaattgttggaacaaatgttttcgagagaaatggatcgactgtctcctgatcaagaggcagccatgaatcagactactcaggaaaagataatgcaaatggcgaaggaagcatggacaagcaaggaaaagattgagcctttccaatttttcccagaggtaagcttgcgatttcagtcaagtgccccgcctggtcctgaatatctgaccaagggttatagtctctcgtcaaactga

SEQ ID NO: 19693 - DNA, 279 bp, A.fumigatus
cgagtggatttaggtccatctgccggcatcactatggccacttctctcctttcgctggccctggaccaccctcttgacccgacaatagcaatgaccggagaactgaccgtgacgggcaaggttctccgtattggcggcttgcgggagaagacggtggctgctcgtcgtgctggtgcgaagaagattatcttccctgcagacaatatgtccgactggttagagctgccggaggtgagtagaatccaaaatacatcgtccttggtccactcttcgagctga

SEQ ID NO: 19694 - DNA, 2274 bp, A.fumigatus
ataatcggctgtagtacgagcgaatttgactactatcgtcctttctcccagtgccggcctcaattcttatggacgtggggaatccagttggcggggtgttcaagtcgttccttgcacgacagtggagcgacagaatcgatctgtatggccatctccatcgcagacagttcatatagccccacgaggcacctggggtttctacttgacccagaaaaggtcaatcctcgtcccaaacagagcatgtggcatcgactcggtcttcgaagactgctgggccgtgatgatcgcgacttatcctcccggtcaccttctggtgactcctcacctcccgcaaaccctgcccccactgcaaacaacagcggcaatgcccaccactcttccaaactccatgataacctgacccgcagactttctcgcagggtaggcgtcggtctgccccgttcgacaacgttcaagagacaggattcagaacgaagagatcgtctagcccccgtcgaaccagagccccgtcgtgccgtttccgccgaccgtcgtcgcccgttgagcgcccagcggaccaggtccccacagcccaccgtggaccccagattgtccgcgcccgaggttccatggcacgaccacgcggaagaacccatggtggaggaggttgaaccacctgcgacgacgaatgatgacaatgaggttatgtccgattggaatccgtgtcctgacgtcgcggatgttcccgaacagccgccggaggatctgatagagatggaattggaaaagcgatggatactgaatctgagtatgcattttcgtgaccggtcggagcgcgagaaattcttcgtcacctacgcggaggcccccaaccgatggcgcagagtcaccatttcgtgtgactatcggggcgctcctcccgattcgctcgagcaggatctgaaggaattgcgctatcagcgagacaagtgtgctcgaatctacgagtccatccgagagtcgcttccagagattcagttctacgacacagtcacaaatctgaaattggagacgcgtgatggccgtctccatgtgcacgtcaccgaagacgtgaacgaaatcatcccttaccctccgacctcctgcatcggccatttgccggaggctcgccttgtccctgaataccagctgcatttcgaggcgcatctgtcgggcttcgtgtacaatgtccgattggatgggaagaactacatcaaaaaggaaattcccgggcccgacaccgtcgacgagtttctctacgaaatcaacgctctacatgccctcaacggctcaccaaatgtcattcaagtggaagggattgttgtcaacgacagtcgagacgtcgtcaaggggctacttattagttacgccgagcagggagcattggttgacattctgtatgagcagcggggcacaatctcctgggaacggcgagcgcggtgggcgaggcaaattatccagggcctgggtgagattcacgagtcaggatatgtgcaaggagacttcacattgtcgaacattgtggtagacgccgatgacaacgccaaaatcatcgacatcaacagacggggctgtcctgtgggatgggaaccccctgaaattgccgccaagatcgagagtaaccagcgaatatccatgtacatcggagtcaaaaccgatctgtatcagctaggaatgactttgtgggccctggccaccgaggaagacgaacctgaacgacagcctcgccccctcttactgggccaggaggtggacgtgcctgattggtatcgcaggatagtatcgatctgcttgagtccttctcctcgtcagagactctcagcaaaggagcttctggtcttcttcccccaggagctttcaacaacaacaacaacaacaacaacaacaccgcaattccactcgacacatcttccccacggaggcctcggggttgggctgtacaacagcccgttacctttatacaatgcccgtgccattaccacagccgcaactttcgccggtccaaacaaccggccagtttatcaacctggtcatttccatggaagatcagtttctctggacgagacagggtctcggctatatgccaatagcgttgactcctttccagcataccctgaagactgttacagtgtgtcacttgacgacgaaaaagtgccgaccacaaacgaacactcaaactccatgcgtgagtatgcggctgataatcagacttgtgaggtgatctttgatcctcgaaattccgagaccaatggtcaacgccctcaattcttcttctga

SEQ ID NO: 19695 - DNA, 1764 bp, A.fumigatus
cgactgccaaaggcattggtagtgttgaagaaggaactgatgaatgcacaactccagtccaagatatccaaggatgtggaggcgaagattcagaaacgtcaacgcgagtattggctgatggagcagatgaagggtatcaagagagagttgggtatcgaatcggacggcaaagacaaactagtggagaagttcaaagagaaggcatcgaagttggccatgccagatgctgtcaaaaaggtgttcgacgaggaaatcaacaagctggcccaccttgagccagccgcgtcggaattcaacgttactcggaattaccttgactggctgactcaaattccgtggggtcagaagagcgtggagaacttcggtattaagcatgccatgactgtcttggacgaagatcactacggcttgaaggatgttaaggatcgtatccttgagttcattgcggttggaaagcttcggggaaccgtggaaggcaagattctctgccttgtaggacccccaggtgtcggaaagaccagtatcggcaagtcgatcgcccgagctctgaaccggcagtattaccggttctccgttggtggcctcacagatgttgctgagatcaagggacatcgtcggacctatgtgggtgcacttcccggtcgtatcattcaagccctcaagaagtgccagaccgagaatcctctgattttgattgatgaggtggataaaatcggacgaggtcatcagggcgatccatcatcggcgttgctcgaacttctagatccagaacagaactcatccttcctcgatcactacatggatgtccccgtcgatttgtccaaggttctcttcgtttgcacggccaatgtcacagacaccattcctcggcctcttttggaccgcatggaacttattgagctgtccggttacgttgcggatgagaagatggcaattgccgagcgctaccttgcacctgctgcgagggaactcacgggtttgaaggatgtcgacgttaacctccagaaggacgctatcgaggaactaatcaaatcgtatgcccgcgagagtggtgttcgaaatctgaagaagcagattgagaaagtctatcgcaaagcggctttcaagattgtccaggatcttggcgaggaggttcttggcgaagacaaggctcttactgacgagggtaaagccgcacaggaagaatcgaagaaggagaccgaagaaggagatcccaaggatccccctgccgatcccgagaaatcaacaacggagactccgcgtctcgcgctcaaggtccctgagagcgtgcaccttagtatcggcaaagacagccttacagactacctcggtcctcctgtcttcacagcggaccgactctacgacaccttcccccccggtgttacaatgggtctggcctggaccagcatgggcggagccgcactgtacgtcgagtcgattctggagaatgctctgactcccgagtcacgacccggtatcgatatcacaggaaatctgcaacctgtgatgaaggaatccacacagattgcatactcttttgcaaagtcggtcttggctaaacagttcccggaaaacaaattcttcgagaaggcgaagcttcatatgcattgccctgaaggtgctgttcccaaggatggtaagttgaaaaaattccttagcatattactctttttgcacggaggtctaacgagtggatttaggtccatctgccggcatcactatggccacttctctcctttcgctggccctggaccaccctcttga

SEQ ID NO: 19696 - DNA, 774 bp, A.fumigatus
gtgacgaagaatttctcgcgctccgaccggtcacgaaaatgcatactcagattcagtatccatcgcttttccaattccatctctatcagatcctccggcggctgttcgggaacatccgcgacgtcaggacacggattccaatcggacataacctcattgtcatcattcgtcgtcgcaggtggttcaacctcctccaccatgggttcttccgcgtggtcgtgccatggaacctcgggcgcggacaatctggggtccacggtgggctgtggggacctggtccgctgggcgctcaacgggcgacgacggtcggcggaaacggcacgacggggctctggttcgacgggggctagacgatctcttcgttctgaatcctgtctcttgaacgttgtcgaacggggcagaccgacgcctaccctgcgagaaagtctgcgggtcaggttatcatggagtttggaagagtggtgggcattgccgctgttgtttgcagtgggggcagggtttgcgggaggtgaggagtcaccagaaggtgaccgggaggataagtcgcgatcatcacggcccagcagtcttcgaagaccgagtcgatgccacatgctctgtttgggacgaggattgaccttttctgggtcaagtagaaaccccaggtgcctcgtggggctatatgaactgtctgcgatggagatggccatacagatcgattctgtcgctccactgtcgtgcaaggaacgacttgaacaccccgccaactggattccccacgtccataagaattga

SEQ ID NO: 19697 - DNA, 471 bp, A.fumigatus
aacctgctcaatgatctctttcaatcatcctcttcgagaggtcccttcttcggcttccctgcaagctgcttctgccaaagcttattggccgcgtctttgtcgagctcggcgaagagaatgttgaatacttccgagtaccagctcactgcatggccttcaataccgtctttgatgttctgtatacactgtcagctcgaagagtggaccaaggacgatgtattttggattctactcacctccggcagctctaaccagtcggacatattgtctgcagggaagataatcttcttcgcaccagcacgacgagcagccaccgtcttctcccgcaagccgccaatacggagaaccttgcccgtcacggtcagttctccggtcattgctattgtcgggtcaagagggtggtccagggccagcgaaaggagagaagtggccatagtgatgccggcagatggacctaaatccactcgttag

SEQ ID NO: 19698 - DNA, 561 bp, A.fumigatus
tggatcgccctgatgacctcgtccgattttatccacctcatcaatcaaaatcagaggattctcggtctggcacttcttgagggcttgaatgatacgaccgggaagtgcacccacataggtccgacgatgtcccttgatctcagcaacatctgtgaggccaccaacggagaaccggtaatactgccggttcagagctcgggcgatcgacttgccgatactggtctttccgacacctgggggtcctacaaggcagagaatcttgccttccacggttccccgaagctttccaaccgcaatgaactcaaggatacgatccttaacatccttcaagccgtagtgatcttcgtccaagacagtcatggcatgcttaataccgaagttctccacgctcttctgaccccacggaatttgagtcagccagtcaaggtaattccgagtaacgttgaattccgacgcggctggctcaaggtgggccagcttgttgatttcctcgtcgaacacctttttgacagcatctggcatggccaacttcgatgccttctctttgaacttctccactag

SEQ ID NO: 19699 - DNA, 393 bp, A.fumigatus
gctcgtcgcatcctgccaagtctcgcgctcactcttgtcgtacttggcctcagctatgcctttgccgcaaattatgaagccccagcgagagcagaccgcatgtggccggatatgcccccagcagccgccactgcattcgctatcatgggtgcgaatctaaccatcttccttctttggaagtttccaccggcgtggcgaatgctcaatcgttactttatcagcgttcctttcaagccccatgccctgagcattgtcggaaatgtcttcagtcatcagcagttcaaacatatgtcattgaacatgctcatgttgtggtttattggaacgaaacgtgagtgctggtcaaacctctcgcagggacttttgatgctgactgtgcctagtccacgatga

SEQ ID NO: 19700 - DNA, 231 bp, A.fumigatus
gtggctcctggacccaactccccgtcgtttccaccgagtgtggacagccccgcaccttacgaccctgacgcccccaagtactttttccaggagaagtatgccccgttgaatgtaaagggtaacttcctgaccctatgtgcttgtccgaagaatgtggagctcggagaatggctggctcatcaaagtaagcgattcatgtacatcgccgtttggtcagatcctcggtgctga

SEQ ID NO: 19701 - DNA, 618 bp, A.fumigatus
aagcacctgtccaactatgtctgcgggtcggtaagtgacctgagtatcccacgaacacgcccgaatttcataccgcctctaactgaattccccaatagcttgacatatacttggcttgtggacgggcgtgccgccaagatctctgctccaaaattcatcaaccgcgttgaaaagtggattgtcagcaagatccatgacccggtcatgttccccaccgagaaggtcaccggcacccctgacacctttgcactgcatgaagctacaaatgccaatcccggtagcgctgacgcgaattctaccggcgaggagtggattggcaagtccagcggctttccccagactttctacaaggactgtcaaggtatcatgaaacagatgttccgttgctatgctcatctgtaccacgcacattggttgaacccgttttggcacatcaacaaacacgacatcttgaacatgtgcttcgtccatttcgtgaccgtcgccaaatactacaagctagtttccgacaaggagatggagcctatgcagcccctgattgacctgttcatcaaacagcagcgtatcccccaggaggctcttgcgggaggtcactggggtcagccaagctctagctga

SEQ ID NO: 19702 - DNA, 276 bp, A.fumigatus
ctggctgattacgcacacaacagggagaaattcactatcttcttccttccccgggaatggcaagaggttatatccgccaaaggatgggtcctcctgaccggcttcgtcgcctttgaaattttcaacctggtatcccccttccgtgtaatgaagctcgatcactttgcccatctgggtggatatctgatcggcgctgtatgggctctggcgtggaaaggcgaacagaagaaacgccggcagaacagaacctggtttgagcgacttatgtctgaatag

SEQ ID NO: 19703 - DNA, 1605 bp, A.fumigatus
gaagacagtgacagggacatccacctcatcaacgggacttctgccaccaggagagcacttgctaaaatgatggcgctggaggtcaaagacgaaacatacgacgagtcagagattttccttagcttcgcgccctgggtcccattaagtgctactgaagacacccacgtagttgaaccagaggcactcacatcttccgtcaaacacccatggggcataattgattatcacctttatctgaacagtctcgaagcgggaaaagatatgcatatcaggcgcgagaacttgtatctcttcgacgacacagactgcgaacccatccgctactgtgatcttttcgtcgccgaaatctacagaatggaagaagacagccagcgagcccgcctgctcttcgccattctacccattgcggaaaaaggtgcagtctttggcgaacgtaactatgtccttggatatgactggaaatatagaagtttgtttgcccgccatttcaattggatgccccacgacattcgtgatatctggtctgtgtggagcgaaggcacaacagtgtacaccatttccatttccaggctgtttaatctcctgcagtcaacattccagaagcggaccgggagggctggcgaggggattttgagctcaaatcctctttgcgcaagccttcaagtgggcgatgatcccggcatggagatggtcattgtcactatgttcgcccaatttgctgcggactttattgatgtcatcttcattcaagaagaatatcagaagcagaagttccgtcatcaacttgcatactatgaagaccaatgccgacaggtcctgcagcgcgcatcgtatcgggcctggtttgccctccgccctggatccgcgcgagccaagtacagaacggagaaaaacgatgaaaacgattccttcagacaactcctccaggatttgtatgccttggaagatgaagagcgacaggagcaggaacagtcgcatggttttgtgatgcaaggtggcgagtggcgcgcagccgacctcgaaaccaagacatggcaacgtgaggaagacagacagaggcgccgtgaggaagctgtccgacgacttgagggtctctttgctataccagacgacctcccatgcactcagtcccccggccaagcattcgaaaatatcatgatcaaagctggagagcatcccacgatcgatgagaattatccccctgacgctccaaggaccccttcacccccattccgccacagatcggttcttcagcagatacaatgcttgagcccaggttctccaggaattgttcgtccagcaacggaggaattcgatgattttgaggtgactgaatatcataagatacccctgcctcttcttcttggccgtgcgcttgagcttcttgaagaatggccagacttggattcgctcgacaacaggggccgattcggatcgcttttgacggatcttggagtacgcgtccgcaagaggcccgttgatgagctcactcttgcaccatcacttggttatgacaatgacagttggaagttggaggtgcagacgcatcctgaggtcgaagaccaaccgcctcgttgtcttcttccatcccctctatttgactag

SEQ ID NO: 19704 - DNA, 522 bp, A.fumigatus
aagaaaacgaaaacccttggtatctgttattactcaagctcaagaagatttgttccacagctagccgaaatgtctgaagaggcccagcccatcgcccttgaagcctttgccgaagccatcagggaactgcccctctccgctgtgtacgcaaaggtgtcggaaatcagaaattccatcgcacacctgcgccgctcaaatagcgagcttaaagcttttatagacgagacttgtgagagtgagagcgataagcgggagctggaagggtacatcgcagaaaatgagggcgtcatcgccactatgaatgaccgaattggactcctgaagaccgagattgagagtcgaggcgaacgatggattgaagaggaaattgaggcgaatattaaagtggatggagacgaagtatccacatcacagcctatcatcaatggtactgcgggggatgagcggcctagagcacacgaggacgcgacgaggaggccggaagataggcaaaccaacgaggaagaaggcgtctacctgtga

SEQ ID NO: 19705 - DNA, 438 bp, A.fumigatus
gaccagttcaatgaatggccgattcataccatcactctcgatcagattcagaagcaattaccagcgaaagacatcgacatggcatcggcagctgttcaactcccaacgacccatgggtctcaaactcagagagcgcctctccttccgacttcaaacacaccacaccatgtgcagactactctgaatttcctcaaagaaaacgaggatggctctcctccggccccgagctatgtcggtaagccagagacctacgaccggccttcggtgacgctgcctgtgaccatccacgacgtcagcggccacgagctggagtatacgctagacaagaacgggttccagttctactatcatgaaagcaaggaaaaggattttctcgacgatgagaagatcaaagccgagtactaccccgaggtagagcagttgctcaaagatgcgtga

SEQ ID NO: 19706 - DNA, 429 bp, A.fumigatus
gagcatcctccctcaggaacgatactgacagaacagccagcaccggcgcatccaaaatcttcatcttcgaccatacaatccgccgccaaccaagagacgaacgcagtgttgccgcccaactccgcggtcccgtccagcgcgtccacatcgaccagtcctacgccgccagcaaagaccgcgtctcgtaccacctccccgacgaagcccccgaactcctccagggccggtaccagatcatcaacgtctggcggccgatccggactattctcaaggacccgctggccgtcgcagacgcgcactccgtcccggacgatgacctcgtcccgaccaaactcatctacccgaaccgggtgggcgagacgtactcggtgcgaccgaatcccggcttcaagtggtacttccggtatgcgcagccgccggagctggtga

SEQ ID NO: 19707 - DNA, 597 bp, A.fumigatus
gccttaatgactgcgattaccctgggtcatgggtgcttcctgaaaaccggtatatggattcagaacgtgctgggatggatgaagattgtcatgtttgccgcgatgacactgacggggctctgggtgatattctttcgccgggaggaaccctgcatgtccatgtcgaatgaggcgggcaggacaggatatgacgtctttctgtgggacaatttatggaaaggatcgaactggagctggagcttactttccacatcccttttcaaagtgttttactcgtatgctgggctgaataatgtgaacaacgtcctcaacgaagtccaggatccgatccggacagtcaaatctgtctgtccttccgctctcgtcacggcttgcggtctttacctactggcaaacatctcctactttctcgtcgtccccatcgacgagatcaagaacagtggggagctcgtcggggctctcctgttcgaacgcgttttcggtccgcatgttggcaggactctgttccctctggcgattgccatttccgccgcaggaaatgtcatggtagtcacgtttgcctgggtaagttgctttgatgacttggagatacaatga

SEQ ID NO: 19708 - DNA, 1386 bp, A.fumigatus
cccgtcgtctctaaggaaacagtaaaatggtatcgctccaccttctacaacgcccttatcctgggtctctgcaacttccttgctcccggcatctggggcgccatgaactcactcggtgcagggggtgcagagaagccctacctcgttaacgccgccaacgcactaaccttctgtctgatggtggtgacctgcttcttcggcagtgccgttgtgcgactcgtcggcatcaaatggaccctcgtgatcgggacaatgggatacgccccgtacgcggcagggctgtatacgaacaaccgcttcggcacggaatggttcgtcctgctcggcgcggcgctgtgcggcctgtccgccggcctattctggatggcggagggggcgattgcgctgtcgtatccggagccacacaatcagggccgattcctgggtttctggctgagtttccgcgtggggggccagatcctgggcggcgcgatcaacctgggcatcaacgcgaaccggtcgacggccgggagcgtctcgtacacggtctacttggtgtttatcgccctacaggctctcggtccctttgcagcgctgctgctgaataagccgtcgcgggtgcagcggacggatggtctccccgtccgactgggcatctcgcatagtccgttgtacgagctcaaggcgatggccaagctgttcatccgccgcgacttcctcttgatcgtcccgctcgttgtgcaggctgtcttcactgaggcggttatgttcacgtttctgtcgctgtggttctccgtgcgggcccgtgccctcgggtcgttcctgtccggaatcatcgccttgatcgtgggtaatctgcttggggcgttcctggacagtcgaaagctgtcgctgcggtcgcgaagccgcggagcctttttcgtggtgctgggcctgcagggggcatggtgggtttgggcgaccgtgatcgtgaccgagtaccatcgcacgctgccgtcgtatgactgggccgatgctggctttgggcgcggatttgcgctgtatctgttttgggttgcggggtttcagctcaattacatgtatctgtatgtatcctgtctcggcctcggtctttgggtctgtgctcacaagttaggttctttgtcgtcggcaatctggcgtcgagtgaagaagaggttgtccggatggccagtctcctacgtgggacagagtcggcctcgcaggctgtatcggtatgccacttcccccgacggtacgatgttattgctgactcctgtagtatggcctggacagtgtcaagatcatgagctctgtgggcagcacctacctgaacttcggtttgtgggccatcgctctgctacctgcgtggcttgtgatcaaggagattggagtgtctctgggggataa

SEQ ID NO: 19709 - DNA, 606 bp, A.fumigatus
gctatccgaggaactggtgtgcatgagagggacaggatgaagtcccatacggctgctaaagtacacaagatggatgattctgaaaatcaatcgctcctacaccccacgtccggtctgtatgaaactctttcctacgagtcgatccacgacatccggacaaatgggcgtccggtgtcgagccgcagcccaatccccgagacagccccctacggccgcaaccttacatggacgagcgcctatatcctggtgatatcgcgcgtcatcggcagtggcatcttcgcaaccccagggtcaattgtgaaatctgtgggaagcgttgggttggcgctcctggtatggctcgtggggaccgtgctcgcagcatgcggcctggctgtatcgatggagtttggctgtatgctccctcggtctggtggcgacaaggtctatctcgagtatacgtatccgcgtcctcggtttctggcgtcaacgttgatcgccgggcagggcggttctattgggctttacggcgagcaactgcattatattctccaaggaccacatggtttcgctctgagctttggagccaacggagtggcagcaaaagggtatggcggtaggccttaa

SEQ ID NO: 19710 - DNA, 405 bp, A.fumigatus
gcccgggtgaatcaggagattgctcgacagggctttctccctttcgcctccgtgctctcatcatctcgcccgttcaactctcctctgggcggcctgattgtccattatatcccttcgctcttggtgattgtacttccgccccccggagacgtctacaatttcattctcgacgttgagggctatccaggccagatcttcgccttggctattgcggttggcttgctggtcttgagacgacgtcagcctgatattacacgaccgttcaaggcatggcttcctgcggtctggctccgaatcatcgtgtgcgttgctctactggtggcgccctttattcctcctccagacagaaagggtgatgtgggctttttctacgcaacatacgcagtcgtgggcgtcggcatgtaa

SEQ ID NO: 19711 - DNA, 639 bp, A.fumigatus
gaagatcaaagccgagtactaccccgaggtagagcagttgctcaaagatgcgtgagtgtgagagcatcctccctcaggaacgatactgacagaacagccagcaccggcgcatccaaaatcttcatcttcgaccatacaatccgccgccaaccaagagacgaacgcagtgttgccgcccaactccgcggtcccgtccagcgcgtccacatcgaccagtcctacgccgccagcaaagaccgcgtctcgtaccacctccccgacgaagcccccgaactcctccagggccggtaccagatcatcaacgtctggcggccgatccggactattctcaaggacccgctggccgtcgcagacgcgcactccgtcccggacgatgacctcgtcccgaccaaactcatctacccgaaccgggtgggcgagacgtactcggtgcgaccgaatcccggcttcaagtggtacttccggtatgcgcagccgccggagctggtgacgctgatcaaatgctttgattccaagacggacggacgggcgagaagagtgcctcattctgcgtttgtcgatccggcgacggagggtgaggcgccgcgggagagtatcgaggttcgggcgttggtgtttcacccagaagatcgggagtag

SEQ ID NO: 19712 - DNA, 210 bp, A.fumigatus
aacactttgaaaagggatgtggaaagtaagctccagctccagttcgatcctttccataaattgtcccacagaaagacgtcatatcctgtcctgcccgcctcattcgacatggacatgcagggttcctcccggcgaaagaatatcacccagagccccgtcagtgtcatcgcggcaaacatgacaatcttcatccatcccagcacgttctga

SEQ ID NO: 19713 - DNA, 900 bp, A.fumigatus
gggttcaggttctcccaaaaccagggtgtccgtttgtcccctcctccctggcccgtgttggccttaattgacttttgcccaaccggcgatcccgcggtcgcaaaactgatccactttcatggcttcagcgaccacatcaacaacacgtatgatctgtttccatcattagcccgccgtggaattttctgcacgggaatcgaccagcgtggttggggtcggtccgcccagacaaaggccgaccgtggaaacactggcccgaccgcggccatcctggccgacatggcggccttcatcgaggcacagttcgaggtgccgccagatgttccggtctttgtaatgggccattcgatgggcggaggtttggttgccacgctggcctcgacccccaagtatcaagagctcgtctcccgactcggggggatcttgctcgaggctccgttcatcgggctcgacccgaagcaaaaacccagcatcattaccgtgttcctgggtcggctggccggaaggctcctaccgcggttccaaatcgtccagcccataaaggtcgagacggttgtgcgcgatcccgtcgtgcagaagacgctgaaggaggatcccctcaaccacgccaccggcacgctggagatgttcgcccatatgctcggccgggcggctgatctgacctcgggcaaattggtgctcaatgatggcgtcaagtcggtgtacgtagctcatgggacggcagaccaggttaccagttacgatgccagcaagcactggttcgacgcgcagactggcaaggtcgccgaccggcagttcaagtcatacgagggatggagccatctgctccatgcggacctacccgagaaccgacaggtgtttgccgatgatgtcgcggagtggattctagcaagagtatag

SEQ ID NO: 19714 - DNA, 615 bp, A.fumigatus
aaccggagatcttcgaaatctccgccggcagtttgcagactgatcctcgatggtatatatctctccctcttccctctcgaaggctttggtagtagcaacaattcaatcacgttcaaaatggattggatcatcttgctgtatggtctatatgtggcggcctttggcgtgaccgttgtcgacgggatcggcgagacggcaggggatacgaccacgctcagtcaatggcgactgcagtcttcccttgcggtgtccaacgtctctgcatggtcgcttccagggaatgacgactcttcctggtatcaggttggggcgcgggcgaccgtcatggcgggtttacttgaaaacggcgtctacgacgacacgaccctgttctactccaacaacatggaaaccaaaatcggcgacgctgccaagttcgacgcgccttggctatacagacatgagctgttgatcaagaacaagatccgccaaggagagcattatctgcttcacacgcatggcatcacctccaaaggcggatatatacgtcaacggggtgctggttgcaccgagctcggttcagcagggatcgtacggcggtcacacgtacgacatcacaaaatacctgcgtgttga

SEQ ID NO: 19715 - DNA, 987 bp, A.fumigatus
ggccacctggttattgcgaacaactatcggaacaccgacctcttctgggctcttcgcggcggaggagggggcacctttggtgttgttgtggcagtgaccctgcgcacctttgacgaggttccagttgtctttggcaatctcaatgtcagcaccgtggccggggatcccaatttctggcaggtgatgacggatttccatgctgctttaccagccatcaatggccacgccgggggctactattggatgactcccaacatgccggtggacaagacattgaatgtctcgtcactgtcaatcatactcatggctgcaaatcaaagcagcacagcaatgatggatcgtctcttcgcgcctttcagatccaagctgaacgaaacctccggtgtctttacggaatacgagtcgctggccttccccgatatccatactcttctctccgatctcctccttcccggaagggaagaccaaactggccataacactatcctaggttcaaggctattctcccacgatttgcttgtttcaagcgacggcccaaagaaactggtctccgctctacagaagatcaagttcgaccccggacaaggtatcaccggccacatcgtcgccggaggacttgtcaccaaaaacggacggagtatcgacagcgctttgaatccggcctggagaaaagcagcgacccatatcgattttggtcgcgcctggccgccgtctgccaccctcgctcaacgggatgctatcattcgccgcctgactgacgttgagatgccaattctcaaggctgtcgagggaaagaagatggggtcctatatgaatgaggccaatgcctacgagccagatttccagactgagttctggggaagcaactatccgcgactgtatcgcatcaagcagaaatgggatcccagtggtcttttcattgctcggaagggagtggggagtgaggattgggatgatgctggactttgccgggttcataggaagtag

SEQ ID NO: 19716 - DNA, 186 bp, A.fumigatus
gatcggattagtgcacggtccgataatgacttggtccaaagagggatccccacctggatcgctcagattcctgcccgattctgtagtattctcaacatgatccggctgtttatcgctgctgtttacttgagaacgatttacatgcccactatgacgtgtgagcctctgtgcccgaggggagggtga

SEQ ID NO: 19717 - DNA, 210 bp, A.fumigatus
agcagcatggaaatccgtcatcacctgccagaaattgggatccccggccacggtgctgacattgagattgccaaagacaactggaacctcgtcaaaggtgcgcagggtcactgccacaacaacaccaaaggtgccccctcctccgccgcgaagagcccagaagaggtcggtgttccgatagttgttcgcaataaccaggtggccctatga

SEQ ID NO: 19718 - DNA, 441 bp, A.fumigatus
  unsure (180),(182),(186): Identity of nucleotide sequences at the above locations are unknown.
caggaaggcgaaacccaaaaagaacgaacagaaaggaaaaaaagagcgggaaacaaagaaaggatgaaggagcaaggaaaagaggaacaagaggaaagcaggagagaaccaaaggtcgagagggggaaaaaagaggaagggagcaagtcaaaagaccaggaggggggaggaaggaagagngnactnacatcccatccctcccatttgtcgcgacactcccatccggcaatgaccatcaatcccatttcatctgccagatcgtataactctggatgctcctgcttgccctccagtcggacagtgttcagccccatgtcgagcatatactggaagatattccgcacacgattggcatcgaaccggagaaacaaatcaggcgagtaccctcccccgagaaccaggaatggcgagccgttcacggtaaacgctgtgtcgttatga

SEQ ID NO: 19719 - DNA, 870 bp, A.fumigatus
ttatatgccattactgcaatttcccaaaacaagaacctggggaaatccccactaaaactggatgattggggtctagccgaatcgggaccccgcatttatatttatgactcttcctgctcagaacccagaatgaagctctcaattactcacccagaaattgattctcgtatactgcagatcgcaatggcatcgtcatatccgaccctcaaagaaaatatcaggaaggcctacgacaatgtagcagtcaagtacgcagaatggacgaaatccagctaccctacccgcgtccaatatctgcagaagctgctcgcatgccttccgcccgcaccagtggaaaagtcggttctcgagttaggctgcgggtcaggccagccgtgcactgcgatccttgcttcagaccctgccatgaaagtcacggcgaacgatatctctcctgtgcagctttcccttgccaaagagcatctcccctctgcgaatgtggctcttatcgagggagacatgatggagctgtcgtttggagatcacagtttcgacgccgtcattgcaatgtattcgatcctgcacttgccgaaggaggaacaagtgactctcctaaaaaggatcttcaagtggttgaagcctggagccttgtttctggggagttttgcggcaggactcaaggaagaggacttgtttgataagcactggttggatgggactgatggggagatgttttggagtggctggggagaggagaggacctgtgagatagtctcgttaattggatttgagctgattctcagggaggttgtcgctgagattgaggaagagaagggagaaggaagagaaattccctttctgtgggtcctggggaagaagccagataattaa

SEQ ID NO: 19720 - DNA, 444 bp, A.fumigatus
cccagccagtgggctatcttcgatttaggcgaccaccccgtccctaccttttacaaaggccgcatctgtatctctggtgacgctgcgcacgcgacatccccgcaccacggcgctggagccggattctgcattgaggataccgccgtgctggctacactgctggaggacgagcgggtgcagtctcacaaggacctcgaagctgcccttgctgcctacgataccagccgccgcgagcggtctcagtggctggtgcagagcagcaggtttattgggaacagctacgagtggttggctgagggagttggcgatgacttcaagaagattgaagaggcgatcaatcaccggaatggtatcattgctaacgcagatatccccaagatgtgtcaggaggcaagggagcaattgggcaagagattgtccaggtcgcggaggggtttcttatag

SEQ ID NO: 19721 - DNA, 273 bp, A.fumigatus
gtctcgaaggtgaaagcagacacgatcagagtccaccaaaaattggcccacgtaagtggtcttatggactatgtctctatcagcatacgactcagctattccgctgctatgtgttcttacaatcttggagtgctcgtatgcagacgctctgtggacacccgggaagaggccctcagcgctattcctgttagcaacgacggtctatctcctgtctatatgcaaacacctaccggtacaaagcacggagagcggctctggaccactggcgattga

SEQ ID NO: 19722 - DNA, 723 bp, A.fumigatus
gagacagaaatgacccctaagaagaacttccacgtttccgttattggcggtgggatcgccggcgtgactctggctatagcactctaccaccgtcaaatcccggtgacgatctacgaacaagcccctgcattcggcgaggtcggcgcaggcgtctccttcagtccgaatgcagtggaggccatgaaagtctgccaccagggcatctacgaggctttcgagaaagtctgcacgcggaacctatggccctcaaaacagaaagtctggttcgactatctggacggctacaacaaaggcacctcgacgactgcgaagaactcgagtcgacaggaaattgcattcaccatctccaacagcctcggccagaccggtgtccaccgcgcgcatttcctggacgagttgatcaagctagtcccccgtgatatctcgcggtttaacaagcgactagagcatatcaccgagcgtgaagatggcaagctcgtcatgaagttcgcggatggctcggaagaggtgacggatgtggtgatcggctgcgatgggatcaaatcccaggtgcgacgcatactcgtgggcgatggtcatccgtccgcgaacccgtcgtacacacacaagtatgcgtatcggggcctggtgcccatggaaaaggctatcgaggctgttggggaggaactggcgtctaactcgtgcatgcatgtccgtgtctccttctctatgcttacgggttag

SEQ ID NO: 19723 - DNA, 216 bp, A.fumigatus
atgggccccggcggccatgtgttgacgttcccggtcaaccaaggcaagactctcaacattgttgcctttcacagctcgcccgacaaatggaccgactacccccgactgacgaggcaggatactcgcgaggaagctctccgggattttgcaggttacggaccaaacgtcatcaaccttctgaaactaacggaggaaaagctcagtgtggtatgctga

SEQ ID NO: 19724 - DNA, 1224 bp, A.fumigatus
tcgacccaagccattttaggtgtaaactctggaatcaccaggttggtctgtgacagttgtccagacacctgggacaatgaggaggaaagagatcgttatcttggagtttcttcgtccgttctcgacgggtgggcccctcgtctgatccgtctccagactctgtggtacaatatgggaaagcatctgcatgtggacaatgcacgtagcatcgcacgctattgcccccggttcaagaacctgatcgtgtgggaatggatggaattcaccataagtagtgccaggttcgttgacgatgactctgacagtgagactgacgaggaagagacatcggccggagatttcctcatggctctgcggcgcaataccttggaacggttcgagatctctcgtgattcacacttcaagccttccatggtccagggcctggttgctcattcccaatccatgcgtgtgttgaaattgcccaagttccggtcggagctggtggtcgaactcctgaaatcgaatcccctgcagtccctcgaagctgtccactttttcctcggttatgagaaacgcgctgagatagctcagccgttcggacagtggctaggtgcttgccaaaacttgcgtcggatcgagacttggctttaccatgacgaactgttgatgctagcgaatgccctccaacatcccatcccttccttggaagtccttatcgtccagcagaattacgaggatgatcccaggatcatcgacgccttctaccgcggtgtctcgcgtcagcgaagcttgcaggagctcacacttaacaccgagatgacaagcaacaagagtgtattcatgtggtgcctgttccatttaaagaagcttcgcaaactaaatctgagaagagtgtcgtcccagctcacattgcccgacattggaactcttacctccaacttccccgacctcacctggctgggtctgtgcgtgactccggtcgtcgatgaaatctgggactacatcgtcgcgcccaagctccgctacctccatttggtcggcattggtgtcttgcatgctcaaccagtccttgattttattcatcggttgggcgagcagaacagaggattcacactgaagctcaagttcagcacctttgcggagctctacaccacggtctcggacgaggatcatcgcgccattgcgtacgcgctgttcagtcatctggatggtcgtctccttccttacagagaaatgctctag

SEQ ID NO: 19725 - DNA, 195 bp, A.fumigatus
tccataagaccacttacgtgggccaatttttggtggactctgatcgtgtctgctttcaccttcgagacttatcttccctacgccgcattgctttgtacgctcgacttgtgcgatctcgctcttttgattcatctcgataaagactttgccgagtatgtggcatatgctcggtcttgctcaagcgatcactgctaa

SEQ ID NO: 19726 - DNA, 186 bp, A.fumigatus
aatttggccgcggccgaaattggaggctattttgaacccctaaaacatgatttcattactaaatctagttattcttgcgctgcggacattgcaatcgcctatggcctagaatatggcagtcactgcagcgtgggggtgcccattgagggcgttgttctgtatctactacctgctctggagggatag

SEQ ID NO: 19727 - DNA, 246 bp, A.fumigatus
aaaccgtgccgtcttgattcttacattattctttgtgcaatgaaaacaatcaacatgaatggccaagttataataagcggttatattaagcgcatatgtcacagagaggatatgaccttgaaggagcaaacacagtatgtcatcaacatgccacatggaattgttaacacacaagagggtatcaaatcggcagataaccaaataaagatcgtaactcgttgcccgccagggtatttccctacatga

SEQ ID NO: 19728 - DNA, 699 bp, A.fumigatus
acagtcaaactgccctcgggctccctcgctgtcttctctccggtcagcctcacgccccaagttcgcgagatgatctcccagatgggccaggtgaaatacatcgccgcactagatcttgagcatcacatccacctcacgccgtggaaagaagcatacccagatgctgagatcatcgccccggaaagcctctgggagaaacgacagtcgaatccagagtataagaacacgcccttttcgcacatcttccgaaaagaggaccagcataagggatcccgcaagatctcggaggaatttgacgcggagtttgagtccgagtacgtgtacggacatccgtcgcgggagctagtcttcctacataagcggtcgcgcacactcatcgaggcggatctcatgtttaatctccctgctcgggaacagtactcgtggacgaaggagggcgcgacatcggggatctttgcgaagattatcaacaccgtgatgtcggctgagccaccagcgacgtggcagaagcggtttgcgtggtatatcttgtcgagtgcggatcggaaggcttttacggagtcaatgaggaggatcgatcagtgggatttcaatcggttgattccgtgccatggggatactattgagagcggtgctaaagggagttttcgtacggtcatggaatggttcttggagaataatcgacgaggttctacatga

SEQ ID NO: 19729 - DNA, 261 bp, A.fumigatus
caaggaaaacctacagttgatgttgtcatttctttcgcttggttcgccgctttcggcattctcgtcgatgccatccacaagttgaactgcggcagtatctggcactggcattttaacacctacagcaccaactcctgtggtcgttggaaagccgccgaagcattcagcttcctctccgccatcgtgtggctcgcctccgctcttgtggttcgtattataaagtctgcaactactgattatgattctgacagcacctgctag

SEQ ID NO: 19730 - DNA, 909 bp, A.fumigatus
accgcatgctctgacactggtgcagactgcaggaacgagtacatgcaagcggggaatatcggaattcgagagaccatcgaaaaggccaatgagatcttccaaaacgtcaagcaaacctcggatgcgaccatcgactctcgcctcctagtcactgctgcagatctggggtataagaaaacagcacaattcaccttgggagacgcgaccgcgggtatcgatgtcgacgagttcgtctccaagtgtatttcgtttatgcgccgcggcccaagtgatccagacgtcgcgatatctaacacgcaacgccgacggccccggccttccggccgcagtcaagcagacctggatgagagcgatgatgagaccggagacgcaatgaactgggattggctggggcgggctgcttgcctgcgccataactcccggccttcagtttctggttttcttctcgggccgttgtcggtacagaagcgtagtcgtctagtgacacaacgacgagcgagggaacgcattgacccatcggaggcggttcgaccacaggatctccaggagaaggacctcgacaggcaggagacgtcgaacctcacgaccatgtgcgccaatataaacaaattgcttgcggaaacggtaactcatggccagaatactgtggatagaatactctcacagatggaggaggagcctacggaggagcttatccaggaagtcatggccaaatatcatgttgccgatgacggaggagtgcctctttttcacttttgcataaacccaaggtcgtttgggcaaagtgtggagaatttgttctatgtcagcttcttggtacgagatgggactgtcggaatatcagccgacagtcggcagttacccactctacgtaagttccttgcgggtctactcctgtgtggcttgtga

SEQ ID NO: 19731 - DNA, 201 bp, A.fumigatus
cctgctcgacccctagaccccgcgaaaccgtatgccccgagtgaggcccagagaaagggagtccagaaacaccaggctatctttagtctcgattttgaaacgtggcgccagctcattgatgtatatgatatcaaggagtctataatcaagcaccgccccgaagagccgtcagagtcgacgggtggtggttggtacagttga

SEQ ID NO: 19732 - DNA, 255 bp, A.fumigatus
ttcaatcatgtccagattataataatgcagcatgggattacactggaagatatctacaactttaataaaactggctttacaatgggcttagtagctactgctaagatagttacaagagctgagatgcttagtcagcccttccttatccagccagggaaccgcgaatgggttacctctatagagtatattaactctactagctgggtgcttccaccatgcattatcttcaagggaaaggtccatattaagggctag

SEQ ID NO: 19733 - DNA, 327 bp, A.fumigatus
tttgatcaaatctgcactgagaatgatattattctaatctatatgcctatatattcattacatctcctccagcctctagatattggctgtttctctcctcttaagcatgcatatggccgcttgattgaggataagatgtggcttggtttcaaccatattgacaagtttgatttccttaaggcctatccacaagcttgtacggtaatcttttcagtagataatattaaaagtggcttttcagcaactggattaataccactgaatctagattgggtgctcagtcagcttaatatccagcttagaacacctacaccaccaggcagctga

SEQ ID NO: 19734 - DNA, 228 bp, A.fumigatus; identical to SEQ ID NO: 18586

SEQ ID NO: 19735 - DNA, 1383 bp, A.fumigatus
ctgtcttctagttctttgttattcgctggtccaaggagtctattccaaaatgctcagttgaacttctcagcatatataatcccccagcgtgcatcatctgtcccgctatctccgtcttccttttgcgatcttcccctcgtctctccccctcccgcaattcccttcagaatggcttccgatgatggtccacaggagattgcagctctcctgcttctccctcctcccccggctgtaaagtttgagcaattcaagggtgcttatgaaccgaccttgtctactgttttttccaagctctgcaagacgcttaatggcgttaatagcattgcaattctagacatcgctatttccataccaggtctgatttcacgaagctctcaacctcgggcgaaaattttcccaagccttcagcgttacttggcaaatatctacaggctgattggaatcgtcagcgcggagcacagcattgagctggatgcccctggtggcatcgatgctcgggtaatattcattgattttccaacgacctcggcagaggatcgtcaggctccacgacatggaccgatcctcgatttgcattcgctggcgaattctgcgcgtctatgggactggatctactatcctgaaaacaaagcaggtcaacaactcgcaacagcgtttgatagcatctactcaaaaaacaaagacccgaacgctggttctttgcatgcactctcaaatcagcccgactggccctctcccaggacattgatagtccccgaagttaaggctcaatcgccgcattattcagtggccgtagggggcacgtttgatcacttccatattggacataagcttctcctcactgccactgcgttggctctggagcccgtggaagagttcgatccgatccctgagcgatatctgactgtgggcgttaccggagatgcattgttgaagaacaaaaagtatgctgaatttctggagagctgggatgaccgatgtcaaagcacctcgtccttccttttggcgattatggatttcagccgtccaaacgaaagtgcgccgcgcattgagcgggtatcacagccggggcccaatggccattatgtgctaatgaaggtccgttgcggcttgacgctgaaattggtacaaatcacggacccgtttggaccgacgatcaccgatgaaagcatcgatgctctcgtggtgtctgcggaaactcgctcgggaggcgcagctgtcaatgatgagcgagcgaagaaggggtggaaaagcctcgatgtcttcgagatagatgtcctacattctggggaggttcccacaacggatggcgaaagctttgcgtcgaaaataagcagtacagatatcagacgacgtcgtatggaaatggccacggctcagtaa

SEQ ID NO: 19736 - DNA, 333 bp, A.fumigatus
ttcgttttctgctccccaggggcggggtgggcgtctgcagcactgagttggactaagggcgacgacggcattagcagaggtcctgactcggccggctgtttcttctgtcgcatcatcggatcaatcatcattcttatgagcacttccgtcttcgacttcccctcttggactccttttagtcctgccagctcatctggtcttcctctgaactcccagccactcgtcctctgtctctgccaaatgttctgcaggttcgcgctggataaccgcatgctctttcaatcatgtgactggtgtgtgccagttggtgaaccaatatccagtcgtccttga

SEQ ID NO: 19737 - DNA, 555 bp, A.fumigatus
catgcggccgccagtgaaatcgctaacggtggcgccggcaccagaacaggcaccgacgcctcgcagaacagccatctcacctccgactcctccgacaccgaacacggcaccacttccgccttctctaccactagcggcagcggcgctgccagcgcgccctcctcccgcggcatcccgctacgcatcaacaccaacctcttcggtcgcagccatcaccacactgaccgcgaccgcgaggactctatcagcaacgccagcaccgccacctccgtgtcgagctacgactactcagactccgaattcaccggtagcgagtcgcagtcgcagccccgtcgacgccgtgtccgccgcgacacggacgcccagctccggccccacagagagatctggacgggcgatctgagcagcgtcatcggcttgcagaaacggggcctccgcggcctcatggagggccgaaggctaatgagagaacgcaatgccaaacccggaagctcgggtggtttgacatctctgcctgcgaccgctgtagatcagagtgccgcttccggcgtgtag

SEQ ID NO: 19738 - DNA, 228 bp, A.fumigatus
catgtagtcatcgtcaaaagtgactggctggggagggccagagggcagatgagacacgagggagagcgctggaatggcctctatcataccaagccccgcgccgctgccgttactatgcctgctactgctaccgttcgtgtggtcggcggattgtgttcgtctgacataatcgatgtcgtgcaggtctatacgttccaattgctccatctcttcgcggaggcaggctaa

SEQ ID NO: 19739 - DNA, 402 bp, A.fumigatus
atgcggccgccagtgaaatcgctaacggtggcgccggcaccagaacaggcaccgacgcctcgcagaacagccatctcacctccgactcctccgacaccgaacacggcaccacttccgccttctctaccactagcggcagcggcgctgccagcgcgccctcctcccgcggcatcccgctacgcatcaacaccaacctcttcggtcgcagccatcaccacactgaccgcgaccgcgaggactctatcagcaacgccagcaccgccacctccgtgtcgagctacgactactcagactccgaattcaccggtagcgagtcgcagtcgcagccccgtcgacgccgtgtccgccgcgacacggacgcccagctccggccccacagagagatctggacgggcgatctga

SEQ ID NO: 19740 - DNA, 240 bp, A.fumigatus
tggcagcggtgctctcccaggagcactccaaccagggaacgtgaaccgtcctccagcagtgtctatgaacacagcgccttctgcgctcccaacgcttacccaactgtctacccagctgcaaccgcaggcatcgcaacagccacaacaacagcagccaccgacgacccctcgttcgggcatggtcaattcgcacggccattccagatccagtccttcgaacctcgagcaacccaaatatag

SEQ ID NO: 19741 - DNA, 633 bp, A.fumigatus
atacaaatcattgatacccatttgacacaaccagacccggatacaccagatctcgcgcctggagacatgaaaatagagtatgtcaaaaccgccgaagccacacattcttatcccgtcacgagaatcctctgggagccgccctcgtcccagaagcaatcgacggacctactcgcgacatccggcgaccacctacgactgtggtcactacccactacccagcccttgcatagctctaactcgatcacacgtcctgcaaatcagcgggatcccccggctgccaagctttctcccttagcattgctatcaaattcaaagtctcccgaacatactgcccctatcacctctctcgattggaatacgatctctcccagcttgatcatcacctcgagtatcgacacaacatgcacaatttgggacattcctacgctcacagccaaaacacagctgattgcgcacgacaaggaggtatatgacgttcgattctgtgcgaacagcgtcgacgtctttgttagctgcggcgctgatggtagtgtgcgcatgtttgatttgcgcagcctggagcacagcacgatcatctacgagccgactgagaagaatgacaaatgtatttcgcccacattctcctgcttttga

SEQ ID NO: 19742 - DNA, 573 bp, A.fumigatus
gtcttgctgacacgagcctctctagtaatgagccctggaaacggtagccccttcagctccgtccaattttatctggcccccgccacttttacgtatcgcaagtgtgtccttttaattgcatgcatggcccggacatatcttaacgcagttgcagcattaccacatgatgctcacctcctagcaacattttctcaagactccaacatcgtccgtgtactcgatgttcggcagcctggccaagccatcctcgagctcaaaggccactccgcacccatcaactgtgtcgattggtcccccaacagacggggtgtcctcgcctccggcgcagacgactgctttgtcctcctgtgggatctaatcaaccagcacaatgccgcgcctgtggcccccgtcgtgcacaatccaggcacaccatcaaccacctccgaacgagggcccgctgcggcctggcaatgcgattatgaagtctcgaaccttagctggtctccccaaggggggacgaccagctctggtcacccgagggattggttaggagtctgtggtggccgaggcgtgtggggagttgcattatga

SEQ ID NO: 19743 - DNA, 183 bp, A.fumigatus
gagtctgtggtggccgaggcgtgtggggagttgcattatgagatggagacggatgaaacgatttttttgcttctagacaacttctacttattcccctttggttcctttccccccccccccccttactttctcatcattcttgagtcttggtttgccttgctaatcattctgtccgacgggtga

SEQ ID NO: 19744 - DNA, 7401 bp, A.fumigatus
  unsure (7374): Identity of nucleotide sequences at the above locations are unknown.
aacttcgacaagagtcagaggatatccctaaagtctatgttacggttcgcaaagtggtttaagacaacctttcagagttcatcgaatacgtccctttctatccgagatttgctcgcttgggtagactttgtgaacaagtgtcaaacgaccgatctcaagttctcgatcgttcagggtgcagcaatggtgttcgtggatacccttggtgccaaccctgctgcaatgctcgctgtgtcgttgtacgatctcgagaagaaccgccagctttgcctggacaagcttcgtgaacttttcgacgttgatgcttgcggtatctacttccaaaagtcgacaattaagcttgaagatcgtgcactgcgagtaggaccttttgcgctacctatcagtggggatgcagcacctgatccgcaattcattatggatgcccctaccacgattgccaattcggtcagaatcgcgcgcggcctacaactgccaaagcctattcttcttgagggtagcccaggtgttggcaaaacaacccttgttactgcacttgctcgagctcttgggaagccactcacacgtatcaacctttcggaacagacagacctcactgaccttttcggatctgatgtgcctgtagagggtggcgatgttggtcagttcacttggcgcgatgcaccattcctgcaggccatgcagcgcggtgattgggtcctgctggacgaaatgaatttggcgtcccaatccgttcttgaagggttgaactcttgcctggaccaccgtcagacggtttatgtggctgaacttgaccagactttcagcagacacccagatttcgtccttttcgctgcacaaaatccccatcatcaaggtggtggaagaaaggggcttcccgcatcctttgtcaatcggtttaccgtggtatatgccgatagtttcacccagaccgacttgaaaaaaatctgcgcaaaactattccctggtagtccccctccgcaaaccgatggattggtggactttgtttcgctcttgaatgagaccatcaaccaggaacgcaggctaggggctgttggcggaccgtgggaggtcaatttgcgtgatatccaaagatggctccagcttgcggatcgcggcgatcttcaagtgccagcaaacaacttccttgatgttgtcatttcccagagattcaggagtgaagaagataggcaactggtttctcagctctatcaacgcgtctttacggatgcgccgactgttgccaaaagcctataccacaatctgactcaagagtatttccaagtcgggttcggagtgatgcgcagggatgctcttcttcagcatattcctgagccgcagatgaagatattcccgggtgacctgccgatcctggaatctctcatgctttgcatagagcagtcatggccgagcatcttggtgggaccatcgggctgtggcaagaccactctgatcagaaagcttgctgcgttgaacggtgccgacttagttgaattagccctgagcgctgacacagacacaatggatttgattggaggatttgagcagattgactacaagagggaggttttatctcttgtacgtgagctttcgctgtaccttcgtcgccatcttatttctgcatcctcagcgatcgagaagacagacgcattctcagcctttctcgagctatttgaacgcttacagagctcagacatctcgctggactttgtgtgttcatcccttcctgtcttgatgcagcttcatcctcaaaaggcccttgaagacttccttcaaagagcacagcacttgatggaactttctacgcagtccaataaaatgaaggttggtttcgaatggacggaaggtgtgctcacgcaagctgtccagcaggggcactgggttgttcttgataatgccaatttgtgcaacccttctgtcctcgataggctgaactccttgaccgaacccaatggagctttgatactcaatgagcaacgtaccgaagatggctctgcaaagattatcagaccccatcccagtttccgcttgttcctgacgatggatcctcgtcacggggagttgtctcgtgcaatgcgaaatcgatgtgtcgagatttgctttctggcttcggagattcctgaaccagccaacagatctatccctgcttacacttgccagtcgtctctgtaccgcctgaggcatatctgggacttcaatcagcttgaggatagaggcgagcttcctcgcctactctgtgaactgggaattgaccatctatctgtcgaggatctgaaaatcatccaacaatcatcagagatggcattggcgggcttgttggacttctccgcgggagaatctctgccctcgatgctcgaccgatacgtgcccgttgtcctcgaagattgctcgtgggagccttctactttttgcaaagcgcaagccgttaagttgagcggtgcttcctttgccgttcatggccaattccagcctctacatcctctcgtgaatgagccgctcgctttaatactggggcagcatgtgaccttatcgcggctcatggttttggctcacttacaagagtgcaagctcaatctccatcgcttaaggcaaagcttgttgcgcgctgatgaatcagccaaactcctcaaaccaagtcagatgagctctctggagagatccctagcatcaaggcggatagctagcctgatgaaggatgcaacgcaacctattggctctttcctcgcggactgcgggcaagcggtctatgatttcatacaaggcttagaccgccaagtgcttgatacccctgaggctgtgcatgctcttcgtgctgttgtcagcttctgtgctgaccttctccgaatctctggagatggtcaagtggatgaaggcgaattccaagtctatctacaaattggaaaggagttgtttgatttcttgctcgactcctggccaccgctgaagtccgtagctctggcattgtctcagtgtcttggtcgttttcaggagaactgggctttgaaaacagggcttagtatgcaaaagctatgggaatcctggcggccagcgactcccgccacccaggagcagctgaggtcgaagttggacctcgagaaagtcgcagccgaattcacggacattgctctcaagactcatctggatttagctcagctgagccgggtacgcgattcccttgtggacgctcagagaaccatcttgttggatggcgctgacgaaggacggctggttgaggcactcaagcagacggtgatggaattggcaaaggtggtgcaggcttctgattcggcgcagtcgccttacttcatgagtgaatttgaagccttgtgccaatatcatgatctgtcgtcgatacagcataccgaaagtaaatctgattcggttgtcagttctattctaccgttgttggctggtcgccaagcgcggcccctcgacgcatcgagtctccagagtcagattcctcgtgtcctccacaaactttctctgtttgcaggggctaaccaaccctccatgtctggcttcgcggtcaatggcattttctctctatcgctcttagagaagctaacgttcgtcggcaccacgactctggaccagatggatagcttggaagaggaaaagcgaactctttctaaagccataactctgacatcgcgcgagatctccaaggaccagttccaacttcttagacaagtcttatcggcgctcgctgctgaactcctcaatatgcacaaggatttcattgagccaaagtctcttgagaccgttctggctacgcttcgcgagatccaagaacaagggtggtgcaattcgtcggatctgcctgctgttgttttggatcagagcctgtctgaagatcattacttcggaccaatcgccaagtacgccattccacaattaatggcttcgttgatgacgggtccgaaggatacagagaagtacaacgaggaaactggattggcgttggttcagatggccagtctgctgctgcaattattcgtgcctgacaaaccgttcgatccctctctcggtctgactgtgcagaggcgaaggcacacgcagcgtgtcatagagctgacaacaaaatccgaagctctagccgtgtttgagcagaacttctctgggcgatcttccaacatgcgacaggaatttatacagcaggaactacgaagcttggggtccgcgccgcctccgtctcaagttactcggccgccggtctctgagatcagtatcttgcagggagaattctcaagcttactctcctctgttttggacagatgcatcgaactcgatgtaaccgcagtgaaaagaaatgatttggaagcagaaagaacgctgactttccttcgtgagaatatccggcagctcatccagcgtttgagtacgaattacagatcttacgacgatattaccgtgcttgtcgtccgattcctggaaattctggacctgggtctatcccttcagtctggccaaacacaacggtcaagtgactctaggatcttgcaggcagtcagcaagagaacacccttccttgggggcactgtctatcccgtttcagcactggaaagccaaaaggggccagcgaaccaagctcattttgttgaattgcgcttccatgaactatcttcccttagagtcgccattaatacggatccggatgttctccacagtgaagctgggcgccatgcgcttcaccggatactcgaacagtttcatatcttatggaaagccaagctccgtgaggatcaagaggaagaagcgcgcaaatccgagttgtaccgctatcgaggctcatgggaagatgaggaggaggtcgaccagaatgagttgaaccagcttttccctacttacgaaagtgacacagctgaagatgatgggaaagccacccggattgatccaaaggctatttcggtccggctcgctacactccacgccgagctcttccaatctgaagatgctaaaaaagccttgtcggattatgtcaggcagtctgccaagctgctggggtccatatggtctgcaggcgattcttcgaagtctcatattcgcccaagcgaacatctttctggagctcttttacttcttgaagatgccatgaacgctggaaatcgcagcccatctggcaaatataacttctacacagattcaaatttctctgaagcgagaagactcgtctctctggcacactccgtcaagtcccgtttccttcagatccagcaggcctggccggagcatgcagtacttcaggacgttattatttgctgcaaagaggtgcttcaattcaagcatacagagcctgttgcgaaattcctcacaaaggttgagaagctccatgctcttgttcatgaatggcagcttgtggcaagtaaagagtattcggcagcttctctttacaacgagctcaccaatctgatcatcagctggcgccggctggaactgtcaacctgggccaagctgctcgatcttgaaaaggagaagtgtgctcaagatgtgagctcatggtggtttgttgcatacgaagcagttattgcagcccccattcagctcgcagcatcgggggaagccgagttgagcgcccatatccaaagtgtcatctctacgctggaacaattcttcatgtcgacaactgtcggacaatacagcgaacgactcaggctcgtggccaatttccggtcactgcttgcgctgtacgttcgcgattacccggctctggagcaactcgtatttgcattgggcaattttcttgaacacttcagaccgttcgagcctgcggtgcacaagtcaatggaagaccgcagagccgccattgagaaggacatcaagcaacaaattcagctagctagctggaaggatacaaatatcattgcgctcaaggaaagtgcccggcgatcacacttcaggctgttcaaactcgttcgaaagtatcgtgaagttctagcgcagcctgtgcagcccataatacagcagggaatgacaaatgaaccaattgaaccgaacatggtcaccgatgaagtcgttttggcttcggcaagcttccctgatgctctcgctttgtgccaggaagagcctacgatatggccaagcagaccgcccagatttcgaaatgcggatagcacagccgggaacatgaccgatctgtattcttcaatgccaaatgagtttgacatctcagaggatctcgatagcttcgtcaaattcttcattgagagcatcactgaatttaaatcgcagactcccaaagtgctgactgaggacaacaaagatgatgtccagcatctcaaggtccagaagcgtcgcttctatgcagacacactgaaacggctcctggaaatgggtatcaaacgcaatgcaagcactaacttgattgagagccaatcttccattgctcaggttctcgctactaccccaagcttaaaagtcgggaactcggcatctcatctcatcaagggctctgatctctacttccaccggtttttggatctcctacctcgcgtacgtcaatcctctcgcgagtactcagaagatctcagtaacgtcgagatctcaaggagcgttggcactgtcgagcacttgatgtttttgttaagaaagcagcgtggggtcatttctccagcattgtctcatttggaaatgatgaagtccacgattatgaagatgtctaatctctggacttctggatccgcatccctctgcaagtcgcattcggatgtctcaaaggacagacaagacctcaggagagctgtggcatggcttattcccatacttggcctcgcagcggaaatcgtgcaactacatgccaaattctctgaagtcgatgcctcaaaggtttccgatggcctgcacgcttggagctcaacgtttagtcgattgaagtcatcactagacaatattccagagttaccttctggcctgacttctcagcgtcataataatatcttggaagaggtgtcgtcttctcttgcgagcttggtcgctgatgtctcaaaatggaccgcagaacgtcccgacttgtctttcgcattagcacaaatcattccatgggcagaggcgaagggaaacgcgactgttagggctgatagccaggacagtctcgctatccaggaatttgacgcaaggctccttgcagcaatggataagatcttggtcagtcttcagaaactcaaagacgtgcctgcttcccttacctccacgggctcgctgtcgcgaagtgacgagttcttcacaagagcaatgaaggctgtccgcttgtctgatgttactttctccctcgaatctgtccttggcaccttgcagcatttgcaagctgactcccacaacacttatgtgattgcctcggcattagtggcgagtttcttgcgcctaacgtaccgtattgcnaacgccgtagaagtcatgtcccccccc

SEQ ID NO: 19745 - DNA, 207 bp, A.fumigatus
gcttttggcaacagtcggcgcatccgtaaagacgcgttgatagagctgagaaaccagttgcctatcttcttcactcctgaatctctgggaaatgacaacatcaaggaagttgtttgctggcacttgaagatcgccgcgatccgcaagctggagccatctttggatatcacgcaaattgacctcccacggtccgccaacagcccctag

SEQ ID NO: 19746 - DNA, 2235 bp, A.fumigatus
tactctgcattgcccacagaccagagtcaggccaacagaattgggggagggaaccactttcgcaggcgaatggcccctaatcctgcagttccggccactcttcctcttcaccatgtcacgtcacagatccagcagctgttggatccttcattctccaacgcgcgatccggtggtgtacttctgccggactacatcagaggcttaccatcccgattgcagagagaagatattgaatacctgtccatgaagggagcactaacagtacccgacgttggattgaggaacgaactgctcaaggcttacatccactatgtgcacacttacatgcctttattggatttagaggagttcttgcagactattgtgcaaaatgacggtattcatcggatgagccttctgctgttccaggctgtgatgtttgctggcacggctttcatcgacctcaagcaccttcatgctgccggttacccctcgagaaaggcggcccgcaaggtcttctttcaacgagcccgacttctatatgacttcgattatgaagtcgatcgaatttctctcgtccaatccctgctgctgatgacttactggtatgagacccctgacgaccagaaagacacctggcattggatgggcgtcagcttgtccttggctcatacaattggcctgcatcgggaccccggcaattctcggatggacgccaggcgccagcgaatgtggaaacgtatctggtggagcacatatactcgcgatcgcttgattgccctaggcatgaggcgccctatgcgtgtcaaagacgacgattgtgatgttccaatgttgacgctcgacgacttcgaatttcatccattttcgccggaaatcgtgaggatggtggggaactctgaaattctacaaaatgttgaacaccagaaaaagctggcccttatgttcatcgagaaggcgaaactttgcctgtgcgtcagtcatgttctatcggctcagtattccgtcctcagccacaagttcggcgggacgatggaaacgacaatgatgttggttcccaagaaatcagcggcagagacgtttgaggttcgacgttgcgatcaggaattggaagattggctggccaatcttcctgcggaaattcagtacactccggcggcatctgcaaagttaacagaagcccaggaagtcttgcactctcatcgcgcgctcctcaaaatggtttatctgactacatcaagcgcgctgcaccgtcctcaggtccttcctgcgaacccctttccgtcaatggacgcagagctgcaggagatctcgaggaataaggtccgattcgccgcggttgaaatcacgaatattgcgcaggacttgcacagcttggatttgacgagatatttccctaccaccggcgtcactgtgcttctgcccgccgtcatcatccacctactcgatatcaaatcgagcgaccccagcgtgcggatgaccagcctccagcgattctaccagtgcatgcgcattctacaacgtttgcgagagatttatgcatcagctgacttcgcgacatccttcttggaagctgcaatccgaaaggctggtattcagctcacagtggctccccaggacgtgcaagctcgtcccggcagctctttcgatgctggcgcacgtgtcgatacactgacacctcctccggattctcttgcccagaagatccctgatctgacttacccgaagccggcggtggttggaactgctcgccaacccgtcgaagaaggcgacacattgttcgcctctacccctcccccctcggatggcagtgaaaacggcagtaccgccaacattaacccgaactatcaccgagatgccttcagcattccaaatttggactcggaactgagtattagcgagttgatggacttggctaatgacgccgaggtgactcagaatgattttgacgcgctgatcaattttgatgatgctggtgccgacttcttcacggccgacgatcatttgaatctcaacggatctggccccaacagcaagggatttggattctccatggatccgatcaatggcatgtctgacttaatgggcttagacgccggaaacaaacctgacatcgccagcctgggtgacaggcagcttcacagcgaccacatggccacgacaacgggacacagtaacaccgggacagcggcctccgagtctaacggtcttacagctaatgtcgacgccgaccttggcatctgcctaagtggttga

SEQ ID NO: 19747 - DNA, 204 bp, A.fumigatus
gatagcctatgtcgtctcggtgaaaaacgatacgagcaccaatggctatcctctgacatctcgaccgagagactacgagtcaaatacctgtgcgtcacagatgtaattgacttgactaggggggtcaatgcacaagagtggaggcagtattccggtctatgtacacagtacagctacacagagcaagtgatcaggaaagtttga

SEQ ID NO: 19748 - DNA, 351 bp, A.fumigatus
tatcctatcatctcgggtcgcacacttcatcggttcgcctgttttttacttttcgctatgactgatctcgctgtatcctcgacgcctgcatccgcaaataccatggagtctgaatcccagagtaaacgtaaagcctcggcggctggcctctctgctaattctcgcccggttaagcggcgggcttcgaaagcatgctgttgctgccgggcaaggaaagtccgctgtgatgtggtggagaacggttcgccatgtacgaattgccgcttggatcaggtagaatgtgttgtcacagagagcaaaaggagaaagttcgttctacatatgtcgacacgctgcagtatttgtggctaa

SEQ ID NO: 19749 - DNA, 192 bp, A.fumigatus
gaggtctttcgggccccatttcagtcaagccgaaagagacgttccgaaacccacagtcccaagtttgagaatcctaccgcgacctcttggattgctttcaaactagccaacaaagcattccaatcctgcacagacactgctatctggaggtcgctgaaacacgatgagaattatgaagcagtttactactaa

SEQ ID NO: 19750 - DNA, 654 bp, A.fumigatus
ctttccattctcttatcgaccaacatggcacatttagaagaacgcccgagcagcctagatggctctgcctggacctggatcttcgaccactgcctacgttatcctgaaacctacgagattccgcttcgtactatgtacgcgctgaactgcaacccgaccagacaacctagctcgggaacccgcacccccgaaactgctttttcaaatcgctcttccagctcgtcgaaaacctccgtctcctctcaggacttcatcttggatcccgctgcggacttcagggcacagttgactcatcatattgctcgaatgccatcccagccctgctccctaccgccgagtttcgtgacctcgttccttcgtcgctgtttcgctcctcaattggacgaggttgatttccctcaagccttgaccgccctggactatctaaaggacctagaaaatcgtcggagaagagaggttgcggccgcattgcagcgactgaatatccatcccgacgacctcaaggaaaagactgagcttgcaaagaaatatccgggggttctcacatggattgaatcgatcaatgtccaaggtcgtaaagttgaagctctctacactcaaatctacctcggacttcgccgctgggtaagctggttcccctctttccctggatga

SEQ ID NO: 19751 - DNA, 201 bp, A.fumigatus
aagttccattgcgcaacggcgcggtttacagggcggctgttgtgggccacgctcttgacatctctcagatctgtccgtggtattgcgtcggaatacttcaaacccgggttcgaaatgatctctatcgcctctggtgcgcgcgacctccctaagatgcctcgagccattttgctggccggctgcaagaagaaggaagtatag

SEQ ID NO: 19752 - DNA, 5112 bp, A.fumigatus
cttatttgtgcaccaactggtgctggtaaaaccgacgctgccatgctgacgatccttaatacgattggcaagaatacagtgccgaaccgtattgaacagccggatgctatagagtttgcggtacaggtggacgacttcaagattgtgtatgtggcgccgatgaaggccttggccgcggaggtcacagagaaactcgggaaacgacttgcatggcctggtattcgggtcagagaattgactggggatatgcagcctacgaagcgcgagattgttgaaacgcagattatcgtcacgactcccgaaaagtgggatgtcgtcacccggaagagcacaggagacacggagctggtgcagaaagtgcgcctcttgatcatcgatgaagtccacatgcttcacgatgaacgtggtgccgtcatagaatctctagttgcgcggacgcaacgacaggttgaaagtacccagtcgctcattcgtatagttggcctttccgctactctgccgaactatgtcgacgtagccgagttcctgaaagtgaacaagatggctggactgttcttttttgatgcgtcatttagacctgttcctctcgaacagcatttcattggtgtgaaaggaaagccaggctcgaaacaatcccgcgaaaatctggacatcgtcgcatttgagaaagtgcgtgagatgctcgaacgagggcatcaagtcatggtctttgtgcattcaaggaaagacactgttctaaccgctcgaatgctgcggcaaatggctgtcgagaatggctgcgaagaccttttcagctgtcatgaacacgagaactactccaatgccctcagagatatgaaacatgcgcgggcgcgtgagctgagggacttgttcgcgagcggatttggtacacaccatgctggaatgactcgaagtgaccgcaacctgatggagcgtatgttctccgagggcttgatcaaggtgctttgctgtactgcgactcttgcctggggtgttaaccttcccgccgctgcagtcgttatcaaaggcacgcagctgtataatccacaggaaggtaaattcgttgacttgggtatccttgacgtcctgcagatctttggacgtgctggacgtcctcaattccaggatacgggtatcggcttcatctgtaccacacacgataaactgcatcactacctgtctgcagtgaccgcgcagcaaccgattgaatctcggttctccagtcgacttgtggacaacctgaacgccgagatctctcttggaacggtcacctctgtttccgagggtgtgcaatggcttggttactcatatctctttgtccgcatgctgcgcgagccgcgcaattacggcatcgattttgctgagatacgcgatgaccccatgctggtgcagcggcggcgccaactgatcattcaggctgcgcgcgtcttgcaaaagagtcagatgattatatttaatgagaaaactgaggaactgcgggcaaaggacgttggtcgcattgcgagtcagtattacgttttgcaaacaagtattgagatcttcaacgagatgatgcgccctcgggctggtgaggcagatgtcctgcggatgatcagtatgagtggcgaatttgataatatccaagctcgggagaacgagtcgaaagagctagaccggcttcgtgacgaagctatacagaccgaagtcgaaggtggcaacgattctcctcacgcgaagactaatattcttctgcagtcgtacatctcccgcgcaaagctcgaggactttgcactggtttccgatatgggctacgtagcgcagaatgccgctcgtatctgccgtgctctctttatgattgcgttaaaccgccggtggggctatcaatgccaggtgcttctgtcactctgcaagtctattgagaagcagatctggcctttcgatcacccattccatcagttcgatctcccccaaccaatcctcaagaatctagatgagaagttgcctacttcatcactggagtcgatgagggaaatggacgttgccgaaatcggccagcttgtccataaccagcgcatgggaaagacgctgtccaaattactggacaatttccctactctcagcgtggaggctgagattgctcctctaaatcgggacgtcttgcgaattcggctcagcctgtatcccgagttctcttggaacgacaggcatcatggagcctcggaagcatactggatttgggtcgagaactcggaaacttcggaaatctatcaccatgaatacttcattctcagtcggaaaaagttgcatgatgaacatgagctcaacttcactattccgctctcagaccctttaccgagccagatctacgttcgtgcaatttctgatcgatggttgggtgccgagacagtgacacccgtctcattccagcatctgatccgtccagacacggaaagcgtgtatacggatctccttaatttgcagcccctacctatctctgcccttaacaaccccatactggaagaactttacggtcaacggttccagttcttcaacccaatgcagacacagattttccatctgctgtaccacacttcagccaatgttctcctcggttccccaactggaagtggaaagacggtggcctgtgagctggcaatgtggtgggctttcagggagaaaccaggctcaaaggtagtgtatattgcgccgatgaaagctctcgtccgcgagcgagtcatggattggggcaagcgcctcgccgcaccgatgggtctgaagttggtggaattgacaggtgacaacactcctgatacgagaaccatccgggacgcggatatcatcatcacaactccggagaaatgggacggtatttctcgtagttggcagaccagagattatgtgcggaaagtgagtttggtcatcatcgacgaaattcacctgctaggcggtgatcgaggccccattcttgagatcatcgtgtcccgtatgaactatattgcatcgcaatccaagggttctgttcggctgatgggcatgtctacggcttgcgcgaacgccactgacctggccaactggttgggcgtcaaagagggactcttcaattttcgacactctgtgcgtccagtacccttggagatctacattgatggattccctgagcagcgtggcttctgcccgcttatgcagtctatgaatcgtcctacgttccttgcaatcaagaaccactctccggagaagcctgtgatcgtctttgttgcatcgcgaagacaaactcgactgactgcgaaagacctgataaactactgcggcatggaagacaatccgcgtcgctttgtgcgtatgtcggaggaggatctgcaactcaatctcgcgagagtcaaagacgaagcgctccgcgaggcactcagctttggtatcggcttgcaccatgccggtttagtggagtctgaccgacaactggcggaggaacttttcgcgaacaacaaaattcagatcctcgtggccacaagtaccctcgcatggggtgtcaaccttccggcacatcttgtggtggtcaaaggcacgcagtacttcgacgcgaaaattgaaggttacaaagacatggacttgaccgacgttctgcaaatgctgggccgtgctggacgtccgcagttcgattcgtcgggtattgcacgcatctttacccaagagtcaaagaaagctttctataagcatttcctgcacactggctttccagtggagtctactctgcacaaggttctggacaatcatttgggcgccgaaatttccgccggcacaatcgcaacaaagcaagacgctctggactacttgacatggacatttttctttcgcagactgcacaagaatccttcgtactatgggctcgagatttcagcggaggaacataatacgatggctgctcaggcaatagctcaagacttcatgattgatttagtcgacaagtcccttggcgagctggcggagtcatcttgtgttgtgtttgactcggcaactggggaggtcgactcaacaccgtttggcaagatcatgagttactattatctctcgcacaagactgtccggtatctgaggtcgcatgcgatacctaaccccacgttccatgatgtgctgagctggttgtgttccgccacagaattcgacgagctgcctgtcagacacaacgaagatctcattaacgccgagttagctcgcaatctgcccttgtcggttgagtccatgggagacctgccactgtgggatccacacgtcaaggcattcctacttctgcaggcgtatatgtcgcgaatcgatcttcccatttctgattacgtcggtgaccagacgtccgtcctggaccaaggcatccgtattatccaagcctctatcgacatcatggctgaattggggtatgtccgcgcctgcgagacgctcgtgagcctgctccaaagcatcaagtccgcaaggtggcccgaggacaacgcgctgtcaattcttcctggcatcgagcccacaagcaagctgcagggtctccccggctccctcgttgccctctcgtcccttcccacagcctccgtctccggtcttgctcgcaaactccaacttcccgcagaattcaccaaagccgcctcgtatctaccgcaagtctctgtatccgtcgcgaacgtctcctcaaccggtattacggtatttttgagccgtcgcaacccgcccacaaacgccgaacacagagtgtacgcgcctcgcttccccaagccccaaacagagggatacttcctaattgtttgcagcgcctccgcagacggcaaggacggcgagctgcttgctctgaagcgcgtgtcctggtcagcgaataacaagaaccagagttcgaattccggctccggctctggctccagccagaatccctccggcaggagtaattatcggaatggcgcgctcaccgtgcggtcgtctgtcaagttcccgcaggatttcctggcgcagtataccactgccaccgggaagggtgtgaatgtcaaggttatcagcgatacctacccggggatgcagtgggtggtatcgaacgtggaggtagagttgaagcctgagacgcagagtgtacctgagtcgtcgaattatcctgagaaggcataa

SEQ ID NO: 19753 - DNA, 366 bp, A.fumigatus
caacatggttgtacagcgcgccgcctgtggaaagactactttcccgaagtcagcgggattgtcttcctcgtcgacgcaaaggaccacgagcgcttccccgagtccaaggccgagctcgacgccctcctcgccatggaagaactggccaaggtgcccttcctcatcctcgggaacaagatcgatcaccccgatgctgtcagcgaggacgagctgagacatcagcttggtctgtaccagaccacgggtaagggcaaggtgccgctggaggggatccgtcccatcgaggtgtttatgtgcagtgttgtcatgagacagggtgagttttcttttttgactttttgtgccatgtcttctacgactttttaa

SEQ ID NO: 19754 - DNA, 2301 bp, A.fumigatus
caagttggaatattcactgagctcgtcattacctctccgaccttcctattctactacctaccgccgccacataatctctcgagtacgatattgaacatacgaccatatcatcaactacctcctctcgacctcaatcccgtttctaaaccaagtaacctactcgaagcgatggcatacttgcgcggtggtgatcgacccttctcaatacacaagcttttgaagatgctactctcgccccatcagtccaacaagcctgttcagcaagagtcagatatgctagaggacgtcgatgagcctcctgatcaccgtttcttgaataactctgcaatgaacgtcgacgacggtgtcgtctacgtaaagtcccccaccaccatgagtcgcggcaaggagtcacttctcacacgtgccctcaagcacagtcccgaactggctcctgccgaccaccaggaccatccattctaccgctcataccactccggcaccgtcagcggaatctcgaccgcggagctgaccagcgacggtggactcacgagcccgtcgttgtccaacactccaagccccccgctatctcctcaactcaacggtagatctgggttggatgcaacggaatcaactgtggaagccaatcttggacgtaagagatgcatcagctttgcgtgcgggcgtaaagccgaggaaatgaaacccgaacgacctacagcaccggaatcgactgccaattcgactccagcggagccgcccaagcggaagacggtgcttacttttgtttgcccggcaagggattcatgctcgacaagagaacggcctcctgttcgcacagctgctcttaggtcgcgaccccgtggatcccctgcccctgtcgcccgcaaggcgtctccagataaagatgtgtcttgcccggttaaggcacagcaagatgagaagccatcagcatcaagcagtcaaagaggtgtccctgtgaagggtctcggcaagtttgaagagtctgaggcgacccggttccacgaatttgccagctctgtcagcgaggatgatgagtgggtcaacaaggttggtgaattcactgagaagatcactatgaccgactgcatgagaaaagaaatcgccattagaaagctcggagaagaagcggaagaagaggcacttgaggaggaagacgaagaggaagacgaggacgacgcggactcgactatccatgacttctcggatgatggcaatgaatccgacaatgaggctggcttcgccgattcagacgatgagagtgatgacggctccgagtatgaattctgggctcccactgcaatcactactgccaccagccctcaggctttagactcggctcgccaggcactggaacgtcgcggctcgaacacatcattggattctgtgactgacgatccccacaagaaatggcccccagcactcgcgtggaaggcaaatggtcgatcccctttcaaacctcccccggtcaagatgcgtcctggaactcccaacctacccgacagcacagattttgtttgtggcacattggatgaggatcgtcctttggaagttgcatataagtcctgcattgagcaacgacgcctctctaaacaagttatcatccctcaggacattgatcccagcttccctacgtcggacattgatgatcaagatgacttggaagaggatgagatggagctgtcgtttagggctgatgaattaactcggggaagaactggtggggattccgtgcgtcaacactcgcctcgtttgtcacccaggcggatgatgtcccctcccccgcgccgttatagtcgcatgtctccgagacgtcttcggtcccctccaccgccggtcaagatgggacctacgcaaagtggcgatggtgtctcggatgatcagcttccctctcgtcgcccccagggggtcaacatcagtgaattggttcaacgcccccttatgactcgcaccaagtccctgcctcgaacccccaaccctttcttcacgtccctcgacaaggctcatcggtggtcatccatcgccgacgtacaagaatcgccagagcgtggatcatcctgcactcgggaggtgcacactcgaggcccgatcgacatcgttgagggtctggagaagaagcgtcagaaacgaagggagaagttctggcgtcaacattgccgcaaagctgccaaagagcagatggagcggcgaccaatccctggaaagggagctgaacggatgaaggagcttggcctcgaagttgctgagaggttcagagcttacggtgtcggccatgacgcccagctcgtcctatctgtttag

SEQ ID NO: 19755 - DNA, 189 bp, A.fumigatus
atccgtctcggtcgtcctgtactctttgcacaccctcatcgttgcttgggaggacatccatcatgcatttacagggagatcacttttttcaaattcgtgtttgcttcacctatacatatttaccctttccttatcagtttaaactatattttcacattccctcactgttgtggccggggccctgtttga

SEQ ID NO: 19756 - DNA, 366 bp, A.fumigatus
gtaagttcttggtccttgttttgccctgcaaaactccgggtcctcgacatctcgaagttccatccttgcgttcgcttttgctatcatacagagccatctagagggacgaaactggcatcttacttgcattactggtttgacccccttccggtttctgctgctaatgaatattctctctctgtagtctacgatatcctggcttccctaggtctcctcaacaagcatgccaagctcctgtttcttggcctagacaatgccggcaaaaccacccttttgcacatgttgaaggtgagtatcctcgaagaacctgggagcgtcggatacggagtttcgtatatgctgactttgcttgcgcttgattgttag

SEQ ID NO: 19757 - DNA, 507 bp, A.fumigatus
atctgtggtgacattcacggccaatactacgatctcttgcgtcttttcgaatacggtggcttcccgcctgaagccaattacctcttcctcggagactacgtcgaccgtggcaagcagtcgcttgagaccatctgcctcctccttgcgtacaagatcaaatatcctgaaaacttctttgttctccgtggtaaccacgaatgtgcctccatcaaccgtatctatggcttctatgacgagtgcaagcggcggtacaacattaagctctggaagacattcactgattgcttcaactgcttgcccatcgctgcaatcatcgacgagaagatcttcaccatgcatggcggtctcagccccgatctgaactctatggaacagatccgtcgcgtcatgcgtcctaccgatgtgagtttctctcccatgcatagcttatatcacggattgggtcctttttctcgtggtgggccactgtggatttccttttgtctgtactattcaacagtcgaatag

SEQ ID NO: 19758 - DNA, 312 bp, A.fumigatus
attggtgtaccgagcgctccggaaactaccatctcccctcgtccttcttttttacccttcgttgttcgacgcctttgtattaattcctttcttttccttcgtttttgtctcgagaatcagcacgtcatggctgatcaagaagtggatctggacaacatcattgatagattgctggaggtgaggggcagccggcctggaaagcaggtgcaactgttggaagcggagattcggtatctttgcaccaaggctagggagattttcatctctcaaccgatactgttggaactggaagcgccaatcaaggtaagatga

SEQ ID NO: 19759 - DNA, 444 bp, A.fumigatus
taccggttcctcgggctattgccgcggcttggcgattatgctagcctacaccggatcgaaactgatgaatttgccttcattagatctgtggtgacattcacggccaatactacgatctcttgcgtcttttcgaatacggtggcttcccgcctgaagccaattacctcttcctcggagactacgtcgaccgtggcaagcagtcgcttgagaccatctgcctcctccttgcgtacaagatcaaatatcctgaaaacttctttgttctccgtggtaaccacgaatgtgcctccatcaaccgtatctatggcttctatgacgagtgcaagcggcggtacaacattaagctctggaagacattcactgattgcttcaactgcttgcccatcgctgcaatcatcgacgagaagatcttcaccatgcatggcggtctcagccccgatctga

SEQ ID NO: 19760 - DNA, 228 bp, A.fumigatus
cttcgggaaagtagtctttccacaggcggcgcgctgtacaaccatgttgtcagcttactagctcccacctcccagttcgggctgcacggtggccgccaaggtctactcaccctgctggtgaccgcccagatcgaacgttgtaaaccggttgttgccgatggcaagttcctccgatgctggaatcatcagtatcagtcccctgctcgaatcttccgtcgccagtcatga

SEQ ID NO: 19761 - DNA, 318 bp, A.fumigatus
atccctgactgtggtcttctctgcgatcttctctggtccgatcccgacaaagatatcaccggctggagcgagaacgaccgaggtgtatcgtttacatttggtcccgatgttgtatctcgtttcctccagaagcatgatatggatctgatatgccgtgcacaccaagtcgttgaggacggttacgaatttttctcgaaaagacagcttgtaacgctattcagtgctcccaactactgtggagagttcgacaacgccggtgcaatgatgagtgtcgatgaaagccttctttgttcattccaggtatgttgtgtgctttag

SEQ ID NO: 19762 - DNA, 423 bp, A.fumigatus
ccgctctctctcgttgcatatgtgtgttgcggaaaactaacctgcacagtcgccgcatacatcatcctcggcctcgccacgatcggcagcgaaatcgagaacccctttggccaggatgtcaacgatctccccttggacacatactgcagacagatcgccgtcgagctcgacatcatcaccgccatgccaccccccagtgtggacgacttcacctcccgcgacgaaaacctggttctcttccctcttagctcctccggatacccggagtggaaggaccgcagcgttgaggatatccgcgccgcgctgcgggcaaaggtcatcgccaaccactcatcttcaggggcttcggactcgtccaccatcctcggggacggaagcctgcggtcccagactgatacgagcatggccaaggcatccgtctga

SEQ ID NO: 19763 - DNA, 411 bp, A.fumigatus
cctgcacagtcgccgcatacatcatcctcggcctcgccacgatcggcagcgaaatcgagaacccctttggccaggatgtcaacgatctccccttggacacatactgcagacagatcgccgtcgagctcgacatcatcaccgccatgccaccccccagtgtggacgacttcacctcccgcgacgaaaacctggttctcttccctcttagctcctccggatacccggagtggaaggaccgcagcgttgaggatatccgcgccgcgctgcgggcaaaggtcatcgccaaccactcatcttcaggggcttcggactcgtccaccatcctcggggacggaagcctgcggtcccagactgatacgagcatggccaaggcatccgtctgagacgtggctacagattcctcagaagtaa

SEQ ID NO: 19764 - DNA, 183 bp, A.fumigatus
ttagcctctttccagacaaacactctgagtgcaaccaaagaccttattcagcctcactatagtcagtatacaataaacgcccgcctagtgagcgattttaagctcagatccaccatgtccactcgcatcctgcctctgccgcggacagggggcccattcagcagccagcggcagtcaatataa

SEQ ID NO: 19765 - DNA, 201 bp, A.fumigatus
gggcgacttgtaaccatggacatatccactcgaatgggcctttttcaaaaagctttccatcagagcagtggtctttcccctggaccaggattctacaccggtctagagttctattcaaatgaggaacgagcggaccctcctaccctcgaggcaagtaaattcctgcttaagcctgctcaaggacgaccttcgactcagtga

SEQ ID NO: 19766 - DNA, 225 bp, A.fumigatus
gagcaaagggtcctttggaggattgcacgggcgagtaaacaaaacatcttgtcagtctctacctttttcatcctgcatcaacctcttcaatttcatcttttttccttcatctctcttctggcttatactgcctcaagcaaattcatcaatctacgcatcatgctccgggttgaggttccttcccatcacatctattccctgacttatcgcaaatccagtatttga

SEQ ID NO: 19767 - DNA, 360 bp, A.fumigatus
tcaagcacaagcccaaattggacgcgcttcctttccaatctgtcaccgcataacggagacttatcaagaatgcgtctcacgttcatccccagcctcattggcgttgccaatgcggtatgtccctatatgaccggcgagctcaaccgtcgtgatgagatatccgatggcgacgctgccgcagccacagaggaattcttgtcccagtattatctcaacgacaatgatgccttcatgacgtccgacgtgggcggccctatcgaagatcagaatagtctcagtgccggagagcgtggtcccaccctgctcgaagatttcattttccgtcaaaagatacagcgtttcgaccatgaacgggtatga

SEQ ID NO: 19768 - DNA, 252 bp, A.fumigatus
gtccccgagcgtgcggtccatgcccgtggtgccggcgcccatggagtcttcacttcatatggcgacttctcgaacatcactgcggcttctttcctggccaaggaaggcaagcaaacccctgtatttgtccgcttctcgacggtcgcaggaagcagaggtagttcggatctggcccgtgatgttcacggttttgccactcgtttctataccgacgagggcaatttcggtacgttggtcaattcgcacaactga

SEQ ID NO: 19769 - DNA, 534 bp, A.fumigatus
tcttttcatatttctgcaggccaaatgttcattcccctcaaccctcacgcgtactcgcccaagacctccgtcaacggttccccaaaacaagccaaccagaccgtcggcgatggcttcttcacagctcctggacgtaccaccagtggcaagcttgtccgtgcggtcagctcaagctttgaggatgtctggtctcagccacggctcttctacaattctttggttcctgccgagaagcagttcgttattgacgccatccgcttcgaaaatgcaaacgttaaatctcccgtggtgaagaacaacgtcatcattcagttgaaccgcatcgataacgaccttgcacgacgcgttgcgcgcgctattggtgtcgccgagcctgagcccgacccgaccttctatcacaacaacaagactgccgatgtcggcacttttggaaccaagctgaagaagcttgatggcctcaaggtcggcgtcctgggttctgtccagcacccgggctcggttgagtggagcttcccaccctccgcgaccgtctga

SEQ ID NO: 19770 - DNA, 429 bp, A.fumigatus
  unsure (424): Identity of nucleotide sequences at the above locations are unknown.
ctgcaccggtactggtccttgctgggactaccagtatcacttgaacggcgatatcgggctttccttgatgtatcaatggattgcgagcggcgacacaaagacgttccgagagcagcattttcccatttacgactccgttgccaccatgtattcgaacattgttcagcgcaatggttcgtcctggacgctgaccaatatgaccgatccggtacgtttgactacctgggtattgcgtacctcgaaactaatcaattttctaaggatgaatatgccaaccacattgatgccggtggcttcacaatgcctcttatctccgagaccctgagctacgcccaattccttccgaagcaagttggtcttgaccaaaatgagacgtggaccgggaatttcttgaaatggtccttctcattagggaagaccggcntgacc

SEQ ID NO: 19771 - DNA, 789 bp, A.fumigatus
tgtacaggattatctgaccgggttcgtaggtccccgagcgtgcggtccatgcccgtggtgccggcgcccatggagtcttcacttcatatggcgacttctcgaacatcactgcggcttctttcctggccaaggaaggcaagcaaacccctgtatttgtccgcttctcgacggtcgcaggaagcagaggtagttcggatctggcccgtgatgttcacggttttgccactcgtttctataccgacgagggcaatttcggtacgttggtcaattcgcacaactgacatcgtcttgctaagtgtcatagatatcgttggaaacaatatccctgtattcttcatccaggatgctatcctcttccccgatctgatccacgccgtcaagcccagaggtgacaacgagatccctcaggctgccactgctcatgactcggcctgggacttcttcagccagcagccaagcacgatgcacacactgctctgggctatgtctgggcatggcattcctcgttctttccgacatgttgatgggttcggtgtgcataccttccgattcgtgacagatgacggtgcatccaagctcgtcaaatttcactggaagtctttgcagggcaaggccagcatggtctgggaagaggcccagcagacctctggcaagaatcctgacttcatgcgtcaggatttgcacgatgcaatcgaggctggacgctatccggagtgggaagtaagtcgtcttccatcgtcatcacggccccctaatcttgtagacatcaagcaaccttcaagaagctaa

SEQ ID NO: 19772 - DNA, 522 bp, A.fumigatus
tctgactgcaaacagttccaacctggtcacattgtccgtggtgttgacttcactgaagaccctctcctgcaaggccgtctgttttcgtacctggacactcagctgaaccgtcacggtggccccaactttgaacaactccccatcaaccaacctcgcgttcccgtgcacaacaacaaccgcgatggagcaggtgagacttttcaaacttttaaggccagtgcttccattaatcttttcatatttctgcaggccaaatgttcattcccctcaaccctcacgcgtactcgcccaagacctccgtcaacggttccccaaaacaagccaaccagaccgtcggcgatggcttcttcacagctcctggacgtaccaccagtggcaagcttgtccgtgcggtcagctcaagctttgaggatgtctggtctcagccacggctcttctacaattctttggttcctgccgagaagcagttcgttattgacgccatccgcttcgaaaatgcaaacgttaaatctcccgtggtga

SEQ ID NO: 19773 - DNA, 1860 bp, A.fumigatus
cagaacctggccacgtgggtgtcactgctcgcgtgtctccccgcagcgatcggcttaccgaacaataatgaccgggttgcgaggagcttgaagagacacggcggccatggacacaaacaagtcgacacaaattcctcgcatgtctacaagactagattccctggtgtgacctgggatgatgaccactggctgctctcaactactaccctggatcagggccactaccaatctcgcggttccattgctaatggttaccttggtatcaacgttgcgagcgttggcccatttttcgaactggacgttccggtcagcggcgacgtgattaacggctggcctctgtattcccgacgacagaccttcgcgactattgcggggttctttgattatcagcccacgacaaatggctctaactttccttggctcaatcagtacggaggtgagagcgtgatcagcgggatcccccactggagtgggctgattctcgacctcggcgatggcaattacctcgatgctaccgtggacaacaagaccatcaccgatttccggtccacatacgatttcaagtccggggtgctgtcttggtcgtacacatggactcctaaatgtaacaagggctctttcaacattacgtaccggctgtttgctcacaagctgcatgtcaaccaagccgtggtggatatggagatcaccccttcccaggggtctgaggcgacagtggtcaacgtcattgatgggttctcggctgtccgtaccgattttgtggaatccggccaagacaacggagctctcttctcggctgtgcggccctggggaatctcaaatgtcacggcctatgtctacacgaatttgactgcctccgctggtgtggacctgacttcccgagctctggtcaacgacaagccctatgtccacagcaatgaatcatccattgcgcaggctgttgatgtcaagttccgtgcgaatgagacggtccggatcaccaagttcgttggtgctgcgtcgtcggacgccttccctaacccgcaacagacggcaaagcaagccgtgtctgcggcaatgggcgctggctatatggggtcgttgcagtcgcacgtggaagagtgggctagcattctcctggacggttcggtagacagctttgtcgaccccgccaccggaaaattgccggatgatgatcacatcctcaactcccagatcattgcggtcgcaaacacgtactacctcttgcagaacaccgtgggcaagaatgccatcaaggctgtgtcaggagctcctgttaatgtcgacagtatctccgtcggtgggttgacctctgattcgtatgcgggtctggttttctgggatgccgacgtctggatgcagccaggtctggtggcatctcatcccgaggcagcgcagagagtgaccaattacagaacaaagctgtacccacaggcactggagaatatcaacactgcctttacaagctccaagaaccggaccaccttctccccttcggcggccatctatccttggacaagtggtcgcttcggtaactgcaccggtactggtccttgctgggactaccagtatcacttgaacggcgatatcgggctttccttgatgtatcaatggattgcgagcggcgacacaaagacgttccgagagcagcattttcccatttacgactccgttgccaccatgtattcgaacattgttcagcgcaatggttcgtcctggacgctgaccaatatgaccgatccggtacgtttgactacctgggtattgcgtacctcgaaactaatcaattttctaaggatgaatatgccaaccacattgatgccggtggcttcacaatgcctcttatctccgagaccctga

SEQ ID NO: 19774 - DNA, 207 bp, A.fumigatus
ttcaatcagctcggtgttcaaatcatggatgaggaggaccaactgcggtttggttttgacctcttggaccccacaaagatcgtgccagaggaattcgtgcccatcaccaagttgggcaagatgcaactgaaccgcaaccctcgcaactatttcgctgagaccgaacaagttatggtatggtgccatcaggaagctgatacagaatga

SEQ ID NO: 19775 - DNA, 438 bp, A.fumigatus
gtggagcttcccaccctccgcgaccgtctgaaggacgacggtgtccacgtggttcttgtcgcagagcgtctggccgacggtgttgaccagacctattctacttcagatgcaatccaatttgacgctgtggtcgttgccgccggtgcagagagtctcttcgcggcatcctcgtttaccggtgggtccgccaactcagctagtggtgcaagctctctgtaccccaccggtcggcccctgcagattctcattgacggattccggttcggcaagactgttggggcgctgggaagcggcacagctgctctccgcaacgcggggattgcaacgtctcgggacggcgtgtatgtggctcagtcagtcactgatgactttgccaatgatcttaaggagggccttagaacttttaagtttttggaccggtttcccgtggatcactag

SEQ ID NO: 19776 - DNA, 252 bp, A.fumigatus
tcatcaactcatttgaccggtctagagtatgcgatgtgtattctgctgacattcacatccacacagaaagtggtcgaggccgcgatgcttggtaatatttgtaatagcatcggtctggacactcccaacatccccacttcaacaatcacctttatttgttcggatgtcgatggcttcaacttggcaagtctcacaaccgacaatcattccactttgctccatgtccactcaccgtccagttgctggtcatga

SEQ ID NO: 19777 - DNA, 447 bp, A.fumigatus
cgatggaagacgacttacttcccactccggatagcgtccagcctcgattgcatcgtgcaaatcctgacgcatgaagtcaggattcttgccagaggtctgctgggcctcttcccagaccatgctggccttgccctgcaaagacttccagtgaaatttgacgagcttggatgcaccgtcatctgtcacgaatcggaaggtatgcacaccgaacccatcaacatgtcggaaagaacgaggaatgccatgcccagacatagcccagagcagtgtgtgcatcgtgcttggctgctggctgaagaagtcccaggccgagtcatgagcagtggcagcctgagggatctcgttgtcacctctgggcttgacggcgtggatcagatcggggaagaggatagcatcctggatgaagaatacagggatattgtttccaacgatatctatgacacttag

SEQ ID NO: 19778 - DNA, 393 bp, A.fumigatus
gaagaagtatgcaactggcaatgctgtatgttctgcattcactcccctctccatattgaatacctattaacgttcgaaaaaaaggccggaaagacagccgccatggaaggtcagcacctgacaaaggtcgatcgaagcgacgacattgtcaagcccaagaccgtcggtctccaggtcgcagacgccatcaagaagcgccgaaacgaggagggctacaaaatgacacaaaaggaactcgctaccaagtgcaacaccaccatcacagtcatccaggactttgagaggggtacagccgcgcccgaccagaaggtcctgagcgctatggagcgtgtgctcaatatcaaactcagaggctcggacatcgggaaggagaagttccctaagaagaagtaa

SEQ ID NO: 19779 - DNA, 462 bp, A.fumigatus
tgccgcaccggtttcttcatcatgccaacgtctgtcgcacaccttgctaatgtatctcaggagctcgagtttcttgcagatgcttcagtcattactcgtcagcaactctcatcgatcctggcccacctgcctaatgaggcccctcaacaagccaatacaccagttcctccgccacaacagcaacaaccggttgtcgctcaatctcaacctcccccggcatcatacgctccccccacatcgcagttcgctaatacctccttgaacgagaaggccgctctgcagcaacaacaatactcgaccccctctattcctccacccgcttaccctcaagctgcgcccgtactgtccgtcgctacagcactctatgcttatactccaacagatgctggagatcttgctctgcagccacacgaccgtgtccaagttttggaacacatgaacgctgattgtacgttggtttga

SEQ ID NO: 19780 - DNA, 300 bp, A.fumigatus
aggcggtgccaggaattcaagctaacagacatagggtggcgtggccgtaatgaacggaccaaccttgagggtatcttccctcgcagctatgtgaacgtaatagaagagaagggagtgtcgtctccccctcctaccaactatggaaatttgccccttgacgttagtcagagcggctcagctgccccagatgaaaagcggccgggcagcaagttcgaggagcatggcaagaagttcggaaagaagatgggtaatgccggtacgtcgattgtggctccattaattagtgtttgcggccactaa

SEQ ID NO: 19781 - DNA, 435 bp, A.fumigatus
tcccagagaggaatagtgcatgactcccctccaaactgcgtcgctcagggctcgagaagcttctgtgtcatcagtataaattcggtggctctgtggactctctccttgtcagtcataacctcacgcgatcactctctccgccaccttctactctaccacttcggacacctctcttattcccaacatcgtcctccatcaataccttcatacgcttcgagcatacgcatcctcaaaatgagtgattgggattctgtcacacgcattggagccaagcaccgtgctggtgccgctccccgagagacggtagtcaggggaaagagcgctctgaacgctgctcagcgccagggtctcgtcattgctactgagaagaagtatgcaactggcaatgctgtatgttctgcattcactcccctctccatattgaatacctattaa

SEQ ID NO: 19782 - DNA, 390 bp, A.fumigatus
gaatcacctgcacagaaagcaaggccaccgtggcgggctggagttatctgggcaagtacatcattgctggacacgaagacggcagtgtcagccaatacgatggaaaggtgggcttattctgcacctggaatctggaaaactatgctgatttgcgcgcagactggtgagcaactggagaacgtccaggcgcacgagtttgatcaccagatcaacgacatccagttctctcaggaccgtacttacttcatcactgcctccaaagacaagtccgctaaggttcgttctgacccattccatccatccatatgttgtcaaagtctgactatcgctagctcatctcctctcgtaatctcgccattctcaaaacatacgttgccgatactcccctga

SEQ ID NO: 19783 - DNA, 597 bp, A.fumigatus
tatttcatctctctgcaggaacggtccctcaaccagatcaaattcaaccgcgatggcgatctcctgttctccgtggcgaaggataagattgtatgtgcttggtggtcggccaacggcgagcgacttggtacctacagtggccaccagggtgccatctggacggtcgatgtcagccccaacacagttctcctggcgaccggctcggcagacaacactgtgcgactttggaacgtcaagactggcgagtgtgttaaggtctgggatttccctaccgctgtgaagcgggtcgcattcaaccccgatggaagcaggctgctggctgtgacggaaaagcgtatgggattcctcggtacgatcgctgtgctcgacatcaattatggggatagtcagggtggtggtctagagaaccaggccgatgagcctagcttgagaatcacctgcacagaaagcaaggccaccgtggcgggctggagttatctgggcaagtacatcattgctggacacgaagacggcagtgtcagccaatacgatggaaaggtgggcttattctgcacctggaatctggaaaactatgctgatttgcgcgcagactggtga

SEQ ID NO: 19784 - DNA, 360 bp, A.fumigatus
ctcatctcctctcgtaatctcgccattctcaaaacatacgttgccgatactcccctgaacagcgccaccatcactcccaaaaaggactacgtgatcctgggtggtggccaggccgccatggatgtcacaaccacctccgcccggcagggtaaattcgaggcccgtttctaccacaaggtcttcgaggacgagattggccgtgtcagaggccacttcggtcccctcaacacggttgacgtccaccccaacggcacagcatatgcctccggtggtgaggacggttacgttcgtgtgcaccactttgacaagccctactttgatttcatgtacgaggtcgagagagagcagctgaggaagtga

SEQ ID NO: 19785 - DNA, 210 bp, A.fumigatus
gcacctatcgtccgaaaaatactcagggatagacttttcatcaacttgtacctgtatttccggcctaactttctgccaataaagaaagagcacggagaattgactttcaagagttttacggagatcctttggatttaccgctccattcggcacatctaccttggtaagtcgtcggtttgccacctctggtactttggagcaaccccgtaa

SEQ ID NO: 19786 - DNA, 1299 bp, A.fumigatus
gatcctgtcttgtgtttcttgtcctaccacatattcactaagcttgacatagatttccttgtttgcatttcatactctttccatacccgtaccagggccgagcacctcgcagccacgatgttcaacgatcatgatcatgttccaccaacatcatcacagtcggattctggcttttttgaacaagaaatgaagaaatctcctcgactaagccttcgtgagcgcctacggcacttcacctgggcgtggtataccttgacgatgagtaccggtggactggctcttctgattgctagtcagccgtataccttcaatggcatgaagggcatcgggatggtcgtttatatcctcaatcttctgttattcgctcttgtctgttctttgatggtgctgagattcgttttgcatggcggtttccttgacagcttgcgccaccctcgcgagggtctcttcttccctaccttctggctatccattgcaacgatcatcactggcttgcatcgttacttcggctccgacgacctagagtcgtacctcatcgcactcgaagtcctcttctgggtctactgtagttgcaccctcgccacagctgtgatccagtactcattcctctttgccgcccactcctacggcctgcagacaatgatgccatcatggatcctaccagccttccccatcatgctcagcggaaccatcgcctcggtcatcagcgaatcccagcccgcgcgatccgcgatgcccatcatcactgccggcgttaccttccagggcctcggcttctcaatcagcttcataatgtacgcccactacatcggccgactcatgcagtcagggcttccctgccgcgaacacagaccagccatgttcatttgcgtggggcctccgtctttcaccgcgttggcgctagtagggatggccaagggcctgcccgacgaattcaagataatcaaagacgcacacgtcgaggacgcccggatcctcgagctgatggctattatcgtcggcgtgttcctgtgggccctgagtctctggttcttcttcattgcctttgttgctgtcgtccggtgccggcccactgcgttccaccttagctggtgggccatggtcttccccaacactgggttcacgctggccactattaccctggggagggcattggggagccctggcgtcttgggcgtcggctcggccatgtcggtcggtgttgtctgcatgtgggtcttcgttttcgtctaccacattcgtgctgtcatcaggcaagacatcatgtacccgggcaaagacgaggatgtgctagattaa

SEQ ID NO: 19787 - DNA, 207 bp, A.fumigatus
tgccttctaggccttaagagtcctgtaggctcagcacgttgcattggaaccactccaaactttccattaattctcgcagcctctagtcagtacgagcacattcccaaggcaatctttcagctttgggcttacacttgcaatctcaaaaagctgagggtgtgccaggaacctctgagacaattagcaaacacaccccacgaacaataa

SEQ ID NO: 19788 - DNA, 1239 bp, A.fumigatus
ccgccgctgcggccggcatacccgcgagaacgagcatctgccattctatcacaattcgagcgcaagcgacgggcagctgccatggcggttccgacggatgataaccgtgtgcgcgcacgactgcgagagcttggtgaaccgatcactcttttcggagaaggtcccgtggaccggagagacagactgcgtgagcttctgacggatctggccgagaggcaggaagcagcagctgcggaaggtgatgtctccatgcgaggtaccacagaggaaactgaagcggcagaagaggaagcagaacaacaggaagaattctacacagagggttcccaggagctactcaacgcccgaaaagcaattgcccgctattccctaccccgagcgaaagcacgagtagaacgcttacgagaggaatctacaatcccattgagaacacatatcaaacaccgcaaagcgatcaaagagaagttgcaagggtttgacctttacgggtcgcagattgcgggcgaccgccctgtgagcatttgtcgctttgcgccagacggaaagacgatcgctgcgggcaattggggtggtggtatccggctgctcacggtgccgaatctggaggagaagtcaaacctcaatggacatacggatcgtgtcggtggattggcgtggttccccggtgcaacgcttccttcctcgaatgtgtccgagtcgagtgtcaaccttgtctccgggggcggcgagggcaacgtggcgctgtggtcattggataaagatacaccactagcgacactgtcaggccacagtggccgtgtatgccggacagaattccatccttcagggcggtacatcgcatctgcttcgttcgacacgacatggcgcttgtgggacgtcgagacaacagtcgaactccttcttcaggagggtcattcacgagaggtttatacggtggcatttaacaatgatggttctctgctggctagcggcggtctggacagcattggtcgaatctgggatctacggacgggccgcacggtcatgatccttgagggacatgtccgagaaatctacggtctcgactggggtgtaaatggataccgtgtcttgtcaggttcgggggatggctggatcaagtgttgggacctccgccaagtacgcaatattggtgggatcggcgcacataaaagtgtcgtgtcggatgtacggtggtacaagggcactgaattcggctgcatcttatctgccgtccactga

SEQ ID NO: 19789 - DNA, 333 bp, A.fumigatus
gaaagccatcggaacaataccagatggaggaagtggtgctctaccagttctgagtcaaccgctcgactgcgccaaaagacatacatcctaagcaaagatggcagcatcatttcaaatgcagcggctagcacagcgatcgctgctctccacagttcccctggcacggacggaggccacacactcgctattcctaacaggcgcctgtattttctgccagctaagaccaagagcttgggctgctcagcctgcgcggcgcccctgtctgactttgcctacccgtcgacttgcctcgacctcatctacaacagcccccgagacgagcaatcaggatag

SEQ ID NO: 19790 - DNA, 252 bp, A.fumigatus
ggtgctttctccatcccgtggttcattcctggcttcgaatttgagatcgaggcctcgagactggaaaagtctcaagattcggatcatgacaagtttggaaaccattttcgaagacaaagcagggaagccggccaaagaagagaacccgataccgtaagaagcaaaagaagccagaatgctgacaaactaggaaatatgccttatctttccttttctggtcgatgtgacaagccactattgtcttcactctga

SEQ ID NO: 19791 - DNA, 441 bp, A.fumigatus
atggataccgtgtcttgtcaggttcgggggatggctggatcaagtgttgggacctccgccaagtacgcaatattggtgggatcggcgcacataaaagtgtcgtgtcggatgtacggtggtacaagggcactgaattcggctgcatcttatctgccgtccactgaaagcaatggacgaatggacgttgacagcaacccgacactcacaacgagcgaacagtcaacaccagcaaccccaattcaaccaaagaagtcaggcacattctttgtcagcagtgggttcgacaagaacgtcaatatcttcagcgcggatgactggtctctagtcaagtccttgagtggccatgcaggcaatgtgctcagtacagacatcagtgatgatgcgcagtggattgccagttgcgggcacgatcggactgtgaagctctggggcatagagtga

SEQ ID NO: 19792 - DNA, 819 bp, A.fumigatus
gcaaagatggcagcatcatttcaaatgcagcggctagcacagcgatcgctgctctccacagttcccctggcacggacggaggccacacactcgctattcctaacaggcgcctgtattttctgccagctaagaccaagagcttgggctgctcagcctgcgcggcgcccctgtctgactttgcctacccgtcgacttgcctcgacctcatctacaacagcccccgagacgagcaatcaggatagcaacctcccagaccttaccaaccactataccatcttccgcgagaccttaccggcagggccacccccggcttcggcattcgatatccctctgagcgatctgagacgcgagttcctccgactacagaatgtgatacatccggacaagttcccgccgggacctgagaagcaacgagcggaggcgctgtccgcgcggatcaacgaagcgtaccggacgctatcggaccctctgcagcgggcgcactatctcctgcgcgagatacatggcatcgatgtgacagcggaggacggatcgactcaacatgcgctcgacccggagaccctgatggaggttatggaggttcaggagaggattgaggaggtcggtgcagggccggaggctgagggaaccattgctgcgctgaaaaaggagaatgatgcgcgggtggcggcgtgtgtgaagagcttggcgcaagcctttgaacggggggatatcgaggctgcgcgtcaggagtgtgtgcggttgcgattctggtacagtgtgggtgaaggcttgcgagagtgggaaccaggcaggacggagatccgcctgatccattga

SEQ ID NO: 19793 - DNA, 1872 bp, A.fumigatus
gtccagcatcttcttcgatcaaaactcggaggagatcatctatctctgttttcaacatcctgtttgtgctgcgtcttagctttgctttcactcattccacatatccaagccacgagcaattcaagtcttcacgccaaccatgatagcgttgccactgactcttcgaatcactctcctgggtacagcatcatccattcaccaccattcacgttccttgttgggcctaatcatgacaagttgacaatacaatcggggcttgcccgccatgtctcccaaccgctcgatcatctcatgaacagtggcctcaccagggagtccaagcatcatattgcggttttagaggaagaggatgccgagacctttgtggccttttgcgagtatgcctacacgggcgattacagcgtgcctacaccggggtctcgcgaggatgacagggtcgagtccagcaacaacccggcattcaatcagatgttctcgaatcccaatcccttcgcctcggccgttcctcccccagcaccatctcctcccccgggtgccaagttttcggacaggaacctggacgtgccagatagtggggacgcgaagactgccgaggcaactgaggagtcggcgcagccgctgaaggagggcgagggcgagggcgtgaaggatgccaccgacgatgtgagagaggatgttgcagcacccgatgatccgccacaggatctggcatcaaactgtgatgagccaagtgagcagcctctggcgacctccactgccgaagaggggtcttcctggggtctcgaggagaacgccatgccctcgaagggcaagaaagcgaaaaagtcaaagaagggcaagaagaaacagcaaggtggtgcgacggcagaggaaccaatgtctaacctgactcctccaaccacccctcctcctggaaatgttgacgaccagatcgataacccgctcacggttgaggctacgacaatgctggatgacccgatcccagtaattgaacctactaaagtagacgaggtagcggaggctgtggaagttcctgagcccactggagcggaccagtcccctgatgctgccgcactatcggatactgagagttgggatcgagcaacctctgtgcctcccaatgtcaaggataccctcaatcagaaagtggagcttgatcccgacagtcaaaagcaggacagagtcaaggaagaggttgcgtctccccgaagccagatgaaagcgttcattgacacctctttcgccaagcagctatatctttcgcgccgcccaactggagttggtctctgggatgagttcgtgaacttggactattttgatcatccctcgacctatgggacaaggcctctcaccccaaccgcgacacactcggatacaaccaagtcagatctcccgtatcttctcttccacgccaagctgtacgttttcgctgtacgatacttgattcccggtctggcgcagttgtgtctccgaaagcttcacgcggatctgctgcgtctggattttcctggtccgaaagacgacgaaaggaaggaagagcgagctgcttggactgcaaccaagggcagaatggtccttgaccttctccacttcacctacaccaaaacgacccgtttggagccaatttccccaacctcggccactcagcttcgtgacaatgagcttcgcaaacttgtcgtacactacgcagcctgcaaggtgagagagcttgcagagtactgcggtcccatggaaagtatagtaagctcgccattcccttcaccagtggacaaacagccacgaagggcgaatcgaccttccagccgtggtttccgcgcgctcttggattcgacaaccgaacttgcctcggacttggtcttccgcatgatgtga

SEQ ID NO: 19794 - DNA, 390 bp, A.fumigatus
cacatcctcgtctttgcccgggtacatgatgtcttgcctgatgacagcacgaatgtggtagacgaaaacgaagacccacatgcagacaacaccgaccgacatggccgagccgacgcccaagacgccagggctccccaatgccctccccagggtaatagtggccagcgtgaacccagtgttggggaagaccatggcccaccagctaaggtggaacgcagtgggccggcaccggacgacagcaacaaaggcaatgaagaagaaccagagactcagggcccacaggaacacgccgacgataatagccatcagctcgaggatccgggcgtcctcgacgtgtgcgtctttgattatcttgaattcgtcgggcaggcccttggccatccctactag

SEQ ID NO: 19795 - DNA, 321 bp, A.fumigatus
ttcttcgtatggagtcttaaggttcggttcttatcaaagcgacacaggcataatgaacttccagaatctgtaatcaatggatcaggcggatctccgtcctgcctggttcccactctcgcaagccttcacccacactgtaccagaatcgcaaccgcacacactcctgacgcgcagcctcgatatccccccgttcaaaggcttgcgccaagctcttcacacacgccgccacccgcgcatcattctcctttttcagcgcagcaatggttccctcagcctccggccctgcaccgacctcctcaatcctctcctgaacctccataa

SEQ ID NO: 19796 - DNA, 675 bp, A.fumigatus
ttgagggtatccttgacattgggaggcacagaggttgctcgatcccaactctcagtatccgatagtgcggcagcatcaggggactggtccgctccagtgggctcaggaacttccacagcctccgctacctcgtctactttagtaggttcaattactgggatcgggtcatccagcattgtcgtagcctcaaccgtgagcgggttatcgatctggtcgtcaacatttccaggaggaggggtggttggaggagtcaggttagacattggttcctctgccgtcgcaccaccttgctgtttcttcttgcccttctttgactttttcgctttcttgcccttcgagggcatggcgttctcctcgagaccccaggaagacccctcttcggcagtggaggtcgccagaggctgctcacttggctcatcacagtttgatgccagatcctgtggcggatcatcgggtgctgcaacatcctctctcacatcgtcggtggcatccttcacgccctcgccctcgccctccttcagcggctgcgccgactcctcagttgcctcggcagtcttcgcgtccccactatctggcacgtccaggttcctgtccgaaaacttggcacccgggggaggagatggtgctgggggaggaacggccgaggcgaagggattgggattcgagaacatctga

SEQ ID NO: 19797 - DNA, 531 bp, A.fumigatus
ccgcctcgcttgctgtgcgtgtccaggcttgtcgacgaaatcaccttcaagctcgctgatgaggccgccgacgcacccaccgcgaccgccatcctcggccccttcttccgcgctgataccccctaccgcaacaacggcgacaatatcgtcaaggacgtgccggacggcgagatggtgttcatgcacggccgggtgatcgatttccagaccaagaagccgctcgttggagcgacggtggaggtgtggcaggcgtccacgaacgggctgtatgagcagcaggatccgaaccaggaggagtttaacttgcgggggaagttcaagacggatgctgacgggcggtactacttttactgcctgcgtccgacgccgtatcctgttccgaatgatggtgcgtattctgatgctccatcgcctatcgcattggagactttgcaaacgctaatcttgaacgacgtacaggtcccgccgggaagttactcgagctcatggaccgacaccccttccgccctgcccatatccacatcattgtga

SEQ ID NO: 19798 - DNA, 696 bp, A.fumigatus
tccactggcgtagaaatagttacttacgcgaaacagggaatgtcaaaattctaccaggtaacattggacacacttctccgacagatggagtttaacaccagcgctacttctctcacgagcaacgagcccgtcaagcccgttcttcttgcgtcgcctggctttgtcgctgccggattccagaaatacatacagtctgttgcctcgacgactacacctgccctcaaacgactcttgccgagtattgtcgtcgttcactcagcctcgggctatttgcattctctcgcggaggttctgcaatcgcctgcagtgaagaccatccttgcggataccaaatatgcccgtgagaccaaactgatggacgactttcttgggcacctccgcaaagagactaacaaggccatctatggacctcgtgaggtcgaggcggcagtcgaccaaggagccgtgggccgtgggggcggtgtcctcattatctcaaatcggttgttccggtcacaggacgtggcggagcgcaaacgatgggtgtcccttgttgaccgagtccgggacgtcgaggggggcgaagtgcgtgtactcagctccgaccatgagagcgggagaagactggacggattgggaggtgtggccgctttgtgcacgttcccagtagtcgaggaggactttgaatcggacgaagaacctgctgaagctagctga

SEQ ID NO: 19799 - DNA, 588 bp, A.fumigatus
ctactgctgatcctcattcccatcctctcttcccaacgtcgatacaggatatacctgacctctctaccggatacgacccttgaggcacatacagtcatggctactcatcgatttgaccccaactttaccgataatgtcatcaacgcgatgggtcccaagaccaatccgcgcttccggaaggtcatggccagcctaatccgccatgtgcatgactttgcgcgcgagaacgaacttaccgtcgacgagtggatggccggcgtcaagctgcttaactgggccggccagatgagcgatgacaagcgcaacgaaggtcaacttgtctgtgacgtgatcgggctcgagtcgtatgtgttacatccaccaaactcacagtcccagacatcaagtactaaccgcctcgcttgctgtgcgtgtccaggcttgtcgacgaaatcaccttcaagctcgctgatgaggccgccgacgcacccaccgcgaccgccatcctcggccccttcttccgcgctgataccccctaccgcaacaacggcgacaatatcgtcaaggacgtgccggacggcgagatggtgttcatgcacggccgggtga

SEQ ID NO: 19800 - DNA, 546 bp, A.fumigatus
cgacggccctgcattaagtggcacgcctacaacctgatcagacctggtgacctccttcgcgcaagcgcaatccgtcgcgtcacaacgacacacgacaccggtacaacaacttcatcccgggtccacttaacgctcgaaatccgcgtgaaaagtttagatttcgaccctcagagctcccaactgcatgtcggaggaacaattgtgaacgagacaccgcacaccaaagtcggacaacatcatacattggatttggagctgaatcgcaatttcaccttggagaaagagatcggtgcgaatggggaaggagttgggtgggacagtattgctgtacagatgctccaggatgccgttgacgagagcggcaaacggagggcggaagcggttgctgttgtgatgcaggagggactggcccacatttgcttcattgggcaattccaaaccgtcttgaagcagaaggtcgagatgtcggttccgcgaaaacgacaaggcggcggaggcggggatcatgataaggtactccacccatctgctaatccactggcgtag

SEQ ID NO: 19801 - DNA, 414 bp, A.fumigatus
cgacccgtgctacctgcgcatgtagacgggacagcgcactcggctatggggtcctcgggtctgaacgatgggcgggtaatctctgggatgaggcgagatgcgcagattctgatctacattgacatcaagaaggcaatggccgcgggttgtccgttctggcgcagtgagaatggagtcatcctcagtgagggcgtggatgtaggggagaatcaggaggttggagatggggcatcgccgaaaatcattccccttgaattctttgacgttgttgtggaacgaaaatgtgggctggggaagatttgggaacgcgggcaaacgatcaaggaactgccgtcggaattgcttcagaaaggcaatcccaagggtccaaaagcacgattggatgggaggaggggtagtaagagaaatggatga

SEQ ID NO: 19802 - DNA, 276 bp, A.fumigatus
gcacctccttgggggaagtataatcctatcagaacaacttataacgctcttactttggaatatacatactattggctgtctattttttcaacatcccacatctatacacctactggtcaaatgcgtctaataaagaacaagatagagcacggtggctcaggcaccgtcactctatgtcctgaagagccagaggatatggtatgcgacccgttgctccactggatacttagctgctctgacgacggccctgcattaagtggcacgcctacaacctga

SEQ ID NO: 19803 - DNA, 204 bp, A.fumigatus
tcagctagcttcagcaggttcttcgtccgattcaaagtcctcctcgactactgggaacgtgcacaaagcggccacacctcccaatccgtccagtcttctcccgctctcatggtcggagctgagtacacgcacttcgcccccctcgacgtcccggactcggtcaacaagggacacccatcgtttgcgctccgccacgtcctgtga

SEQ ID NO: 19804 - DNA, 186 bp, A.fumigatus
attgacagcgcgaaatactatgcgaatgagaaagaatgtgcggtagctatgaaaaagtctggaattgaccgttccaagatctttttcaccaccaaggttcccgcgtcttccatgtcctatgaaaaggccaaggaagccattgagcaaagtgtcgctgctactgatcttggttacatcgatctgtaa

SEQ ID NO: 19805 - DNA, 429 bp, A.fumigatus
cagcggtgttggaggcgaagattctggtggcaggatgagattcatccctggtgtgcgcgagaggacattgttgcctggctgaagaagcgcaacgttgtcattgaagcctattctcctcttgttcaagctcagcgcctggacgagcctgtgttacagaacttggccaagaagcacaacaagacaggagctcaaatactgatccggtggagtctgcagaaggtacctcctttgtcgctattatcgattgagtccgtgactaatggagtcttgcaggggtacgttcctcttccgaagtctgtaaccgattcccgtatagttgagaatacgcaagtctttgactttgaattgtctggcgaagacatggagagtctgaacaccggcatttatgctcctgtttgctgggatcctgctaaggatgttccactgtag

SEQ ID NO: 19806 - DNA, 285 bp, A.fumigatus
tcttcagtccgggacaacatatcgccgccggacaaggatgtcaacaataactctctgcgcgatgtctgtacaatctattgcagtcaactagcagagagaagcctactgttacgatcttcaaatgcaccgctacatctcgatctcgaaaacttagattttagcctacctgtcgtccctctaccatgcccgatcagccgcggcgcattattctggaaaaatccaagacagtgcgccgccggtatcaacgcagcaacaaacgtttccaatttacagcttcacaaatag

SEQ ID NO: 19807 - DNA, 468 bp, A.fumigatus
  unsure (146): Identity of nucleotide sequences at the above locations are unknown.
tctcaacgtatcgaaaagatgccctgcctcgaagtctgtgggcactcaatccactatgctgattcccatcccaacggagctcccaaagacggtgcgaccatagtcttcatacatggccttggctcctctcaaaattactactttcntattctccaccatctgaccctgaagcaccgctgtatcaccctcgacacctatggttctgcccgctccccgtacacgggccaggccatcaccatttccaccattgcctcggatgtcattgcggtgctggatgctgtacatatccctaaggccgtcgtagtcggccactcgatgggtggactggtcgtgacactgttgggtgcgcagtacagcgatcgcatcacgactgtagtagccgtgggccccacccatccttcggagagtttagcatccacaatgcgccagaggagcgacactgtgctcgagggtaggttgcttccatag

SEQ ID NO: 19808 - DNA, 243 bp, A.fumigatus
cttgggtgcagaattctgctgcacgcgccctacggtggaaaggagggccgtcttggtgcctggcgcgccctcgtggaggctcagaaggcaggccacgttcgttccattggtgtctccaactatggcattcaccatctggaggagttggaggagtacattaacagcggtgttggaggcgaagattctggtggcaggatgagattcatccctggtgtgcgcgagaggacattgttgcctggctga

SEQ ID NO: 19809 - DNA, 372 bp, A.fumigatus
cccaaaatagtcggaatggaagcaatggccaacaccgtccccaacgccgctacaggctgccaagcctccccgctcgccaaagcgttcattcgtgagctccttctaggccagaacccgaatggctacgccacgctatgccaggctattgccaaggctcccgcaatcgactactcgcgcatcacagtgccgtttctgctcattgccggcgaagaggataagtctgcgtcgttggaaggatgcaaatatatctttgaccgggtgtccagtaagacgaagaagatggaggtattgcccaaggtcggccattggcactgcatcgaggcaccagatctggtgggtgggatgatcgcggggtttattgagagagtgtga

SEQ ID NO: 19810 - DNA, 399 bp, A.fumigatus
ctatttctacgccagtggattagcagatgggtggagtaccttatcatgatccccgcctccgccgccttgtcgttttcgcggaaccgacatctcgaccttctgcttcaagacggtttggaattgcccaatgaagcaaatgtgggccagtccctcctgcatcacaacagcaaccgcttccgccctccgtttgccgctctcgtcaacggcatcctggagcatctgtacagcaatactgtcccacccaactccttccccattcgcaccgatctctttctccaaggtgaaattgcgattcagctccaaatccaatgtatgatgttgtccgactttggtgtgcggtgtctcgttcacaattgttcctccgacatgcagttgggagctctgagggtcgaaatctaa

SEQ ID NO: 19811 - DNA, 813 bp, A.fumigatus
cctacctgtcgtccctctaccatgcccgatcagccgcggcgcattattctggaaaaatccaagacagtgcgccgccggtatcaacgcagcaacaaacgtttccaatttacagcttcacaaatagagcgcatccaacgcgaagaggaacgcgaagcacgagctaaaaggctcagagaaaaggagaagaaacgccaagccaataagaagaaaaaggccgaaaaggaagccaaagcacgcgaagcacgacgccgccttggtcttcccgatcctcatgctctccccataccctccagtcagccgttgctttccaaattcctcaagaagcctgcagcgaaaccggatacagagaccgagacttgtgaggataccgaatcagacagccacagccaggggagcatcgcgaccgagatcgacgagagcctgctctcggatttagatgtcgctgccttcgacggtcagacggctgctggtgcgtcaggtccagataatcatcctgcaagcattgatgagaagggtcacgttggtcggacacagggtgatgatgacgagttctccgaatgctcgattttctacgacgaagacatcatcaaagaagtggaaacaattgctactgcacaagttacgacaggcaggctgggggaaatagatcaggcgatgaaagaatcatgcaaacctgcgttaacggtaggagaatcatttcaagacgacacggcgatactccttgaagagtttggccacgaattcgcaagcgatgaagaattcgagcaggaattgattaaactcgatactgtatccgttggaaaacaatcttga

SEQ ID NO: 19812 - DNA, 3294 bp, A.fumigatus
  unsure (109): Identity of nucleotide sequences at the above locations are unknown.
caccaaaaagcatcaagaagagaaggaaccttagagacggaaaaagcatccctgtcagcacgccatgataatatgcagaagcgacttcggaagctgcaggcagaggcgnacgcaatgaggtctgagagaagtcagcttgaacgtgaggtcgccgacgtcaaaaagcttctcgaagagaaaatttccgaagatgcagaggctggtgagagtaggaaactgcttgagcagcagattcaagacctgaagaatcaactatttcaggcacaggctgatctcagccgggagcgacagtcgagagacgacgtccaaatgcttgcggaacacaatcttgcggagctcagggacaagtacgcctctttgaatgaatcgaagatcatcatagagaaagagatgtacattcagcaggacacacttcgccgtgcgactgaagcgcgagcagctgcggagaagtctcgcaaggagctccagactgagctgattaaacttcgcgataggttcaccaaagtggagagtgcccgcttgaatgcagaggccgagatcgagcgaaatgtgaagaagcaggccaacgagcgcctggatagcgtccgaaaggatctagaggaaaaggcgcgtcagctggaggatgtcgaggaagagcgatctcggctttcattgagagtgcaagaacttactaatgcaattgctgagtctgaaaacttccgcattcgccatgaccagcacaaggaacgcctcgaacgagagctggttacgcttaaaggcaggctcacagcctccgagaacgacaatcgcgctcttttgaccaagatccaacagaaaaatctggatattgccagatctaattcaaaagccagcgagagccagcgtctccgcataacgaatctgcagagggaaaaggccaagttggaagaagataacagaaaactgactcgacaactcggagaccttcaactttctattacgtcgttggaaaagcagaaagaaaagctgtcattgagtctggaggatctgaatcatgaggtcaacagggaacataaggccagtcgcaacgctgagaaggccgcctcaactgccggtatacaacttgccgaagcaaacaggaacttggagacagagagacagctgcgaactcaggctcaggcaaacacacgaaagcttcagggatcgcttgacactgctcacaaagaaattgaggctttgcaccgccagttgatgctcctacacaagttcgtggagcctctgtcagacaagccgccagaatcatgggagtccgttcagccagacttagttgagaaagtaaatctagcccaacttctggatacagctcaaagcaaacttcaagtgatggaggagaagtataatcgagcagagagccaacttgcagaaatgcggcgtcgtcacgaggacgagatgaaggagctggacgcccgttactcttcatccaagcgtgcattgcttgaagagattgaccagaatcaggtagccggtaatcgtaccccgacgcatctgagaaagaattcagaaaacggtcttgtcaagaagttcgctacgccaacaacacctaaccggagattaaatctcaacgaagctacaatggattctggtcggtcagatcggacagtcgacaccatcggctaccagaaacgcatggatctcgctactgagattgaagagcttcagaataaactccagatgagcgagatgcagaaccgtcatctccagaatcaacttgaacaactcaaacccgtccgagacctatggcaggatgagagcccgtctctcagacgcatgcagcttttggagcgcgagaatggccgcctccatgaccaactagatgattccgcaaagaaggtttctgccctagagaggagtatccgttccggagagctatcgctgcgtgatgtccaggcgaaatcgcacgaggagctctacgatctgatcaattctcaggaacagtctcgaagatccttgctcaaagtccataatgaggccatgactgattttacggaggcgaaagcgcaatttgagaagctcaagcgagcaaaagctactcttgaggtggaacttcgagacgcactctccgaagcgcaagagttaaaagttgccagagagcaggatgccgtcagccgaaatcagcttctcgaggaattctccgacttgcagatacggttggatgcggaaacatccaagtccgctgatctcgcctccagcttgagtctgtataagagtcgggcggacgactacttcaacaagctcgaacaagcagagatcgccgtccttaaagccactcgcgcggaacagtttgccaagtcccaagcccaagaggcagaggagacttgtgcgcagattatggctgagcgcaaacagatggatgctcttgttgaagatctgcaaagacagactcagatgctagaagctaggatggaggatcaagcagccgagctacaaggagcgcttcaagcgaaacagcgcttgcaaaatgaacttgaagattacaggaatcagcgtgcaatcgatatcgaagacaaagaaacttcgatggagcagacgaggctgaaataccaaagggaattttctacgctcaacaatgagctcgagatggaacgagagaaggtgctcaatgttcgtagcgagaacgctcgtcttcgggaggaactggaggatctccgtagcaagtgggataatgaagttctgaacagctcaacttgggctaaagagaaagcacggatggaaatcacattacaggatgtcactacgtcccgcgatgaggctgtcaacgcccataacgaagcccaaggcagagttgtgtccctcctttctcaggtccgaagtctgcgaacctcgtttgatgacatcacggcagagcgtgacacattgttcaaggagaagaagatgcttgaagcccggctggctgaggctgcggagagactggaggaacttgccaagggcgaaagtccgtctatgcgcagcgccgccagcatggaccgcgagctcctagagctgaagtcgaaactcgcccaacaagaagacgtctcagctgccgctgttggcaagatgaggcgagctgaagcactagtgactgagatgcagaaagaagtcactgctgaaagggaggcgaatgctcaactcttcaaggataaggctgcgctagagaaacaactcaaggaggcgcagttgcgatgtgtcgatttagagaccaagagctactcgactggcagtcaggatgttcgattcctccacaagaggatcaaagaggtaagttttcatcccactgaaatgcgtcacccaagatactga

SEQ ID NO: 19813 - DNA, 201 bp, A.fumigatus
  unsure (149),(167),(192): Identity of nucleotide sequences at the above locations are unknown.
ttgtggtgtaaggactctgattccaacttcctcgtagagctgcctaagtacagccggattgatcccctctcttaccaactcattgtaacgaaatgttgtggggtgctaagcgcagagccgcgccctgcgcttgaaatcgaaagctgcgnccactatttttcccgctnccgtgcgggcccagaaacatctttntgtggttga

SEQ ID NO: 19814 - DNA, 2814 bp, A.fumigatus
agctgtggagcactgcaatatctgacattggaacgtagaggtgaatccggagctggtaaaaccgagaataccaagaaggttattcagtaccttgcagcagtggcaactaccgacactccatatgctcgttcaggatctaagcaattgtctactctctcgcagcagatattgagggcgaacccaatactggaagcatttggtaatgcccaaactgtcagaaacaataactcgtctcgatttggaaaattcatacgcattgaattcacccgctctggtcagatttcaggtgcctcgattgattggtatctcctggagaaatctcgagtggtcaaaccgaatagtcacgagagaaattatcacatattttaccaactgttgcaaggcgccgacccgaagctgcgggaaagcttgctcttgacagatttgcacatcgaagattttgcgtacaccagagacggcaatgatagcatcgccggtgtctcagacgtggatgagtggaattcactgattgaggcatttcacgtcatgaagttctctgaagaggaccagatgtgtattcttcggacagttgcagcggtcctccatctaggaaacatcactattgtcaaagaaagtttgcgtgcagaccaagctgccctgggccccgactcattaaatagcgtcgagagggcttgccagttgctagggatagagccagagccctttgtaaaagggctgctccatccgagggtaaaggcaggccgggagtgggtggaaaaggcccaaacaccagagcaggttcgactagcgctagacgctctcgccaaaggtatttatgagcgaggtttcggggatcttgtcaaccgcatcaacaatcggttagatcgcagtaccatggctggcgacgatagcttcttcatcggcgtcttggatattgccggtttcgaaattttcaagaacaacagcttcgagcagctgtgtatcaactacactaacgagaagctgcagcagttcttcaatcatcacatgtttgtccttgagcaggaagagtatgcacgagagcaaatcgaatggcaattcatcgactttggcaaagacttgcagcctaccattgatctgatcgagttgacgaaccctattggcatcttctcatgcttggacgaggacagcgttatgccgaaggccacagatcgctcattcacagacaaattgcattcactctgggaccgaaagtccccaaaatatcgcgcctcccgcttgagtcaagggtttgttctgactcattatgctgcagaggtggaatacgacaccgaggggtggcttgagaaaaataaggaccctctgaacgacaacgtaacacgcctccttgcacgatcgacagataaacatgtcgcctgcctcttttccgactgtggcgacccggatgaggataatgagcttcccaaaagcagagtcaagaaaggtcttttccgcaccgtcgcacagcggcacaaggagcagctgtcaagcctcatgaaccaactccaccagactcatcctcattttgttcgttgtataatacccaatcacaagaagcgtcccaagatgctaaatgcccccctcgtcctagaccagcttcgctgcaatggtgtcctcgaaggtatcagaattgctcgtacaggattcccgaatcgcctctcgtttattgaattcagacagcgatatgaagttctctgtcctaacatgcccaaagggtatatggatggacagagtgttgcccataatatgctccaaaagctaggtctagatcctgcctggtaccgtgtagggcggacaaaggtcttttttcgagcaggtgtcttggccgagctcgaagaacaacgggatcagctcatccggactatcatgactcaattccaatctgcagctagagggttcatccagcggcggatatcaaacaaacgcctataccgggcggaggctacgagaatcatccagcacaacttccaagtctatctagacatgaagcgaaatccctggtggcggctattctcgaggatgaagcctctcttaggagagacacgtactgctaatgaagtcaagaaacgggatgaaaagattaaagagctggaagccaaaataaagcaggacattgctgaacgccagaaacttgatgaagagagacgccgtactgagattgagattcagaaaatccaacacacacttgaaagcgaacgagctctggctcttgacaaagaggagatcttcaagagactgcagcttcgtgagatcgagttaaccgaaaagttggctggggccattgcggaccaggagagtcttgaggaccaattagacactctgatagccgcaaagaaaaaggctgatgagcagcttagccagcgcatcacgcagcttgaacaggccggcgagatcattgaacgtctggaagccgagaaacgggatctacagtcccgcctcgacgtccttgaccgtcaattggaggaggcccggagctctgtcgccgagcaggaagcccgcgttaaggagctaggccaggaaataaaaatgctccagagtcacctgagtctcaaagaccgcaaaatacaagacctggaagcgaaattactcaaaacagaccaggatcttgacatcaagctcgcaagaacatccaaagatctggagctgtcgaaaaagcagatcaaggacttggttgaggaaaaccgttctatccgacaacagatttctgatctctcctccacgtctactggatatgaggaaatgctcaagcgaaaaagaagtgaaattgctgttctgcgaaatgacaccaaaaagcatcaagaagagaaggaaccttag

SEQ ID NO: 19815 - DNA, 228 bp, A.fumigatus
acttactccggtttgtttttggtcacgatcaatccgtactgtccattgccgatttacacaaacgagtacgtgaaaatgtacaagggccgtagcagagaggaaactcggccccacatcttcgctatggctgatgaagcctttcggaatttggttgaagagggcgagaaccaaagcattctagtgacgtatattcctcctcatgaagctgtggagcactgcaatatctga

SEQ ID NO: 19816 - DNA, 234 bp, A.fumigatus
  unsure (206),(226),(227): Identity of nucleotide sequences at the above locations are unknown.
aatgcgtcacccaagatactgacgcctcaaatcaaacagttggagacgcatcttgaagagcaagagaacaagcacagctcggaacaacggtcactgcgtaatgtcgaccgtacagtcaaagatcttcagtcacagttggagcggcgtgataagctgaacgcgcaactagaggaagatgtcaacgtcttcaccgcggggctggaagngtcgtgctatgtctatattnnaaaacgc

SEQ ID NO: 19817 - DNA, 183 bp, A.fumigatus
tcttcagctcttagaattggagtcttcgatccacaactgctgacattgatgcaaagcaagctgcatactatttatatgatgtgcgatgcctcaacccgtgcagctaacacagcccacgtcttacttactcagtacactacagaatcttaccagaattcgcttgtgttgaatagcctcagttga

SEQ ID NO: 19818 - DNA, 225 bp, A.fumigatus
ctcgatctcacgaagctgcagtctcttgaagatctcctctttgtcaagagccagagctcgttcgctttcaagtgtgtgttggattttctgaatctcaatctcagtacggcgtctctcttcatcaagtttctggcgttcagcaatgtcctgctttattttggcttccagctctttaatcttttcatcccgtttcttgacttcattagcagtacgtgtctctcctaa

SEQ ID NO: 19819 - DNA, 192 bp, A.fumigatus
  unsure (65),(106),(131),(149): Identity of nucleotide sequences at the above locations are unknown.
ttttgcacagcgtatgatcctccaggttctggcaaccctgacccattcatgtcgaacggtgcttncggcgcttcatcccacgaagatacttctttttcaaccacanaaagatgtttctgggcccgcacggnagcgggaaaaatagtggncgcagctttcgatttcaagcgcagggcgcggctctgcgcttag

SEQ ID NO: 19820 - DNA, 687 bp, A.fumigatus
caccccacaacatttcgttacaatgagttggtaagagaggggatcaatccggctgtacttaggcagctctacgaggaagttggaatcagagtccttacaccacaactagagggtgtatctccagctatcaatccgcctaccaaacctgttgatgtcccaggaaaaccggctggtgccggtcttgactcggcttcgagcagcagtgttgataatggacctgctcctgtggcgttggatcgctctaaaggagaaacagaaaccccagtggcagcagcagcggcaaacgcacctgcccctgctcctacctctaccatccagcacagcaccactgcgaaaccattggaaaggaaagaagtcattgcgcgtatgcttgctgcgaaagctgccaagacttctggaatgccctcaacccctcaaactgactctgcaaaagaagcgctatcgtccgaaagctcggtctctgccctcgttggcaaagacacgcctgcgagttctgggcgtgaaacccctcctaaggagaaggacatacgcacaagagagaagaataaggcgaaaccagaactagcccgacagcgaatcgagcagctcaagaagcagggtttggtgagaagtcagcaaaaagcgcagatagatcccatgcgtcgtgatgaaatgtcttcaccacggggctggaaggtccgcgcagga

SEQ ID NO: 19821 - DNA, 681 bp, A.fumigatus
aggcaaaacttacttcaaaggcagaggagggacggggccgctggcattcccaaaccagacgatagtacccttcctcttgaccacctccagacttccttcccaggtatcctttccgacggaatcatagacgacatccacaccccggccgccagtgatctccttcacctgcttcacccagtccttcccctcttcactgcggtagtcaataacatgatccgcaccaaggcccttaaccagctcgaccttctcaggaccacccgcagtgccgatgacatgcgcgccgatcgacttgaggatctgcgtcatgagaaagccggcaccaccagcggcagcatgcagaagaacccagtcgcccttctgcacggcgtaggtctccttcgccagcgacaagacagtcagtccgctcaggaacgaagccataacatcctcatccgaaatgccgtcggggattttgactgccttggccgcagggacggcagtgtactccgcatatccgccagtgctgagccaggcgacgcggtcacccacctggaagttgtagtggtttggtccgggccccagggcgacgacggtgccggcgccttcgcgacccagaacttcaggctttggggcggggtagagccctgtacggaaataggtgtcgatgtaattgattccggagatgttgttcttgacgagtaa

SEQ ID NO: 19822 - DNA, 204 bp, A.fumigatus
caagagtgctatggtttgctacccaatcttctgacgagaggtaacacaaacgtcgtcactttgcagggcacattcgacaatggactgagcaagtccaacgaaatatcggcatcatatgcttggtcttttcctcatccaggattgattaacgatccattcttcagtggccaacaatcgtcgatgacggcactgaaaagaggctga

SEQ ID NO: 19823 - DNA, 1551 bp, A.fumigatus
  unsure (1136): Identity of nucleotide sequences at the above locations are unknown.
gagaaagttttgtctgccctgttactcccttggaagtcaccacacatctaccttggactcatcgcggccaacatgcctcgatttgggcgcaagcggtcccaatggccgccgcctcccatggtggaggacgaagccatctcgctctcccgggagctccacgggatgtccatactaggagaaaagcctggggtggaaggagtccgtgcccgaggaaccattgaccaataccctgtcatcctggatgcgcccatttccgagtctgcaaagcctaagcagtatggcctggatgagtgcagccgtgaaatcagttcctcagatgacagcgcaggaccagccacgccacctgaaagattcgtacaggatccacttattcgcgtcgctgatgattcccaggaattccacttgacggctccaacggtgcctgtcaccttgccggtcaaggagaccaggcctcaaaccaagccaaggaaggaggatcgtcagccgcccaggatcttccaggacaccagcagcagccgccaaggaacggagccgagtcagaccattcccaaaccccaaagtagaacagggaagacgagcattgatgtgaaagcgaccactcaaatccctactcgcaaccccgagcgtgtctctgtgcctgtaaggaacggacaaggttccctggggatgcctgtagagaagactacttctgccgcagtcccaaaacgctccggtagcgtgagggatgggcgtcgacagtcccccggcgagactcaacaaccgcgctcatcagccgggtacgtctctgcatcggcagcaaacaaggccccgatggatcctggaaacgcgcaccaggagccgccttcgcagacaagcaagagagctcatgctgtcccttccatggtccctcctacgagatcaggtttggctgaaaggttggaagaaaaattgagacagcgacagaaagttcgcgagtctggaagttctagtcaaccaagcgaactgcctcttggtcgtcctacgggccccaccgaaccgtcgtcctccgagcctcctcgagcttgtcggtgcaatgcacctcctgagacagtgccaggagctacttctcgcggaactcgttttagggctttgtccaccccagcgaagccggcgccggntgctccccgctcagatgaagtcgatccgtttcctgcttcactccgtactgcgacgtcggaaccagtgcctcctgtatcatctcagtcgacgacgaaacggacagtatcattttatggcgagcaggagcatgggcaagagcgcgagaaatcaagatcctcaagacggcagagtccttccaaagcagtggttcgccaaccttccccggaagaagctggcccctgccttctgccttgtccacggtctgtccctgtgaccgggtaccaggactggtataccattaaagggttggaacatctcgacatctgcccttcgtgcacgaaacagatgcgtaattcacgattccaggatctgttcatccctagtttaccggttccacgtgtcgtcttcaccacggggctggaaggaacagcgctc

SEQ ID NO: 19824 - DNA, 312 bp, A.fumigatus
ccgggcgtccaactggcgtgcgcaaagtcaatgaggcggaggtcgtgcaccttgggagggtcatcctcttcctcctcgtcttcaaagtctattcctcctaattgtgccgtctctggaccgaggttcatattgattgcctgctgcgggattccctcttgtccaacccgcaggttgacgacttcgaaggagccatctccctgcagagcgaagtcaaaatcctcgtcctcttcatcggcctcttccggtgatctgtccctgggtttcttttcttcttctagtgcttgttccatcgcctctgggtcaccttcgtag

SEQ ID NO: 19825 - DNA, 912 bp, A.fumigatus
cggctgaacaggacctcctacttcccgtactacttcaaccccgaaaccgaggacatggtcaagctggccacagtcacgatatggaactttctcacgtacatcctctaccacgacgtagccccagagtacaaagcgaacatcgaggaagccaggaaatcctgcgacattgccggcaaagagctctggaaaaaccagcagttcacatccaaaggaccaggagacttcaataccgcttgctctaccctcttcggcggcgtcttttttgatctctacgttgaaaacaaccagtggaacaacagcaaggacgataccgtgcgtatgaccaatgggatcgcccgtaaagttgtcaagttcgctctggcaggcgctggtattgatagacaggttgtccagttccaagagcttgcaaacgaagacgcactgcgggcgatgcgggtccaagacatcgatggctttgaagtcaccgccatcatttttccagacggtgagactaaggagttctaccaggtgcacgctccagatctccaccccgttggaagaatgctggcaaaggcctaccgcgaccccggcaaacctgacattgatctcagccctgaggagagacttcaatgggaaaaaggcggtgcacccgcattggagtttgacttcttccttgaagagactttgctaaagttttgctatcctggaatgaaggtcataacggcggtttgggaacttaactgtggatttcattacttcgacgagatttccacagcctactgttctatttacaccgttctagccaatgacttgatgataggttggaagaaaccgaaggatttacgggtgggagacgatcgtgaagctgacgagacattcgatgaggagggtaagggttcaaagagaaaggaaacagagggaccaagctgttga

SEQ ID NO: 19826 - DNA, 249 bp, A.fumigatus
ccttcccgatcatgtaccatcatatttcggtgcctgttgagcgttgacatgttcgaagcatcgccactcattttcacagtcggacatcaagctcggccggacatctgtacatggaagttcgattcgctgcctattaacgcccaactcctgagtctgtgctctgatagggccgccaagatgaaacacactgcccaactaggccctttacgatatttatataccaagctctctgccgctggctcttgttga

SEQ ID NO: 19827 - DNA, 969 bp, A.fumigatus
ctcagacttactagcctcactatcctctcctcccatcgaatgcatctctcccgcaccttcgtcccccgcctcagtaattcccttgcggccacatctcccgcactcgtccgtctctctggcgttcgttgtcatctccaaccgtcatttcggccgacagcctcactcagaagttcatcccaaccacacaccatgtccattccaaccactatgaaagccgtcctgatcgagaagactggtggtcccgaggtcctcggcttcaaaactgaccatcctgtgcccaccccgcaagagggccaattactcgtcaagaacaacatctccggaatcaattacatcgacacctatttccgtacagggctctaccccgccccaaagcctgaagttctgggtcgcgaaggcgccggcaccgtcgtcgccctggggcccggaccaaaccactacaacttccaggtgggtgaccgcgtcgcctggctcagcactggcggatatgcggagtacactgccgtccctgcggccaaggcagtcaaaatccccgacggcatttcggatgaggatgttatggcttcgttcctgagcggactgactgtcttgtcgctggcgaaggagacctacgccgtgcagaagggcgactgggttcttctgcatgctgccgctggtggtgccggctttctcatgacgcagatcctcaagtcgatcggcgcgcatgtcatcggcactgcgggtggtcctgagaaggtcgagctggttaagggccttggtgcggatcatgttattgactaccgcagtgaagaggggaaggactgggtgaagcaggtgaaggagatcactggcggccggggtgtggatgtcgtctatgattccgtcggaaaggatacctgggaaggaagtctggaggtggtcaagaggaagggtactatcgtctggtttgggaatgccagcggccccgtccctcctctgcctttgaagtaa

SEQ ID NO: 19828 - DNA, 1389 bp, A.fumigatus
gtatctatccgctctcggctcaccttcctcgcccacgtcatcatatctcagcctctcgagcggctgtattatcctgcattgagcatccaatcattgtcagcgcagtacgcttcgtgcgcatatacagggtcgcatgactggtctaacacctttcactacagtgacggtgtgcgttgcactacctccggttccttcattgcgaaaccttgcactccccaagaagttgcattctacgaatctagcgcctttcaccccgcctttcgagacttcattcccacttacatcggaaccttatcgtctgccgaccagcaaggccccttagcgctcactgctgctgctcaacagagtggagctattgttctacccaccgcggacgactcatcatcatccgccacgccgaccaccgcggaggctccgcagcttggtttacaagcgggattaggatcgaacggcacaactgaaaacaaaccttgggttccctctggcggaaaaaagcttgaaacggggctgtccatagtcctagagaatatcgcctccgggttcaaacgcccaaatgtcctggatgtgaaacttggcgcgcgactgtgggctgatgacgcgcctcccgctaagcgcgccaagctggaggctgtggccaaggagacaaccagcggtagtctcggatttcgtattgccgggatgaagatttggaccggtgctcatggggagacggacgagggcagcaagacaaatccatacgccaccaagcatgaggggtccgagggtgccaggggtaaaatcgttgaaaaagacggctataaacgctatgacaagtggtacggacggtctttcaacgagaagaatgtgaaggaaggctttgagacgttcctcgccggcgcaaaggctggccctgttgatcggtccaaactaatcgccaagagacttgcggacgagctgaggcgtgtgcagtcgatcctggagtcggaggagagcaggatgtattcatcgagtgttctcattgtctacgaaggtgacccagaggcgatggaacaagcactagaagaagaaaagaaacccagggacagatcaccggaagaggccgatgaagaggacgaggattttgacttcgctctgcagggagatggctccttcgaagtcgtcaacctgcgggttggacaagagggaatcccgcagcaggcaatcaatatgaacctcggtccagagacggcacaattaggaggaatagactttgaagacgaggaggaagaggatgaccctcccaaggtgcacgacctccgcctcattgactttgcgcacgccagttggacgcccggtcagggcccggacgaaaacgtcctcatgggagtccggagcttgatcaggctactcgatgagcttgctgtggaataa

SEQ ID NO: 19829 - DNA, 279 bp, A.fumigatus
agtaagttttgccttcatgtttttttctggtttggacatggactgaccctggatagtaaactctcccccaagtgtgtcaaggttgcccgtcctcaactttttggctacattgagactcgcgaagaattcgaattctatgtcaatgagctcttccacctgctccagtctggccagctcaaggtcagaattcacaaggtttacccgcttgagcaggttcaacaggcgcatatcgaccttgaggggaggaagactacgggaaagtctctcttgaagccatga

SEQ ID NO: 19830 - DNA, 543 bp, A.fumigatus
gtattgacgttcctcgcaccagcccctcatattaaactctacggctatgaagctacacaacgctccttggagcgaatcctctatgtctgggccatccgacatcctgccagcggctacgtacaaggaatcaatgaccttgtcactccattttggcaggtttttctcggcatgtacatgacggatctcaatgtggaagaagacatggatccaggccaattgccgaggagtgtgctcgatgctgtggaggcggattcattctggtgcctcacgaaacttcttgatggaattcaggataattatatatatgctcaaccggggattcacaggcaagtgagagctttgcgcgacctgaccatgcgtatcgattctacactcgccaaacatctagaaaacgaaggagtcgaattcatgcaattcagtttccgatggatgaactgcttgctgatgcgggagatgagtgtccagaacaccatacgaatgtgggacacctacatggtatgttcgagagtccgagcggcgctcataacatcggaatcatattaa

SEQ ID NO: 19831 - DNA, 2502 bp, A.fumigatus
tacatgccttccactcctgtatcttggagatgcgttgttcatcgggtttaccccccgttgttttggacagacgaccgacttgattccttcgccacctatagggaagctcgagaacgtcaagagcgtgaagaatacgaacgcaaaaatccgaaaatccaacaacagttcgccgacctgaagcgctcactggcctctgtttcagaagagcaatgggccaatcttccggaagtcggagacctcacggggaagaatcgaagagctaagcagaacctgcgacagcgcttctatgcggtaccagacagcgttattgccagtgcaagggactccactcagttcgaaaccaccatagccgatgacggtacccagacggatgttcgtggaggcgcggcggacggcacaatgacgaactttgcggatattagtgctgcccgtgataaggtgcttaaggtcaggcttgatcaagccgcccggggttccactgctgattcctcctccgggagtgcgaccaacatcgacccgaaaggatatctcacaagtctgacgcagtcggagctgaaagcgggcgaagtcgagattggcgacatcaagcgagtgcgtgtcttattggaatctgtaaccaaaacgaatcctaagcacgctcctggatggattgcacttgcgcgattggaagaacttgctggaagaattgtggccgcaaggaacatcattgccaagggttgcgaactctgcccgaagagcgaggatgcctggctcgaaaatattcgtttgaacgaaggccacaatgccaaggttattgcagccaatgcgatcaagaataatgaccgttccacaagactttggattgaggccatgagactggagtctgacactcgcgcgaaaaagaatgtgcttaggcaagctattctccacgttccccagtctgttaccatctggaaagaagctgtgaacctggaagaagatcccgccgatgcacgtcttttactagcgaaggcagtcgaaatgatccctttgtctgttgagttatggcttgctcttgcccgtctagaaacccctgaaaatgcacaaaaggttctgaatgctgctcgcaaggccgtccctacaagtcatgaagtttggatcgcggctgcacgattacaggagcaaatgggcactttcgataaggtcaatgtgatgaagagggcggtccaagcgctggcaagggaaaatgccatgcttaagagagaggaatggatcgcggaagctgagaagtgcgaggaagagggagccattctcacatgtggcgcaatcatccgcgaaactctcggatgggggcttgatgaagacgatgaccgcaaggatatctggatggacgatgcgaagggcagtatcgccaggggcaaatacgagactgcaaaagcaatttatgcttatgcattgcgtgtctttgtcaaccgtcgatctatttggctcgcggctgccgacctggagcgtaaccatggctccaaagaggcgctctggcaagtccttgagaaggcagtggaggcatgccctcaaagcgaagagctgtggctccagcttgcgaaggagaagtggcaagctggcgagatcgacgacgctcggcgggtgctcgggcgggctttcaatcagaatccgaacaatgaggacatctggctcgccgctgtcaaattggaagcggacgcggaccagacagatcaagctagggaacttctcgcaacggcccgacgggaggctggcactgaccgtgtttggatcaagagtgtcgcctttgaacggcaattgggcaacattgacgaggcgcttgatctggtgaatcaggggttgcagctgtatcccaaggctgataaactttggatgatgaagggccaaatctacgaataccagaacaaatatccacaggccagggaggcctacagtactggtaccagagcttgtcccaagtcggtgccgctttggctcttggcctccaggcttgaagagaagtccggtgccgtagtcaaggctcgttcagttctcgatagggcacgccttgccgtcccaaagagcgctgagttatggacagagagtgtccgtgtggaacggcgtgcaaataatatcggacaggccaaggtcctgatggccaaggctctgcaggaagttccaacgtccggtttactatggagcgagagtatctggcatcttgagcctcgggcgcaacggaaggcccgtagtttggaggcaatcaagaaagtggaaaacgatccgatcctgttcatcacggtagctcgtatattttggggtgagcgtcgactggaaaaagccatgacgtggttcgagaaagccatcgtctcggacagcgatcacggcgacggctgggcttggtactacaaatttctgctgcagcatggtacagaggttcgttcatcgtcatccgtctctgatttactgcaatcatgtcgtacgactaacgcgactcctcgtacaggaaaaaagagcagacgttgtggccaagtgcgtctcaactga

SEQ ID NO: 19832 - DNA, 237 bp, A.fumigatus
gcattaatatgtgctcttcacttgtttcctggagttcttgcgcggattgctgaccttcctcgaagacgggctggctctccattctggaaaggcagatcagtgtctcaacctcaaggaccttcagctaccgcaactacgatcgttggcgcttcatactctcacgcgaatatcttaaagtttgtcatctctcagtctgctctgtcctcggcttatgaactgacgaagagcaatctttaa

SEQ ID NO: 19833 - DNA, 474 bp, A.fumigatus
gcccctctagaagcaacttgctatcaggtgctgattgtcgctgctttagatcccgcgaacgctttaaatttgattgatcatgcaccgccgccgaagaatgggtcgccaaaggaggtggaaatatactcaagcagaatctcaagaatcaacaaatttaaacgtctacttcagactagcaccgtttccttatcagagctgagaaatctggcatggtctggcatccctgcggaagttcgcgccatgacttggcaaatcttgctcggctaccttccgacgaacagtgaacggcgagtttctacacttgagagaaagcgcaaggaatatctcgacggagtccgacaggcttttgaacgcagcactaccccatctcctggcaatccacaagcttcctccacaggtcgcggcagaggcctggatgaagcgatatggcatcaaataagtattgacgttcctcgcaccagcccctcatattaa

SEQ ID NO: 19834 - DNA, 480 bp, A.fumigatus
gcttcggtcgagatggcctcgggtcggaaggatttcctgaaccagcctgcgcccgaaaattatgtcgcgggcttgggcagaggtgcgaccgggttcaccacccgttctgacctaggacctgcgcgtgagggtcctacacctgaacagatccaggccgctcttgcaaagagagcgcaacttctcggagcagcccccccaaccgcatatggtgcaggacgcgaaaaggggggacgagaagagaaagaggaagaagaggaggatgaacggttccaagatccggacaatgaggttgggctttttgcctacgggcaatttgaccaagaggatgacgaggcggaccgaatttacaaagaagtagacgagaagatggataagcgccggaaagcaagaaggttagtacatgccttccactcctgtatcttggagatgcgttgttcatcgggtttaccccccgttgttttggacagacgaccgacttga

SEQ ID NO: 19835 - DNA, 402 bp, A.fumigatus
gacacgcactcgcttgatgtcgccaatctcgacttcgcccgctttcagctccgactgcgtcagacttgtgagatatcctttcgggtcgatgttggtcgcactcccggaggaggaatcagcagtggaaccccgggcggcttgatcaagcctgaccttaagcaccttatcacgggcagcactaatatccgcaaagttcgtcattgtgccgtccgccgcgcctccacgaacatccgtctgggtaccgtcatcggctatggtggtttcgaactgagtggagtcccttgcactggcaataacgctgtctggtaccgcatagaagcgctgtcgcaggttctgcttagctcttcgattcttccccgtgaggtctccgacttccggaagattggcccattgctcttctga

SEQ ID NO: 19836 - DNA, 222 bp, A.fumigatus
ctaatactggcgggagctttagcggtcggttgtgtctgtgtctcctccctctcgacctctcttccctccatcatcacttccaaccaatccaaccgctctccagtatcttcccttccacttcgctgtcgactgattttaccttcttccttattttccccctttcttttccttcccttctcattcattatcgaacgtaacgactattcgtcacacttcatctag

SEQ ID NO: 19837 - DNA, 324 bp, A.fumigatus
ttttcgatggcgttttctaactcctttcttcccaggtatgacgcggatgagaatacgaaccatgcgtcttcagctcccaagattcccgactccacagtgtcacccgcgcctgcccaagaaacgacttcccctgcgacacaaactgcagagaattccaagtcagaaccagaagacggccataccgcggattcctccgcgtattcgtatgatggacatcaaggaaatggctcgggcatgtatgatacgaaccatactaccaacgttactgccgctcctacaaccgaacaagagcctcagggcaccggaatcaaggaagatgggtaa

SEQ ID NO: 19838 - DNA, 726 bp, A.fumigatus
ttaccgcaacttacgaattccctcctcgggcttgggctcaatgccagcaacctcggcagcagtcttggtctctgccgctgtcttgtcttccttcatgaaggggaaagcaagaacctccttgatgctgtagttgtccgtgaggaacatgaccagacggtcaatacccataccccaaccaccggtaggaggcagaccatactccaaacttgtgcagaagttctcgtcgatgagttgggcctcgtcatcaccctggtccttctgtctggcctgctcctcgaaacggagacgctggtcgaaggggtcgttcaactcggtgtatgcgttgacaatctcctttttgcaaacaaaagcctcgaaacgctcgcagagaccggcgtgctgacggtggtacttggcaaggggagacatcatctgggggtggccggtgatgaaggtagggttgacgcaggtctcctcgatgaactcgccgaccagcttgtcgagcatacgggcgttggtcagaggaggcgagcattcaacaccagtcttcttaagcacgcgcttgaggaactcgccagtttcggcggtgtgcagctggtctccaggagggaacttctcgcctgtggcctcctccaatgcgggaatcatctccacccgcctccagggtgccttccagttgacgttgtagacctcaccagactgagtgtggaaggtggtctcatagccaccggtaacgtgcttaactag

SEQ ID NO: 19839 - DNA, 633 bp, A.fumigatus
gccccagtagaactcgcaatggcgaactcccggttgtgggtcagatcaaagcccttcgttacggaactgacgaccaagctaacatacacgttccagaccgccgacaatcagcatcttcaggtacagctcggggggaacacgcatgaacaggttcatgtcaagatcgttatggtgggtaatgaagggtttagcggtagcaccgccggcgatggcgttcatcatgggggtctcgacttcgatgaagtcccggctatcaaagaagttgcgcacgtatctaacgatcttggagcgagtgacgaagacattacgagatctctcgttcatgatcagatccaggtaacgttggcggaagcgctgctccttgtcctggaaaccgtagtgctccgaaggaatggcgtgcaagcagggcgccaggagaacaacctcagtggcgaagatagaaagttcaccgtcggcgcggttcttggggctggtacggccagggaaaccgacaacaccaacgatatctcctctgcgcaggtgctcgtgctgagcctcgaaggagacatccccgctggcgttctgggcctggcacacaacctgcaccttgacaccttcggcacggatatcgtagaagaagagcttggagcctga

SEQ ID NO: 19840 - DNA, 198 bp, A.fumigatus
ttcattctcaatgactgtaatcagttcttcacggcatttggagaaaagtttcgtatgtacactctgacagatcgagtcgatgaaccgggaactcgctatttcatagtagccacgagtcgtctgaggactattagcaagtcacttgaactcaacctcaccagcaagatagaactcaccgccatcattttgagctcttga

SEQ ID NO: 19841 - DNA, 243 bp, A.fumigatus
tacctggctgcgaaagaccttgaatctcagatggacgaaagcggtcagatggctgtctacggagtattttctgtggatgtcgaagctccccgtgacccgtggttcaccaaagcggatccttgctactcccgacttgttctagtcaacctaaagttagtgcctaaggaaccaaacgaggtacctgtggtgggcctggaacagagtgcgtggtcatctgggggcatcactgcagtccaagcataa

SEQ ID NO: 19842 - DNA, 1509 bp, A.fumigatus
tgttcccaaggtgggttacccctccttacttttccccctcactcagagagtgtagctgactcaagggtcattgaactcgatcagccccttttcgaagttgccggtcatcccattatcaatcactgcctcaaggcacttgccaaaatctctgatatccgagaagtcatcctagtcggctactacgatgaatccgtcttccgtgatttcatcaaagactccagcaaggagttcccccagttccgaattcaatacttgcgtgaatacacggcacttggtacagcaggaggtctctatcatttccgtgatgccatcctcaagggcaagcccgagcgcatcttcgtcctgaacgccgatgtctgctgctccttccctcttggtgagatgctgaagctgttcgaggagaaggacgccgaggcggtgattctgggaaccagggtcagcaacgatgccgctaccaactttggatgtattgtctccgattctcacaccaagcgcgtgctgcactacgtcgaaaagccggaatcacacatctccaacctcatcaattgcggtgtctacctctttgctaccgagtgtatcttccccgccatccgcagtgccatcaagcgccgtactactcggcctcgtctcctctcatacccttcctcggaaaacctggaggcttccttcgttgccgccgacgaggagacggagaagagcgaggtcctccgcctggaacaggacatcctctccgacttggcggacagcaaccggttcttcgtccatgagaccaaggatttctggcgacagattaagaccgctggctcggccgtccccgccaatgcgctgtacctgcaaaaggccttccaggcgcaatccgacgaactcacccctccctccgccacgatcgtgccccccgtctatatccaccccaccgcaaccgtagacccgaccgccaagttgggacccaacgtttccattggtgcccgtgtcgtcgtcggcgccggagctcgtatcaaggactctatcgtgctggaggatgcagagatcaaacacgatgcgtgcgtgatgcactcaattatcggctggagcagccgggtgggcgcctgggctcgtgtcgagggaacccccatccccatgacaagccactccaccagcattatcaagcatggcatcaaggtgcagagcatcaccatcttgggtaaggagtgtgctgtcggcgacgaggtgcgggtgcagaactgtgtgtgtctgccatacaaggaactcaagagggtatgttatttggctcttctgcatttcttgacgacactaacgttggtgaacaggatgttgccaacgaggttattatgtagtgagacattcaaaaaggactgctcaaagttggatctattcgatggattatacatatttctcgttaccactaatccgttcgactcttctatcaatacgctttactctaagccattttcttggaccttagacaacgttgaccatctgggcgcgaggacagcgataattttagtataa

SEQ ID NO: 19843 - DNA, 723 bp, A.fumigatus
ctcctcgtctccgcattcctttctatcctcaattacgtcttcaccagcctcacccattgcttctatggcctttcgccacgcctctctctcctctccaataccatcctcctcatcctctggctcatctcccttggcctcttgagctggagcatgtcccacaccatcctcaccacctgcaacgcaacctactgggccacctccaccggcatcgccgtctgccgcacctacaaggctcttttcaccttcacctgcaccagcacatttgccgccattgccgccgtcgcgctcgacatcatcatccacaagcgccagacccgactaggccaatacgaccccatgaccagcaacccagacatcaagctgcacgagcgcaacaatagcgccgtgacaaacaccaacgccagtgtcccactcgacgacgagcggcacccgctccaggctcagcatcaattccacgacagcccctacacagatcgtcacggaatctccgacatcccaggctccggttatgcggatcaccccgcgtaccgggtaccgccgcctgtgtacgggctgagtgcgtcagcagagcattaccatgcgggtgaggcgcacgagttctcggagactgcgccggcgagaagtcagcagggtgggccgcgggttcggttcagtggtgttgggcgtccggagtatggctatcctgcggagcagaaggcttatgattccgggacttatcggtga

SEQ ID NO: 19844 - DNA, 2196 bp, A.fumigatus
cctgttgcagctacaagaaacaacacgccagtcgtcatgtccggactaccgtcgtccgaaacagaggcaataaatcttattgcgcgggacatgaagtgtctggtcaagaagatacaggacctccggcacataggggtcgaagacagcagaatcgctctcccgaaaatatgcgtcataggcgatcagagtaccggcaaaagctccctaatcgaaggaatgagccagataaaggtgcctcgcagtgctggaacatgcactcgctgccccatggaaataaacctctcagaaggcgagccaggtcaggattggaattgccgcatctttctgtcacgaaaatacatcttcgacggctcccggaaggtcactaaactccccaagaagtcgcagcctctgggaccatggattgaacaagaccaggaagatgagcactttaccgatgtgagagataaagatggtgtacaagcggccattaagtgggcccagctcgccattttgaacccaggaaggccttctactgactaccaacccggacataatggcgatacggacgagtcttattgtcaagtgaagttttctccgaatgtcgttcggctggacatctcggcgcctaactttcctaatctctccttctacgatctacctggtgtcatcagccaggcggaacacgatcatgagcgttaccttgtttcgctggtggagaacctcgtgagagagtacatctcgcaggaaaattgcattgtgttattggcactgccaatgaccgacgacgccacgaattcaagcgctgcaaaaattatgagggatgtccctggcgccaaagaaagaactcttggtgttctcacaaaacctgatcgtatccagacgggcgaatcgtatgatcagtgggtcgaaattctggaaggagacaaatttgcgcttggtcatggatattatatcgtccgcaacaatcccaatccgcccatcgagcactctcgcgcgagagaagaggaggctgtcttctttgcaaagattccttgggcaacagacctatccgcctatcaaaacagattcggaaccaggaacctacaatgggggctttcaagtctccttctggagcagatacaggggtgtctgcctaggattgtcgagcaaatcaatgagaaagccgcgcgcatggaagcagagttacagactttgccagatcccccgtcagcaaatgttccatacatcctttgtggcaaattgaaccatctcaaggatcagatccgtgcccatattgacggcggctcagctcagtatcccctccagaagatatggggcaacattgccagggattttaaaagagctctgctgaagacccggctgactgttcagcttcttgcccattcggacaaaatggccattcccattgcgcgcgaggacgccgactctgactgcgagatgacctcaatacagcgatcagtgagcgtgaatctgaaacgcaagaccccatgcgacaggcttactccaatacccgcggatcccaagccagaacagccctcgactccgaggccttcaggttactatacagagcactttaatcgatttgaacgtcccgcacgaatgttcacttgggaagaaatcagagaaattaatgaggattcttaccgtgctggtattcccgaccagacggaccccaaagccgtggaagtcatgaaccagctcagtgttgagcactgggacaagccaatggaagtgttcttgggggccactcaccagttggtgagggacatgatgatgagacagctcaaagacgtttttaggccatactatcaaaccagtctgtaccgggaactgaaacgaatcatagacaactaccttcaaacgcttcgcaaagagcacttcagacacgcgcaagagaactacaatattgagcataacaagccttttaccatggcaatttccgcgctcgagcaagccacagaaaatgcgtacaagtatctgaaagctcgccgacatgaagcaaggtcgcactgctttctcgatcttcaaggcaaaatccctcggggagacccgcgccgcgatgctgaaattaagaaactcactgctgcggagctcggccctgacggattcgttcaagagctcaaaatgatggcggtgagttctatcttgctggtgaggttgagttcaagtgacttgctaatagtcctcagacgactcgtggctactatgaaatag

SEQ ID NO: 19845 - DNA, 234 bp, A.fumigatus
cagaacccagctgtcgaacgctgcatggagttgatggcagaagatcccgaacgccagcgacgccgacagtacttgttgaaggagaaagagaaggtcctcaaggctcaggaatggctcgcaactgctaagaaggaagacgatgctatggactctgcagactctgactcgaccattaagtctcaaccacccgaagactggtccagttttcccggatttgggcccgtagctggctga

SEQ ID NO: 19846 - DNA, 519 bp, A.fumigatus
aatatttttcttggatatagcaatacttcgagatccgtagcaagcgaatcaacaagctgcgcgagaccaagcagcccgacccctaccctcacaagttccaggtcaccgatgacctgcgtgaatacctcaagacctacgatggtctcgccaagggcgagcagaagcccgatgtcaccgtccgtatcgccggtagaatctacaccaagcggtcttcaggctccaagctcttcttctacgatatccgtgccgaaggtgtcaaggtgcaggttgtgtgccaggcccagaacgccagcggggatgtctccttcgaggctcagcacgagcacctgcgcagaggagatatcgttggtgttgtcggtttccctggccgtaccagccccaagaaccgcgccgacggtgaactttctatcttcgccactgaggttgttctcctggcgccctgcttgcacgccattccttcggagcactacggtttccaggacaaggagcagcgcttccgccaacgttacctggatctga

SEQ ID NO: 19847 - DNA, 885 bp, A.fumigatus
ttgtcggcggtctggaacgtgtatgttagcttggtcgtcagttccgtaacgaagggctttgatctgacccacaaccgggagttcgccattgcgagttctactggggcttacgctgatgtctacgatgttatgaacctgaccgaggagctgatctccggcctagttaagcacgttaccggtggctatgagaccaccttccacactcagtctggtgaggtctacaacgtcaactggaaggcaccctggaggcgggtggagatgattcccgcattggaggaggccacaggcgagaagttccctcctggagaccagctgcacaccgccgaaactggcgagttcctcaagcgcgtgcttaagaagactggtgttgaatgctcgcctcctctgaccaacgcccgtatgctcgacaagctggtcggcgagttcatcgaggagacctgcgtcaaccctaccttcatcaccggccacccccagatgatgtctccccttgccaagtaccaccgtcagcacgccggtctctgcgagcgtttcgaggcttttgtttgcaaaaaggagattgtcaacgcatacaccgagttgaacgaccccttcgaccagcgtctccgtttcgaggagcaggccagacagaaggaccagggtgatgacgaggcccaactcatcgacgagaacttctgcacaagtttggagtatggtctgcctcctaccggtggttggggtatgggtattgaccgtctggtcatgttcctcacggacaactacagcatcaaggaggttcttgctttccccttcatgaaggaagacaagacagcggcagagaccaagactgctgccgaggttgctggcattgagcccaagcccgaggagggaattcgtaagttgcggtaa

SEQ ID NO: 19848 - DNA, 327 bp, A.fumigatus
ttcaacatggcggattccaacgcagtcaacgaggttgaggcctccgtggccaaccttttgctcgatgaggtcacgggcgagagagtctctaaaaccgaattgaagaagcgccagaagatgcgcgagagggaggcgaagaagaaggagaaggaggccaatgcccctcctaagcctgagaagaaggtctccgctgaggaggaagaggctaacttaacccctaacgtatgttcgatttgcactcgtcgaaatctaagtggatattcgaggctgtcgggattcgttgctaaaatatttttcttggatatagcaatacttcgagatccgtag

SEQ ID NO: 19849 - DNA, 747 bp, A.fumigatus
caatacttcgagatccgtagcaagcgaatcaacaagctgcgcgagaccaagcagcccgacccctaccctcacaagttccaggtcaccgatgacctgcgtgaatacctcaagacctacgatggtctcgccaagggcgagcagaagcccgatgtcaccgtccgtatcgccggtagaatctacaccaagcggtcttcaggctccaagctcttcttctacgatatccgtgccgaaggtgtcaaggtgcaggttgtgtgccaggcccagaacgccagcggggatgtctccttcgaggctcagcacgagcacctgcgcagaggagatatcgttggtgttgtcggtttccctggccgtaccagccccaagaaccgcgccgacggtgaactttctatcttcgccactgaggttgttctcctggcgccctgcttgcacgccattccttcggagcactacggtttccaggacaaggagcagcgcttccgccaacgttacctggatctgatcatgaacgagagatctcgtaatgtcttcgtcactcgctccaagatcgttagatacgtgcgcaacttctttgatagccgggacttcatcgaagtcgagacccccatgatgaacgccatcgccggcggtgctaccgctaaacccttcattacccaccataacgatcttgacatgaacctgttcatgcgtgttccccccgagctgtacctgaagatgctgattgtcggcggtctggaacgtgtatgttag

SEQ ID NO: 19850 - DNA, 2670 bp, A.fumigatus
gcccatggctggttcctgttccataagaggtattggttgttaagttggattcgcatggcatcagactcacgctgtctctgttctgcctcaggctgcaacgatctccgcctccgctctggtagcctcttgattgcagctggcgagccaccacggagtacgataaaccgcgaaccgcgaagctcacgacgggtgatttgctgcatacgcagctctttcacgatgtctgacgacgcaaagtccaaggtttttccagatatttccgccaaactctccgcccttcctaagaaatctctcttcgagcgtcaaagggccgaagccgaagccaagcgggcccgagagcaagcagagacagctgctgtttatgaggattttgtcaagtcgtttgaggatgattctggaccatccgatcgaatcacaaccggaggtagaccgaacaacacctttggaggaagaagtgccgcgcttggaggtggacctgcgaaacgccattttaccagttctggtcctagaagcagcggtccggggactctaggacctccgccgtcatcgctatctcgcaaacgcactcatgaaggattccaaccgttccagaggaatagagagtcagcgcagggtatcctaggattcgacaacactggctcagcatcgtcccccgctgcgttggcctttcgcacttcggacgacgaggaggatagggtagccgatgcaaaagaggcagagagagcagcggcgaaacctacgctttatctggcttcattacctcctgggacatctccctctgcaatcaaatcgctcattccgtcagtgttatctgtcgacaacgtgaaaatcctccacccctccaaccagtccccgaccgatcgcaagtcgatttccgccattgtcactcttgcgaatgaatccgctgcttcggacatagactctaccgttagtgcactacaaaacaaatacttaggatggggatactatctttcgattgcgaggcatctctcctctgccgcgatcagttcctcaatgccagtcaccgtgggtccgtcgtctacaagctctcttccattcggtgcaaagaccattactcccgagtatggaggtcgcttgaaccgtgcgccacctcctgggtctcaccgtggtggcttcgcgccccctgcctcgtatggagcagcgtatggtcgcagtgggcccgtcacgcaggtggaagtgaaaacaccttcagatctgaagcagctcaggctgatacacaagaccttggaaaatctattgaattacggcccagaatttgaggccctactcatgagtcgaccggaggttcaacgagatgagaagtgggcgtggctttgggatccgagaagcgccggaggagtgtactatcgctggaaactatgggatatcctcactaacagcagtcctaaaggggctcggcgtggtaggagtcgaaatgcatcgatattatttgagggtggcccaagttgggtatcgccggacacgggcatcaagtttgaatataccacacgcatggatgaatttgtttccgatgaggattacaattcgtccgacgaagagatgtcagacggggaggacgagagacggcacctagggggcgctccgccagccgacggagccggtactggtaacgaaggagtcggttacatgaacccgctacagaaagccaaactcacacacctgcttgctcggctcccaaccactcatgcgaagttaaggaaaggtgatgttgcgcgtgttacagcttttgccattggacatgctggcgcaggggcggaggaagtggtggaaatgatcgtgtcgaacatcatgaacccctttgcatacactggggccaatcctgaccgcgagattgaaaagggtctcgctcggcaggaagcctccaagaatgaatctagtcatgcttcggttgaaggggcctcgtcattatccaaaacgaacatggatacatcttccgccaagttggtcgggctttaccttgtgtccgatatcctttcatcatctgccacgagcggtgtgcgccatgcttggcgctatcgacagctctttgaatcggcattaaagtcccaccgggtcttcgagcacctaggtagacttgaaaaagacctgaactggggacggttacgagccgagaaatggaagagaagcgtaggttcactgctgcacctctgggaaggatggtgcgtgtttccacagtcgagtcaggaacacttctctcaggtatttgagaagccgccgctcacagaagaggaacttcgagaagaaaaagcgaaagcggaggctgatcgggctgctggtgcagctttcaagggcaagaatcgctggaagactttggaggaggatgaaacagctgggaaatttgacccttcgcgtccccctgctcaaccagttcataacaggatggatatcgaccaaggtcataccgcttccgcaggaggtgacctggctggagagcctatgagcgacatagatggagagcctatggaagacagcgacctagaagaagcactggatggagagccgctggaggaggattctgccatggagaccgaacagaaagaagaggcgcccagcaaatccgaagcgccatctcagctcgaatccgggcctcctgctcgaaaaccgcgaccgagggcagaggacatgtttgcggattccgacacggagtga

SEQ ID NO: 19851 - DNA, 342 bp, A.fumigatus
gaagttgacggttcgttttcatactcgtgggactcggtgatagtgcagagcgttaatattgcggcagtctcttcccttccagaaggtgcagcaccagatcgcgaccttcgatgctcagccttcgaacacggagggcggcatcatggtcatggtcaccggtggtctgctggtacgttaggcctttcctatttaattcgttgttgtgtggttttggtgctgatgtcagaacaggtcgatgaggagcagaagcccatgagctactctcagactttccagcttcttcgtgagggtgagagctactatgtcttcaacgacatgttccgactcatctaccctgcgtaa

SEQ ID NO: 19852 - DNA, 807 bp, A.fumigatus
cacatccatagttggtcagactcccatctcaaggcattccttgatcgccatggcgttcctgttcctcaacctcgcaggcgtgacgtactcttgaaggctgctcgtgaaaactacgaggccatcgcaaaaaaagttggcgagactgcgcactaccctggtaactggctttatgagcactggaccgagtccgatctgaaggagtggctggatgagcgtggttggcctgtgcctcagccaacaaccagggacaagcttatcgcgtctgtccgtcgcaatgccagactagccagtctgcaggcgcgcagcattgcggcttctgccactaaatcagccgaagctgcacaatcaagcctgagtgaggcattgttcaacgcttggtctgactccgatttgaagaagttccttgatgagcacaacgtcaaggtgccccagggctcgaaacgtaatgagcttattgctttggccagaaagcaccgtgcctctcttgtgagccaggcctctgttgcctccaagaccgcttccgagtctgcagcaagcgtgattggcgcccctacgtccaaggctggcaaccaatacacccgcgcaaccgatcaagccaatttgaaggcccaagatgcattcgatgcggctgttgagacatggtcagactctcgtctcaaggcctacttggacgcacgcggagttcctgttcctcagtcgagcaagcgcgacgagcttcttgccaaggtcagactgaacaagcacaaggccgcgactggatggaatgcctggacctttgacacctggaacactgaccagctgaagtaa

SEQ ID NO: 19853 - DNA, 525 bp, A.fumigatus
gaaagcccccgtgtctgtgtcaaatcacacctttctaactttgctgataggaaatacctgtcttccatgaatgccaaggctgctcaccgcacagatgtcacccgcgatgagctcataaaacaggctcaggaagcatacgccaaagcctccaaggctggaggagcgaacatagcctctgccacttcctacatggctcaagccactgacgcagttaaggacacgacctttgacacttggtcccactccgaactcaaggcataccttgattcctacggcattcccacgtaccagggttctagtatcaacgagctccgcgccgcagccagacgcaatgctcaatacttccgatacggaaccactagcccacagggaattctttactccaagctccaggaatggtcccggtgggccatggaccagctgaagattggagccttgagtggccgagctcaaggccaagaggccgctgagaaggcgaaggcgaaggcttcagagggcgctgagaagatccgctcagagctctag

SEQ ID NO: 19854 - DNA, 258 bp, A.fumigatus
cttacaacaaatggcacgaaactgaattggaacgatggctctccgatcatggttcgctttttttccatcgataccccaagcatacacacggctaacgatgctccagacatcccttatcccacccctgccgaccgaaaagctcttgaagacttggtcaagcgcaattgggattccaagattcagaagcccctcgggaatgcagtcgagaatagcgctgaccagtggcatcatgccaaagaatggatttttgatacgtga

SEQ ID NO: 19855 - DNA, 435 bp, A.fumigatus
aggcgcccgtttgccctccccgcaaagttccccccgcctgttggggttcggcacctttcaaccccaaccacccttccctggaaaacaaatggggaagggcgaaaaaaccgtttaattttgccgttccggggacgagtttttgaacgggaccccaggcaaggaaattttacggccctgaaagcctgggggtcagaccttgaatatcgcaggaagattcagctaaaacctgtttgtatattccagggcggcccatacgagaactttgccggtcgagacgcatcgcgtggtttgcaacaccagagcttcgatgtcgagatgctcactaaggatctaaaggttcttctggatgacctcaaagatctcaacgaggagcagttggagaaccttccagtcctgggaggagcgctttctggagaagtatctcgtcgtgggtaa

SEQ ID NO: 19856 - DNA, 189 bp, A.fumigatus
tccagaggcgccaaagtcgtgaacggtatctatcacttttgcagtaactctatgagggacgtgttacggctgcgtatttatttctctgaggacctactgcgtcggactattgacaagatgacacaaagccgagaccgagtaaaagaagcccttgtatctcatgataatgtctacaaagggatttcatga

SEQ ID NO: 19857 - DNA, 282 bp, A.fumigatus
acttcaactaacgaacacagtcttatcatatttgggattctcctgtcgtatctccctcagcacattcgcataatcaacctcaaaagctccttcgggatctccccatacttcgtcctccttggaaccacatcaggtacctcggcgttggcaaatgttgtaacacaacagcagagtttacatgatgtggaatgctgcaagaacatcaatggactagcttgctttgggggactactcggcatcttccaagtcgggacacagtggctttgctttgttatcatgtaa

SEQ ID NO: 19858 - DNA, 735 bp, A.fumigatus
tgtggaatgctgcaagaacatcaatggactagcttgctttgggggactactcggcatcttccaagtcgggacacagtggctttgctttgttatcatgtaagctcacctacttctccgcctgataacattcacgtgattaatgcaagatcgtgtagtctgcttttgttcgttatttacttcccccgagccacctctccaatctcgcctacagaatcagagtcttcggcgagaaatggcccatcatatacaacagcgttggtcgtcagcggtatttgtatcctccacgccgtggtgatgttcatcacctctgccgcaatcgcggtcaaccggccatcccagcttcaggcatggtccaacttttcaggggtggttgctgccattctcgcttcgatccagtatttccctcagatctacactacgttaaggttgcggtgtgtgggtagcctgagcatcccaatgatgtgtatccaaaccccgggaagtcttgtgtgggcaggtagtttagctgcacgactgggaccaaaaggatggagtacatggggcgtgttgattgtgacggcatgcttacaaggcacgctcttggcaatggccatcttttttgaatattttgggcccaacaagcagcgcaaccatcgccatggcaaagatcttcctccgaacggtagtggagaaggcccagaggaaagagaccatgagcagccgtctgaggaaacgccacttctccaaggtcagtga

SEQ ID NO: 19859 - DNA, 1674 bp, A.fumigatus
cgtaccattgttgccgcttcaaccatgacagctcctctagtcaaagacctgcacaggatgcaggagctcttttccaacattgtcgctgcattagaggcaatgattgtgttcccttcattatttcgtgatccctcgcgtaagcggcggaagactttccacggcgcctactggcgacgtcggacgctcgacaactttgccgaggaagtcgaccgcctcttcacttcaccattgtctttgcgcaatatgataatcatgtcagagaagatccgagaacagttcaagtcgtgcctccagtccagcccggtgtgcatgctgccatcgtacaaccatgcactgccgtcaggaactgagaaagggacgtatctggctttggatgttgggggatcgacattccgggtcgccttgattgagttaggaggcgcaggagcaatgaagattcttcaagagtcatcatctccaatcgacaacgatgtgaagctgttggaaggtaccttgttcttcgattggatggccgagaagattgagtcaatgctgagtgcggtgggtgctgactatggtcgggaagctgtgcctctctcaatgggattatcatggtcttttccaattgagcagacatccatcagcagtggcctggtgattcacatgggaaaagggttcttgtgttccaacggtacccttggtcaggaattgggggatttgatcgtccaatcatgccggagacggagcctcaacgtacgagtcgacgcaatagtgaatgacagttccgcagcacttctttcgcgagcgtacgtcgaccccaaaacacgcatgtctctaatcctcggaactggaaccaatgttgcggttcattttcctgtgcgtgagataggattgaccaagtttggcaccagaccgccaggctggtttgattatgccaagcatgtaattatcaacagtgagctgagcatgtttggtggtggaattttgcccatgacccgatgggatgatatcctcaaccagactcacttaagggctgattaccagccattggagtacatggttactggtcgcaacctgggtgatattgtccgactcatcatcacagaggccgtcgaaaccgcgaacttgtttagaggcgagcttcctcattccatgcgagacccctactccttcgacaccagcattgttgcattcctcgaagcagacacgtcaccatcactggtcccttcagcagccctcctccagaaagagcatacgttcccagtgtctccatccgtcgaagacctgcgcttcttgcgacgaatttgtcagattgtatcgaagcgcgcggcagggtatctggcaaccgcgatccacagtatgtggtgcctacgcaatgatgcagaattctccgatccgacagaatcgaaagcatcctctgtcaaggatactcaggaaatcacgattgttgagagtgaggaagactctcggagtttatccatcgcatgtgatggtagtgtcatcaacaaatatcccggcttcagagatcgttgccaggggtacctcaaccagctcactcagcaaactaattcctcgcaggggccgctagatcctgctacgagtccttatattcgccttgaactagcgcctgagagtgctatcttgggggctgcagttgcagttgccgtggctgtggaggatcagaagtcaggataa

SEQ ID NO: 19860 - DNA, 225 bp, A.fumigatus
acagacattgatgacttcacgtactcgcatatcctgaaacaagaatcgatggtgaccagcaagatgggcaataattgctcagctaaggacaatgatccattcagaaaccagcacgtgcgcatttaccatgcgatatgtgctatatttcgtttcaattgcaactgtatgctatgtatgggtcctgactttgaatgcaacattcttaagacactaaaatatcagtga

SEQ ID NO: 19861 - DNA, 1440 bp, A.fumigatus
gctggctatcgtctcaaggcgtttccacccagtggcagcggaatcaagatgaggtggagttccttgctgaaggcagctgtcctgtacagggcaatccttagtcctttggtttctggtgcagtcattccccgcggcgccgttccagtcgcctcggatttaagtcttgtttcgatcctgtctagtgctgccaatgattcttcaattgaaagcgaggctcggagcattgcctccttaatcgcgtcagaaatcgtgtcaaaaatcggcaagactgagttcagtcgctcgaccaaggatgctaagtctgtgcaggaagcattcgacaagattcaatccatctttgcagatggcacccccgatttcttgaaaatgacgcgtgaaatcctcacggtgggattgataccggccgacattctctctttcttgaatggctacctcaacttggatctcaactcgattcacaatcggaaccccagtccgaaggggcaagccatttacccggtcaaagctccaggagatgcccgttactcagtcgcagaaaatgcactgcgggcagcgatccatatccccgcctctttcggctatgggaagaatggaaagaagcctgtgattctggttcccggaacagctacacccgcagggacgacttattacttcaacttcggcaagttgggaagcgccgcagatgccgacgtagtctggctcaacatcccccaggcctcgttgaatgacgttcagatcaactctgaatacgtcgcttatgcaatcaattatatttcggccatttcagagtccaacgtggcggttctttcatggtcccaaggtggactggatactcaatgggccttgaagtactggccatctacccgaaaagtggttgatgatttcatcgccatcagccccgatttccacggaacggtcatgaggtcacttgtgtgcccgtggctggcagcgcttgcatgcactccctcgctgtggcagcaggggtggaatacagagtttatcagaactctgcgaggcggcggaggggactctgcatatgttcccacaaccaccatttattccacattcgatgagatcgtacagcctatgagcggcagccaggcgtctgccatcctttcagactcccgggccgtcggtgtatctaataaccacctacagaccatctgcggcggcaagcctgcaggaggggtttacactcatgaaggtgtcttgtacaacccactcacatgggcattagcggttgatgcgctatcccatgatggcccgggcgacccgtcacggctggatcttgacgtggtttgcgggcgtgtgctgccaccccagcttggcctaaatgatctgctaggcacagaagggctgctgcttatcgcattagcagaagttcttgcatataagcccaaaacctttggcgagccagccattgcgagctacgctcattga

SEQ ID NO: 19862 - DNA, 291 bp, A.fumigatus
tctaacagacataataggcatcgtcctggaaaccccgtttccggcactcgcactagcgacggtgcctactatgtcaatttcccaggaggtgtgaatgacattgcggtctttaccttggaggtccagcgagtcaagggaaccgagacagtctctgttactctcaatgacaatggaaatggcagtgctccaggcagcaagtggtcgtgcacctcgaccagtggctctgttatggggacggtgaagaagtgtgcctatgatggcgatatcaccttgacccctttcaacgcctag

SEQ ID NO: 19863 - DNA, 384 bp, A.fumigatus
acatcatcatcatcagcatcaaacaacgcaacgcaactgtttatcagcaatcctttctcatcgtacaaaatgaaagtctctaccatctactctgttgtcctggctgctggctctgctatagctgtccctggcaaacgggctgggcaagccattactatcagcgacctcaaggcctctcaggtcgaccaacagggatatatcaccttcgccttgaaagatcccaactacgacgactccaccggtgcgaatgtgatctggtatatctatgtcccttctggtccaatacgtgatctaacagacataataggcatcgtcctggaaaccccgtttccggcactcgcactagcgacggtgcctactatgtcaatttcccaggaggtgtga

SEQ ID NO: 19864 - DNA, 549 bp, A.fumigatus
tatcgcatctttaaacccctggtaagagccgcgtggcgaacgtttcgctctggccctaagttggcggtgatccctcactccaagacgccgacggtattcctgccttctatcacaagcacctacgctcccttatttgaatgcgactacaacatgcacaagtcaaacagtacatacttcactgatttagatgcaagtcgatcatatcttctctccgccctctgttatgacggattggtcacggttgaccgcgaactagccgccgagggaaagaagggcatgttggctgctatcatagggtcagtcaccaccagctttaagaaagagatccggatcttccaggagtacgaggtgtggtccagaattcttacgtgggatcgaaaatggctctatattgtgacccatttcgtccagaaaggctcagcgaaaccgacaggttatctaatcgcgaaatccacgcgccttgacttgaagaggtcgaccgaagaatccagatgccactctggccaaccggttacttttgctaccatcgatttccaaatacgtctttaa

SEQ ID NO: 19865 - DNA, 306 bp, A.fumigatus
gaaaagggcgggttcacatccctccgggaacgaattttgaaagcttccggccttatgggacaggataataaggaagagaaacgcgaagttctccctaacaatgttcaaggacacacaagcgactcgggcgttcctgaagatatagagtcggaacgcctcaagggtatgaagtacgctgaatcctggaaccaattggactcccttcacgaagaactactcaagcaagatgagttagtcaatggcgtactagctctaaatcattttggagacatctcgcttccctggaaacgatttacaactgcctaa

SEQ ID NO: 19866 - DNA, 375 bp, A.fumigatus
gagaagaatatcccagagcagagaggcatctttgatcttccatgtagatcaatgcgtgatatccttgtggagacgtttctcaccctggttacgcccttcgcacccatcatagacatcctcggtttcttacgccactacaggatccgcctccttcacttctcttgttacatgccgtgttcgccgtcggttcaaggttctgtccatctggaagtcaggacacaggggccgtaccaacggagtcttcaaaaaggcaaaagccttgtgcgatgcaggctacgaacaagatccgatcccactcatccagtcaacgctatcctaggcctatactgggagggccgaaggtatttaagcacaccggccgttctgtttggttag

SEQ ID NO: 19867 - DNA, 228 bp, A.fumigatus
agtactcgtgtcctgcgtttgttagactgcttgaagtttgatgcagatacaatgtctacatacgtcgtcagtgaccagcctctaaataatagcctcgttgggtcgatatcctctcttcttagtgctgctggtgtccctaatttactctggggaaactatctactgaccgtctacggagtccccaccattgttgacgttagtgtcctccctgtacgcgctattgattga

SEQ ID NO: 19868 - DNA, 222 bp, A.fumigatus
gtcatcgtgctgtccttttctactctcttccttgcttttcaagaaggttccgaggaagatactttttatgccagacaattcaaaacctacaatcagcgagtgatcaagtggcttcagaaggtctgttcggagcaccccgtcggctttccatacctcaacgatgacagcccctcaatccacaccgccccgcgtcctctcagtgacgatctcggcctcgcataa

SEQ ID NO: 19869 - DNA, 660 bp, A.fumigatus
tcaagtggcttcagaaggtctgttcggagcaccccgtcggctttccatacctcaacgatgacagcccctcaatccacaccgccccgcgtcctctcagtgacgatctcggcctcgcataacttctccaagaatgccgtctcttctatcaaacttatcgccaaccttggcgtggaaggcgactgtcatgccggcgaaactgttcagcaccgctcacgcctgcacattaagcccccgccggcaaaccttcgccaagtgcaccttataccgattgaaattctgcggggtatatgcgcaacactgccgactgacgagatgaggacacagctactggcgcctggagctctgggacagaatatcaccaccgagggagtcgatctcttgagtctcggtgccggaacggaaattcgtttcgttgaagatggagaggcagtgggcgaggaggctgttattacccttacagggttgagaaatccatgtcctcaaatcgataagttccaggctggattgaaagagcagttcttggttcgtgatgaagagcgtaacattgtgaggcggttggcgggtgtcatggctacagtgaagaagggaggagttgtgcggcctggaatgaagctaattattgacaagccttcccaatatgttccgttggatgttgtctga

SEQ ID NO: 19870 - DNA, 186 bp, A.fumigatus
aaaatcagcacctcagaacttttcactgatggagcgatgtggatgagagacatactgtccaccaggtccgtatacatttccgtgactttcgagaacaaccgtaccgccaccattcgtgcaagcgacaccgttagcatcaacctaagagaacatcagctttacaaccttcaaagtctcttcctgtga

SEQ ID NO: 19871 - DNA, 540 bp, A.fumigatus
actgcgtatgcacctgatgtctccctcgtcaacggcgtctatcatgtgtattattcagtgtcaacctttggatcccaatcctccgccatcggtctcgcaacatcctcgaccatggacttgaactcatggaccgaccatggatcgaccggtatccaatccagctcctccaagccgtacaatgcgattgacggcaacctcttcaaggacgggggaacctattatatgaacttcggctccttctggcatgacatctatcaggcaccgatgaactcggccgcaacgtcggtggcgtcctcatcctataacatcgcctataacccctctggaacccacgccgtcgaaggagcattcatgtataagtatggcaattattactatctctttttctcggccgggatctgctgcggctatgacacgtcccggccggcatccggagaagagtataagatcaaagtctgccggtccacctcagcgactggtaatttcgtaagtgaatcacaggaagagactttgaaggttgtaaagctgatgttctcttag

SEQ ID NO: 19872 - DNA, 435 bp, A.fumigatus
cggaacacgacactgacactttacagatggttctccacgacaatgggcaccggcatcgtcgccatcctgttccatctcataccgtttggacatacatacctgcactacgtatccatcgtcttctttatcttcaacgtcgttctctttgctgtagtgctctccatgtccatcctccggtacacgctgtaccccgagatctgggccgtgatgatccaggaccccacgaactcactgttcctcgcaacctgtccgatgggttttgcgacgctgattgagatgtgggtgttcgtctgcgtgccggcctggggggactgggcgaggacagtggcgtgggtgctgtggattgtcgatgcagtggcggctgcgtcggtgacagtgtcattgtcgttcattctgtatttccagccactggtcatttgcttggcaaaaggctga

SEQ ID NO: 19873 - DNA, 423 bp, A.fumigatus
atgaatggcacgcatatatatagaaaatttgttccctcctaccatgcctcttttctcaccattgtgaaattgactggagattggtcagtagccatgtctgcctcagttttcgtggttgtagcgtcctgcctggcggccttagcccatggctatgccaacccggggtcgtgtttgggagcatgtaacgttcatgatcctgccctgatccgaagagagtccgacggaaagtactttcggttctctactggcaacaaaatctcctatgcgtcatcctcttccattgaaggcccctggactgtgctaggctccgtattgccgagtggatcgtctatcgacctgcctggaaatgatgatctttgggttagtaatttctcacttgactccatctgttttcttcttactcagtcggaattctccatttga

SEQ ID NO: 19874 - DNA, 294 bp, A.fumigatus
tgttctcttaggttgatgctaacggtgtcgcttgcacgaatggtggcggtacggttgttctcgaaagtcacggaaatgtatacggacctggtggacagtatgtctctcatccacatcgctccatcagtgaaaagttctgaggtgctgatttttcacaggggtgtcttcactgacccaagccttggccctatcctttactaccactatgtcgataccacgattggctatgcagatagccagaagctctttggatggaataagattgatttctctagcggatggccagttgtatga

SEQ ID NO: 19875 - DNA, 1125 bp, A.fumigatus
tatcatcatcaaaacctcaagatgcagctcaaggaagttctttccctttatctactaggagtctccttggtgttcgctcatcctggccacgaggagaagcgggcatctaacgagctgctggcgttcaaggcccacgtccgtcgtggtctttcgctgtgtacgcgctccttcgatgagagtggcctcagtgcgcgcgccattgctcgccgtgcgaagctcgccagcgagtaccggcggcgtaagttagccgttcgtgacaccgacgacgtgctcaacacctctcatctgtcctcggccgactacacaacctcgaccgatgagagggaaattttcagcagcactggcacctgcgtcctcaaccctgagggcgagacgggccccttctgggttagtggagagctgatccgctcggacatcatcgagaaccaggctggtgtccccgtcgtgctggatattcagttcgtcgatgtcagcacctgtcaggccgtcgagggcctgtacattgacacctggagttgcaacgcaaccggtgtgtactctggcgtgagcggtaacggtaacggcaacagcgcggacacgtctatcctcgacgagaccttcctgcgtggtatcgccaagacggattcggacggtgtggtatctttcaacactctcttccccggccactactcgggcagaacgactcatcaccacatcatcgcccatctgaatgccaccttgcttcccaacaacactttgaccggcgggacagtcccccatatcggccagctcttctgggaccagtccctcatcgacgaagtggaagcgacttcgccctacagcaccaacactgtcgcgcagaccaccaacgctgaggaccgcgtcttctcggatgagacgtctggtaccacctcggacccggtgttcaactatgtccgtctcggggacagtgtagaggatggattgctgggctgggtcactgtggctgtggacctaacagcaacctacacgcctaactacagcttcgtttatacctccagcggcagtgaggctgtatccggtaattcgggtagcagcgggagtgctcctggcagcagcggcagcgccccttccggtggcatgggtggtggacctggcggattctga

SEQ ID NO: 19876 - DNA, 810 bp, A.fumigatus
ccaagtactgaaagaagacagttggttgtggacgaagagtcggcggtgctgggcctccccggcaatcgggaaacccgactcaaactcgacgccgaccactcgcagatgtgcaaagtcgggtcgcgtggccccatgtacaagctgatcaagggcaacatcaagcagattgtcgaccaagtcctcgtcgccgaacaagggtacatccctcaacagtcgacatcgtcccatgcgggcccaccactacctacggttacgcataccaacagcagctcgccgtaccctagtgccccacctccgacgaccggccaacgcatcgtgggaaccatgtacacggcagtcgacagcgatccacgttccatcaaagcggccgaacacaagaacgtcggacgctgggatcaagcccggaacctggagtatgccatcttccaggaacacctgcgaacgctgggcccggatcacaacagcacgattgtggtgggctacaatctcgccgagatcgacctcgaggcctcgtacctcgccaaagcaaccgagtggtgcaagtgggtgaccgaccagagtcagcggacgctggggccccggcacccactgaccctgagagccgagagcctaatgggcgaaatcctctgcgcacgaggtcgctaccaggaagccgagtcggtgtgcgccaacgtcctcgcacgccagcagatgagcatcggcgatgacgacctcgacacgctggagacccgccgccgcctcagtgcggcgtatgccaatctcgcccaggagcagacgtcttcaccaggcggctggaaggacaggcgctaa

SEQ ID NO: 19877 - DNA, 339 bp, A.fumigatus
tctgacgacagtaggattctgtatcttgggaaagtcctgcgcaaagtcgtcgagagtcacgaagcgatcgaccccatagcgggatcgatcgcgtacaccatgggactgttcatctcgctgctcatgtggagtttcgggttgatatggcttgtatttgccctggcgactatctatcatgcgtccccattccctttcaatatgggttggtggggattcacatttccgctgggcgtgtatgcggcgaacacgctcctgctgggtcagcagctggatctgatgtttttcagaatttttgggatggtaagcatatatcaacatttagaaaactatgaatactaa

SEQ ID NO: 19878 - DNA, 423 bp, A.fumigatus
ccctgccccaagtttcctagagccctgtcaattctcttctatggcctcttctacgacctctccacccagctgtacatcggcaggaagattcccatacatcgcaccggtctctttttaaattccacatgcgcaattacgagccgcaagctcactatggcggagggttcgcaggagacggaagaccaaagtgtccaggtgccgcgcgcttcgacagcccccgcgttgcccgcaattatcaccaccaccaccactgtgcgcagtcgcaaggatggccaacgcaatgacgataacagctttacgaatgatagtcccagtgttgcgacaccaggacttttaaggacttcgcagtctttccctgtcggtatgtgcaactcttatcgtcttccttttaaggactggtcattcagacaaatctgccaatga

SEQ ID NO: 19879 - DNA, 615 bp, A.fumigatus
cgaggcatatttgtgattcacaggaaaggagtatcgttcctcagtcggataatcggaggcaaaaagaaagagaatctatctgaagcagaggacgatgtctcggaaccggacaccttccgcatggatgccaacgccgcggcacaaccgataggcttctttcccaagtttccccctccgccaaagtacatcagggtgaaggcatattacaagaaagacaaaacgttcagtagggtttttctcgcgcaggaattgactgacatagcggcaccctcgaacaactcggtaaaggatgcaacgggatcgacgacaggcaccctaagcggcggcaatactggaaaagcaatatgggcgttatcattctcgaaggatggcaaatatttagcggcagcaggtcaagacaggagggtgcgcgtttgggccgtcattgcttcaccggatgatcgtaaagaagaaggactcggtgaaggcgaagaaactcaaggtgcggacgagcctccgcagttgaaggcgcctgtctttaggactaagccgatccaaatgtacgaaggtcacagtgggagcgtgttggacctgagttggagtaaggtacgatgctcacatcgaagaggcatatga

SEQ ID NO: 19880 - DNA, 474 bp, A.fumigatus
accaaacctcaagttatcgtgactgaccctccaatgcaaaccacgcagacccgcatcacaacaaaatacggcttcccctcacaacgaccttcagcacagaaaaagccctcttcgacatcaaaccccgagacgaccgactccccagcccggactgccaccacacccgtcgcagtcctcaccctgaaaacatacaacccaaccgcaggcatctgcctgaagtatcgcacgaataaggcggcggaggtcggccgacttgtgaccagtctggggaagttggcgggtggtgcgaacgccgctgggctggggctgtcggctccggcgccgacgacgactgcttctgctgttgcgacggatgtggagatgacagatgctccggcggtggtcgaggaggctgcgagtgcgaatgcaagcaaggcggatacgggtgctaagggcgggaaatcgaagaagaaaggcgggaaggggaagaggtga

SEQ ID NO: 19881 - DNA, 390 bp, A.fumigatus
acgagagaaacgagacagcagcatacttgtatcaattgcgtcaaagaggtaggtccgctgcttaggctccttgatgtatgtatcaatcagcagggagtatgtctccgaatgaatgttctcaatcatgatctggaagccgtagaagcatcgagcctcaggcacctgcacctcattgctgaagcgctccaacaagttctcattaacgattccgtcagaggcagcgaagaaggcaaggacatgagagatgaaataacgctcatcgtcattcagacggttgttccagtcgtgcagatctttggagagatcaatctcctcggcggtccagaaggaagcttcggctttcttgtacatttgccaaatctgcgtcgaagaagcggggcatatcagtaa

SEQ ID NO: 19882 - DNA, 1710 bp, A.fumigatus
tctgacgcgggcgatcagaataactttctactgtcttcctcaatggacaagactgtccgcctgtggcatgtgtcaaggtcggaatgtctctgctgctttcagcacagtgatttcgttacttctatccagttccacccccgtgacgatcggtttttccttgcggggtctctcgacactaaactccgtctctggagcattccggacaaaagcgtggcgttcgtcgcggcggtcccagatatgatcacagcgatcgctttcacccctgatggtaggcactcaattgctggttgtctcaatggtatgtgcaacatatacgacacggatgggttgaagccagttgggcagatacacgtccgatccgcgcgaggccgcaacgccaaaggcagtaagataacaggcattgataccattactttacctcgtggcgaccccaacggtgaggtcaagcttctgatcacaagtaacgattcacggatacgacagtacaactttaaggataggacactggaggcgaaatatcgcggcaacgagaacacatgcagtcagatccgtgcctcctttagtgacgacggcaagcatatcatttgcgggagtgaagatcggcgggtatatgtttggcctacgggtgccgtggagaaggacttcgataagcgtgctgttgaagtttttgaaacacagtccgctattgtcaccgcagctgtaatggctccgtcgaagacaaagcaggtcctgggcttttccgacgacccagtgtacgacatctgcaatccaccaccggtgaccttggtgagcgccgcagataatgaaaatgctcgccaaaatcgcaactccgacattatcaagctagcgcaggaatccccatcatatctctcccgttcaacgcacccggaaggcaacatcatcatcgtcgccgattattcgggcaaaatcagagttctgcggcaagactgcgcgttccaaaagcgccgctacgagaattgggacacccattccaccttttccaggagactgttgcgccgatccaattcagctcgccatagcatttcctcttcaatcgggaaggagtcgtctcacaagacaccttcagagcgcattatctcttggcgcaactcggtcatagggcacgacacagcgaagcgtgaaggctctcgtgatggaacgaggactcggagcccgtctccccacacgtctatacccgatgtctcacgttactcaggtccagtgcgtcagttttcaggcggagcacctgctgattctctgtctctcactgtgtctccaccgccatctgcatacaagtcgtcgtttgatagtcgacggtctagtgtagaagcctccaagcggaacgctgaggacgttagaatggtcccgaccgcgaggacaatagtcgccaagggaaaggacaaggacaaccctttgtggttacagggccaacaaagttatgcgttctggaacaaaatcacccatgatgcgctggcagcgcagaacaaaaccccatctcagtctcgggattcgaacaggttatctgttccaggacgcaaattcagtatggccagcgctttgagcagtgattacggctcctctaatggagagggagatgagggagatgtgctcaggtgtgataactgccaagggacgaactttcgagcaaccaagtcgcggacaggcaagcagaaattgatctgcgtgcgctgtcatcgacctatcagctaa

SEQ ID NO: 19883 - DNA, 279 bp, A.fumigatus
gctgcatcctctctcgagaatctcaaaatgagcgactcacctgtgaagaagctcaatttcggagttgtgggcaaggaaaacgcgccgtcgtccacagccctcaccgacgcgcccaccgaaaagattgcggaaaagcctacggaagcttccaaagttgctcaaagtatcaaggaactcgaggcaaatgaaccattgcttcaagagaaccctcatcgcttcgttcttttcccaatcaagtatcacgaggtgagtggcacgtccacaacgcgtcacgcgtaa

SEQ ID NO: 19884 - DNA, 618 bp, A.fumigatus
tttcctctagttccttgtatcaggaagaaggcccagtgggccatgagatggatttctgataaggaatctactttcgctcagcgccttgtggccttcgccgctgtggagggaatctttttctctggatcttttgcttccatcttctggctgaagaagcgtggcttgatgcctggtctcactttctccaacgagctcatctctcgtgacgagggactgcacacagactttgcttgccttctcttttctcacttgaaccatcgccccgacaagaaggttattgaggatattatcgttgaggctgtggccattgaacaggagttcttgacagacgctcttcctgttgctctcctgggcatgaactctaagctaatgtgccagtatattgagttcgttgctgatcggctgttggttgctcttggaaacaagaagtacttcaactctcccaaccccttcgacttcatggaaagtatctcgcttgcaggaaagacgaacttctttgagaagcgtgttggtgactaccagaaggccggtgtcatggcaagcaccaagaaggatgccagccaggacactgcaaaggacgccaatgatggaggcctctgctttgatgaggacttctaa

SEQ ID NO: 19885 - DNA, 594 bp, A.fumigatus
accattgcttcaagagaaccctcatcgcttcgttcttttcccaatcaagtatcacgaggtgagtggcacgtccacaacgcgtcacgcgtaaagtggtttactccgcaccatgtcctatatgtgcgttgtttactgatatgccccgcttcttcgacgcagatttggcaaatgtacaagaaagccgaagcttccttctggaccgccgaggagattgatctctccaaagatctgcacgactggaacaaccgtctgaatgacgatgagcgttatttcatctctcatgtccttgccttcttcgctgcctctgacggaatcgttaatgagaacttgttggagcgcttcagcaatgaggtgcaggtgcctgaggctcgatgcttctacggcttccagatcatgattgagaacattcattcggagacatactccctgctgattgatacatacatcaaggagcctaagcagcggacctacctctttgacgcaattgatacaagtatgctgctgtctcgtttctctcgtttagaccgatcactaatttcctctagttccttgtatcaggaagaaggcccagtgggccatgagatggatttctga

SEQ ID NO: 19886 - DNA, 366 bp, A.fumigatus
ctgactttggaaactagggatctttccacccgtctcggcctgaaccaggatgagggcgagaagtggattgtcaacctgatccgtgacacacgtgttgatgccaagattgactacaaggagggcaccgttattatgaaccaccctccccagtctgtgtaccagcaggtcatcgagaagaccaagggtgctttcttccggacacaagtgctgaggttcgtccgtttattgtatccacacgatcgacaagttactaactttaattttctcacagtgcggctgttgcgaaataaagatatggttcagatttacgccccgaaaacacaatttatctttttttcttcctccgaatggttctgttcatgttaa

SEQ ID NO: 19887 - DNA, 198 bp, A.fumigatus
tcaagcaagcattcttttaccgttctctccagattactcaacctaacaggggagattaagaacaagaaaaatcaagaacaatttggtatcaaattctcctgttatccaaccagcgcgttctcgttgtggttccgatgggatttcgtcattcatattggtcgagagatattgccggagagcccacaacaccacaggtaa

SEQ ID NO: 19888 - DNA, 192 bp, A.fumigatus
gcccagtccgagtctactcatgtaagggataatggccagataaatacgaagatcatctgcatgatttcgaaggaattgattgaggttcgagatgctcagctgcaatacaatcctactcgcttagagaagctgatcagcattcccatttacaaccagtatagaatcttccagacgagatcacacttacagtag

SEQ ID NO: 19889 - DNA, 597 bp, A.fumigatus
aactacttgatggacgttggaaacctacatcctcagtcaacagaccaattggtaagagccagcgaccgtcttgccctctaccagaaacagctccaagcctccgtcctgtcaccgcaaatcacgtcttccagtcatagtatctcaaacgccgcaaaagcaactgaccaaatgtctcgcgatcccattacttgtcatgtccttaacaccctgtcgggcactcccgccgcaaacctccccgtaacactgacattcctcgggagcagcaatggcaacaacgccagccaaagccccatcacattcaacgcaacgacggacgcagatggacgcgtgaagaattggactgccaccgctgcaacagctacgacagtttcgggggtcctttcatcgctgccgactgcggacagcaagacgaactgggccgtgcgttttgaggttgggccttggtatgcagcgcaggggattgagagtttctggccagaggtggaggtgaagtttacagtgaagggacgtggacgggagggtgaggaggattggcgccactatcatgttccggtgctgctgggcccttggaattattctacttatcggggttcataa

SEQ ID NO: 19890 - DNA, 216 bp, A.fumigatus
ggtaccatagttactggccacgttgagcattaccccattcgcatcaactcctgtgatggcacagcgggattcgttgacttcaactaccttgtctggagtgagaatcaggctaatcacaacatgaatcatgccaggggagctggcagaccagattcaatgcatcggctccgtgaaagcatactgcaccattgcaaaggctggctaagcctggcataa

SEQ ID NO: 19891 - DNA, 1104 bp, A.fumigatus
aagacaacaccgctggaagaaatcgccaaccaatacaacttgcttcccaagttgatcccctatctcgaccgtcacctcgtctttcctctgcttgaattcagctcgggccaagatgacgagaaggaaattgtccgtgcgaagtatgagcttttgaagcacacgaacatgaccgactatgttgccaatctgtggaaggaaatcaacaactccgacgacattcctgatgagttcgtgaagaagagggaggaggttctcgccaagttgcaacagtacgaggaggagagcgcgaagattactcagctgttgcaggatgagagtgtcgtggccaacctgcgaagtgacaaggtcgccaacttgaagttcctcgaggaacagcacggagtgacagttgaaatggtcaacagcctttacgattacggccgattccagtacagctgcggcagctacggtaatgccgcagagcttctctatcagttccgtgttctttcaacggataacgacaaggtcgcctccgctacatggggtaaattcgcttcggagatcctcactaccagctgggaggctgcgatggaagaagtccagaaggtcaaagattcgatcgagacccgtctattcaacaaccctctgggtcagctccagaaccgctcctggctgattcactggtctcttttccccttcttcaaccacgatcccgctcgcgatgtcctgaccgatctcttcttctcccccgcctacatcaacaccatccagactaactgcccctggatcctgcggtaccttgccgcggcagttatcaccaatcgtaaccgtgcacacaagaacagcagtgtataccagaagcagttgaaggacttgatccgtgtggtgcgccaggagggttatgagtacaacgaccctatcaccgacttcatcaaggctctctacgttgatttcgatttcgaagaagctcagaataaactgggcgatgccgatgaggtgctccggagcgacttcttccttgtttcgaccactgatgcctttgtcgaggctgcccggcacttgatctccgagagctactgccagatccaccagcggattgatatcaagtatgtgacagcatcctaa

SEQ ID NO: 19892 - DNA, 213 bp, A.fumigatus
cgcacctctaccacttggtactgtagtatttcgaggtcatctcatcttcccttagacagaaacactagtgctagtgcaaatggggttgtttttattgagaaattagtccgtgtgcctgttggcgagacggaacctgagtggcaactggcgacttcggcagatttgattctgtcgtccaaccagaaaatcaagaacttgcgatcacgtgattag

SEQ ID NO: 19893 - DNA, 729 bp, A.fumigatus
tttttctatttctgtatttgcttgtcggtcaatactttcaagtcaggtccctgcgactcatatctctttcgagccaattttcttggaaacttccaatacaccagaatcaaaagtttttggcctctgcggggaagcaaatacgtgtgtaaattcaaccccatcgctgctcaccgaacaagcagactaccccttggcaaagaatttgagcattttctcactgcactgagttgcaatagatttctgcttaccagattctcaacttccgaatccctcaaaatgtcttcaaccgcggttgtgcacggcgacgatctcatggagccgaccctccagtccattctcagccagaagaccttgcgatggatctttgttggtggtaaaggaggtgtcggaaagacaacgacatcatgctcgctcgcaatccagctcgcgaaagtccgcaaatccgtgctgctcatctcgaccgaccccgcacacaatctgagcgacgctttcgggcagaagttcggaaaggaggccaggctggtcgatggatactccaaccttagcgctatggaaattgatccgaacggcagcatccaggatctcctcgctagcggggattcgcagggcgacgatcccttggccggactgggaatgggtaatatgatgcaggatctggctttcacggtatgtgcagtcttgaacagtactgggagtgtgtgtgtccatactgacaatcagtgcccttag

SEQ ID NO: 19894 - DNA, 630 bp, A.fumigatus
atccctggtgtcgacgaggccatgtccttcgccgaagtcttgaagcaagtcaagtctctgtcgtacgaggttattgtattcgacactgcgccaaccggacacacccttcgtttccttcaattccccaccgtccttgagaaggccctcgcaaagctctctcagctgtcgtctcagttcggaccaatgctgaactcgatcctcggtgctcgtggcggtctcccaggcggccagaacatcgacgagcttctccagaagatggagtctctgcgagagactattagcgaggtgaacacgcagttcaaaaaccccgatatgaccaccttcgtgtgtgtctgcatcgccgaattcctgtcactgtacgagaccgagcgtatgatccaggaactcaccagctacggtatcgatacccatgccatcgtggtaaaccagcttctgttccccaaggaaggaagcggatgcgagcagtgcaatgctcgcaggaagatgcagaagaagtaccttgagcaaatcgaggagctttacgaagatttcaacgttgttcgcatgccgttactggtcgaggaagttcgaggaaaggagaagctggaaaagtcagtccccatccatcacttgtttgaaaaaaatcactaa

SEQ ID NO: 19895 - DNA, 249 bp, A.fumigatus
acagccatcctacgcgagcatccaatcaagcttatatacctccaagagtcccaacttagaacgaccaacacgcttgcgaagatgtcacaagtccagcaatattggctaccaggctatggtctctcgagacatattgtgctgggccatatccagtatttccttggaccatcagcgactgtcagaccctatacttaccaggtaaacgattatctagttggcgaacgtgtgaaatgggaagagtctgcctaa

SEQ ID NO: 19896 - DNA, 198 bp, A.fumigatus
gactcgaaagcgggccatataatgataactggtctcgactacgattcatttttcgggtgctctggcttcgatgtgcatcgcctaggttctttcgtcctagacacgttctccaatggcctctcgatccctacaaatgatacacgagacatctctcttcataagcagtctcattcttcactgtcacctgcaccgatctag

SEQ ID NO: 19897 - DNA, 477 bp, A.fumigatus
gattacttgcttattgtcgcaaacccgattccttttcttcttgtagagtaccgaaagcactacttgactcgtatattcggtagcccctactacggatgctactttctcggattcatcatcttcaccctgggcctcgctcgcgaccatgtgtatcaactggccctccaggatcagccttactacgccccagtgcaccaaccgattttaggctccgtcctgttcggcatcggatctatcctcgttctgtctagcatgtatgcccttggcgtcaccggaacgtaccttggagactacttcggcatcctcatggatgctcccgtcactggtttccccttcaacgttaccggttcccccatgtactggggcagcaccctgaacttcctgggtgtggctctctactttggcagggtcgccggtctcttactcactgcggaggtcttcgttgtatactggatcgctctccagtgggaggagtaa

SEQ ID NO: 19898 - DNA, 192 bp, A.fumigatus
ttccttgccggcctagtcgttctccatgttcaaaatgccaaccagaagtcatccctgagatcatacaaacaagtaacttcccccacaaaagactccgccaactccatgctatgtatctattcaaaatctgctgatttgcgtgtgattgaagtcgttcaatacggcctgttgactatgccccgagccagatga

SEQ ID NO: 19899 - DNA, 585 bp, A.fumigatus
gcgcgtcgtcctcgtcctcgcttgcctgttgctctgctctcctcgaccgtctcgatttcatcttcgtcaaccccctttttgagttcctcgccttcagcgagaccccatttttcaggatcataccagtcctctccatcactcaactccccgacgtgtccttccgctttacaccactcgaagacgtcttcctgcatccgacatgcccggagtaggcactcaagcatgtgctcgaatcctcgaactgtttcttcctgcttctggataaaagaccagagcagccgtcgcgtttcttcggcttcattggctggtagtccaaagttgggatcaggtagcacagactcaggcacgaggaatagcggatgtggcgctggcagtgcgttgagtgtgtcagtggaagccgagggggagagcttgctagaatcttggtcgggtcctggatttaaagcacttgcttgcgctcgtgtggtcatgcgtcgtggcggctccggtgatgagccatcttgcatctccgtgtccgtttcatctccttgtggatcgtcttgttgttcggcttcgacttccgctccttgcttgtcatttgcttga

SEQ ID NO: 19900 - DNA, 402 bp, A.fumigatus
gtgtctgcagtaagcttatactctcgagcgtacaggcacaaaagattgaattgtcattgcccatcgagacacaaaagactggatggtaagcctgagactccaccgtgcggtaacggagttcgggtcaaatcaagctcatgcgtgcggtacaggaagctcaacacgtctccaaacaccatcgaggacaaggacattctcaagatgtacctggtgaccccaccggtcaagaagattgacctggtatggccattgggtctgtcggtcactgctcgtaacctcaagggtgtcacagttaaggatgcgctggacgcaatctacaagcaattcaagaagaaggcacgcctctctgctcgttttttccgccgcccttcatgccatttcactactgaccgttccctttag

SEQ ID NO: 19901 - DNA, 3039 bp, A.fumigatus
gtaaacactccccacgttcggttgacctcgaatagctcctacttctcaccgccaacgtttatctgtctgtcatccatatcaatcagtgtatgtaccctctctcaacccgcgcaggtaaggtaccttcccgttgttctgatgtttgtttgtcgttgctgcttcaccagtactaataatagcttgatagtcctttcgatttggtttctgccctacttccgatcatgctacccttcgtcttactcatccgttctaccttcctttactgagcgtcatgggacgaccctcgcctatcagtccataccacctgggacaatggccctaaatcgtcgcgatataattctctttagcactggtggctttattgcatggggcttagctgttcgctggctcccaattttgcgatatctgggatatgctctcgtattgggtgctctgctctcgtgtaccgcggtgctggcgctggtgtttctcacgattcggccgttagatagcgcaaaacctcctagatctagcagccttcctctcacatttctccttccgaagcactggcccagagaagtggaaggtattcgcgcgcgctcgacataccgcacagattccctctacccgcagtcgttcattgtatcggagagtattgatgagctgttgtctctggtgacacgggactttatcgcatcttggtatcagcatataagcccgaatccggcttttgttaatgaagtggatagagtcattcgagccgctatcggcaatctatgtaatcgattgcttgcagaggatctggtctcgctggtcgtgtcgcgtatctttccgatcctgaccgctcatctgaaagaattcgacgttgcagagagatctgtgcgcggacggaatctgacgcgaaatgtgaccgaatctgaggagctggacctcgccatcgctaaaaaatatcgcgatggtcgtcttcatcccgccgcggcgctctctgtgtccgatcagaaatttgtggagcaggagtatctacggaagatcacattggggttactaccaaagctgtttcccgagcaggtcctgaacagccgtatcgtaaccgttctgatccgtgagatattagcttgcgctgttctctttcccctagtgtcggtcctatcggacccagatacgtggaatcaattggttgaagcttatggaagaacaactatccaagatcgcaaaacagttcagaagatacgggcggctctcgacgaacatgcttcgcctgccccgaagtccaaacatggtcacccgtttcccaaactcgccccgaacgattcagaaagggcctttgagcggtttgtccgagccattcggcgttgtaacaatttatccgatgccagacgtttcagggcgctggtcgcaagtcaactgaaacgggaatctatggtggaaggtcaggatccggtttacctccggcgcctggaaactggcaaaagagttttggaccaaaaggttgctaaactatcagccccggggggaagtaatacgccgtatgcaaacgctgttgagtctcattttcgtcgcaatagttcttcgagtaaacccgaggcgtccttgattgatgtgatgcatgatgcatccggtctctcctacttcatggagtttatggatcggcagaagctcatgtcacttgtgcaattttggatcgttgttgacggtttccgcaacccacttgaagatgattttggtgatgagacatcgccgagctcctcaacctggaccacagcggatcgaaatgatatggcactcattagtgaaacctacctggccaagcccgaactcaaagtcagtgaagaagcacgtcgagctgtcaaggcttttttaagtgcaggcaaacgggctacaccagaacaataccgtaaagcacggacggtcattctaagcacccaatccgcggtcctggaagagctacaaactgtgtactaccccaaattcaaacaatccgatctctactacaaatacctcgcatcagacgaagtttcccttgccggatctcgtgcgtcgcctgtcccagtcgagccgcctgccagacggcctctgcctcctttaatggctcgtaccgcctcgcaccctgggcagaagccgaaggatctgcggagggctgtggcgtcctccagtgacgcccggagtatgggcaaactctttgatgatgaggagcaggcgagacggtccattgattccgagcggtcaacgccattgttcgatgatgactacgatacagaccctctcgcagcttctacacacagccttggcaacgactctcaaagtggcttcaatgatgctacccaaaaccaggcaatcaagtcaatggaagccgctttgaatgacatcatcgcgaatgaccccgaaaatgcagatttaggagaagtgaggtatattgattctggattggccggatcgtttagcgttgatcgaggtctcaaatctccgcgtagcacaggagacttgggacgcttggacaatcgcatggatgataataaagccaaaccaagcatagcttcgcttgggcttgttgaccagtcatctcgaattggcgttttcgatgatgaactctttccggatcagcaaaagtttttggaggatgaatatgacgaacctcctgagacagatgacaaggaccccgcggacgaagttcaagaggctgctccaggagatctcggcctgacagaggcaatcgaggcgcttaccgttgatattgagaagctcgctgctcaagagaccgtgatagatgctctgacccggaaagccgacctcacgaacaatactgccgagttaaggatcttgcgaaagtccaaggctagcattcagcgtgagattcaccgcaaggagatgcagcgacaacaatatatcattcaggaaagtgacaatagcttatacggccgctcgaccgtccgaatccagtccattgtagtgggcaaagaggcagacggccgagagtatgcgatgtgtaagtctattcttccagtatccaacattgtcgtattcgctgtagtaactgactcgaactgtttcagacgtgattga

SEQ ID NO: 19902 - DNA, 1020 bp, A.fumigatus
ctgactcgaactgtttcagacgtgattgaagtgcaaagagacgccggcgagcagatgccagctgcatcctgggccgttgctcgcaggtatagtgagttccatgagctgcatcaaaggctgcggataagatacccatctgttcgtcatttggagtttcctcgacgtcgcatggtaatgaagctgcaaaaagagtttctgcagaagcgtcggttggcattagaggcttatctacggaacttgttgctgcttcccgaggtgtgccagacccgggacctgcgagctttcctgtcacagcgagccattatccctcgcgatgagacgccacgtgacggggagaccaaggacctagtgacccgtatctacaactcggtcgctgacgggatggatgatttcctcggcaatttcggtgtactggaccaactatcagcggccggtcagaatctcatatctgcggctacgaatcatcaacacagtcctgtatccaattcagggctagccaccgaggatgcagtcacggcagccgaagccgaagctgaattaaacgcattcgaagaccgcgagctggagccattcatcaagcctatttgtgatctgttcctggaagcgtttgagctgaataaaggcaacaactggctgcgtgggcgcgcagttgtggttgtgctccatcaactgttgggtggaacgatcgaacgcaaagtccgtgaaggcgtccggtctttggttcaggacgaatccctcctccgctatcttagcatggttaaggagactatgtggcctggaggcgtcttgcgccagaacaaggtccgcacggcatccgagagactcaagagccggacggaagctagcctggtgctggcgactctgatccccgatgtggcgggcaatgtcgtcgggcgagccaatgctcaaggagcagctcgcaggatctttgctacgctaaacaaccagcgcttgaactcgcatttgatattcagcattctagacgaagtggtgttggtattgtttggcggcgcgaaatga

SEQ ID NO: 19903 - DNA, 252 bp, A.fumigatus
  unsure (196): Identity of nucleotide sequences at the above locations are unknown.
agagacagatgttactcagggagactggagaaagacagtcaaaccgccccttccccaccccgcgtgaccatgactgacagtcagagcaccttcacctcagtacttcacacacaagtcatcactccttctgatagttttgatgtcttcagtaatacagtctatgacttagattcctgtaatcagggccaagaaaaanaaagaagaaaagaaaagaaaagaagagaaaagaaaaatcccttagatccgacgtag

SEQ ID NO: 19904 - DNA, 1515 bp, A.fumigatus
tcctttgttcccgacttggcttctcttatcaaggacttcggtattcagccggagattgcgttttggatccgccgacctagcgtttcccgtaaggttgccgatgctgaaaaggcaatgcaagaggaggaagcagcagccgccgctgcgagggctcgcgaaatcgaagcagcgcccatcaaatccgaggatgacaaaatggaaacgacagatgagggtgaaatgaatggtcctgcggatgaatccgccgagaactctatggatgttgacaaggagcaaggaatgacaaacactgaaggagacagcaatcctacttcgggacaaccagagcaaccggcatcctctagtccgactctgaacccagtgatgcaggatctcgaggatcaggttaagtccgcattgacccctgagacttggggagtggtcggcctgcatttttacgtcatcttctggcaactgtcactttacgacgtgcatatccctcagaaggcttacgaagacgaaattgaacggcagaagaaaaaggtcatggccatcaacagcgatcgatcggacattagcatggccggtactcagcgaaaggaaagagaaaagaagcagataacccaactccaggaacgcatcttggaggaaaacaaggctcatcttaaggcttacggtcagacaagggcaaggctgcagaaggaaaaggaccggtggttcgccggcatgcgcgggaagcatgattccctcaacgtcagcctactggaacagtgtttcctgccccgtttgctgctgtcacccatcgatgcgttctactgctttaagatgctcaagttcctacacacgtccggcacaccgaactttcgtaccgttgggctgttggatcagttgttccgcgagcaaagacttaccgccctgattttccaatgcacctcacgcgaagcggataatcttggccggttcttgaacgaggtcattcgcgaccttggtcgctggcatgcggacaaggctgtgtatgagaaggaagcttttggtacgaagaaagacctgcctggctttgccatcaatgtcgatcccgaaggcaaacctaccacgttcttggagtacgaggacttccgccggctgttgtataaatggcaccggcttctggcttccgctctcaaaatctgtttgaatggaggcgaatacatgcatattcgtaacgcgatcagtgtgctcaaggcagtcgtgcagcatttccccgctgtcaactggattggtcgtgatatgctcactagcgtcaacaatctcagtcaaaacgatgagcgagacgacgtgaagatccctgcggcgtcgctgattggcgatctgaatcgccgagagaagaaatggatgctaccacaagccttcatgatttcaaaccaaccagcgagcaagggacctgcgccagcagctggaaaacccggaactcccggaactccacgccctcgatctactacgccggcttccctaaatgctgcagcgcctgagttcaagcccccaccatccgcggagtaa

SEQ ID NO: 19905 - DNA, 1770 bp, A.fumigatus
ccgtcggagcgcggttcattccagccccgtgggtggcagaacagaagaccagacgaagatgagctgccagagccctcggatcaaaaggttatgctgctaaagagcctgctcgccatcggagccctcccagaggctctttttatcctaagcaaatttccttggcttatggatgcctaccctgaactccccgaatacattcatcgtatcttgcatcatagtttgagcaaagtgtataactcattgcgtcccttgccgacggtcgaggagctcagggaacaacagcagatacccagccaagatcagggaggtctggcaaaaggacagattcggctgacttcagcgcctccaagacgagtccttcgctgggctcagctcgacaaagacgacacgaatgatgggaccgactatagattctattgggatgattgggccgataatatcccagtctgtcaatctgtagacgatgtttttgccctttgttcatcgtttctgaatatctctgggcacaagattggacttgaccccagcctgctagctaagctggcgaggattggcaaattcagtctcacccaagatgattccaccgagaacaaagcgcgctggcaggatctctgcaaacgtctccttgtgcctgcgatcagtttgaccaaggcaaaccctggtgttgtgaatgaagtattcgatcttcttagattctttccaagagcaacgcggtacaacatctacgcggaatggtattctggacaaacatctcgactgccggatatcaagtcggcttttgatcaagcaagagctgagacgaaagacgttcttaagaggctgagcaaaacaaacatacgaccgatggctcgcgcattagcgaagattgcctttgctaatcccgggatcgtgatcaatgtcgccattagccagatcgagtcctacgagaatcttatagaagtggtcgtggagtgtgcgcgctacttcacatacctcggatatgacattctcacctgggccctaatcaactcgcttggacaaaagggacgaagccgagtgcaagaaggcgggctgttgaccagtcgatggctaaacgcgctggcaacgttcgctggcaggacctacaagcgctactctatcatggatcctacccctgttcttcagtacgtcgttgaacaacttcgacagaacaactccacggatcttatcgttttggagcagatgattagctctatggctggtatcatcacagatacaaacttcaacgatgcgcaaatccaagctatggccggtggcgagatcctccagtcacagaccatcctacaactcctggacaaacggcacgaatcgaagacaacttcgaaacgattgatgaaagccttgactgtatcggaactggccggacaactgcttgtagcaatcgcccaggaacgctggacgtgtatctataaggcgacggaaggagattccgaactcaagttactaggcaacgtctttgacgagattcatcgcatcctagcgcagtatctggatgtcctacgcagcaacatgtcagtggatgagtttgatcctttgttcccgacttggcttctcttatcaaggacttcggtattcagccggagattgcgttttggatccgccgacctagcgtttcccgtaaggttgccgatgctgaaaaggcaatgcaagaggaggaagcagcagccgccgctgcgagggctcgcgaaatcgaagcagcgcccatcaaatccgaggatgacaaaatggaaacgacagatgagggtgaaatga

SEQ ID NO: 19906 - DNA, 879 bp, A.fumigatus
cacagaaagatattgacaaccttcaggtttggaacatacagtacctgcgatgctatcaacgctggtttggatcttgaaatgccaggaccgacccgctggcgcggaaccgctcttgcgcatgccgtttcatccaacaaggcatttgaattcgtgatggacgagcgggtccgcaacattttgaacctgcacaattttgtcgagccattgggtatccccgagaacgcgcctgaaaaggccctgaatcgaccagaggaccaggctctgctccgacgggcggcggcagaatccgtggttctcatgaagaaccaggacaacattctgccgttgaagaaagagaaacccattctagttattgggccaaacgccaagactgccgcgtattgcggcggcggatcagcgtccctcgatgcatactataccgtgacaccatttgaaggtgtcgcggcccagagccagggcgaggtcacattctctcatggcgtctactcatacaaggaactccccttgcttggtcctctactgaagaacgacgatggcaagaaaggcttcaagttccgcgtgtacaacgagcccccgtctgagcccaaccgccaactcatcgatgaactgcatctggaatcgtccagcggctttctgatggactaccagccccccaagatcaaaaccttcaccttctacgtggacatggaaggctatttcccgccggaagatgactgcatctaccacttcggcgtgacattcgtgggccacggcaagcttttcgtccatgacgaactcgtcgtccaacactccaagaacccaccggaatgccaccgccatgttccggcaacgccaccgtccaaaaataaatgttccaaggaacttcaaggccggccataa

SEQ ID NO: 19907 - DNA, 2520 bp, A.fumigatus
caaataaaaactatgcgcagacctgaaggcggtcctagacaggaagtgactaagaagtccgaggtagaggatggggagatcgaagacgctaagatgacagatgtatcagctaaggacattgagacaagcaatcaagttgcccagaaaccagcagaaaaagctgaagctgcgtcacgccaaggcgaagagtccatcgtcacacagcctcctgagaccactagcactcaacctacgagcgagaaacccgttgcttccactgaggcttatacaggggtcgaactgccatcgcatccacgaatttctgactcgccagccgcatcaaaaacggccacgaaggcttcggaatctggacgccttcctaatgttcccagacgcccggaatcagatcgagctcctttcagcagtcccaatatgcgcccccaatcacagatgccaagtcgcccgttccgtggagatgatggtcggttgccgccgcgctctgatatcatggatgctcgacgagacaggcagtcagacttccctcgaggcggccgattcggtgatcatgaacatagccgatcgttcgagcagcctggaccagaaggcagaagctacggtcgtctagaaagagacttcccatccagaccccctgcggacgaacccttccgtggccctccatatcgtgacggacgtctcacacgtgaggcggatgggccggaccgtgctggacgcttgcgcgggcctccagattcccgtgaagctccttcgtcacgatctgtaccacctggcccacagacccaccctgatcgtgcagacttgattcaagaacatcctgagcgcggtggagacggatatcggcgcggggagcaaatgcggcaagaaaaggatgatcgaagagctttgccaacacgggctctctcccccccgagggcggacctcccgaaccgtccgccacctgatgatcgccgcttcccctcgcacgctcaagggcgttcgcgctatgatgatacaccaaccggaccccgtaatgaccggccatcccgggctcctatggatgcttccgagcctagggagcctggtgccgatatgagccatggccgattacgtcaaccagaacccgcatccgacatcccgtctggtccacggggaagaaatccatccggacggggtggacgcaccgcctctggcctctcgcatgctacaccgtcttctcctgccggggccgcggatcgtcaaccgcccactggaccaggtcgccaaggaatgcgaggcgcgcctgaacagtcgagttcaaccgggccgtcgtcgccaacaattgagaagctcgatgccagtggaattcatccagatcgtctcaaggctctgcaacagcaagcgagtgaggatacttttggtggcagtccacgctctcatcaatctctatctcccgcatcaactggtccgccatccggacctcgtagtggcctcgcgccactatcgggcccgaactcaaacaatcgcggaccaccttcaggaccagctttcggtggtgaacgtggaaggggtgacaagcggttcgcggggatcaacaacatgctccagcaatcaggcggacctggagaccgtggaggccctggcacacaaatccgtggccgcggcgcgaatagacagtcaactatgggtggtccttcgccccaaaatactcgaccaggatcaccgggagcttcggaagagggcagccgatcgggtttatccagtcacggccgtcctgatcttctgatcggccgaccttcagcttccttcacagaagacgatggcccttccaagggtcgcctcggcggcggacgaagggagccagcggaagaaaccgggtctgagtctagacggtctggcagggcctcacacgaccgggaacgggaacgggaccgggaccgagatcgggatcgggatagagagcgtgaccgtgatcgcgatcgtgagcgtgaacgccggggtggtgcggacgaggagggaggccgtagtagcagtcatcgagaggaacgagaacgggtccgagagtttgagcgtgagcgtagccgacgcggtgatactggaggaagtgcgtctcgagaggaacgatatgattctcgagaagcctcgcgacgcggaaccggctcgcgcgaagaaaaccgtcgccgagatcgccgcgagagggaagagaaccccgaatttggaccgagcagccatgagcatgaaggccgtctccgacctccttcttcgttaggtggaggaccaccgccgccgccaccacctcctctcccgggtaacgctgaggaagatcgacgatggggtgcaggcagcggtggcggcaacggcggccgcgaattacgggacagggatcgagaccggaatcgcgaccggggacgggatcgggactacactcgtgacgggggaagcggggggccacaccgaaaacgaggccggcctggaggagatgatggacctggtgaaggaggaggtggtggaggccgaggtggcatgcgcatgggaggggaaagcaaacggccccgacgagggcaatga

SEQ ID NO: 19908 - DNA, 723 bp, A.fumigatus
ctctcacagctggtaagtgatggcgcgatctcacatgtgatttccaaccacgaatggatgaagttttggtgttatacatcgacaatggagctaacaagaataatgattacaggaattgatttctggcacacggctgccgttccccgactcaacatccccagtcttcgcatgtccgatggccccaatggggtacgcggcacacgcttcttcaacggtgtccctgcggcctgctttccctgtgcaaccgctttaggcgcaacttgggatactaagctcctatacgaggtaggccgattgatgggagaagagtctatcgccaaaggcgcgcatgttgtgctgggtcccacaatcaacacccagcgatccccgcttggaggccgaggcttcgagtcgttcgccgaggacggtgtgctctccggcattctggcgggacactattgcaagggtttgcaggagacgggcgttgcagccactctgaaacattttgtctgtaatgaccaggaacatgagcgcttggctgtcgacagcattgtgacgatgcgcgccatgcgcgagatctatctcttgccctttcagctggcgatgaggatctgcaagactgcctgcgttatgacagcctacaacaaggtcaatggaacgcatgtcagtgagaacaagcagatcatcaccgatattctccgcaaggagtggggctgggatggtctggttatgagtgactggtaa

SEQ ID NO: 19909 - DNA, 216 bp, A.fumigatus
ctggtgaagcagcctcggctccgccagcttcgagtcacgttccttccggagcgtgacaaattcctcttcggtaacgccgtctctaagatgtttattttgctgcctatgctcatggacactcagcgaggggacgggctccttgcgcccttcgggaggatagtcatggcccgtccagaccttgacgtgatcgggcaggcccaagaccttccgccctga

SEQ ID NO: 19910 - DNA, 1446 bp, A.fumigatus
tcatcgtgccgttcaactcttgcttccttttgttcacttgcactccagttctcttacatcttccggtctcatatcatgtcagtcatgtttcgcagccgcgtaacagtggcagcctctgctgctgtttctcactcggtatttgctgcacagaatgcctcgacggtaacgcggggtttcgcgacagctgcggtgggcacgtcgcgcaatcacagagtagtcgtggtgggcggtggcagcgctggtctcacggtcagtcatcagctgcttcgcaccggaaagttctctcaagacgacattgcggtggtcgaccccgcgatctggcatcactatcagcccggatggactcttgttggcggtggtctgaaaaacaaggaggatctacgtcaacccctcaacggcctgctcgatcccaagctcaggttctacaacgacagtgtgcacacgttctcgccggaaaacaacttcatcacgctcgccaacggcgacaaggtcaactatgagcacttggtcgttgtgcccggcatcaatgtcgacttcatcagcatcaaaggtttgcctgaggctctcgcggattcgaactcgctcgtttcgtccatctacggctatgacacttgcgacaaggcctacagctccatcgagaaactgcagaaaggtaccgccatttatacccagccggctggcgtgatcaagtgcgcaggcgctccccagaaggtcatgtggctcgcgctagactattggaaacgcgccgggctctacaaccccagcaacccctcgagcggagcaattcagatcagtttcgcgaccgcgcttcccggaatgttcggtgtgcccaaatacagcgccaagctggaggagctgcgcaaggagagaaaggtggaaggactgttccagcacgaccttgtctccatcgatggcgacaaggcgactttcaagcgtctggatggacaggagcaagtgaccagacggttcgatttcctgcatgtcgtgcccaagatgggagcgcatgcgtttgtgaagaacagccctctcgccaatgaggctggtttcgtcgacgtcgacgacaacaccactcgccacaagaagtacggcaatgtttggtcggccggtgatgcctccagtctccccacgtccaagacggcggctgcgatcacggcacaggcacccgtgctcgtcagcaacctgctgcgaaccatggagggcaaggagctcgactcctcctacgacggctacacctcctgtccactgctgaccgagtacggcaaggtcctactggcagagttcaagtacgcaggagaacccaaggagacgtttggtaaaatgctgggcatcgaccaggccactcctcgccgtgcgttctaccacctgaagaaagacttcttcccctgggtctactacaactacatggtgaagggcacctggggcggtcccaagggctggatccgatag

SEQ ID NO: 19911 - DNA, 423 bp, A.fumigatus
ttgaaccggctagacaatgttttctgcggtgatctgatcttccattcggatattggcaccgcacgctgcgatttccctggcggcagtgcaaacaacctctatcgttcagggcggaaggtcttgggcctgcccgatcacgtcaaggtctggacgggccatgactatcctcccgaagggcgcaaggagcccgtcccctcgctgagtgtccatgagcataggcagcaaaataaacatcttagagacggcgttaccgaagaggaatttgtcacgctccggaaggaacgtgactcgaagctggcggagccgaggctgcttcaccagtcactgcagatgaacattcgggcagggcgattgccgaaacctacagagtcggggcaacggttgcttcaccttccgttaaaattgaaggggttgaaatggtag

SEQ ID NO: 19912 - DNA, 1125 bp, A.fumigatus
catcatcatcctgatgtcatttcttctatacaaatcaaggtcaagcgaaggcttcatatatctcgacgaccaccaaggccagagaccaagatggaccgtatatacagaaacgtagcctttcaattgcggccaaatttacctctccatatacctacgtgttctcactcaacgcggagcatctcaatcctgacaatccaccgaccgaggatcacaaacttcaaatcaggagttaccaagacacagatcggtagagaatactcactcacaacaagtgaagaaaacatgaggatcgcaattactggcgctcgtggctccgtcggccaatttgtggtcaaactctgcgctgatgccggccactccacggtgcagatcaatcgcaccgacaccgactatgacggcacgccccgctcggagatggcaacggcggacgttgcaaacgactatgacgcgtgcctcaaagcattcaagaactgcgatgcggtcatccatctggcatcgatccccgacccggtcgataaaccagatcacaccgtccacaacaacaacgtcaactcggcattcaactgcttccgcgccgcggcggaactgggcatcaagcggttctgctatgcttcgtcagtcaacgctgtggggctggcgtatgcaaaccagccactccaattcgactacttccccgtcgatgaagacgccccgcagcgaccaacggatgcctatgcactggccaagcatgaggccgagatccaggcacgctcgttcgcgacatggttccctggcatgaagatcgcgtgtttgcgtatacacgaggtcgctcccctcaaggacgtgcagaaggagcaccaggaagattgggagaatgctgcggtcaagcagttatggggctgggtgagccctcaggcgacagcgagggcgtgtctgctcgctgtggaacggagcgataactttgagggatgccaggtgtttaacatcgtggcgccgactaccacccaagacacaccctcggaagagttggccaagaagtattacccgggggcggagattcggggcgatatgtccaagaaccagagcttctttgccgttgaaaaggcacagagaattcttggatggacccatgatgagaaggagtga

SEQ ID NO: 19913 - DNA, 693 bp, A.fumigatus
atagtcgtcttcatcctgtccactggtccaactaacaagccaacttatcaaagtcaaatcccgactattctaccaaattactacctatcaaccacaatgttcaagtcggccgctcttttcagcctccttctcgctgcagcgacagcctctcccaccccgagcgaggacctcgaggcacgagcttgtgctggtctgggcccatccgtcatcgacgtgctaagagtctcaacacccgacaatgcctctcccggccagcagttcaccctcagccgcgctgggtatcccccttacaacacgcaaatctccgccataacattcaactacattcccccgaacgcaacaggctgcatgctggaaattgacatcccggccctgtcgcaacccaaccagatcgccgagggtgccacccaggtcgatatctggactactgacccctggaactatctctcgctgcctacgtacaacagccccccgaagagacgggagatggtcggcacgtacatcttcccgacgcagccgacgactgaggcgtcgaagactatcattgcctcgaatacgtgctcggataccatgagcttcctcgtggagttgagcaactggcagcaacagagtggcagtgtcaccttctacaatactttgggtggaaagcaagggattgagcctactgggttcaagatgatctataattgttaa

SEQ ID NO: 19914 - DNA, 492 bp, A.fumigatus
ggatcgcaattactggcgctcgtggctccgtcggccaatttgtggtcaaactctgcgctgatgccggccactccacggtgcagatcaatcgcaccgacaccgactatgacggcacgccccgctcggagatggcaacggcggacgttgcaaacgactatgacgcgtgcctcaaagcattcaagaactgcgatgcggtcatccatctggcatcgatccccgacccggtcgataaaccagatcacaccgtccacaacaacaacgtcaactcggcattcaactgcttccgcgccgcggcggaactgggcatcaagcggttctgctatgcttcgtcagtcaacgctgtggggctggcgtatgcaaaccagccactccaattcgactacttccccgtcgatgaagacgccccgcagcgaccaacggatgcctatgcactggccaagcatgaggccgagatccaggcacgctcgttcgcgacatggttccctggcatga

SEQ ID NO: 19915 - DNA, 192 bp, A.fumigatus
gaaattctgataagcccggtgggcccacccgcccctgtatcggcgaccatgtttaagttcgttatgcttggcatttattatgtcagctgcataaatagtgatgtcatgcatagaagccagtcgccgattcaaagtcatgtgtttggatcgccgagtgggtacaggtcgatccccgatgcattggctgcatag

SEQ ID NO: 19916 - DNA, 798 bp, A.fumigatus
gcgcagacatatttgaacatggcatcgattcaacctcacatctgcagaaattggcaagtaacagcgggtctgttcggggcgcctcctactgcagtccgagtgccactgcgccctcttccttatagagccacacagaagtcgccctacacgactggaaaagtgcatctgagaccgttagcagtctatacaagaccgctgtcaaaagtccgtgctctgaataatcgcgcctatcctagcaaaagctccctgaatgggcccgttcatcgagtaccgtatagcactgcaaccatggaaccaggagaaccgaccattcacgatgtgtttgagagcaagacaggcacctggcaatacgtggtggcggatccaacgacatcaacagccgtcatcatcgatccggtcctggactatgaccccgctacccagggcatcaccacggagtccgctgacgcgctcctgtccttggtcaaggagaagggatacaaagtcgaccgaattcttgaaacccatgcacatgcagatcatcttactgcagcgtcgtatctgcagaagcgcttggccgaggagcaaggccaccggccacgaatcgggatcggcaagcgcatcgggcaagtgcagaagttgtttgggcagagatatggcattcctgaacaggaatataaagatgtctttgacaaattgtttgaggacgatgagacatttaagattggcaatctgatggcccaggccatccatcttcctggacacacgccagaccatttgggataccgcattggaggtatgccgagtcacgcccattga

SEQ ID NO: 19917 - DNA, 885 bp, A.fumigatus
gacgcgcgggcttcatccgacaggctttgggacttacacgctaacaactcatcaattgaccagtgtgaaggattggtcgctttcgagtataccaacggcctcgttagaaaaccaaacaccctcgtgttcatcggcggcctgggcgacggactcggcactgtcgaatacctgaccgacatcattacagcgctggaatatacaccctggtccgttttctcacccattctctcttcctcgtatagcggatggggagtgggtcatttgggcaaagacatcgatgagattgcgcgctgtgtgcagtatgctcgggagtacaagcaggggttattcggcgcagggaagatcgtgattatgggtcattcgacgggcagtcaagatgtcatgcactacttgagttgtgcgaatccgcgaccgcgtcacccggtgctggacaaggatgcggcagtagaacctcccaagcggcctcccgtcgacggagccgtcatgcaagcgcctgtctcagaccgggaagcgatcacttgggtcatccgagacggaacggatagggacgggccgggaagaatgcgcgagatataccagagaactattgcgcgtgcccgatctaccccttatgaagatgatgacaccctcgacaccatcctccccctgtcggcaacaactcggatcgggtatccgagctcaacacccgtgagcagtcgacggtttctgagcctggccagcccagatagtccagagaaaccggaagaagacgatttgttcagctccgacctcaccgatgaccagatgcagaagaactttggccacctggggtcgcgcggtctgctgggttcaaaactgttagtcttgttttccggaaaagaacagtcggtggccccgtggggttga

SEQ ID NO: 19918 - DNA, 264 bp, A.fumigatus
cggcaagaaggatacaaagtctgggaagcccatgtcaccatcaactccaaggagcaaagccaatgctacacctccatcaggcgagccagcaccatctcgtgctcagtctggcccgaatgcaggccctacaagcgcaccatccgcacagaagcagtcgaaatcagcgaaaggcaagccagccgctccaattacttcgcctacggctacacaggcattcctcaagcatgccaatccatcgcagggagttacagaaccattacttga

SEQ ID NO: 19919 - DNA, 540 bp, A.fumigatus
atattgaaatcagccatggcacgacccaaagtgcatcccgccaatcgtctgcgggcatacgaggcatgtctattctgcagaacatccaagaggagatgtagcggatcgttcccgtgccaaaactgcatccgaaagggacaggcgcattcctgtatgccaagcaggcgaagggagtcattctcagcttcaaggcaacccaacacgccggatgcgccaagcggacctgttactgctattatgccgtcccaggtactgtcttccacagattctcagagtcatgcatcgctcgagacctctgtcgaccagggattagcctcccctgaagcacaacacaaaacgcgtcctagaatgttgcgtagcctgcaaggggaaagaggtgtgtgtgtgtgtgtggtaacagatgatttcactccgaagcatttgagtgttgacatgctatccagtgtatgtgggcagggctgcgtcgctatccttcctgcaactactccgagatactgtcacccaacacataggcccgtcacagttctcacacaatgttaa

SEQ ID NO: 19920 - DNA, 1506 bp, A.fumigatus
catcgatacagctatgccaaaccttcgagaccctcccgcgcctacatccatgttacatccagcgagcatattgcgcctctatccgataaagtccgacaaacatcgttcgtagatgctcgcaacacgttcaatgatcccgtactcttgggaccaccgtctctagagttcgctccctacgccaaaattcctggtagtcgtgtacggaaggatgcccgccagggtacaattgaccaagatcccgaatttatcgcgttcctcgaaagtctgacacagccgattacaaaacctaccactgttgatacacctaccgacgccgaagaaaagaaggaaaccgttaccactacgcctctcgtgcagtatatcaaggaaaagaaggccaacaaagcgaaagaagcctccagcaagtcttccaggcatgccaaaggcgagaaggagtccaaatcggagaaggtacaagccaagaaacttttgcaacgtcaggacaaggatgctgccctggcacctactggagacaaggcagagaagaagtcaagggcctcagacaaggcgtcgaaagaagcagtgaaagcggcaaacagggccgccaatgctgctgctaagcaagcggctaaaccagcagcgacacaaaatactagcaaagatactgctcagcctgcttcaactgaacggaaacgcgagcgtaataacatcgctgtggcagccaagattcttcaacgagacttggggcttgcaccttcaggcggccgtcggagggctggtaagggtggttcgacagagacggactcgagcaagaaagaaccggacgctgctattactgcagatagcggcaagaaggatacaaagtctgggaagcccatgtcaccatcaactccaaggagcaaagccaatgctacacctccatcaggcgagccagcaccatctcgtgctcagtctggcccgaatgcaggccctacaagcgcaccatccgcacagaagcagtcgaaatcagcgaaaggcaagccagccgctccaattacttcgcctacggctacacaggcattcctcaagcatgccaatccatcgcagggagttacagaaccattacttgaaactgcatttgcacctttcggaaagatcttgaaggtggagattgacaagaagaaggggtttggctacatcgactttgcagagccggatggtcttcagaaggcaattgccgctagtcctgtcacggtcgcgcagagccaagtcgtcgtgcttgaacgcaaggccaatcctggtgcagaaaagactcgcggcaagggacgacgcgagcaacccgccccgaataatggcagcaacagcaacagcaacagcaatcgtggtgccaagcagggctcagatggaggatctggaccagcgacaccatcctcgtcgcgtggaccacgtggaggtcgcggatccaggaacaagggcggttcgaagggcaacggagcaaatgccagttcaaacacacctagtgggaagactggtggggagacgaaatga

SEQ ID NO: 19921 - DNA, 255 bp, A.fumigatus
atcctctcactaactccctcagactttcccttcgttgcttcgttcgtccgcacccgcaccatggtggacaacaagatccctgagccgggaccagccaaactgaggcgcaatgcaggtccagacgaatggctggaggcagcaaaagattgcaagtatctgtcagagcagcacatgaagcagctttgcgagatcgtcaaggagtacatgatggaaggtgagtctgctcagggatcaagggatacactccggctctga

SEQ ID NO: 19922 - DNA, 333 bp, A.fumigatus
caaagtatctctgaagaatcaaatatccagcccgtatcgacaccggtcacgatatgtggcgacatccatggccaattttacgacttgcttgagcttttccgggtatcgggcggaatgcccgacgggtctgaggcggaggccccgaagacgcagtcagctgtcattacatcggacgatatcgaacctccatctacgatctcagatcccaagctacgaaagaagttgagaaatacctttgcgccggaggatggcagcgaagactccagtgcgagccaaagagaccggtcctcgagcgtcttcaccacgcggctggaaggaaccgcacttggcgta

SEQ ID NO: 19923 - DNA, 1272 bp, A.fumigatus
tataacaagaacctcgttataacaagaaatttggactgtctggaatatctcgttataacaaggttttactatacgaggttagggccgagcgcaggccttggcgaatatcccgccgcggtgatcaaaacggctttttcacctccagggaagaaagactttttcctccgccatcaaccttcattgctctctgcgaggatgcatctcccaaagctcttcgcgtcagggctggtcctgttagttgttccctcagccgtcaccgccagaagaggcggaggcggaggcggaattgacaccgacacgtcaagcgatggcgacgggggctcctccagtgcccctgggggcaccagcaccattggcggcggcagtacatcctgcgggcccacaacagaaatactatacaagagcgatctcgtccccatgaactcctacaactggacgagcaaaggcgccagcaacagtggcacaaacccaaccacatacgacggatcctacttccagggcgaggcattcctgcattggcaattcaccgcatgccggccatgccataacagcagcggcactgtacgaatgctacgctacgcctgggttggcccgcagccgccgtaccccaccggcccgaccaaccccatcatcatcgggttcaaggcgtggcataccaacgacgccctcgagaacatcaccttctcgtacgactttctccacgacgggctgtactgtcccaccgcgccggatctcgtcaagatccagaccagcaatggatggacggactaccaggcgagtaccgatatcccgcgcgcggaccgggctcgcgcgcatgatgtctttgatttagacctggcgctggatgcggagcgaccagattcggtccgcttcaacgggagcatggtgccgggccttaaacccccgccgacatacaccgtggaggttctcttgcccgcgtcggcttgcaaccgacagtcgcggctgtcccttggatatggagaagagctcaatatgtctgggtccctgacgaatacgactctggagctgagtctggctggggtgggaaaggggtcttacgcctctggcagtggaatcatgctccgtgcgatgtttaatatcacattctctggaacgtttgatagcgggaactcgactcgggctgtggcgatcaagccggatactcagcccatggtgttttgggtcgataacggggctatgatgcatggctgtttgagctggatgttgaagttgatgttcatcgggtgggtcgcctggtttgtctgctgctga

SEQ ID NO: 19924 - DNA, 330 bp, A.fumigatus
caaccgaactgtatccttgtttcttgtctcgccatgagtatcagaaggacctcggcaacggcgcacaatgcggccatcaaagaccgctcgcaagctgtggcagcgcaggttgcagagcaacaaggctggctggagaaaaagctcaagcccaagaaggtcactgccagatatccgttcaagggagcgcctttgctctatgcgacatgcgcctttggaagtctgggggatgccctgtttgggtacaactctggtattgtcccctataagctggacggcaggagtgctcctcatgctaacggcaataggtatcatgtccggcttgctggttaa

SEQ ID NO: 19925 - DNA, 999 bp, A.fumigatus
gtatcagaaggacctcggcaacggcgcacaatgcggccatcaaagaccgctcgcaagctgtggcagcgcaggttgcagagcaacaaggctggctggagaaaaagctcaagcccaagaaggtcactgccagatatccgttcaagggagcgcctttgctctatgcgacatgcgcctttggaagtctgggggatgccctgtttgggtacaactctggtattgtcccctataagctggacggcaggagtgctcctcatgctaacggcaataggtatcatgtccggcttgctggttaaccccgtcttcgtgtcgcgcttcttcaaagactatggtggtgcagacggtaccacgaatgcagtcaacccatctatcacgggcatttcagtcgcatgtctgcaagcatccgccgccgtgggtgcactcattgcagggcgtctaggcgacatcatcggacgaaagaggtgcgtccgcctcggcggcttcatctacttcttcagtgcattcattcaaatattcgctcccgacttcgccacgtttattgccggacgtaccatccagggtctgggagtcggatttctgtccatgaccgtgcctattatccagacagagattgcggccccacatcggcgtggtctcatggtcgggatcgagtatacattcctcattgcaggatacatgttgtcatgctgggtggactacggtttcaatttccttttacctggccacatgtcgtggcagggtccgttcatcgtgcagatcatcctttcgtttatcttgctggccatgtcctttttcttgcctgagacacctcgctggctggcaaagaatggtttcatgcaagagagtttacagactgttgcggacttgcattctggaggcgacacggaagcggagcatgtgcaaagggttttcctcgagatccaagaagcagtcatatatgaaaccaacctcgggaagtcgagttggacggtcagcctgacaaccatcttatggctccggtga

SEQ ID NO: 19926 - DNA, 294 bp, A.fumigatus
cacgatgaacaggaaatgttcacccgttatcgcaaacgaacgatcgttggcatcacggtccagatgtttgcgcagctgaacggaatcaacatcatttccttctaccttccaagcacccttgcatcagccggattcgacaatcgcaaatcgctgctgtacacagctgcgaacgcgcttccgtataccgccgctacaatcgtaacatggtggttagcggacaaatggggccggaagcctttgctcattctcggaggtgagtgtctggtaccttctcgaaaccatatggccagctaa

SEQ ID NO: 19927 - DNA, 480 bp, A.fumigatus
ctgttttatccctcaggcctcgccatggcagttctgctcggtattgtctgcgccttcacccaggccaatctcgacatcacagtcaaagccaacggtcaatacgcctttgtcatgctctacaacattgtctacggcttcacctggggccctatgccctggcttctccccgcggagatctttcccctgcgcggtcgcagcaagggaatggcgctggcgaccacgagcaactggatcttcaactttatcatcggtatggtgtctcctgatgcttttgcgggtattcatgggtacttttacgtggtgattgcgggcttctgcctcttctctgccggtctggtttacttttactatgtggagactgcaaatcatacccttgaggaaattgccgtcttgttcggggaccaggcgtttgccgatggggacggggcagtcatggaggttgctgatgtgaagaacgatcatgggaaggagcttgtttga

SEQ ID NO: 19928 - DNA, 207 bp, A.fumigatus
  unsure (98): Identity of nucleotide sequences at the above locations are unknown.
tccgagtgctacttgtgcgaagcgtcgaagaaaagagtcccgagagttctctaccaggtcgaacactgtgcttgtgaatcgttccacctgttcgtcgnaggctctatgcagtgcgctgcggaatgcaagcctgctcagtatataacctatggcaaggatcgcgccccgtatcttcagcaaggcttctccgatcgccggtttccatga

SEQ ID NO: 19929 - DNA, 5061 bp, A.fumigatus
  unsure (2540): Identity of nucleotide sequences at the above locations are unknown.
gcatcgcctctggtatggtggcttgtacatcatcatctttcacattatccatgcgccaggttaagcatatttttttctctatctgaattcgttatggcttccggcgccacgtcagcgagttccgaggctcgcgagttgagcttaatatcaaaggttgagttgcgaattgcacttgcagatacagatgagaaactcgaaggactcctcaacacatatctggctccgttgttactgaagctaggttccgagagccacgcagtccgcagtaaggtcattgcggtgtgccaacatatcaatacgagagttcaagcaccgtccatccagctgcccgtggcagctctattaaagcagttcaaagaccagaagtctcaactgatcagacattttgatttgctttatcttcaacaaggcattgatcgattgagtcccaacgcaagaattgacatcttatcccctctgctccagggaatctctgagatcggagcaaccaaccaaggtgccattatcttcaaccttgtcttgcggcttctgcctttgctcaatctacctccaaagggcagtgaagaggatacacggctgaagtcgacgctttgcctttctgaccaggataggagttttctgtcttcgtggttcgagaagttacttcttctgtaccctgcagaaaaagatgcaaccacatgtcctgggctatcacctgcggagtacacctttttgaacaaaggccttcctgcagatgagacatggaaccctgcttcgaatggcggactcaaccttaccgcgacgaaagtaacagctttgaggttcctcactagcggagctttcacggactcggagagattcattcctgctcttatcgcctctgcggatgtaaactctcgagtttctgaccttggtgaagagattctgaagcgattcattcctgacctagaacaccctgatgtggtgcagaaactgtatagcctctactttggagacggtacggtggatggtgcccagccggcgcgacccccgatacagttgaagatcctcgttttcttaggaaagtcgattgtagctacgaaggatacggaaaaagtaattcgattaatcgaggaaggtctcctctcagacaaagcaaggtcttcccagggcctacaggcctcgaaactgaggacccagatctttacattcacaacctgggtggtgcggatgggatctccttctgatctcaagctgatggcgccaaagcttatagcagggttgtgggacttcatccaatctcagggttggccgagccctgcagccagcggccaaaggcttcccgcatcagacttgagtctccgtgggcttgcctacgagagcattggtatacttgttcccaaagtggattttcaagctcaggatgaccaggcgcaattttctgactttgatctgatcaaatgggtgttcacgtcattgacctccgatgactcgggtcctcagatctttgtgagcattgagcaggccctgggaagtattttgaactcctcagtggaccgatggaatagggaatttcaagagcagattcgtcctttcctcgtccatcaaatgggtaatctacccggtgacgaagaccccatcactggattcaagatcgtccgcagatcgcaatatgctgccgtccggttctctaatcgattcttaccatatagtgatgttgtggctcgctggattgacctcatggctgttgcgcgcggatcagaactgaatcaagaggttgtggaggaaggcaagaagggattacatccttattggtaccggctgctcaatcccagcaaagacagaaaatgggtcgcatcgacagctgcggatgaaaccgaacaggcttggtacaacttcccaacgttttccgacgcaacacgcttcttacttggttccccagaatcggcgagaagtgcagtggcaccagctctgtccgcgtcggaggctctgtcggggccatacaggaccgctctgcccgttgctatcgcgtttctccgcaacattcttctctgggaggcactctcagcatccggaaacatcatagaaattgatcaagattgggatgtcaaactcgacgtgcttcttacgtctgatgagggagcccgacgaggattgaaacagtacatgcagtcgtcggacaaggaacctattttattattcctcacaagcgccttgaccggtctcacgagtgacaaacgactgggtctacagcggtgcggcgagcactttgtgagcatctgctcactggcttcaaatgacacagttggggctatggttccgcagacgttggcattgaaagcctctgtaagcagtactgatcaggaaatacaaaataaagctgcgcaagctcttgggatcctagcatctcaccccgcgttttctgatgccgatatccgatccctgctttcagatctttcagattctgtatcctcatggaaaccggcgatcggagaagccttgctgaagatacggggcgcgatccttgccataggttatatactgagcaggcttgcattccgcagcgcactgcatagagcctncgacgaacaggtggaacgattcacaagcacagtgttcgacctggtagagaactctcgggactcttttcttcgacgcttcgcacaagtagcactcggactacttagtctctcggggattctctcgccggcaatgatctctgatgccagatggaagcaaatcaaggagaaactaactcaagacgcaaaatccgagagtgatactgccatcgccaccctgggcctcctggccttgacctttgcgagatcaagtcctgatcatgcgctctttaaggagcttctcacttcactttatgagctgcatgagatccgaagccctgagatccactttactgtcggtgacgcattaagtagtgccgtggtcggttggaattcgaagtcgctgctcaggcaatttgacgtcgacgaggaggttccacacatgacaatttcggagaaagtactcgctgagatgacagacaagatcatagcggactgcaccgcatcgaagccctcgctaaggaagtcgtccgctatatggctgctgtgtctgatcaaaaactgcggacatctggccgagatacaaagccgtttacgcaaatgccaggctacattcacaggcatactcggagatcgtgatgaggttgtgcaggagactggagcacaagggttaggccttgtgtacgagatgggcgatcaatccctcaaagacgaccttgtgcgagatttgatcgagtcctttactgcgaacaaatctaatctcggaggaggcaaagtccacgcagatacggagctttttgaacctggtgctctccctactggcgaagggtcgtcgattaatacatacaaagatattatgaatctcgcttctgaggctggtgacccaacaatggtgtaccggttcatgtcgctagcctcgaacaacgcgctttggactaaccgtgccgctttcagcaagctcggagtcagcactatcttttctgattcgagtgtcaacggatatctggcgaagagtaccaagatctatccgaagctattccgctaccgatttgatcccaacccgaacgtgcaaagatccatgaacaccatctggactgcactagtcaaggacccagcagtggtaatcaatacccatttcgatgagatcatggatgatctgctgaccagcatgctggcgggtcgggagtggcgcgttcgtcaggcaagctgtgctgcaatcgcagacttgatgcagggacggcaacctgaaaagtacgcaaagtatctggacgaaatttttactaaagcattcaagctcctggacgatatcaaggaatcggtccgagtgtcggcgctcaagctctgtcaaacgcttaccaatgcaatcgtgcgcaccttagagacgagtgatttggaaacaaaacgagctaatgccatgctagcaagcgccattccttttctgctaagcgataagggcatggagtccagtgtgcaagaggttcaaggatttgccatcgggactctggttcagatgatcaggaagagtcctagtggtccattacgagcgtttgtacctcgcataatcgaacagtttctcaattcgctgagctccttggagcctcaagcggtcaattatgtccatctcaatgccgacaagtacgggttaacgggccaggagatagataagatgagattatctagtatccgcacctcaccgatgatggaagtgatcgaacgatacttgattgacatgctggacgacgccagtatgaaggagtttgcacccaggctcgaaggtgtccttcgctctgcagttggacttccatcgaaagtgggatgcagccgtgtccttgtcctcctcagcatgaggccgatgcttttccgtccgtatgcagatcgattcgttcagctgctcagcaaatacgtcgttgatcggaacgaaactgtcagcgcatcctattgcacctccattggctatcttatgcgcttggctacagacgaccaagtcctgaaaaccatcaattatgccaagaatctatatctggccgcggaggacgccaatgaacgagtcatctcagcagaaattttacactctacatccaagctctccaacgaccggtttatggcgtttgcagctacgacactaccctttgtctttatctcaaagtatgacacggatacccatgtgcgggaggtcttcgataatacctggcaagataacgtcggcggcactagggcggtttcactttatcttaaggagattgccagcctcgctgcggagaacctggattccccccggtgggccattaagcacacggctgcccttggtattgcaaatgccatcatgttgctagacgccgatctcgatctcgccacaagtcaatcgctctggcctgtgctggagaaggcgctggcaggaaagacatgggacggaaaagaggctgtgctcaaggcgttcatgaagttcgcaagccaagctcaaaagttgtggcaggagaacaagcagcttagtgactcaatgaaggtaagtctcagtcttgcgtaccgtgtatacctaggaggctaa

SEQ ID NO: 19930 - DNA, 1182 bp, A.fumigatus
gagaatactcgtgttagtgcgtaccgtcagaggctgcgcgctgcccttgagattcagcacatctcaatattcttcatgggaaatgcgttctaccagattaggacagatccgaagcttactgagccggactcggaggaattcaagcgccttgagaaacgcgaaactgaggcttatgaagaggccaagctgattcggatggagatactatctgatgtttctcgcaaagtttctcgctatatgaaagtgattagagagaaatcggaaaagaagcagttcgtggttatcccgaaaatgaagccacagctttacagcaaaggactggaggcccgccgcatattcgacagatacgaggagttctgtgaagtgatgaataaacacgctgttcagtacaacgaatggcgcgatatcatggtcaagttactctcgcagtcgctgattgaccaggaggatgaatcagagctcgaaggaaacgagtacgaaaggtcaacaaagcatcaagatgagatgtatgtttatatggaagctctgcgcgccatgtttgcggaccgtcacgatgctctcactggtcagcaaaacgtcctcattgcacacgaagtgaaaggcggcattatccaagctcagcaaggtgaggggccgtctccggcgctatttctttcggtgatgaacacccgtagtgcgctgaaacccgcgcctgcgcttggttctcttcgtggcatcatcagcgagcttcgcagtcttgcgacctctctcgaatggcaaggaagtgggggaagctctcgcgctcttgccgagttggaacttgtcaactcagtcctccaacacgctgccaagatggctgcagagcagaacaaagtgtcatcgaatctggagagagaagtggagatgttccgggacactatgaataaccgcctcgagtactaccgtcagttgcaacaaatatccgatacggttgctccttatgatgaggagagtgtcggtaaaccgttggatgaagaactatatggggcgaagctcaaacaagagaacgaaatagatgcaaagatatccaccctaaggtcgaaacatcgttatcttctacatctgagagacgactcaggggctgataatgcatcgagaatatgtgttatatgtcagtccagctttgaaataggtaggtgcatgtgctctattcccaaacgctga

SEQ ID NO: 19931 - DNA, 561 bp, A.fumigatus
gacttcgttttgcttacatttataggggtcttgaccgtttgtggtcataaatactgtaaggattgtctgcgaatatggtggaatcaacatcgtacctgtcctacctgcaaaagaagactcaaggtcaacgactttcaccaaatcacctataagcccgaagagtttgtggtgcaggaagagaagacacccaaacttgaatcgggtcgttcatcgaacagcttcatttacactgacatcagctcgggtacgctcaaagagattaagaacatcgatcttgaggcctcctttggcaccaagatcgacactctggcccgtcatattctttggctacgcgagcatgacccgggtgcgaaatccattatattctctcaatataagaccttccttgaagtgttggggacagctttttcccgatttaaaatcggctacagtagcattgacaatgcagatggtatagagaggttcaagagcgacccagcggtatgtttccccaaaccccactgttactgtttctttactgataattgccttgcaggtcgaatgcttctttctacatgctaa

SEQ ID NO: 19932 - DNA, 276 bp, A.fumigatus
gaggctaagtggccgggtcaggttattgcgatcagggaggcgaagcgcaacaatccgatatatcgcccgcatggtcttgtggccttaggcggagtcgctcgggcgcgcagcgatgtggacttcatgccagatgcgctgaacattgtgtctcgagtactggacgaagtcaccgaggctgacgcagactccatggacattgattcgggtagcggccaaaattccaagtacgtctacaagatctgctcccctttctcagtcttttgtaggctcttctag

SEQ ID NO: 19933 - DNA, 417 bp, A.fumigatus
cggacagcaatcaagtcttatctcgaagaaatgacgcctttgattgaaaaagctgtggtgcacgggacgagaaaagtgcagatcagcctttacgaagaattaggcaagctatttgagaggttcaggaaatgggcaaccgcaggcaatggccagaagcctgaagcaggcgaattgcagggaccgttggtggcgcttgcgcaaaaaatgctttgtcgggagatagacatgtccatcgaaaacatccggatgggtcgcgcacaggccgcagctgcctacgttgctttgtcccaacagatggagctagatgtcactcaggcactacaggattcggtcaagacctggaaagacagcgaaagatcgggactggtacaacaagtcctcaaccagatattgactgaccttgcagtattgtggtga

SEQ ID NO: 19934 - DNA, 207 bp, A.fumigatus
aggaaaacaaaaaccaagacttctctatccgccaatcaaaacgtactacaatccatggatgaactttactctagcactgacgctatgcccgatctgactagctataacactgcagaacgctttttggggacgcaaggagcgcagtccaagaaaccagacagtcgcccgaaaacccgtctggcagtcgaatttcagccagccttgtga

SEQ ID NO: 19935 - DNA, 600 bp, A.fumigatus
agaggttcaagagcgacccagcggtatgtttccccaaaccccactgttactgtttctttactgataattgccttgcaggtcgaatgcttctttctacatgctaaagctcagtcatccggtcttaacttggtcaacgctactcatgtgtttctctgcgaaccacttgtgaacactgcaattgagctccaggccatcgcccgggtgcatcgaatcggtcagcaccggcctactaccgtctggatgtatctcgtatctgataccgttgagcaatcgatctacgagttatcagtctctcgtcgcctggctcatattgtccagaaggagaaagtgaaagaggcattggacgacccaggagccgttttcaaaaatctaactgaaacagccattgattcggcaaactccttggaagtacaagatgcgacgctggcaaagctgatgacaaaaggaacagcagggggggaactcgtgaagaaggatgatctatggcaatgccttttcggcaatgccacccaaaagatggacttaagggcagatggggaagtggcgaggtttttgcgaggtgatgcagcagagaaaagaagggccgctgcttcttcatga

SEQ ID NO: 19936 - DNA, 201 bp, A.fumigatus
gatgcaggagaatatgatttaaggtcagctcttggggtctctctaatcatggacaagccatacccgtctgttgtggtcatcgagcagctctcgggcatgatgggcatcaatcccgtccacgaccaggctacagggcagatctggcgagcaggcttctttagccaccatagtctgcctgtagctttcgacccggatgcctaa

SEQ ID NO: 19937 - DNA, 204 bp, A.fumigatus
gatgtgacaaagcaaaggaaatctgccagtggtattgcttcttccatcaaacttctacagagcaccgcggctattttccgcgtgctgcagaaggtcacttatcaaggcggatgggcctttggcaaggtggaaatgtggaatcgaagctggagccatacaaggaatagcctcctgcttggcaacattcaaacgctagctgattga

SEQ ID NO: 19938 - DNA, 1410 bp, A.fumigatus
ggtacggatatttccgtcgctgccgcgattatatcgccctttctcaccgagcccacgctcctatcgatgcagtgttacgctctgatgtctttatatctcatgaatgcaagccaattcagggacgcctacagcctacttgggacagccattcgcgatagccatagcgtcaatctccacgaggagcccagcgagcgtcttcagccaaaggacagaatagctcaaagacggatttggtggttactcttcatgctcgatattaaatgctcccagcagcttggaaagccggtcgctgtacagaccgctacgataacgtgtgctttaccgtcagtggatgagctgactacgatgccggaaaacacaagggtctgttggaaggacctgcacgtctcgacctatttcattcatgcggtcaagttcgcagtgtctcttgccgagatccaacgactgatttccccgtcaaaattattcgaggataccaacaacatcaccgcgctcgaacagcgagcgaacctgctggccacatcactggctggtctagagaagtggagcaatgaactaccggaggacctcatcagccccaggaagaacacgggccacgcggaagctatgtccacggcagagagtccgatagtgttagagctcggagcacccagctggctccaccaccaacgggttctccttgaagtctactatcataatgcatatgtcatgcttcagcggccattcatctgtttcccacaaccttccaattcatctcccgtccaacagccacaaacggaccaccatgctcgcagttcgctccagcacgccataaccatgataattatcgtccacgacctctgctcgtcttccgaccttttttttggctggcccgcaattctgcacccgttgtggaacgccacggtaactattcttggattcgttgtagcgaacccgtcctcttcgcggtcacggagggcaatccagtggatcttcaaggccttggctgtatttgaggccttcgcagcaaccgaacctttcgctgctcgagctgaaactctcacgaaatcacttgtcacgaaactgaatgacatattgaccaccctggatgaaaagtcggagcaggagcagacaaacgaccgcggcagaattgccccgggattgacactgcagcaatcacccgactctgtaccctcaactactccatcatccgcgaacccggttgatatgctgagggggtctctcgcgggagggttggagcacacttttgataatacatttttcacgaatgacagcctttgctcgtcgattgaagcagctgagattaacacatgggccgcctatcaagatcatcttgacatatggaatggcagccactcagataaagctctggatgcaacatatacactgggaataggcaatactccttga

SEQ ID NO: 19939 - DNA, 642 bp, A.fumigatus
ttctcggacatcccccacgggatttcaacacaccgaatcaagatgaatcaaattcctgtgttcgccggcttggggtcggatgcgcttttctcggaacgaactctggggactgcggccgaggacgctagaacgccagagggccagattatattacgagcgtgccatagtatctttctgaaggaggtcgcctccgtcacccacagccggcgtctaccatcggacatcaatctggacgacttcgtggagccggaaagcctcatacgacctcggcagtgtaatgagcggaatagcatcattcaacatgtatctctgtacaccatccagcttttaaggtatctacggtactcgaaggagaagcctggtatcgttcttggtgtggctggattttgtgccggattattgccttgtgcagcggtggctacgtccaagactgtcatcgaactgctagcccgggcccaagatttcttctacgtagctctgcatttaggcatccgggtcgaaagctacaggcagactatggtggctaaagaagcctgctcgccagatctgccctgtagcctggtcgtggacgggattgatgcccatcatgcccgagagctgctcgatgaccacaacagacgggtatggcttgtccatgattag

SEQ ID NO: 19940 - DNA, 1050 bp, A.fumigatus
  unsure (255),(323),(366),(367): Identity of nucleotide sequences at the above locations are unknown.
cgaaatgcccaagggaccttcgttgaaggagattcaagaggggaggctcgtaatgctgctcagagggaagaaatggccgctgccgctcgtcgtgcgcaactccttgccgagcaggagcgtttgagccaagcgcaagcgcaagcccccggtcttccatccaccgccaactgggccagtgctggatctccggctactccgacgtccaccggttccgtctggaacaacaagggtcaggccactaccactggtggtggngcaaaaaagacgcttgctcagatccaaaaggaagaggaggccccgaagcaacgcctggcggcttgcgnggccgctgctcaaaccgcagctgtttcttcacccgcgacattnnaccgcaagcggtatgcggatctcggcagccaaggctcctgcgacagcccctgttgccgaaatcagctccgggtgcttggaactaccgtgggcgccggcggaaagcccaaacctcctcctgccgcaccatctggtccccgcgctaccagcggtaatgttccaccggccgcatcgcccgccaagccccgggccgtacccgtagcctctccccgacctgtagccgtcggtagcgccccgccgtcaaacgccaaccgcgccctggaggagtttaccaaatgggccaagttgtctttgggtaaggggctgaacagcaatatcaatggtgagttctgcatctacgcaatcatcgagaacaaacaactgatggtgattttagtggatgacttcgtgcaacaattgctcctcttgcctgccgaggcggagattatctcggactcggtgtatgccaactcgcagacgctggatggtcggcgatttgcggaggagttcattcgccgccgcaagctagcagataagggcattgttgaccccgtagcacccagcgcccttgcggaccagaagaatgctgccgggggtggatggagtgaagtggccaagaagggatcgtccaatgcgcaccgcgaagaggagagtagtaacgcagcgttcaaggtggtggccccccgtaagaagggcaaacggtga

SEQ ID NO: 19941 - DNA, 564 bp, A.fumigatus
ctccggctccctcgccgaccgccgcgttgtcgccgtatacagattcctcagcggcaggtgcggcgccgtcggcgagtccgtcccaatggccagcggcgcccggtgggccgcaaactcggcatacgcaaacgcacgcgcgcatcgctcctcgcccagcagccgcggccacgcacgcagaatcgccgggtccgcatgcaccggctgcaccgaggccgtgatccccagctggcccagccgcgccgcgtcctcaggcgccgtcagctccagatgctcgatgcgatgccgccggccgggcgtgcccaccgcggccagcgtgtcgattgccagccgcaccgtcgcatcgccgatcgcatgcagcgcgcactgcaggcccgcagcgtccgccttggccactacggcccgcagcatgtcggccggccacagcggctcgcagttcgtcggcccgtcaccatcggcagtcgcagcagcagcagcagcatacggcagcagcagcgccgcggtgcacgcatccaccaccccgtcgcagatgaccttgatgcccgcgatgcggaaatccggcgatga

SEQ ID NO: 19942 - DNA, 186 bp, A.fumigatus
accctccgttgccaccaccgctactgctaccttcattgtgactggattggccttggttatgctcgtttgattctgacgtgttccacgacggatgttcaccccatgtgggaggggcctgttcgctatgctgagctagaccactactacgacggcgctcgggagatggaggttcaggactgtcgttaa

SEQ ID NO: 19943 - DNA, 681 bp, A.fumigatus
caaccgcagctcatccaccacaccatcggcaacttcaatatccaaccggacaaacaagccgtcacccgcatcaatgactccctatctacattgcaacaatctcgcgagctccgtatgcgcgatgccgagtcggcactccgtaaactctcccgtaacttgcatgccctgaccgcgcaacatgaggaagccgtgtcctcacacgactcggcaaagcacgctgcgcagatggttgagctcgacacgaagaaattccggatcgccaaggccgcaacagagctggagattgagagcgagaggctggaaggcgagctagagatgctcaaggagagactggctgagttggaagcgcaggggctcgagggcgacgaagctacgcggagagagagggaggccgatgatgcgactatgtgggtggtgcttctctgtttttactggagagttctgactgattatgcgacagacttcgcctcaaaatctaccggtccttgggcattgatatcgaggcggacgaggccggcaacttcagcaaggccgttattcgcaacagtcgcaagggagacgtccacgtggtcaatatggaccccaagttctcgcgttttttctatgccaattacttttggtcaaccatgcagggttgagttgtgcaatctggttatggcgtttggttttctcccaggttga

SEQ ID NO: 19944 - DNA, 993 bp, A.fumigatus
aagactacagagaagatgccgggctttggaagtgtgcgcggagagagtcgcctcaagggcttattctccaaggatagctcagaggatatttcggcctccatcaaggagaagccttctctcagcaacttggagcgtttggccgaagaccaggaggagaaacgctcgcagtcaccctggggggaaaccgttaagacacgcactggccgcagtgagacgaacccatttgcagaggacactcgcagtggaagcgctgcccttggaggatctcaggacgcgagcgcgccgtcccagaccgcggaccagctgggcttctccgcatttggaatgacatcgagtattccgggcttcagagagctaatgcagagccacgaaaattctcgcaaccccacgccgagcttactccaaggccaggaacctactagcccgaccaacaccaatccttaccaaagcccgcagggcgaacggatcgacgctgatgatgtcgagaccgacggatcggacattcagaacacccaccaccctggcctttcgggtcttcgagattcggccggtccattcagctcgatgcgaagaatagggtcgggcatggatcttccttctatcgaccgtagccagacttccagtgccgcaggcaaccgcagctattctggtctcggcggtctcggcggccttcctactctgggaggcgcttcggcttggtcttctggcgttgttgggactcctactcgagagaggtccgccttctctaccggcttcggtgatcccatcttcggcaccatggctgatcttcagtcacctagtctgtcaacgctgggaggcggtggcatcttcagccctggtattacgggtactggcagtattggccgctccagcaagctaggctctcttttccccccagcaatgcaggagcagatgcaaggggatcaagccagacaaggcagtttggaggatggttctcaacatcaaggtaggtctaactatgctcctatatag

SEQ ID NO: 19945 - DNA, 1701 bp, A.fumigatus
  unsure (1024),(1099): Identity of nucleotide sequences at the above locations are unknown.
attttccaatacactgaccctttttgtgaagaagtctcacaaggagacaaagctggtcaaccgacgacaacctcaacgtcccagactcctgtctctgcgatcggttccgttccggcctctatggcttccgaagcaccacaaccgagtcaaactccaggacagtccggaagcaacgctgggtctgtgcctcctgcccaacaacggaccatggtgatgcccgaccgaatgcgctggatttaccgtgatcctcagggtaacattcaaggtccatggaccgggttggaaatgcacgactggttcaaggctggctttttcagccccgatctgcagatcaagaagctcgaagatccagagtttgaaccattggcgcagctggtgcgacgcattgggaactctcgcgagcccttcctcgtacctcagatcggaattcctcatggacccgaccccaacgctggtgctccttggaccggatccaccaccgcgcagcctcccttccctggcagcttcccgagttttggtaccaccttaaccgccgagcagcagaacgctctggagcgtcggaagcaagaggaacagtatttgatggccagacagaaggagcatctcgctcagcagcaggcgatgatgaagcagatgcagttgcaaggcgccgtccatcctggcatccaccctcaacttcagcatcattccagcgcccacagccttcacagccagcctagctttggcagcattgcttcacccattggattccagccatctccgattcaggggccaatgcagcagcagccgcctcagtctgtggctggtttcttcgatgcagcagcacccttgaggcagggcccgcagatggtcggagccgatctggtcaatagcccgcatcaacttgcgccgctccttgatcgcttgaacatcagtcgtccggatccgttcgcatttggcagcccgtcctattttgcggctcggcagccggacaatctctttcattcccaacaagtagccacgatgttgcaagaccgtgcccggntacagcaggaacaagaacagtttgacagtactcagggagaaggcattttcgagcagcaggcccgcgaagaccggntgcgtcagtttcatgcactgagagcgcaggaaggcgatttcggcatgcaaaatgctcaaggtcatccttcccatcatgctaccgaaccttcccagcagcaggaaatggcacccatcggttctcctcagaagaccggtaccagctctggtgttgttgaccagggcaccgcaccaagcgaggaagccccgctcactctgtctcaacaagtccagaaagctgcatccgctcagagacagcagcaggaacagcaggagcagcagcagcagcagaatgagcagtctcacgccgactctgcgtggggcgccaaagacgacaccgctatgccccctccgccttctgcgtcgccgctccccgctcctgccgcacagcgtaaccgtcagaatgtcgccgagtccctggcagcgaactcgcggtcgcagacgcagacccctgtcgaggctcccaccacgtccatcgcgccttgggccagagggggtaacgaaatgcccaagggaccttcgttgaaggagattcaagaggggaggctcgtaatgctgctcagagggaagaaatggccgctgccgctcgtcgtgcgcaactccttgccgagcaggagcgtttga

SEQ ID NO: 19946 - DNA, 774 bp, A.fumigatus
acaaaatgcccgctcccacaccctttggtggcctctatggcaaaatctcacttcatgttcgaccccgacttcaaaaacctcaatcatggcaggttccccttcgagtcgagagtttcattgacctcactaacaccttcccttcccccaggctcgtttggcacatatcccgttgcagtgcagacagctctgcgacacttccaatcgcaagtggaggcccgtccggatccgttcatccggcacatccagccccaattgatagacgaagcccgccgcgccgtggcctcgctgctcaatgtgcccaccaacgagtgcgtgttcgtcaagaacgcctcgacgggcgtcaacaccgtcctgcgcaaccttgtcttcaagcagggcgatgtgctggtgtatttcgacaccgtgtacggcgctgtcgagaagacccttgtctcgctgactgagaccacgccgctgcagctgcgcaaggtccagtaccagttccccattagccatgacgagctggtgcggaagttcctggaggtcgtggcgagtgctacggcggaggggttgacggttcgtgttgcggtgtttgatacgattgtcagtttgcctggcgtgcggttcccgtttgagcggttgatcgaggcgtgtcgcgccgaggggatcttgagcgttgtggacggggcacatgggatcgggcagattcccctggatctgggtgctttgcagccggatttcttcacgacgaattgtcacaagtgggttttttttttttcttttctcaacctttga

SEQ ID NO: 19947 - DNA, 1797 bp, A.fumigatus
gcaggatccgaagacggcctcggctcgattgacgctgcaggctgcgcaggccgcggaggttgctggggagatccagaaggcgttggtgcgggactatgggacctttgtgcctgtgtttgcgcacggcgggtggttgtggacccggctgagtgcgcaggtttacttggagaagagcgatttcgagtggcttgcaggtgtgctgaacgagctatgcaacaagctggtgaagaagtttgccgagccaaagttgtgatggtgatatttcctacgtgtatatacttccttaggtgtatatatatatatatatatatatctctacatgaattctgcgtcagcaactgcctaggaacggctgtacaccctccttccatcaaagtatgtctcgcacaccgaggcctccagcagcttctcggcctcccactccatctccaggactgcaaaatccgccttcttcccgacctccaggctccccgtgaacccatccgccaaagcacgagtacgccgagccggccgtcgccgccgaaaccgcctggcagcagcgacagcttgaactgcgggtttaccgtcacagttgactccggctccctcgccgaccgccgcgttgtcgccgtatacagattcctcagcggcaggtgcggcgccgtcggcgagtccgtcccaatggccagcggcgcccggtgggccgcaaactcggcatacgcaaacgcacgcgcgcatcgctcctcgcccagcagccgcggccacgcacgcagaatcgccgggtccgcatgcaccggctgcaccgaggccgtgatccccagctggcccagccgcgccgcgtcctcaggcgccgtcagctccagatgctcgatgcgatgccgccggccgggcgtgcccaccgcggccagcgtgtcgattgccagccgcaccgtcgcatcgccgatcgcatgcagcgcgcactgcaggcccgcagcgtccgccttggccactacggcccgcagcatgtcggccggccacagcggctcgcagttcgtcggcccgtcaccatcggcagtcgcagcagcagcagcagcatacggcagcagcagcgccgcggtgcacgcatccaccaccccgtcgcagatgaccttgatgcccgcgatgcggaaatccggcgatgagcgcgcattatacaccgcatgcagctcgatcgcgcggtccacctgcgccagacactcctccaccgtcgccgccggcgtgataatccaatgcgccgccagccgcagcgacaccttttcggtctgtcgcagcgccagcatcgtcccccacacgttctcgtccgtcgccatctccaccaccccggtataccccgccgcattgtacgcgcgcacggcactccgcacaaactccatcttctcctccgccgtcgcgacccgcgccacatgcggccacacgatattcaccgccgccgcctcggagagtaacccgctcggctgtccgtcttccccgcggtggatgaccccgcctgccgggtcaggcgtgtccgcgacgccgagctcgcgcagcgcggcggtgttgcaccatgcgctgtgcaggtctttcgagtcgatgaagatgggccgggggtcgaggtcgtcgagcatgctggcgagcgcctgcccgtctgtcatggagtgcatccacccgcggcagaagaggcggggggcgtgcgggagctgtgcggcggcggtcttgatggtagagcggatgtcggagagggatctgcagtgcccgaggtcgattttggagaggcctgcgccgaacaggaggagatgcatgtgtcttttgtctttgtgttag

SEQ ID NO: 19948 - DNA, 693 bp, A.fumigatus
  unsure (39): Identity of nucleotide sequences at the above locations are unknown.
ttaaggtggctgtataccccccgcggcagcgccatcctntacgtcccccttcgcaaccagcatctcatccggaccactctccccacttcctggggcttcatcccatccccggactcccccaccaccgcgccctcgctcatgcgcagcagcggctcgggcaagtccgccttcgaggagctcttcgagttcgtcgcgaccaccgacgacacggcgtacctgtgtgttccggcagcgctgaaattccgctcccaggtctgcggcggcgaggaccgcatctacgcttacctggagaagctggcgatggaggccggggacattgttgccgcggcgctgggcacggaggtgatgcaggagcccggcttgaagcccggagaggtcagtcagctgcgccgctgtgccatggcgaccgtgcggctgccgtttgccgtgtctggtagtgagcaggatccgaagacggcctcggctcgattgacgctgcaggctgcgcaggccgcggaggttgctggggagatccagaaggcgttggtgcgggactatgggacctttgtgcctgtgtttgcgcacggcgggtggttgtggacccggctgagtgcgcaggtttacttggagaagagcgatttcgagtggcttgcaggtgtgctgaacgagctatgcaacaagctggtgaagaagtttgccgagccaaagttgtga

SEQ ID NO: 19949 - DNA, 189 bp, A.fumigatus
ttatgcgacagacttcgcctcaaaatctaccggtccttgggcattgatatcgaggcggacgaggccggcaacttcagcaaggccgttattcgcaacagtcgcaagggagacgtccacgtggtcaatatggaccccaagttctcgcgttttttctatgccaattacttttggtcaaccatgcagggttga

SEQ ID NO: 19950 - DNA, 681 bp, A.fumigatus
taccggtggtgcgcagcttggacactatattccacgggttggccgacacctaccggcatggccagaatcaggatcagaaccagaatcaaaaccaaaatcggaacgccaccggtcaggagaatgaaacggtcgccgacgagcatcgtgcgcggagtgagtcacccgaattccgtgcaactggcaggctatttgcgcgagatgcggatggtccgcagccgatggcaccacctttcggcaccctcggagagtacgtcgccattttcgtttagtgtttatggtccatggctgacttcctttgatagtatcctcgaactgtttcgcgccgactttgggggcggtatggaaggtggaggagtgcgtgtgatgacgggtccgaatcccctggccatgctttcgactctgctcaacttcgatcgacacggggatgcggtgtactcgcaggaggaactggaccgggttatctcgcagttgatcgaccagaatctcaatcgaactggggctcccccggctccgcaaagcgctattcgggccctgccgaagaagaaagtcgatgaggagatgctaggcagtgatggcaaagcagagtgctcgatttgcatggagcaagtcgaactaggcacggaagtcgctgtcttacattgcaacactggtttcactatccctgcattgaagcctggttaa

SEQ ID NO: 19951 - DNA, 1857 bp, A.fumigatus
cacaaagacaaaagacacatgcatctcctcctgttcggcgcaggcctctccaaaatcgacctcgggcactgcagatccctctccgacatccgctctaccatcaagaccgccgccgcacagctcccgcacgccccccgcctcttctgccgcgggtggatgcactccatgacagacgggcaggcgctcgccagcatgctcgacgacctcgacccccggcccatcttcatcgactcgaaagacctgcacagcgcatggtgcaacaccgccgcgctgcgcgagctcggcgtcgcggacacgcctgacccggcaggcggggtcatccaccgcggggaagacggacagccgagcgggttactctccgaggcggcggcggtgaatatcgtgtggccgcatgtggcgcgggtcgcgacggcggaggagaagatggagtttgtgcggagtgccgtgcgcgcgtacaatgcggcggggtataccggggtggtggagatggcgacggacgagaacgtgtgggggacgatgctggcgctgcgacagaccgaaaaggtgtcgctgcggctggcggcgcattggattatcacgccggcggcgacggtggaggagtgtctggcgcaggtggaccgcgcgatcgagctgcatgcggtgtataatgcgcgctcatcgccggatttccgcatcgcgggcatcaaggtcatctgcgacggggtggtggatgcgtgcaccgcggcgctgctgctgccgtatgctgctgctgctgctgcgactgccgatggtgacgggccgacgaactgcgagccgctgtggccggccgacatgctgcgggccgtagtggccaaggcggacgctgcgggcctgcagtgcgcgctgcatgcgatcggcgatgcgacggtgcggctggcaatcgacacgctggccgcggtgggcacgcccggccggcggcatcgcatcgagcatctggagctgacggcgcctgaggacgcggcgcggctgggccagctggggatcacggcctcggtgcagccggtgcatgcggacccggcgattctgcgtgcgtggccgcggctgctgggcgaggagcgatgcgcgcgtgcgtttgcgtatgccgagtttgcggcccaccgggcgccgctggccattgggacggactcgccgacggcgccgcacctgccgctgaggaatctgtatacggcgacaacgcggcggtcggcgagggagccggagtcaactgtgacggtaaacccgcagttcaagctgtcgctgctgccaggcggtttcggcggcgacggccggctcggcgtactcgtgctttggcggatgggttcacggggagcctggaggtcgggaagaaggcggattttgcagtcctggagatggagtgggaggccgagaagctgctggaggcctcggtgtgcgagacatactttgatggaaggagggtgtacagccgttcctaggcagttgctgacgcagaattcatgtagagatatatatatatatatatatatacacctaaggaagtatatacacgtaggaaatatcaccatcacaactttggctcggcaaacttcttcaccagcttgttgcatagctcgttcagcacacctgcaagccactcgaaatcgctcttctccaagtaaacctgcgcactcagccgggtccacaaccacccgccgtgcgcaaacacaggcacaaaggtcccatagtcccgcaccaacgccttctggatctccccagcaacctccgcggcctgcgcagcctgcagcgtcaatcgagccgaggccgtcttcggatcctgctcactaccagacacggcaaacggcagccgcacggtcgccatggcacagcggcgcagctgactga

SEQ ID NO: 19952 - DNA, 432 bp, A.fumigatus
aaacagagaagcaccacccacatagtcgcatcatcggcctccctctctctccgcgtagcttcgtcgccctcgagcccctgcgcttccaactcagccagtctctccttgagcatctctagctcgccttccagcctctcgctctcaatctccagctctgttgcggccttggcgatccggaatttcttcgtgtcgagctcaaccatctgcgcagcgtgctttgccgagtcgtgtgaggacacggcttcctcatgttgcgcggtcagggcatgcaagttacgggagagtttacggagtgccgactcggcatcgcgcatacggagctcgcgagattgttgcaatgtagatagggagtcattgatgcgggtgacggcttgtttgtccggttggatattgaagttgccgatggtgtggtggatgagctgcggttgttag

SEQ ID NO: 19953 - DNA, 225 bp, A.fumigatus
ggcttgatcaaatccaacgctcggacggaccagcaagagggcgtccgtcttctgtcagaaatcttccgcgctgccccagagcgacgacgcgaatgtctctactacttggccttggggaactacaagctcgggaactacggcgaagcccggcgatacaatgatctgctgctggagaaggaaccagggaacctggcaagctgccatcctcggttcgctgatcgatga

SEQ ID NO: 19954 - DNA, 555 bp, A.fumigatus
cagcttggacatcgctccagaagactatatatacgagtcttgtctttctttcataatttctttttcaacgttggtcattatttcgtcattcactgcaatatgaaaaccgtcttcaccaatggcctcatcgtccgaggcaacgggagctcacaatcggagcccgtcctgggctgcatggtcgtcgaggacgacaagatagcatacattggcgctgagaacgacgagtccgtcgcacaagcaaaacaagcaccaggcgtcgaggtcgtagacctgcaccgacgaaccgtcatcccggggttcattgatgggtatgtctccctcattcatctgttcaataagaacgcgacactacgcttcccttatggtttcgctacgctcgcaactaacacaaagacaaaagacacatgcatctcctcctgttcggcgcaggcctctccaaaatcgacctcgggcactgcagatccctctccgacatccgctctaccatcaagaccgccgccgcacagctcccgcacgccccccgcctcttctgccgcgggtggatgcactccatga

SEQ ID NO: 19955 - DNA, 192 bp, A.fumigatus
aaggttagcattatccggctgtcgatcgctatgcccacgctaaactaccctgattctagtccgttgaaaccagcagagctccaagtcttgcgggcccagtacgagaaggagggtgactatgttggaatccagacgaaattcaactacgcatgggtatgccgactgctattctgtttccagtctaccggctga

SEQ ID NO: 19956 - DNA, 633 bp, A.fumigatus
tttcacagagattgtacgaaccccagttacgtgctcggcatcttttggatctctgctaatcgtcgatatcagattgaaatcccgcctgatacggaagactcctcctctcgacccacgaatgactccccaccccgcgaagagaataatcaacccaacgtcaacccttgggccgatcataacccctgggcaaatgaagagggctatggaggagacgacaacacatggcggccggggttctcacgtcgtacatataggtcccccgatggccggtttactttcacaaccaccaccaccactttgggtggcggcggctttcacatgggccgatccatggaccaaagacaaatgcccatagacccattgataccggtggtgcgcagcttggacactatattccacgggttggccgacacctaccggcatggccagaatcaggatcagaaccagaatcaaaaccaaaatcggaacgccaccggtcaggagaatgaaacggtcgccgacgagcatcgtgcgcggagtgagtcacccgaattccgtgcaactggcaggctatttgcgcgagatgcggatggtccgcagccgatggcaccacctttcggcaccctcggagagtacgtcgccattttcgtttag

SEQ ID NO: 19957 - DNA, 480 bp, A.fumigatus
ggacgcggcgcggctgggccagctggggatcacggcctcggtgcagccggtgcatgcggacccggcgattctgcgtgcgtggccgcggctgctgggcgaggagcgatgcgcgcgtgcgtttgcgtatgccgagtttgcggcccaccgggcgccgctggccattgggacggactcgccgacggcgccgcacctgccgctgaggaatctgtatacggcgacaacgcggcggtcggcgagggagccggagtcaactgtgacggtaaacccgcagttcaagctgtcgctgctgccaggcggtttcggcggcgacggccggctcggcgtactcgtgctttggcggatgggttcacggggagcctggaggtcgggaagaaggcggattttgcagtcctggagatggagtgggaggccgagaagctgctggaggcctcggtgtgcgagacatactttgatggaaggagggtgtacagccgttcctag

SEQ ID NO: 19958 - DNA, 582 bp, A.fumigatus
ctgatgacctcagaatccgcaaaactcaaacatcatcaccaccatcatagcgatctggaattacctaatccccatgcccaccaaggacctgaagagacatttgagaatctgctcatgatgctagaggcgcaatttggatcgaatattgcaccgattgaacgaccgcgcattccttctggtattcgtgcgaacaggacgaccaaggccgatccgtcggtatcagccgccgtcaagaccaaatcagatgctgcaggtgagactcctgccgagtctcaagaggacgagagcacggaagaaattgaggcggcagaacttgctcgtcttcaagcacttggaatcccttatcctggaattgagatcaaggttgataagcacgtcgcgcgggtatggctcgaaaatttcgaggtcgagtgtgcaaacaccgtgctccgggatagagtccgcgtggtcattgaacgggccgtggagactgtctcgagcatgtggggggaagggcatccggcagcccgagcctcaaatggaacgcaaggcaacaaggaggtggctgtttcaaagagtaatgagattgaggcaagggcctaa

SEQ ID NO: 19959 - DNA, 546 bp, A.fumigatus
ctcatagtatttcttcagtgtttttttgcgccgatattaacaacattagcgcccagcaaaatgtcacgacgcgcgcaagtcgaggaggtctacgactcagacccagaagaggtcgctccctccgacccctcagcctccatcctttcccctgctgcaatacctcctcccggcgcttcgaatatcccaatgagaccggctcctgagcctcgccgagagatcccaaagcattttcaatgtttatatccagtttacttcgacaagactcgatcccgcgccgaaggccgcaaggtcggcatagagcttgccactgagaatccgttggctcgggacattgtcgatgctgtacagatgctgggccttaatgttggctttgagccggagaagttacacccgaaggactgggcaaatccgggacgagtgcgggttatgttgaaggacgaggatggtaaccttatcaatcctaagatcaagaacagtatgtgcactgcccctggctacttttcgattccccgattcctttctccactctcgcagatcgcgaattaa

SEQ ID NO: 19960 - DNA, 369 bp, A.fumigatus
ctggctgtagagcaccatctctatatcctcgttgcgcagtatctcaaagctcaccccacgaccgaagaatcaccctaccgtctgagaatcagaggcctcccaatgccagagaagctccctggtgctcctccagctccccgaggctggaagatcggaaagatcctgccgatccattcccccgcttacagtggcggaggtgttagcgataaccccctcaaagatgccatggctgagatgcagagcatgggaggaatgcctggaatgcctcagatccccggtatgcccaatcttgctggcctgatgggcgaaccgtccgccgcgagtggcagcgaaaaaaagaagaaggataagaagaagggcaaggcctga

SEQ ID NO: 19961 - DNA, 297 bp, A.fumigatus
cgacgccggccttcccccgaccgagggatcatgaacacagaccccacgagaaacctgcccagctacggggccccgaatctggggccctcgcttcagcttcaacccgacaccaactcccctcggccattcttttgttctcctgcgccgagcagaactgcgacaggtaaaactcgtcgtgcggcgggccgccagattactcggaaccgcgcgagttacagttgtcatacttgtcggaggcgaaaggtgaaatgcgacaaggtatgcgcctcggttgtcgtcgcttacattgttgtcatt

SEQ ID NO: 19962 - DNA, 732 bp, A.fumigatus
ccaatgagtccgtggtctcatatctcccagattcttgttcacggcgagaagcatcagatgatgcgactcaagtcaaaattactcagtctcaatgccgacaaagccgtcaaagtcaaagtctatactccagcaaattgcgatgaagttcgcatcccatttagaaaggacaagatcgcgaaagttgtcggtaaattagcccaagtcgctcctccttcggatcaggacgatggccgcttaatgtccggtgtcttggttcagaatggatttgatctgtcgttgatggcgcctgatgacctccgcgagtatgctggtttaacaacaacgacaattacatgcaagcagcatatcacacttagctctgcaagtatggatcttatccgatgggcacttgagggtacctttggcgctatcgaagaactcggtagcaacgagcggagtaaggtcaaagaagagtccacaaaggccgttaacggagagcaggaaataaaagaggagccggcagatgaggagatcccgatggaggagacacagacatatctcgtcatgggctgcgttctcatccgctatcactctcggactcgtgaggtagaactagaatgggagggaaatatgatgaatgacggtgttgccgacgcggtcatggcggtgctgctcacggttgagagcagtcctgcatcggtcaagcgtatgctgatccttttctcattcacggaatatcttgatgctgactga

SEQ ID NO: 19963 - DNA, 303 bp, A.fumigatus
aaccccgttccgcacagtaacattcagaagacagacttccatgtcccaacgaccaccactactcttaaacgcgtccccaacaatcgctgcgctgctctgactcatagtatttcttcagtgtttttttgcgccgatattaacaacattagcgcccagcaaaatgtcacgacgcgcgcaagtcgaggaggtctacgactcagacccagaagaggtcgctccctccgacccctcagcctccatcctttcccctgctgcaatacctcctcccggcgcttcgaatatcccaatgagaccggctcctga

SEQ ID NO: 19964 - DNA, 258 bp, A.fumigatus
attgagttcgtcaaggacaagaccacaaaggagccttttgctccagagactgccgttgccttccacgtccaagagactggcatgaagcctgtccatgggatctccttatatgcagcgagcggatgcgtcgatggcatacgcggtgaccatgtccttctcgctcctccttataatgtgactaaggacgaaattgatatcatcgttgagacggcgggtaaggtgattgaagaggttttcgtgaacatcggcattatctag

SEQ ID NO: 19965 - DNA, 339 bp, A.fumigatus
catcgcatagcatccaatactcgcagtgctgttctgcatagagacacacgctttattcccaagaaagccgtcggcggtaaaggcagctatatcttcttggaggacggaaccaaattcctcgattccacaggcggtgctgccgtttcttgtctaggccacggccacgagaaggcaactcaggctgttactaaccagctcaatcagcttgcctactgccacactgctttctttggtaccgaggtatcggaagaacttgctcgtttcctttgtgattcgacggggggcaagctttccaagctctatgtcgtcagctctggtgcgcgaccgtctcaagtttaa

SEQ ID NO: 19966 - DNA, 408 bp, A.fumigatus
tcggtcacacacacaggctccgaggccgtcgaggcagcactcaaacttgcccgccagtacttcctcgaattatcgcccgcccaaccgcaacgaacccggtttatcgcgcgcctgccgtcctatcatggaatcacactcggcgccctagcaacaggaggccacgtcctacgttgccagccatttgagcctcttctcgcgcaaaacacctcgcacgtctcgccatgttacgcttaccgcggaaagaaagagcatgaatcggacgcagattacgtcgcgcgactagctgcagagctggatgcggagttccagcgagtgggaccagagacggtttgcgcctttatcgctgagccggtagtcggcgcggtgagtactccacgagcaatccatcagtcatcaccgttagcctga

SEQ ID NO: 19967 - DNA, 636 bp, A.fumigatus
catgctgatcctaatcccgacattctggatatcaaggccctaggcgccgtccctgtcgtcccaagctactttccggcccatgaaagccatctgggaaaaaatcggagcgctttttattctcgacgaagtgatgtgcggcatggtacgtgcgggcacccttgcacgcatgggaagacgagggtgttgttcccggacctacagactatcggtaaggcactcggaggaggatacgccccagtttctggtctcttgatcagcgagaagattgtgcaggcgatggacaagggcactggcgtctttcgacatggacagacgtaccaaggtcaccccgtcgcttgtgcggctgcgttggccgttcagaagactatcaaggaagaaaacctgcttgagaatgtgcgggccatgggtgcttacctggaaaatcgactcagagagcgtttgcaggcgcatccgaacgtgggggatatacgagggaaggggctgttctggggagtacgtcgccatctttctatgcgtatcgaaaggaggaacatgactgacgctgttaatagattgagttcgtcaaggacaagaccacaaaggagccttttgctccagagactgccgttgccttccacgtccaagagactggcatga

SEQ ID NO: 19968 - DNA, 1023 bp, A.fumigatus
cagcgggcgtatgtggcacgcgacggcaaccggacgatcatctaccgcgggcagaagagcggggtggacgacttcgactgggtgcggtgtatggcgcggccgccgcggccgctgtctacggtcgtgctggacgaggcgcagaagcaggcgttcatcgacgatatcaaggagtatctgcatccgaggacgaggcggtggtattcgaatcgcggcatcccgtaccgccgggggtacctgctgcacggcccgccaggcacgggcaagacgagtctctgttttgcggcgagcgggctgctgggcttgacgctgtacctactcagtctgaactcgaagagtctcgatgaggacagtctgatgtcgctgttctcggagctcccgcggcggtgtattgtgctgctcgaggacgtcgatagcgctgggatcacgcagaagcgcgcagaggacgactccgtggcgtcggccgtgctcgtcgaaaaggacaagtccagcgccgaggagagggagcccgaaacgaaggcgaacaagggtgtttcgctctcgggtctgctcaatgtcatcgacggagtcgccgccagcgagggccggatcctcattatgaccaccaaccatgccgagaagttggatccggctcttctccggccaggtcgcgtcgacatgactattgctttcggatacgctgaccgcgatgccatgcgtgagctcttctcggccatatacagtatgctcgagggggatgcgcggacatccaagatgacgtcagtccgaaaggcgtccggacaagtgcagaagaaacatgccaaagccacagtcacccagcggaagcggcagcgcttgtcaaaggaaaagatcgctgagctggcttctgagtttgcatcacgcatcccagagggcgaattcaccgctgccgagatacaaggccatctactcaactataagaatgagccggaggctgctatcgatgcagttgaggagtgggtgagaagtgttcgagccaaacgaaaggaaaaggaacagtccaaataa

SEQ ID NO: 19969 - DNA, 3003 bp, A.fumigatus
tcagagctggatggagactcaagtagggctgactcgccaatgcaagcacaacgaggtggtgaagcagattggttttacgctcgtcgtgaagctgtaagtgcgatcctgggtcctgatcacatctcgcacatgccggacgacgaactggatgctctgttcgaggacgtgcagaaagtgcgagcaacgcgtcgaggactcgtagaaaatgaagacgattcagattctctgagctcattcccagttcgtgacaagtatatgtcaaatggtaccattgacaatttttcgcttgacaccgccatcaccatgcctgggacccctggccagcagtacgatggcgagggacaaaatggaagcgactttacgttgcaggctgcccgacaggacatgcagcggcacttggacaagcagaaagaggaattcaaaaacaaactcagaattgctgaggcctctgatcaagatgccgatgaattacgtttagagaaagaaaggatggaagaagccctcaggtcgacaaaagaggagtatgaagaacaattaaggaaacagaaagaagcgtttgagaatcacatgaaagaaatgggccagccagtgccgagaatatacgaaaatggctttgcaaagctggatgaacgagaaattagaatcgcaacttcagtttttccgtcactgggtcccagcacaattacgtccgcatggcccgagaaaatattacagcatgcgtcgctcctaaaagaggcccaggtgatgagccaaatcatggacaagaatgtcagttttcaattcgcaatcattgaccatggacacaacatggcatcgtcttacgacctcgtactcaacggcatctcgggagatgaggatgtcgttcttgaggaagccaagaagccttgcatcgcagttcgggtgattgactccaaacaacgcgtcatccatctttggtcgatcgagaagctccatcgtcgcctccaagccatgcgccaattgcaccagtacatagatcgtccggattacatccagcacttcaggcttgagaaccctttctctgagccttgttctccgcagttctcccttgtgggtgatgccgatatccccttgacagctgtcttcgagacacgggttcaggatttctctgtcgaggtcatatcaccgtacacacagaacgttgtgggtatagtcagattgtcattggagccctcatcggcgcaggcgccgtcatcaacgcttaaattcaatgtggtcatgcgtgatatggttggctttgcagaatgggaggggacggatgtgcatgcccaactttttgttccgggtatctccgaggaaggaggggctactactacgcagatgattagcggctttgatgagagtcctatccgctttgaaagtgtgcatagcatgagcttgcctctttcgagtccaaggacgtcagcgcttaagatctgcatctatgcacgtgtgacgcagatgcacctggataagctcatcagctgggatgaaatgcgcgattccgcggagctgcctccccagaaacgtaaggccccgcgcatagctgaatcagaattcttttctgaagagaggcatgatgtatttgccagggtgcaagtcctcgaattggcagagtctggcgagtacctccctgtcgaagtggtacaaaacaatagtcttgacgcgggcacgtatcaactacaccaaggtctgcaacgtcgcgttcttgtcagtctaacctacaactccacggagggtcttccctgggacgacttgaccaatatccgcgttggttctgtgagactgctggatccatggggcaagatccccgaccaagaccttcagaccccggatgtgccattgaagtttgttcaggagcctgccgtaaaagataatgctgatggtacatcgaacgtcacgttggttgctcaatgggattcgagtttacatggttctcttctccttgatcgcgttactgcggacaagtatcgcgtgcaagtcacagttcgctgggatctcgtatcctctcgtttgcaagatcccgttccattcgaggtagatctcacacttcagatccaagggcgaacctatgtgcgcccgcagtccatgttcaagcaacttttcaattcgactcgggttgtccattcaacagttcgcatgttctctctcgctatccgtccagtttccgccaaacgtgccgctgatctctggcgtatgaatacacagaacgattatgtgaaaggcgaggaacttttggcaaggtggtcgcctcgaaagatttcactggtgcgagattatatcgcagctcgcaaacgacgccggcgtcttgctgagctgaatgcagccaaaggggctctcagtgccaatagccttgctccttcaccagtcagaagcggacgttcaacacctctccggagccaagagctgaatgagcggaaaacgagactgcttcggaaatatcttgatctttgggtgacaaagactgaccccattgaagcaattcttgttcgaagcaacacggagcctccatcggacggagccgctttcgcgttgcgcgcgaagcagtcttcactagtctctgatgatggcagttctgtatcaaaccaggaactattaaagccacggtttatcgcaacgatccagacactcccgaaaaatatgtcttccttgaaatccggctacctattgactcccgacgacacaaacagtcactgggtgcggcgttttgtggaactccgccgaccctatcttcacatatactctgttccggacggcgatgagatcaatgctatcaacttgcgcaactctcgtgtcgatcacgatccggactttgcacgactgcttgccgggtctgacagcggagtgtctgcaaaaggccggcccaacgtatttgcaatctatggaacgcaaaacacattcctctttgcagctcggacagaggcgcagaaggtcgaatggattttgaagattgacgagagctactttagcaacggcgcctctcgtgcttcatccaacggaaattaa

SEQ ID NO: 19970 - DNA, 453 bp, A.fumigatus
  unsure (86): Identity of nucleotide sequences at the above locations are unknown.
acggcaatagcatcggtcatggcggagactgcaacaacggcgttcctcccctggtgtctacgccgattctactgcaaaagtggcanaagacggcttcaccccacttggcgaccccgttccgaaactgaccgtgacgatagcgacggaccattggtcgaagctcccaatctgattctgcacggtgacacgtacttccttttctattccacacattgctttacggatcccaagtacgacgtgcgatgggccacctcgaaatccatcacgggcccgtatgtcaagactggtcagaaactattcaagaccggtgactatggactaacatcaccgggcggaggtaccgtctgtggatgtggtgacaggatgctcttccatgcgttctgtgagtccaacaagcggtgtacgtatgctgcaaaccttgccatcaatggcgatcaggttacacttctatga

SEQ ID NO: 19971 - DNA, 321 bp, A.fumigatus
agacaccttgtggtgtgctttaatcccgttgagaatgttgttttgttgcacgagtgcggcttgaacaatgttccaaccattggcatcatcgatacggatgccgacccaactcaagtgacttaccccattcctgcgaatgacgacagtttgcgttccgtggctgtcattgctggcgttctgggaagggctggagaggcaggccaaaaacggagactcgaggaggctaagagcggcaggatcacatacagactccctacactgaaggagctcggcatcaagcttccagagaatatggctgagaccgctgaaaacaagcaatga

SEQ ID NO: 19972 - DNA, 339 bp, A.fumigatus
gagaaccagaaactcactatacggcgaatgtggctcacacaaagcaggatccctagcggcggcatatccaccttcggccctcttattgtcaaggcttttggatttgatcagttcaagacgattctcttcaacatcccgttcggtgcagttcagctcgtggcaactatgggtggagcttggttggcaaccgtcatcaagatgaaggggcctatagtcattctcttgtgtctaccgccaattgctggctgcgtaatgctcctgcaaattgcgcatgatgcggaacatcggggcgctctgcttgctggatattacattgtaagtcatgaagaccctttttga

SEQ ID NO: 19973 - DNA, 312 bp, A.fumigatus
aaccagcctcgccatgttctgtgtactggttcttctctgcatgtaagttatcttcttctcctttgcggcactcaagctctaaccctcacgtttagtatcaacctggtgtatctctggtttctcaacaagaagcacgcccagaaacgagtttcaatgggaaagaatgcgacgatcgttgatcactcaatgtacgctgttggtgatggtccagcagataaggagggtgtgcctgtccagcagaccgccacggaagacaatgcgttcaaggacctgacggactggcaaaatgaggactttgtctatgtattctga

SEQ ID NO: 19974 - DNA, 222 bp, A.fumigatus
attcttccaaggctgcgtatgtgttgcagtacttctgtatcgtcgtcctggtttgctgatacgtactgtcataaacaggacaggtatatcccgatattcgaccccgagtacgacacctttgattcggtgcgctcgcgaagcagcatactactcaacgctatctgcacaataggaagccgcatcgaacccagtaactaccacctattgctctatgccttgtga

SEQ ID NO: 19975 - DNA, 624 bp, A.fumigatus
gcacgtgaaaaatacttcacccatctggaacttcaatcagggccagggaagcacaagggaaccatgtccctaggagcagagccggcatacagtaagggcagagatgaggaactgattgagacagttcaatctgccccttatcagggtcacacgcaacatagcgagacaaagaaagatgacgcccttcagctcatcgagcaagtgggccactcgacagttcttaccgcagagaataacgcacgagttctgcgacgaatcgacttgaggctgttgcctgttctcttgggtatctatttcctgcaacagctcgacaagtcgaccctctcgtatgcctcggttttcggtttgatcgagaaagcccatctccacggcaaacaatactcttggttaggctcggtggtctatgttgcgcagctcgttgctcagccccttatcgcctacatcttggtcaaggtccccttggggaaattcttagccgccaccactcttttgtggggtgtctcgttgacatgcatgacggcagcgaacaccttcccaggcttgctggtttgtcggatgttcctcggtctatttgaggccggagttggtgagcgttttcatttcattgtcagcatccgtcattga

SEQ ID NO: 19976 - DNA, 1650 bp, A.fumigatus
gcaatcatgcctcaaaaagaattctgccccaaagggtaccaagaacagccttcaggaaatgccgcggcagacccgtcagtgtatctgcgctcagaaaactcgaaagattgttcctttgattttacattcgaaccgattcgtccaaaccttttccgcgtgacattctcctcgcaagaccgtcctcttcctccgtatccgagcatttcaaagccaaacacagacctcaatggcattcatgtatctgtcaccgatggcagttcttccaagacaattgaggtcggcgacgtgacggccactgtggaatggagcaatactccaatagtctcgttgtcgtggactggtgaagagaagccccttcacagggatctgccactgcgctcgtacgtggccgacgcaaccggcatcgcgcactattctgagcatgaccggaatgcgctccatgttgggctgggcgagaagagggcgcccatggacctcaccgggcgtcacttccaactttccgcgacagacagcttcggatacgatgtttacaacacagatccgttgtataagcacatcccattgctgatcaaagtgactcccgctggttgtgtggccattttctcaacaacacactccagagggacgtggtcggtcggttccgaaatcgatgggctctggggtcacttcaaggtttaccgtcaagactatggaggcctcgagcagtatctgatcgtaggaaagaccctcaaggacaccgtgaggcaatatgctgagctccttggcttcccgctccttgtacctcgctgggcttatggctacatctccggtggttacaagtacaccatgcttgatgacccaccagcgcaccaaggactcatggagttcgcagacaagctcatggaacacggcattccatgctctgcacatcagatgagctccggttactcaattgcagagacagaacccaaggtccgcaatgtcttcacctggaacaagcatcggttccccaatcctgaagactggattaagaagtaccacgctcgaggaatcagactccttgccaatatcaaaccctttgtgcttgcgacgcatccagattaccagaagcttgtcagtgagggcgcactgttcaagaagcccgatactcaggaaccaggcacaatgagactatggagtgcagggggtgggaccggtggtgatggatgccacattgattttacctcctccttcgctttccgatggtggtatgaaggtgtccagagcctgaagcgagccggaatcgatggcatgtggaacgacaacaacgaatatacacttcccgatgacgaatggcaactggctctggatggatcaggagtcactgaacaggcaaagacacagagagacaaatccgtcgggctctggggccgcgcaatgcatactgaactcatgggcaaagcctctcatgatgctttagtcgacatggagcccaaatacagaccatttgttctcaccagaagcgccactgcgggaacccttcgttatgcagccagctcttggagtggagacaatatgaccagttgggagagcatgaaaggcgccaacgccttgtcattgaacgctgggatttcactgttgcaggtgagactccaccatagcagattgagctggacgagcattgcatgctga

SEQ ID NO: 19977 - DNA, 951 bp, A.fumigatus
aagacgaagactgactgtctttcctcaacaggaccccaaccctctcccgaactcctcctccgatgggtccaactaggtatccattcacctcgattcgccatcaactgtttcaaaacgtcgcccggaaacaccgccgtcggagatgtcattgagccctggatgtacccggagatcactccgctggttcgcgacgccatcaagcgccgttatgagatcctcccctacatatactcccttggtctggagagccacctgaccgcttctccgcctcagcgctggattggatggggttacgagtccgatcccgaagtctggaccaaggccctcaaatccggagaagaacagttctggttcggtgacacgatcctcgtcggaggcgtgtacgagcctggtgtaaccgttgcgaagatgtaccttccacgtaaggcaaatgatgagttcgactttgggtatgtcaacatgaactcgccctacacctattatgcctccggtcagtgggtcgagatcccctcgcaatggagagatagcattccgcttgtcgcgcgtattggtggtgccattcctgttggaaagcccgttcaaactagagtgcctggggatgagaccgaggcttccttggcggtagacgaacttgacgactacagaggcgttgagatattccctcccaggggcagctcacatggttgcgtcttctcctatagctggtatgaggatgacggaatttccctgcagcctaagatgtctacgtacaccatcagctacagctcgacggaggagaaggtgactgttggattcaaccgcgacgaagagagcggctttgttcctgcttggaaggatctggacatcattttgcacaacggcgatgagagacgcgttgtgtctgatggctggcctgttgaatacaagggtaaagactcccgaggccgtgttgtttatactctcaagcattaa

SEQ ID NO: 19978 - DNA, 753 bp, A.fumigatus
agtcgaggccgtctaccaggccgccaacgagcacctcctcaagaatggcacccagcccgtggatctcatcaactggtcatactggctcaacatccccactgcggacccgaacaacgtacgtatatccccctatcccaccgagtggtcgcttgtttttctcactgccctagcccgtcatcctattctacatcatccaggaaggagtcaagaccgtcgacccggcctacaccaagcccttccacgaaatcggcccgctctccgctgaagctatcggaggcagctacacggatctcgcgggatggacaggcatcgccacgacgtctccaccatgccaaaaggccgggctcgtcaacccccgcttccccatctatctcagagagtacaacgtccccgcccagaagacggcctatgatatcttcgccgctgcaacccgcgggtcctcggcgttcaacaactccatcttcatgttcgagggctactccacgcaaggtgtcaaggccatcaacagcaagtccagtgcctttgccttccggaatgagaaccttcttgccgcaccgctggtcacctacgcgccggccgggccggagcgcgacaatgacgccaagcagctgggtaaccagctccgccagatcctcttccaggcgagtgggctcaatgagattggcgcttatgtcaactatgcctatggcgacgagacgccgcagcagtggtacggcagtgagcagtggcgccaggaccgcctgcgggccttga

SEQ ID NO: 19979 - DNA, 576 bp, A.fumigatus
ccagctcgtggcgcggcgggaaagcaaacggtgaccgggacctgcgagtgcgtcagctatctgggacctgccctgggaggcggacatggctggcttcagggacaccatggactggttgcggatcagttcgtttccgccaatatcgtcctcgccaacggcagtctgaagacgattgatgccaaatccgacctctggtgggccctgaatggcgcaggtcacaactttggcattgtgacctcggtgaccaccaagatctacgatatccagcatgccgactgggcaatcgacacgctcatcttcagtggagataaagtcgaggccgtctaccaggccgccaacgagcacctcctcaagaatggcacccagcccgtggatctcatcaactggtcatactggctcaacatccccactgcggacccgaacaacgtacgtatatccccctatcccaccgagtggtcgcttgtttttctcactgccctagcccgtcatcctattctacatcatccaggaaggagtcaagaccgtcgacccggcctacaccaagcccttccacgaaatcggcccgctctccgctga

SEQ ID NO: 19980 - DNA, 2331 bp, A.fumigatus
ttctctcctaggaacgtagcagcggctttcatggaccgatgttctgcgtacaatagcgcggatgtcaatggacgggattgcatggaaatgtcgctcagcgagaagatcgctctctgggacaggatgatcgagcgcggcgcggaatgcgaaagagggctcgatagcatgatggatatagttcaaagacgggaaacccccgaaggcgaagccgacgacgaagaccaagaggacgacgatgacattcccgacctgatcgtctacagaaagattgttctcggagctccggccttcaagacccttgttgcgaccctgcagagggagtgcctactggtcacccccgagttggactttatgcgggaaatcggccagaaattgcttgaatgtcttccgctaagcccgcggatcagccggagaaggtcagcagagtcattcaaggtcaaatgtacagtgagctgggatccaatcacattcctcatcacccaagagtacacgccgcagccagcaaccgcattcgagacagcgattactctgacgggatccaacagaatcgcacaggctttgccatgcgggcaatatttgtcccagacgtggccatcaactggggagcagataatgggcctcatcaagggcttgatacgcaaggggtttcataatccacaatcaggtattctgcacgacggaaccgagatcgtcgccgagcttcaaggtgcaattggcgattcgtcaagtatgctctacagcgaggtgactggtacggcctactcgattatagaagtggtggaacaactggcctggctgggagccgctcttcggtcgtctcccatcgagtccggagttgtctactgcagaccggttgtcgactgcagctgggcggtgcaggacgagggtgaggcaacgcgacgagtagagtatcattgcaagatagactatacactccgcatgggagaggacaacccgatacatctcaacggccagtgttggcaccacctgttccgaaatcctgtggtcgtcgagggatatcctattgcgcggcgaccaaagtctacgaccgacacaggtttggagattccgctaaacatgatggcggggcttgcccaagcccaccgtctcagtacgttcaacagtcggacagtcctaaaaggatggtctacgatgcttgtgcccacggaacaacatgacggtctcgtgttctggcacctaatgcaccatccggaaggcaagaggatgtcctttgatacgtgcaacacttttccacccaccaacgtatgccttcccgcgctggagaaggctcgacatgtcctaggctggtgtgctgaaatgcaattctttggaggagccgccgatgcgagttgcaacgtgcggcgatccaggctccccgaaacatccgaagactgcatgctggacaaagcatatctctccagcggacacatgatatccggtggtcatccgttcagcattggccgtaaggacataccactgcatatttccaggcacagctatatccgtaagctcaggtggattgcgcaaaagttcgtcatactttgggacgaaggtgataaaagaggctggctggtcaacgggaccagtgctctactccatcttgttcgcgcagctatgaagcaggccagtgtagaccgtttccaatcttacctgctcttcgatgccgacaaattacgggagtcacggcgatcccatgagcctactgctgcaatcgacgtcctaatggatccgagcaaccgagcgctaaaagtttatcacgaaaaggatgactccattcactttgagagccaggtagagcacttctatgacctcctcgagaagatcatcgaccaccaacagaatacagcgggaaagggcgggagaaattgcaacaccattcccagggcttatctggaaggctgggatttccacgagctggtcgtcgaggtcgatcctgtccaccctcgggtggcggttcttgaatcgatcggcaagtcctgggtagactttgcccgctcgatccacgctgttacactcttcgggcgcggcttcggtgagattataaagcccccgacagggacctgctggcagtgggcaagactaccaaagtggaggtactacctttccgcttgtatgtccgacctgaaagatattatgcaaacgcgaggtgatccggactcgatcccaatggaacttgtcgacaacatcctgtggcagaacagcgactcgttcttagcgccttgtagatgcaagggcgacgacggcgagacgcattcggactttgcgcaggttctgctgccgtcaagcatggctcgtgaaatgctgcagaacgtgacccggacggccgactag

SEQ ID NO: 19981 - DNA, 1356 bp, A.fumigatus
aacagtggcggcgctgtcatctttggtcagaatagagaagtggagtggttctgggacgacacgggggagccctgtaggaaagaggaggctatcccgtcgcaagcatttccaggctccccatcccacgatagcggcattggcagaagtgtggcatcgttgacgtcgacaaccggtgaaagcatggcgggtttgtgctcttcgcaaccctcggtgaacgggctctctgatgggccgcagccaggaaacgctggttcggaaggcactggggtcttgagtatcaccaccctcgatgaacggttacagcacctcgtcccggaggactataaagtgggaatcgtgtgcccactgtacctcgaactgatggccgtgcggactctgttcgacagcgagcacgaggcgctgactatcacggatcatgaccccaattattatgcgttgggacgcatcggacggcataacgtggtcgccgcatgtctccccgacggagagtatgggaccaactcagccaccagcgtcgcctggaacgtgaaacgcacttttactggcgtcagattctgcttgctcgtcgggatcgggggcggagtgccgtcgtcggagaatgatatacggctcggggatgtcgtcgtcagcagaccaacaggtacactgggaggggtcctgaattacgaattaggaaaagccctgggaaaggggggctttcaaccacaaggatgcctgccgcccgcccctggacatctgatgtccgcccttagtgacctacggtccgacccgcgactctcctcaacgcccctgcagccatatctagagcagattgcgtcaaagaacccagcgtacaagcaccctggttccggaaaggacaggctcttcacctccgacaacattcatgtagaacagagtgggcgccgtggaaactgcgaaagctgtgtctctcaaggggaagtcgagagaccaccccgattgtcaactcacccgaagattcactatggtctgatcgcgtcgggaaacaaggtcgtgcgagacgcggagatgagagaccaggtggcgaaccagcacaatgcactctgtttcgagatggaagcagccggtgtcatgcttgccttgccttgtcttgttatccgaggcatctgcgactacgcggactcgcacaagaacaaaatttggcaggaatatgcggctggagcagcggcggcatatgcgaagctactactctctcgcttgcggccgtcgccgggccagttggaggacgaaagagctgaatgccactctgtttcaagacttcagcgccccaagcgagcgcggactgtttcgacggcggctatcgagccatcttcgggactgaagaaagttcggcgttaa

SEQ ID NO: 19982 - DNA, 636 bp, A.fumigatus
cccgtcatcctattctacatcatccaggaaggagtcaagaccgtcgacccggcctacaccaagcccttccacgaaatcggcccgctctccgctgaagctatcggaggcagctacacggatctcgcgggatggacaggcatcgccacgacgtctccaccatgccaaaaggccgggctcgtcaacccccgcttccccatctatctcagagagtacaacgtccccgcccagaagacggcctatgatatcttcgccgctgcaacccgcgggtcctcggcgttcaacaactccatcttcatgttcgagggctactccacgcaaggtgtcaaggccatcaacagcaagtccagtgcctttgccttccggaatgagaaccttcttgccgcaccgctggtcacctacgcgccggccgggccggagcgcgacaatgacgccaagcagctgggtaaccagctccgccagatcctcttccaggcgagtgggctcaatgagattggcgcttatgtcaactatgcctatggcgacgagacgccgcagcagtggtacggcagtgagcagtggcgccaggaccgcctgcgggccttgaagaagaagtatgacccggcaggcaagttcagcttttatggcccgattgcttag

SEQ ID NO: 19983 - DNA, 1245 bp, A.fumigatus
ctctctgtacaacgggcagttgatgttcgagctcgcgaggcgatggagactcccgcgcggtctcccttcgccaacgatgaatacacagttggatggatctgtggtctcgccagcgagctagcagcggcacaatctatgatggataaggtacatggggagccacaaactccgccagctgaggcggacaacaatgtgtacatgttgggatccatgggcaagttcaaggtcgtcgcggcctgtctacctatccaacatccctcgacagaagcagttgtcaagaagatgctcgtcacgtttccgagaattcgcgtgggcctccttgttggtattggcgcagggataccgaatcatgacaatgatgccgatatctgcctgggtgacgttgtcatgagcagcagccccaaaactggaggagtcattagctatgactctggaaaggcacttgcagacgggtcctttgagagtctttctgtatcgaacagccctcccatgcccctacactctgcttcggcaaagctccaatcacagtataagatggaagggggcagggcagcggactatatcgaacagatgcggagaaggtttccccaaatatgcagcatgaaaggctctgatcctggcgatccggctgatcgcttgtttcaacccagctgtccccatgctggtggtgattcctgcacagaatgtgctccgtcagcggagattagtcgcgaaccacgtccagacggcatcccaaggtcccattatagaaccatcgagtccggtgatagggccatcaaagacgcgcctacacgagacttgattcaggacagagatggtgcgataatcttcgagagggagacaacaggtttgatggataatctccctttgatggtcatccgtgggatcggggactacaccaactcccacaaggaagtccgctggcaggcttttgccgctgctgctttcgcaagaggttttctggaccatgtacagcccgaggctattgaggccgagcctgcagcgataaataccatgtatcacggtatgtgcgacttgcaagctatgaaacgtattgcaccggatgagcccttctatctgactgtgcacgattaccatagatctaggagccccaatccgagatggaccggccgaatctcgcaacgtggtgggggcgtctgtggactcggaaagcgtccctattcaggatgctgcaccctctttgacagcggtaacattcacggattctggctacgcatcaactaa

SEQ ID NO: 19984 - DNA, 270 bp, A.fumigatus
cgcactcgcaggtcccggtcaccgtttgctttcccgccgcgccacgagctggtcagtcacgagtttggacttggtgccgcccccgatctgggccgtttccccatcctgggagatttcgacgccgctcacctggtccaggtaaattccaatcccggggtcatcccggccaagggtgttattggcccattcccccccttgttcccccaaaaagggcagttctccctgttgggctttttccccacccccctctttgacctcccagccccataa

SEQ ID NO: 19985 - DNA, 291 bp, A.fumigatus
agcactggtcccgttgaccagccagcctcttttatcaccttcgtcccaaagtatgacgaacttttgcgcaatccacctgagcttacggatatagctgtgcctggaaatatgcagtggtatgtccttacggccaatgctgaacggatgaccaccggatatcatgtgtccgctggagagatatgctttgtccagcatgcagtcttcggatgtttcggggagcctggatcgccgcacgttgcaactcgcatcggcggctcctccaaagaattgcatttcagcacaccagcctag

SEQ ID NO: 19986 - DNA, 462 bp, A.fumigatus
  unsure (162),(165),(166): Identity of nucleotide sequences at the above locations are unknown.
attccaatcccggggtcatcccggccaagggtgttattggcccattcccccccttgttcccccaaaaagggcagttctccctgttgggctttttccccacccccctctttgacctcccagccccataatcaggggggggggggggggggggaaaaatttttnttnnttcatccccccccccccctcccattcttttcctctccctccactcaacctaatccccttcttttcccttctaccccacctcaggcctccctcccttttatcccccacccttcctctcatttttcccccttcccttctacatcacacctcccttttatttctcacttccacattcctcttttcgattaccattcccctcttcgacaactcctcctcaacatacccacggctgtcccccgttccatatcctccctacctccccctctcctccctttctcttccacggcgatcgctgcg

SEQ ID NO: 19987 - DNA, 201 bp, A.fumigatus
atcgttggaacgaaagttgaccagaaccacgtgaactgggtgactgcgtacaatatgctgaccggtattcgcttcacggtgtcgagaatcaacgcaaagatggaccgggagttgacacccgcagactttgaagccaagcataaattctctttcgacatgtatgacgaccgtcaccttgcatttcccttacccagatcttga

SEQ ID NO: 19988 - DNA, 1041 bp, A.fumigatus
caaatggctaacttttgcgttgctattagtaccggtaacgagctgacgccctctgcaaaatacgacttcaaatttaaggactatgcgccgtgggtgttccggcatttgcgagccaagttccgccttgacccggccgactatttgatgtccctgaccagcaagtatatcctctccgagctgggctcgccaggaaagagtggaagcttcttctacttctccagggactacaaatacatcatcaagactatccaccactccgaacacaaactgctacgaaagattcttccagaatattacaaacatgtggagcagaatcctaacacgctgatatcacaattctatggtcttcaccgggtgaagatggcctacgggcgcaagatccactttgtggttatgaataacctcttccctccccaccgcgacatccaccagaccttcgatctgaaggggtccactatcggccgggacctgcgggagcaggatcttgagagaaacccgcgggccactctgaaggatctaaactggcttcgcagaggccgtcacctggagtgcgggccctcgaagcggcaattcttcctcgctcagttggaacgcgatgttgagctattgaaaaagctgaagatcatggattactctctcctggtgggtattcacgaccttgggagaggcaacgaagaaaagcttcgcgacaagacgttgcaagtgtttcaaccaggaggtgaccgtgaagaagagacgagtccgaacatgctgatgcgcactccttccaagctggaaaacgaacgcaaggcacgtgagctacggatgctcatcaaaaaggagcgtcctgtgccgcttgataaagccgctgcgaagatgcctgaagagattcttgatgagagacagtatcacgtcttttatgcagacgacggagggttccgagctactcacgagaacggccagcctggcgatgagatctattacctcggcataattgactgtctgacacatgtaagtgcattactgcgatgcaacgcagccagtctcccatcgaggctctga

SEQ ID NO: 19989 - DNA, 354 bp, A.fumigatus
caatctcccatgcgaagggctacatggattgtctttaatctcactctctcgaacaatttcttctccttttattattcttttccgttcccccaatatttccttgcatcacaaatattgttgtatattgcttctctcctcgcttcgtccgctctgctccgcgttactccctatttcaaagccgcccatcgtcggactttggcaattctctgccatcctagacgcacttggaaccttgctgcctgctacttcctcctgcacttcattctggcgattctcagctgtccttggatccctgttttggactcaatagtctgctgggagaagccttgttttaatttctgtgagcagatttga

SEQ ID NO: 19990 - DNA, 519 bp, A.fumigatus
cagtatgggaccgtgaagaaactggaaaacttcttcaaaggactttcccatgatcgtggccagatctctccaattccgccggagagctatggcgaccggtttgttaaattcatcaagggcattactatgtcgaaggaggaagtcgaacgacatagagaagctcgagcgcagggcgaagcatcagcagaacgaaccgattcagttgaacgaacaatgcaggctgccgagaaggaagccgcaaaggacgtctcgaccacgcatcctcgaacgctttcaactatctgggaccctgcggacgccaacggaccaggtccgacgtcgactctgcccatagtggacgaagccggtgagcagagcagtgttggtggacacagccagcatagccgacaggggccgtcgctcacagaaaaggatctgccgcccttgcctggcatgggcagctcgcaagatggcccaaaaggaaaaggagtttcttatagcggtcccaacggcacattgtcacctgtagcaagccgatga

SEQ ID NO: 19991 - DNA, 1698 bp, A.fumigatus
actacaagatcctcgctgccgaccaacatggatggctctcaggctcaggcgaatcagcctatggttccgcctcagcagcactcgaacctaatccggacagaccaggtccagaaattacctcatctcaatgagcagcaaaaggctcagcacacccagttggtgcgcaatttctgggagatactcaacagccgggacccgcagagtgcggaataccagaacgcccacatgagactcacacagctctctcagaatctgatgaaaggcatgcgaatgtatcaacaaaaccgtcagcaagcactccagcagcaccaacaggctcaggcggcagctgcagccgtgcagggacagccagttcaacgtacgcagtccgccaacccacagtctttctcacagcttctcccacagatccaacagaaagtgaacggtcttcacttcttcctccctcccaatatcagcaaagaacaggtgcaaacatggctgccggaggcgagactacggtacggtattgcgctgcagaaacaggagattggacgcgtacgtatcgcggaactgcgccaacagtttgcgcagcgacagagtgctgggaatatgagccaggaagaggtgcaggagtttaaaaatcggcagctcgcggcggagaaactctaccgagaaggcagcgacttcctgaacaaattcaaggagcaacaggaatccttcaaggcacagcaacaaaaccagcagctgaatagagcaggtctaccaaacgccgcgcccggtcaacctcaacagccacaggggactgcagagcaggctgccgctgcgactgggtctgcgcctgccgccacacctgcgcccaccgccggtgacaagcgtccagtgaatgttcctggacccatgcaccctgggcaagcccccactccggcacctcacaccattaactctgctgtaaatgcggcgcgaaatcaagccgggcaagcggccatgcctccctccacgactcagccgggccaagcgccggtcacacaagctgcaggcaccgcacctgccgttcccgccgcgccttcccaccaaccacaacagcagcagccgcaacctctttcccaacaggggactccaggcgcgcaggtcacgttcagccagacccctaatccggacggttcgacgcctactccttcagcctcacagccaatgaccgttcagggtccaccacgtcctttgtcccatcaagctgccatggcgcaagccgctcagaattataccaacaacgccgcgaacaataacctggctcaacaaaatgtgtcgcaggcagctgccaatcctcatgcacatcctcaggggtatatttccaatcgcgcgtcggaaaattcagcgcgtaacatcaacatggccattccaaagaacctcaatgttcctcctccggagccagtcagcatggcaccagcccgacccactttgtctggcggccccagtcatggcgccatgggtatgatgggccaaccagccatccagaagcatcctggctacgtccttgaaggcgaaggccagcgtgtattgagcaagaagatgcttgacatcctggtgcgccaggtcaccggcggaggagagggtgaaggccttacgccggacgccgaagaggtaagttctattcttcacattagggctgcttttcgctgtgtacgatggtcaggatatgcatttgctaaatcatcgcgatag

SEQ ID NO: 19992 - DNA, 255 bp, A.fumigatus
ttcattctgcaaatggccgacgatttcgttgatgacgtgatcaccgctgcttgccgtctcgccaaattgcgcccatcctctacgcttgaaatccgcgacatccaactcgtcctggaaagaaactacaacatgcgcatctccggcttctccaccgacgatctccgcactgtgaagaaaccacagcccacgcaaggatggactcaaaagatgtcagccgtccaggccgccaaagttactcagggaaaggccgagtga

SEQ ID NO: 19993 - DNA, 405 bp, A.fumigatus
ccccaaggattctacatctctctgtccgtgaacaatcaaagggtttttatcacaatcatggctaccaacggcgattttaccgacgatgaatcgcagcctggctctcccatgttggatgcggcgaacggccaggatgatattgaagaacaggaacgacttgacgtggaagagaagcccctcaagtctgcgatgaagaaaggtgcagcgccccctgctcctcagccgaagcgtccagaactccccgagcagcccgacccagagactctcgatttgtcgacgctcacacctctgtcgcccgaaattattgcgcgccaggccacaatcaacatcggtactatcggacacgtctcacacggcaagtcgactgttgtgaaggctatctcggagtgcagactgtccggttaa

SEQ ID NO: 19994 - DNA, 618 bp, A.fumigatus
gattcgacacccgtttgcagggtgctaccaagtccacgaagcaaggtgcatcagatgagatacgtcgctgttgacccctctgtggaagccggcgaggagttacttgctgtctctacagaagatggcagaatcatattctactcaactaagaggctgcagaaggcttcagatgacgacgaatctccaattcctcacgctgaagctgttgctgagctcggtggcagggcagctggctttcctggcagagtcaaggatttcgagatcttgaatgtgggaggggagtccaccgcacagaagggcgatcttcttgtcgtcaccgcgaacagcgagggggttgtacgcgtgtggatgctacgcgcgaatagtctccttcgtaatacgaaggagaatccggaggcttctgacaacaagagccaaggatcaaagaacctacaggtcggaaaactgttgaacgtctatgagacaggcaatcggataacctgcctcaaagccttcgtcatgctacccccagacccgttaacgcccgatgatttcgacgagagctcgggcgacgacattgaggaggatgaagaagaagaggaagaggaggagtccggcgaagggagtgatgaagaatga

SEQ ID NO: 19995 - DNA, 285 bp, A.fumigatus
actcgatgctccgtgacgagctactccgctccaagaacgatgagatcgcgtaagtattttattttttttgagcgattttttccactgtacatgatctccttatatcgaattgtcgcttattttaaaatttttttcagacgttgtttgttgtcgcggaagcgcaaactgagcgagctctactttgcgaccgtaggcttcgcgggcgcgaccgagaacgctccgaccaacgcactctatcaccaaaaagaacagacgtttcttgacgccaacgacctcactaagtaa

SEQ ID NO: 19996 - DNA, 2967 bp, A.fumigatus
tatatctacagaggtcgctatttcaatgaagctactcttccaccattccccgactttgcagctctcatcccgcgccctgaagaacaacattcatctgaaccagtcgtccaaacagacgatgtctcctctgtcattgcgcctaaagcggaaggtgctgttcgaggcatcgcgcccagttttcagcagcaggagggacagactgcacaggtgattgaacagagattggttgaagactcgctcaagaaggatgatgcgcgcatccaccagcagccggcgctcgctacaacttccgaaatcccgcaggtcgccaagtcccctacgacgcctgcgcaacctgaccaactgccgcaaaaggcgagctttgcagtgcctgataccccccctacgagtaccagccacgagtcggtggatgccagcgtttctccggctctgaaagaactcccccccagcgaagtcgcacctccgcgcgcggtctcaaaccaactaccctctgcgcaaagaaagcctgagagtcggccgtctctagtcttggctcagccttcggaagatcaacctctctcacccgcttcgtccgcaggcccttattccaacaacactccggctcctgtcgctgtctcccctgataccagcccggccgaggaagttactgaacgagcggatgaagttgcgctgagcccgaaacgtgttggtccagtacagttacagccaggcttggtcccgtccacgccggatgaacagcttcagctggaggcggcgcaatctcttcaacaaaacgccttagcaagcaagtcgatcggcgacgttacaacggcaagcagtctgtctaatgaagtaatcaaagaggatgttggccccaccccgtctgcggcagccgattcattaaaagagacacaagaccagacttccacatctgtagaggctcccgaacccaagaggccagatggagttgtcgtcactcccgaggagtcccagccaccagcacagagtatacaggaagagacccagtctcaagtgggcgctgaagttaaggtggttgcgtcaacgactccggctggcaagaagccaacaccggcggctgtgcttcctgctcaaccagaacgtatgacaacacgtgtatcatctggggccatccgacacaagtccgtatctgagatacttggcgagactcccaaaccatctgccgtgcaacctgagaaagctcatgcgattgagaaacctgctgatatggtgcgggctcctgctagcgcctcacccgaatctacagcgaagatgcgcttgaaagacagaaaagcacgagagaaagagaggagcaagctgtcgactgtcgtttttcccaagcagcagcaacagcaacaacagcaacaagaaaaggatgattctttggatattgtccgccagtatgcgggcgaattagctaggttgaacgaggagcaggactatttattcaccttgtttcagaacaaggcatatgctcctcctcgaggaacgaatcttagcacactgctggcttcagctcacaagacacttacaacttccaaccacctccttgaatatcaagaacagatggactgccgtaccttacgtcgaatctatgccctacagaatgcgaacagatggccgctgcgccaattgaagcgctccgttgagcctcctcgacagggaacgcattgggacgtcctgcttgatcatatgaagtggatgcgtaccgacttccgtgaagaacggaaatggaagattgcagcggcaaagagctgtgctgactggtgcgccgagtatgtcaacagtgacccagagcatcgtgcccttcttcgtgtgccgtgcaggataccttcgaagtttgaaaagaaagaggcccacgcatccagcatgatctcaccgccagaggagaccactgaggagatgctcgttgtctcgcagcctactccggatcttataccgtctgcagaagatgagtccgtcagtgacggcttcaacgatgagatacgtcacgatatccgggacactgtggctcccgccgcaatcttctcccttggctctgatgagttcactttctcattagacatgacacctgcggcccagaaactccttgatgaactgccgatatacacacctgtgaagatcgctcctggggccaatgtgccgatgttcgagcagcctcctgattctgcctggaagaccgaattattgcccgtctcaaaatatgcttctggtaggatcaagtttcacgaaactgagtcacccagaaagcgtagtagatatgattatttgcaatacgattctaatccggagcacggcatgttagacttgccgcctgaacagaccaatgttgcgcttttcagacctgagaataaacccatacgggataggatccatcccggtcattccttcaggcccccaactgaataccctatgccttccgttggtttcttcgagtccaggcagtcctctcagtggacatatgctgaagacgacgaattgcgacgtcttgtgaaggagtattcatacaactggtcgttgatatccagctgccttactccatcatcgcaatttacatcgggcgctgagagacggacaccctgggaatgtttcgagcggtgggtgggattagaagggctgcctgccgacatgtcgaaaacacaatatttccgcgcatatcaccagaggatagaaactgcccaacgcactgtcttggcccaacagcaggctgcccagcagcagcagcaacaacaacagcaacagcagcaggggggcaacaacagtggccaagcccagccaccgattcgcaggcgtacaacgcaacctgtgcgagtcgacagaagaaggtcttcaaagcatcttgcattgctagatgccatgcgaaagctggctaagaagcgtgagacaatgcttcagaagcagcaacacggtaagctttcaatgtcactgagattgttggattatactaaactctatctttatttcttctag

SEQ ID NO: 19997 - DNA, 1155 bp, A.fumigatus
  unsure (784),(848): Identity of nucleotide sequences at the above locations are unknown.
gcgaatttggcagctcagcgtgcaggtcaaatacctagccagcagccgatgatgaacgctccacctggacgaacccctaacggtatacctcataatcctggaacccccggtatacctggcgctacacctaacgggatgcataatggaatgcccaatgcattgccgaatggcataccgccagggatgggcgtcagccaaggccgacctcacatgcaaggtgtgccggctggtggaccacccatgaatggccccattcctccgaatccgatggcgatgaagatgatgccgcaaaccgggatgccacaaggtccgggtggtcgacctggaatgccaatgcagacatctccggataacacccgcgttatgcgcgaagcgaaccgcttgcaagaacagcagcgtatcttgcagtctcggcagcagcaaccacagccaccgcaacatcaacaacctcaggctcagcaagcacagcaacaatttcacaatcagcagcagttcggaccgcaaggctctcattcgccgaatatgaatcttcccaatgtcaacggcaccccgaataaccccagctatgatggcggctatcccagcccggggagtggaatgcagagcccatcttttccattaatgccatgcttcaaggcgtgttcactccgttctcctcggatggggcagcccaatcttctatctggcggggttgtcccgacgatcagtagcatccagagtcagattcaaaggagtaacccctacatgccccccgagcaagtaaacaagttggccacagaccgantacatcagtaccagcagcagcgaatgtcccaggtggccatgaatgcagccgcaggtaacatggntagtgtccaggccaactatcaagttcctcacgatggcaatttccagtctcctcaacctggcatgaatggcaccccgggaatgcaagttcctcagtcacaaggattctcgcctatgatgcgcgtcccacaacctgctcaacagaatcgaatgggagtaggcaactcacccgcgatgaatgtcgcccttccccagcagagccgtagcgcaacaccgcaaacacagcgcagtggaagtgctcaggcgggccctgtaccaggctcaagcaagagtcctcatccccctcaggctcagatccctagtggctga

SEQ ID NO: 19998 - DNA, 426 bp, A.fumigatus
ctatcagactctcatttacatgacgccaaggcaaaagctcaccacttcaaacacaaagttggaaagttcttcaatgtcgtcaatcccaaccaccgacatgatgaggagcatgagcgggaaacggacaaaaagagaactgcgattgccgagtcacataggtacaagtcctttgctccggttagagagggcaacagagtcaagtggtatgtcgacgcgctggactacctctgggccgtctcagtcgctttggaggaggccaaggaggtgatctatattgaggattggtggctctctccggagctgtttcttcgtagacctccatattcgacgcaagaatggagactcgatcaagtgctcaagcaccgcgctgaagctggcgttaaaatatatgtgattgtttacaaggaggttcgtcggccatattga

SEQ ID NO: 19999 - DNA, 693 bp, A.fumigatus
taccaaaagtcacaactcggttaccatgatagtgaactggccattgttgttgaggatcaagacttcatcgatagcatgatggacggaaagccatacagagcctcacgccttgccgctacattgcggcggcaactgtggcgggagcatctaggccttcttccagcacaagactacgacgcctcgaagcaccctaacgcacagccacctaacgtgtgtctcaatgagattctcgagggcccggagaacgactttgtcacagatcccttgaacgatgacttgtggaagacatggacagagcaagccacaacgaacacggaagtatatcggatgctcttccgcgcggatccagatgacaacatccgcacctttgaggaatatgacaatttcagaccgcaaggcggtatcaaagagggtcacctgttcgatccgtaccaacccgtcaaggatgtccgagagaaactggaccagattaagggccatcttgtctggatgcccctcgatttcctgaaagatgccgagatggcagaacctggtctggctgttaaccaaatcactgaggcaagtttgttacttacacggtttggaagatacttttttgctaatcttgatgcagagcatctatacctaatcgtctgctatctttgtcccaatagcggagtacttcgttgcaatcaggattttgataccatttga

SEQ ID NO: 20000 - DNA, 192 bp, A.fumigatus
tgctccagaagaagcacctgtctctgtgccaccatgcaaaaatccgaggtcaagctggtcacagaactcaatgtcgattacagtgacattggagatgcgaacaaactgttccaaaatcccttcggcattgatgagaattgcggcgaggtagaaaccgaatccatagtcgaagtctggtcttcgagaagatga

SEQ ID NO: 20001 - DNA, 1356 bp, A.fumigatus
  unsure (39): Identity of nucleotide sequences at the above locations are unknown.
gcacgcctgccagatgtggggcggaggccgcccctatgntacgctcccacagacagagaggagaagcccaagcatatcgtccgcagacaggtatatgagctaccgggtccgaacccagatgacgagaacgagaagttcgacgggccggaactatctccgctgcctgttgatgcccctcgcttgctctgcatcctgggtgacattgatagtgatccaacaatgtacgaacgtgcatgggaggtctcaaacaacagatacgcacgcgcgcagcgttcattggcccgccactatctttcgttgaagccccctgctctcgaaaaggccgaggaggcataccgcaagagcctccacatcaaccgtctcaatcacagcgcatggtttgcacttggttgtgtacagcttgaacttcaaaaatgggaggacgccattgattcatttacacggactgtgcagctcgaagacacggacgccgaagcatggagtaaccttgctgctgctatcctgcgaaccgccaaacccagcgaaaccaccgaggcggcagaggaggagcaccaggatgcagacgccgatgccgactcggaaaccaaaaaagcaccacaggatccctataagcgcaagcgcgaggctctcgctgcactccaccgcgccgctcagctcaagcacaccgatgctcgcatctgggacaacgtgcttaccgtcgcagcctcgatccctccaccagctacaccattccgcgatgtggtcacagcccagagacgggtgattgaacttctcggctcaaagaacggagagaagtgcgttgatatacctgttctcagcatgctgattgatcacgtcgtcgacacctacaattacgacgacctcctgatcaacgtggatgagaacgacgagaactcggagcgcgtcgtccgcagtggtaccatcgccggtcagatcctctccttagtggacgattccgttgtgcctctcatcacacactcggctccactctggcttctcgttgcccgtgtagaacacttccgtggccagccatccaaggcctttgaggctcacgagaaggcctggcgggcgtccgttgcctcgtgcacacagggcgcgttccaaatgggcgatgagaagaagtggatggatgttgtccgtgcaactgagaggttggtccgtgatggatatgccaagtttgggcctatggacaaagaaggcaaacatgaaggggaggctgagatggttgccaaggactggcgattcaaggcccgcagtgctgtcaggggtattttgggtaaaggaaaggacttttgggagggttccgagggctggaatcgtctgaaggagctgcagtccgaagtgggaagttcttag

SEQ ID NO: 20002 - DNA, 651 bp, A.fumigatus
gcacatcatgaaaaattcattgtcattgactacgctgtcgccttcattggtggtatcgatttatgttttggtagatgggatgctcaccaacaccccctggcagacgttcatccggccaacttgaaggacgaaatattcccaggtcaagattggaacaacaaccgtattatggatttccagagcgttgcagattggcagtcaaatgaagtaagcaaagcagactatggtcgaatgccatggcatgatgtagcgatgggcttggttggtgattgcgtctatgatatcgccgagcattttgttcttcgatggaactttgtcaagcgagataagtacaagcgtgaccatggcgtcgactggcttttgctggagggccgcaccggcgatgacgaagatcttgtcggggtacaacgtccaaagtatccttgtggacagtatattcaacatcctctcaatccgctagacaccaagccgcgagggatgcaaggcactgtgcggggccagattattcgaagcagtggcgattggagcagtggaattttgactgagcagagcattcaaaatgcttactgcgagattattcgtaacgctcaacatttggtgtatatcgaaaaccagtttttcagtaagttcgcctccgttacaatgctttag

SEQ ID NO: 20003 - DNA, 498 bp, A.fumigatus
ctaactcaactagagcatgtgttcctttttaatctgcgcgcttatgaccgtatcaacaagacttctgctctagaagaactggagaaagaagcaggagtgacgtatcatgacatccagcgtggcatagccgagtctatcatgagcgacagcgtccacccggtggttggcgaagaaggcgacaaacacgaggtcaattacgacgacgcagagcaagagaaggaagaaaggcttgcaagattgcgcagatacgaggagaagcaggaagggcgcagaagtgagcaatatcgaagcaaggactctgtcgcacatactacgatgctcaatggcggcaagatgtctgaggagccttgggaaggagatccggagagtgaaaaggcaaactttgtccaggaagagctctacgtgcacggtaaagtgtgcattgtagacgacaggattgccatctgcggcagtgcgaacatcaacgatcgggtaagtataccctcctataatgcttga

SEQ ID NO: 20004 - DNA, 333 bp, A.fumigatus
tcgaccacagcaggataccccttgatgatctctcttgtggccggtgccctacccaaaaagtcagtatatcacaggcaaatcaaagcagacatgagtactcatgcatcgcacaccaaccccgacgcaatgaacccaaacagtaccgcatccacctccgtcggcccctccccaccccagacccagaatggcctgtcccgatcggactgcttcttttgcgcctccgctaccaccgcattcagactcgcccagatctcctgccggaactcactgatctcttcttcagtgaaggccatgataccctggccctggagattgcgggtaactttgcggtag

SEQ ID NO: 20005 - DNA, 306 bp, A.fumigatus
cgtgttcaagttactgccactggagaccagcaaaagcccattatcaataccattggtggtgcaattgtcgacgcctgcgttcgagctggcaaagagggtcggaagttccgagtgatcatagtgatgcccgctattccaggatttgctggagacctgagacaaagtgcagcaaccggcacacgtgcgattatggattatcaatacaaatgtattctgcgtggggaacactcgatttttggtcagatctctgctcaaggagttgatccaagaggtgagttcttaacctttacagaagcaaatgactaa

SEQ ID NO: 20006 - DNA, 444 bp, A.fumigatus
actcaccctctaacattgtcatctcatctccccattatcaatacccacaatggccaccaaatcatcacccataattaccatcttccgcggctttccagaaaccggttgctacgtctggtcccccttcgtcacaaaactggaggccgtccccgtttcagcaacatcccctaccgcaccgaacaaggctctatccccaaagctccccgtggcaaggtcccctatgtctccatccagattggcgagcagccgccacagacgctcgcagattcaaccctcatcaccaaagcgctgattgagcaggggtacgtagaggatctgaatcagcgtctatctccaacggagcgaatgcatgacctggcgctcaaggcattgctagaggacaagttgtatccttaccaggtacgagtcaaatcactacgcacgacagtgacgaaattatcctaa

SEQ ID NO: 20007 - DNA, 297 bp, A.fumigatus
gcatgcacaggagatgaggttgagatggtcactgagggcggtgaaattgcttttgtccatcgcatgatcgaggaaagccttcatcttcgcaagagagttgtctggtacacctcaatgcttgggaagctgagcagtgtatccgccatagttgagaagctcatggagtacgggaacaacaactacgcggtaaccgaatttgttcaaggaagcaagacgaagaggtgggctgtggcgtggtcgtggactgatcttcgtccgagtatggtatgcttcagtataccttggtctagtgtttga

SEQ ID NO: 20008 - DNA, 240 bp, A.fumigatus
cgaaacaccgccaaagtgtcttccctactcgttccccgtgccatctccttccctccggaagttgacactggttcgcgccggttgtctccggactccaacatgtctcaatccaaggctggtcggaggaggagatcgagcagcatcatctaccaggagccgccggaatccatcgagcataccagtgatcaggctgccctgccgaacctcaatgctaactgggtcaatgccaagggtatgtga

SEQ ID NO: 20009 - DNA, 1572 bp, A.fumigatus
caacgagccgtaccagacacacaggcgctcaacctgctactgaacatactgtcgcctggtgctatcgcctcagggccggtctacattccctccccacagtaccttgcagtcgcagccacgtttctcgtccacccatccaccacaagccgagccaagacagcagaggaggaagaggcaccgagcgcagcgctgcggctgctccggctcaccaacacgcttgtcggaccaatttctgctaggtttgcggcggcgtttgcgttcaatcacttcgagtcctcgcggcagggaaggcggcggcgcgtacaggacgacgagaacgcgaatggcgatatctcgaacgacgacgcgaggacactgcacatcgatttgtgccactcggcatctctctggtctcgcgctgaagacttctggcatgccgtagggtgggcattcaactgctctgttctacatccggaacggtgggcacgatggcagatctggctacagttcatgtgcgaggtgctcgaggacgactggaacgagcgaaagaggcagtccacgggtgttgcggatgacgaagcccgtcgcgaagtgctcgagaaaagcttgattttccggtacatcgccggcgggagcacgccgtatgggcggaatcgaagaatcctacgagccatcttcgcagatggcggctcggcctccgtcagtgaattccgccaggtgttccacgacgaactgaaaacgctcaagcgcgaggacaacaatatcaagaagcgcgaaggcgaagtcaacatcgacaaggaccagttcggcgactacctatccgaggacgaggacgggtccgaagcaacagactccgcggcgccacccccggccagacgtccaacccgtcaatccaaacgcatcagacgaggcgccccccccaaagacaccccaaccgccgacgcagtctccgccgactcacccagcaccgcccaggtgcacggcggtgtctccctcctcggcggctttccatccctcgccctccgccaacgcctcctgcacctcctctcctccgtcgccgaggacctccccgcctccttcactactcttgaggaactctaccacctcttcgtcgaaaatatccgccacctgcccctccccatctaccaagcgttcgtgagccccttcgtcctcccgcatttctccgccgccgcgcagaccaccctctgcgagttcctgctgtttcggatgcgcgagaacgcagccccggacacagacgaggagtatctgaaccaggcgaagctggaggaatgtttcctgccctatgcggctaacacgcccagcatcgtcgataatgccaagatgtccatcgcgctggagtcgcttctggtgctcctggcgtatagtgatatgctgactgtcacgccggagctgaaggctgcggtgcaggatgggatcatggcccgggcggagaaggtccaggtggaaacaaggaagagccagagtagtcgcacgacggaggatatcgagtggtgttggctgttggagagtggtgaccggttgatgtttctggtagatgaggttctttcgcggaagggtgcttccacaaagtag

SEQ ID NO: 20010 - DNA, 246 bp, A.fumigatus
tcccgatacgattacgagcactgcccgatgacgtttctttgcgccctcaataatattattatcgatagcctctacatccacgtcgcaacacagcaagccacgttttcatcgcgcctaatcggtctttgttctaggctgccatcaatagttccctctcacctgggtccgaatgagtccagtgaacagcttgtggttcaagtggaaaagccttcgattgccgtggcgaagatccttccttgtcggtag

SEQ ID NO: 20011 - DNA, 198 bp, A.fumigatus
tatggagctgtacttgaatatagcaaacagtttggagataacggcttcgaataccatacagaggactacctaggatatagcgtggcctcaattcccatgtgtatagccaagggggagccaaaaataacaatccaaatcgacggacattttctattttgtagtaaatctacagagcagtctagaacacatccaatatag

SEQ ID NO: 20012 - DNA, 504 bp, A.fumigatus
cacaagcgagcctctctgacttggagggacgcggcgtggtacagggaaacggctgactcgagcttgtcaattgcaggtgcctggacaatccatttcgttctcattatcgccttgaagatcttctacgacatcattcctggcgtctcgcaggagacatcatggactctcacaaatatcagctatatgttcggctccttcatcatgtttcactgggtgcggggtattccattcgagttcaacgctggagcgtacgacaatctcaacatgtgggagcagattgacaacggggaccagtacacgccaacaaagaagttcctcctttgtgtcccgatttgtctcttcctacttagcacacactacacacactacgacttgacatatttcactatcaatttcctggccactctgggtgttgtcattccaaaattaccatttgtatgtccccttcgacttgatcgcgtggtcattgctaatctggtccatagtcgcaccgcctgcggatag

SEQ ID NO: 20013 - DNA, 252 bp, A.fumigatus
gtctcttttccgacttaccggatgagtcgacgtagtatctcctttcttacactaccacttggcgtctcagtgtttccttttcctgttcttttacgagcacccattgcttgctatattagtctattggacagcaccgtctacgggattgacttttctctccagtttcccaactgcgcttacaacagtctccttatctgctgcatgttcgtggtgtgtctggggtttgggggtaatacaataaagaatacttga

SEQ ID NO: 20014 - DNA, 192 bp, A.fumigatus
gttccaccagtccaggcctcctccggtatatctacgggtgttagaatgcgtcggtttgactacctgggcttatcgcagcactgcttgcacatccaggcgtcttcgaccctgtaccatagtcgtccttctatctggctgcgcgtgttgctgcaagtgatggccggcgccattaagctcgatgctggtttctag

SEQ ID NO: 20015 - DNA, 423 bp, A.fumigatus
aaacgctcaagcgcgaggacaacaatatcaagaagcgcgaaggcgaagtcaacatcgacaaggaccagttcggcgactacctatccgaggacgaggacgggtccgaagcaacagactccgcggcgccacccccggccagacgtccaacccgtcaatccaaacgcatcagacgaggcgccccccccaaagacaccccaaccgccgacgcagtctccgccgactcacccagcaccgcccaggtgcacggcggtgtctccctcctcggcggctttccatccctcgccctccgccaacgcctcctgcacctcctctcctccgtcgccgaggacctccccgcctccttcactactcttgaggaactctaccacctcttcgtcgaaaatatccgccacctgcccctccccatctaccaagcgttcgtga

SEQ ID NO: 20016 - DNA, 1035 bp, A.fumigatus
ggcattatgacgggatcttccgataatgaaaatgactcgcgaaccgcctctgttggtgttcagcgcagccgcttgaacgacttggctgactcgtcgcgccccaactcgtcggatccaaacccgaatcctcgaaaaagacaacggagaaatggcaaatctgcggtgccagatgtgcgagactttgtccctcaaggcgctactttcacagcggcatccctagaggtagatccggacagcgcgtccagctctggttctgattcgtccgacgacgacgatagcgacagcaaatccaccacgtccgatgcagagaaacagaatactgcacggacgaatcctcaggcacctgccattaactggaacaagacgagcaagagtggcatcagaacgtcgctatccaggcgagcggacagcacgggcgagaacaaacaggcttcttttcagttcaaggccgtcaacgacaaattctggcgcagtcgcagtgcttctgtgtctagtgacggtggcgatcaggatgttacgttggttgaaaacgagggtgacatggaggaaggggagcttgacgaggagacatcagcagagtcgagtgacatggatcaatctggagattcggatgactccgtatctctggattccgaggctgatgactcaatactgctgaatattggcgatcagaatgaccaaacagatggcttgtctgctgaagtaaaacctgtgtcggtgaatggtcttgccgcaagcgaccgatccacaatttcgaaggaagaatcacatcgtctcttttcccagaagtactccgtcactccgacaatacttgcggatcttgatcgaaatgatatggagatacaggctaggtgcttgttttatgaccgcgatatcaatgatatcaaccttcaattgccggtatcgtgcaccgagtgcttaaaagagggacatcttgcagcagtgtgtccttccaaagaggtatgttctcgaaacattcgactgagtgtcagatatataccccccatgacacacacggtcttctggaatctataa

SEQ ID NO: 20017 - DNA, 498 bp, A.fumigatus
tgcgtacattgtggcgcctggaaccagcaccaaagcatattctgcccgtcctggcggagatgtcaacgatgtcgagaacgcggtcatgatgaagaacaatgcacctcgcttctccaaggctccgcatccgagataccttgtgatctctgtggatcatctagccacctggaactccagtgcgatatgatgtggaagatcccacggcaggagctgccctcggggcccgtactagtctcaatttcatgctcccactgcaccagcaaccgtcaccttgtcggcgactgcccgtccctctcacggccgatggtctcatcatcattcaccctccgaggcattgacccccacatggtgacaaacattaactccgtaatcagcggcaggcaaggcggaccagccccccgaagaggccagagcggcatgcaaatccggggccgcgctgaccggccctcggcatcctcagacagcgaggacatgatgcgtcttcacgcggggttcaag

SEQ ID NO: 20018 - DNA, 240 bp, A.fumigatus
ttcctcgggagtctttcagtggaaattctgcatgaacgcaaagtcccatcggtttctattcggcctggtatggcatcagttacatcattagataaggacctgcgcaatttgcgcttgtcccgctataccccgcaggctgccgcagaggtccgcacatggattgaggagacacttcaagagaaactcccagcgggggatctcctggatgcgcttaaagatggcgtcgcgctttgcaagtaa

SEQ ID NO: 20019 - DNA, 1716 bp, A.fumigatus
ttggatggacatttcagactcatcaacctcgccgtttcgcccggcgtcaagtataagcagtcatctatgcccttcgtacagatggagaacatctcgcatttcctacgcgcatgtcaaatacctcctctgagcctaccaccacacgatgtctttttgaccgtcgatctctacgaatcaaaggacccggcgcaggtcttgcagtgtctgatggctttcagtagaagggccaatgctcttcaacccagcaaatttcctcgggcaatcggtgttcagagcaaagggggtgccgtgagtcctcatttgaccggctcgagccaatcagccaatactcctttacgatctcggggacatagcaacgtcagcaacaattctggggcatctagccccgccaagtcgccggctgtgagtagctggagcaagaagtcagacgaacaggtgacaataccggcctggaatatccatcaatatgggtatatgggcggtgccagtcaaggcaaccaaggagtggcctttggcgctcgtcgacagatcacgaccccttcaccgtttgttccaagcttggaagagaaggagaagcgcaggcgggaagaagaggagcgccagcgtatcgagagagaagaggctgaacgcatccgccgtcaagagcgggaggcggaggaagagcgcgccaaggcggaagaggaacgcaggtgggcagaagagaccgctcgtctgaaggaggtggagcggcgtcggctggaggaggagcgtcgacagtgggatgaggaacagcggaagtgggaagaagaggaacggaagcgccaacaggaggagcaggaggcagaggagagactaaacaaagcaagacagcgtcagcgggaggcaggtgatgtccgcctgagaggacaatttctcagtcaatatcaagccggccttactggcgagtctagggaaagtcagcgcatcaaggaattggagcgggagctggaactcgcccaggaacgggagcgccagtatcagcgtgagcgtcaggagttgaaggagaaagaaacgggccagccgcaatcgcagagtccgcgccctgtgcctgttcctccgaagcccagctacagcctctcgtctctcgagcaagaacgacggctgctgcgtacggaatggcagaagcatcaggctcacgatggcactgccgagtccgagcccagcgatgcgccgcctccgatgccgccccgaccccttccggaaccggctacaccgcaatcagtggccgcatcgcctcggccgctccccgacccagccgcttatgccaacaagtcccagggccaggagagccgcgtcgaccgcttcctcgcgtctaaccggccacctgtcgcccctaagcccgcgactcatcgcccacaggactacaccaccaccgcagaggtagacgaagagaataaccgccgagtagctgcgcagcagaagacaaaagcaggcgggtgggcatccaagtccctactggagagggaaatggagcgcgagcgtgagcgccagcgcgagtgggaagagagtcagaagcagacacgtgaggcagccgcaaagggtctgaaagatcctaccattggcatcgggccgggccagggcgcttgggatgtgcaccagtacggtttcatgggcggcgataaccagaaccgaggcggacccggtctgggtgtagggggagcaaggcgacagatcattgggcctcgcccgccgccataa

SEQ ID NO: 20020 - DNA, 237 bp, A.fumigatus
cacacacggtcttctggaatctataaaatgcgattactgactacctatagtgcgtacattgtggcgcctggaaccagcaccaaagcatattctgcccgtcctggcggagatgtcaacgatgtcgagaacgcggtcatgatgaagaacaatgcacctcgcttctccaaggctccgcatccgagataccttgtgatctctgtggatcatctagccacctggaactccagtgcgatatga

SEQ ID NO: 20021 - DNA, 294 bp, A.fumigatus
gctcggacttgccaagtccattcaccacgctcgtgtcctgatcaagcagcgtcacatccggtatggttcgcatgcgatagcgttaaaaaaatgatgctaacctttttgctcaacagtgtcggcaagcagatcgtcaacgtgccttcctacatggttcgccttgactctcagaagcacatcgacttcgctctcacttccccctacggtggtggccgccctggccgtgtccagcgcaagaaggccgctgccgctgctggtggtgacggtgaggaggctgaggaggacgaggagtaa

SEQ ID NO: 20022 - DNA, 375 bp, A.fumigatus
ggtgtggcgtgtccagctcaccctttccaagatccgtcgtgctgctcggtatgcgctttctcagatctgcgaaaattgggagcagtgactaacatattccggtctagtgagcttctcaccctcgatgagaaggaccccaagcgtcttttcgaaggtaacgctttgattcgtcgtctggtccgcattggtgtgctcgatgagtcccgcatgaagctcgattacgtcctggccctccgtgtcgaggacttcctggagcgtcgtctgcagacctgtgtctataagctcggacttgccaagtccattcaccacgctcgtgtcctgatcaagcagcgtcacatccggtatggttcgcatgcgatagcgttaaaaaaatga

SEQ ID NO: 20023 - DNA, 1197 bp, A.fumigatus
  unsure (304): Identity of nucleotide sequences at the above locations are unknown.
ctgaggtggagatgcactgtgaatcagcgttgtgttgatgtatgtcggtcgcctcgcaggcctacaggtgcagctccgaaaccgaatacgagatttctacggaatatcataaaggaaacggacagtcataacgctgcattgaagcggaaggaagaaagggaagccagggaacgaatgcgacaattacggggccaagcattgtcttcctcctcaaatggtaccaaagaacgcgaccgtcatcgatcccgacgcctgtcggacaacttgggctcgctgagagacacaagaggaagccgggaatcanagcatcaccctcatatgagaaatcgtaggagtcgttcagcttcctcggacagagatgggtcccgcagacaccgacgaagccatcgatctgacgacaaagatgaaaagcgtcatcgatcttcaagggaaaaacatcgccgccactcatactcacgtagtcgctctccacgagatgatgatgcctcgaaatctcgcgatcgctacagacgacgtcgacgcacggtctcattgtcgccctctcgcagcccatcaccagacagacacaggggtcggaaaggtagagaaaatacaagacacagcactcgccgcagctcacccaatagccacatggcatttgaatatgccacagcatgtgggagaggacggacaccatctccgagaaaagagtctgggtttgattctgatccactcgaggatttggtaggaccgctacctcctaagcatggtgtcgacagcgattggggagcgatccgctctcggggtcggggcgcctataaagccaagttaagcaatatcgacgctcactttgctcccgactacgatcctacgctggatgttcacatggaagatggcgatcaagatcaacaaaaagggccctcccgacgtcccgttgcaggtcttacaacagaggaagatgattgggagctcgccctcgaggcgcttcgcgaccgtgctcgttggaagcaaaagggtgcggaaagactacgagaagcgggcttcgacgatgctgtcgttgatcgatggaagagtacttctagtaaaacaacaataggcggtgatgatgaaggcagacttgaagacgtgaagtggtcaaagaacggcgagggccgcgagtgggatcggggaaagtttgtcaacgatgatgggcatatcgatgtcaaggcttcgtggtag

SEQ ID NO: 20024 - DNA, 195 bp, A.fumigatus
cattggcgcacagctctcacgcaatatagggagcacaatatgatccgattctcgaatggcagcccccaagcgctttggtatagtcagcatgcaggaggacaagcctttacatacgacgcaactgagaaacaaggcaagcggccatatgcatactcggcaaaaggcacgcacgctgtttacgttatggtggggtga

SEQ ID NO: 20025 - DNA, 216 bp, A.fumigatus
atcttgaactttggagctacctccgttgtccacttgggcgcaatcgccgcttttctttcttcgcccgcgatcatgccttcaaacactggagaaatgaacgacgaactgagcaacgactatgttgcagaagtattagccaaggaggcccgtgacagctcgatgaaatattcggctcaaggcatgggtgcttatttacctagaaggtatgataactga

SEQ ID NO: 20026 - DNA, 360 bp, A.fumigatus
tcttcgagctctgacaacgacgtagcgcctcttgtatggctccatagccaagatccgtacatgccctccgacattggacagcaacttgtccatactacgccaatggttgaccataaaccaatccaagggctccagtcacccttgactcttgataacctcgacggcctgaacagtctgggcaacacaagcgtttacttgacatcccgggaaggcattagcgcttctccgcagccagcgtggttcaagggcaccgctccagatcaacagggcaagacgaacggcgccgtttcctcgacaattatcattcgcgatcataacaatgggacggtggatgctttttatttctacttctatgcgtaa

SEQ ID NO: 20027 - DNA, 261 bp, A.fumigatus
ttctggtgtcggctggaacaacaaaagttccttcatacggccttaggccttaaggcctcgtgtatggatcaagcggtgatggagattcattttacgactatggacggtatcttacggatcgtagtcactgttctcgatgccgttcaaatactacctaattatgcattaccattgagcaataggaacctcgatgcagctgacatcgaaatctcttccaaggtgatggggaatactcacagaacaacactgtttgggctgtga

SEQ ID NO: 20028 - DNA, 240 bp, A.fumigatus
agaatgaccaaccagaatcccgctgaaacactggaacagctccgacaattggagcaagagaatggcgacctgaagacttgtctcgcaatcatacgcataagcgaacctatctcttcttcagatgccgaaaaatccaattcatcgccgtcaaagcgtacctctgatgtttcggccattgataaccccactcctgcttccctggaagcagatttgacgcactacaaggtatggataagataa

SEQ ID NO: 20029 - DNA, 294 bp, A.fumigatus
gggacatggttaattatcgacactccagtaagtctgggtctaagttttaacgtgctgtgtttactcggttgggtcattgccatgtctggtttagcttgccaagaaaccacgcaatccaagaagaaacagccgcgagatatgaggtcacgtggtatggctctccacctttctaggctttttgaggaagattattattatgatctgtcctggaacccaaacccctctctgatccgagtgtttgattttgattctggtgtcggctggaacaacaaaagttccttcatacggccttag

SEQ ID NO: 20030 - DNA, 264 bp, A.fumigatus
agtaaggcagtgacttcaccactagttgaggaagccgcactagatggcaatcaaagcggtgtcccttggaaattgtctgataagcttttgtttacttttccgttatctaccagccaacacgcagtcaagggtatccgttctgaggataaccaagattatcaggcaaagaaatcttttaatattccaactcagggcttcgaacataggactcacacatatcgctgccatacgtacctcattttgaagagaccgcctagagaatga

SEQ ID NO: 20031 - DNA, 201 bp, A.fumigatus
gaacatcgtctcgatgaaggaatattgcccggttatgagtacagtgttttccaggcaacacaggacggaacgagaaccgacttcgagaagctagatacagagggggggattgccactcgggcccgagccgtcgttttacaggccgtccgatccactaccatggctcgtgatgttcgatgggacgtcctagtatgtcgctag

SEQ ID NO: 20032 - DNA, 444 bp, A.fumigatus
gacaaagaaccgacagcacccgcagagcccaatgtctcgcaatcccttcaatcctccgatcctgccaagagcgaagcgaagcaagagacggatgagatgacggagatcctggagcgtctcaacttagctgctgataacaactgtgtcttctcgatcagcgatgagacacaagagctcctacgcaagttcacactcatcttcaaggacctcataaatggcgtacccaccgcttaccacgacttggagatgctccttagcaatggcaacaagcagctacagcagacatactcgcaacttccaggctttcttcagaaactggttgagaaactcccggagagatggaccgagacattggcgccggaggttctcgcagcggctagcgagagggccagccgaagcggcctcaatgttgagaatgtaggcaaaagcggctgccgctgctaa

SEQ ID NO: 20033 - DNA, 1308 bp, A.fumigatus
tccgctcataacggatatcaaactttgtcaacacctgggccagtgaaacccaaagcccaatacaacaacaacaacataagactggacgagccccttcaattgatcacaaacaattccattgttatcaacgcaatgacacaaactaaatctcacaaatcaccaaagggcgctatcaaagatagccgtgctctcaacatcatgaagcacctggaccccaagtcttcgagctcgtcctcacggcggtccagcaagtctctccctctcagctcctttactactgaccataaacgaagagcttcgagctcgtcgatctccagcgtttcctcagtctcatctatcgaagcccttagtgacgaggccaatgaatcagaggaggacgctgatgatgaaaaggaacagccagctgttcgcggcccgtcttacggtaggcgtgacaagggccgtaagtcgggcatgaagcctacgggccggaaaagggtgaggctctccgacgatgatggctatgacgggcaaagaagcagcgatgaaagtgactcagatgggagctccgacgatgtatacgctgccgtggacgatataagcgacggagacgatgaagatcaggatgttgaaatattggaagaactccttattgtcgagtcagaggatgagcacgccgtcgatgacatcttcaagacttccactgtgtctgagcttgacttggccggtaccaatagttttgaagatcacatgctgctgtctgctgcctcgttctttgacgaggatcagctctacagtgctatggaaacctttggcgagactgacttcgccagcgaggcggctgcggagacgcccatgcctaggcgtgtccattttgaagaggattctgattcctcgtcggaaagcgactcgcatacagaggatgagatcccgagtgatttcttgcaacaggacagtctcgatcctcaactacgtcgtatgattgagaacgacaacgagaactacagcagccgccgtcgccagtccgatgagttgttcgctgagtcggactatggccattcgaacatttaccacgtcgagtctgacgccgtttccgaggagtccgagtcgagtggctatgagagtatgcagtgtatctggactttccccttgatcttcctactgacctgtttgaagccgatgatggcgagaccacagatgaagaccttccaccaccggcaacaattacccacccccgttccattctgcgccgcgattcctctgcctctctgcctcccgccgacgagaacaaaagccaaccccctactcgtcggcgaggtccaatcttag

SEQ ID NO: 20034 - DNA, 291 bp, A.fumigatus
cggccttccgtcgcaaccacaacagatatcaagccctcctacggttgccccagcaccgagaattcatgcctgccaattctccctctcggcctgctagcgtcttccgccatgccagacatgcagaccagcgcacgcctactcgaaaacgcaaggctagcggatatgccggcggcgaggctgtccgacgaaagctcatggatgcccaccggcgcactcaaattcctttctaaatctagtgatgctacatgttcagccacaaccccttacggacgctttgaaaggattggatga

SEQ ID NO: 20035 - DNA, 1032 bp, A.fumigatus
gagtatgcagtgtatctggactttccccttgatcttcctactgacctgtttgaagccgatgatggcgagaccacagatgaagaccttccaccaccggcaacaattacccacccccgttccattctgcgccgcgattcctctgcctctctgcctcccgccgacgagaacaaaagccaaccccctactcgtcggcgaggtccaatcttaggtacttttgttgcagacccccacaagccagtggccttggtcgactgtacggggaaacatcttgtgatcattccagcctatgcctcgtcccgccatgactggctcgagtctgccaccaccagcatttgcggcactgccaacaatagcccacgtgccactactatgcacctgatcgacgagagcgacacggatgccctggcctcgccgaaccgtcacgaccttagtccgatgttggcatcgagtgctaatctaatgatgacggcccttggaaacgacattgccccgggtggacaagttatgggtcctccggaggcattttacccatctcgtgattttgctattgatagttcctttgaggatgatgacgatgatgatccggaagcctccttgaatgtcgaggatttcatagactttggagacggctcctcagacgaggagatgggcaaggcatctgatgaagatgcgattgcttcgccaatggccactgcgtccatgacagtcgtatccggtactcctacccccaaccgcggaggggatgtacaacaaagcaacagtgctgaacgcttcctgaatcatctggatcgtggcattgtgacggccttccgtcgcaaccacaacagatatcaagccctcctacggttgccccagcaccgagaattcatgcctgccaattctccctctcggcctgctagcgtcttccgccatgccagacatgcagaccagcgcacgcctactcgaaaacgcaaggctagcggatatgccggcggcgaggctgtccgacgaaagctcatggatgcccaccggcgcactcaaattcctttctaa

SEQ ID NO: 20036 - DNA, 195 bp, A.fumigatus
tccggatctccgtctcccctcagaccggccagcaccgctacttgggtgtcgacctcttcacccgtcagctgcaggaggagtccagcttcgtctccaacccctccccctcggttgtcgttcagaccatgctcggtcccgtctacaagacctaccgcattctggacctccacgaggatggcaccatcaccgccatga

SEQ ID NO: 20037 - DNA, 201 bp, A.fumigatus
ctgcccccactctcggcgagtccccgccgatatcgtgtgattgccctcgtcgtggagagtctgccccattcgtatctcggtctctcgtatattgattacgtccgacccttccaccacgtcgcgcaggtgggcgtccagatttgcgggttgacggacgggagggagcgggttccggagcaggtgcagcggtctccgggctag

SEQ ID NO: 20038 - DNA, 2352 bp, A.fumigatus
aaaccccgacctgctctcccttcttttggtagtataagaggacgccgagaggacgaacctgagcccgcccagccggacttcagtgacaatgaatctaccgcctcgtctgggttcgatgcagtggtatccggctggtctgtcccaaacgaccatcctgctcaaggcatgtcccacccttccgtaacaaatcatccatctggcacagaagtcgatcgcattgccctcactaaatcctctgaaggctctggcgaccaaacgaatattgcacttcgacaagatggtgacttagttcatgagctggtgtctcaagcttctccggctctgaaaccgtcagtagcggatgcaaacttgatgcgagggcaggaaccattcataactccagatgtggagttagcactacagggcatggcggcccaaacaacctcacctggtgctgaaaaaggacgttcaagccttgagatatacagagttcccggtggtttcccgcgaacctcgttagaactcgatcccaaagctgccagtaaaaggaagggtaagaggagatcacgtggcaagtctatcgacgaatatatgccaaatgacaaagagagcggcgacgagtcaggtgaaagtgtttacagcgatgccgaggagggcgtcgattttgatggctttggctcaatcaatgctatcgtggatgcgcggatagcgcaaggcaaagacggccggcctgtatattttctcctcaacaacgcattctccaaagatgacacacgcggattcggggctatgtccaccaatggagcggcgaacaagctcgaagtgtcaagtcaggccgattgcgtaacaactcctgcgcaaatgcaacctgcttactctccctcctctgcacaagcagcgtctacacgctctactgttcaggcgcagacgaccgccaaagacatacactcgtccccacgcccgacccaagcagaaaggcctatgtcagccatagtgtacagtgattcagggcttcgtgacgctgtcgcaaaggatggctcattacacggcctatcaggcaacggcagctctgctttacatcgagccgatactgagcgggccaaaaagaggccagtgtcattcgggccggtcatccaaaaggagatcgacttaggcccttctagcgagagactcataaacggcagaacgccctatttgcctcaaaggaggatgtccaatggaagcgactcatctagcagtttcgtaaggtccacgcgccgtgtcaaaaagggtggacagcataccatgcgtcgcaccatgcggggaggccctccgatccgcaccttgccaccgtctcccggccgggtgtcatcacccgccatagaaagtcggcctctttcttcggggtcggtcacaggcaccatgcgcactacattgcggagtggacctaagaacgacaagactccgagcatcttctctaacaggtctgcgaaattgaaggtcaccaagacagccacacctcgtttcgtatcacgattcccagattcggatgatgaagatgctgatttccggcagcgaaaacttcaacgtcgatacgataattccagtgacgatgagcaagaccgcgtgatgcgcggtctacgcccggttcgcggcattcctcgacggcagggaacaaatgacggcgattcgacagaactggaagatagctctgagaacgagaggccggccacccctgcaccagcagctgtctccaagaaacctgatcttccttcgcacgatccaggacttgctgcagtggccaggtcccgtggaatgacagaggcggagctggatgagttcctccaccggccggcaaaggggcgagtttctgggattctgggccggtttactttgaagaaatccaggccacccatggaacacagagcttccaagtccaacccggaggaccttgctcacatgcgggacgggaatttgctcaatcccggtaggggagcaacggtcacaacagttactgccaaccactccgggacttccccttcgaagctcaccaagggaggcttgaagaaaccgaacgagaacagctggccaatggactctgggcgcaaagtgtcagacgccgcagcggatgctgaaactgtggcggaacagcacccagtagcgacggatgcatctggagacggaagtgcatctattgcccgccatagtgagccctttgcagaggacagcgcaattaatatgcagagctccgaagccgcacctccgcgcgaggaacggcaccctggtaacagcaatggcaacaataacgtcagcgcaaaggatatcgtcttcccacagggaaggcgaaagaaacgatttcctcgtcttcgaaaggcattcggcatgcgcagctaa

SEQ ID NO: 20039 - DNA, 1101 bp, A.fumigatus
taccatctaacattctcccccgttcccacccccagataccgtgaatccacttctcgctacgaacctttacctcccaagcccgtctacgaccaggcccttgagtcccagcttgacatcactgagcgagagtatcgtcgccgtaccgaccctacttacgacgtcaacctttcgtacggtcgtcaccaagctccagtagactcttaccaagcctaccagccccaacagacttccgacgtctctctccatcggtctaagaccgagatcgacgtctcttacgacaaggcctacacccctaagcctctcgaaacacgtaagggagactccttcagccgcagcgagcttacagtagagtctgtcccttctcgtccttcctccgcctcttcaatctctcaagtcaaggtcctcaagccttacaccgctatcgaccaaccccctgctcgcaagatgggttactacgacgacgacggtaactaccactccttccgccgtggtgtggagcgtgctgtcgaccgcatcacgcatccattccaccaccaccatcatcaccacgatcgtgaggaagtagtcatcgctgacgaacgtggcccagttcgttaccgtgatggcgtccgcgaggatgttcgcatcgtcgagccccgcgcaagcaagaccactgcagaatccgtccccatcccctgccacttcatccgcatcggcgacatcctgattctccagggtcgcccctgccaggtgatccggatctccgtctcccctcagaccggccagcaccgctacttgggtgtcgacctcttcacccgtcagctgcaggaggagtccagcttcgtctccaacccctccccctcggttgtcgttcagaccatgctcggtcccgtctacaagacctaccgcattctggacctccacgaggatggcaccatcaccgccatgaccgagaccggtgatgtcaagcaggccctccccgtcgtcacccagggtcagcttttccgcaagattcgcgatgctttctctgagggccgcggtagcgtccgtgctcttgtcatcaacgatggggggcgtgagctcgtcgttgactacaaggtcatccacggttcccgtctgtaa

SEQ ID NO: 20040 - DNA, 369 bp, A.fumigatus
  unsure (238),(240),(268),(270),(271): Identity of nucleotide sequences at the above locations are unknown.
atactcacgcacctcaaccgcaatgcttctacatggaatcgtgtctcaactgtatggccgtcctgcttacactcttacagacaatattcatcgcagtacctcccagtcgccccagtccaatcgtcccctgcgacctcccgtgactcgtcccgtgataattcgcgacgggcgaaagactctaattcacgacagagcgagtccattgccaaccctaaacgcagatcaaccatgaatagtngngatgcggcttatgacgaagaggagcagntnnggcgagcgatcgaagagagcaaggaggatactcagccccctgcagaggacatggctctccgacgaggcaagcggagtcgaagcgacagcgaagcgtga

SEQ ID NO: 20041 - DNA, 237 bp, A.fumigatus
  unsure (7),(8),(23),(25): Identity of nucleotide sequences at the above locations are unknown.
aattccnncactggagcggcacntntgcagccccgtggtgaagacgataaacaggcgacggagtatctggagctgagttatacatcccatctgcaggcggacagaatcagcaacgaatctagctggcagtggtcttctctcctctccaagaactccccatccacctggtgctggaccggcatgatgagacgtccagaagagaagacatccttgatgagaggaacatactcaacgtag

SEQ ID NO: 20042 - DNA, 729 bp, A.fumigatus
gattcgtcccattgtcagaatcattgtgctccatttgcttcacggtgctccaccatgactcctcgtcgctcttctcgtgcccgcacctcccaaccctcgcccgccatccttcagcatacaaactcctccagctcgtcgaattccttggctcgcgaaagaagcactcggtcgaaccataaaatttcctcgcctcagagatctttaacccaacggtctcagtccattgatgatgcggacagcgccacaaggaacgactacccacaaacgcggcagcgccagcgctctcgaggagatgatgaccatgtgagattgaatggggaggaagaggatgaggatgaagacggagagggtgacgaagaagaagagattactagatgtctttgtgggcagcaagactacccaggcttgcctccctctcggcgggaggctctcggtcgcaacgggccgactgttgggttcaaggatcaacatgcgttgaatctttctacagattcatcggacctgatgtccgacgatatcggtagcatgttcatccagtgtgattcttgcaaagtttggcaacacggtggctgtgtgggaattatggatgaagcgatgagccccgacgagtacttctgtgaggagtgtcggaaagatctccacaaaattaagaatgagtccaacgggtatgtttcttcaaacctcttttttactcttatctcaagaatttccccttctctgatttactga

SEQ ID NO: 20043 - DNA, 1170 bp, A.fumigatus
  unsure (14),(16),(17): Identity of nucleotide sequences at the above locations are unknown.
cgaagaggagcagntnnggcgagcgatcgaagagagcaaggaggatactcagccccctgcagaggacatggctctccgacgaggcaagcggagtcgaagcgacagcgaagcgtgagtttgatgacggcccaagtaacattggttttttgtgctgctgctgacccgttttccccgcctagtcacaaacaggtgacgaagcgccagcgtacaagttccccttcaccaagcgctatctcgaaaccagagaacacagaatctcaacctgcatcagaagatgagttgaagacgaaggtaaatggcaacggcacaaaaagctctagggtggcaccgcggggtcatcgtgaaaagcccgtcaaagaaacagaagaacccgaaacagacctctcggagattgcgagccgcaagaggggaaagttcgagaggcgaaatggtgaaggtaaaagccccgaagttatcttgggattactcgttctaacacatttacaagaagcagatgccgaccgtgagatggcatcgccgactaaagccactgcggaagaccctgagcctcctcaaactagcccggagaccgctgcacctgctccggaacccgctccctcccgtccgtcaacccgcaaatctggacgcccacctgcgcgacgtggtggaagggtcggacgtaatcaatatacgagagaccgagatacgaatggggcagactctccacgacgagggcaatcacacgatatcggcggggactcgccgagagtgggggcagtcaacggagcgcagtacaatgtagattctggaaaaccgagcaggccccgctacatgaaccctcaacggacaaccatgaacgagatgaagagacgagttgccggaatccttgaattcatctcccggatgcaggtcgagatggctgttgccggcgaaacttccacccctcccggcaatggagaccaaccaaatggctctctcacaaaggccacgatggatcaagtcgagactgcattagtttcgaataccaacgaagtggagtcggggacatcaagtgttgatagcgaaacagcatctggtcagggtcccaaggagaaggagttcaaagatctgagcagcgtcgaaatgatggatgtcctcacgcgccatctcctaaaatggcaacaggaatatggcaaattcggggaacggtga

SEQ ID NO: 20044 - DNA, 183 bp, A.fumigatus
atcttgctcaacgcatcatttttatctctgcgaccccgaatttcgacagttttcaatatgcccggcggaaagggaaagtctgttggcggaaaggctggtgcgaaggatgctgcggggaaaacccagaagtctcacagcgcaaaggcgggtttgcaggttagtatatcttgtgtttctcagtaa

SEQ ID NO: 20045 - DNA, 210 bp, A.fumigatus
ctccaggaccgcgattggtatggtaccggcgacaacgtacaaacgtcgacgaaatattctgttgcggattaccgtcgaacttggtgtcatgcaatgacagtcgagtggaagacaaactcccgaggtggttatattgtagcgggcgcaggagtccagctgggcaacacaaccgactggtctagcttgaaaatatttcgtgatcgctggtaa

SEQ ID NO: 20046 - DNA, 321 bp, A.fumigatus
ttaagactgtcgcgaccccttcatattccccatcgtgtgttttgtcctgattcattgacatgcataattttagctgcggtctatgtcacggctgttctggaatatctaactgcggaagtcctcgaacttgccggtaacgccgccaaggatctgaaagtcaagcgtatcacgccccgccacctgcagctcgccattcgtggtgacgaggagctggatactttgatccgcgccaccattgctttcggtggtgtcttgccacgtatcaaccgtgcgctgctgctcaaggtcgagcagaagaaaaagaacaagtccgatgcttaa

SEQ ID NO: 20047 - DNA, 660 bp, A.fumigatus
attgattctctttgttatgctaactcaaccatgcagacctggcttgatcagcagcctggtatgcccagtcctttttcgaacctcggacccggacctcttcaaagtggtgcggtgcgttccgaaaccacagttccctcggagggagaggacgagttgattccgaccgcgatcgttatcaagaacatcccttttgctgtcaagaaggagcagttggtgcaattgatgactgagttgaacctcccgcttccttacgcgttcaactatcactttgacaatggcgtgttccggggtttggcctttgccaatttcacctctgctgaggaaaccgccaccgttatcgaggttcttaaccacttcgaactgcaaggtcgaaagttgcgggtggagtataagaagatgctccctctccaggagcgcgagcgcatcgagcgagagaagcgcgaacgtcgcggtcagctggaggaacagcacaggcccatggctgcctcgcagcttcaaactcagagttccatgtcgtctctcacgtcccacatccctgcaacgtctccttctcccgtttcgcagcgtggccaaaagctgggtaagtcggagcgagccaatccacactcccaaaacagttttaaacagttccgatgctttccttcggtgcaattgtgctaa

SEQ ID NO: 20048 - DNA, 1377 bp, A.fumigatus
acctcccgcttccttacgcgttcaactatcactttgacaatggcgtgttccggggtttggcctttgccaatttcacctctgctgaggaaaccgccaccgttatcgaggttcttaaccacttcgaactgcaaggtcgaaagttgcgggtggagtataagaagatgctccctctccaggagcgcgagcgcatcgagcgagagaagcgcgaacgtcgcggtcagctggaggaacagcacaggcccatggctgcctcgcagcttcaaactcagagttccatgtcgtctctcacgtcccacatccctgcaacgtctccttctcccgtttcgcagcgtggccaaaagctgggtaagtcggagcgagccaatccacactcccaaaacagttttaaacagttccgatgctttccttcggtgcaattgtgctaatttcacttctattgcagaggtcgatttgaatgacagcacaactttatcctattactctcagctccttcttttcaaagaagaccccagtcgcgattccgtgctgtttccgcccactctcacccctatccagcgccggactgtccacactcttgcacacaacatgggccttggtcatgcttcccgtggtactggcgaacagagacaggtccaggtgttcaaagtcgctcccggcactaacgtcagtccgcctctaacctccatcccgactgcagttcagccagccgataccgctcgtcgtggactgaatcgcgcagctacgattgacttcagcgaagccaggaacgagggagggcctggtccttttagcaatcttcgtggacagacttccggcttcctcggcgttcttgattcgcctggcaactacggaagcacccagaatctccgcgcggccaagtcgtttgccgatctccgctcgtatactccttctcctgtgccttcttccgcaagcttcccggcagccttgcaatccaatggcacacgtttacagcattatgaggctgtgaccagcggcgcgtcgaacacccccaccttgacttcagccccgtctggctcctcccttggtgtgcaacgggacgacaatcttttggtgaacagtctgagcagcctgtcccttggcactggaatcggagggccgaattcgagcccccggagattgaggggtatgttctcttgggatcagccggaaaatcagccttccagcgctggtcccattggtagtaaccgatccatcggacttggatttgacggtcagtcacaggagcgcatgcccattaggcagcctagaggccccgtgcctgaaaaaggctcgggattccgccgatcgaacggacatcaatcgcgtggtagtgatgaattgcgcaccaattcgggagtggagattattgtggagtaa

SEQ ID NO: 20049 - DNA, 336 bp, A.fumigatus
cacatcaccggttatctcttggtcctcgaatatatcgcagtgtttcgcctcgactcccagctcacgcaaatgcctcgctgtctcagccgcatcccagctccgtacttgctcctcggtcggctggttttcctcttcttcatcggtttcatgacccctgatgtaagagacccgatgttcgagatggctgctatattcgctcgaggaatcattacttgctttgttttcgtgattggccacgctatgacgcggggtgctcaggtcggttatgtgctcgtcgataacgctcaaggtttcattcataaccgggctgtcctggcctttcaattgaccgtctag

SEQ ID NO: 20050 - DNA, 1953 bp, A.fumigatus
gagaaaaaggattcatcgcctaggggaaacgagaaaaagccatgtttgcccttcaccatgagtccttcgaccaccaagaatcgtccgcatttacctaataatccgcatcaccagctggaatggtccaattcaacggcaaacttatttctgggcggtgttggggtgcggaaatcatggatgttgggtgcttcaccttctgtgtcaatcagctctgcttctggtgctcctaccattcctctcgattcatcctgccagtcttcacttgctgttgtctcggctccgtcttctgcctttgcctctgccattgccaaccaacctaaaagtcggccgcaaggcatacaagaccccccttcatcctccgtcacaatcgtcccgcggagtcagaagagccaaaaagataataatgaggtcgccttcactgccaatggtaacttcattaatgctcctactgcgtccccgccgtcagtcttaatgtcacccgtgacgcccgggggaatccttccacaaaatcgcgaaattctacctccctgccctggggttacgccaagcctccccgtgtctaccataacagctaccccgaatgtcagcgctcctcctgtgataaatgagtcaacggtgtccgtccatgcaactcaaccgctgcagcagtcacggtcctcctcgctttccgtctccggattcaaagcagtgcctcccatcatagccttgccagtgctggagaccgggaatgaccgctgtctgtcacatggcgttcctccatcccctccgccaatttccgggccgatgcagatacacagacagctggaaaatcctaggcaaattaaccagcgcaatctcatgcccgccaccgcagcgccgaccacagtgggcggggagaggatggccgaggaaacttcagcgccatccacaattcgaggcgggcagagacaccaggagattgagagtcctcagcagttcatagccccggctccccctgaagcacagcagcagtctcgaccgtcgatgaccagcgccccgcccgattggaaccatattccttccagccccgttggcctgggtccttctacttccttcatcaaccagacattttggacacagtcgcaggaggccctggatgctttcgtggcaagagcggatagtgccatgctgctctcagagacagtggaactgccacggacacgtcttctacgggatgcttgtaacgaaaaggatttgttctacctaactcttcatcaaatatacaccctgcgcacctttgctccttcggagtttgctcggttaccgtacgtaagcggacaaaacgagacgggcatggaagttgtgcagcagcttctagtagacaaccaccgtttatcaggcgacttcttgaggtggagcgttaattttcctcggccgttgggtgtgatgtgtcagacacgtgagttcccaatagttctccatcggatcgcccgttccctgggattgttcgctgaaaagtggacggcttttgatcgtcacatccgagagcgcggttatccccctttgattgatgaattagtcgtgcaatttggcataacatcgaccgtactattatcaatagtattcctagccttgtcccgaaggattttcggcacgcagcatgaagaccagttgcggagtatctacagcaagaacaagcggaattacgtcgaacggttcggttccaggcacactccgcagcagattcaccgcgagaacgagcatttgatccaggcatacaaggccctttcccgtgcccagatatcgccagttggtcaacaaacttcacgtgtggcacaggagcatgcagctgaaccccagcgctcattgcagcccgttgggcccacagggcaaatcacatatgtcggaatcccaagccctcagatgcccgtccgcgcaagtacccggacattagttttaatcgcagaccctgccaattggttggtacccttctga

SEQ ID NO: 20051 - DNA, 3018 bp, A.fumigatus
ctgacctgtggctggtctttagatgacttcgacgcgcgtggaacggatgagcttactttgcgacgcggggagaaaattgaattgatagaacttgacgaaggcttcggcgatggttggtatttgggaaaagatgtgagaacaggggacaaccggtcttttccctggtggtatgctcccctttttcggaacaagctggtcgttgtggtcataactaataaagatcgttacttagtttacacaaccgccgccccgaagatccctatccgaccgccgagagaggatatgattgtttcggacgaccccaaaccggcagcggaggaccagctctcgtctgaattggttgcctcgcccaagagcggagaatctacgccacaagcatctcgacacgctagcatatcggagacgcaaccgccagaagtagccacggacctatcatccatgaagtcttcccccaaccagcagcatcggtcaagttcttctcccttacccacttcgcgactcgccgtcgatattcagcagtcgattagacagaccctagacggtcaattgaaaggccaggacagcccggttatgaatgaaaccttgagcgttatcgacgagcacataaccgacctgagcaccccgcgtcatagcgtggccaatcacgaaaacaaagcaagtaatgattcctcgagcgaatatagcagccatctcgaacatcgggtctcttacatcaggggtcatgaaaccgatgaagaagaggaaaaccagccgaccgaggagcaagtacggagctgggatgcggctgagacagcgaggcatttgcgtgagctgggagtcgaggcgaaacactgcgatatattcgaggaccaagagataaccggtgatgtgctactggacatggatcaggaatttctcttcatgaaagagtttgacttcggcgtcatgggtcgtcggttgaagacgtggcacaaagtcaaggctttccaagaggaggtcaagggtcttaaacaacaacagcagcagcggggctctgcctccagctatccagcgccgccggaagatagatctcttagccgtgccagccacactggcccttttcttccccgcatccctcaccttacaagaggctcggccggctccatacagcatccgcggctcgtaagtagcgggatatcgagtaccacaagttctcctatgactccgcagactccagtcttcatggatcatcaaagaagaccatcagcagcgtccatccgggagatcaatcaccatcgtcgtcattcttccatagacacagggcaccgtgtggatacgtcgcctcatactggtcattttaagcagtcttcctttgacagaaattggactctggccagcggatcacagcgggtcccctctcgctcaggcacttatcccatttatcccgaaggagtacttccccaacatactctccggcgcccggatactaacgagtctgactctgcggtctccgtgaccgatcggtatgatgagctagaacggggatacttctcgggccccgaaggagataccacgaagaacaagagactgttgcagaaacggtcctccgtgacgggaagtgccactcattcccggcaacctagttacgccgatgataaactgaaagtcaacaagcgacattcccgcatctccagtgttgactcaatccgagatacggccaagcaagctcctgctgctgtggtcgacgttcagagtactgcagcaccgaaaagccgatttagaagcctgagcactcgagtgattgaccgacgcggtccaacttcgcagtcttccactccaacgtccacagagaagcctagctctggcttcttttcatcgtttgcaccgcttgccccctttgtgggaaagtcggatgcagaagggtcaggacgtgcatcttccttatccatctctcagagcaagagtgctgggcccaagacacggcgcaccggtgggctccgcatcatatccgatgttgtcgggaagggtatcgacacctctgtcgcgcctgcctcgcccgttagagataccgatccagcttcggtcagaaccggttctactacaccgtcgacatcgaagagttctgagaggcatagcactgaaagctcaatcaagaacgcagagggaggcatatctttgccgcgtccaaatgcctccgtcaaggcgggcccgaaatccaagaaagacaccagtgcctatatgcgaggcttggagaagaagacaccacaagagcaaatggacggttgtgattactccgggtggatgaagaagcgatcatcaaatctaatgactacgtggaaacctcgcctatttgtcctacgtggccgccgtctgtcgtactactactctgagaacgacaccgaagaaagaggcctcattgacatcaccgctcatcgtgtactacgagctgataacgatcccattgtcgccttgcatgcaactatcaccggcgccacggcatcgccaacgtcaccctctccttccaacggtgctgacacttcgccggcggacaagtcgtccacctcaccttccgctcgcaattccaagcttgatccagaggggccgttctttttcaagcttgtgcctcccaagacatctcgtaccgtacaattcaccaaaccagcggtacattacttccaagtggacagtgtcagagaaggccgactatggatggctgcgctgatgaaagcaactatcgagcgtgatatgagtcggcccgtcgagacgacgaacaagcaaaagacagtcagtttgaagcaggcccggatgatgaatcaacgacctcctgcactgatgactgagtcagaactgcaagagaccaaggaagaagagaagcgcaatcgagcgtcgaccgaaacggaggaacgcaataacggcttgcgaatccacggcctaaatgtcgacaaagcgcccgtaaccggtgagagtaaagaagacgaacctgcctccccagactctcttgatggtctcgatacggggccatcgtgtctgctaccagagactcttttgaaatccgattga

SEQ ID NO: 20052 - DNA, 237 bp, A.fumigatus
aatattaatatgattaacgtcctaatgcttatctatattctatttctgtatccactcctttcccttaccgtgcctctgtggcaatatcactatggaaacagccctttcaatgcactttcaaaggtacctgcagagggatctcgggcaaatacaaggtatgagactaatatccatacgccgaaggaaatagacagctgcattaagtatgtcctttatatagacggagtatcggggtag

SEQ ID NO: 20053 - DNA, 1485 bp, A.fumigatus
gaccaatggaagcgaaagaagcagaccaaggagcaagcccgcgaagccaaacgtgcgaaattggatcccgattctgccaaaacggccaaggatgtgatggacgaaaatgctcggaagcgtaagcgtggcgaggaggaggaggaggaggaggagcagaatgggtctgagtcatccgaggaagaagagctgggctctgaacttcccaaggaaggcctgaagagaggcgatgccaaatcgaaaaagcagaagcaggccgctacagagcaaccggatgctacggcagccaaattggaggaagccgaagcacgcaagaagttaagagaggagaagaaagcacagaagaaagccgctcagaaagaaaagaagaaggccaaggaagctttaaagaaagacaaaaaaagtgaaaagtccgagtcgaagcctgcgagcgataaaggagaagagcagaagccctccaaggtagaaaacagcgatgatgagattgagcaagaaggagctgtccctgaggaaggcctctcactcgaattcaaccccgagcccgcagaacagtcatcctcaccatcctcaacacccaactctcccgggtttgatgcctcaaatgatcactccggcagctcttccatatcttcaatcgcccctcctcctgcttccaccgacgccaacgatgcctcccaaaaatcatcatctgaacccaagcccctcaagccgacccctgaagagttgaaacagcgcttacagaagcgcttggacgaactgcgtgccgcccggcatgccgacggattcaacggcaagcccgcccgaaaccgccaggagctgatcgaggctcgccggcaaaaagccgagcagcgcaaggcacacaagaaactgttgcgacaaaaggccaaggaagaagagcagcgcgccaaagacgaggctatggccaagcgcttctcccccggtggctccggctcacttcttgcgtcgccgcgatcccccgctgattcgatcggctcgaacgtcaacttctcatttggccgggtggtgttcgccgatggccaggtggccgatcccagtctgacgaacgtacgggaacagccgaagcgtcatgggccgcaggatcccgctacggctctcaaggcggcagaggcaaagaaggcccgcctggccgagatggacgaggagaagcgtgcggatattgaacagaaggacatgtggctgaacgccaagaagcgtgcgcacggggaaaaggtccgggatgacacctcccttctcaagaaggcgttgaagcgcaaggagtccgcaaagaagaaatccgagcgggaatggaaggagcgtcttgaagccgtcaagaagggcaaggatgcccgtcagcagaagcgagaggagaacctccgcaagcgacgcgaggagaagggcaacaaaggcaagaaacctgccgcgggcaagaagaaggccagacctgggtttgagggaagcttcaaagccaaggtgggtggaaagaaataa

SEQ ID NO: 20054 - DNA, 525 bp, A.fumigatus
tctatccttcggtcgggttttacttcgtcaggcaatctgccccttccacccacccttaacacagtcaccatgttccgttccgctgtcgtccgctcgttgagagcttccgttccccgtgctgtcaggactcctgctgccttccagatccgtagctctcctgttgctcgtcctgctcaattcgcccctcgctttgcttaccagggtgtccgcctctactctgcccccgccggtctgaacaaggaggaggttgagggccggatagtcaacctcttgaagaactttgacaaggttcgttcgttcaacttcttttcccttgctctcagtggtccatcggacggaacagccaaaattttaccaacaatggtgtttgagtaccaaattactgacgcgattgatggtgtacaggtctccgatgccagcaaggttcgtggccaccgtttatgccagctgatgcaatgggccggctaccccttccatcttcaaactttcaagaaagcaatgatttgtcatatggacaaagtctaa

SEQ ID NO: 20055 - DNA, 549 bp, A.fumigatus
tccttctgtctaggtgaaacgtggaacctgatgaagattgggtatcagctcaagcaggtccgcgaacgacttgccaagggtctcgtggacaaaggcattcttcgtactgaaaagcgtaatttcctcctctttgacatggccacacacccagtcgccgacggaggcgccaaagatgatcttcatcgccgtgtccgcaacgtttgtaccagccgcaccgtgatcctgccggccaaccaatggctccctgaagatgctgagttccggtatcttcgaactgttgtcatgatatgcgcggcctatgcggccaacgtgttggagaatgcacttgttacaatgagccacgaggcgagagagcgtgcttttgcgcaagttgatgagttgttggcagagtattcccagtggccgttcgctcggaggccgggtggtggacaggccattggtgccaacctggcacaggccatcaacgaagaggtcaataaagctaaggatcgagaacttcaattggaggtatgttttgtcgtcctctatttacagtgttacggaaactga

SEQ ID NO: 20056 - DNA, 210 bp, A.fumigatus
cgagtttgtcaacaggagttcagcattgagatccccgacaaggaggccgacgctatccacagtggtaagtacactcgaacagtgcctagcgaatcgctcatccaagttcatctacttattctctcaacagttgacaaggctgttgagtacatccttgcccagcctgatggtaagtttatctcgtgcgagtacaagaatccaggatattga

SEQ ID NO: 20057 - DNA, 441 bp, A.fumigatus
acgcatcaccatatacgcctcacggccgagtccccatcatcatcagttgctcaaccagttccccgctttcagtccaccgtccttcatcctgacatcctcatggcctcagccgggggcttgacacgccggagaggtggcggtcgagtcgctggcggagatgacaacgatgatagcagagtgtcatccccgatatctagaaatggctccgcacttgaccaccgcgggcccgaggcctcgttcacaagctctgagaatggccacaagatcgctttcgatccccgggatctgagtgagagcgaagagcgaagcaaacagcccaaattgaccctgatggaggaagtgctgttgctggggttgaaggataaacaggtcagtgctggattgaaaatattgccgcgaagctcgatgagccgcttgtgcgcattgacgaggcattgctga

SEQ ID NO: 20058 - DNA, 282 bp, A.fumigatus
ggatatctttcattctggaacgagaacatttcctctgttcttcggggttgcattgtcatcgagttggttctccgcggtcgcatcagcatgcaaaaggactcctcccggcgacggttccctctcgcagatcgcgtaattgaagtcatcgatgatacattgactggtgaggtcttgctggacgaggcattgaagatgatgaaatcgagtgagaagatgagcgtgaactcgtggattgacctgatgagcggtgcgtgcaagcactcctggtcactgaagttctga

SEQ ID NO: 20059 - DNA, 1185 bp, A.fumigatus
atacttttcatcatgaagccagcgaagccagcgcaaactgatatggatgaacaaacattcgtcccgagtacgatgagggccctttactacagccttagcgagaaccacagccacgatgtgaaggctgtggattgccccgagccaggcctgatctttgatactgacttccccacacccataccgtcaccaacacaatatctcatcaaagtccagacggccgccttctcacatgacgagctgcgactggcgaaagtgctcaacccgaggatatccatgcccaacattcccctccacaacttctgcggcaccgtcatcagcacgcccggtgaagatcactggcgtcatgctggccctaagttcaaagtggaggatgccgtcttcggactgatcagtcacagccgagacggcgccgcagccgattacgtcctcgcaacggaaaacgagctcgcattcaagcccaggaacatcagcgccgccgaggcggcgacgatcccactacccgccctcaccgcatggcaagccctcttcacctacggcaaattgaaccccgccgacacgggccatgttcgcggtggcctgcgcgtgctcgtcaccaacgcccgcaacagcgagttcggcatccaggcgcttcagctgctgagggcctcgtccttgttcccgcactaccgcccctggatctgcacaacctgcgacaacgaagaacaggggacaacactccgcgaccaattccaggtcgacgagtacattgtcgcggccctcccgttgccgcccgactgggacctggccacaacgttcaagcagaagcagtgggagcccgtggatatcgtcatcgactgcgcaggcgaagacatgttccagcaagcccactcaccagcagttgtcaaggaagatggcgccgtcctaaccgccgtcgaccccacgccggctcagaacgggcggaccgagcaagatacccagaccagcaacggctcgaagaagaaaggcccgttgagccggtttatctctgtcgagccggatgggaaggcgctcgcgcacatcgccacgttagtcgaggaacatagcgtccgcggacgggtagagagcatcacggatttggtcaacagcgcagatatactagatgcggacgctgctggcgccggtggagggaggcgaggcgggatgatggtgatccgggttaacccatag

SEQ ID NO: 20060 - DNA, 189 bp, A.fumigatus
atattaaagaaacagagaattgatgtttctgtgcctaatgttaatttagaagatcatggtcgtctcaaacaacatttctttctcactaacgtctgctggattgttagcgcttcgccggttacggatgagagccgcaccaagacacatctgatcttgaacctcaacaataactggtatggttccaattga

SEQ ID NO: 20061 - DNA, 396 bp, A.fumigatus
accctctccacccctcaaccgggccctcgctctcctcactctcctcgtctgctcgccgtcttttctctcctttctgatctgcttccctacaactgtcgcaatggcctcctcgacatctgttgcgaggctggtcgcctaccgtcgccctactccctacctgtgggcctcttctctccgtctttcgtcctctgggttcaatcgcaacctttttcctcctcggtgtcgagagctgctacaccagctggtcctcctcagcctggattccgtttacctgcgccaaggaaatgggaccaggatcccgagtcctcgctagacaaggccagcaagtacttcctcatggctgaattattccggggcatgtacgtggttctggagcagtttttcagaccaccgtaa

SEQ ID NO: 20062 - DNA, 474 bp, A.fumigatus
gaccggttttcacattatagttatactatctactaccccttcgagaagggtcccatctccccccgcttccgtggcgaacatgctctgcgccgctatcccactggtgaggagcgttgcatcgcttgcaagctctgcgaggccatttgccccgctcaggctattaccatcgaggccgaggaacgcgaggacggaagtcgacggacaaccagatatgacattgatatgaccaagtgcatctactgtggttactgccaggagagttgccctgttgatgctattgtcgagagtaagttgatccgacaggttgatcagtatgaccccacagctgacaggatacacgcagcttccaacgcggaatacgccactgagacccgagaagagttgctttacaacaaggagaagcttctggccaacggtgacaagtgggagccagagattgctgcagccgctagagccgatgccccataccggtag

SEQ ID NO: 20063 - DNA, 882 bp, A.fumigatus
  unsure (1),(2),(3),(6),(7): Identity of nucleotide sequences at the above locations are unknown.
nnnctnngaatggcagcgctctcttccagccccgtggtgaagactgcccgtcgactgcggccgttcttgtaccaaacagcaccagcgcatacggtggtcatcgagatcccgttgtcagacgcctccatacatctccatcaaattggtcccacggacagcaatggtatttgcagccagactgtgaattttggttcgcgccatcttgcagacggtaccagaatacggtcgtaccttcggggttgggagggcgaggtgtccatggagacactcttcgctggtccggaaggttggcttctgatatccgacatagacgacactatcaaatatacaatgacttctgaacccacgggcatcttacggactacttttgtcgagcctgcgcgtcccattcaaggaatgcctcaattctacttccatatacagagacagctagtaccaacctgcttctatctatcagcgtcaccatacaatctatatccttttctccgcgagttcatctacacctggttcactccaggaacactcatgcttcgggagtcttcctggatggatgtcggttcgttgattcgatcctttactacagacaccatggagtataaagtgaacaacatggagaagttgtaccagtcttttcctgagagacgtgtgctctgcattggtgactccacgcagacggatccggaggcctatgcagagatctacagacggcacccgacctgggtgaaagcgattctgatccgtaaagtcacaaacgtcccacacttggaagtgaagaattctccagagcgattcaagactgcttttaaaggggtcccggaaagtgtatggacagtattcgaagagcctaaagaagtatatcatgtcgtggacccactttcttag

SEQ ID NO: 20064 - DNA, 705 bp, A.fumigatus
gttcaaagtggaggatgccgtcttcggactgatcagtcacagccgagacggcgccgcagccgattacgtcctcgcaacggaaaacgagctcgcattcaagcccaggaacatcagcgccgccgaggcggcgacgatcccactacccgccctcaccgcatggcaagccctcttcacctacggcaaattgaaccccgccgacacgggccatgttcgcggtggcctgcgcgtgctcgtcaccaacgcccgcaacagcgagttcggcatccaggcgcttcagctgctgagggcctcgtccttgttcccgcactaccgcccctggatctgcacaacctgcgacaacgaagaacaggggacaacactccgcgaccaattccaggtcgacgagtacattgtcgcggccctcccgttgccgcccgactgggacctggccacaacgttcaagcagaagcagtgggagcccgtggatatcgtcatcgactgcgcaggcgaagacatgttccagcaagcccactcaccagcagttgtcaaggaagatggcgccgtcctaaccgccgtcgaccccacgccggctcagaacgggcggaccgagcaagatacccagaccagcaacggctcgaagaagaaaggcccgttgagccggtttatctctgtcgagccggatgggaaggcgctcgcgcacatcgccacgttagtcgaggaacatag

SEQ ID NO: 20065 - DNA, 1056 bp, A.fumigatus
gatcttcgacatcgcagcaacgccgcgaagacaatgccgccgaaaaaccccctctcacctccgacgaaacccttcttcaaatcccagcccgtccgccacgatggccaacaggcccctccgccggtcgtgcagtacaacctgaaccagctcagcagcaccagcacctctgccgccaacggtgagcgaatcctgatcctcacgccgatggcccgcttcgtgccagagtactgggacaacgtggtgaaactgacctacccgcacgagcttatctcgatcgggttcatcatcccgaagaataaagaaggcaacgcagccctagccgcactagaagccgccatcgcgaagacacagtccggccccatcgacaaacggttcgcgagcatctccatcctccgccaggacttcgagccgcccctgcagtcgcaggacgagaaggagcggcacaagatttcgaaccagaaggcgcgccgcgagtcgatgagccgcgctcgcaacagtctgctgtttacgacgctcggccccgctacggcttgggttctctggctcgatgcggatatcgtcgagacgccgccgacgctgatccaggatctcaccgcgcacgatcaccccgtcctcgtccctaactgctaccagcggtactacaactccgagaagaagaagatggatgtccggccgtatgactacaactcgtggatcgatagtagtacggcgcagagcatggcggcggagatgggcccagatgagatcctcctggagggctacgccgagatgccgacctaccgcacgctgatggctcatctagccgatacagctaatccgaatccgaagaaagtgatcgagctggacggcgtgggcggcacagcgctcatggtcaaggcggaggtgcatcgcgacggcgcgatgttccctgccttccctttctaccacctggtcgaaacggagggcttcgcgaagatggcgaagcggctagggtactctgtttatgggctgccagattattttgtaagccgcacctttttctttttctttttctttttcttcttcttctttggatga

SEQ ID NO: 20066 - DNA, 615 bp, A.fumigatus
cttgagtttcgctgcgatagggatcgcaaattgaccttgacacaaaactaccgccgcttgggactcgttcacaaactcaatgctccgactggaggtagcgaaaaaaagccgaccaaagatggccgcatcgaggagctgcccgaggatcctctccacatcaggagcagtgccaaagcgtcggcaaagcaggcagccatgggcgagactagggtagaacgcgatccggaaacaggcaaaattatccgagtgattcgtgacgaagaggagattgaaattgctggccgcaaagtcaaaccctcgaatccgctcaacgacccactgaacgagttgtctgaagatgaggcagcccggcaacccgcttcgcaaagaaccaatgccaagagcgctgttgttcaacagctggaacgtcaggcggaccaagaaggaaaggccgtcaaggcgaaaaagccccggcatcagagcaagcgggaggaggaatggatcatgaggttgatcgagcgtcatggagagaattacagcgccatggctcgtgataggaagttgaatcctatgcagcagagcgagggtgatttgaaacggaggattcgcaagtggaaggcgaaccactcttcatag

SEQ ID NO: 20067 - DNA, 462 bp, A.fumigatus
gatcttcctaggcgaagactccccggagcatgtgcgcttcgtcatggtcgaacccaacaggaatctcctcctcggactcgggatcatggtcggcttcttcaccttcgtggccatggacaaagctctccgcattgcaacatgatgcgaaaggcatgcccactcacactcgcacacagacaccgacagctcttcccacggcacaaccaccagctccaccaccagcaccgccaacaccgagctacggaagcgcaaatccactcccgccaccaagaaagaaccagaagacgagaaagacatcaaccccagcgtcaaactaggcggctacctcaacctcatcgccgacttcacccacaacatcaccgacggcctggcaatgtcctcctccttctacgcctcccccaccatcggcgcaaccacaaccgttgccgtcttcttccacgaaatcccccacgaagtcggtga

SEQ ID NO: 20068 - DNA, 1455 bp, A.fumigatus
  unsure (1177),(1222),(1227): Identity of nucleotide sequences at the above locations are unknown.
cctcgtgattgtttccaccattgcactcgtgatgatgatatgcggtatggaatttccgtgcatgctacggaaatattcgctcatttgatcctagacttcgcgactccaatcttgttgcagcaactccttcaagccatgcaggacatgagctcaggaaaacgtcctgccatgacctatgcgctggccaccctcgtcgttcgtgtggttgcggcgcaatcgcaggtactcaacctttggtttggtagacgatgctacgaaaggagcagaggagagatgatcatgatggtctacgagaaagcactctccaggaagaacgtttttgacacccaatcagaacaaaaagatgaagggcccgcaaacagagagcttgccgaagaagatgccgacgaagaagcggagattcccacgcgaaggaaattttgtgggatattctctgggagccggcaaaccacaaaaaagccggctaaaacagctgcctcgatgggcaagattttcaatctgctccgtggtgatgtctacgaagtcgcccagcggttttgggaagttgactccttgattgacaaacccctgggacttatcattgcgatcgtgcttgtttggaagctatttgggccatcatgctttctaggaatcctagcaatcattgtggctcaggcattgaacgccgtcattactcgcacacttctccgttgggagcgagtgcggagacttgcaacagatgccagacttcagataacctctcaatttgtcgaagcgcttcgtcacctgcgttggtatggctggcaggatcactggtaccggcaggttatggatgctaggcagtcggagctgaacctacgcattatcaccaacctgtggagcatcctgattcgttttgtgaacacttttgccagcggtgtgtttcctgtagtggctctgtatgcttatacccttctggccggtcatcctctccgcatagatattatcttccctgcattgcagctatttactatgctggagacccgccttagagatatccctggtctcataacggtactgatcaacgcatctatcgctgtcgaaagaattgaggacttcatggccgagccgaacaaggagaaccctgctaccaagcccgccgactctgcttctattcagctacaacattgctcatatgcttggcctggtcaggtcgtcncagtgctttcagatatcaatttgacaatatcaaaggggctaacantcgtntctggcaaggtaggggctggaaaaacggctctacttcaaggcgctcctcgggagagttggaacggaatcggtggctccgctaagattcctaatgagttgttgggctattgtgctcaaacaccctgggctccagagcatgagtatccgagacgacatcctttttcctcctcaccctatgatgagcaacggtatcagagagtcctagatgcatgtggccttgcttcctga

SEQ ID NO: 20069 - DNA, 675 bp, A.fumigatus
tgcgaaaggcatgcccactcacactcgcacacagacaccgacagctcttcccacggcacaaccaccagctccaccaccagcaccgccaacaccgagctacggaagcgcaaatccactcccgccaccaagaaagaaccagaagacgagaaagacatcaaccccagcgtcaaactaggcggctacctcaacctcatcgccgacttcacccacaacatcaccgacggcctggcaatgtcctcctccttctacgcctcccccaccatcggcgcaaccacaaccgttgccgtcttcttccacgaaatcccccacgaagtcggtgactttgcgctcctcatccagtccggcttctcaaagcgtaaggccatgggtgcgcagttcgtcaccgccatcggtgcgttcctcgggacattcatcggcatcgcgatccaggagttgggaggcgggcacagcacagcggctggtggtgtgacgggctcatcggccgggctgctgggcacgagtctcacctggggcgatatgctcttgccttttactgcagggacgttcctctacgtcgggactgtgtcggtcatcccggaactgctcgagacgggcaaggataaggcagttgagatcaagaagacgattgtgcagttcctggctgttgcggtcggggcgggaatcatgcttgcgtga

SEQ ID NO: 20070 - DNA, 2271 bp, A.fumigatus
atgcatgtggccttgcttcctgatctaaagaactttgagcatggagacctttcttttgtcggtgagaatggtataggcctttctggcggccagaaggcgcgcgttgcgctagcacgagcgctttatagtaccgctagggttctgttccttgacgacccgatctctgctcttgatcacaacactgctgaggccgtggttgaaaagtgctttacgggtcctttgatgcaagaccgcctcgtggttctcgttacgcatcgtaccgcgcttgtcaatcatcttgcggatcaaaaagtccttattgaagatggccgggctacaattcacagtaaacaggccgtctctatcacatcggcggctgataaagacatccaatccttagggaagaccgccgaggcccaaagtgagatccaaggcgctcttcgagaggctgcggcctcggttccgaccaagttcatggaggaagaacaccgtgcggaatggggtgtaaaagcccgtgtctattggaactacatcagagctggaagatacagatggtggatttcactagtgcttgtcttggctgtctatcgattgacatcggtaggacaatcgtggttcctaaaggagtggggagaagcctacaaccagattcttctagcgttcagcaattctacccccgacggcagatattccgcacgacagttggttataccgtatgggtggtcccaggtgtcccgttggaaaccaaccgatcctctagagaaattgccagcgccattcgatgatgtgcgtccttggcttctggcattctttgtgataacggcgtttcaatcggtcatgcttctgtttgcgcaacttctgatgctggtcatcgtctactgtgcaggcaagaagctctttcaccaggtcatggttcgagtgagccatgcaacattccgcttcttcgatgtcactcctgtcggccgcttgatgaaccgactgacatcggatatcggagtggttgacggtaatattagtgaacaatttcaggctattgcgttccaagccatcacatgggtctcgtcgattgtggtcatagcgtcggtgacaccggcatttcttggattctccttcgctctcactgcagcattcattttcatctttcttcaattcctgccaacatctcagagcctgcgacgtcttgagatggtatctctaagtcctctgatctcgaatttcggcgaactcctacatgggctcacgactgttcgtgcgttccacgcggaagaacgctttcaaaaccgagttattgcagttgtagacaaattccagggcatggatcatttctactggtcgcttcaaagctggctaatgtatcgatttgaaaccctgtcagctgcgtccacgttgtgcctcaccgttctggcattatacaccaatgtcaccccgggtcttgcggcttttgtactgatagccgcgaacaactttgttacgtccacccatgctttgtgcaaacaatttggccagctacaaatggactttgtctctgttgaaaggatcgatgagttgcttcgcattgagcaggagaacccagggaccattgaacccccggcatgctggccaaggttcgggcaggacatcacattcgatgacgttaccattcgatacgcaccgcacctggagccgtcactccgcagcatttctcttaccatccccggaggatctacgacggctgtcataggcagaacaggaagcggcaagtccacgctggccgtctcactgctcagcgtcatccgccctgaatcaggccggatcatcgttgacggcatcgatatcgcgcaagtcgatacgcaagcgctccgaacgcgcgtcacgttcgttgcccaagatcccgttctcttccctggtagtatccggttgaatctcgatccgaccggtgaatactcggatgaggaatgtgcagatgtgctgaagcgtgtctgtagtcggcatggctggaatctacagacgcacgtcgaagccggtggccgcaacctcagtcagggtgagcggcagctgatcggtctcacacgggccgttttacgtcacagtccgattgtcatacttgatgaggctaccgcgtctattgaccatgaaagctctcttgaaatccagcaggtcatcagggaggaactacgggagtcgaccgttatcaccattgcacatcggttggaagcaatcaaggacgcagactactatgtcgtcctagataagggacgggtgtcaaagcatggctatgtcaatgataaaggtacttctcagatacagacatag

SEQ ID NO: 20071 - DNA, 210 bp, A.fumigatus
accatcgaggatatttatttatataacgcagcccttgatgaatacttgaagggaaatccagtacgcatatttcgaattgtgacaaatgtccttattagcattcgaattactgatatgatggacacacatctaattcagtgttttaagggctatccagtgcttgttgctcaagtataccttccgtcccatatatatgaaaatggcaagtag

SEQ ID NO: 20072 - DNA, 1806 bp, A.fumigatus
tcctcggggtggctgcgtctgcgattcactctgtggtcttcagtagttctggcctttatacctctcggtaaaaacgaaggtcaactcggattagtcgattcggacgctcgatcccttgaataccagattacgcctcggcgcgttggagcgtccctattcggcgctggtatacagagtgtgtctgccatcgaccacgccacaatcgttcttctccaaaaccatgaagtttgggtgttctcccaatatggctattccaggctctcatttccgttgggcatcagctcaagcttcattagaaacagcttcatggcaactcggtatgacacatcagccaatcgcgtggttcaggtgaaatccggaggcgatacaatctgtgcacggtcaagttctggtgaagtcttcacagttcgcgttaatagatctgaaaatccgccaacttcaacttcgactacaaatccatcgaagactcgcaactccctatcggctccagtccgggtttggactgtgaaaaagtcgcatatggccgccacagatgttgatgtcggacaagacggatccatcatcatatgtacggcttcggggtcagcttggacaaaagagaagcgcagtaaggcgaaagatggtacctcaaaggactacaaatttgctcgtgtcccaggcctttctcgtgttgtgggggtgtgcagcaacgcctatggggcttacgccgtagcgcagcgcgactacgatgtgaccaaggagcagatcaatgtcgatcaaagcacattatgggaagacttcctcccattatcgcccttcgcttcgctagtatccaccgtaactccgttaaagacggatgatgcctcagatgctctttcggatggaggatccgccaatgcaatgaagagagtggcaatgtcgatttcggacattgaatcttacttccaacctcttcgaaacgaggcacccgagggcaccgtattcctcttgagctctctttctgatgctcggataccagtccatgaattcatcttgaccgggcgtagctcggttctcaggaaggcgttccatgagtttcgacaggcatactacttttctttgcctgatattctggacattgagtatgggccaaatgggcagtgccatgtgcggttcaatggattggactttttgacgatcctcaatcttgctttttttctgtatgcagacaatgtgctggacgtatggcaccagatgagagcttcggctgctaatacgtcaagatatcgtcaagttcgctctgaggttatgcggatcgcaacatatctgggcctgccgaccttggaacgagctgcgcggctcatgataaagcctatgaaaagtctgaaatctgatatggcccatgcgtttaacgatccgactttcttcgagagctctgatgtaacgatcgagctcaacggcgaaacaatgaaggctcacagtcaagtactttgccggagatgcccctttttcgacaccttgttcaacgggcgctctggcggaaaatggctattatcgcgccgtacaggtgcgaatgacagcattcgcgttgatctcaaacacttagaccggcccgtctttgaatttgttcttcgttatatctatacggacgcggaggagcagctttttgacgaggtccgatcgaaaacgctggacggattcatcgatcttgtacttgatgtcgcgttcatagcgaatgaactgatgatcgaccgattagcgcaagtatgtcagaagatgctaggcaaattcggtatgacatttttcaaggcattcagtttaatggcatcgtttactgagaccctttag

SEQ ID NO: 20073 - DNA, 1827 bp, A.fumigatus
gcaagttcaaaagatggtgcactggagtatatctgcttcaatctggaagatgttttggcgcaaaggttggtttgcattcttacacatataagaggagatcttaacgcgtcacgcaggtgtctcagagaccttgatgagaacttggttgaggctcttgatactgtctgccatgaaaatcaaatgacaagcttcccagtgtcgagaggacggaattctgaagcctatgtgcttgagaagtaccctgaacttgtcacatcgatacaagcggatagacggcggatgattgattcgatgaggctccagtcccgtctcaactgtcttcaaagctacgaggagaagccccgtcctgtcactgacgagaagctgcgtgcgtcactgtcagtgcagaaggccaaggcagcttctcttaaagagaactcggacatacctcgtagtcccattttgaagtccagacaatcaaccagtgacttgatgttccaaatggacgatgaccccatgctatcacccgcagattcatccaagggaaagacagcaatccgcaaaggtgtggcgtcggagccgtcacgagattttccagcgttgggcacaagtctcggtgacaagcaagcgttcaacaacgattccaatgtcatgccagaatcgttgcagtcgccccaagagaacgcactttccgactcgccttcagtattcagagcagcagtactcgaacagaagaagaatggttaccccatctccagcccatcccagacaccgtgggcttcgtcggctatctcaactccgaagaaagatttgaaggatattatgtccgaaacctcggagaaaagggtgtccaatttaagccttggcatgtccgctcgccgtgagaacagcaataactttacccccaagctgtctcagaaggaaaggaagaagcttcaacagcagcaattgcaggagaagcttgcggctcaggagaaggcgaaggaggcaccacagaatccatggaaactttctactcctgtcaaactaccagacaagcctggtactccttttggatctcatggaaaggacggggagtcttctcaaccgtcaaagttcgctcagaagccttctatgacccttcgtcaaacagttgctgggacaccgccgcccagatcaacaccaagcgcaacaccaacacctggccaaggccgcagtgtctctggcggcccccagccacccctgaaatcttcgccacaacaagccgcagccgggccctcgacatctcccaatggtctagctagtgctcagacccccatcaaatccatacgccacataccacgccctgaaccgtaccagacgagtttttgttctccttcacctaactcgttgtccttggctgcaatattaatgcagcagcagaccgaaaaggatgaactgcgcgaggcagcaacagctaagcataattttcaagatattcagctggagcaggagtttcaggaatggtgggacaaagagagcaggcgtgttcaagggatactggagcctgattcaaccacagccagtcaaaaggacagcgaaggcagaggtggtcgcggcggacgcggtagaggatcaaacaatcgcaagaagcatggcaagggcccggagaatgctactggttctccgggattaactcaacagctgtctcgggcgaagggccagaacgggcagaagttctcagactctcgtcgggacaacctgcaacccgaaacgaatggaaatcattcgagctctgccggcggcaattctcgtcgcggtggcagaggaggccatccgaagaagggaaaagaacgcgaccgaactgtgtcaggccagacaattcaatga

SEQ ID NO: 20074 - DNA, 1422 bp, A.fumigatus
cactttgggcacatgattagcacgctctgggaatctttcttgagagacgatgttgaaagcttccagcgatgcctggcgaacgccaattatacgtctggtagccagaggccttccgccgcgggaggaggctcaggcttcaaggttggaagcctcgatggagtgacaccatcttctcctttctcctcaaaaggcaaaaagctgagcgggacatctcctggagctaccacgcctgatcgaaataccggaagcccgcgtcctggcaaggcattgtcccgcgcagacttaaatacgagagatcactatggcagaactctcctacaccttatctcttcatcacagaagccgtctgctattcacttcgcgaaatctctcctcaagatcccctttcttgacttgtatgcgcaggattgggagagtggatggacagctctgcaccgggcactttacgcaggcaatgctaccatagcacaggccctgatggctcgagacataagtgatgtaaccgatttcagcaagtcagggaacgtgggccaccccagcggtggccttatcaagattaaagatcgggaaggttttagtccttttgaagtatacggcgctaccattgcttctcgagacatcaaacggatcacctcctccagtgcatctctcatccccttagagctggagcatagtgacatcgcttcggatgcaccgtcccttcaagacgactcaggtgaagacagctgtgtcggccgaggttcactaaatccgcggacgaatttggctgccgatgaagtctttacgtttggcagcaacaagaatctaaaccttggcctaggagatcaggatgatcgtcagtttcccgtgaggatcaatcttgagcgcccggagcaccttctgcaccgattctatcgtgaattcctggatcggcaatcagatgatggtgagccgtcttcccaacaagacgtgactcgcaccgcagaactaccagccttgataaaaaacaaacctatcaagattcaggctatcgccatgtcaaagctccatacagctattatcaccgatgatcctgagtcaaatctcttcttgtgcggctttggtcccggcggacgtttaggtactggcgacgagcagacaaggttcggcttcgtgtgcatcgaaacagggggactcgctcgtaagagagttattgcagtggctcttggccaagaccacaccctcgcgataaccgcgcacggtgaggttttcagctggggcagtaataagtatggacaactcggttatagccttccgcgaatgcagaaccgagatgatgtgcccatgcagatgtctccgaggcagatcttcaatccattcaaaaaagaagtgatcctcggggtggctgcgtctgcgattcactctgtggtcttcagtagttctggcctttatacctctcggtaa

SEQ ID NO: 20075 - DNA, 288 bp, A.fumigatus
attgcggttagacacccccacagtgttattgccaacgagctcctcggcatactggttgattccaggaccatcaccgatcttaggcgcagagacaagcacttcgactactattacaccaccggcatatactttaaggaagagggcaaatcctccaaagtcgccggccataatcgcaagagcccctgctacaatcacagtaacttcgacatcaacaatcacaacctgtcctgtgtgtacgaacacaccaactactacttctaccaacacgccaacaataacaccccctga

SEQ ID NO: 20076 - DNA, 285 bp, A.fumigatus
tcctggatcaaccgttacaggcacaaccacgttaacgaagatttcgacctcgacacttacaagtctaggagtgacagttacggatacaatgcctgtaacggaaggttctacccagaccatcagtcagattctaacgatgacggccaccaagaccgaggtcttgcctgggagaaccgtggtagattcaaagacgattaccctacctggaacgacaatagtcaactcgaaagctgtgacgctcacggttccaggaacaactgtgactactatgaggacaatcactaa

SEQ ID NO: 20077 - DNA, 1572 bp, A.fumigatus
cgtgacgacgacggatctgcaggtcattcccacaacactgcctggagcaatgattttgaccactgttatgcggccagcaagtaccatgatcgtatcaggaactattactactctaccagggtcaactattgtacaaagcgcaactctccctggattgcggttagtcgagactgtatcagtgactgtcatccagagtactactattttcgatacagtaacgttgactggttagtttctcgtccaacgccttgctatacatactggaaatttgctgacgaggtaggctttgacaaagctataacaaccacagaaccggctgcatctacggctcagagcggcaacactgtaacagttcctgcaaccaccacaacgttattcatttgtccgaccctcagcatcaatcccacttacactccggtcgctcctctcccaaggaactatacttggggttgtccaccaggttatctttgcaaaaccaaacacacaggtgccgacgcaggctgtaacatcgaagccagcatgccggcagagtcctatgtctgcagtccagacgagtgtatcaagagctctccattcatccacgaccagtactggggcacacctgtcgagtccagcgagatccgttcatcctacaacatctcaaaggactacttcaacctcgaccctgagatcttcggtctgaactactccatctttcggatccccgacctcaaacccggcgatgaccattactacatccggtcttctcgccgaacgtggagcaaattacttgcccggcagtcaattggagtatccacagtacctggcgcttgctatgacgaatgtaacgatgcagcattggaggttgaatcgaccggcaagacacccgacatatgcaacgctgggtcggctttcaatgtctccctgggccaatgcgagaagtgctgtaatacccacaagacagctacttctgccagctttgagcaaaaggttctgccaaactttcagcagtttttgaacttttgtgaggggttggaggactcggctaccactgcagctgcggatactgtcggttcgactactaagggtagtcagacatctacaacgccaggaacgacatccacgcaggaacgcggtactatgtcacaggctgatccattaacagcgtcgtctacctcgaattttaccggcaaggccaccaagagtcgtgataaatcaagcacggccgcatctgcaacctctgttgaacaaacaataataccctcaccaacccagcagacaaccgcaccgcacccaatgacggaatcgaagcctgtaaccgcgagtgggatcagtacggatactatctccagttcatcatcatgctcagcgacaggtacctcttcgagagagactgcacaaagttcttccgcatgcgagaacactggtaacagcgcggctacttcaacatctcacagaccaacgagtacacattccggagcaagtccgtctgcacctgcattacttttcacaggtgcggcaagtctccagacagtgccatctcactggggtattttggctttcatttttggagttgtgggtttccacatctga

SEQ ID NO: 20078 - DNA, 1695 bp, A.fumigatus
gcagcaaccagcctaccgacgagtgctacggcatactcagcagtggccgaaacatcaacatcacctgctgaattgcggttagacacccccacagtgttattgccaacgagctcctcggcatactggttgattccaggaccatcaccgatcttaggcgcagagacaagcacttcgactactattacaccaccggcatatactttaaggaagagggcaaatcctccaaagtcgccggccataatcgcaagagcccctgctacaatcacagtaacttcgacatcaacaatcacaacctgtcctgtgtgtacgaacacaccaactactacttctaccaacacgccaacaataacaccccctgaaactacaccaacgacatccacaataaccagtactcctgtcaccacgccgacagtaggaccaggatctactgtaactacgactgtgactgtgacaaccactgctccaggccctacagagactgacactgtcaccacgactgtcggcttgccaggcaccacggagacagacaccctcactagcacagtcactattccgggaactacgggaacagatactgtcactacaaccattgacttacctggtgccacagtgacagccactcagagtgcaacctcaaccattactatcacggctaccacaactcagtcaggtactacctgcgctgcaactccaggcgatggaataacccaaaccaccacagttactgttagttctgaaggtgcaacgaccatgaccttgactcagacagtaactctacccgccacgacggtgtccaacgcagctacgcttacagaagctacatcggtagcaatgtcatggtttactttaacagtccctggttcaactgtaactgagacgactacatcaaccaagatcactacacaaaccgtcactgtttctgggagcacagtaacaggtatcacgacagtgactaggacctcaacatcaacagtcactagtcctggatcaaccgttacaggcacaaccacgttaacgaagatttcgacctcgacacttacaagtctaggagtgacagttacggatacaatgcctgtaacggaaggttctacccagaccatcagtcagattctaacgatgacggccaccaagaccgaggtcttgcctgggagaaccgtggtagattcaaagacgattaccctacctggaacgacaatagtcaactcgaaagctgtgacgctcacggttccaggaacaactgtgactactatgaggacaatcactaaatctgggacaacaatgactatctcggaggtagtcacccttcctggttccatattcacgacgatagagacaattccaactactctctccgggtcaatcatagtcacgacaaccactaagccaggacagacgattaccatgtccggatctgtaaccacgttgcctggatcgactattatccaaagcagtactcttcctagcgtgacgacgacggatctgcaggtcattcccacaacactgcctggagcaatgattttgaccactgttatgcggccagcaagtaccatgatcgtatcaggaactattactactctaccagggtcaactattgtacaaagcgcaactctccctggattgcggttagtcgagactgtatcagtgactgtcatccagagtactactattttcgatacagtaacgttgactggttag

SEQ ID NO: 20079 - DNA, 183 bp, A.fumigatus
acaaacaataataccctcaccaacccagcagacaaccgcaccgcacccaatgacggaatcgaagcctgtaaccgcgagtgggatcagtacggatactatctccagttcatcatcatgctcagcgacaggtacctcttcgagagagactgcacaaagttcttccgcatgcgagaacactggtaa

SEQ ID NO: 20080 - DNA, 717 bp, A.fumigatus
tatacagctctagagaactgttcattgagaatggcctcattaggcagcctcacaagatccatttcgactctcgttttgcagtttaatgagtacagttctagcgttagctcccagcccagtgaggcagctttccttgcaaccgtgatgcctgaatacagccagcagcatcgaatccctctgcgcgttctggtctccccgacaaacttccttaacctcaaaaggatgtactcgcagatccccaatgttgaggtccaagctttcagaatccagcctcgtcacctcaacataagcatgatgcttttgcttatgtctgtttctcagaacgacagcatgcccctgtatatggctcaagtaacacgtgttcttcgggagatggcaatggaaagtggcggttgcttcgattaccttgatttccgagaacgtctgagtgctcttcgtcttgatcgtgtccaaactccattcctgcaccagaggctggatctgcttgactcatatctggaccttactggacaggctacgagtgactatttcgtcgacggcggcgttacgatcttggacctatcatgcccatttgttgaccagaatacggcctgcattctctttcggattgccattgacttattcctcagcgctcacccttctcgggggaaaatgatagtcgctgacgaggcgcataaggtaccactatgggaccgcatgggattcgtgctttgctaa

SEQ ID NO: 20081 - DNA, 588 bp, A.fumigatus
ccagtcaacgttactgtatcgaaaatagtagtactctggatgacagtcactgatacagtctcgactaaccgcaatccagggagagttgcgctttgtacaatagttgaccctggtagagtagtaatagttcctgatacgatcatggtacttgctggccgcataacagtggtcaaaatcattgctccaggcagtgttgtgggaatgacctgcagatccgtcgtcgtcacgctaggaagagtactgctttggataatagtcgatccaggcaacgtggttacagatccggacatggtaatcgtctgtcctggcttagtggttgtcgtgactatgattgacccggagagagtagttggaattgtctctatcgtcgtgaatatggaaccaggaagggtgactacctccgagatagtcattgttgtcccagatttagtgattgtcctcatagtagtcacagttgttcctggaaccgtgagcgtcacagctttcgagttgactattgtcgttccaggtagggtaatcgtctttgaatctaccacggttctcccaggcaagacctcggtcttggtggccgtcatcgttagaatctga

SEQ ID NO: 20082 - DNA, 732 bp, A.fumigatus
gtggctgtcactgtggcaccaggtaagtcaatggttgtagtgacagtatctgttcccgtagttcccggaatagtgactgtgctagtgagggtgtctgtctccgtggtgcctggcaagccgacagtcgtggtgacagtgtcagtctctgtagggcctggagcagtggttgtcacagtcacagtcgtagttacagtagatcctggtcctactgtcggcgtggtgacaggagtactggttattgtggatgtcgttggtgtagtttcagggggtgttattgttggcgtgttggtagaagtagtagttggtgtgttcgtacacacaggacaggttgtgattgttgatgtcgaagttactgtgattgtagcaggggctcttgcgattatggccggcgactttggaggatttgccctcttccttaaagtatatgccggtggtgtaatagtagtcgaagtgcttgtctctgcgcctaagatcggtgatggtcctggaatcaaccagtatgccgaggagctcgttggcaataacactgtgggggtgtctaaccgcaattcagcaggtgatgttgatgtttcggccactgctgagtatgccgtagcactcgtcggtaggctggttgctgcctactgcatcttagaagttatatcgagcaatagacgtttaactgacctcccacggttcagaaacagtgactgtttcaatcactgtctctgttactgtcacatcttctgctaa

SEQ ID NO: 20083 - DNA, 333 bp, A.fumigatus
  unsure (115),(118): Identity of nucleotide sequences at the above locations are unknown.
agcagcgaacaaaaggtgctgaaggaaaactgctacagtgcccagcgccgacttgacgaacaaattatgaagaaccgtaagctccagaccatgttggaagagtcggactttcgtntanaaaccttgaatcatgacattgcggtgggggaagttgatctagatgagtatggcaaccagtctatcatctgcgagctcattttcttacttagtggcagtcttaggaagggatttcagagtatggaaaagcgcctgaaggcgttgagcgcgaagttctttaagagctcaactagtaccgagccagtatgtcccatattcactaatggtattgactag

SEQ ID NO: 20084 - DNA, 1101 bp, A.fumigatus
  unsure (202): Identity of nucleotide sequences at the above locations are unknown.
cccaagacggtaaaagggcagctttcattaggccgggtttccgaatttttcgaaccagaatctcagtctctagatgatcggtatcggccacgtcgcggagaggcgacggtattgcaccatcagtctgatgaaagtacgccaatgtgtcttatttctgaacgatgccgggactttgatggcttgagtttcgggacagcacagntacaagaagaacaagagcgcgagcttgccccggaaatcgaacaggaacgccaaattgagcggcctcctccagccgagcctaagcaacattgtcttcatgcggacctccttacgttcgtgtcgaccggcatactcaaggagcactccagcgctgtccggcctgcctttgaggccctcaggaatacgtcggccgcccgttatctagacgtgtctcagtttcccccgggattacgagttacaaccgactttgccactaccattcaattccgggaggggtcttctagcttgtctgatgcataccagcgccctgtccaatgggtcttaacccactctatctacgattctacctccggaaaacgaaatgcaagtcacgtcataattataagcccctacgaggccatgcatctgctgtcagaagtccgacgatcgacaggggccacgattcatctgtacgcgccacgtcagcacctgagcttcgtgcctctcgatcggttggacctgtacaatattcctagccgtgctgaccctatcgatataccagacgacctgaagatacagttgaatctgttcgcgggtcagttgtatattgcctcgtacgatgagtacctcagactgtgtgacactcttggggtcgcctctgctgcaacgccagataatctcagtgtagccgctgacgggttcattctacggggcaatgtgactggaaagtcgaccttcagtcagagcccccttaaattcttgcaagtcctcctgtcacaaatcaggaaagacggccaagatatcagcaagactcacattggcaaacttttggacggccgacttctcgaagcacgcaactttgattccgcaatcgaagagcttacgctcgcgaggttgagtattcgaagccatccggagtaa

SEQ ID NO: 20085 - DNA, 702 bp, A.fumigatus
tgccatgcttcaactaggaattacgccaaatctcacccggatctttgcattctcgccgtgaatacatttgtacaggactctgaagaccccaatccattgattagggcactggctatcagaacaatgggatgtattcgggtggataaaatggtcgactacatggaggaaccgctccgcaagacactccgggacgaatcaccgtatgtccgaaagactgctgcgatctgtgtggcgaagctattcgacttgaatccttcattgtgtttggaaaatggtttccttgagatgctgcaggaaatgatcggcgatccaaatcctatggtggtcgcgaactcggtgaccgcgctttcagaaatccatcatgccgctcctgagacccgagctcttcaagtgacatctaacgtactgcgcaagttgttgatggccttgaatgaatgtaccgagtggggtcgggtcacaatcctgacaactctggcagaatacaaaaccagtgatgtgacggaatcagagcatatttgcgagcgagtcgcgccacaattccaacacgccaatccaagtgtagtacttgcagcggtcaaggtcgttttcctgcacatgaagaacatcaagcaggagttatccagcaactacttgaagaagatggcgccccctctaggtatttctcttgagcccacttgtcatcccgaaagcatggcacgctga

SEQ ID NO: 20086 - DNA, 522 bp, A.fumigatus
caatgctggcgatatcctggccgggtttgtggaagggttcaacgaagaattctcacaggtctggttgctgcgctcgacttgtgtatgccaaggctaatttttttttatcagacccagcttcagattcttactgctgtcgtaaagctattcttgaagcggcccgagaaggctcaaggactggttcagaaagttctccaggcggcaacggctgagaatgataaccccgatgtccgtgaccgagcctacgtttactggcgtcttctctccaatacaagcgatcccaatgctacgaagaacattgttctttcccaaaagcctcctattgttacgacgatccactctctcccgcccgctcttcttgaacagctgatcggtgaactctctactcttgcatccgtctaccacaaaccaccagagcaatttgtcggtcagggcagattcggcgcagatgccgtgcaacgtgctgctatagagttcgttgccttgcttcttaatccgttcttgagcagtcagctaatatga

SEQ ID NO: 20087 - DNA, 450 bp, A.fumigatus
tggaacagggaacaaattcaaaacgcccgtgaaaaccccttggctgcagccgctgcggctgccgcagttacgggtgctacgcccccgccacaggctcaaaacaacgttgagaacctcctagatatcgatttcgatggcgcagctcccgcttcgacccagaaagaacctgctagtggaatgtctggtctcgagggtcttgctggtactcccgttcgagtagagtctcccgctgttggctcgcccgctcctgccgcaagcaacaacctggatgacctccttggtgtgttcggcgatagtggcagtacctccgcatctgccagcaccgctattcccaacggcggtggtgccgctgcggatctcatgaacggcttctctggccttgatctctccgccaacacagggggcaatcagcaaagaaagaccaatgaggatattctatcactgttctaa

SEQ ID NO: 20088 - DNA, 900 bp, A.fumigatus
  unsure (887): Identity of nucleotide sequences at the above locations are unknown.
ctgtccttcgaagatgtcgtccttaaaggactggcgtccgatggtggcctgttcatccccgaagaaatcccttcgcttcctgcgggatgggagacagagtggcgcgacctcagttttgaagatctcgcatatcgtatcatgtcattgtacatctcgccgagcgaaatcccctcggaagacctccaagatatcattagacgctcatacgctacgttccggcaccctgagaggacgcctctggttgaattggatggaaaacgcaacctctacttgctcgaattgttccatggaccaacattcgccttcaaggacgtcgcgctacagttcctcggaaacctctttgaatatttcttggtgcgcaagaatgaaggcaaggagggtaaggacagacaccacctgaccgttattggtgctactagtggcgatactggatcggcagcgatctatggtctccggggcaagaaggatgtctccatcttcatcctcttccccactggacgggtgtcgcctatccagcaagctcagatgacgacagtcttggatgccaacgtccacaacctgacagtcgagggctctttcgatgattgccaggacattgtaaaggccttgtttgctgatcctgatctcaactcaacccacaacattgctgctgttaactccatcaactgggctcgtatcctggctcagatcacatactacttttactcctacttctctcttaccaagacctccgccttctccaaagacacgaagatgcgcttcgtcgttccttcaggaaatttcggtgacattctcgccggatggttcgctaagcgcatgggtcttcccgctgagaagcttgtcatcgcaaccaacgagaacgacatcctggaccgcttcttccgtantggtgggcattaa

SEQ ID NO: 20089 - DNA, 306 bp, A.fumigatus
acgcccatacaagttttttccagcttttctcgcagaatgtgtttacagaccgacgatgagggcataagtgtgggcggtgaaaatatgaggatcgttgatagcatactgccttgtttgtctctatctacctctctagacaactttggatatggtcccattctggcaaacgaggaaattatccagcttcggccattatggatacgagacgatcacttatcccagtcgatgacatccatgtttttttttgcttttttttggttgatttaccccgcactgaagcctgattttacatcctctaattattaa

SEQ ID NO: 20090 - DNA, 435 bp, A.fumigatus
ctaccttctacatcaacaactatcatcatgtcagtcccatttagccagtttccttcaaccgcaaccattgtcccagctccttttcaagtagccgtccccgatgagcagatagccgagctgaagaccctggtgaagctcgctaagatagctccacctacacttgagaatcagcaacaggaccgtcgatatggtgtcacatccgactggctgacgaccatgcgagagaaatggttgaacgactacgactggagagttaccgaggcccgtatcaatagcttccctcagttcacaacaaggatcgaggacatatcgctgcacttcgcagctttgttctcggaaaagagagacgcagttcctgtgatactccttcatggatggcctggtaaaactctattgccctcaattatttcgtccgtgcttatagaaaaaccatag

SEQ ID NO: 20091 - DNA, 183 bp, A.fumigatus
tattcaaaaccgcaaagcaccccattaaatcgcctgactagggttggagagaaattcctcgattgggtggacgagcctctacctttagagaccatccttgatttcgtctctctgtattggtttacggagacatatccgcgggccatctacttttaccgcgaggtctgggtcccgatttcatga

SEQ ID NO: 20092 - DNA, 666 bp, A.fumigatus
gtatttctcttgagcccacttgtcatcccgaaagcatggcacgctgatatctatatagtgactctggtgtcctccgctccggaagtgcaatatgtcgcattacgaaacatcgatttgttgttgcagaagcagcccgatattctgaacaaagagctgcgggttttcttctgcaagtacaatgaccctccctatgttaagttccagaaactggaaattatggtccgcatagccaacgaccgcaacgtcgatcagctcctcgcagaactgcgggagtacgcattggaagtcgacatggatttcgtgcggcgcgccgtgagagcaataggccaggttgccatcaagatcgagagttcatgcgagaagtgtgtaaacacattattggatttgatcaacaccaaagtgaactacgtcgtacaggaggctattgtcgtcatcaaagacattttccgaaaataccctggatacgaaggcatcatccctactctctgcaaatgcattgatgagttggatgaaccaaatgcccgtgccgcgctcatatggatcgtgggagaatatgcggagaagattagcaatgctggcgatatcctggccgggtttgtggaagggttcaacgaagaattctcacaggtctggttgctgcgctcgacttgtgtatgccaaggctaa

SEQ ID NO: 20093 - DNA, 219 bp, A.fumigatus
ctcgaggggatgtcaattcctcagcatcctgcgtctgcagcgaccatcttcctcgaccaaccaccaagctgtcttcaattctgcccttcagcaccaaacaacttcattataggcacctacctgctatccgagaataaggacagcgatggaaacgtgcaacagacgaagaccggaagcctccagttatggaacctcagtccgctgagcaatgaactgtga

SEQ ID NO: 20094 - DNA, 249 bp, A.fumigatus
gcaatgaactgtgagatctgtactatcttcctcccgagttccaggctaaccgatagtctatacaaaacgctcagctctctcatccaaaggctagcactgccatatgccgtctttgatcttcacttccatccgcgagaatcaagcatcctcgccattgctaacagcgccgcatccgtggcccttttcaaattctcaaccgaccccgaaccccacatcagtcatctatggaccttaaccgtcaacgaagat

SEQ ID NO: 20095 - DNA, 192 bp, A.fumigatus
tgggtagaaagtctcgatatgtttatcgaaaccttcagacgggaagtttgtatagccctcgatgacatcaacaactacagggcgccaggccactatgtttcggtgctgagaatcttcatcgagtcggacgaagcttcggataatatcggcgcagagactggacaagatcatgttgttagcagtggttggtaa

SEQ ID NO: 20096 - DNA, 249 bp, A.fumigatus
gttgatgactcgagagtcgagactgaatcaaaggaacgccaaggaaataggagaggtaacggagtatcctggatacatggtggctgccagttcccttgtcattcgtctatccatagttgcgattggactattgattgtcaaccttatcacaccaacatggctctagacaagcatggtacctcgggaatgtgcaagtggtatgatgaaatccctacctttaatcaactgattggtcctcatatacgataa

SEQ ID NO: 20097 - DNA, 600 bp, A.fumigatus
agtatagttctatccatgttcagccgcagaaaatatatatatatatatatatgtgcatcaccacagagagctaacagggacattcaacaggtagctgcaggccgcattctacacgctctgaacgccgatgccaaagtaacagtcgtctgtcctcactcaggtctcaatgatgaggtggctttccgtgtatctgagggccaagtcacgcatgttgatcgcacattcgagccggaagatctcgaaggagcagatatggtactttgcgccattgatgaccccgacgcctcgtctcgcgtctggaagctgtgtaaggagaagcgaatacctgccaacatagccgatgtgcccgcagaatgcgacttctactttggcagcatgtatcgcgatggaccgctccaagtgatggtgagcacgaatggaaatggacctaaacttgcaagtatcattcgcaaaaaaatcgcagcatcattgcccgacaacatgggtgcggccatagaaaatgtgggcaaactacgcaagaaactacgcgacgtcgctgccaggccagaggaggggcctagtagaatgaagtggtaccgtgaaccttacctttccggttga

SEQ ID NO: 20098 - DNA, 1281 bp, A.fumigatus
cgcggcccttccagccccgtggtgaagacggcaggacaggtctttgcaacggtaggaagggacatccaaggcgaaaagtatgcccaagcatctgaagaaatggccaataagacggagcaactctatcggagtttgattagagcgcagcggaagacggccgttagagaggccctctcacgcttcatccccgcgacttcggtacggcatgttggatctatgttcaatgtgacttggatgtctttcctctccggattgtcggctcccatgcaagacacacagaatcttgaaaccattaagctctgcatggaaggaatgaaactggcgatacgtatcagttgcgcttttgatctggagactccccgggtcgcattcgtaacaggccttgccaaattcacaaatctgggcaacgtcagggagatggtaccaaagaatgttgaggctttgaaggcgctgctcgacgtggcactcaccgaagggaacaatctgaagagttcctggagagaagtcctcacctgtgtcagccagctcgaccggcttcaacttctcactgatggcgtcgatgaaggttcattacccgatccatctcgcgcccgtattgtaccacaaactccatctgatggatcccgcaaatctatgcaggcgtcaagacgcccaccccgtccgcggtcagtcaacggacctacagctttccgttctgaggttgctatggaaagtcgatccgctgaaatgatacgcggagtggaccgcatctttacaaatactgcaaatctcactcatgaagctatcattgactttgttcgtgctttaagcgaagtgagttggcaggagattcaatcttcaggtcagacagagtcccctcgaacatacagcttgcagaagcttgttgagattagctattacaacatgaccagagtcaggatagagtggtcgaagatctgggatgtccttgggcagcacttcaatcaggttggatgccacaccaacactaccgtggtgttttttgcactggattccctccggcaactatccatgcgttttctggaaattgaagagcttcctggtttcaaattccaaaaggactttctcaagccgtttgagcatgtgatggccaatagtaatgccgttactgtgaaggatatgattcttcgatgcctgatacagatgatccaggcacgtggagataacatccgctcaggctggaaaacaatgttcggcgtcttcacagtcgctgcccgggaaccatacggtaagcaagtattttatcgcttaggatctatgtga

SEQ ID NO: 20099 - DNA, 381 bp, A.fumigatus
tacctagaagagggaatcgtcaacatggcattggaacatgtcactcaaatttacaacacgcggttcggtgtggtcatcacacagggagctttccctgacctaatcgtttgtctcacggagttctccaagaacatgcgattccagaagaagtctttgcaagcgatcgagaccttgaaatcaactgtcacgaagatgctcaggacaccagagtgccctctatcacaccgtggaatcacatctgaaggtgttcaagaggatggcacaaacctggccaagcaattatcacggcaatctcaagaagagcagttctggtatcctatcttgattgccttccaggatgtattgatgacgggagatgaccttgaggttcgatcaaggtaa

SEQ ID NO: 20100 - DNA, 285 bp, A.fumigatus
gtcacaatgcggggagttcaaatcttctctgggacatcccatcctgtccttgctgagaccatctgcgagcgtctaggcacactccccgctcgggcagtgctcggaaaatttgcaaatggtgagacaagagtggacattggagtttccgtgcgaaaccaagatgtatacattgtccagagcggcagtcagaagatcaatgacagtgtcatggagctcttgatcatgatctctgcttgcaagggtggttccgcgaagtcgatcacaggtgagcttttcgtcgaatga

SEQ ID NO: 20101 - DNA, 1095 bp, A.fumigatus
tttggccccgggaacctcgctaattcggaaaccagagcattgacttatctttttgacacactgattcgtcacggaggcgactttcctcaagaattttgggatgtcttgtggagacagcttctctaccctatcttcgtcgtccttcactccaaatcggagatgtccaaggtgccaaaccatgaagaactctccgtatggctgtcaacaacaatgatacaagctttgaggaacatgattacacttttcacgcattattttgatgcgctggaatatatgttgggtcgtatactcgagcttcttacactatgtatctgccaagaaaacgacacaattgcgcggattggtagcaattgcctgcaacaactgattctgcagaatgttgcaaagttccaacaggaacactggaccaaggttgtaggcgctttcgtggaacttttcagcaggaccacggcctacgagttattcacagccgccgcctcgatatcttcgaagccagcttcaattaggaacgagaacggggaggcatccaacgaagatggccttcacaagacggagcaagagacagccgagtcaacgcgtgtccaggaaactccatcggacgcccccaaggtgaatggatcacagcctgtgacttctgagcacgaagagggcgacatgcctgccgcttcgactcccgagttggaagattaccgcccgcaggccgaacctcaacagcagcccgctgccgtgaccgtcgcgcggcgccggttctttaatcgcatcataacaaactgcgtgcttcaactacttatgattgagactgtccacgaactgttttcgaatgacaaggtctatgctgagatcccaagccacgaacttctccgtttgatggagctgctcaagaaaagctatcagtttgcgaaaaagttcaacgaggacaaagagctccggatgcagctctggcgccaaggcttcatgaaacaaccgcccaacctgcttaaacaggaaagtggcagtgctgctacatatgttcacatccttttccgcatgtaccacgatgagcgagaggaacgaaagagcagccgcggggaaacagaggctgcgcttattccgtaa

SEQ ID NO: 20102 - DNA, 384 bp, A.fumigatus
gtattacgggctttgtcgttaccaaccactgctaacaacatgatcttgtccagtctctgcgccgatattatccgaagcttcgtccgactcgatgaagattctcagcaccgaaacatagtggcctggcgccctgtagttgttgatgtcatcgagggctatacaaacttcccgtctgaaggtttcgataaacatatcgagactttctacccattagcggtcgatctattgggccgcgaccttaaccccgaaatccgcctcgctcttcagtccctgtttcgaagaatcggagaagcaagactgggtatagctgctgtgcagacacccatcagccccaggagctctatctcacagcaccactcccgcaggtatagtcgggatcactag

SEQ ID NO: 20103 - DNA, 1107 bp, A.fumigatus
caaatggttggtacaatgacgaatagacatctgactgaataccaggcgtcacaaatgcaaggattcttcggcaagcctgtggataacctctttgctgagccttttatcgcccgttggattcgaatgaacgtccctggctggaaggaggctgtcgttgtcagcaaaaacgccggaggtacaaagcgtgtaacatcgctagcggacaccctgaagctcaattttggcattgtcaccaccgacagacgccgtccgaaggtcgctatgtccatgacagatagtactgtttttttcgactctatgaatgatagcattcccaaggatccgaagccttttgtcctacacctccgcaagaactcgcagggcggcgaatcgagcgaacgcaacaccgcagagaccgaggaactactgcgcccggtgacaccacccgctgctcgtcgcccatcagagttggaagcagctcacgagtatacggacgtgcgtgtgcgtgatgtgatcactggcagacttgtacagggccatatcgtggatgatgatttcccctcgggtggtcccacttcggtacctgcctctggccatacaactccaggacagccgtctagccaagatcaacctgagtccgtcccagacgcgatggtcaactcatttatctcaaccacatcttctctacctggagatcatgctcttggtgggtcgtttgatgccgctgaatcttcggatgaggaagagagcaacgggcgaagcgtcgagcaggagaagatgatcaccctggtaggtgatgttcgagacaggactgttttccttgtcgacgatatgatcgacaagagtggctcgtggattgctgccgcagaaacggttgtcaaacgaggcggggctaaacaggtctactgcattgctacacatggactttttggcggtgattccctcgagcagatggaagcgtgtgacgcgattgactatattgttgtcacgaataccttcccaataactccccagatgatgagaaagtcgaagaaattggtcataatcgacatttcgagtcttcttgcggaaagtatccgacgccaccattacggtgaaaggtctgtagttctccggactgatctttga

SEQ ID NO: 20104 - DNA, 1950 bp, A.fumigatus
ctatcttcaagagaactgtggagagaagaagcgaagctcgactcaattcttgccaacgcttcaaatgaagtggaccgggcagaacgtacgctttctcagatgatggatcacaataccagtcgtggaattgcggccgttcgaaggatcaagcgtcaacacaacctggaaggagtttatggaacattggcggaactcttcgaggtgaatgacagatatcggaccgcggttgaagtcacagctggccagagtctgttccattatgtcgtggacacggacgagactgcgacgaaggtgctcgagatattgcagcaggagaaggctggacgagtgacttttatgcccctgaaccgactcagatccaagcctgccaatctgcctcgagcgagtgatacgattccaatgatcgacaaactacaatatgattctgccttcgaaaaggctttcaaccacgtgtttggcaagacgattatttgcccgaatcttcaggttgcctcacaatatgctcgaagccatggtgtcaatgcgattacccccgagggcgatcggtctgataagcgaggtgcgttgaccggtggtttccacgactctcggcaatctcgacttgacgcggtgaaaaacctcacgaaatggcgggatgaatatgagaacaagaaaaaccgaggcgcagagattcggaaagagctggagaagttggaccaggtcattacgaagtctgtcggtgaattacagaagctggagcaacagagacatcaggtacagcatagtagtggaccgctccggcaagagctcagaagcaaacgggatcttctccagaagaaaaatgacagtcttgacgccaagcgcaaggctcttcgcaatatcgagaccaatttggccgctttgagcgatcaggtgaatgcatttgaggcggagctgaatacaccgttccagaaggcgctgagcaatgaggaagaggcgcagctcgagtcactcagcgtcgttgctcagaatcttcggcagcaatatcaggaactctctgctcagcgaagcgagttggaggctcgaaagtcgatccttgaagtcgaacttcgggagaacttgaaccctcgtctcgaccagcttgtcagccgcgatactgatatgggagatgatgatggacagggaaatctgaaggagaccgagcgggaaatgaagcgactgcgcaaatcgttggagaatctcagccaacgcctccagaatgtggacgagtctattgagaaggcaaatgctcaagcaaatgagctcgagaaacagaaggctgagatccgtcttgaactagaagagctggcgagatccattgaaaagcaccagcgtcgcatggaaaagaatatgcagaaaaaggctgccttgaccaagcaagcagcggaatgtgcggcaaatatccgcgacttgggcgtgcttccagatgaagcgtttaccaagtacaagcacaccgactcgaataccgttgttaagaagttgcacaaggtcaacgaggctctaaaaaaatattcgcatgtgaacaagaaagcgtttgagcagtacaacagtttcaccaagcagcgcgaaaccctaaccagccgcagagaggaactcgaagcatcgcagaagtcaattgaggaactcatctcagtacttgaccagcgcaaggacgaggccattgagcgtacgttcaagcaagtctcgcgtgagtttgccaacatctttgagaagctcgtccccgcgggccgtgggcgcttgatcattcagaggaagaccgaccgtgctctccgacaagaggatgacatggactccgacgacgaacgggctcagcagagtgtcgaaaattacgtcggagtgggcattagtgtgagcttcaacagtaagcatgacgaacaacagcgaattcagcaacttagtggtggtcaaaagagtaagagctttctttcccgggcacaccgtttgacttattga

SEQ ID NO: 20105 - DNA, 297 bp, A.fumigatus
acaggtctctgcgcacttgcactggtcttcgcaatccaagcctgcgacccggcgccgttttacctgtttgacgagatcgatgccaaccttgacgctcaataccgaactgccgttgcgcagatgcttcagtccatctcggaatctaccaatgggcagtttatttgcactaccttccgtccagaaatgttgcatgtagcagagaaatgctacggtgtcagcttccggcagaaagctagtacgattgacgttgtgtctagagaagaggcgctcaagttcgttgaggagcagaagacttaa

SEQ ID NO: 20106 - DNA, 342 bp, A.fumigatus
attctcgcatcgcgcgcctcgaagatgtatgtcaagcaaataatcatacagggcttcaaaaggtatgcgctgtcatctgaacaaactctgaaaaaattgagtgttgcggctaaatctctcattgcctctagctacaaggaccaaacggtcatcgagcccttctccccaaaacacaatgtaatcgtcggtcgcaatggttccggcaagagtaacttctttgctgcaattcgcttcgtcctgagcgatgcctatacccatcttggcagggaggaacgacaggccctgcttcatgtatgtggcgctctctctccttcgaatgtttcgctggctcacattcactag

SEQ ID NO: 20107 - DNA, 1215 bp, A.fumigatus
gaaggttccggatctgcggtcatgtccgcctatgttgagatcattttcgacaactccgatgatagattccctactggaaagccggaagtggtcctccgtcgaactattggtctcaagaaggacgaatacactctagatcgcaaaaatgcgaccaaatccgatgtcatgaacctcctcgaatcggccggtttttcgcgatcgaatccttactatattgtgccgcaaggtcgagtcactgcattgacgaacatgaaggattctgaacgtctaaacttgctaaaggaagttgctggtactcaggtctatgaagcgcgccgcgcggagtcgttgaaaatcatgcacgagacgaacaataagaaggccaagatcgatgaactcttagactttatcaacgagcggctcgctgaactggaggaggagaaggacgaactgcgcaatttccaagaaaaggataaagaacgccgatgcttggaatacaccatctactcgcgtgaacaacaagaaatttctggcatccttgacaatctagaggaacaaagacagaccggcgtggaggacacagatcttaatcgggacagattcatcgaaggagagaaggggatggcgcaaattgacgcagaaattgctgagtgcaagcaacaaattgaattcctgaaagtcgataaggtccagcttgaagacgagcgccgcgaggcctcaaaggctcttgcacaggtggaattgcgtgctaaatcgctttccgagaaccaggctacagcccaagtgctcaaagcacgctatgatgaagatctcaggaccgtcgaacgcgcgatcaaggagcgcgaggctgaactcgaggaactcattcctcgcttcaatgcagtcagagaacaggaagacaacatcaaagcgcagctcaatgaagccgaaacaatccgccaacgtctgtatgccaagcagggtcgcaactcgcgcttcaggaataagtcggagcgcgataagtggctacaggccgagatcagggaaaaccacacctctatttccacagtacaggccgtgatggcgcagactcaggaggacatcaaagagcttgagaacgacattgcgcttttggaaccggaaacggaacgcttgcgccaacaaattgatggcaagggagacactgtccattctgtggagcaacaggtccaagctgcaaaggacgaaagggataggttgatggaccagaggaagtaa

SEQ ID NO: 20108 - DNA, 234 bp, A.fumigatus
ggggacatcagttaccgccagctccaccccagcaaagataaaataaaacagagccccgactgccgagccatctccgtcgtggatctctctttttcccttcccttgcccccaaccgcccctctccagatctccctcttcctctccttctctatcttcaacatttttaccaaccggaggattgtccgagatgaggtcttcaccgcggggctggaaggggccgttcaggtaaaacgc

SEQ ID NO: 20109 - DNA, 258 bp, A.fumigatus
gccatatctagactaaaattgcccgtcttgaacaatatttccggcatcaagtcttgcttgtctcaagaaacgatatctctcgaaggcataatggataccacgtctgaacctcctgcctttaacctcaccgacaccgaccgggaggtcttggccatgacagacgaccaattcgttccccacgactgggacaacctcaaagatatcatcggtatgagatccagaccctacctagtacgagatagattgatcaacaagtga

SEQ ID NO: 20110 - DNA, 597 bp, A.fumigatus
ttcgccttttccccgcacacagcaagaaatgatctcggcgctctgaagcggaaaccatccgatctggtccgatacctctcttggtccagagacaccaaggcccaatacggctccatcacaaatttcatctgcaagcgtcgtctgggctggcatttaccggaacccgccggcaccgatgactccagcggcaccgccgtggcagacagcgagccagtcttcccttacaacaatccgatcccctttgccgatccctcggattacaagatcctccgcaacgactggccatacggtcttgcgccgggaattgcgcacttgtgcgtgtggctgcgcacccctgtgcctgtccaggaacacggtggagacctgacggatgagagtcgcaggctgattgaggagtttgtgcgaaggacgtttgtagagcgacttgcgagagaggggtataacaaccctaaggatcatgtgctgtggttcaagaattggacggcactgcagagtgtgaggagtctggaacatatccatgttcttatcagggatgtcccggagagcattctcttcgagtggacgcaggaaccgcctcgcgatgggcttcccaattag

SEQ ID NO: 20111 - DNA, 1713 bp, A.fumigatus
gacattctagcagtcatgtctactcaaaccccgagcacacaggcagcaagccttgcagatgggctgtcaccatcccacacatatgtccctaacagaggatatgtgaacgctgaaggcacaatccccgccatggcggggcaagaccccgaggtgcaagaagtcgaggaggacgaggacgaatactacgatgatatcttcgaggaagagttggatgaggaggactttacatcatcgaatactgcagatcttaccaaagcttacaaccgtcaacgaaaagtgaacgaactagctgcagaccccaatgcgcccaaatggacctacccgaagacgaacacccagaaacccaccgtcaatacatatgcatccgtcgatgatcaggtgaaatccttgactcggcatgcggctaagatcaagctcgaccatgtgcagtctggattggcggttcgaggtgagcgtggtggcgacagggccgaccgagcaacatccgagcaagtgcttgatccacgtacgcgaatgattctgttgcagatgatcaatcggaatatcgttgcagagattcacggctgtttgtcgacgggtaaagaagccaatgtttaccacgccatttggtttcccgacgaggaggagattcaacatcaccgtgccattaaagtctacaagactagcattctggtgttcaaggacagagacaagtacgttaccggtgaattcagattcagacaaggatacagcaaaagcaacaaccgagcgatggttaagttgtgggcggagaaggagatgcggaaccttcgaagaatctacactgccggcatcccctgcccggaaccaattcacctgcggctgcacgttcttgtcatgggattcgtcggtaactccaaaggtctaccagctcctcgtctgaaggatgtcgagttcgacataccagagcctgagacaagatggcgtgaactatacatcgagctcctcggatatatgcgtgtgatgtaccagacatgtcacttggtgcacgctgatttgagcgagtacaacatactttaccacaaaaataagctgtatatcatcgatgtcagccagagcgtggagcacgatcaccctcgcagcttggagttcttgcgtatggatatcaagaacgtgagcgacttttttcgccgaaagggtgtggagacgctctccgaacgtaccgttttcgagttcatcatttccacagacggacctgccaccattgaagcgagcgaggagatgcgtggcgcgattgaaaagctctacacactgaagccagatcaagccgaaactgagcaagacaccgccgttttccgtcagcagttcatccctcagacattagagcaggtctacgactttgagcgtgacgctgaaaaggttcaggcgggtgaaggctcggaccttgtctaccgtgatctccttgcaggagccaaatcatcctcaaagaacatccctgatggggaggatgatcaaggatcagatgccagcggcggtgtttcagtcgcagactctgcatccgacttggaagaggtgccccacggagaagatccgtttgcgaaaaaacaaccgcgtggtaagcggttcgaggataaggactctaaacgcgagcataagcaaagggtcaaggaggaaaagcgtcagcaacgcgcaaacaagatgccgaagcatctcaaaaaacggctcgtctctacttcatccaggaagaagaaatga

SEQ ID NO: 20112 - DNA, 846 bp, A.fumigatus
gctctagagacaatgtggcaccgcgatgtagctagtatcaattatatcgagacgagcacatggacgaggcaggagcataatggtttctcgcatcagaacccgtcgttcatcggcgcagtgctgaaactaaagcccagcgctgctcgggtttatttgccgccggacgcaaataccttcctgacgactcttcaccactgcctgaaatcaaagaattacattaatctcatggttggctcgaagcagccaactccggtatatctgacaccggaagaggcagagagccattgcagagccggcgcatccatatggaggttctgcagcaccgacaacggtctggatccggatgtagtactggtcggaattggcgtcgaggtgatgtttgaagtcattactgcggcagccattctgcgcaagcgttgtcccgagctgcgtgtccgagtcattaatgtgacggatctgatgatcctcgaaaatgaaggcgctcacccgcatgctctcacaacggaggcattcgacaatctgttcacatacgacaaaccaattcacttcaactatcacgggtatgcgacggaactgcagggactgctgtccggacggccccgtctggatcgagtcaccatcaacggatacatggaagagggaagcaccacgacaccgttcgatatgatgcttgtgaacaagacatcacgcttccatgtggcacaggctgcccttcggggagcggcgaggaggaacgagagcgttcggatcaggcaacaagagctctacacggagctgaaccacaacattgcagagacgaagaagtacattatcgagaatcgcaagggtaagtttgcctgcgcttga

SEQ ID NO: 20113 - DNA, 234 bp, A.fumigatus
agaaaaattttcacaatgccaggagaagtcattgatacaccaaatccccaggcattaccttcccatattccggatgtagtggaacagctacaagtgaaattggacctgacgagtctggaacaacctgcctgcgatgctttaattaagttccgtcgagcggcttcatacatcgccgcaggcaagttggctacttatacgtcgtctgctgttcttgctaatgtctctcagcgatga

SEQ ID NO: 20114 - DNA, 273 bp, A.fumigatus
agagacccaactcatgcgctaactttattcccaggccactggggaacatgtcccggactgatcttggtatattcacacttgaactatctcatcaagacgcgggacctcgatatgctttatgtcgtagggccaggacatggcgcgccagccattctagcctctctttggctggaaggctcactggagaaattctatcctgactactcacgaaacgccgaaggtctccgtaacctcatctccacattcagcacgacagccggcttgccaaggtga

SEQ ID NO: 20115 - DNA, 666 bp, A.fumigatus
ggatggacgggacccaagaaactgcacggcaagttcatcgaggggtcattccattcgcaccaggttccgcttcccaaagcgaagaaggacaaggaggaattgcaggccctccatgagtggctgtcgtcgtacggtcccaatgagcttttcaaggaaaacggagatattatcgacgagataaaatctatcattccttccgaggattcgaagaagcttggccaacgcgtggaggcatacaaggcatatgcaccgccaaacctcccggattggagacacttcgccattgacaaaggcagtcaaggaaagtgcaatgagagtaaccgggaagctcatcgacggaggttttccaggttaatcttcacagagtgggacttttcttcgccggacgaactcgagagcaacaagttgagcgcggcattggatcgcacaggcaggaacttccaatgggatcagttctcaaatgctcgaggaggccgtgtcattgaagtgctgagcgagcacatgtgccagggtttcctccaaggatacactttgactggccgcacgggtattttcccttcttatgagagcttcctgggaatcatccacaccatgatggtgcaatacgctaagttcatcaagatggtattgcgctctctggttgcccagtctaaaatgggatgctga

SEQ ID NO: 20116 - DNA, 606 bp, A.fumigatus
caaggaatagcacccaccttcttcacagcgggaatctacgtcctcctcggccgcttcatcacgatcctcggccgcgaatcttccatcatcagcccaaacctctacctctggatctttgtcacctgcgacatcatctcgctcgtcgtgcaagccatcggcggcgggatggcctcggccgcaacgaacgatgtcaacggcgacaccgcgcccggcacgcacattatggtcgcgggcatcgtcttccagatggcctccattaccgtcttcgtcatcctcgctgcggattttgtccggcgcgccctccaccgtcgcctcctgcagtccatgagcggatccattgtgcctctgttcggcgccatgattttctccgttgtgtgtatctatgtgcggagcatctaccggaccatcgagctatccgaaggttggagcgggtatctgattaccacggagcgctactttattgcccttgacggcgcgatgatggttgctgcggttgtggtctttaatgtcttccatcccggctggatgatgcccaccgggaagagcatgcagtttcaacgagaaatttactctgcggatgggttgcctgcgacggagcttcgctag

SEQ ID NO: 20117 - DNA, 594 bp, A.fumigatus
ctcctatatggacctggcgctgacaacgtgcgtagatcatggcacgccattaaatacatcgaccctgctgagtctggtgccgtgctgccaatcctgcacctgaatggattcaagatcagcgagcgcaccatttttggctgcatggatgatagagaattgatttctctcttcactggctatggttaccaggtccgcattgttcaagatctaaatgatatcgacaccgatctccatcgctccatgacctgggccgtcgacgaaattcataaaatacagcaagcagcacggtctggaaagccaatcttgaagccgagatggccgctgctcatcttgcgcactccaaaggtatgtccgctacgtaaagactaccaaagagaatcagtctggctaacgcttgcacctatcactgatagggatggacgggacccaagaaactgcacggcaagttcatcgaggggtcattccattcgcaccaggttccgcttcccaaagcgaagaaggacaaggaggaattgcaggccctccatgagtggctgtcgtcgtacggtcccaatgagcttttcaaggaaaacggagatattatcgacgagataa

SEQ ID NO: 20118 - DNA, 648 bp, A.fumigatus
  unsure (446): Identity of nucleotide sequences at the above locations are unknown.
tccttcgtgagtgcttcactccacgcatttcaaagcatcataactcatcgttgtcagtcttgtgttccattacaccaacgaagctggaaatctaagccccgcgagcacaaaagagatgcatatcagcagggtgggtcattcctctctcagccatcacggacgaagcttatgttgatcgctatccaggcagaggagatccttaacaagcaatccggatggaaggcattgacaggaacaaccgacttctccaggatcgctgttgagaaccccccatcccacgcccacaagcttgctttcgatatcgtcgtggatcgcatccttgggtttgttggaaactacttcgtcaaattggacggtcaagtagacgcgattgtctttgctggcgggatcggcgagaagagcgctcttctgcgcaaagtacttgttgagaaggcctcgtgtctacnagtggccgtggatactgcggcaaatgagaccgggccagcggaggaccaaacggtccttgatatctcgaaagaggccgggaaaagaccccgggtgcttgtctgtcagacagacgagcaggtaagccgtcgtcccttgacctcatgtttgaatgagttactaacacatctgattagtttgagatggcatataattgcattttga

SEQ ID NO: 20119 - DNA, 213 bp, A.fumigatus
cgtgccaatacgagctcttcgcggcctgatctcatgtccgaatccgacggaattgatacctctcctgaaaaaatcatccaagtagtccttttatttgaccacgcaccgtggtatttgaggtctgccatgtacgatgagacacgaatcggtactggtcctgtgaccttgattggcctgaggccgagaggcttgcgacggtctataagtccttag

SEQ ID NO: 20120 - DNA, 420 bp, A.fumigatus
cacttaccaccggctagaagagctcgagaatctagctcctttgtacgtgtgatctttgaaggaattggaaaagagtggctaatgaccctgattactatcagacacaattattctgccctggagatcattcgcacttgcaagcaggaaattcccaacgtcaaaagcgtcacgttctttgactctgccttccaccagacgatgcctgaacatgtgaagacttatcctatcgaccaggggattgccaaggcaaatggtctccgtaaatacgggtttcatggaatcagttattccttcatcctgcggtctgtcgcggaatttctcaaaaagccagtcgaggagaccaatatcattgccatgcatctcggaagtggcgcctcgatgtgtgcgatcaggaatggcaaatcagtagacacgacgtaa

SEQ ID NO: 20121 - DNA, 273 bp, A.fumigatus
accgcgcggatcggtcgccagcacatcgtcctcggcacccaggccgacaaccgcatcaccatctccaactgctacatcgacggtgtcaccgactactcggccacttgcaacggttaccactactggggcatctacctcaacggctccaacgacatggtgaccatgaagggcaactacatctaccacaccaccggccgctcccccaaggtccagggcaacactctgctgcacgctgtacgttccttcccttcatccctaatcacccctaactaa

SEQ ID NO: 20122 - DNA, 366 bp, A.fumigatus
tcacccctaactaatagaggaaatcaggtcaacaactactggtacgacaacgccggccacgcctttgagatcggctccggcgcctacgtcgtcgccgaaggcaacgtcttccagaacgtcaaggccgtcgccgagtcccccatctccggcaagctcttctcctcccccgacgcctccaccaacaaggtctgctcctcttacctgggccacacctgccagatcaacggcttcggaagctccggcgccttcagccaggctgatacggacatcctctcgaagttcaagggcaagaatattgcttccgccgctgcctacaacaccgttgtttccagcgttactgccaatgctggcaacggtaagctgtag

SEQ ID NO: 20123 - DNA, 252 bp, A.fumigatus
ttcggcaggcttctttcccgagccgtcactcccaccctcttcctgctccttctgctgctgctgctgttcccctaccttttcttgctgctctttcttcttcttccccttctccccctcttccgtctctttcttcttctcgttaatcagccatggctggccttccttgatgaactcctccgtcgtgtgcagcacatatcgccaatgcttcggatgcacatccggccgcctcaaatgaaagtcctacaaagataa

SEQ ID NO: 20124 - DNA, 312 bp, A.fumigatus
tctgcgcaaccgcaccaaatgggtgtagaatccattgacacaaactacactgcggacaccaccagagaccacttcaagtccggcaccacattccgcagctacgatgacgatgcgttttcctatactgacacggtcgagctgtccgtggcagtggcaaacccagagagtagagaatggcggccccgagtcaaggattggctcgttctgatctgtatatcgaccttgacgatgctggtcgcatttgatgcgacaatggtcgtaccattcatcccggtaaggcatccaagccaacccagtgaacccccttcttaa

SEQ ID NO: 20125 - DNA, 957 bp, A.fumigatus
tgcatagagtgcctcctgggatccgtcacccagaagacgcaagagttcatcaagcacgacgccgaagaaaaagcgaaggagaaagcaaaatcaacaaaagaggagagcgcggttgcccttaagcgtcacaagttcgttctctatcctttcaagccacgtttatcaaaagctcacctcgatcgcagatggaccgcggtcaaattcctctgcaaacgaccattatcggaagacacgaagtgctacacctttgagctcccatctagagacaagaagctcggcctggaaacaggccagcatcttcagatcggcttccacttccaggaccggcttgtcattcgcccatacacccctacccggcccatcctggagtccgaagaagacggcacattcgaccttgtcgtcaaaacgtacttccccagttctgcacaaccaggcggcacaatgagcaatattcttgactgtcttcaggaaggcgaggaggtcgaagtaaaaggtcccgcaggcgagatccgataccgcgggaacggcgaattccgcgtcgacgacaagacgtatcatttcgatcacatcacattgattctgggaggatcgggcattacaccgggatatcagcttattgcacgaattctgaggacagaacaggggaaaggacccaaggtcagggccatcgatgccaacaagtccgaggaagatatcttgatgcgcggcgaactcgacaagtacgcaacagaaaatgcggaccagttccagatcacgtacgtgctttcgcacccggcggaagactggacgggcgagaaggggcatgtgaacgagaagattcttcataaatatgcctttgagccaggggagaagagtgttgcgcttttgtgtggtccgccggctatgatccagaaagcggtcttgccagtattgaagaaatggggatacgacgaagacaagaatttgtttggtttctag

SEQ ID NO: 20126 - DNA, 1623 bp, A.fumigatus
gactttcatttgaggcggccggatgtgcatccgaagcattggcgatatgtgctgcacacgacggaggagttcatcaaggaaggccagccatggctgattaacgagaagaagaaagagacggaagagggggagaaggggaagaagaagaaagagcagcaagaaaaggtaggggaacagcagcagcagcagaaggagcaggaagagggtgggagtgacggctcgggaaagaagcctgccgaatcaggtcaggaaggaccagatcagggcgacgaggaagactcgaagaaaccaaagtataccccggagcaacaagcactcctggcgtatctgaagcaagaggcggagtatatgcagtcgttgaaatcgaatgacggcaagggccgttcgcctgcgcggagttcctctgtgccaggagagatcgatgaagccgatcaattcaccccagacaactgggttcctcggacggaccacttgatccgattaacaggaaagcatccgctgaatggcgagccagatctggtcgagctcttcgacgcaggtctcatcacccccaattacctacactatgtgcgcagccacggcttagtgccgcacctcctctgggagaaccacaaactggagatttcagccggcaagtcgttgaccttgttgatggacgatttgaaggataggttcgagagcatcaacatccccgccgtgatggcgtgcgacggaaaccggagaaaggagctcaatctgatcaagcgcagcaaagggttcaattggggcccggcggccgtaggttgtgcatattggaagggcgtgctcatgcgagacgtcctgctcatggcagatattctgcagctgatggacgaatacaaggacgtgcctctttgggtgaactttggaggggccgaaattctcagcgaaggaaaatacgaaacctccatccctctggattactgcatggatccatgcaatgatgtgatccttgcctatgagatgaatgactcgcccatacctccggaccatggctacccactgcgcttggtgattcccgggtacgtgggcggacggtgcgtgaagtggctggagaagatctgggtgaccgaccgtgagaatgacacctattaccatatcttcgataaccgggtcgtcccatcctttgtgaccgaccggtttgacgaaatagggcagaccatgtatcgtctcccgagcacggcatgcaacgaacagatgctgaactcggtcattgcgaggccagcgcagggagagaggatagacctcgcggaagtaagaaagggcaggaaatatcgaattatgggctatgcgtataatggaggaggcaacgaggtacaaagggttgaagttagtctcgatggtggagttaactggctgtattgcgttcgcaaggtatgtcgagagccatgtttgcgaccggtcgtgatgctttttgacgcttctgatacggaacagtttcctgaagcaccgctgcgacatggtaagaaattctggacttggttgcactggcatgtggacatcgacatcacgcagctccttcgcgctgagcagatcactgtccgttgctgggatgtgaacaagaacacccagccggaaaatccgacgtggaatctcgaagggtga

SEQ ID NO: 20127 - DNA, 438 bp, A.fumigatus
agtgcctcctgggatccgtcacccagaagacgcaagagttcatcaagcacgacgccgaagaaaaagcgaaggagaaagcaaaatcaacaaaagaggagagcgcggttgcccttaagcgtcacaagttcgttctctatcctttcaagccacgtttatcaaaagctcacctcgatcgcagatggaccgcggtcaaattcctctgcaaacgaccattatcggaagacacgaagtgctacacctttgagctcccatctagagacaagaagctcggcctggaaacaggccagcatcttcagatcggcttccacttccaggaccggcttgtcattcgcccatacacccctacccggcccatcctggagtccgaagaagacggcacattcgaccttgtcgtcaaaacgtacttccccagttctgcacaaccaggcggcacaatga

SEQ ID NO: 20128 - DNA, 801 bp, A.fumigatus
acccccttcttaacgaactgccagagtttatcactcacgttcggagaacccctcagcagcaacctgtggctcaactcatgctatctccttgccagtgccacgggacagatcttcttttcgatgctcgccgaagtcatcgggcccggccctcttctggtcgcagctgctgtcctttcaacagtggggacaggagtatgcagtggctccctccaattatccgagctagtcgccggtcgtttcatacaaggactcggcggagggggcgtggtatctgtttcgctgctctgcctggccgagaacatccccgacaaacacctcatccgcttctcaaactacgtctcccgggtccgcctggcgggcgccatcctcggattagtcatgggtagcttgttgttcgagtacatcgcctggcgcggcgccttctactcaagcttcttcttctgtgcgctcggcatgctcgtcatcccctttgccatcgacctgcgcggccacagggggatctcctcgcagacctttctcaggctggactggctaggcggcgtgctgactctcctgggactgtgctcgctgcttatagggatcagctggggcggaacaagctacgcctggagcgcctggcaggttctgacacccatcactatcggggcatcctcgatgcttgtgctagccgtaaatgaaacgaactgggccgtccgaccgttcttccacaggaacgatttccgcactcttcccgtcctgatgatgtatgccggcagcttcctgcacgggttcacggttaagtctcccacatctccgaactaa

SEQ ID NO: 20129 - DNA, 651 bp, A.fumigatus
acaagaacacccagccggaaaatccgacgtggaatctcgaagggtgagtgtcgagccatgaaagcaaatcgaaggtgtacctcgctgaacacaagcagcatgatgaacaactgccactatgtcgtcaagtcggaaaccttcgtggagccgacgaacaataagccatatctgctgttccgtcaccccgccgaagctgggacgggcgacaacgggtggatgaaaccctcgatcgacatccagaaggaagatatccggcgatcagcagccgttcccgagaagcagttcacccgtgaggagatcgaaaagcacaccacggatgatgactgctggatcattatcaacgataaagtatacgatgcgaccagcgtcctgagctggcatccaggaggaaaagcgcccattatggcccacgccggtcgagttcatcaagacacgtcgaaggaattcgaaagtattcacgacgattatgctgttcggaaattagagggtataccgtccctcttcgcgcccatcggacgtgctaacatagtgcatagagtgcctcctgggatccgtcacccagaagacgcaagagttcatcaagcacgacgccgaagaaaaagcgaaggagaaagcaaaatcaacaaaagaggagagcgcggttgcccttaa

SEQ ID NO: 20130 - DNA, 582 bp, A.fumigatus
agacacgccggaatctccagccactcgcagacagtggagcacgaggagcccgccgagctgcggaagagcctgtttgacgacccggcctcccagcccgaggaatgggagaacgtgttccggacaaacgtgacgcagctgttcttcaccaccacggcgttcctgccgctgctggccaaggggtccgagcaggagcacggctggtccagcacggtaatcaacatctcgtcgatctcggggattgtcaagatctcgcagcatcattttgcgtacaatgcatccaaggcggcggcgatccatctgtccaagatgctggcgcatgagattagctcgtccaaactgaagatccgcgtaaataatatcgccccgggggtgtttcccagtgagatgaccgcgggggagagcgatgagaagcagaaaagctttatccccagggagaagtacgagcagaaggtgccggcgggccggccgggcaaggacgaggatatggcgagtgcggtgctcttcacggccacgaaccagtatctcaatgggcagacgatcgtggtcgacggcggctacgtcttggctgcaggcactgtctaa

SEQ ID NO: 20131 - DNA, 441 bp, A.fumigatus
gaccgcgcggaccattgcggcctgccgccgtgcaggcatccgcttcttcatggtgacaggcgattttggcctgacggcggctgccattgcccgggacgtgggcatcttcactggtaccgcggagccagacacggtcgacgacctgcggctatccaccagcgacgacgaaaacgagaagcaatctctccgctctcgacgcagtctcctcatcaacggcccaagcatttcctccctcagcgacgagcagtgggacgcggtctgccaatacgaagagatcgtcttcgcccgaacctcgcccgaacaaaaataccgcatcgtcgaggagttcaaggcgcgcaacaacgtcgtcgcggtgaccggcgacggcgtcaacgacgctcccgcactgcgcactgcggatgtcggcatcgccgtcgtctccggcagcgacgtcgccattga

SEQ ID NO: 20132 - DNA, 3381 bp, A.fumigatus
accgcaggtccgagtgttcagtctcatacactcttgaacacccttgaaattgctgctcttggcatggctcaatctcctgcttcctccgaacctttgaaacaggatttcaaattgggagttgataaccctaacgagccccctgatggtcgaacgggtcgtgcaacccgcatccaattcgatggtgatgtaccaccggaagagggaagtggaggaatctaccactctcgacttagtcggcatcgttctctgagccgagacaccattcggagctctcacgatgcctcccagagcaacaaggccgccgggataccgatcgagttcaggaccctctcgtttcaaatctccgagtcccagaacgctaccgaagcggccatcaaagcaaggcagggcaaggacaataagcccgatcaagattacttcgaaagcttggactatcacatcctgcagcccgacagactcttccagcaactcaacgtggacccccggtctggtctcagctcgtctgctgccacctctcgactgcagcgggacgggaaaaatgtcatcgctcatcatagcgagaactacctgaagaaaatctttttctatgtctttggtggcttctgctccgttctatggatcggtgtcatcatcttcttcatttgttggaaacccctcagcaacccaccgtccgttccgagtcttgccatggctatcctcgtcctcatcgtgatttttctgcaagcaagcttctctgcatttcaagactggtcaacgaaacatgtcatgaactcgatcctcaacctgctcccatctgaagcccttgttgtgcgagacgggaagcaaatccgcgtgccatccacagaccttgtcgccggcgacattgtccatgtctccattggcaataatatccccgcggacatgcgtctcttccagacatctggagacgtccgcttcgaccgttccattctcaccggagagtcggacgagatcgaaggtgccatcgacgtgactgacgacaacttcttggagacccgtaatatcgctttcatgggcacgagtgtcaccaacggcaatgcggttggtgtagtggtactgactggcagtcgttctgttatgggccgcatcgccaaaatgaccactggcgtcaaggaaaaaccgacattgatccagaaagagattactcgttttgtgaccatcattatctgcctcaccgtcacactggttctgatcatcctcttcacctgggttggttggttgcgtgtggaacattaccagttcatgaacgtggtctcgatgctgaacaacgtaatgggatgtgtcgttgcgttcatccctgaaggtatgcctgttggagtggcactaactctgatgatgatagccacgcggatgaagaagaacaacatattgccaaagggacttgcaacagtagagaccctgggctgtgtcaacgtcatctgctcagacaagacgggcacactgacccagaacaagatgtttgtcaggtccctcggcctgaccgatcaagagctccacatagagaagctgcttggagatcagggaggctcggccgagcggcccgaagcgctgagcatccttcttcggggctcgttcctgtgcaatgacgcctcttttgacccggcgacagttggactgccagtgaatgaccgagaggtgacgggcaatgccaccgatgccgccgtcctacggttcgtcgagctcgcccagcccaacggtctttctcagtatgcgcagtacgagagagtccaccagattccgttcaactcgaagaacaagtggatgcttaccatgcacaaggatccccagcgcaacagcagctatctcacctatgtcaagggcgcaccggatgttcttctaccacggtgcacatcgtactactccggccttgagagcagaatcaaacccatggacgaaaacgcccggagaatgctctcggacttccaaacgtccctgtccaggcgcgcagaacgtgtcattgtgctctgccaacggtactacaccccaagtgccgcagtgggatcaaacgacttcaacgacgaggtcttggcccacggtgtccacgacctgaccgtgattggcatttttggcatcgtcgatctgccccgacctgagaccgcgcggaccattgcggcctgccgccgtgcaggcatccgcttcttcatggtgacaggcgattttggcctgacggcggctgccattgcccgggacgtgggcatcttcactggtaccgcggagccagacacggtcgacgacctgcggctatccaccagcgacgacgaaaacgagaagcaatctctccgctctcgacgcagtctcctcatcaacggcccaagcatttcctccctcagcgacgagcagtgggacgcggtctgccaatacgaagagatcgtcttcgcccgaacctcgcccgaacaaaaataccgcatcgtcgaggagttcaaggcgcgcaacaacgtcgtcgcggtgaccggcgacggcgtcaacgacgctcccgcactgcgcactgcggatgtcggcatcgccgtcgtctccggcagcgacgtcgccattgaggcagccgacctcgtcctgctcgacaagttcgactccatcgttgacgcgatccgcctcggccgcctcgtcttccagaatctgcaaaaggtcatcgcctacctgctccccgcaggcagctggtccgagatctggccggtgctgatgaacgtcttcttcggggtcccgctgcctctcagctccttcctcatgatcatcatctgcgtcttcacggacctcttcctctccctctccctcatcatggaaaaggaagaattcgacctcctcagcctcccgccccgcaaccataagaaagaccacctcatcaacctcaagatctacgcccagtcctacctcttcatcggcgtcatggaaacattcatcgcccactccatgttcttcctgtacatgtacaagaaagccggcatccccttccacgccgtcatcttcgccttcgagtcctactccgacggcttctacggctactccgccgagcagctcgcccacttcaacaacgtcggccagggcgtgtacttcgtcaccctcgtcatgctccaatggggcaacatcctttccgtccgcaacaagcgcctctccatcctcaccgcggacccggtccgcaagcagcgccgcaacccctggctgcccctcgccatgcttgtctccctcgtcatcgccatttttgttaccgaggttccgggcttccataccctgttcggcaccgcccccgtccccattgagttctggttcatcccgttgcccttggccctgggcattctgttcatggatgagttgaggaagctgcttgttcgcgcgttcccgaggggcattattgcgaagatttcgtggtga

SEQ ID NO: 20133 - DNA, 282 bp, A.fumigatus
cggcggctgccattgcccgggacgtgggcatcttcactggtaccgcggagccagacacggtcgacgacctgcggctatccaccagcgacgacgaaaacgagaagcaatctctccgctctcgacgcagtctcctcatcaacggcccaagcatttcctccctcagcgacgagcagtgggacgcggtctgccaatacgaagagatcgtcttcgcccgaacctcgcccgaacaaaaataccgcatcgtcgaggagttcaaggcgcgcaacaacgtcgtcgcggtga

SEQ ID NO: 20134 - DNA, 582 bp, A.fumigatus
tcatcatctgcgtcttcacggacctcttcctctccctctccctcatcatggaaaaggaagaattcgacctcctcagcctcccgccccgcaaccataagaaagaccacctcatcaacctcaagatctacgcccagtcctacctcttcatcggcgtcatggaaacattcatcgcccactccatgttcttcctgtacatgtacaagaaagccggcatccccttccacgccgtcatcttcgccttcgagtcctactccgacggcttctacggctactccgccgagcagctcgcccacttcaacaacgtcggccagggcgtgtacttcgtcaccctcgtcatgctccaatggggcaacatcctttccgtccgcaacaagcgcctctccatcctcaccgcggacccggtccgcaagcagcgccgcaacccctggctgcccctcgccatgcttgtctccctcgtcatcgccatttttgttaccgaggttccgggcttccataccctgttcggcaccgcccccgtccccattgagttctggttcatcccgttgcccttggccctgggcattctgttcatggatgagttga

SEQ ID NO: 20135 - DNA, 915 bp, A.fumigatus
ttattgcttagcgcggctcgttcgaccccctgtggtgaagacagcagcaccaagatcgggtcgggcaaccaacgaagtgtgagcagtactcatacgctaccgatccaatcttccgcaccccatcgttcaaggtcgaattccccgctccgaatggcctctaatctgggttcatctccatccgctcagaccctggctgtgtcgcccgtccacggccgacccccactcaatcggaagagctcgtggcagcgaagccgcaaatccctcaaagagctggaggaggaataccatgactccgatgaggagctgccggatgatatgagtttgtggaacgtccctatttctccgcgcccgttgcaggatcgcgcctcctcccgaggaaccagtccagatggccgaagtccaggcccacgcccgcttccgctgtcgcattctgtctcggacatgtctgttttgtcttctacgggtgcgaaatccccgcggggatctcggccgggccgacagatggtgcgctcaagctccgctggtcctgagcgtggacagatttcacctcgcaatccccgcatttactcatacaacacaatgttgtcggatctttcggaggaggcgaagatcatcactcaagctctggaatatcatgccgacgaacgcgatcgcaaacgtgcagagaacctccagagcgggatctcctcgctacgatccagctccgaatcgaaacgcgactccaaagccacaattgaactgcctcctctgcaaaagtgcaatatcatgatcgatccgttgcccatcagcaaggagaaggaaaaggtcctaacgcgtacgcggcctagctggcttcccccaaaggaccaaaaggaagagaagaggcatttgagggaatacaagaaaatgatggcaatggcgcgcgaagcaggttag

SEQ ID NO: 20136 - DNA, 621 bp, A.fumigatus
ctttgtttacagacgatcgccgctcttctggttcttcagttcccatcgccatcttccgccttccttgccatggccaatgccctgaaccggcctcttcctgtcgcatttctcacgctggaccgcggggccatcggtcgtacgtattcattggcgtctgcgacgctccgctacaagttccctcgcctggcaactcatctctacgagactctgcgtctcagcgacgaggaaatctgggaaccgatgttccgctctctccttacgaatgggctagatttggagcgtgtcagtcgcgtctgggactgctgggtgtttgaaggagatcgtattctgattcgcgccgcagtcgcgattctcggttgcttgcagccgcaattgtttgcatttacgcagccggacgaccagggtcgtgccgctgtgaaggacattctcggatggggccctcaccacaccggaagcaacaaacccgccgcgcgtcacagcgctccggctgcccctatgactggtttcggtggttctcagtccctcaacgccgtggctggtgattactggatactcaccaccgcagggaacgaagatgggttcatgaatgaggtccgagaggcgggtaaggtgcgggattag

SEQ ID NO: 20137 - DNA, 654 bp, A.fumigatus
gcgatgaccttttgcagattctggaagacgaggcggccgaggcggatcgcgtcaacgatggagtcgaacttgtcgagcaggacgaggtcggctgcctcaatggcgacgtcgctgccggagacgacggcgatgccgacatccgcagtgcgcagtgcgggagcgtcgttgacgccgtcgccggtcaccgcgacgacgttgttgcgcgccttgaactcctcgacgatgcggtatttttgttcgggcgaggttcgggcgaagacgatctcttcgtattggcagaccgcgtcccactgctcgtcgctgagggaggaaatgcttgggccgttgatgaggagactgcgtcgagagcggagagattgcttctcgttttcgtcgtcgctggtggatagccgcaggtcgtcgaccgtgtctggctccgcggtaccagtgaagatgcccacgtcccgggcaatggcagccgccgtcaggccaaaatcgcctgtcaccatgaagaagcggatgcctgcacggcggcaggccgcaatggtccgcgcggtctcaggtcggggcagatcgacgatgccaaaaatgccaatcacggtcaggtcgtggacaccgtgggccaagacctcgtcgttgaagtcgtttgatcccactgcggcacttggggtgtag

SEQ ID NO: 20138 - DNA, 510 bp, A.fumigatus
tgttccacacgcaaccaaccaacccaggtgaagaggatgatcagaaccagtgtgacggtgaggcagataatgatggtcacaaaacgagtaatctctttctggatcaatgtcggtttttccttgacgccagtggtcattttggcgatgcggcccataacagaacgactgccagtcagtaccactacaccaaccgcattgccgttggtgacactcgtgcccatgaaagcgatattacgggtctccaagaagttgtcgtcagtcacgtcgatggcaccttcgatctcgtccgactctccggtgagaatggaacggtcgaagcggacgtctccagatgtctggaagagacgcatgtccgcggggatattattgccaatggagacatggacaatgtcgccggcgacaaggtctgtggatggcacgcggatttgcttcccgtctcgcacaacaagggcttcagatgggagcaggttgaggatcgagttcatgacatgtttcgttgaccagtcttga

SEQ ID NO: 20139 - DNA, 951 bp, A.fumigatus
agcttcccgacatctttatccgctgctgggcgcccaagtaactcctgcagtccggaacaacggccactactgctgtcttcttcctccgtctactccagcatctccgcatcactatcaccatcactatccccaccaccctcctcgctagcccaaaagtacggcacctgcatcgagatccttcattatggctcgttcagctccgtgcgtctatacgcccgcaaacccacaaccagtcctacaggtacatcccccaaacaactccacgtggtcaaggtcttccgccgctcctccagcccagccatcataacccaccaccgcttcgagcaatccctctcctcctccctctcccaccccaacatcctccgcaccatcgactccctccttaacgaccgcggcgagctctgcctggtaaccgagtactgcgccgccggcgacctctgcaccctcatcgcgacagctggcgccacgctcacgctctgcgatatcaactgcttcttcaagcagatcatgcgcgcaatcacttacctccacgaccgcggcatcgcacaccgcgatctcaaaccggagaatatcctcctcaccgtccacggggcggtgaaattggctgactttgggagcgcggtgtgtctgccccgtattgatgcctccgactccgatgccgaggccgaaggcggggtggtctcctcatactccccacccaggaaactcctctggacgataccctacattgcgccggaggagctgtgcgaggttcggaggttcgacccgcgggcgggcgatatctgggcttcggggctggtctatatggccatgcagtgtcggcggctgccatggcgcatggcgagcgaagaggaagacggatggtaccgggagtatcttgttgggcggcagggggaggaagggtacgcgcctattgaagggctgggagaggtatgtgccggctttttgtga

SEQ ID NO: 20140 - DNA, 489 bp, A.fumigatus
cggtactcgttattgacccctatagacaagcgcagagctgccaaggccgcttcggccaaatgcgaaaaggataatacgcgggaagctcttaagcgtatatgggatgagtacgtgtttcccaactgggaccgtgctatcggtgaaacccgtacgcgggaattgtggtggcgcggtgtgccgccccgtcatcggggcacgatctggcagcgcgccatcggcaatgaactatccctgtcggaagaaacatacaagaaggccttgcaaagggccaaagacgttcgctccaaatctcacggcgaggcgggcgaaagtcataagcggatgaaggaatggttcgatacaattgagacggacgtgtcgaaagcgtttccggacctgaaactcttccagttgggcggcccactgcgcgatactttgatcgacgtgcttgaggcatactcgatgtatcgaagtgatgtgggatacgtcagtggtcttcatgtaagctga

SEQ ID NO: 20141 - DNA, 1164 bp, A.fumigatus
cgaaagacgtatgtgcaaagtattcttccaagtcctgtccaatcaccacgaaatcttcgcaataatgcccctcgggaacgcgcgaacaagcagcttcctcaactcatccatgaacagaatgcccagggccaagggcaacgggatgaaccagaactcaatggggacgggggcggtgccgaacagggtatggaagcccggaacctcggtaacaaaaatggcgatgacgagggagacaagcatggcgaggggcagccaggggttgcggcgctgcttgcggaccgggtccgcggtgaggatggagaggcgcttgttgcggacggaaaggatgttgccccattggagcatgacgagggtgacgaagtacacgccctggccgacgttgttgaagtgggcgagctgctcggcggagtagccgtagaagccgtcggagtaggactcgaaggcgaagatgacggcgtggaaggggatgccggctttcttgtacatgtacaggaagaacatggagtgggcgatgaatgtttccatgacgccgatgaagaggtaggactgggcgtagatcttgaggttgatgaggtggtctttcttatggttgcggggcgggaggctgaggaggtcgaattcttccttttccatgatgagggagagggagaggaagaggtccgtgaagacgcagatgatgatcatgaggaaggagctgagaggcagcgggaccccgaagaagacgttcatcagcaccggccagatctcggaccagctgcctgcggggagcaggtaggcgatgaccttttgcagattctggaagacgaggcggccgaggcggatcgcgtcaacgatggagtcgaacttgtcgagcaggacgaggtcggctgcctcaatggcgacgtcgctgccggagacgacggcgatgccgacatccgcagtgcgcagtgcgggagcgtcgttgacgccgtcgccggtcaccgcgacgacgttgttgcgcgccttgaactcctcgacgatgcggtatttttgttcgggcgaggttcgggcgaagacgatctcttcgtattggcagaccgcgtcccactgctcgtcgctgagggaggaaatgcttgggccgttgatgaggagactgcgtcgagagcggagagattgcttctcgttttcgtcgtcgctggtggatag

SEQ ID NO: 20142 - DNA, 2037 bp, A.fumigatus
  unsure (1619): Identity of nucleotide sequences at the above locations are unknown.
actccattgtcggggttgcctcctcggatattgttacagtggatagctttgttcctgtgctttccaaacgtcgtaagttctcgtcctcttatcaaaccgatggcctgtagcgttgattggagtacagtcttgaatgtccttctgcctctgcatggtcctcgaaaccggacgatgacggaatccataattcactcgaattttgatatacttcgttacctcgccggtcatcttatcactcaatccaaggcgcctcgcgggtttcgtcctccttcgcccaccaagctcctctccagtctcctaggtgggggacagtcgaaagatgtcaaggacagtggagctataggctcgaaaggccccagttctgctaccctgcttggtgaattcccgaaaatgccgcctccaagagccaatgttactcgatccaatacgctgccctcgatgttccctggaaaggaggaaacccccagcaaaatctccgtggttgggacagctccttccaagggaccagatagtccgttcagcttgttggaacaaacatttacggcctacgcccttgcacttcagtctcgcagcggcaatattgttgggcgaagtctgcgtgcaagggagaatgtcgacaggtcatcagtcaatgagttgtataatgtacttttggaagaccctgggaagattcaagctgcagctgaagtgcctgttgacacattatttgtcgcatttgaaacatttatggcaaatgcgtggaaggaacatatgggcccggtgatagaatccggcgctttgaagctcattcagagccaatttgataccatgtttcctcgcgactttgaggagaatttccgcagatttctcacggagatcagtcctcagaaccggcgtgcgctggcgtctctggtgcggttgctggccgacttgctcgatgcgtctgggaacgacggcgatcgaggtgccctaactgcggccttcgctgagattctgacagtcgaaggagaccccatgcagcacatatctcttctagaccgacttgtggacgattttgacaatctcttcgatgagtttatccccagcggcgcatcgctggatggaatcttaagcagcgatcaaagtaaaccaagtgcgcgagacgcagggtctgttagctcgaatgcgtcctcgttccggaaacgtttcggcttcagcttgcaccgagagagctccaagaatgacggcgaaagcaaggtctcgtcgattctgcggactctcagcaagagcaaaaattctggcgacacggaatccggtacccctcgaggctcgttgctgcgttccaagtcgatcgacgtggacactgggctggcactacacttacgacctggctcacgcgaccgtcccagtgcagcttcatctcaggaacacctgcgacgaccgggtagctcgcaagggcagcccccatctctatcctcaatccgaggtatctcgacgaacggagtagtcaaagttcgaagaaggagaaggagctctttatccgatctgaggcccgggacggcgtccacggacacgtctgctgtatcgcctcgccaggatctgcggcctgccactcctgtaccatcaaccaatcgttccgaaaccgaattggcgacgcctcntacacagcccagaccacagaccagtcatggcacagattctacgaacagaagcacgtcgcccaccaaaagcaactccccttctcgattggcctcgccaagccgacgatcaccgacacgtccagttaccccaagccgcaaagagaacattgacccaactttgagtcgaacgggccgacctccaagaaagaaaagtgaccttgctgtttctcccactcaggagcaaaagagaagattgcgggcactcagcataccatcatctcgaaatgttgggctcaaggaacgcccagtgctggttaacggatctgaccccaggcgcctgcaaactctgatctcgtcgcaaagaaccccgaagctgcgcatgcagagcccccaaaaggtatgcttccccgactttcctctgctgccaggccgactataa

SEQ ID NO: 20143 - DNA, 300 bp, A.fumigatus
acaaaggtggatgccggagagagagagagaagtagttggttgttcttggcatcggcggacgatatattttgggtcgctgtgcgagcgctgacgacctctacccttagccttattatcagagaacacatcaatttcactaggcttttgcaatcgttaatctcattgatcgagtacatggtgttctacacgtctcgggtgggctattcccacatcaagcctacaacagcccgccagaaggaggccacgcagggaaagacggatcccacaactcccggtgtgcagtatggacatagagaatag

SEQ ID NO: 20144 - DNA, 414 bp, A.fumigatus
tttgttttcactcgttgcgcgctaattcctccttccttgaaattgcccgctatggcgaccgtgtcgagcgccgtgtccaacctgcctctggagcagctcaccctctaccaggcctccgatccctatctgtattcgatcttcgtcttctacggtcccgttacaacagcaaatgccaccgtcagcagttcgcgcatccaggcgcatatcctgacccccgccggttttcagagctattctcgggatcaccgtctcccccgcggacccgttatatgcagccgtcaaacacctcccccgcgagagacaaggcgacgagatttgtcgtggtcttgctgtcagcatgttgaaatattttgccgagttgtccgaaccggccaaggaatgcttggaaacaatggctcgtgcggggaagcctga

SEQ ID NO: 20145 - DNA, 657 bp, A.fumigatus
gacgtagggaatgcggtgttgatggcaggttgcgaggagggaggccttggggaaggcgaggaggggccggcagaggagaatgccaccggtggccatggggaagcctggctgtttgccctcgtctttgccctgcacttgcgatgtggtcgtgctcccagaacgagcacagggtgcgcctgcgctgttgtcgcgagggcggaggatcaccatcgagccactctccgagacgccgtagagaccatgacactctggaatccgggcgatgggcgggatcccggccaagccagcacctcaggcaccggtacacagcctccagagggtggtctcgacattgtcatcctggtggtggcccatgaggagggcgctgatgcgtctgtctcggcaggctatgccgagagcctgaaagcgcagacgtcgggcatgggtttcgaacgcggagacgctgctgccctgtggccattcgagcgcgagaatttgtgcttgcaagcctgtgtggctgttagtccctggcgagttgacaagatcgtcatctggcttacccatgtcactcagccatgtagctacagtgcgggcttccccgctgctctcctaccgggctttggggtcaacgacaaaggctgtcacggtcaacccgtctacgaggttctgttcttgtag

SEQ ID NO: 20146 - DNA, 1695 bp, A.fumigatus
tctttggagatagaggacaaccatgatctacaatatggccaatatacgggtctcatccgagcactcggagcgccaatgttcctaccgacatcaagactgaaacgagcgccctcccaaccgaccaatctcagcaaatctaggatcttcaccagaagtcagaaggagtctctgcgtctgactatgtgcgagcttgttgacactgaagagcggtatgtgagcaagttatacaaccttgtgcgcgaggtagccgaagaattccgattgaaggcacaaggcagaggagcgtccagcaccagtccagacgaagcctctctggccgctcttttccctccctgtctcaatgaaatactcgacgtcaacctggggtttttggaagtgattcgtaacgtcctggaggaaacggaaagggatgcgattgccgatattggagacgatactgagcttccgtcgtccatgtcgcatagaacggcgtcaagggacggaaaggacccgattggtgccgtcgcatttgcgaatgcgcttctcgaatggtttccgcagttctcacaaccctacgcggactacatgcgagctcatacaggctttacacagacactcaactcatttatgagagataagaactcgagcttttctaagagagttgttgagaccggagagcaacgattacgctcattgctgatggagcctgttcagcgcctacctcgctacagccttctgattgacaccatgaccagcagtcttcccctgatccaccctgccgtcaggcccctcctgaaggctcgtgatatcatcaaggatatatgctctctcgacgacccctcatccacgaatcacgaccagagcttccgacgattaaaagagctagtggatggttggccggcaacgatactgccagtcggccgcttgatcactgccgtcgacttcaacgagttgtcacctccataccacatcgatccttcatctccaaaccagaatcagggcatcatgttgatctataagaactgccttgttctcctagcgaaggctctaggaagcagaacaactgcacgcggtttacttgcagatctcgacggcgccgcgtcaggacccgggggcccctctgccctgcaaagctcaggtgagattaaggtcgcgcaagtatacgacctacaaaccgtacgctcaatgcagtcgacctgcgggagaattctcttcctcgctcctacctcggccaaagcgagaccagatcagaataccacagtggatctgtttgctctggaattagctgggatgtatgaggggcgagcgagtcggcttatcgaagaaatggcgaaggcgaaaattgaaggccggttttctgagagcgagcgggagaacggtaaatggaccctgaggagccccacggggactgtcgggaacctaggcattctggcctgtgttctcgaagaaggactggacaatgtcttgggtcggagcggcctgtccaagattcgaattgtcttcgacaccccgaggtctatttccaccaaggcattgaacacgtcagatttggaggtggtcatctctgtttcctctacaagtgaggattcttatcgtgtcgacatagactccattgtcggggttgcctcctcggatattgttacagtggatagctttgttcctgtgctttccaaacgtcgtaagttctcgtcctcttatcaaaccgatggcctgtag

SEQ ID NO: 20147 - DNA, 363 bp, A.fumigatus
  unsure (213): Identity of nucleotide sequences at the above locations are unknown.
ctcgcaagggcagcccccatctctatcctcaatccgaggtatctcgacgaacggagtagtcaaagttcgaagaaggagaaggagctctttatccgatctgaggcccgggacggcgtccacggacacgtctgctgtatcgcctcgccaggatctgcggcctgccactcctgtaccatcaaccaatcgttccgaaaccgaattggcgacgcctcntacacagcccagaccacagaccagtcatggcacagattctacgaacagaagcacgtcgcccaccaaaagcaactccccttctcgattggcctcgccaagccgacgatcaccgacacgtccagttaccccaagccgcaaagagaacattga

SEQ ID NO: 20148 - DNA, 528 bp, A.fumigatus
caatctacccattctaggtcggttccaaacggtaacggtgtcaacaattctcgtctgaatgcgaaccgtatgctgcgtgcgaagaagattctcgcttacgtggcggaaagaatcgacccttcatactccgaagacccgcaggaaggcgcactgaagccggaagagtatctggagctctactgccagaagatggtgtgtaccgcgtcgacgcaagacgacctcgtatcgtttgctaacttgaaccagctcatcccacccaatatgactctggcgaccatccgtgctcatatctggcgatcatcaggcgatatggttctatactacagagccaacggaaagaaagagataccaatgcccgggtcaggtagagaaggcgaccaaggcagtcagtcggccgacgcaacaaatacgccacatctgtcggagacagcaggcatggcgaacggggatggaggaagtgctcagcccagcagcgtccattctcagtcagcgtctggatctgcttcggtgtctatccaaaactcgtga

SEQ ID NO: 20149 - DNA, 444 bp, A.fumigatus
tcgaagacgccatcgcccactccaacaatctactatcgcaatgccgcctcctacacttcaacccgagcacagggacaatgcgcatccgattccccagcctacagcagcagcagaagcagcagcaattcccactgcccacccgcagccctcacttccaaacccaggtccaatccctcagcctgcgccgcatcacagaactcatctccccgcacccgtacaaccacttccccctacctagcttcgagaagtttaccacagaactcttcccctcctctccctcatccccaccaacggaccgcctcccttttacactgggtggcatcatgttccatcctttccaacccacctccacctctgcacccgatcaaacgaacaacatcagagacgaaaatacatggctcctcacccgccaaccatacatgcgcaaccgcgccccctcaatga

SEQ ID NO: 20150 - DNA, 714 bp, A.fumigatus
caatgtcgagaccaccctctggaggctgtgtaccggtgcctgaggtgctggcttggccgggatcccgcccatcgcccggattccagagtgtcatggtctctacggcgtctcggagagtggctcgatggtgatcctccgccctcgcgacaacagcgcaggcgcaccctgtgctcgttctgggagcacgaccacatcgcaagtgcagggcaaagacgagggcaaacagccaggcttccccatggccaccggtggcattctcctctgccggcccctcctcgccttccccaaggcctccctcctcgcaacctgccatcaacaccgcattccctacgtctcagacccgacaaacttcgatccaaccctcacgccgcgcaacgcgatccgcagcctcgtgtctccgacttttccgccacgcctgccgcgcgccctccaggccgcgtccatcctctctctgatcaaatcaagccacgccctaatcgaagacgccatcgcccactccaacaatctactatcgcaatgccgcctcctacacttcaacccgagcacagggacaatgcgcatccgattccccagcctacagcagcagcagaagcagcagcaattcccactgcccacccgcagccctcacttccaaacccaggtccaatccctcagcctgcgccgcatcacagaactcatctccccgcacccgtacaaccacttccccctacctag

SEQ ID NO: 20151 - DNA, 243 bp, A.fumigatus
agaaaaaagagagaacgaaagacaatatgtcaagaaagagggacaacaacaacagttacacgggtactgcgatgcgaccaaattaaaggcgggaggatttattatgttaaacgacacaaggaaagaaaggaaagtaaggtaaagaagaagaagaagaagaagaagaagaagaagaagaagaagaagaagaagaagaagaagaagaagaagaagaagaagaagaagaagcaaatgaacgaatga

SEQ ID NO: 20152 - DNA, 933 bp, A.fumigatus
tcgagcgtcaccgcaccagtggacattccatcaccgaatgcaaagaatctaggaatccagattccgtatgatccatcgtctctgtccatgcgccctggaaatgaatcgtttggaagccatacggcgcctggttttggaatccatctggccaccactccaggttttctgacgtcttccatgctcaatacttccaacaatcactttggcacctcgccgggtgatgtcggtgaccatctggcgtcccctcatcccgacgtggtaaggaattccatgtccgacaaatccgattatttctcgtccccgagacaacaaggctcaaatgcggtggatgcgacgacccctggagatcctactccaactgctctgccccaatcacccgccgagcctgataaagaggagaggaagagaactggatcgatctttgggaagaaattccggatggaattccccaagaagttgggtaggacgtcctcagaggtcaagcctcaagttccaggaggaaaaggcaaaggagcccccaaggaaccttggccagtcaaagaagaaaaagttttcataaaccatctgggcggtttcaacgagagaattcgtcatgaatccgatgaattcctcgcgccgaacccggacaagaggttcgtgtcagccatcacgccaagtccgaataacgagaccccaatgctagatatcccacctcgtactgccgttatcattcaggaggaatcgggagataccgctgtggcctcggatctctacagaggcagtgttggtagcattggccaggaagttgaccggcttgagaagtccatacccatgtggctggctgaactactcttaaaggtgagatttcttcagcctttcgaatttgaactatggctaactcttggcagaaccaagtccctgccaaggaacccgtcaaaatcgcctttatgctga

SEQ ID NO: 20153 - DNA, 297 bp, A.fumigatus
gagagcagcggggaagcccgcactgtagctacatggctgagtgacatgggtaagccagatgacgatcttgtcaactcgccagggactaacagccacacaggcttgcaagcacaaattctcgcgctcgaatggccacagggcagcagcgtctccgcgttcgaaacccatgcccgacgtctgcgctttcaggctctcggcatagcctgccgagacagacgcatcagcgccctcctcatgggccaccaccaggatgacaatgtcgagaccaccctctggaggctgtgtaccggtgcctga

SEQ ID NO: 20154 - DNA, 1413 bp, A.fumigatus
ggtgctggcttggccgggatcccgcccatcgcccggattccagagtgtcatggtctctacggcgtctcggagagtggctcgatggtgatcctccgccctcgcgacaacagcgcaggcgcaccctgtgctcgttctgggagcacgaccacatcgcaagtgcagggcaaagacgagggcaaacagccaggcttccccatggccaccggtggcattctcctctgccggcccctcctcgccttccccaaggcctccctcctcgcaacctgccatcaacaccgcattccctacgtctcagacccgacaaacttcgatccaaccctcacgccgcgcaacgcgatccgcagcctcgtgtctccgacttttccgccacgcctgccgcgcgccctccaggccgcgtccatcctctctctgatcaaatcaagccacgccctaatcgaagacgccatcgcccactccaacaatctactatcgcaatgccgcctcctacacttcaacccgagcacagggacaatgcgcatccgattccccagcctacagcagcagcagaagcagcagcaattcccactgcccacccgcagccctcacttccaaacccaggtccaatccctcagcctgcgccgcatcacagaactcatctccccgcacccgtacaaccacttccccctacctagcttcgagaagtttaccacagaactcttcccctcctctccctcatccccaccaacggaccgcctcccttttacactgggtggcatcatgttccatcctttccaacccacctccacctctgcacccgatcaaacgaacaacatcagagacgaaaatacatggctcctcacccgccaaccatacatgcgcaaccgcgccccctcaatgaccctcgacctccccagcccggaatcagaggacttctactcgccctggaaactatgggataatcgatactgggtgcgcgccgcagtggtcccggacaagggaggagtagactccgacatgtgtgcacattacacgcagtccgagctcgatgaggttcgtcggtgctttgatgcgcaagggttgtcgctggttgtgcggccgctgcggcagtccgattcgcaggccattcgggccatgattgatggacagggtcgtgggaagaagcagcaccaccccgctttggcagtggcgctgaagcgcctcgcactcgaggcgccagggcaagctcgcttcaccgttcctttgctggttgttcaaaagatctctggtggcaatgcagaacaattgccgctggcgcttcctacactctcttgcagattactttccgcttctcaggcgcaaaggctacttgaaagttcagtaccttggaccgtccgctggcaatggatgtacaagatgattgaccatgattctctcaaattgatgggttggttatga

SEQ ID NO: 20155 - DNA, 822 bp, A.fumigatus
cggagttgtagcagggaaggatcattggacaacagcgatctctgtcgggaatgcggtggccgaggacagttgctctgttgcgatggctgcgtgaactccttccacttttcatgcctcgaaccccccttggatcccgccaatcctccggagggagattggttctgtcccaaatgttccgtctcacggcccatccgtaagatggtggataagcttgacagactagcgaacaaagagtttatgctacccgccagtatccgaaatcacttcgctggggtcaaaactggatctcgacctgaagataaaaatgatcgtacaaggtacaccgaatgttcttacaatcttgtcaacggagtcggacgaggagtatgcaatggtttttacgacgatccaaacctacgcaagatcacggactcggatgggaatctcatcatctgttacgcctgcggccgcccaagcgacggagacaaacctatcctacaatgtgacttttgtcatttgaattggcatatggattgtttggaccctcccatggccaaaccgccccaacaagagaacaaatccgataaacgttggcgctgtccgatgcacgttgaacatgagatgtattattaccactggaatgacgagggagcctatgacgcgcgaaagatccgtcgacctgcgcgaccacggatgattgacatcgagattcttcccagcgaagaggaatcggaacgaattgaaaatgaagaagatgtaggaggaggcatcctttaccgcgtctccgaaaaaggggtagaagcggctttccttgcgaaagtcaaacggtcagtcatcctttga

SEQ ID NO: 20156 - DNA, 525 bp, A.fumigatus
aatccctttctgagcttggctgactatctggacagggaaaatgccgagtttgagtacaacaagcagcaagcagataagtacttcgaagaagctagagcgcagcgcgatgaacttcatgcacgagccgtcgaattctatgccgcccagcaacctcgtcccttgccggatgccgcagaagcgattgacaactcgcgatcagcagccgatcgtgaagctgccaagaatcttcttgctttcgccgctcagaatcagacagagcctgcggacgacaattctcggattactttcctcatcgacgcgctgcgagctcaggcacctaatgatctccccgaagcacatactgaaatcgaatctctgcgtaacctgcagcagctgattgaacgacgtattcaagcgttgagttctcagactgagcttgaagctactactgcccaggtctccgaggccgccagttcgccttttccaaattttgcgatcgagcacggctccaatatggatgagccggtcgaggcaacttctgcttag

SEQ ID NO: 20157 - DNA, 648 bp, A.fumigatus
agcacactaatgccgttcttgaagtcaccgtggatgataagctttgcttctcaacgaacaaggtacttcaaactcctctgccatctattttggtggtctaaccacgtgcaggtcggccttcctactggtaacaacttcggcataacggcagccactcctgagaatccagactccttcgagatcttcaagttcgtcgtgcaacctaccgcttccggaacgaacgcagcacctcctgctcagccgcaagccaaccaacaaccgattgtcaaccaaggacaggctcgtccagtggacccccgctcagtcaactctgaccaactcgccgatctcagcagccgtcttcaaaggctcaatgacgccactaacagcattgcccgcgacgccagcagccagtcctctaaagcggaaaatcgccatgtagagcttcttcagaagatggctaccaaggagcaggtggccaatcttgacgcccggttgcagaagatcgagctgctgctgcagaatattcaacgtgacctggaaggcaaagactaccgcgaccgcttcaatcagctgcacgagaacctgaggtcgtcgcacatgagcctagctgagaatctgcaaaacacaattctcaatggtaagaattcgatgcgtatccctccatag

SEQ ID NO: 20158 - DNA, 2100 bp, A.fumigatus
gggtaccgatcacaaataaaagagaatacaaacggcaatcgctgccctctcctattggtcgtactgcgaagcgacctggacgcccacgccatggctcatcgacaacaaggactgtcgcgcaccttgccgaagaacttcaccttcaattccacaggcaccgaagagcctcggacgcctgaacatgcatccatccatgtggacggaccacctccacctcctcgccattcgagttgccgcttacgaagatcgcgcattcgctcggggaccgacctcgtcgcgcaggtagagtacgatcgcaccacgcttaccgccaacccatcggacatcccgctgccttcgatcgagttacctccgtcgtatgacgcttctatagctcagtcataccctggatccattgccaaagatgatcgcttcctggcgcctccgcgtgatcgaatggctctgaagacacccccggcccagatccgtggcagcccgtccgaacttaccgacggatggccttcgtgggactctcaagctatcggacagtcgctgcagcgccctgggtctgcctgttcccaggcatctgactcctcaatttcttcatgtgaaacgttcgcctcgcgccgttccgttggtggaagttgcaccagcgcagaaagtgacagttatgacccctttttctatctcgagattccgccgaagcagctggcggaaaagccatccgtggctacggccaaccacaagaaaacgaatcgcggctttcccaagagagaacggtggactttggatatggacaaccacctctggaatacttatcagctatacatacaagatccgaccatcacccctttcaaaatgacgcctggtagtatccccccgctcggtgttacacaccgggttgctagagaggccaagagatcttgggaaaggaagcgatacaggcttgcacgacctttcacattttccgtgcaccaaccgcaacaaccacagagcggcgaaacaacacccacaccacgaacagaatctccaaagaatgcctggcccaaaactgaggcctcgactaggcgtcgtctgaagcttctttgcaagcgcaaattctccattgcgcctcattaccagaggctcatgcaatcccgcagcccgtctccgttcctagatctgttctcgcagccttcgcacgaggagcaccctctagacagccctggcaacagctcaactacttatgctactcgtgatctaggtgtttccctggtctccagctcagtgcctggacctctttcgcagcttgcagtcgaggaccgttctccgcaaaatccagcgtacgactggccgcggaatcagacagtgccgcaggccagctgggaagaaccacttgcgagaacaacacagcttcaggcggaacatccggggtccatcccgcgccttgggtctccattcacataccacacctggggcccgaccagttcaagaaagaaaaattccaggcatacacccaggaccaggcgagagacaatacacgtgaccgggtcccggttgtgctctcctccatgcacagaagtcttaccagctaccgatgacagcaacattgtctattctgtgccaaggcccactgaagcgtcgccaggtcacgagaaccaggaccatctggagactctgatccgggatggcaagttgagtgacattggtaatcgtcgcctgcggatccgaagtcgtggagcaacaacaagctccatcgctcctcaaaacctggaccagctcttctctccaccctcttctgcgtcccgaaacgaggcatcaaccacgtttgttgagaaagccctgcccaacccgctattgaacctgagcggggagaacctcaagcgccttggctctcctttcaaggtggatgcatcgaaacgccacgagggacgcagaatccgacacaaaccctctttgtctgacccttttgcaagcggactcttgccccaagtcagacccgtcaatcaaagtgctacgcttaaggaccaacagaacatgaccggtgcactgccgtatgacccaactgagaagggcatatccgatgcggaaagaatccgcagacagatcttgaatatgtcctattcaaggcgacaatgctga

SEQ ID NO: 20159 - DNA, 288 bp, A.fumigatus
tatgttacagaaacaaagaaggtgcaacaattgtctcgcggcgagaactccccagttgaaggtgtcgagttcagttggctcaagtttgatgcttcaatgttcgcggaggcggagaatcctagtttgacgtgtgctacgaagtactgcgacgtgacattcgagtgccattgcgtactcaatttatcaatattccgtcaatatgttataggctatcaaatgtctccagaggcacgaacatctatacgcccttcattatttcattggagacttcgtctagtaaatttgtag

SEQ ID NO: 20160 - DNA, 561 bp, A.fumigatus
ttggtggcatgtaccgaatctcggtttacgttttcatgtattcagtcaaatccaaatctatctgtctcagaaacgatgcaagcaaaacaacttccagatcatcatgtaagggaagcggtaaatccacgaaccggacggcgagagcgtgttttcgtcaatcttgaggccgtatatcctgattataaggatccaaccaaagaggtcagctttgaagaactccgtgccatgcaccgtggatggatggataaagactggcgcccgcaaatggcaccttttaagaagatacctggcaatatcgctggttcagagagaccggcgggaaatgtgatcgagcaaagtctggaccagggattatcagagcagtttagtcaaaaattgaaagtgaaagatgcaggctcacaagggacgcagcgggcgattgaagatggattgaacgagagcaaagctaacaaagcacggaaaataaaactacgcgaagtcaaaggcgagacacaaacaagtaagcaatatcttgtgattgcagtctcatttcccaattctgaattcctcactaaccgttga

SEQ ID NO: 20161 - DNA, 663 bp, A.fumigatus
ttcgcttcgacgataagcctactgcaccctctttggtcgacttggaagaagagatcaccgacccacgcgagatctactactccccccgtggactgtgcggctgggcgcaacaagggcctgtcgctcatcgatttcgcccgcggtattgacatgcgagcgttccagccttccgtccaatttattgccgactgggagaccggcgaacatgaatgtaacgagatccgcgagatgcggccctggacgcaccagatcgatctgtacggcatcgcgggaaccgtgcacgtcatgcttttcggcaaatacatcgagtcgacgccggtccggaagagtgaaggcggcacggtgtccgtgcggacgtaccgcatccgcgagtcgctgaaacggtactgggaccgcgagatctggaccgacgttttcgacctgttactcaacccgtgcaccgagcgctgggcgcgcatggagctcgacgccgcgggcccggatcaggatctccgcggcgctgggaaccaaataatcctccctgtcactcattccatgcggtatgtgcgagagaagatggaagcttggctgcttgcgaatgcagagaagaaaggccttggtctgcaaattcggaagctggaggctgtctttgccgagaagaagaagaaactggaacggagctga

SEQ ID NO: 20162 - DNA, 1314 bp, A.fumigatus
cgataccgtgttgccctcgacaaatcatttcacgactcaccaacagactatccctttggaccgcacgcttgtttatctgtcgccgccatggcggcctccgaggatctcatcaattttgatatcatcgagaatcaaaaggagaacattcaatcattaccaggaggacgctcagccaaggagcttgctcgcatcttctcacccagggactctagtgacaaactcgcggctccatcaccaaacgaaaccaggaccttgaatgatgccattcgacaggagtatgaggcagaactgcaggctattgacgactccgatgacccgcttgatatatatgaccgctacgtgaaatggacactgaacgcttacccctctgcacaagccaccgccgagtccggtcttcttcctctactagaacgcgccgtcagggcattcctctcctcggcccactacaagaatgatccccgctatctgcggctatggcttcactacattaggctcttttcagactctccacgcgagacttttgcgtttctggcgcgccaccatattggtgaagggctagcgcttttttatgaagagttcgccgcttggcttgaaggcgctggacgctggacgcaagctgaggaagtgtatagactcggtattgaccgtgaagctcgaccaactgaacgattgatccgcaaatacaccgagttccagaagcgctacgagcagcgcacacaggaccatggaccatcatcacccgctttgcccgcggtgcgaccagcactggctgccaaggtcgatccgttttctttgtctgcagcagccccggttgccgatccgcaagctcaacgacccgctcctgccgctgcggctgccccgcggacgaagtctgggaagcccaagatgactattttctcggacgctgactcggcagcaagccagcccgctatatcaggacagaccaagggatgggatagcattggctcaatgcgcgagagacgtaaggagaacagtgtggaggcgaagccgtgggtcggggagaccttgaaggcgggaaagaaggctgctccgaaggagaagatgccaatctttagggatgaggtgagtccatgttcactgtgctgtcaccctttcttgaaatttcatatatttacgatcacaggactaattggtggcatgtaccgaatctcggtttacgttttcatgtattcagtcaaatccaaatctatctgtctcagaaacgatgcaagcaaaacaacttccagatcatcatgtaagggaagcggtaaatccacgaaccggacggcgagagcgtgttttcgtcaatcttga

SEQ ID NO: 20163 - DNA, 1743 bp, A.fumigatus
ccgttgacaaactgtccagtcaaaatgaagttcgactctccgacaggaggcaagattcggcgcaagagcacggctgagccgacaatgacaatccatactcgcgctgctaccgacgagatctacagcatcttcaaccagccactcaaagcagagacagaaaatgtagcagatagtagtgactttgaggatgacgactacacaagtgctggtgagagcacatgcactggtcgcatctccatcacctccagtgacttttgtgacgatgagaccactaccttccacagatctgatgatgaggctgaggaggaggactttgaagaccacacgcacgccgagagcgttgttgacggtgaatggactcagttctcctctaaagaggacccaacgcattcactgggagtggatcccatctcaccccatgggaacacattggacgctgcagagacaagcaggagagaaaggtttgtgcctgagatgccagaggactataatccaccttatggtccatatcgagatcctgcagtagtcgcgcaaaatcgtcttccttttatgacaccgatcgtggagcaaaccgagcactctctcccttcgatgacggcagctcgaaacgccctgtacaacaccaaaaccccatccaaaccgcagatgggaaacttctttaccactccgctgattggtgcaacaccgcagcaaactgagaatctcactgtgttcactgaggatgtcgcgatgagtccaacagtgaagaaagcccggtccggtcttaagatactgtcgcccttgaaggaacaacaacaacaacaacaccgggttattatcaatgattcacagtgtaatcccacagacaggagcattcgcgagagcattcttcaagccgtggatccgccgcttgcatcctaccctgggtaccattgtcaccctgaagtggaaagccactatgcgcctgcgatccagaagtttgtcaaaaggcatgtcaagcgtcctcgaagcggtgacgaagcgtccttcgatgtaccaattctcgaactacccggcgcacagagatgttacatcatcaggcgagaacttggagccggagcctatgcgccagtgtaccttgcagaaagtgtcgatagcctcgagaactacccgtcctccgattcggaagccgaacccgcagatgatgacagtccagattcccaattcacgaatggaaagaaagcggtaacccgcagtagctcccgttatggcttcgaggcgatcaaactggaagttggccctccgaacgcatgggaattttacatgattcggatcgctcacgaacgcataagtcaactaccagagctatcccgtgcgacagacagtatcatccgcgcccacgagcttcacgtgtacaaaagggaaaccattctagtagaagattaccacgggcagggaacgctcttggatctggttaatcatatgcgcaacgagtcaatcaaggccaatggcaccggagagggtggtttggacgaggcgctcgccatgttcttcactgtggaactattccggaccgttgaggcccttcattcgtgcggcatcttgcacggcgatatcaaagccgacaactgtctaattcgcttcgacgataagcctactgcaccctctttggtcgacttggaagaagagatcaccgacccacgcgagatctactactccccccgtggactgtgcggctgggcgcaacaagggcctgtcgctcatcgatttcgcccgcggtattga

SEQ ID NO: 20164 - DNA, 369 bp, A.fumigatus
gaccgccgagcggtgtttccggccgcaatggcctcctctcagtcgttcgccaaacctttccagaagatcctggacccgactaagatcggaacctggaatgtcgtccgtcgtccaccgatcgaaaatcacagtgttattcagggaaagcctcgggaacaaaactcgaatgccttcaagacacatcagtggaaggagggagtgcggttaagaaaggcgctcaatgccatcacccacggcaagaatatctttgtctaccacaacatccgcactaaccaggtggtatactcattgacaagatatctggaggtgcgtactgccatcgtccatccgtcacagtctgtctttctaatatgtttcgtgcaaatgtag

SEQ ID NO: 20165 - DNA, 756 bp, A.fumigatus
aaaaacaatgtcctccgccaactcatttaccacggcaaaaagactgttcccgccacccttcgaaaagacatgtgggtgccgtactactcagtgcactttaccgactccaaggtcggtctgcgagcgtaccacctcctccgcgaattctccatgcagcgccagctcgctccgccccgcgaaatgatcaccatcaccgaacaattcctcgcccagaagcggccccgcaacccggaagaggcgaaaaaattcgacgagaagtacgccaataaggtcggctggctgatggagaagaaagaccgggctcgcgcggtcatggatcaaaaggctaccagcgttgcggatatcgccgccgtgctctccatccaggaggatgagatcgcgaatgggtttgcggatggcaagaggggatatctgactccagctgctcggagacgaagaagggaggcgaggaagaaggaacacgagaagtctgccgagcaggccgagcgtgtggctgctttcgcgcagaccctgagcacaccggaggtcgactactcgatcgaggaccctaacgaggatgcggagctcctgggagacaacggggtcaagatcctctgggctgatattcacgacgctcgctttgcggagaaatggcctgatcgtgtctggcatggcgagttggatctgagccgcgaccatgttatgcccggtgagaagcaaatccctggcaagaaggatttgctggcgagcggtcagttcaaagagaagcaggcttag

SEQ ID NO: 20166 - DNA, 1299 bp, A.fumigatus
ataacttgcaggatccagggttcgtcgatgcggtcagagcctggtcacgtctgcgatttgttcgtgcaggttggcttaccgtcgaggaatccatggcatacgtggcatagtaagtgctcaactttcttgtcttgccctttgaatgcttctattctgacagattatagctattatgaacatcttgctccgttgagccctatcgtcattccggacttttcacagccttcaactcatcgcactcttctcactgatgagcctgtactggctgtcactattcttacgaccgcatcacgacatatgaaacccaagggtgatggagcatatacccggtcattctacattcatgatcgactctggtcttatctccgggggatgattgagcgtcttttctggggccaagagaagtttggcggaaatggcattggaatcagcaagcctcggtcatttgacctggccccgagcgcagccaaagtgagtctcaaagggaacttgagatccctgggcagtatcgaggcgctcttgatcctcacggactggcaccctagaaacttacacttcccccctggtgatgatgaaaatacactcttggacttggacgcgcacactcaagctcgccttgaaaaggatgtcgagcatgatggtgagccaacgcaccatcggtcttctcagacctcaggcgaggggaggctcgccttccagaagtggttggagcctgcttggcggtctgatcgaatgtcctggatgctgttgagcaccgcacaagccttggcttttgagctgggagtctttgatcagaagagcgaagcaaagactgcgaacgactctcctgccgaacagacacgaaaacgtcgactccggcgtctaattctcgtttacatcacgcaaagcagtggccgtctgggaattccttctatgcttccattgccacagtggactaatgacatccaaccaactcctgcgtcaacttcaaaaggtggtgataccaatattgatcggatgcatgactgctggattgggatcaccaagattatgtatcagagcaatcagctgttgttcgcttctaatgaacagacatcggaactgattaggagtgggcgatatcgtgaccagattgaccgatttcagccttttctaagagaatggcggaataacatcgacacgattgaccgtaagtacagtgtaccggatctgctcttgacatatgctgactatttagtcgcgcctgccatgcggcacatcttgatgattgaatacgaatatacccgtaagtggcttcttatttttgactgtagattgtga

SEQ ID NO: 20167 - DNA, 1776 bp, A.fumigatus
aaccgcaagctccgacatttacaaggcatatcgatccgcaacctcgtcatcacgccccccctgagcaggcctcgtgggaagaccattgacgatgaggagatccccaattctctgcaatctccttccaaacttctagctcaaagcgcaagccggcccttgccccagtcgcgatcttttgccgacctaaagactgtgcccgctacatcggacagccgtgatgatgccgaacagcaacctgcatggcgactacggaggagaagcatgctaccgtggaatgaccctaatccacagatgagacagatcaagttggaggatatcacgaagaccagaatggcggatacgtggttctcaattcattgcgacggcatcgatactcctgtctatgtgagcgaagttgtagagaatgctacgaaccccagcttcaaggcgtttgatctgaatgtttgcgggccgaaagtctcccgcgcggattgccttactctcaagctctgggcgaaatcaacgaccatgaaggagtatgtgttgctggtcgaactgcaattgtgtctgcagtcactacattttctcggcaaatcgttggatagcttccatcaacccttgccctcgaactccatcctcttccatctgacagacggtgtgtatactaacctaactggtattccatcctccaacaccttgataccttcggccgcgtcaaaattctcagatggggtcgttttgccaacatcttcctacgacgccctgatgcgcttggcgaatctggacgaatgcattcaggacgcgctcgccacgagagagaaactggagtcgcagattagtgcgatcctagaacagaaccatcatgccatgactctcacaagtgacgtctcccgcgcccaagataagcttgctctgaccaagcatgccgtcgcagcggggaaaaaacagctccgcgcaacatggaagcgcaaagaggaacttattgccagtatcaaagctcgaagggaagccatggagcgtggacggtatagtcaggaaaaggctcgctgtcatctaccagacgctcagcagaaattggcctcctgctctcaggtgctgaaacagaatactgaagaaaccaaaggtcaaattcggcgcattgccgaagacttgcttgcgatttaccccatcgagccgattcccgacaagccgctggcatttactatcgccgggcttgcccttcccaactcaaatttcggcgacatcgatcgggacgccgtcgcggctgcacttgggtataccgcacacttggtttacttgctttcgttctacctatcggttccgatcccatacccggtttatccatatctgtcgaactccttgattcaagatccggtgtctgcctcattacctcaacggacataccctttgtacccggtcaatgttcagtaccggtttgaatatggagtcttcctgctgaacaaagacattgagttcctattgaataagctaagcctgcgagcactcgatatccgacatactctccccaacctgaaatatcttttgtatgttctcacctctggtacctcagagatcccagcacgcaaatctggtgggattcgtggcctcctccaaggtcggctaactcccagcctgtcgcgacggggaagcgaggacagcgtcggctatactgagtcgattttccctcgcaaagaggtgagaccaagctcgaaattaaatggagatctcgcgtcagacaaggccaaacaaacaagcccacactttcctagcaccgcaacctcctatcaagtgacttag

SEQ ID NO: 20168 - DNA, 243 bp, A.fumigatus
tccacttccctctgttgtgccggcagaaggcggctatacacgatcatgatggctgccagtaatacacagcaagagaacggaatttatgcgcagaacggccaagcccaaaagtcgccgtcgcctcaacctcagcatcgtcgcggttatcaggcctgcgacccttgccgcaaacgcaaggtcaaatgcgaccttggcagtaagttgtatcctatatttcggttatacattttgcacggcaattag

SEQ ID NO: 20169 - DNA, 840 bp, A.fumigatus
gagtgcatcaatatagctccgtcaactgaacgctatccaccgtgcttcccgtccttctcgccccgacaaggctcgtcgtctcggctacaaggccaagcagggctatgttatctaccgtgtccgtgtgagacgtggtggccgcaagaggcctgtgcccaagggtgccacctacggtatgttgcgcattcaggatctttctcaatgtgggagaagttgggactaactatggtttcgtcttcaggcaagcccacaaacatgggtgttaaccagctcaagtatcagcgtgctctgcgtgccaccgctgaggagcgtgtcggtcgtcgctgcgccaacttgcgtgtcctgaactcctactggatcaaccaggactccacctacaagtactacgaggtcatcctcgttgacccccaacacaaggctattcgccgcgatccccgcatcaactggatctgcaacgctgtccacaaggttcgtctacagcgctcgtgcaactcggcgcgattctgggagatttgcgacgctcttgctaacattttctgtacagcaccgcgagagccgtggtctcactgccaccggcaagaagtcccgtggtatcaacaagggtcaccgctacaacaacacccgtgctggccgccgtcacacctggaagatccacaacacccagagctactggagataccgttagatgtagaaaattgggtgttcatgggggtcggtggttatggaaaatctctctcttcgaggatgtgtttaatccggcgaaaactcgcttctatgactttgtcattgaatcatcagggtgcgagcctaatgcaacagatctttcggatcggatgttag

SEQ ID NO: 20170 - DNA, 1863 bp, A.fumigatus
tttcaggcactggtgccttctaacccgaccagtcccgcaaccgaccacaccggctggccttcagggacaagtcctggattgagcagcccgatgaactggaaccacgtcggaaacagttcgttcacatggggcacaggcatttggaattctgaatccagaaaagagccgccaccccgactctcagagattgtcccgtcgcctacgatgtctaatgcgtctgctgctaacaactatttttcggatgagttgttgagtcccactgcccgcactacatctggagagtcggcgataccgttctctatcccgcttcaccccaccccaaagacctatcgctcgcagtcttactctgtggggcagatggatccagagtacttgaacacgatggccaataagtcggcggcaccgttttcaggtgggcgtgttcggaatgctggacaatactccgcgctgcaacaccgatcgtctcggccaagcctccttggagaactcggtcatgaccctgccactcttggtcgggtttgtgaggatgatgacgatggcggtagcggtaacagttccgacggtagtctcaacgcttattcggcgaaccaggcccgcacaattgagcaactctcacgggagaatgcaattctgcgtcaggctgcaggtcaattggataacagacttagagatcgcgccatgtcctctgcttccactgccagtgggtatgcagttggtaccaacttgcgcaacctccatcgaattcgcggtaccgtccccgaggaaacagatcttgctgtggaggatctcgacgaagtgggcgacatgaccggttatagcaacattcacagcagcctgcgtaaaaggttttccgagcattcgggtaacctcgagaagcagctgccttccactctcaaccctcttgagaaccgtgcgctggaaagtattcgtaaggcgaattggcagacttctcttggatttggcagcatcgccgatattcctcagagcaggcgacactcgtttgcagatattcccattcggcacgcttctgtttctggcgactctcaagtagcgaccacttcccgggctggaatgggagatcgggaagaccaccttgcgaatatcagtgatagttccctttcaaatgcccaaagccagaatcgtgagtatcaccgtctgcatatggcttctcgtcccgaggaacatgaaatggaaatggaatatttacgagctcgtcaatttgcagaatcatactttgctcgcgaccaagctcttcgtgttgccgaaggaccctctgcagttcctacttcgcttcaccaggcttatacgatgccaaacgcttacgtccgccatcagtctggtcttgcacatggccatcagaatcagcttctgtatatcgtgacttttaagtgccaccgtgctgacgttttctacatccaagaagacactggcttgcaggtgaaacccggtgacttggttattgttgaagcggatcgtggcacggatttaggcactatccagcatgcaaatgtatccttgcagagagcccgggagctgaaacagcagtatgcagaggaacactacaaatggctgatgatgttctctcggcaaggccagaacggaactgcgaacgtgactgggagtgttccagccttgagtggaagaagcactatcggtggcatgggtcctcatggtccgcatggtgtgcaggatttagcaggagatatcaagcctaaactcatcaagagacttgcgcagaaccacgagatcctgacgctccgcgacaaagagggcaacgaagcgaaagcgaagcgtgtttgtcagcagaaagttgccgagcacagactcaacatggagattcttgatgccgaatttcaaatgtaa

SEQ ID NO: 20171 - DNA, 555 bp, A.fumigatus
ggagtacgttcgggccatcgaattcatggtactaattgcgacaacagggattggaagaaactcactttctattactttgcggattcgtacatcaacttcaactctcttgtgactgatctcttcaagatctacaagaccaggatctggatgtcagcaatcaatccagcatcctttgtgactccgccaactgctggcttgccacctccgggaggtgttgcaaatgccgacggccgagtgtacggcgcagctcgagacggtatggatgttggcagagacacggtgggcaataagattggccccctccgcagcacctacatagatccttatcagtcttttccccatggtgcccgacagcctgaatccggccttggtgaacttgcacccagtgccgatcccttctccccatacccaccaaacgcttatggtgggaccttagacaccggctatgtcgactatgccgcgcatagcccaggcgtgggcagtggtccgtctcgagttcataatgcgccaaatgactggaccacccggttccagggtttgtcacttggatcttga

SEQ ID NO: 20172 - DNA, 207 bp, A.fumigatus
ctccgtcaactgaacgctatccaccgtgcttcccgtccttctcgccccgacaaggctcgtcgtctcggctacaaggccaagcagggctatgttatctaccgtgtccgtgtgagacgtggtggccgcaagaggcctgtgcccaagggtgccacctacggtatgttgcgcattcaggatctttctcaatgtgggagaagttgggactaa

SEQ ID NO: 20173 - DNA, 339 bp, A.fumigatus
actcctactggatcaaccaggactccacctacaagtactacgaggtcatcctcgttgacccccaacacaaggctattcgccgcgatccccgcatcaactggatctgcaacgctgtccacaaggttcgtctacagcgctcgtgcaactcggcgcgattctgggagatttgcgacgctcttgctaacattttctgtacagcaccgcgagagccgtggtctcactgccaccggcaagaagtcccgtggtatcaacaagggtcaccgctacaacaacacccgtgctggccgccgtcacacctggaagatccacaacacccagagctactggagataccgttag

SEQ ID NO: 20174 - DNA, 3042 bp, A.fumigatus
tggatgaacaggaacgacgggaacgggaggaattgcaagcgcagcaagagcagtctcgagcgcaggacgcacaacaggctcagcacaacactctcccggccggtgaggagcactgcgctgacatctctaccgttgccattcctaaaactcccctccggggtggtcaagccccctccagccagggcgccagggtattggctggctcggcctgctggcttttcgttcagggagaacgtacctgcctacgaggacttttatcagcgtacgcgactggactggatgattctcttcgatctgagattgtggaagaaaacgcgcactgatcttcgcgatctttacatcggcaccgtagtcagtgttccgcagtttaaacggattttgggcttgcgcatgtcagccctctataccgcattggcgcaattatacctcattgccgatagagaaccagatcactctattgtgaacctttccttgcaaatactgacaacgccgtcaataactgaagagattgtgcggcgtggaaactttttgaccaaagtgatggctatcctgtacacgttcttaaccacaagacaggttggcgaggcatatgaggtcaatccgaacgcaacattggcgtttgacgcaggcacagtcaccaaccgccgcctttaccacttctttctggatctgcgttaccttttgcaatccgagtatgtacagcatcacgttcgtaccgaggagcaatatctttcgcaattcctagatcttgtcaagctttcccagggtatttgtccgaatatccgcgcagttggggaacatgtagagtacgagccagacgcctggataagcgcttcgattctgatgcgagaaatcaatcgcctctgccgccagttttgtgaagccttccgcaatcctgaagtcgatggtggaaagaatctgttcagggcaatccgaatggctactgtttctgcaattgttcactccgccgggttggagcgccagcgattcgagcaggcagaggtcaaagagtacgtccgtttcaagctgctgccgtgctttgatttcgaggtcgaccagactggtcaaattccgcgtcatcgcgtggtagactttgtcgtcgaaaaggggtccatcagctttcaccatgcactgcattacacactctcgtggttgctcgaatgtgcgcgtaatgtgagcggtggtcaaatgcgcgatgttctcttagatgccgctcgcatggccaacgacaatatcattcgcgacagctccctcacacccgatgacttcttgcttaccatgtttgactatccattgagagtatgcgcgtggctggcacagatgaaggccggaatgtgggttcgcaacggcctcagtcttcggcatcagatgtctcagtaccgaggcgtgtcatcgcgtgactttgcatattaccgcgatatctttctgctgcagaccgccttagtgacttgtgatccaagcagggttctagcatccatagcagatcgtttcggcatggtagactggatgaccagaaactatactccacgcgctggatacgaggatgcgcagatcattgatgtggccgaggagtttgttcacttgttgatcatccttctgactgaccgaaattcactcgaggccatcgacgataacgaaactgtgactcgtgacaatatccgaagagacattgcccatgtcttatgcttcaagcctctttcgttctccgacctgtcaacgcgcttgagcgataagctacttgattcgagcatgtttcaggagacattggaagaggttgcagtattccgtccgcctgaagggctgaacgacactggcactttcgagctcaagccgaaatatattgatctcattgacccttatagcgctcattataccaaaaatcaacgagatgaggcagaaagcatctacagggaatgggtagctaaaaagacgggaaagaaagcgtcagatatcgtttttgagccccatctgcgacctatcacttccggcgctttctctgatctttcccacttcacgaagactccactgttcgctcagcttatccatcattgccttgattatgtcatgtcgtcaaaggattgttcaccgaacatcccatctacccgcgtcgaaaccttccttcaagtggtattacatctcatcctggccgccactcttgaggacaatagtcaggaagacgagatggcggatgaggcgagggaatcattcatttccaatgcattgtccagagccagagggactcaggcgggcaatctgaccatcatcggcttgctagagaaaatatccgtcatgcccgaattctccgcctgcgggccgaagatccgtcacattctcaagcgtctatggcagaagcgcccccgggcgtacgcttctgctacggcgtccttgacgttcccattcgacagagtggacacgaattctcctgccattgacgtcgatagtgaaaaggagttgaagaagaaacaagcacttgagcgacaggcaagggtgatggctcaatttcaacaacagcagcagaatttcctaaatagtcaaggcgccattgactggggagaggaggatttcagcgatcttgagtcggagcccgaggccgctcccgaggccaagctctggaagtaccccagtggaacctgtattctctgtcaagaagaaacgaatgattcgagactatacggcacatttgccctggttcaggacagcaatattctgcgacagactgacgttcaggatcccgactggatcagagaagtgctcaagacaccgttaagtcttgacaagtctgctgaggacattcggccatttggcgtagcaggtgagaaccagatcaccgtgaaacgattggactctactggcggtgaggtcatcagtgagaagatcggtcttagcaaagggttcgacgcgaagaacacggttcgtgggcctgtgacgactggctgtgggcacatcatgcacttttcatgtttcgaagtctattatgcagccacccagcgtcgtcatactcaccaaatcgcgcgaaaccatcctgagcgcttgttcctttaa

SEQ ID NO: 20175 - DNA, 1830 bp, A.fumigatus
cgactggctgtgggcacatcatgcacttttcatgtttcgaagtctattatgcagccacccagcgtcgtcatactcaccaaatcgcgcgaaaccatcctgagcgcttgttcctttaaagaattcgtctgtccactttgcaaggccctcgggaacgcgtttcttccgatcgtttggaaaggcaaggaggagtcatatcccggccttcttagcaccaccgttccatttaacagctttctaagcacggaactcagaactgcgctgtctcagccgcagaatcatgctatccttgtaggggaggactcgttgcaactgcagttatatcaggatatgttccttgactaccttcaaagggcgtttgttcctcccgttgccaatcagattgagcaattggtgtccggttctccgccaccgacgactgagcacccccctcaagtaagaatgccgatgccaggtttgttcccatcccacgaagacgccagcgcatccagcccactacaaccggtctcgtcgactccggatgaaagccccatgtttgagcttttgcaaatctacaagcgtctaaagaagactctccgaacgaaccatatccattcgactttcaatcacccccctgaaactatccacagcgttaacgacgatctcgttcacacggactctttgttctcaagcttcggttacagcatcgccgctgtcgaaatcgcccagcgcggtgtcgaatcggaagcagggtcaactctgctcgataagattccccagttgaccctcacgcatctccgggtgctggccgaaactgccttatcatatgctgcagtcgggtgtttgtacaagagcggcggtaatcacagccgtgctgccgatgaatttcaggaaatacatcgtcagaagatttgccagttatttgttggctatccttttgtggtcggcacagcactgctcgatggagcgcgtgatattgagcccatgctggccaaggatacatttgtcttcctggcagaatgctccctgtctctgttgcccgtgctgaagattgatgtacaccacctcgtccagctgtgctatgtggccgagatcgtcaaagtggccatgacctacatcttgcatcctcaaggactgaagaaggaacttgccgaacacggagacgcgcattatctcttggacgttgagctatcggatgagcggtatgagtatactcgccatttcttcaacgccatcgtcggtgagttgagggagaactcgttccgtcatgatgaaggatcctcgtttgctgcagacagtggctacgttaaggatggcgaggattcagcaacaccaggtataatcatcgcgctgaggcggctagtatcgagctacgccctagccttcctccgaaaggttgtcatcctgcttcacgtgcagcatggcgtcgagttcctgaccgctggatccaacgatatgggagcttcagagctagaccgcctgacaaaactgctgcaacttccctctctcgacgacatattctcgtctgtcaaccctgcgaagaaagccaacgagcttgatgccgtggttgccggctggatctctcactggaacagttctcgcgtgggcacccgcattacggaccaccaattgtggccaagtcttcctcatccggctatcttcgagctgatcgggctcccgaaatactacgacatcttgatcgaagaagtcaaccggagacggtgtccgaagacgaagaaggaattgacagaccccagtatttgccttttctgtggagatatcttctgctcgcaagctgtgtgctgctcggtggacaatagaataggcggctgtaaccagcatctgcagaagtaa

SEQ ID NO: 20176 - DNA, 186 bp, A.fumigatus
gtttacgctatctccagatcctcttgtttcatatatcgtctgctgtctgtctacattaacgatcttcacgacgtcaacgctttcctgccaattatctacccatacgaagtggaacattcggaatcaccctcatttgtcccgccgcacagagctccgtctcatcataccgactctacgcagtactga

SEQ ID NO: 20177 - DNA, 1758 bp, A.fumigatus
atgatgctcacggaatgtgagaggaaacttggtgaaggcctccttcggcttcccttcgaacacggttgtcgctatggacccgaggccgagcgagatttgctcgagcttctctttcgttcactagtaggcttcgatgaagaccgtttacgtcagctcttcccgaacgggtttccggaaggaccatggaagttagccgaagcgcaaggtgctcaggaaggagcagagtacaccgaagctgcgcgggggaagcgttgcggccatatcttccgggccggggaggcaacatatcgatgcgttacctgtgctgtcgatgatacgtgcgtcttgtgtagtaaatgctttgacgcctccgaccactcgggtcatcagtaccagatttcgctgtcgtcgggtaactgtggttgctgtgactgcggcgacgatgaagcctggcggtatcctttgttctgcgcgatccataccgatcgcggcgataccaagggcaagcagcgcgctcagactttcctgccgccggattgggccgaaaatatcaggcttacgatctcccgagtgatggactatttttgcgatgtcatttcgtgctctccagaacagctgagattacctaaaacagaggatggcataagacaggatgaagtggcatcccggctcaccggcgactggtacggtggcggagatcaggaggaggaagaaccggaatgggcttgtgccctctggaatgacgaaaaacatactattcgggacgtagctaatcaggtcgctcgggcttgccgggaacgaatccgctttggtgagaaaaaagcctacgaaaccaatgatattgggaggaccgtggtcagacaatccaaggacttggcccaactgctgaaggtatcccaagtcctcgagcagatcaaggttaccactacagtgcgatcggctcgtgatacatttcgtgagcaaatgtgcggaactattgtcgaatggctttctgatattgctgggtgcaccgtactggaggacgatcagattttgcggcacgtaatctgcgaagagcttctcagtccttggcgacaaggcagtggtgcctataacgccagtattggattgaaaggcatcgatgaccacgcaaggcaggatcattcgccataccatacgctaatgctggctgcggttgcccctcaagctcaagtgatattcgcgcctgaagcggacattgaaggtgatgaggaagataatggtaatggtaatgaagcagagggcgacgatgacgaggatcacgccgatacgcatgaagatgcggacgacgaggacgaggagatggagatcgacttgaacagattgcgagaagaggtagaagaagatgaagatatggtcatgggcactattgatgacagcgtaaccttggaaatggcgaatatgctcgaggacatgcgtcagaggcggatggcattgatggatgaacaggaacgacgggaacgggaggaattgcaagcgcagcaagagcagtctcgagcgcaggacgcacaacaggctcagcacaacactctcccggccggtgaggagcactgcgctgacatctctaccgttgccattcctaaaactcccctccggggtggtcaagccccctccagccagggcgccagggtattggctggctcggcctgctggcttttcgttcagggagaacgtacctgcctacgaggacttttatcagcgtacgcgactggactggatgattctcttcgatctgagattgtggaagaaaacgcgcactga

SEQ ID NO: 20178 - DNA, 294 bp, A.fumigatus
gaagtgctgactccgcacaccactagatgtggcaaaaacgtgggcctcttcatcaacatacgcaaatgcgcgatcctctacctccataacaagaacggctcctggcactttgctccataccttgaccgccatggcgaggttgatcccgggctccgacgaaatcggcaactgattctgaatcaaaaacgatacgatcgcctcctccgtgatgtgtggctgaatcacaacattcctgccacgatcagtcgcaagctggaggcagacatcaataacgggggatgggaaaccctttga

SEQ ID NO: 20179 - DNA, 1485 bp, A.fumigatus
ctgggttttgtttctatgattaggcgctcagtaacgaaagtcgatttcgcccggcaattggccgaacaacgccgcgagtcccagcagccacccacgaaacggttcaagtcggccgccgctcccaaaggcacgaaactgcctaccgggtatcaggatcgagctgcgctgctgcggcaagaacaagatgaaagtcgctcagatatcgagaggcgcgttcaggcgctggaggagatggttacgctcgggcagatcgaccaggcgacgtttgacaagatacggtctgagcttggggtgggcggtgaccttaagagcacgcacatggtaaaaggtttagactgggagcttctgagacgtgtcaaggcaggggaggatgtaacgaaagcgtccgaggaagggccggattcggccggaccacagaatattgaagggcttgatcaggctgaggatgtggatgaggaattcgaccgtgttttagaggagaaggagcagacagtgttaccgtctgcaccgaaggaaaagaaggagaagaaaggcaccatggcaccgccgccactgcctgcgaagaaaacgcgggatgaaatactacgagagttaaaagctagccgtgcggcagcggcagctgctactactacgtcgcattctcctgagccagtgttgggtggcaaattcaagagaatcggtgaatccaaggttgaaaaaaaaagattcattgagcaagatgagaacgggagaaggaaggaggtgcttgtgattacggatgcagagggcaagaccaagagaaaagtgagatggcttgacaagcctggtgagggcaatggcttgctcgtacctgaaaaagacacgaaaccactgggtatggaggttccggccgaaattgctgctaaggtggcagcccctcctacggatcaggatgacgatatctttgagggagtaggagccgattacaatccgttaggggacgaggatgaggatgatagttcttcggatcaggacgaaggacagactcaaactacagaaaatacagtcattagcacaaaagaagaggaacccgctgtcaagccgcacaaacctcgcaattacttctcgacctccgcaaaagatgaacccccagagtctgaccgtcgtgctaaccccctaaccacggatccaactttgctggcagcgttgaagcgggctgctgccttgcggcagtcgtcaccctctgcgggggcggttgctggggaaggagaggaagatgtggataacgagactctcttacgtcgaaagaagtttctcgaggaagctcgacgccgcgaagaactggacgctgcagatttggactttggatttggagggagtcgcattgaagacgaggaagatgacgaggcgattgtgtttgaaaatgaagggggcaagaagaggaagaggggtcctaagaagaagaaaggcgacaagaatagtgcagccgatgtgttacgtgttctggaagggaggaagaaagactga

SEQ ID NO: 20180 - DNA, 198 bp, A.fumigatus
tccgaccttgtcgttaagggcctggtcctgaacttccttcaactctttggcaagcgtttcgctcttatggttggcgcgatgactagcggattctgcagcctgcaattaaactattgtcaacatatgcccaacaccattgaccactacgagggaacaaacctgcgccttcctgaagtccgcatcggccttcaattgtag

SEQ ID NO: 20181 - DNA, 987 bp, A.fumigatus
cgtcagaattttcaaatggattttgatttttttgcggatttcgaagacaccgaaaagaccatattattatttgttcctccccacgttcacgccaacacccgccaatcctcggtcgacccttttcgttctgtcctttcgtgtatatcaagcaagcgcaacttcgtcacaatggcaaaggacaagtccgagaagaaggacaagcgcgagaagaaggagaagcgctcagagaaggacggcgtccacaagagcaagaaggacaagaaggaaaagaaggacaagactgttctcgttgaggcagtagagcaagagcttactagcaaggttctagatgggatcgataaagctgttgctgccgagactgccgtcaatggaactgctgaggctgagatggaggttgacagccgccccgttggcgcacttgtgccatttgccaaccctctggttgaggacaagcaggccaagaaggttctcaagagtgtgaagaagggtgagtattccgaaaatcatttggacaatctgtatatcaagagctctatttctcagagcgaaaagacatcgactgggttaatcgtgtactgtgttgctaataaccttctagctgccgtaaacaagtgcctgaaacgcggtgtcaaggaagtcgtcaaggctcttcgcaaatcgcccactcccgccgccaatgctgctatctccactcccactggcatcgtcatccttgccgctgacatttcacctatggacgtcatctcacatatccccgttctctgcgaagaccacggtatcccgtatgtttttgtcacatcgcgagccgagctgggtaactcggctgctaccaagcgcccgaccagtgtcgtcatggttgtgcccaagtcagcctccaagggcaagaagaaggacggcgagtcggaagccgatggagaggatttcagcgaagtctatgaagagttggtgaagctcgtccagaaagagtccaagaaggtgaacctgtaa

SEQ ID NO: 20182 - DNA, 810 bp, A.fumigatus
aagtccttcgttgtaggagaacttgcactggcctataatgcatcgagtggaacgacgccggagaacgcgcgcgttcgtcttgataatttccaggtattggagaaggtcgctgccaacccacattttgtacaggaagagaagggctcaggggacgagaagagaggacagtatagcgtcctcctctctaacatcacacggtcttcaccgaccgtggctttcaagtaccaagttcacatcgatcagttggaagcttcgatttactgtcccgtgatttttaaacctgcgtggaatctcgaagagttccaggcaagcgtgatcatcttctactctatgaattcctcatttgcctcgtcggtaccaagagaatcaatcaccatcaagaacctcacattgactgtgaacttggacacctctcctgaagaaggccgcgagccggctcatgccacgagtgctgtcatgtatcccaattctggggccaccttccgtcgcaaacagtcagccgtcacttggaaaatcccggaacttgaagtacgcaccggagctgacggaaagctacttgttcggtttgcgacttcaaccagctggccacggaaaggcaaagtggacgcgaaattcgagctccagacagcagacgctggctcccgcttggggattagtaccatgtctcagcacgaggacacgccgcagacgggaaccgatcctttcgcagatgaagatggcagtctgcaagcatctgattccctgtccacgtcatgggaagaagtacccacagtccgcaagctggtggctggcaaatacgtgtcatattaa

SEQ ID NO: 20183 - DNA, 225 bp, A.fumigatus
aacccttggtcatggacatgcgcgctatatcttagtagaaatgcatccgtcgtctttatcgtcggccaaagagcaatcaccgcaacacggtttaaccctcccattcacaaccagtttctcgtcacacctctcacacagacaatcgacctcacagtcgcctatccatccacatctctccagcacgaactcgatcccttccacgatcccaaccgtcaacacagctaa

SEQ ID NO: 20184 - DNA, 216 bp, A.fumigatus
cttggcatagatacggagaaggaggagctacgcgtacaaatcagcactctgcgatacgagctggagaatatcatacaggagcgggatttgatgatgctccgccatgacaaggaactccgagatctacaattgaaggccgatgcggacttcaggaaggcgcaggtttgttccctcgtagtggtcaatggtgttgggcatatgttgacaatagtttaa

SEQ ID NO: 20185 - DNA, 1926 bp, A.fumigatus
ttgcaggctgcagaatccgctagtcatcgcgccaaccataagagcgaaacgcttgccaaagagttgaaggaagttcaggaccaggcccttaacgacaaggtcggactagagcggaaacttagaagcctacaggatgaaaagcagaacatccaggaggaactggaagagactcaagctcagcttctcgaccaggaaaggcaacacaaacatcagatcaatgaactagaaacaattcgctcgtcccttcagaaaacgctcgaggaactgcagaacgatcttcaaaatgcaagaaacagtttacaatcaactcaagagaaactgtcacagcgagatatggatgttgccaaccttgaaacggaaaacattcgcttgaaagcagagggggctgacggagaaacaatgtccgtattgaagagggagcattctgatcaagttgctcacattaggaacttggagactgcaaatcgagaacagacggcagaactgcgccacctgcggaaagtccagaagaatgtcgaggtagtagaagaacaaaagaagtcactggaaaatcagctccagctcatgaaggaagtggagtcggaattgaacactctgcggatccagaaacagatcctagacgatgagcgtagctcgtggaccagtctgctgcaggagaatgatgaacctgcagaatttgactcgcccgaggcagtcgtcaaagccctgttgcaagaacggattgagaaggcgacattggtcgacaaattgggcagtatcgaggcacaattcttggaaaaagatgagataatcaagagcttggagactgagagagccaacctccgtcaggagctagagaaattgcgcgctgccggctccaccactggcggagccacagctgagagtcgcatcagggctagattagaacgtcagcgggcacttgcagtcaaggaggttgagtatcttcgcgcgcagttggagacttttgacacggaagaggtcactctgaacgcggaacaaagccagttcgaccaacgcaaatctgagcagatcgccaacctggaaaagcttgttgatgaataccgcgcggaagtgcaaaaagctcatgaagagctcgcgaagcgtgaagctccacagcaggaggatacacaagcccgaggcgtcaaacgaccgttgtcaccagctgagagcgacgcggagaacgaaagactctctgtcttgacgcggaagaaccggacgctgcaagactctctttccaagtctgaacaggccgcagccctcctccgcaaggaactggaagcgaccaaaacccagctcaagtccctcaaggccaagtctcgtacacgcatcttggagctgcgcgacaatcccaccgccgaagcggaaaagctcaagttctccactatcgcaactctccgggcagaaaatcgagatctcctggcccaactgcaggccaaccacgcggacgtcaaagttgtgcccgtcagcaccctcgaaagcatgaaactggagctcaacgagatggagaaagtagtcgctgacaaggaaaagcgcatgcgccgcttgaaggaaatctggaccgcaaaatcgtccgagttccgcgaagcagtcgcctctctgctaggctacaagctggatttccttcccaatggacgcgtccgcgtcacctccatgttccacctctcccccgcctaccgacacggcgacggcagcgcctcctctgactcccgtgggccgggaagcatgggcaacggcgaagagaactccatcatctttgacggcgagaacggcacgatgaagatctccggtggcccgaacagtcttttcgcgatggagatcaaacatctgatcaagttctgggtcgaagaacgaaaggatataccctgtttcctggcggcaatgacgttggacttttatgataagaccacgcgggctgcgaggatgtga

SEQ ID NO: 20186 - DNA, 774 bp, A.fumigatus
gtattcgagcaggtcacaacagatcccgaagccagaaaacatcccaacaaggagtcttctggacctgtcaccaacgactctcttgctgccgaatcagccaggcacggtggcgactacagccagaaccgcggtgccgaacctcttggggtttctggcagccagtctacattcaataacacaaacacctctggcgctactaagctgtcctctgcccccgacgctgccacccgtgaggagctggacaaaaaggagaagtaccctgaaaacatgggtggccaagggaagttccctggtgcccatgttccagagactggctacactggcggctcgacagctgccaagcggaatctgggtatcaacaagggcgaatattccaccacccagcagagttctcggcctcagacccgatctcagactcaatcacaatcccagtttcagtcccagcccgctgaggcgagtggaagtggttaccacagccagtacaatggcggccaagccccttcgtacatccagagtgtgaccaggcagcatactcaaaccaaacccaagggcaaaaacttgcaggagggtagcttcgatagcgaccccaacaataacgccagcttcacttccgaaatcggcagcgaccaagaccctggccgcttcgccgaaaactactctcagcgcaaggccgcagatactggagccgctgatgctgcccgaggtccagtcgagaagaagggagtcgacgataagacatggtatcagcctttggaaagtgatcagagagcttaa

SEQ ID NO: 20187 - DNA, 1104 bp, A.fumigatus
atttcagctttgacatatcaattcccgtcactctctgctctgtctgcctccgcaaatcagattacccagatcttgacacctatcacggataccatcacgaccttgacactggaaaacaatgacatctcttcgctatcctcaatagcatgtctgacctctttgagcaagctcgagcacctctcgctgagagagaatcgtatcgggaaagtctatgcgtctggcatggaaggaaactctcttcagttttccgaaaatctcagatcggtggacctatccagaaacaatatcgattcttggctgtttgtgaatgaacttcaacgcgtatttcctgggctgcaatctttgcgcatatcaggaaatcccctgtacgacaagcctgttgccccctcgaacgtcacaaatttaccggagaagccaatgacggtggacgaggcctatatgctaacactctctcgactcgcttccatccaaacgctcaactacagcaagataactgcccaagaccgaagtaatggcgaactctattacctttccctcattggcaaggagttatccgcgtatccggaaagcgcagaacgcgagattcttgctacacatccccgctatcaggagctttgtgagaaatacggagcgcccacaatcaggagagccgagctggcaggcgctgccgtgaatccgcgctctgttgccgcccgagtagtgaagttggctttttgcttgcactcatcagttagttccggtgcaaaccaagaacaatttcgagttcagaagatcccgagatcctttaatacatatcaagtcaaggcaatcgcctcccgcctgttcaatttgccgccttaccagtgccgactagtctgggagaccaacgagttagaccctattcatcaggagaaaaaggacgatggagacgattgggatagtgatgaggatgaagccacagctattggattgggggagagtaacaagctcacaccggcgacggaggatggaaagttcatcagaagagaggttgagctcctggattcaacgcgagacataggcttttggttccaacccgatactgttgaggcaaggatcagagtagaagttgcaacatcgaattga

SEQ ID NO: 20188 - DNA, 852 bp, A.fumigatus
ccccggttctggtgcaaacaatgcaagatattcattcgggatacacccttcgagaaaacccagcatgaagcgagtgccaaacaccagggaaaccttaagcgtttcctacgagatatccaccgggaaaatgaacggaagcaaagagaaactcagaaggcgaaggatgaagtcgagcgattaaggcaaactgtcgcaggaaaaccaggtgcaaaagacagcggcgcaacagcttggaaacgcgcctcggctgcccctccaccggcagaacgacctgtgtccctggaagagagaaagaagcagatagcgcagctggcagagatgggaattgctatcccggacgaataccgtggtgaactcgcgctcgctggcgaatggcagacggtatccgaacgagttattcgaccagatgacgatacagaggaaggaaagcctggtagctctatcggcgttcggaaacgcaagatggaaggcgatgaggaggagcaggaggcgcgacaggaggccgagagattcgtgagtcagggttggggctcgaggactcggcagtatcctggggtgcagagcgatgcagacctggatgcacttctaaattctaccaaggatgtaaagaaggtcaagttgtcggcgccggatgaagggtcgaaagagaaggctagcaaagagggtgctacaccaagcaacgatacggaccaggctgcggctcaggagtcagaactaccatcagtcaagtctgagggtaaagaagcggcgcagcttgctacaacagataccccagcggtgaagcaggaagaggaggcggcacctacaggagttgtttttaagaagcgcaagccgaaggtcctgaggaaatag

SEQ ID NO: 20189 - DNA, 192 bp, A.fumigatus
gcgtgtctgctaggttgcgacgtcgtatatcatccagtgcatcgatttcgcacgctttttgccttccgaaagctccgtttcacgcagaaccctattctcgccagcacccatggaggaatcagcagaatcggcgaatgggcctggggaatcgcccaaacaagcaacttcgtcgaccgaacaacccgctcctga

SEQ ID NO: 20190 - DNA, 501 bp, A.fumigatus
tgtgacgaaggacatcctgtttgcagaaattgcgtcaagagcaagcgtgaatgtttaggttacgaccctgtctttagaccgcaggcgtcaacaccctctgcaattcaacctgctcccaatcctgctccctcactcgtcgtcaatccacaggatccaacgccttcctatccctcggcgccccctggttacgtccctgcggcatcccagccttttgctccctctcttcattcagaatcgccatccacatccaccgaccaacagtacgactacggcgcttcttccgctgacccttcgttggggggcaacaactcgaccaacatggccagcgcccagaatgtcactcagggaggactgcagccgactctcaatgcgaccaatgccacggtcactccgtcggaaacttccagctacaaaggtacgtccttctcgtgcggtattcatcccttgatattacattctagtacattctcacccagaagcagtgaaacgagttcagattag

SEQ ID NO: 20191 - DNA, 1146 bp, A.fumigatus
gttgcgacgtcgtatatcatccagtgcatcgatttcgcacgctttttgccttccgaaagctccgtttcacgcagaaccctattctcgccagcacccatggaggaatcagcagaatcggcgaatgggcctggggaatcgcccaaacaagcaacttcgtcgaccgaacaacccgctcctgagacaattccggatcagacacccaggcctcctgcagagaatgcccctgagaccgcacctcagccaatgcccgaacaagctcctcaagcggcggctgaacagcctaccgaaaccagcagctctgctccggtacaagcaatacccgccctcgatacgtcgcttcctccaattgacaagtcaatgccggctgtcgacacgactctgcccccgatagatacgtctttacctagtctggattctacattgccaccactggactcgaacgtgccatctttgcctccaatcgatacatctcttccgccacttgacacgacgttgcctgctgcagaggccaatttcttgctttcaggtacacgagcatccaacccagaacctgctgcttcagagtcgactggcacagtatccggggcatctgagcatctcacatcccaccagtcaggccacgcttctgctgaaacggcaccctatcaatattcgaatgggacgtatcaatcgcagcctgctcaacagccgcatcaggcgtcgccaccgcaaaaacagcaagatgtccattaccagcagcagcatcagtcggcgcaacagtatgcgcagccgcagccgcagccgcagcattctcagcaaacacatcagcaataccaacaacataatcatgatgtgtaccagaaccatcaacccgcatcatcgcagatgaacgctccgccacagccatcccatattcctcaggctcccattgggtcacccatgccctcaaacatgcccccaatggcttctgtaggccagtatatgacaggatatccctccaatgtatcacaaatgggtatgaacacgaacgcgcagatgcgctaccagctccctggcgactcgaacaaaatgctatctggcggaaggcataagaaagaagttaagcggagaacgaagaccggatgtctaacgtgccgaaagcgcagaatcaaggtatgtaatttgtga

SEQ ID NO: 20192 - DNA, 900 bp, A.fumigatus
tattacattctagtacattctcacccagaagcagtgaaacgagttcagattagcgatctactggcgctgagaggcattcctccgccgccccctcatcctatcacgtctctccccccgaaccgtctcgaagaaatcaaggccgtcttcctcgctacatacgctcccgccatcgatagatttttcgagactcgctggttttcggagaaggctctcggtcacttgttggcgaatgcgcagctgatggccgagtactctgctcttattgatgcatttaacgatcggaacctcagcgatcccaacgtcgttgcacagctggagagctttgaggcatccgtcgtttggagtaccatgacattgtgccgtcatgtgatgaatgtgtcgaacggcagccatggaaaggatttcgagctgttggctaccgcgtccaggctagatgtgatcgaggctctgataactggcgagcatatggagagaaatccactggcccaatggcccgttccagaaccggcagctgatccacccactcttcctgatcaactgatgcggagagcattggacttttggagttcgatcggccacttcttgactctccatgacaacgaagctagctctgcaaaagaaattgatgatactctggctcgttgcagaacgctattggacacctatgagaatcgcgatgtgatttattccattgctattgcccgccacattggacagcgctgggcagacttcccgcacagcctccctcagcatgtcaccaccaacgaaaaggatgcgggagccaagctatatgtggcgcagaaattccttgagcaagaagccagcggcaagggcaccacacaggttgttaagcgcatttgcggcatggttgtgcggtcctggtacatttcccgggagtag

SEQ ID NO: 20193 - DNA, 585 bp, A.fumigatus
ggtcgcctggcgctcctctacaaaacgtatctcagtgatctgaccccccttccaggcgccggatacgaccaaatcgatgtccacgcctgcagcgctcgcaatccgcccctgcgcgtctccaacgtctccacagctgtggacgacgcaaccgccgacgtgaacatgttcctgatcatcggtgcgctgcgcaacttcaacgcaggcatgcaggccctccgcgaagggaaatggcggggccaacccctccccgcactcggccacgaccccgagggcaaggtcctcgggattctgggcatggggggaattgggcgcaacctcaagaagaaggccgaggcgttcggcatgcgagtcatctaccacaatcgccgccagttaagcgaggagctggccgccggagcggagtatgtgacgtttgatgagctgctggccaagagcgacgtgatcagtctaaacttgcccctgaatgtaggttgtctattctggctttggctgggagtttctgcgggttatgtatgcgtgattctaaccatccagagaagaaacacacacggcacatcatcagcaaagccgagttcgagaagatga

SEQ ID NO: 20194 - DNA, 714 bp, A.fumigatus
  unsure (33): Identity of nucleotide sequences at the above locations are unknown.
cttttatctgttttatcttggcgggtccggccnctcgtagtgaggacgcccccgatcgctcccgtgatatccttggcgacccgaacctatctcacccttcccaccgaacccgagctcagcgaaggatgcgctaccatcgttcctatccagcatcgcactaacctgatggaatgtgatgacgacgagtgggaagagatccggaatttcatgaagagtctaactcgcatgtaccacgatcagggccgcgatgtcattttctacgagaacgcagctcagccgcatcggaagagacatgcagcgatggaagctgttccactgccgtacagtctcggagaaacctcacccgctttcttcagggaagcgatcctcgcagcagactccgaatggacgcagcaccgaaagctgatcgacacccttgcgaaggcgaagcagggattgggtcggaatgcgtgccgtcgcactctggccaaagagatgccctacttccatgtttggtttgaattggacggaggactgggccacgtggtggaggatgagcaccgctggccacgcggcgatctgtttgcccgcgaggttattggaggcatgctcgatctcggcccagaggttattaaacgacaaggccgctggaaccaaggaggcgatcgcagggtggaagggtttaagaagcgatggcggaagttcgattggacccgagtgcttgtggaaggctag

SEQ ID NO: 20195 - DNA, 222 bp, A.fumigatus
ctgccaaatagcagctgtctcaccggtccgaggccatcccatgtcccgattgatgtgtcctgcctcgcaattgacgccgatgctcgtactgattctccccgcataaacccccacgccacgctcacatatcgcagtcaagcctttagtgactttcctcactcgggaaagaccagcacaaaccagaacgaatcccaccgacatcggaaatatcacctcatctag

SEQ ID NO: 20196 - DNA, 285 bp, A.fumigatus
cccagtctcttcttcgcatccagcgcacacaagacatggcaatcgctatccgagattgcggaactgatcactcccactgccacgaaccgcgcagagttcctgcaggaatgccgctccggcaagctggacggcgtcgtcgccgcctacagaaccttcgactccatcaccatcaccggcttcatcgatgaggagctcgtcaacgcacttcctcgctcagtcagcttcctcgcgcactgcggtaaggtcgcctggcgctcctctacaaaacgtatctcagtgatctga

SEQ ID NO: 20197 - DNA, 192 bp, A.fumigatus
cttgaagtcacacgcagacacctcacaatgggttccaccggtaccaaacctaaggtcctcctacttggatccatcgtccagtacgcactagcctctctccctgtctctcttaattactcttctgacccagtctcttcttcgcatccagcgcacacaagacatggcaatcgctatccgagattgcggaactga

SEQ ID NO: 20198 - DNA, 378 bp, A.fumigatus
tctgaccccccttccaggcgccggatacgaccaaatcgatgtccacgcctgcagcgctcgcaatccgcccctgcgcgtctccaacgtctccacagctgtggacgacgcaaccgccgacgtgaacatgttcctgatcatcggtgcgctgcgcaacttcaacgcaggcatgcaggccctccgcgaagggaaatggcggggccaacccctccccgcactcggccacgaccccgagggcaaggtcctcgggattctgggcatggggggaattgggcgcaacctcaagaagaaggccgaggcgttcggcatgcgagtcatctaccacaatcgccgccagttaagcgaggagctggccgccggagcggagtatgtgacgtttga

SEQ ID NO: 20199 - DNA, 432 bp, A.fumigatus
gctgctggccaagagcgacgtgatcagtctaaacttgcccctgaatgtaggttgtctattctggctttggctgggagtttctgcgggttatgtatgcgtgattctaaccatccagagaagaaacacacacggcacatcatcagcaaagccgagttcgagaagatgaaggatggcgtcgtcatcgtcaacacagcgcgaggcgcagtcatggacgaagaggctcttgtccaggccctcgatagcggcaaggtctactctgccggcttggatgtcttcgaggaggagcccaaggttcacccgggccttatccggaaccccaatgttctgctcgtgccgcacatgggcacatggaccgtcgaggtgagactcactctacagcagcgaagtcaccatggcagacatatactaatccgattgatttttgttgaatag

SEQ ID NO: 20200 - DNA, 192 bp, A.fumigatus
aacggagctttcggaaggcaaaaagcgtgcgaaatcgatgcactggatgatatacgacgtcgcaacctagcagacacgcctattcgcggttctgtgacttcgtacagtggcctgaatgtttggtgccagcttgcatctattcctgcggtctatcggccaaatgcgatgttagtattgagaatccgcaaatag

SEQ ID NO: 20201 - DNA, 240 bp, A.fumigatus
catttaatcttcctgcaacttaatacggccatttattacgcagcctgcacgccattagtcgactcggttgtcaaaggagtttccgaaaatcgcctctggtgcctgcagttggtgtggttaaagggttttgggctcgtgtccttgaaggaacctctctccaaggtcaagaatcagaagatcttcctcatcttcatcaacccactggtcccatccggccgctttcaccatatgcttcggtaa

SEQ ID NO: 20202 - DNA, 720 bp, A.fumigatus
aaaatgtatggcaaggctgactgcggcgctaagcctccacgggctgatatctatggactgcagcctgctgctcatctaccccatgctcttgaacatctaacccaagtcttcccagaacaaagttcattcctcttaatcacactttcatcctacatccacccaggcacatccgccgcagagttgccgtgctcgcggaatcgggaggttgtgggattgcgctggacccctcatcaattcagcccctccaagggacacttcccacgcaaaatgagcgaccttctgagtattaccgcgagtgtcataacggtgcttgaattggcagccacggcgactaactacctgagaggcatcagaaatggagatacggatcgagtcaacctccgggatgagctgagaagcaccacctgcctggtcgagatgctcagagaccgcatcgaggatgcggaagacgcagcgacgacgtcgggacttagcagaccgctgtatatcaaggatctttctggcccagataagcctcttgttcagttccagcgcatcctggaggacatcatcaagcagctcagcccgcagagtaaactgcggcaacgatcgttacctatgacatggccatttaccaagaaggatatcgcggagaagctttcttgcttggaacgcctaaaaagccattttattctggtcctgcagaatgacctcgcgtacggctcttgccccaccatttaa

SEQ ID NO: 20203 - DNA, 645 bp, A.fumigatus
tccgccaacgacactgaactgtctgcgttccttcgcgacatgcatcgatttatccgtttcttccgtcaagtgattgacgtagcgccgctccaggcatatttctcaggtcttgtttttgcgccacagaggagcctggttcggcagacgttcgaaaggtttttgcacacccggatatctcatatacccaacccgcaactggattggagtcctcgcctatatacgcttgacctccatggaaatacacccgaatcggtagccttctcggaagccggtgaccgacttgcatcaggcttgaagaatggcctcataaaaatatgggacacaggcacaggtggtcccatgcagacactccagggccatgatgacatggtcaattcagtagccttctcaagggacggaaatctactagcatcaggctcaagggatcacaccgtcaagatctgggatactgccacctgggattgcgtgcaaatactcgaggggcataatggtcctgtcacctccgtatctttctcagcgactagtgagcaagttgcatccggatcagcggatgagaccatcaaaatctgggatgttgtcgccggcaaatgcgtgcaaattgttgtcttcaccacggggctggaaggatccgcggtggcgcattga

SEQ ID NO: 20204 - DNA, 201 bp, A.fumigatus
gtcctatgggcattggaactgtcgaggtcaggagcgcggacagaatcacagaatcagaatccgactcgggtgaaactgtatcctaggatctacttttacctggctcacgattgtacgatttcaaatatcgaggacgccaccaccgattgcttgtgcttgactgtgtttgctgtagagattgtgttgtgggctcatccttag

SEQ ID NO: 20205 - DNA, 279 bp, A.fumigatus
ccagtgggtttcgctaaaaatttgacagcggatagctcccgggtatctccagagcttcgcaacttacaaaacttagaaaagcactccgaacgcagcttggccttgaaatttaatgttcagatattcaactcttttcgtcatcaggggcccaacggagtccatcagtgttttgtatttgagttgcttggtccttccgtcgacaaggttctcaacgactactatgactttggagatacgcttgagacagaagatatccttcgcatgacggaccagctttga

SEQ ID NO: 20206 - DNA, 2124 bp, A.fumigatus
gcagtcatcgctcgccctcatttaggccaaataatgtttgcccagatcctcctgaatccggcgcaggctaccaagtctaacctggcgggcatcgctcatgttacctccagaatggactggtattgcgccgtaaccggacacctcttgaacaagaacaatattatgaccggaacggagtcatttcaagaggtcttagaactgctggagaaggcagttgtgctactctacaaggagctcctcctttatcagatgaagagtgtctgttcctattaccggaatcgaggcgttggattcctgcgcggactagcgaacttggatgactgggatggtaatttggcatgtgtcaagaacgctgaagtcgtcgtgcgggagtactcggagcaatattgccgagagtatcacaagagctctctgcgccagctcgtcgactctagtagtgaaatggagaaatatcttggtgacattcatcagaacttgcgagactttatcgccttgcagaagacaacgcgaaggaacgatgaggacaaggaatgcctccaggatctctttgcagtggatccgcagtacgatctgaaggacattgaagagaagaaggataaattgctcgacgatgtgtatgactgggtctttcgcaccgatgagtacgccgtgtttaccgattggctcgatgacgggcgcaacggagcatcctaccgtatgctgtggatagacggacctgccggcaccggaaagacgatgctcttcatgggcatcattcgcaagctctccgatcagccctccgccctttcaccgagtgtctcgtacttcttctgtcaaggtacagatcagacccggaacagcgcaacgaccatctggagatcgctggtttggcagctactggtgcagcaaccacttctcatctcgcaccttcgagaccagcgtagaaatgctggtgcccatctgttgagaggcgagcgtgcattttatgtgctatctgacgcacttcgcagcatgctacaagacccttgcctatccccagtatatttcgctattgatgcccttgacgagtgtgataggaaaaccccaggcctggaccagcttcttcagctgattgagtcttcacttgctctctccagtaaggtgaagtggctggtctctagccgtccggaggttcttctccacgcaagaggcaagcagctcaaggagatccatgcttcaacagcttcggtcacgttgggccctaggcgtctagaaggaccagtcaatgcatatattgaccataagcttgacagcatgaagggaaaagacggttatgatacggagaccttggcgcaactttcagacgagatccgtcagcgagccaagtccacgttcctctgggtggcattggcgttcaaagaactggacggagtggatgggtgggacgccgtcgagaccatccaaagaattccctccggcttgtcgaatgtgtacgatctaatcatggcccaaatcgagaagggcagttcggaaaaccaaaagcggtgcaagaacatattggtcgctgtggttctcgcatatcgtactctctcgctccccgagctcgccgtgcttgctggattgcaaccaaagattaaccctcggacaattgtcgagaaatgcggctcattcctgacaatttccagccaaggcgtctccctgatccaccagtccgctaaggactatcttgaggcaaactacacccaaaagctgggtagtagcgtcggccaaggcaatgcggacatctgcgcgcgctcaatcaatgcgatgggttcgatactaagacacaacatctatgctttgccgcacccaggtgttgatataagggatgtaacgccgcctgacccggacccgttggctccaatacggtactcctgtgttttttgggtcggccatctatgcaaagcaaaaagccagggctttgggaatgacctgaccgagggaggggctgtccttagagtcttcaaagagcattttctccactggctggaggcattgagccttatcggtgggatgtcggagagcatcaggcacctgaaggaattacagactgttgttgacgtaagtcactattcgagtttatgcgaacgtatgcttacaaaagtcatagtccgccaacgacactga

SEQ ID NO: 20207 - DNA, 444 bp, A.fumigatus
agactgcgcgcctctatcacgggtatgatccagatggacgactgtcctgtgccagcggagaacatgtttccggacgtcgaaggcctcaagggtcccttcacctgcctgaacagtgcccggttgggcattgcgttcggtgcgatgggcgctctggaggactgcatcgaccgtgcccgcacttatgcactggagcggaagcagttcaagggcaacccgctggcgaagtatcagctcatccagaagaaactagccgatgcagccactgatgcggcatatggaacgctggctgctactcaggtcgctcggctcaaggacgccggcaagagcactccggagatgatctccatggtcaaaaggcagaactgtgatcgagctctggcgaatgcacggctgtacgtgtcaccctttcctcaaatactgctgctgaaagttgaattatactga

SEQ ID NO: 20208 - DNA, 360 bp, A.fumigatus
cagctggtgtttctgacagtttcactggcaagcaacaatcatgggtcctgtaagtccccccacctcatttccgtcgctggtggcatttgtgccgcgagagagtttggatttaatgctgacattcctcttcgacagggtgactcgccatactcgggaggcgtctttttcctgaccatccacttccctaccgattatccattcaagccacccaaggtcaacttcacgactcgtatctaccaccccaacatcaactcgaatggcagtatctgtcttgacatcctgcgagatcagtggagccctgctcttacaatctctaaaggtattcatcgatgtgaaatgatctattttcgcaaatgctga

SEQ ID NO: 20209 - DNA, 186 bp, A.fumigatus
attatactgacacctttttcgatgcgtagacttcaggagattttcggcggcaatgcaaccagcgacgaataccatattggacgacacgtcgccaatctatttgtcgtgcagacctacgaaggacagagtgacattcacggtgagtacccggcgggatatcatagcctgtcatttcccacacgatga

SEQ ID NO: 20210 - DNA, 552 bp, A.fumigatus
tctacgctttgttttgggagcatccgtatattccctttctttgtaagattgtcaaagatctttttttcccctcctttcccaaagcagacgccattctcaattctttccgaacgtgtaacgcatgctcgtgtgtcactactgcgaatccagactgcccctctcccctctcctttggaattagatttgtttcatctgccaggctccggcgatcatcttacccctctcttggtgctgcacctaccgcgatcatcatccaacatgactgaccgcgatcgatcttcagggacccagtcttgtccgcctcccgagttgcctcaactggtcgctgaacagcatgtccctattcctcccaatgacaaggagacaaagcgcttgattgtcgtcctctctcatgccagtttggagacatatcgggcttcccatggtggtcgcaatggctcgggtcgggatgagaaatactcgttgctcaatagcgatgagcacatcggtgtgatgcgcaagatgaacagggatatcagtgaggctcggcctgatatcacccatcaggtttga

SEQ ID NO: 20211 - DNA, 249 bp, A.fumigatus
accttccaagaatatacagggcgagtcgactccaacgcagacatgcctctgtcccacctcactctgactgtctctcacctaccaacatcgacttccttcttcctctcctgcctacaacccctagggtatcagtttattggtcgtcacgatgactatattggatttggtcagaaatcaggcgagccggcagatttctggataacagaacagaagccagggtcagtattctttcggaacatcctgtcatag

SEQ ID NO: 20212 - DNA, 858 bp, A.fumigatus
cgaggacgaaatcatagatcgccagctggtgcagcacatgttgcttttcctgctccgtcgaaagatgctgtagggtcctttttcatcagtgcactgaaggccggcgcaaagattcacggtgaaccaaagacgcgggacacagaatcgggatactatagtgctgctgtgatcgactttgacggcaacagcatcgaggctgtgtaccgtccgggtatctctgctaagtcggaagtcagtgcatctccaattggcttgcttgagaatgggtccgttgtgtcccgagctagcacgaaggtcagctccgtcaagcctcaaagtatcgctccctctgtcaggtcagaggccaagtcgtgcgtctcaagggcgaccactgctgtagagagagtggcaccgtcagagcgaactgcaccgaccatcatctcgcgggaggttcagcaagcgccgtctcctacctatattgtcaaccatacaacccacaccacccaaaaaaaggacgacagcacagccaagacaatcgttggctcgctcatcggagcggctgcaggtgcagcaatcgcttatgcattgaccaaatccgagtcccagtcgcagtcctcggaggccactcctcctccgcagtacacaccccgggatttccctcagctggcttctccatcgcaagctccctcgctagctcaggaacatcaggactacagggcgattgatgctcctcccgccaggagcaccttctcccggtcagatgcgcgatccactctgactcgtagtgtctcttcgaagaatcctcgtgcgagcacaatatacgaaggcacggagttcgttccccctcgggggagaaaatggcagtgtgtacctcgatga

SEQ ID NO: 20213 - DNA, 708 bp, A.fumigatus
aagtgggcgtcgtgcctcggatgggagtgtctacacggtgaaggatatccctctgagagcgatcgagtatccccccacggcccgtttcaactacgtttcccgtgcaatcccagtactctcatcagcagcttcccggataagtcgcgattcaatgataaagagagcgtctattcagcatcgactgccaagccatccaaggccaaccatcaggatcaccactcttcccgccattcttcgcatcagtcagcggccagatccatggcggggagcacggcctcgtccgcacgaacggcccgtcaggtcccgctgcccgaagggtccgtgacatcctatgcgtcgtaccgcagcggtgcaaagtcgggtgtctctgcccgtgagatcccgcttccccagagcgtcgtggatgactttgagatccagaccaatatcacgccggacgattctataagccaggtcgatttctcacggaggtcctcctactcccaccaatctcaccgctccaaagccccctctcatgcctccaaacgctccagcaaattcgacgaacccgtccaaccgagcgatagcgtaagtcaggtctcgaccaatgtatccaagacgtcgcaaaggaccatcaaagcaaacggcagtatagctggcggagcctccaaggccccatcaaaggctccaaccacggtcagcagtcggagaggcagccaggttgcctga

SEQ ID NO: 20214 - DNA, 504 bp, A.fumigatus
tctcttcgctgtttctccactcgacagtgccttctcactcttctcgattcgccgatcaacaaagctggcaagctccaaatctacatccacactgcgaaaggtgtccttatcgaagttaacccatccgtccgcattcctcgtaccttcaagcgttttgccggtttgatggttcagctactgcacagactttccattcgttccaccaattctcaagaaaagctactcaaggtcatcaagaatcctattacggaccacttacctcccaactgccgtaaagtcaccctcagttacgaagccccagtcgtgcgggtcaaggactatatcgattccctgggtcccaaggagagtatttgtatctttgtcggtgccatggcaaagggccaggatgactttgcagactcgttcaaggatgatacgatcagtatcagcaactacagcttgagcgccagtgttgcatgcagcaaattctgccatgctgcggaggaatcatggggcattctttga

SEQ ID NO: 20215 - DNA, 213 bp, A.fumigatus
aagcagcagaagtgcccaaacacgaaccggattggagcatcggactcttcgagagagatcccctcaagctctgcctcactggccccatacgactactccggacaagtctgtctgtcatttactgtcgcaccacaatcatttggtgatctagtgggcctaatctctgcaatcaccctctcaggcttttacagtgtccgatatccaagtcagtaa

SEQ ID NO: 20216 - DNA, 300 bp, A.fumigatus
actgtcccaacaacgcttcttctgttaattccaccatgtctccaaaaggcatctcacttccaccctctcaaatacttcaggaattcttctccaaaccttctgtcttttaacgagcttcgcagtacaatcccgatggcctccccacatgcacagactgtgattaatacaatcgtccgacaaatccccacaatcacagctttcacagagatcgtttacgaagacgtcgctcctgaggacggggatcttattactcgctcgcttgctgagtcggccgtcgtcgagcagcatagcgcgaggtaa

SEQ ID NO: 20217 - DNA, 204 bp, A.fumigatus
aattcttctcacgcaagccaaaaggcaccttattctataacagtctataaacacgcaatatggtacactctatatctagacacaggacctattccgctcaagcaacaagaggcacatcctgcgagccaacattattcaacaagctcaagaagcagttccatcctatctcagttagcaagacaaccaaaccggagcaagacgtga

SEQ ID NO: 20218 - DNA, 936 bp, A.fumigatus
  unsure (167): Identity of nucleotide sequences at the above locations are unknown.
gaaagtgtactcggggtgcgactattacaccgcgaatccagactgccctggacgccatcagttcggggacagcgtctatcggtcattgcatcggggtccatcggcacaaacgtcttcagcatcagtagcggccagacattgaaaggatgcggacccatcgacgtggntaacaagcgcgcacgcggcgcgatcgagtcactcaacacagacggagtatccatccctaccttcaccatgaccggcaaccctaacttcgggatgcgtttctacggtgtcaaacgcctctctctcggcaacatcaccatgaagctgagcggaggactgggtatccggtttgaacgtgacaaggccgccaattccgacgtcagcatggacactatcacggttaccggagccggaagtcatgccgtcgagacctggaacattgacggcctcaccatcaacaaggtcgttgcgcgcgacgtgggcgagtgcggcctgttactgcagacaacgacaaacgcgaaggtgggccttgtggacggcgacaacgttgctgctgggactggctacgccactttccgcatggctaatgccaatggccgactcgctgatgggagctacaagacgaacgtgtttgtggacaaggtcgtctcgcgcggtggcggccgtggtgtcttttgtgtctcggagtcgggcggtgttgagatcagcaacgtggatctggctgacaatgggaacaatgctatcctcattgagaactgctatggggtgtcgattcgtggggggactgtgaagggcggtggtgaggtgcgactggcggctcgcgacgaatttaagaacaatcgcgatgtgtcgattacgctgaaagtgaatggaaacactgtgagggagaacccctgcggtgaaaacatcacctggaacatttccggtgatgccagtcttaatgtctgttag

SEQ ID NO: 20219 - DNA, 567 bp, A.fumigatus
cgactgcggttagttctacatcatgtgaaatttgaatcagttgttcattgcagacagtgtcttttcgccgttggagatagcctcgcccaacaagccgtggaaaaaaggggtatcgctcagcatgatgtggcccgtacgggacgaatggctttttatgggggaggtaacgttcaacccttcccttacaagttaccgttgctaacggtggtagctgttttcggtcccctggccacaaagtggttccaggtcctacagaggcgtatcaatctgccctctgcacaacggaccgtcgttggccgcgtcgcagccgaccagttactattcgctcccaccatgatcggagtctttctgtccagcatgtccgtcttggaaggcgggagtctcagtgaaaagttggagagatcgtactggccagcgctgaaagcgaactggacagtgtggccgttcctgcagctggtgaactttgcgcttgtgccgctgcagttccgtgtgcttacagtcaatgtgttgaatattggtatgattcctattcacgtcttgctccggtttggttgtcttgctaactga

SEQ ID NO: 20220 - DNA, 402 bp, A.fumigatus
ctcgtagtgaacatgctgttcaggaaacccaagttaccgcaggccaatcctgacgcttactaccaggatgacaatgtggcatccgacacacactcccaggcggccatcgcaggtgaggatggtcagttagtcgatactcatattcccctcttgacttggcgatcgttcgtcatgggtgtgtttgtctccatgggtggttttctattcggctacgacaccggtcagatctcaggtttcctggagatgaagaatttcctgcaacggtatggtcaaaagaagtcggacgggacgctctacttctccaacgtccgatccggattgatcgtcgcactggtacgtttatttgatctcctgtgccacgtgcatctgctgacgagtgacagctatcgattggaacattga

SEQ ID NO: 20221 - DNA, 486 bp, A.fumigatus
ccgggaatttccccgaacgggactcacaccgctggggtggtcatggtggtcttcgcctgtcttttcattcttgggttcgcgtccacgtggggtccaatggtctggactatcatcgcagagttgtatccatcccagtaccgagctcgagccatgtccctggcgaccgcgtccaactggatgtggaactttctgctagccttctttaccccgttcatcaccggtgcaatcgatttccggtacggctacgtctttgcagggtgtttgttcctcgcggccgcgatggtgtacttcaccgttatggaggggcagggaagaacgctggaggagatcgacacgatgtacgtgtggaagatcaagccgtggcacagctccaaatatgtctttcctgaccagacggatcgccgcgacgaatccgagaagcgcacggcgggcacgaatgagcacatggagacgtccggtgctcagccggagacagagattgtgtag

SEQ ID NO: 20222 - DNA, 1131 bp, A.fumigatus
cgagtgacagctatcgattggaacattgatgggagctttggtcgcagcacctattgcagatcgcataggtcggaaatggtcgatcaccagctggtcgttgatgatctgtgttggcatcactgttcaaatctcctctcccaccggcaagtggtaccaggtagcgctcggtcgttgggttgccggattgggtgtcggtgctctctccctcctggttccgatgtatatggcagagtccggccctcggcacattcgtggttcgttagtcaggtaggtcgtcgaatgtcgtgtgctgtcagatacagcgctaactattgcagtacttaccaattgttcatcacactcggcatcttcgtggcgaactgcatcaactttggcactgaagcacgacccgatactggctcctggcgtatcccaatgggcatcacctacgtctgggccctcattcttggctctggcatggccctgttcccggagagccctcgatatgactaccgacacggtaaaatcgacaaggccatcaccacgctctcaaagatgtacggcatcccaaagaaccaccgcgcgctgaatgtcgaattctatgatatcaatcataaatatgaggaggaagtcgctagtggtcaggtcacttgggttcacctcttcaaggccccacgtatggcgtaccgcgtggcggtgggtgtctccctgcaagcgcttcaacagctcactggcgccaactacttcttctattatggaacgaccgtgtttaaaggtgccgggatctccaacagctacgtgactcagatgattctcggtggcgtgaatttcggaaccaccttcctaggcctgtatctcatcgagaactatggtcgtcgtcgggtccctcatgccggtgccctgtggatgttcgtatgtttcatggtcttcgcctccgtcgccaacttctcgcttgaccgggaatttccccgaacgggactcacaccgctggggtggtcatggtggtcttcgcctgtcttttcattcttgggttcgcgtccacgtggggtccaatggtctggactatcatcgcagagttgtatccatcccagtaccgagctcgagccatgtccctggcgaccgcgtccaactggatgtggaactttctgctag

SEQ ID NO: 20223 - DNA, 264 bp, A.fumigatus
cagctatcgattggaacattgatgggagctttggtcgcagcacctattgcagatcgcataggtcggaaatggtcgatcaccagctggtcgttgatgatctgtgttggcatcactgttcaaatctcctctcccaccggcaagtggtaccaggtagcgctcggtcgttgggttgccggattgggtgtcggtgctctctccctcctggttccgatgtatatggcagagtccggccctcggcacattcgtggttcgttagtcaggtag

SEQ ID NO: 20224 - DNA, 438 bp, A.fumigatus
ttaagtcctgtcctgattttcttcggaggaatggttcagatattcggtgggattggggaatggatcattggcaacacattctcatgcgcgctcttcttcacttacggtacgcatgtccatattaaatccaaggcatggcaaaatatttatacattcgttacaggaacattgtggatcgtccagggaacgacgctcatgcccttgttcgatactggaatccatttctcgtccacgggcaacttcctcgagggacagcagacacccatgtataacgccagcataggtttgttaaacaaatggcaaatggcattggcattggctatggttgaccggttcaatagcattctattttgtggccctgacagtcataaccttcatatacatgatatgctcccttcgaaccaacgtctgcctcttctccgcgctcttcttgcttga

SEQ ID NO: 20225 - DNA, 612 bp, A.fumigatus
  unsure (458): Identity of nucleotide sequences at the above locations are unknown.
tgtgcaacagccgtccacaagcctcaaggtgtcacatcggccgacgtcatccgaacccttcagcaccattttaacccctccaagctcttcaagccctggctcgaagaggagcgcgcgcgacggaacagagagagcagctaccagcgcaacaggcgccgctcgaggcgcctggacgtcaaaatcggacatggaggtaccctcgacccattggcgactggcgtgctagtcacgggtgtgggcaagggtacgaaaagcctcaacgacttcctagggtgcacgaagacatacgaaacagtcgtgcttttcggagctgagacagacacctacgacaagctggggaagatcgtccgacgggctccgtacgagcacatcactcgggaggcggttgagaaggcgctcgagcagttcagagggaagatcatgcagcgtccgcctattttctcggcgctgaaagtccnagggaagaagctttacgagtatgcacgggaaagcaaggaacctccgattgagatccagtcacgccccgtggaagtgagcgatctgcgcatcctcgagtggtacgagcctggcacccacgaatacgagtgggcccagggaagaggctgccggtga

SEQ ID NO: 20226 - DNA, 192 bp, A.fumigatus
ttccataaggttcacggcaggagatattctcactgcaactgggcgatcagtaacaagcgatggctctatagccaaggcaattcggtcaactgcagtcatttttctgcgtttgatagttatatcagccaaggtgcggactatctatctaggcatttctcaatagcattaatgctccagctgaggtattgttga

SEQ ID NO: 20227 - DNA, 654 bp, A.fumigatus
gcgatctgcgcatcctcgagtggtacgagcctggcacccacgaatacgagtgggcccagggaagaggctgccggtgaggagaaggaagttgcggaaaggcttctggcgaaggatgataccctacccgtagctccggccgctgagaacgaagtcccggcagaggatagcggagaacaggagacatcaacaggtacaaaacgtaagacaccgccgcctgctgaggagcccgcaaaagacgaggaggacgctccttctgccactgataccgagctcgctccatcggcggcgaagaaacagaaaatcaccgccaatggcgactcagcgccggcgcaggatgagctctcagatggttcctcggaaacagttaccgcgtcagcaaatgaaccctcccctcaacctcctgctgtgaaaatcaccatgaccgtctcgtctggtttctacgttcgctccttggcgcatgatctcggcaaggccctcggtagctgtggtctgatgagctcgctcatccgaacgcgccaagcggatttcgagctggagtccgacaaggtcctcgagtataaagatctcgaagctggcgaggatgtttggggtccgaaagtcaaacgattcctagaggagtgggagaagaagagagcggaagcgaacaccaaataa

SEQ ID NO: 20228 - DNA, 3105 bp, A.fumigatus
cgcggacttgtttgtgtagcccgaaccacagtgcagtttcagtcaatcttggacaagttctcgccccatgatactgtattctccttcacaaagtcagcagatcttaccgagagtgcactgtcttctgcgtgcctgttacatgctgcgtcaggttctatcacctcctcttcaagctccctccgccgtcgcaggctgatggaaattgctgaagatgcagaggaaaacaatacgaccaaggaccagacgcaggtcccatctccacatccggacaatcgacaaaggtcaaccagccatgtatccgaagccaccgtagtgcccccatcagtcacttcgaacgctcgagaagcccccattggcgacgaatcgcccaccgtcgcaaatatcacccacaattcccaagccagtgatcaagtgtccatctcctgggatagcagatccgagcgccccgcttcacgacgaagacttgaggatgacatatcctacgcaccatcggagtcgcggaggtctacacagtcggccaggccgtcgctcagggacctggagcgtgcgactacctacaccccgaaagtcaagcgtggtcctcgaccttcagtagacgggagcgggcgtcctcgcacggcaagtaatctgtctcgaaactccgagcagcgggcaataacctctttaccagctggtgttaggacatcatcgctacggaaaggcaacccgagcccaaaccggccccgttctcaaggaagtccagtggcatccgtttccagccgaacagccccccctgtgccaccattgttggtcccaccattgtcaatgccgatttcacgggcccagttgtcacctggtgctaaatcactgagtgctctctcttcgtccggcacctcaaacgaaaaggaaaggctgatgaaagctctccagttgcgaaaaactcagatggaaaagcgtgcggcggagagcaaaaaagatggaaagacgaaaaatggaagattgaccgatgttgacgagaataaggagaacattgatcaggctgatgacaagtcgaagcatgatcaagaaactgcagcagtggccgagcataccaaagagctttgtcttaagacgcagctctctattaagcctggatcaatcgcactatctgaggaaaagcttgcccctggcgaaaagcttgctacgtctgactccacaaaacccgattcggccgtgggtatggaggtctccaacttcgatgacgaacagcttctcaatcagtcgctcctgaacgcggacaacgctcttatagccaatccggaagaatcgtcggagacagcccagtttcacgcatctcaggtgtccccggaaattgaagcggtcactaccgtcgaagacttggctgtgtccgttgacaacgacactaaaaatggccccggcttgcctagcgccgacatccacgtcccaccccaaaactttgaaaaagctgcaacagagaaaaaccaacaaattgttccctctccttcacatccggaaaataatcctgttactggctcggacgaggctttagcagtgaccaatccggccgattcaatcctgccccaatccattcctattcccgactcgccgacttccaattcgcggttgagctccactcctgaagcgacggtaattgcaccttgtcccgccgagccgcagaatgagttgatccctgagacctcgaatgcggattcgaagaacgtgaaccctcgtaaagacaagcgcaaacctcagctcgagcctattcaggtccccactccagactattctgatgacgagaatctcctttcggatgattccttcatggaagaactgaagagcgccactgtcgaggaagcgaagcctgtttcggtcggaaagtcgccgttgtcgccagtctacccgaataacaatgaccagataagctctcatgcttggaagaattcacgggcagtttcgaacccgagcgccctggggcaccgatttcacagcatgcagtcactctctggggagagatccgtctctggtccttgtggagacgtggatagcgcagcaggtcctgtgcttgtggccaagaaaatcaatgtatcttcgggaatctcaaagcgcatcaaggctctggagaagttttcaaacagccgcgaaacatcatctaactcagggttgaatttggctccacctactgcatcctcttctttcgaagctctccgaaagcgagcatctctgtcattaagtggggccaattcagacgcaagctcaattttccggcatggctctcataccccagaaactttctcccgagcccctagtgttaaacgtcgcgactcacaatctagtacgaatgctgcatgcaccacgagctcaatttcggtgactgcccggatagtccgcgacgcaaccaatgcccctagcgattcaaaatcagacctcccggactcgggcgttctcaatctccaagccagtcctttgaccgtggaacgtgggcctcctgaagagacgattaccaaaccagaagaacgtagtatgtcttcgtcttctgcgacttctggtcaccagtcccgggccgcttcagtgtcacgatctgagagcagattgtctgtctcctctgcctcgaaaaaggaagatgcctttttgtcgaagtcgaccagcgatttatcttcgtcccccgaggagaagcgggcctctcgcgcttctcgactcctccgccgcatgtcatcgataacgtcaaattcaaagaagagcgtcattggggcattcagtccttccgtcaaggaagaagaaagcaaaccggtccctgctgagaagccgaagactagcgtgagcagcgcggcaatcgatgtcggcgaggtcaatgttcagttccctgacaccctcctctggaagcgccgattcattcggatcgacgacaaaggatatttgatattgacccctggaaatgtcgattcaagcagccgcaacatggtcaagcggtaccatttgactgagttcagaacaccatgtataccagatgaagatcgtcaagaactgcccaacagcattttgcttgacttcttgaacggtagcaccctccagtgcgcctgtgaatcccgacaaggacaagcctttgttctccaaagtaagtcgttataa

SEQ ID NO: 20229 - DNA, 411 bp, A.fumigatus
ggggagggttcatttgctgacgcggtaactgtttccgaggaaccatctgagagctcatcctgcgccggcgctgagtcgccattggcggtgattttctgtttcttcgccgccgatggagcgagctcggtatcagtggcagaaggagcgtcctcctcgtcttttgcgggctcctcagcaggcggcggtgtcttacgttttgtacctgttgatgtctcctgttctccgctatcctctgccgggacttcgttctcagcggccggagctacgggtagggtatcatccttcgccagaagcctttccgcaacttccttctcctcaccggcagcctcttccctgggcccactcgtattcgtgggtgccaggctcgtaccactcgaggatgcgcagatcgctcacttccacggggcgtga

SEQ ID NO: 20230 - DNA, 207 bp, A.fumigatus
aagaacccagatctacgtcaatcgcttaatgtgatgcaggataaggatgaaacgagctgccacgctaccaatacctcactggcgcaatcaccgtgcttaatatctcgactgccttcgtctttactaacagatatccttgattatgaactttctcccatgctctggagcttcgacctgcggtcactgtacccatatatccagtcatag

SEQ ID NO: 20231 - DNA, 2355 bp, A.fumigatus
cgaattgctcgtccaataccacgcatcctttgctggtttcccaaccaacgtaagccttacctactgtatttagtttctggaatagacctaatatgggtacatagcaccccgaactgcagtcttggttcgccggaatatgccgacacatactcacgcgacagcaagagaaccactattttgccggctagagctagaacagacagctgtgtcaaaccgctcaagatcgccctgatgactcaccaggtggaaggggtgacttggatgaaatccatggaagatagtgagtggaagggaggaattcttgcggatgacatggggttagggaagaccacacaagccctctcgctcgtcaaatcacgaatttgccccgatgcgcggacgctaccgactctcatcgttactcccgcgggattgatccaccagtgggagcgtgagaccgagaacatctttggttcaggccagcgtgtctttgtgtactatcggcggaaaggccggctgacctttcaggatctatgtcaataccatgtcgttttaactacctacgggaccctctgttccgagttgaagcagaaaccctacgactcaccgatctttggagacggcagggcgtggcaacgcatcattctggatgaggcacaatgcattaaaaacgctagatcaaagactgccatggcctgttgcgaagtcgcggccacctatagatggtgtcttagcggaacaccactaatgaaccacctgggggagctctactcgttattgaaattcttgaggatccaaccttacgttaatactgacagcttcaatagtgtaagtccgataggagagatcgtaactttaacatgcctttgcatcctactaatatggttgaagattctcaaatcggagtctatcggtagagggaatgacgctgagactgcgagagacatgcagctgcagggttttctaaagaccatcatgctgcgacgaacaaagtcgacgatcctcaacgggagaccgatcgtggagcttccttcggtaactatagaggacgtatatgtggccctcacggaggaagagcgatgcacctatgctgtcctggaaagctttacacagcgccatgtgcaacggtatcttaacaatggaggagaacagcggaaaattcctaatgtgctgagcttgttacaatacctccgccaggcttgctgccatatacttctcctttccggtgcagcacttaccgctcttcaatcatcaaggagcgaggagcacttggcggtaaacgcattatgccttcccgaggaggtcgtcactcgtctgagagataacgagactatatctcaatgccctgtctgtttagagagagcatatagccctattattttctcgccatgcggacacagtgtctgtctggcgtgctttgggaagatgtgctccacaactgcgccggagggagcaagtaccgaagtgcccgtggggtttcgctgccacagctgtcgcgtgaccgttgatttacaaaaagtgacagactatagctctttcgtgcggagtcacaatttctcgtcgtccaaccaaggcagttcaacgctctttccttcgtcgctcaaagcgctccttggactgaacgacgagggtgacgaagacgatgaagatagcggcagtgggatggacattggcttggaggcttgccgcactgaccacgttattcctccccttcggtacggggtggctccgtctgagatgagctgcgctggcaagcaaagctctgcagcgatgagaaagcaagtttgggagaaccacgaagcgagggtggcatatggacatgccttaccaaggaagtgggtgaacagctcgaagattgaaaaagctgcggagatcataaaggcaatcagagaccaaggaactggagacaaggtcattgtctttagtcatttcactgccctcctagatctcattgaggtccctatcgcgaggagcggctggaaataccgtcggtacgacggacgtatgactccggcagagcgcggctctgcaatttcaagtttcgcctcgcagccagactgtttggtcctactggtgtccctcaaggctggaaatgcaggattgaatctcacatgtgcatccaacgtcattattatggagccctcgtggaacccgtacatcgaggagcaagcgatcggtcgagtgcatagaattggtcaagaaaggcatgttcgtgtctaccggcttctggtagcagacacgatagagatacgcattctcgaactccaggagaagaagcgaaagctaataagaggtttctcgaacggcgccgtcatgttgggcactgataacctgatcaggggagatattgcttatatttttgtaagtgaaaattga

SEQ ID NO: 20232 - DNA, 303 bp, A.fumigatus
ggcaggccattgtgtagagaaattgtgatagggccggcacattctcaacgaggagcccgagtttttgtgatcattgttaaggccgccactctcccgagccgcacacgctatgcattcctgttaattttgagcattggatttatactagtgaacacaccaggatccgaatctcgatgtcaacttttacttgccaatatctctcatgtgaatgtcgttgagtgctggaacaattctaagctctccaaggctccaggtactgtctctataagtaacaatatggttactactgaatatccgttatga

SEQ ID NO: 20233 - DNA, 201 bp, A.fumigatus
gttgtgcctttccacacattcagagggaaaaggcggcccttatatattcgtgaaatccatcacgtgatcggatgtccggtcctccggtccttccactacggtctagcctcctggaaccgcggaatatggtgggtccccaaggccccgcttgacatgatcaactccagcaacgcgttcaacgtttctttcactactgactga

SEQ ID NO: 20234 - DNA, 2370 bp, A.fumigatus
ctagagactcatctcggtgacgaagatacgtgcgatcgattgggtacactcataaaaagctactatgagagcgccgtcgggtcctacgctcgtaacccagaagcattatcgattatgatgctaaccgccttggagctgtggattgcatgcgacaagtcggccacccggattcacacagtcctctgtgattatgatgcctgtattccaatggagatgtttgagtcacttctactaccgttccgatctcaaatggcaagacttgaccgtgcggagtcttacttgcggctgcgcaagcagcgagcgatccattctgggcccggtgtttttcgagattacgggacaccagcctgtttcgctgtcaggtatttcgaccagtctgagaaacatcagggactgcttaacacaatcgaaggctgcgctcggcgggagagagaagagaaaaaggccgagcttcgtcgaaagcgtcaacaatgtgccaatttgtacgcattgtatgatggaatgcaatgcacttacgaagaagtcatcattgacgagcgcttcaacttccgagagtctcgacatagcgtctcctgcaaacggtgcgagtataagcgccaagcggacgcgatgaaagtgagcgtccacgaatggccacttcctagtaatcgtttacaagcaaagtccacggtgttcgagctggacgtacctcgccccttcggatgttggcgtgatataaccatatttttccttcttgatgttttgaacgttcaatatacctccagggatgcaccgagggccgaacacacgctccagaattaccgcggcttgtcgtcctttttcacttctgtccaaggcgtcgggcgagtcggccttctatcacagaataaaccgcacgaacggacacatcggctgaacaagaaagttctcaacgtgacagaagacgaagtctgcgtgaacaacggcttgctcttcaaatatttcgatttctcgacgcggacgttcgtcgggaattttgggatgtcggacaaaattgcaggctcatgcatgtataagttaccatccaggagtacgtccttacagcagtttctatttcggccatcgggcaagcaagatggaccatcgcccaatacagttattgcatcgcaggatggctgtccggtgggtatgtcgcttgaggagtacagatccctgtgtacgatgccacttgggatcgaaatccagtggcaaaatattcttcggcagctggctatgccgtcgatagatctcaagaaggcagaggcttgcatctttatcctgcagatcatcaaccaggttggcccatcaaccgcgagattggttacgaggacggcacatgacatcttaaacgacactgcgtttacaaccgcgctgttaggacgtattcaagacatcgcggcgagactagaggagaattgggaaatggcacaagggctcagcgctctaagttccttggttctcagagttttgaccctatcgccctccgcagacatccaggagatatgtctgaatacagtcaagcatctgcgcaaaatctccttagcatgggttaagattgttaccgagaaagccagctctacaactgacgatagacacagaagcgacctgctactgcggagcggtcatctagcgttaatatgcgccacaacgttcgatgctgaagacttagccttggttcgaatgcttgagaatacatacgatactgcggttttgcttcaatgctgtatggtaataaatgacacacggcgtctcctgtgcgagggatccggctcccctttaattccgatcctatatcgtcgctggcaaatcttaagttatcgcagcttgccggtcctgaagcgaaatatcatccagcgcgcgaattcgccgctagatagagctatcggaaatatatgggcaacgtaccgtgctgggtcctactgggaagcatccccagaggcgccgatctgttggcttgtcactggtattccatgtcaatccggacatgggatagatttacccgttcattataacctcttaacgggggagcttctcgtcaatggccttccgttggctcgactgccctcggaatatgagagacatgacacatacagaacccttttcggacaatcttcgttggaggtgatgccgagtgttataccggggatgcatttcgcctgtcgaaagaaatacatggggcacaccgtcaacttagcgaggaaaaggttgactggcagtgaggaaattgatttgtgtattcaagcgacggaagagggccacacctgggagtttatacctcccagacttctgatggactccttccccgacgcttttctagcgggctacgtgcactggtacgatgtccacaatggctatgtggaatttcggccctag

SEQ ID NO: 20235 - DNA, 4236 bp, A.fumigatus
  unsure (4223),(4226): Identity of nucleotide sequences at the above locations are unknown.
tttgtgtattcaagcgacggaagagggccacacctgggagtttatacctcccagacttctgatggactccttccccgacgcttttctagcgggctacgtgcactggtacgatgtccacaatggctatgtggaatttcggccctagaaaagccttggatatcatcagttttcaattggagactacagaagaccagcgcgcgcgatccttggcggctagccaaagataatttatttttggtaagcgtgaaaagtagaaccgcagaagtgatttccgccacgttgcagtcgatcgaaaagccgtccaagttgtactgcactttcgattccacaacttcaagtttaggaatagaacttccccgtcttcggctacggtttgaactcaaaccgcggagttccgcgatccagtcgcgagagtatcagggcatgttaattgaccctgaccagtcactggatacgttggtcggcttgcgcaacaggctcatcctgcgtcatgaaagcggtggggatcgagtggtcctaataccagaaggacaggtttcctggtataaagataacggccacattgctgtggagatcggctggcaggcagcgaccaccctccacccttacccagtggacaatctgctcggtcgcctgaccgacaacggcagcttgcacagcagatcaatgctgtgctatttgcatgccctgacatcatcctgtctgccagacccccttacccagagaacaggaactgagcaagctctcaccatccttcggtctgcatcgatgcgctcatttgaccggctccacccggaggcaagtataattctcgccaaaattgcagagctgacaccagaaaggcattattatccatccaatgagcgagttatgcaaaccgttcgatgggacaagcacctcgggttcctcgcccagcatgatagtttctacaaagaggtcaaggcaattttcgaacacgacaaccgaatgaggatgtttcatccgaatgagcaggtgaaacaaccaacgatgcctaatatagttgccgatttgctgagacggaacgaaattcggtcgtcctcttttcgcgtttctggctttggggcagaggaccacacggttgaatatgaccggccatacgtaggtcttgatctgaatcgaaactcggcaagattcttccgtgtctacagcctgtgcagaattctctatgaggaaatcccctcagcccgggagatcttacatgtggacttactttcaaaactctggcagtctctctctcaaactcacgttgtccacgccgccagtctgccagttgatagtaacaagatacaatacgatgcagcattgatactggagccaatgacatttgtatctagtcactggtgtagccttcatcaactgctctgctcaagagactctggactgagtaagtttcagttgatggtatggttggcgaccttggcattctccgatagctccaatatgttcgtccttgaaatccttgcttcactctacgttatcccagagatggcagagctcacactgccttctcgcggaccgtttcagctttggcatgggtatgaggtggatgaggcaatattggggtctcggatccgtcagtcagccgttctctcgcacaccccagaatccaatctacatcccctacccaacgagactttgcaggtgttccaagcccgaaaaagaagaatcgcaaaacggaaccggacattggctcttcagacattcataagaggcttgaaagatcagtggccgatccgatctcttacaatacccccccaacaagctggcccaagatttggagactactacggaacacacacagccatgactcaggttgctgagagttttcagatatggttcgacaatagagagtttcgatcatatctctcagatatctcgtctctcttcgtcagccaaatagtccatcctgttcagatgccccctgtctccgtcccaggtcaagtgaaacagacaaccacacgccggggattcatccgcattgacgacctgcttggtcctgagccaatactggacatggagcgtccacgtttagttggtctcctaagtagccaccccgagtatgaggaaccagcacctcgcctcatggccttcgtcgattctttagaactgcagtcaaagtcccaatacgagagacgttatgtagagcatctccggggcagcattagttcactacagcagaagaaaagaagggataatattacgatggactctaaacaacttggggcagctcttctcgactactttcaccgttgtgaaatgtactgtgagcgcatatacaactctataagggtgcgtttgacgcgttttgatgaaacgcttgatagcccccagaatagtctgcttttggaaacagtggccggcatcggtaattggccgagaatttcaccatatcttctggttcagcaactgacgcaccaacgatggctttttctacccgagcgttggaaagccagcatcgtcgagtatgggtgtgcaatcacggcgcttcagcaagcaagacgattaaccactctagttagtttccgtgacgatttgattagagaactccaaaatccgggccataccaactgggatccgcaccagtaccccgagtcctttctcttggagattgaaaacaacatattgataagagatgtccaggaacagattgcgcgggagatgagagatatcagttcaggcaggaatgcagtcatgcagctgaatatgggtgaaggaaaatcatcggttattgtgccgatggtggctgcccaccttgcagacggatcacgcctggtccgcgtgatcgttgcgaagccccaatcccggcagatgttacagatgctggtatcaaagttagggggattgttgggtcgaccagtttatcttatgccagtatcccgctccctgaggttaacggtgacggaggcagatgcgatattccacatgtgccagaattgcatggaagggggaggcgttctcctagtgcaacccgagcacatattatctttgaaactgatgtgcctcgagtgctttgtcaccgggagagatgcaattgggtgttccttgcttcggactctcgagtttttcaaggagtacgcgcgggacgtggttgacgagagtgacgagaactttagcgtcaagttcgagctcatctatacaatgggggttcagcgcccgttggagctcaccccacaacgatgggtgatcgtgcaagagctccttaatatcatgagggtgattgcgccgagtgtcaagcaggactatcccaggtcaatagaggtggaagagcgatcggtgggtagctttcctcggatacgactgttgcaaaatgatgcggagctagaactattcaggcgggtcgctacgcacgtatgcgatcacggtattgattctctaccggttttcagacagtcaagagcagtgagaagagctgtacttgcttacactctgaagcaggagttgagcttagaagaaatcacttccgtcgaggaagaaggtccagcaggattctggacagacacaacaaagagtcctctactcctgttacgaggcctttttgctggggggattttagcattttgtttcagtcagaaacgatggcgtgtgaattatgggcctgatcacgcaagaaaccccccgacaagactttcagtcccctaccgagccaaggactgcccgtctccccggtctgaattcagccaccccgacgtggtcatactgttaacatgtctaaattactactatgccggcctcggcgatgaggagctgtttctggcatttgatcatcttgttaagtccgatcaagcagagatagagtaccaggcatgggtggtcgattgtccgtcccttccgcacacttatcgtcaattgggcggggtcaaccttgaagaccgacaacactgtgtgaaacaaattttcccctggtttcgctctgcgaaaggtgcaattgattattttctggcccacgttgtttttccaaaggaactgagagaatttccagacaagttatcagcctcagggtgggatatcggggaaatcagaacccagccaacagttggattcagcggaacaaatgattctcgtcagacccttcctctaagcgtacagcagttggatcttccggagcaaagtcatacgaatgccttggttctcgattaccttctgatgcccgagaactcggtagcgctgtcttcaccacggggctggaagagagccgtgccatnggnagtcgacgac

SEQ ID NO: 20236 - DNA, 519 bp, A.fumigatus
atgagacggtcttctttttggcagcggtttgtacacacatatccgccaatacctcatataaagagagcctcccatgcctcaaaaagcacatacgtccgccatcctgagcattcatctacttgtcctaccagcgaacctgcgttcattagaatggtcttgcgaaatctgtccgcaccctcactagaggcgctctgttccaaggagcaaatagagctcttggactccattgatcatctccgtctccagggtatcaatcactacatctccttacctcagattatcgtctgcggcgatcagtcgtctggtaaaagctctgtgttggaagcaatatccggtgtctcctttcctatccgaagcagtctttgcacccgattcccaacggagcttgttctacgcaaaagtagccaggtcggcgtttgtgtatctattgtcccacattcgtctcgtagcgaatccgaacaggaagcgctcgcccattccacgaggagcttgatagctttgagggtcttccccaattga

SEQ ID NO: 20237 - DNA, 1584 bp, A.fumigatus
cgaatccgaacaggaagcgctcgcccattccacgaggagcttgatagctttgagggtcttccccaattgatcgagaacgctaagtccgccatgggcatttacaccaacgcgaaatccttctcgaatgaccttcttcgggttgaggtatccgggccagaccgtccacatttgactatcgttgatcttccggggttgattcattctgaaacaaaacagcaatcagcggccgacgttgaattggtccacgaagtagtgaagtcctacatggaggagccaagaagcattatccttgctgtggtatcagcaaagaatgatgttcctaatcagattgtcctcaagcttgcccgtgcagcggatccgtacggtacccgaactttgggcgttatcacaaagcccgacaccttggtccacggctcagacagcgaagcccaatttgtgtcacttgccaaaaaccaagaggttgaattccgcctaggctggcacgctttaaagaatatggacaccgaaaagggcacatggacgcttccagagcgagacaaagaagaatctgcgttctttgcttcaggtgtttgggaagctttgccgcggtcccacgttggtattgatcgtttgcgtgaacgtcttagcaagctcctcctggctcagatagccacggagttacccagtctgatggaggagatcaaagctaaaatggaagattgtttgcagaagctggagaagttaggagagccacggacgactcaggaagagcagaggtcctatctttttcactgcagtcagtctttccagaatcttgtgaattctgcggtggaaggaacctatagtgaccctttcttcgagaatgcaaagtcggaaaccggatacaagaggaggattcgcgccgttgtgcagaatctgaacgagcagttcacgtctcgcatgaaaaggagggggcattactacgaaattgacgacgacgtggacgacgaggacgaagactcgttgggaggccaacttttcatctctcgagagcattacattcgtcacgttgaaaatctcctgcggcgaacaagaggaaaggaactcccgggtactttcaatccgatgattatcaacgacctgtttatcgagcaatctcagccatgggagagaattacgtctgaacatgttcgtgaagtttgggaggccgcgaaagccttcgtcaagatcgcggtgactgaagtcactgatatgagcacctcaagtgccatactgatggaagtgttcgacccgagtctcgatagcgttcttaaatccttggagaacaaaacctgcgaaattctccgcgcttaccgagaaggccacccaatcacctacaaccatagcttcactgatagcctccaacaaacgcgccaggatactttaatgcccaagctctcttatacaattcggaaattctttaatgtacctcaactcacgtcctcgcaaaatattgatggtacattcgaccttcttcatctccgtgatagcctgttagaatcttttaaggcggacacggcacgcttcgctgcgttgcaagctctagattgcatgagagcgtactacaaggtcaggcgacaatcatga

SEQ ID NO: 20238 - DNA, 1533 bp, A.fumigatus
tttcaggggcaagtcgcccgtcacggatccgcattggaaccacgaggccactttgtatgtttcctcaccccgtcgcttgtattactggctaaccagaacagtgacgtccttggagaagagtcggagatcgatgtttcggtttatgatcgcaacaatcaggaagcgttccttggacacgtacggctgtccctgaacctcaaagaagaccacagtcggttggagggctggttcccattgtcggcgcgcggagctggcgattctcagatctccggcgagattcacctggagatgctcttcgagaagacagagaagaagcaggtgggaccaaatgactttcagattctgaagctcatcggcaaggggacgtttggacaggtgtatcaggtcatgaagaaagatacgcaccggatctacgccatgaaggttttgtcgaagaaggtaatcattcagaagaaagaggtcgctcatacgttaggcgaacgcaatatcctggttcggacagccatggcggcttctcccttcattgtcggcctcaaattctctttccaaacacccaccgatctgtatctcgtgacagactacatgtcgggtggcgaactgttctggcacctgcaaaaggaagggcgctttcaggaggcgcgggccaagttttacattgccgagttgattctagctctccaacacctgcacgaccacgatatcgtttatcgtgacctaaagcccgaaaacatcctgcttgacgctaatggacacatcgcactgtgcgactttggtctttccaaggccaatctgacgcagaatgataccacaaacactttctgcggaaccactgaatatcttgctcccgaggtcttgcttgacgagcaagggtacacgaagatggttgacttttggtcgcttggtgttctggtcttcgagatgtgctgcgggtggagcccattctacgcggaggatacccagcaaatgtacaagaacatcgcgtttggcaaggtccgcttccctcgggacgcactcagcacagagggtaggaatttcgtcaagggcttgctgaaccgaaaccccaagcaccgcctaggcgccaagggagacgcgaaggagctgatggctcacccattcttccatgacatcgactgggaggcgctcgcccgcaaggatgtcatcccgcctttcaagcccaagctcaagtctgacaccgacacgtccaacttcgatcccgagttcaccaacgctcttgacaacagtgcctcgctgaacgatcgcgccgctgcgttagctaatggattcatgcccgcctcgacgccactgtcgccaggaatgcaggccaattttaaaggctttacctttgtcaatgagaactcgatcgatcaccacatgaagcacgacccgagcgaccacatggacgaggatccggagacgtggcagcgggcacaccaccgtggcaactccgccgaccagcgcatgagtggtattaacaagaacaacgacggcggtgagccgggcatcttcaacgttgatgataattttgatatgtga

SEQ ID NO: 20239 - DNA, 1443 bp, A.fumigatus
aacaacagtctgcaggacgacgataaccaagatacaattggttccaatcggtcgacaccttctggcattgcaactcccaagccagatctctcagacaaacgccaaccatccatcatgcacagttatttccaggttggtctctcttctagtgatgacaaccgctcttccaagtcatggcttccttcttctgagactcttccttccaccaacggtatccagccgggtgcacatgccacagatacacgggatggtcaaggctctgggcataattcatcttctgcgggatcgtttgtcatgatggagcgcgacgaggcttcggacatgaatgcctctttagattgccctgacaagaaatttgatacccaagaaatttcacaggggtctctgcctcctacgaatctgcccactcccccttattcctccgcctgttcccttttgcagaaagagtcggaggaagctgagttggcatctttgacccccgagaagggcatgggttctattttcactgctttgaagagctatctcgctccgtgcaccgccaccaatccacctgaatctcaagcacgtcgtcatacctcccatccagtctctagcatctccgacgaccccgtccttgcctctcacttctccaacccttcactacctgcttctgcagattcttttattccgccggaaacccccctacttgatcatgagaacccacatgttctccacctcatcctgaagaccctcgcgaagctaactggaaatttgtctgatctttctcatcaaaagaacacacctccgctcacccctcgcgccatgtccaacgaaactgctaagaacccgcctgttacatcaccgtcctcatcatcatcatcaggggcacacccttcctcggagcagccacaccccgataagatggccacgtccgccgacgaaattgcgggcaaactcaacgatgcgtttccttccccgtcagagactccgaaggcagagcaacaatctggcccttctgtcggctcccttaagggaaaactctacgtcaagattactgaagcccgcggtctcaggccgggctttgatccgtatgtggtatgcgtgttcgagtggaacgaggtcatctccaagagtgcccaggatgaggaagaagcctccatcgagcgccgagagaaggaaaaggagaaatccgagcgcgaggcggggcggccaatggcgattccgatgaagagccgccagagcagcaacaacagcgcaatggagggtcatgatttcaggggcaagtcgcccgtcacggatccgcattggaaccacgaggccactttgtatgtttcctcaccccgtcgcttgtattactggctaaccagaacagtgacgtccttggagaagagtcggagatcgatgtttcggtttatgatcgcaacaatcaggaagcgttccttggacacgtacggctgtccctga

SEQ ID NO: 20240 - DNA, 591 bp, A.fumigatus
cgttggcggggcgaaggtgacgaccatgccgggcttgatgataccggtctcgacacggccgacagggaccgttccgataccagagatcttgtagacatcctggaggggaagacggaggggcttgttggagggacggacagggggctcaatggcgtcgatggcctcgatgagggtcttaccagtgaccttgccggccttggtctccttctcccatcccttgtaccaggggcagttggaggagggctcaagcatgttgtcaccgttgaagccagagatggggacgaagggaacggccttggggttgtagccgaccttcttgatgaagttggaggtttccttgacaatttcgttgtaacgatcctcggaccacttgcaggtgtccatcttgttgagggcgacgatgagctgcttgacaccgagggtgaaagcgagcagagcgtgctcacgggtctggccatccttggagataccagcctcgaactcaccagtaccggaggcaatgatgaggatagcgcagtcagcctgggaggtaccagtgatcatgttcttgatgaagtcacggtgaccgggggcatcttcagatcgtgttag

SEQ ID NO: 20241 - DNA, 522 bp, A.fumigatus
tatttttcttcaccaactttccatgaacccatctcaccaagttcaaaggaaaaaaaacccaataaacttcatgcaccgactgtaacctgctttggtgctctccgctacccgatcggatccatcctccttcccgcaaacttccttagctcgtcattgcccagcgacgtcgtcacagccttttttgtcgactccgctacacacaacctcctccatctaactatctcagccacgaacttcttcgcctccaaccccaccatttcggctgagtcgattcgagtcgcatcaattcttccgttcttttttctcccttttcgccagatcacctctggactcgaatggaatctccataatggccactgctcagagcggaacagatttgtctgcagatgtggatttggtaaaccggccggtatcgcagaagtgagtaatatctactttatttatattgctgctgtttcgtctccccgtatttacatccaacctggggggaaagaatctgctgctttaaaatatggggtttga

SEQ ID NO: 20242 - DNA, 183 bp, A.fumigatus
aggctaacacggacgtgttcgttctgcattacagcccagtgcccagccgaagattgcaatggtgatcgtgcatacttcttccagctgcagattcggagtgcggatgaacctatgactacatttcttaaggtgagtgtttatccgccacagtcatgctggcagctgcatcgtgcgcagtgctaa

SEQ ID NO: 20243 - DNA, 549 bp, A.fumigatus
tcactggtacctcccaggctgactgcgctatcctcatcattgcctccggtactggtgagttcgaggctggtatctccaaggatggccagacccgtgagcacgctctgctcgctttcaccctcggtgtcaagcagctcatcgtcgccctcaacaagatggacacctgcaagtggtccgaggatcgttacaacgaaattgtcaaggaaacctccaacttcatcaagaaggtcggctacaaccccaaggccgttcccttcgtccccatctctggcttcaacggtgacaacatgcttgagccctcctccaactgcccctggtacaagggatgggagaaggagaccaaggccggcaaggtcactggtaagaccctcatcgaggccatcgacgccattgagccccctgtccgtccctccaacaagcccctccgtcttcccctccaggatgtctacaagatctctggtatcggaacggtccctgtcggccgtgtcgagaccggtatcatcaagcccggcatggtcgtcaccttcgccccgccaacgtcaccactga

SEQ ID NO: 20244 - DNA, 501 bp, A.fumigatus
ctccaagaacgatccccctcagggtgctgcctcttcaacgcacaggtcatcgtcctcaaccacaccggtcaggtcggcgctggttacgcccccgtccttcggacttgccacactgcccacattgcttgcaagttctctgagctgcttgagaagattgaccgccgtaccggcaagtctgttgagaacaaccccaagttcatcaagtccggtgatgccgccatcgtgaagatggttccttccaagcccatgtgtgtcgagtccttcactgactacccccctctgggtcgtttcgccgtccgtgacatgcgccagactgttgctgtacgttcgcaaaattcaccctcaatcaaagatttgaagctgacaagttataggttggtgtcgtcaagtccgtcgagaaggccgccagcggtgccggtaaggtcaccaaggccgcccagaaggccgccaagaaatagagggctggagagtgaaaaattttgcttgaacaatcttctatga

SEQ ID NO: 20245 - DNA, 501 bp, A.fumigatus
gccccctgtccgtccctccaacaagcccctccgtcttcccctccaggatgtctacaagatctctggtatcggaacggtccctgtcggccgtgtcgagaccggtatcatcaagcccggcatggtcgtcaccttcgccccgccaacgtcaccactgaagtcaagtccgtcgagatgcaccaccagcagctccaggagggtgtcccgggtgacaacgtcggtttcaacgtcaagaacgtttcagtcaagaaagtccgccgtggtaacgtctgcggtgactccaagaacgatccccctcagggtgctgcctcttcaacgcacaggtcatcgtcctcaaccacaccggtcaggtcggcgctggttacgcccccgtccttcggacttgccacactgcccacattgcttgcaagttctctgagctgcttgagaagattgaccgccgtaccggcaagtctgttgagaacaaccccaagttcatcaagtccggtgatgccgccatcgtga

SEQ ID NO: 20246 - DNA, 225 bp, A.fumigatus
gcgattccaagctatatcactgactcaggctcaccctcaacgcgcagctacagcgaaaccaccaaccacaccaaatccactttatttctcgaagaggttcatcatcttgaggctacactagaagctatgtatctatctaaaagaaaaaaaaaaaaaggaaacaactattcttatctactgcatctgctggtgcagcagataccttattcttttatatgtatttag

SEQ ID NO: 20247 - DNA, 186 bp, A.fumigatus
tctccaaattcaaaggtcgagattattgtgccttatcaattcgtcaagtcctacctctttcccctcttcatcacgcatatcgacacatactccattcagcactggcgaacccctcctttacccagtcaatgtggggtgtatcagaggagtggcggtcgatgttactgcgataaaggccaattctag

SEQ ID NO: 20248 - DNA, 264 bp, A.fumigatus
gactcacttaatctgttcaccttgccagtttgccccaactgcggcaattctctgacaatctcacgcggcgagccaaccagagagtatcccctgggggtcaaccgattcgagtgccggacgtgtccctatcagcatctgctgaagcacggtagacaggagaagaccaccatgaaacaaaaggaggtggaagacgtctttggtggcaaggaagagtttgcgaatgccgacagcatggccagtaagtgctggatgattgcaagatga

SEQ ID NO: 20249 - DNA, 327 bp, A.fumigatus
cttctcatcttcttttgcagtaaggaagaaaagactcacatcaacatcgtcgttatcggccacgtcgattccggcaagtcgaccaccaccggtcacatgatctacaagtgcggtggtatcgaccagcgtactatcgagaagttcgagaaggaagccgccgaactcggcaagggttccttcaagtacgcctgggttcttgacaagctcaagtccgagcgtgagcgtggtatcaccatcgacattgccctctggaagttccagactcccaagtatgaggtcactgtcatcggtaagctcgactcgccccgatatgttttggtgctgtag

SEQ ID NO: 20250 - DNA, 861 bp, A.fumigatus
ctaacacgatctgaagatgcccccggtcaccgtgacttcatcaagaacatgatcactggtacctcccaggctgactgcgctatcctcatcattgcctccggtactggtgagttcgaggctggtatctccaaggatggccagacccgtgagcacgctctgctcgctttcaccctcggtgtcaagcagctcatcgtcgccctcaacaagatggacacctgcaagtggtccgaggatcgttacaacgaaattgtcaaggaaacctccaacttcatcaagaaggtcggctacaaccccaaggccgttcccttcgtccccatctctggcttcaacggtgacaacatgcttgagccctcctccaactgcccctggtacaagggatgggagaaggagaccaaggccggcaaggtcactggtaagaccctcatcgaggccatcgacgccattgagccccctgtccgtccctccaacaagcccctccgtcttcccctccaggatgtctacaagatctctggtatcggaacggtccctgtcggccgtgtcgagaccggtatcatcaagcccggcatggtcgtcaccttcgccccgccaacgtcaccactgaagtcaagtccgtcgagatgcaccaccagcagctccaggagggtgtcccgggtgacaacgtcggtttcaacgtcaagaacgtttcagtcaagaaagtccgccgtggtaacgtctgcggtgactccaagaacgatccccctcagggtgctgcctcttcaacgcacaggtcatcgtcctcaaccacaccggtcaggtcggcgctggttacgcccccgtccttcggacttgccacactgcccacattgcttgcaagttctctga

SEQ ID NO: 20251 - DNA, 276 bp, A.fumigatus
ttgcatacagtagaaattgatcaatctactagaaggcctaaccaaccggcctgctggcctgccgtgaccatcgagttacttgccagcttgctccaaggcactggactatccgcccaggtgactcacaacaggacagataggaacgagcggttcgcaataatacaagaattcaatgagggcagatgccaggccctcattacatgccgcattggactgtctggtatatctctgcaaggtgtcaacattgtcattctacacataccatctgagggttga

SEQ ID NO: 20252 - DNA, 1164 bp, A.fumigatus
cgatgcgtcaacaataggtattacctgctatacggagagaacgtgactgcgtttccggacaacttccgcatgatagctggcgacacatacctgcgcgactttccctggccgatccctgaccctcccaagtcggaatggacaggcaagcaaggatcgcaggaggctcttcggcagaaggcgattgggttcaactgcctgaactacgctttagatcccgaaccttcgctgggccgccatttccttccaaacaagacgtacctggacgaacactgcaccgacggtgtccggttcgagttgatgttcccttcgtgctggaacggcaaggatgtcgactcggatgatcacaagtcacacgtggcctatccctcgctggttatggacgggacatgccctgagggcttcgagacacgcctcgtttctctcttctacgagagcatctgggatacatatgcattcaaggacaaggaaggctactttgttatcgccaacggcgaccctacaggattcggttaccatggtgatttcatgcagggctgggagtcgggggtcctgcaacaggcagtggagcagtgcaccaatccttcgggtcaggttgaggactgtgctgttttcaatattcaaagcgaggacgagcaacaacagtgcacggtcgatatgccgcccgccttgaagcacgaaaaggtgaccttgactagcggcggtcttcccaacaacctcgcaatccagtgggggcccgcctatgccagcgatgtttccgcttccgtcagctccgtggtgtccagcgcgctcagtgcagccactgaggcggttgcctcggccactgcgcaattgtctctccatgtcagcgcctttggaaacaacctgcaaatcagcaagccaacctcgacctggaccccgactccaaccacatcctatgttgaaagtgccgtcactgaagcggttgtctatgtcgagcaggagattatcgtctgggtggacggcgagaaaaacatccttgggactggtactggtagcctagagacgttgtcaaccaccacccgcaccaccacccgggtcgtctcgactgttgtcactcttcccacggaaacagcagtgaagagagaagagcatgttcaccatgcccacaagcgccatggccacggccaccttcatcaaaggagctag

SEQ ID NO: 20253 - DNA, 507 bp, A.fumigatus
tccagctggtcaagaaacccaaacaccaccagcaaaatgaccgccagtatcttcgccttcctcctcgccgcagctgcagctgtctcggcgtcaaccctcccaagcccaaccccagtccagacaccaacaaccctagcaacaacaacagcaccccccataaccacacccgcagcctcaaacccaacctgcgggcccggctccaccctcatccacacaacagactgcacaatgggcacccccgtctcttactgctacagcgcgccgccccctatctcctgctcgacgggcttcttcccgggcgtctggcacccaggccactgcatcgaggcctcgacgtgctaccccgttgacgcgagctggatcacaaccaagtgctcgaatggcgggatcccgtggtcgacgtcgacgctgtttgagggtgtgcttgctggtgagacgaccagcacaacgattagtggtgagttttcgttcgcccatccccggctttctttggccgctcaggggtga

SEQ ID NO: 20254 - DNA, 1602 bp, A.fumigatus
ctacctatcagggaacatggaaatggatgcggtctcaacggaaacgattgtcgtcccttttctgcctcgacagttgctttccgttgcccggcaaactgtcacgacgtcaaattgttgcaacctcacaccgttggcaaccagacttacagctaccgaggactagtcgtcggaggaccacaaccaggttcgtccgagcccggtgtgtaccgagccgacagtttcgtgtgccaggccgctatccattctggggtcatcacgaacactgttggcggctgcggtgttatgaagctagaaggagcggcacactcgttccccggttcgaaacagaatggtattcagtctgtaagctttccgtcgactttcccaaaggccttcagcttcatcgacctggcttcgtcccaagctacttgccctccagatccgagatggactcttctgggcataaccatcgccgccctcgcacttctgtggctcttctcgacgtcgccgtcggtcctgttcttcaccacctttttcatgctcttttgtcaagtgggactggtgtctgatcccccctcaatcccgcagttcgctgatcttgtgtccactttaattgcgcgattactaccagcatcctttgtagtttacgtgctgtacaagtattgcgcgcgtcctctcctgacgccgctttctttgcccaagttccagctgaccaagatgttcttgtacctgccgcccgctttcatcggcgcgttgaacaattacacttttgcgagactgattccgctggagcgtctgactcctcatgatattcagcggcaaccgggagcgaagttggcgttggccttggtgattccgaccgtcgtcacagttatcctcagtcaggcctggcaaatccgccagggtggtttgatgccgcattatctcaaggtgtattgcaccatgggtctcattcttctgattttgcttccactacccgggcttcgcctgcgaattcaccattacattcttgccatcctgttgatgccaggaacgggaattcccacgcgaccgtcgttgatataccaagggctgctactcgggctattcatcaacggtgtggcgcgctggggcttcgcatccataattgagaccccggcagccctaggagagctaccgggctttgacggagccaagggttggtggggggccacatatcccaacatcaccgatgcatctgtcgtcatttcgcttcctgatgcaggctctcacgggtatcgtggcaatggtaatatcactttcgagctatgggagagagaacgcatggcccagctcgatgttgatggaatcagtgttttggtcaatgatgtggaacgctggcgagggtacttggacgaggataagcgcggagaattcacctggcaccgacatggacacaacggacttgaactgttccacggtcctaccattgaaagtgatccggactcccgtgtgggtgtcaccgatgtgaaagatgatgacaaacccgaggatctcttcttccgcttcgccttccttcgaggagccgaagcgggcgagtacgggccagcaggggtctggcttgaagacaggtcgtggctcccgccagcgaccccgaaggcttag

SEQ ID NO: 20255 - DNA, 501 bp, A.fumigatus
tatttgtgtcatagaggacatctcacaatgattggtgaaggtccggaggatggctcccgagtctatatctcaccagttctcgactccgagaatcgtaccgctgatcccgatacttcctacgactgtttgctccctcgggatgaagagggcggtgccacttatgtccccgtctggttacgtgaatcctccaagtcgtttcgctggggctgggtacctctacctattcggaaggttggacgcgctactacggattgggtgaagggcccgactcctctacattcgctgctgctcaaaccgctattcccgcacatccaagagcttccggttcggtatctgaaccgattgttccctaagcggaaacacaaaatctctttacttctactcttgtacatcgcttggtttactccttgggccattgttctgctccattctcgttcggctggctacatcgagggatatggacgaccgcaaaccctttcgtgttcgacgactttttggtga

SEQ ID NO: 20256 - DNA, 618 bp, A.fumigatus
aaaaaaaaagacatcttcggctttttccctcagacaatccaaggcgccgatatcctcgctacctcgagcgagcagaaatatcgtgtcttcatgcctgacttcttcgaaggccaacccgccgacatcacctggtttccctcctcagaccgaagacacaagcaaaagctgggcaatttcttccaaaccaaggctgctcctcctgcaaatctgcccaagattccatccttcgtcgacgaagcgaacaagctcgcccccaacggcaaggccttcgagtcctggtctatcctcggatactgctggggtggaaagatcgcgtgcttgtcctctgccaaggacactaagttcaaggccgcggtgcaatgccatcctgccatggttgatcccaatgatgctaagaatgtcactattcccatggccatgttggcttccaaggacgagaatcccaaggacgtcgaggccttcggtgccaacctaaaggttgatcattatgtggagaccttctcgacccagattcatggctggatggcggctcggtcgaaccttgaggatgaggatgtccgcaaggagtatgagagaggttacaagactgctttgagcttccttcagaagcatgcttaa

SEQ ID NO: 20257 - DNA, 2940 bp, A.fumigatus
tgtaaggcttacttcacacttcgtggcgctcctgcccaacggtgcatattaattaaccttatcaaggctgaatctaccacgactccgaatgcgcagtcggtaaagaatcccgaccgaaaaggtcactgcctgggctcttcttggacaagacatatacatcattcaggcgagcacggcggagggcaggatgcgtcgaaatctaccgccgacactcttgctagatctcacaacgcatatgttcacgacaaaccgtcgtctgagacccatctcagcagggatgatattcatgccatattttccggagcaccatactttctcctagaaaaaggcaagcatggactctggtatccacacgtgatcttcccatgggatgaccacgaccctacaattcagcatctatgggacagaaaactccttcctcatccttcatataccctgtgtacccttcatgcccatcttcccgttcccgaaggcttccttgaaggtgaccctcccctcctcttggacagctggaaaagaaccggcgcgccaaagagagctactttcgatattggcatattcgaagtcccaaatatgcttgctatgagcgggatagagccggggactgtgggctttcgctattttctagagcttccagtggctgattccgttcgattcgttcatactggaacgtctcacccacatactaatctactgcacattcatagcctaccggccgttcaggctgacgaacttctggagcattaccatgagccctactcgcagtgtctcgacggcactatacatgatcgaaaaaaacttcttggtgatggtccgaccgcctggaaaagaattggtctgcgagatatcaattttaaagccgtggtcgaccgccttgagaccttgagaaacctgcgtcacaagttactatatgaaaccacgcagaaaacgatactcgacgtagaaactgcgcaggacctctatagcgatctattttccaagtttctccattccccgccccgatccatgctcaaggatctcgatagcacgcacggtctcaaggccgagatcaaagcgttaacaatggtgttagcgacaccaggagcatggttcgacttcagtctcgtcgactggcgtttccgcataggacagcttctctgggaagctcctccccatgtggacggcgatttctttgatccaagtatccttcacaaaccctgggcccatccggggttagaacagaaatggtttctgatccagatgctgctagctgcagagttacttcttcgcctagatgccattgtcaaagttgggctacttgagagctcgaaggacgtcagtgtctcggctcaagacgtcaaccatttcgataagctacgcaatcctaaagttgactgggacttggtggtggtgcgtcgattcttcgacagtttcaagatctcctgggtcgactgccaatccgctgcagtgtcgaatgctccgtcgcagccgccaacccaggagaagtcacctcaaaaggctcgtcgcttttcattctttgacagcataacacgcaggcattctgtagcctcttctcctcactctgatgatcaggggatgttcagacttacacccactcatatcgaacagcaagtcgaaggacttttggtatttgcggaaaacatcggttggccacgtgttgactcgctcagagaaattttcgcatcgaaattacaacacggcgattcaaacctagatatcaaggagatatttaaccgccctgcacgtggtgcttcagtagagggccatacggaggaaaccaccaaagacgacacattcagaaaactcgctacacgccggctggtagtcctcagcggtccttccagcgatgatactaagtcggcgatgggtggttggatcacgagatgctggctttctggctttgtggttcctggccaagcgatcagccacttgctcatggctacagtactagagaatgatcaggaagccattgcaagacttggattgatagccaatctatatgggggattcgctctcaatgggaagagctggtggagtcaagaatgcattgttggccgagtcctttccgctctgaacgaaaccaaggcttgcatgggttggatcagcagcacgaacattcccaaggaatatcaaacccaagagccccttgacgatgcctggtttgaggtgatcgtcagtgagccgccgaccggcctggggaaaccccgtatcaagcaagggaacaagatctccgtggagtcgacaccgctagggctgggatcgttggtcagtggcgagtttaccttgccggtggacgatgtacctgatgcaaagtcaccagtggatgtcaagttcaatgctttgactttttctacaatggaagagcggcgaaattcaaaccagcatgcaattgtggcccgcaaggcaaccatgagtttctcgctgaggacggggacaagcacggccacagccgacgtttccttcccactgacatataacgtcaattttgtgacgtcgcatgcgtgccggttacctccagggttagcgtcataccagcacaatgcgtcgcctgatggagacggcaagggcgatagatcgcggtcactgtctcccgccgaagccttttctctcaagtacggacggcttccaggccatccattgcctagctcatacagatacaaatatcttgcactagatgacttgccagctcctgagggatcatccatagcgaaggtttttgaacatgccggctttgatctgacagttgacgaagtattcgttgtcgatgctcgacaatctgccgagaaagaagcattggcgagatcatggtgtgcttctgttggctacgatgccatcattggtagaaccgggcggacatgcctagggtgctgtattagagaggctcgggctcttgcggtcaaggtggtcattcgcgtgggtgatcaggaaattaccggctag

SEQ ID NO: 20258 - DNA, 195 bp, A.fumigatus
cttgtgacgcaggtttctcaaggtctcaaggcggtcgaccacggctttaaaattgatatctcgcagaccaattcttttccaggcggtcggaccatcaccaagaagtttttttcgatcatgtatagtgccgtcgagacactgcgagtagggctcatggtaatgctccagaagttcgtcagcctgaacggccggtag

SEQ ID NO: 20259 - DNA, 6585 bp, A.fumigatus
tgttgtccttccttactttcagaagtaagtcaaactgcatatgtgctgatgtctctacctactaacctccaagcctttaggtttgtcaattcctcatggcaagagcatgaatacgagttatgtttgactttgctccggttgaaccaggcaggttgtatcacttcggaactctctaagcctggctatgtcacctgcccaactccctggaagacccgcatcaaggatatactgggcagtcgtgggcccagtgccactgaagtggctcttctcaatgcttattcgaagcttcccagcgccatatctctgaccacggaaccctctcttctacccgatatgactcgcagtctttatgatcatttatcccgcgtcttgaaggagagtgaacttgatttgtccacctccacaaaattcttccttggccaaggttttaagtcctatgtggatttggctgcttctaatgaaggtgtcgattcgggcctttggggtgcaatcggctctgctgctgcaaaatactcaaggattcagccgttcctgggagcgatcttgacttacgtgtcgagttgctctacgaagctggacttcggacaacccgccctggaagatttcgcaaacgttctaatcaccaacctcgcgggcccttctcaacaagtcagattattatcgttaaaaattttgcgagagttggtacaagcttcaggagaagatcctgctcccatttctttggccattgaagtcgaagagagcccgctcaatctgcaaactgcacgagttctgtcgatgcatgtccgcaagcttgccatcctctacccgcaagtggcttctcagcgatggatggccagtttgattcctaatttttgctttggtttattttcaaagaaattggcaccgctgtgggaggattcggccgctgcactaaagtcgattagcgagcactcggcaggggaaaaaatcgtttcggacctagcctttcagtggcttcaggagcgcggctcgactgataccgcggataaagcggatgacgaggcggaataccatacatctggggattttaaatgcttcaatgcggctaatattgaagatcgtcttgcttctcatttcaatgctacggttccgcccagttcaaagctaatggaagggttcgagagggaccatgaggtctctgacgttgttcctgtggctcctcgaacccatgctctgcgtgttcttaatgcagcacctgctctagccgagaagaagtcgcgactgattgtccccctgttccttgcgtgggcattacgcgatgacgaggatgtcgaaagcgccaacgatttgtacattccttggggattccatgaccggttgtcgttccttgggttgctcggaaagttcgccaatcctcgggtgctgttcaaggcatcagaggtccatgacgcccttcttggactgctctgccacggtaactcagagattcagaagtccgcgctcaaagcgttgtttacctggaaatcaccgaacattatgccgtaccaagaaaatctgttgaatattctggacgagtcacgtttcaaagacgaactttctgtcttcgtgcatgtcggtggtgaggacagcttgattgaagaagcccatagaggtgaacttcttccggtgctcttacgcctcctctatggacggatgatatcgaaagctagcgcaagtggccaagctggccaagttggacgcagaaaggcaatactgcggacattgtcacagctccccgataatgaattcgaaattttcatgcgcgtgtcgttcggtcctcttggagatgtctcattgttacaggaggggcaagtcaaccaagaagcatttgctcgagacctagttagtcccaggagacagatgggtctgctaaggatgatcgaaacagtgttcgatacgctgcaaagccgaatggctctatatgcccagcgatccatggacacggttctatactgtttggtcagagcctgtcgagagctagagaaagacagctccaacgttgctgcggattctcccgaagggagactattgaccgtgttccgcaacatccggcatacttgtattcgttgccttgagctgatcttcgccgtctctctggacaaagactggtctgcttacattcatctcatattcgacgaagtgatcaaccctcgccttcagaatttcgcgattgagacggctcaaggagtctcaggtctactgcggctgttccatacctgggccaccgccccccggtcctctttctatcttgtgcgccacaacaataccgtcctgactaaggtcgtcgactgtctcagcgtggaatctgctcgcgacgaggtcaaggtgtacgtgatggacgagattctggtccctcttatcagacttgctagtgggaaagaactggaagagaaagaagagatgagcgatttctcggcagacgagattcgatcagaagtcttgtccccttacatcgagcatactctctctcaccttggtcgtctgctgaagcgcggaccttcccgtacggttttggtatctggagtacaaaccatctccctcttagcaccatgtgtcgaatcgttccaagagaccactgagctggttggtatcacgacatacctcctgcgtcagccagctgatagagtgtctcccaaaacaaagtcaggtctcctgcgcatcctcgaacacttcttgcctctgttcaaccctgaagaagatccaacactatttcaagaggtgtttgaagcagtttcgtccatgtttgattatttcagagatgatgcgaaccgagaggtgttgtccggggttttcgcagctttcgtgaaacatgatcctgcattggataaagtggccgagctttgtgcggaccttaactcgatctctagaaagaaactcgaagttgactatgagcgtcgtctccaagccttcgcacaaatcaatgatagtctttgggagatcctggatgcgaaacagtggcgtcccctcctctacaacatgctatttcatgtgaaggatgaagatgaacttgctatcaggtcaagtgcttcttttggactgaaccggtttattgagagagcgaccaaggaagacagcgccgacgctgacgagtttgaacccctggtcaaagaaatcctgttcccagctttacagagtggaatccgacagaagtcagagctggttcggaccgaatttgtctccactcttggctactttgttaagatgaatcccacgcggcccaatgtacaagatatgcatgggcttctcgttggtgatgatgaagaggcgtcgttttttacgaacattctccacatacaacagcatcgccgtcttcgagctctccgtcgtcttgctagcgaagcagcgaagggcagtcttcaggcttccaatatcagtacaatcttcattccactgaatgaacactttgtttttgaccaggaggtcgacgaaggtggccacaatttgattgctgaagccgttgccactatcggagctcttgcagaatggctggactggaatcaattcagagccattttccggagataccgtgggtacatgcagagcaagtctgagatggaaaagaacattttgaggcttctgggcagaatggcggatgccttgagcaacgcaatgcgccaaaagacggtggttcagaagaccggcgacgacagcatggaagaaattgagattcccgcgccctccaagtgcaaccttgctcgaactatgccgtcacctgctaaggtcgcgacagagctgaccacaaatttcattcctttcttgactgacttcatccaccacaaagatgaggctcagatgagcttgcgtctgccagctgcagtcaccacaatcaagcttctgaagctgttgcccgcggaggatatggcaatccgcttgcctcctgttcttttggatgtctgcagcattctcaaaagtcgatctcaagacgcgcgagataccgctagaaagactcttaacgaaatagcccttctcttgggtcctaactatttcgggtatattcttagggaactccgcagcacgctcacgaagggttatcaacttcacgttctttcctttacagttcactcgatgctcgtggcgacaactgatgatttccagcaaggagacctggattactgcctagcggatctcagtgccatagtgatggatgacacctttggcgtagttggtcaggagaaagacgcggaggattatgtgagcaagatgaaggaagtcaagagcagtaagagttatgattcgatggaactgctggcgaagaatgcgactgttcgaaatcttgcgaatctgctgcggcctttggagtccctgttgcgtgagaagctgaactctagcatggtcaaaaaactcgacgaactcttgcggagaattggagtgggtctgctaaggaacccaggcgccgaaagccgtgacatccttgtattctgctatgaagtcatcaaggagacatatcgcgatccggcgggagtggagaaagagccctccgtttcattacgcgaacagcgttatttggtgaacctcaaaggcgcaaacagaggcgacaaacgtggaacgacctcgtctcatatctataagctggcccgattctcgcttgatgtgctgcgctcaattctcaacaaatatgactccctgctcacgcctaccaacctggccggcttcatcccaatcatcggcgattcgttaatacaggcccacgaggaggtgaagatcgcggctgttcgtctgttgtcgactatcatcaagcttcctctcgcagatattgataacaacgctcacgtctacttcaccgaagcagtcaagatcatcaaggaggcaccaagtaccaacaccgaggctgcacaggcgtccttgaagttagtgtcggctatgctgcgagagaggaagagcgctaaactcagagatgggcacctggcgtacctcctccaacgtttggtctccgacattgaagagccagaccgccaaggcgtgacattcaacttcattcgtgcggtcatagccaggaaatttgtggttcccgaaatctatgagttgatggaccacattggagccatgatggtcacgaaccaaacccgttcggctcgtgatctagcacgcggcacctatattcacttcttgattgagtatcctcaagccaagaatcgatgggcgaagcaactgagtttcctggctaagaacttggattataagcaccaagaaggtcgtcaatctgtgatggaagctatacacatgctcttggctaagacaggaaccgaattggctcaagacatcgtgggcacatttttcttgccggtggtcatggtcatggcaaatgacgatgctcctgagtgcagagaaatggcaggtgcgctacttggcgagctctttagtagagcggacagggaacagatgaagtccatgctcacacccataaggtcctggctcgagcaaaccgagaacactcttctgaccagtactgggttacaagcaatgagggtcttcttcgaggttgaggaaacaataaaggacaaagaggcccgttttgtcatggagatcctccctgagatcatgcagccaattctccagagtgatgagactgaacattgggaagtgctttacttcgccttgcagcttcttactaagctttgcaaggccgtccctgctgtggctctagccaaagagcgcggtccgatctgggctgctgttcgagagtgcctgttttaccctcatgcttgggtcaagacttgcgcctctaaccttgtgggcacatggttcgcagatctggccaggaccaatgctgcgaatggctatgggtccattccattggtaggttctacagggctggcacttgacaaggatgccatgctacagctgatccgcgctagtctgcgctgtctccgcactcctggtataagtgaagaacttgctatgcaaaccgtccgcaacattatcttcctgggccggtgttgcgcacagaacggtcttgtgttcccctccagtgggtctaaggatgccgaattgagcgaaagcgagagtgaagacgaggatgacgacgaagaaaccgctaacggacgcacggagcgctctgacaggtctgctatccagtacattttccagcaggtctcctcaattcttcgcagagaactcctcacgactaaggcacattccctgattcccaagagcgcgtccattggtcttcttgcagccctttgccgacatcttgaaactgatcagatccggccctcgctgcccaccatccttcttcctcttcaacacttgaccgatccgtcaattccggctcctcgctcgtccgatgaacgcttccgggaatcatacaaggcactggtctcaaactgtcatgaagtcctcgacctgcttcagaagaaattgggcacatcggagtacatcacccagatggcgtctgtccaggactccatcaaggagcgacgtgagggtcgtcgaatgaagagacgcattgaggcggtagcagaacccgagaaatacgaacgggacaagaagaggcgaaacgaccgcaagcgcgagaagcgcaaggaaaagggaatggaacaacgaggaaagagatcttcaccacgggggtcgaaggaccgacgctat

SEQ ID NO: 20260 - DNA, 1452 bp, A.fumigatus
caagcactaccaaagtgtttcttgtcgagaaacactgcaacaattttatcggcgttgctctccctgtcgccgtcgatccttgagatggtggcaacatcatcggcttcgcggacagcgtccgtgaagcgtgtgaagaaaggaacagagacaacaaagtcgcatcggttcgaaccgttctctcagcgtgtcgcaaaattgaaaatcgacccgatccatcgagtgcgtcgtccgagctttggcgaagaaggagaaggggatggagatgagacgttttcgtattttcgatcggcgtttgaccactggattgagctgaacctctcagacaatttttcgcaattcgcacgaaaagtcaacccgctatgtgaaagtcttgcccagattctataccacgaggacaagattatgggactactggtggaatatatcgagaagagagaccagctttctattgaaccgctgctaacactacttgctcaatttgcgagggatcttggggtccgctttgagaaacactttgctaccgccgtgaccctcgtggcgtcggtcgcggccactcatcctgatgtcgaagttgtcgagtggagctttacatgcctggcatggatctttaaatttctttctcgtctccttgtcccagatttgagacagcttctgggtatcatgacaccctacctcggaaaagaacgccagaagccattcgttgctagatttgccgccgagtcaatgtcattcctcattcgaaaggctggactcgtatactacaagaataaggctccattgcagcatgcagtttcgttcttgcttgacgacttgcaccaggcggctgcggattcaaagaatgtggagacgtacaaggaagggctgatggctatgttttcggatgccgtcaaaggcgtcaaaggcgggctacactcgaacgcaacagatattctcaactgtctacttgataatgctccgaccggcaatgaattgcgcagcaggttagcagttgaggttgtaagtgggatacttatcaatgtcaatcataatacgactgccgaaacatacgaaccagttgtcgagacgattaattcctacatcgaagccaatcgcaagaagtccgacaaacaacacgcaaacttgtactgtcgtttgatgttcatctgtgtctgtacccgcaaagggtcgcgtataaagaactggaagcctattcatcagactctgttgctcttgcttcagaatgcctcggctgcgcctagcgcgtatgccgattcgatccctcaacttctgacaaccgtggcatacgcactccaggtgtctcctatggatgagatgttaccgttcatgcgcccactcatggatgcagtcgcaaaggaacagctttcggcttattttctttcgttctgtgctacattttcggaatggggcgcggagaggttccatagtgttgtccttccttactttcagaagtaa

SEQ ID NO: 20261 - DNA, 1011 bp, A.fumigatus
cagagatctagtgttgtggttgggagtgtgaactgtgagctgcgtgaagtgttcaccaagctcgccaagttacacgtcaagcagaacttctcaattgcgatcattgttggggacctgttcggagattgctcatcggagcatgagctggacgagatcagtgccctgttacaggggaacatcaacgtacccctgccaacttactttgggttaggcaacaggccccttcccaccaggatagtggaaagaatcgaggcgaacgacgaagtttgtccaaatctgtacttcctgggcaaacgcggtactcttaagaccgcggaaggcatccgtcttgttgctcttggtggtaatctcgaggcagacagcaaagcaaccaataagttccatcctggctatacagagtcggacgccagggcactttacggagcccacagtgcggacatcctgatcactcaccaatggcccaagggcatccgaaccgggtccagtgcaccgttaccggaggatgccaaggtgccccaggaggtgcaatgcatcgcggacctctgctctaccttgaagcctcgataccatctttcctcgtctgatggatttttttacgagcgcgaaccatttttccacatgccatcagaggataacccagacgccaaaccgctcacccgcttcatcagtctggcatcatacagcaaaacatccaagcaaaaatggatgtacgccttcacactagatcccaaggcccctccaccccttaccatccccgttggcgatactgcaacccctgtggcccccatccaagtcaaacggaaagtccttccctctcagcgtgagtcctaccaccgcttcgccggcattgaagaagatcacagccggccgcgcaagcgcgcccgagcccctcccccagggccggagcaatgcttgttctgcctctccaaccccaacattgcaacccatctcatcacgtccattggcaacgtcctcaccacggaatggccgaatcggcccttaacgcgggga

SEQ ID NO: 20262 - DNA, 1473 bp, A.fumigatus
atcaaatttcagttaaccatggcctcctcatccagatcactcccgagttcacctgctgggctcgttgaatctccctccaaatccatgtcgcccaataatgctcgtccagctcatcgcgccaggccgccgaagcctaactacaagcacatccaccgttttcctcttcccctcgacgtacatcctctaccgcctctcattcctcataatcctctgtcgctcattagtgtggtgctgtcgtacctgacttattttatctcaccacctcaccaagaaacctatgccgcctacttcgattctgcgacgtcctccgtccatgtcacggatcacaaggctattcaagccttgtgggagatggggttctttggaaagggtactttaagccgaagtcagcctagttggctggaacgggagaagaaacggaggggattacttggtggccagaccaacgaggaactcacacggcagcgtagaacagaacggcgtgaactgaagctcgagagagcgaggatggagaaagtagcgattgagaagagattgaaggccgaagctgcggcgcgtgagagtggtgctactaccgtcgaccagacgacggcgacgctacttacagacgttgcttctggtggtacagccgttacactcgaaaagttttctctccggaaagcaagagaagctagaatgctcgaatcgcggcgttccaaggagcaggagaacaaagaaccggcttccccttcttctggacaagagtctcccagcaaggcagttcgcttttcacctgttgttcaagagaaagaatttgcgtcggattcggcaactctacgccttcccggactagctacagaggctcaggagacctcgcaggaagagcttcccctgaaaaacgaggagcacttacagttatcgaacgaagaggcctttttccttgcttatggacttggggttcttcatgtctacgatcatcaacagaagaccatcatccctcatacgtcgttactctcattattctgtcacaactcgtactaccctccacgtgatccatccacagatttgaaaccagacgatcctttcatgatatcgtacattgtctaccaccactttcgatccctgggctgggtcgtgcgctctggggttaaattcggagtggattattttctgtacaaccgcgggcccgtgttctcccacgctgagtttgcggttgtagtcattcctgcctacgagcactcctactggtctgaaacatcagataggagatcttattgtgccacaaaacaggcacgaagttggtggtggctgcattgcgtgaatagagtccaggcgcaagtcaagaagagcttggtggtatgttacgtggaagttccaccgccgcgatctcacgattcgaaaactcactcggaggacatcggggctctcctttctcgatacagggtgcgggaaatgttaatcagacggtgggtccccaaccgcacgcgggactaa

SEQ ID NO: 20263 - DNA, 831 bp, A.fumigatus
tcctggacaacgatgggagcatcgctgaaggacggcttcaatgagctctttgagttgccttcgcacccaccgcttacgactccaacaaaatcagcagcgccaggtacgaactgtgacaatgggcagttccgtctggcacctactgctgaagaagtaggattcgcttgtctcatcgctgacaagcactctcgccgcccgaaatacatgcaggcgctggcgttgaatataccatgtttatcagaccgctggattgaggactgcattgcccaaaaccgaatcctggattgggagatatatttgctcccctcgggcgaatctatttacctaaatggagcaacgaaatcgaggttcttggctccgtatccggctacaacagcgcgactaccggatactattgcttctcgccccaacttacttaaggaccagtcggtgttgcttgtcatgggtcgcggtgggcgatcagatgaagaaagaagaaaggcatacattttcctcacgtacgccttgggtgcttctagggttgagcgtgtgtctgacctcaagtcggcgagagcaagcctggaccagcaggccgctgctggaactggatgcgcctgggattggatctatgtcgacggcgatgagatggcatcagcaaaggccacgatccttggttcctcaatgcccagtacacttaaatctcagtcattcaagggtacgaagaagcgcaagaggaccgaattgattgagttcatcgatggcagcgatttaggcttgagtaccagcgtcaaaatagtgggcaatgagtttgtttgtcagagtctcatacttggaaggctgtttgggcagtga

SEQ ID NO: 20264 - DNA, 204 bp, A.fumigatus
gggctctcctctttctggcctccgtcgcgcaggcgcaattccagttcttcgagcacatgtttggaggtggtcatcaagaacaccatcaacaaaacacacaaaattctgccagcgacagtgcaagatatcaacagctatgggaaggaagtgagttattacagagcattttgctgctcaatcaaaactcgtggacaacataactaa

SEQ ID NO: 20265 - DNA, 3495 bp, A.fumigatus
gaccttgcaccatcccaatccctgctggacgaattggagacggtcgattctcttcctcctagggtatctgatgataagagtcgcgaaaataaccaaatctcggactttgatgcatcgtccactaaaccggaagtcgttcgacaatcgccggccaggtcgatttctcgaacagagcatgctgctgtacccttgaatgaccggaaacagttcttcgggtctaaagacgtccccgaaagtcctctacccgttggacaaaccgcgaggatgagttccgcagacggtgtcccgtcagacactcaggtcgtttcgcagtcggtgttcgatgatatgatcagacaaaacaagaatgctgctagaaatgcgtccgacagcaatcttgtggagcgggctacaatgatgactttgcacgagggtgacagtggccatgtagatttgttgtctgggttcgagaacacatgtcccgatataatcgatgccgaggacaatggagagcaaaacagctccaggttaggagagtcgtcgcccttgcactaccaaccgaatctcttccctgaatcgcagcggttcttgacaagcacaccagcgacggccttcaaattaggccaacccgagcgttccaactccgagaccccatgtgttccaaaaaatcctcttccatcggacatccaatcaagtggtggggtcatggcactgagccaggtgttcaaggcgacacaggctccgtcgtctccattggtttatggtcagcagccagacctcatgtccgaccgaccttctccaaacctccccattcaaaatcatccgctagccgccgtgctatcttctcctctgaacgcgctcgccgcaaccttcccgcaagaccgctcggagacaccaatggcctacatcagcatgaaagagtctcaggcgagacgtgacaggctcttgcaagaaagaatgacacgttccgcggagcacatatatgcagaggaccagagcgacagcgagtttgaaaaggaacctagttttgtggagcgtatcatccgacagagaacgatcaatcaagaagcttcggcgcagtttgcgggagttgcagccccggcaaggcagtcaagccgacgtcgaaccggcgaagaaaccacatcttccctcagcgagttgaagcaacgagatcaggcagacgtgctgaaaagcccgacgtcccgtgtggatcctaacaaaattgatgcggtacttcaatcgggtgcaattagtgaagccgaaactgaacatagtggggacttgacacgatctcaacctactcaacaggttcccagtctgtcgacagatgaagacaaggagaactgcaacaatgattcagaacattgccttcctattacagcttctgcgcatgaccgcctttctcaggcactctctctacatgacgattcattggcccaggaagatattcaactgtcccgcagccctgaccgggaagcaaacgagcctaaagcaacattggaaaccatggttgtgaaagattctcaacaatctcctcggcaagaagatcgtggacaccacgataaaattgtcacgaacagtctgcggcatcacagcggacggcctcgtccccgggtccgataccatggtgatccttctgaccgcgatagagttatttcatcgcccacaaggcctttagcactgcgctcgtcaccacctcccccagagtgtgtacaagacccagtgctacacccggcccatcttaaccgcgcaataacgcgtagtcagtcaagctcaccgaactgtcacgactcctccagtcagctcccaagggacgcatcctccgcccaggaactcgcgacaacggaatctagcaatgttgctagccgaaagcccaatggaaccgaatccaagggtgcaagagttgatcctcatgaaaaaccctcctccatgccctctcgcgtgaccgaaacacctgtgccccaacgtccgaggggcttcggtgatgtaatcccaacgataagtgttcccgagactagtccaaacacaatacacaatcagagctgggcagacgatgtggataatgaccccatggatcaggaggatgatgacctgccgccgacttatcctactgagcaagcgcgcatcagtcactctcaaccccttatccctgagagttcgaccccaactagacctttccgcaccgccaaaatactctcaagcccaagtgggagacagcgcagggcgctaacagagatagctgctgatgcttctcctcaagctggaactactctcatcgatgttgatattggtattctcacagccgatgataaggaattcagttctgtggtctctgcgtcccctattccaccgaggaaaaagcggcgtggcaatgggcagaacgtatatgcatctgatccaatattaacattcacgcctcgtatcacttcacagtacgctcaatctcaaaatggcgagaagcccaggggccagattttgcaaaccgaggagttcgtggataagtctgaatcaagcttcctaaaaaggtcaagatcctccaagcgaataggaacagtatgggaggtggaggatactcctcaacatcacgtctcccggagagaaaggttgaagaagctttccctccctcgtgctgaggcagagtcagggcctcaaccactggaacgagcaaagaatatgaatttgcatgcggcggaaagagaggatccttgtgagggaagtcttaagttcccgcaagctacaggagagaaaatgaaggataagtcccctgagttgttgcgcaatgacgagtccgatccagccggtccgggtcatagggacagctctccgattgcgctgaaccaagtcattgctccctggagtggccagaaacgggcatattatcctgcaacatgtgttggcaagccacccggcatctcgcagacgcgagtcctggtcaagtttgaagatagtgctcccctcgaagtgccgatgggcgctgtcaaaagactggaattgaaaataggtgatgctgtcaaggttgacatgccccacgtcccaaaggtgacacatatcattcgcggctttgaggataagattagtgccgaggacctcacaaaggctgcttctgatggagtccttccaatcaccgatgtatatgggtatactactctgatactcgggccgaaacaacgcaagagccttccgagtggtgggctgacggggcctgacaacctcatcaaggttcccgtatcgcggatctatttggacacgatcttgtggaatcagctcaaagatcgagctttcacctacagttcgggagctacgcattccgagagtaggctccaaacgccttctgacaggtattccacgccagcatctccgggttcacggctaccgcgaagcattcgcttgatgaacggtattttcgcgggcatggtgttcgcagtctcctacggcgataatgacgaagccaaatctcgcatcacaaagatgatcctggacaacgatgggagcatcgctgaaggacggcttcaatga

SEQ ID NO: 20266 - DNA, 255 bp, A.fumigatus
aatgctaaacgcgaatcattactgtccctaccaagttataaaatcccatataaatgtgcaatcggcattaccattcttactccatggaccgacccaaagaaacgcgaaacgcgaaaaccacgtgactgccaaagtaatattaccagtttaggaatagaacgtttctacttgggatactcaactgaggagttattactactccgtacatcagaaacacaggctacacaaggactttgtgtgattcaccagaaatag

SEQ ID NO: 20267 - DNA, 933 bp, A.fumigatus
ctctccgccaagattggaggaaaaagtcgcggatttccacctgtgatgagcttccgcagtcctcgccggttgggcattggagtgacaccactttccgtgcagccgacaatgttacaacccaggctgttagcacccttccgggcgctggaacgcacatttgtttcttccctccgctcgtcgcaggcgatacaccacccgcctcgatcttcgctattcttccaacgaacccccatctccgcaccatctccgatctcgaaattcctcctccctctctctcacgtccgtcacgcctctcacgccactcagggtactgcaaaccgacactcccgtgatcctgctgggaagcgactcggcgcgaagagaaccggtggtgaatatgttgtccctggttgcattatcttccgacagcgaggaacgaagtggttccccggcgagaactgtgcgatgggcagagatcacaccatctatgccacggaggctggctatgtgagatattacctcgatcccgagcggcatccggaccggaagtacattggtgtctgctttgagaaggatggaaagctgcccacaccccggaacgccccgacgaaacggaggttgaacagaatcgctgtccctcgcatccctgatggccccgaagtcgttgctcagtcagatttgcttgcaactgttgaagagggcacgatgatctccagcgtggtggccgccaatgccaccactggccccccgctgcgtcctggatacatgtaccgggaggcgaactggcagattggtcgcgctgctgagaaggccggcatcaccgccaagccctataagcgcaagaatcgttggctggcctggagaaagaggcaggctagagccgaacgtgctgcccagatgaagagccttaagagcaagaagaaggccgcgaagaagggcaagggtggccgttag

SEQ ID NO: 20268 - DNA, 378 bp, A.fumigatus
gactgcgagcattgtataagaacaaggcttgtgcgcattgcagggtacgtttcgtcatatgggctgaatgttccactccagtgtccactaacgtgtgtgttttctggccagaccgagtccagctatgtaattttcacggacgatccggcaaaacgatatgaggatttcacggatgcggatttctctcagaaagatgataatctgggaatcaagtacgagaataatgacattttcgaggacactgtattactgctgcggtacaactgccctgacaggagttgtgatgtggcttgcttgggttggcctgacctgcatcgtcacgtcaagagcaagcatggcaaagtgatgtggtatgtactcagttgttgcgcgccttga

SEQ ID NO: 20269 - DNA, 468 bp, A.fumigatus
cgatttcactatgtatctctgggaccccgaaaactctaccaaacctatcgcgcggctgctaggtcaccagaaggaggtgaaccatgtcacgttctctccagacatggcctatattgcctctgcgggtttcgacaatcatgtgaagctttggaatggacgggacggaaagtaagtcgtgagatcggatgtttcaccatcattcagcggctaaccaggccatctagattcatcactactctccggggccatgtaggcgctgtatatcagtgctgcttctccgccgattctcgcctgctcgtgtcatcgtcaaaggacaccacgttgaaggtctggaatgtccgcacaggcaaactcgccatggacctgccgggacataaagacgaagtcttcgccgttgactggagtccagacggacagagagtgggcagtggaggaaaggacaaagctgtgcggatatggaccaactaa

SEQ ID NO: 20270 - DNA, 1662 bp, A.fumigatus
ttattcagcgatctttgcactaggaacaagaaggtcttcacgcatgagcatgaacttttcactatggcagagttgcgcaaacacgagaagtacggcgatgatgtgccaggtgccttggatcaaagtggtttcaaaggacatcccgaatgtggattctgccgcaagagattctacggcgatgacgaactctacgcccactgtcgtgaccgtcatgagagatgccacatatgcgaccgccgttcggggagtcggcagcagcagtactacattgattacaacgcccttgaggatcattttcagaaggatcatttcctctgcctggacaaagagtgtctagagaagaaattcgtcgtttttgagtcacagatggacctgaaagcccaccagctggagtgccaccccaacggactctctaaggatgcgagacgagacgcgcggacggtagatctatcagactttgacctgagagcaccttatcagtcccagagacaacgccgtggtgctggtcgcggccgtgatccgaatgcggaacccctgccagtatcaagcactcagccattaaggagagatgagatagcttatcagcgacagatggctattcagagcgcacagtctgtttctacccgcagctttggcggccagctcactcgcaatgatactcagactgttcgcgcgccagccaggtctggcgctgcaacaccggttcgaacacctcccgccggcccgccagttgcggaaatggaggctctcaatgtcggggctccgtctgggcctgccactccgcaggatcaagctcgccgtctgcggcacgctgctgtgattgaacgtgcctccaacctcctccggaacgacgcaagcaagctggcagactttcgttccaaagtctctcaataccgcacgtcggcactttcacccaccgggctcatcgatgctttcttctccttattcgatacctctagtactgaactcggaaagcttatcaaggagctcgcggaaatttacgaggatgaatccaagcgcaacgccttgctgaaggcctggaacgattggcgcgcgatcaatgaagactaccccgctctaccaggcccaggaggccaaatcccaggcatgtcatccggcacagtaaatggaagcggtgtcggcggaaagcgtgtcctccggctcaagtcatcgacagcacaatcttcccgctccgttgttggcagaagtggctctatcgtctcgacatcctcatcctcatccaccaaccccttcccgcctctctcttcctctacagcccgctctgcgcctagagcgaccacaacaagttcaccctgggccacagtggcccctactcctgctcgaaccatggccagcgccatcaacccatcttcccgtcccgcacctaccccctcccgcaccgtgcagaatacaaatgactccgaggcattcccggctctccccgcagcgccgaagccgaacgtgcttatggcgggcctcactcgcgggacagttcgatgggatgaccgacagcccccacctgtcaatgcttgggcatcgtccaccggaagtggttccgcgtctgtgaacgggcctgaggatgaacacggggagtcgtcgtcagctggagggaaaaaaggcaaaggcaaaaaaggcaagcagacactattccattttgggtag

SEQ ID NO: 20271 - DNA, 1083 bp, A.fumigatus
gacgatgacgaacgtgtaccatatcgattcacctaccagtccgacgacaaagatggccaaacgatcgatattcaggcagacctgtatcactccttgctaaagccaggtctgaagactactgaagataccattcacctttatttcacgccgcaggccgttttccgggttaaagctgtttcgcgatgctccgcttcgatcgccggacacggagaggcgattcttgcgacatccttctccccagtttcttcgtctaccatggtctcgggaagcggtgactcgacagcgcggatctgggattgtgacacaagaactcccaagcatacgcttaagggccacaccagctgggttttggctgtgttctactcgcccaacggagcaatgatcgcaactggaagtatggataacactgtgcgactgtgggacgcggcaaaaggaacagctttaggaggaccacttaagggccatgcaaagtggattaccagtctggcgtgggagccttatcatacgcaggaaattggcaggcctcgattagcgtccgcttcgaaagactcgacggtccgcatatgggatgtggttggaaaaaggattgacactgtcctcacgggacacaagggctcggtcacctgcgtacgctggggtgggacagggaagatttacacttcttcccacgatagaacgatcaagatctggaacgcacagaacggttccctgcttcagacattatcagcccacgcgcatcgcgtgaatcacctggcgttgtcaacagactttgctctccgaacagcttaccatgaccacaccggcaaggttccaggatcggacacggagaaggtggctgtagcgaagaagcgctttgaacaagccgccatggtcaacaataagatcgtcgagaagctggtatcggccagtgacgatttcactatgtatctctgggaccccgaaaactctaccaaacctatcgcgcggctgctaggtcaccagaaggaggtgaaccatgtcacgttctctccagacatggcctatattgcctctgcgggtttcgacaatcatgtgaagctttggaatggacgggacggaaagtaa

SEQ ID NO: 20272 - DNA, 312 bp, A.fumigatus
  unsure (43),(264): Identity of nucleotide sequences at the above locations are unknown.
cgctatgaaaacaactggattgcagcgccaccattcattccantacagaacccctaccaaaaggatcaagtatactggtacgcagcaggctgcgacgacatgaacgggataaccgtcgccacgaacggcacacatgcagtgacattaacccccggcacagtcgcattttgcaatgccgcaaacaccctccacctattgatcggcacgggacaagccacgaagtcacgcgcccccatgcctttgaaatgccaggccccgccggcntgggagaagggacccgtagacgcgccgggagggatagagggcgagtga

SEQ ID NO: 20273 - DNA, 246 bp, A.fumigatus
agactctgcttcttttgtgcgttaaacgtcgcacacagctcggtttcgccgtgcaatcaccggacttgtcacatctgtgctttgagactgcgagcattgtataagaacaaggcttgtgcgcattgcagggtacgtttcgtcatatgggctgaatgttccactccagtgtccactaacgtgtgtgttttctggccagaccgagtccagctatgtaattttcacggacgatccggcaaaacgatatga

SEQ ID NO: 20274 - DNA, 240 bp, A.fumigatus
cgtctgtcagttcccttgctctatattgcagatactaggcaatggctgacatcgcagctcatcctcgctcccacaaaacgcacctttcaatacgtggagcaatcaggtaacaacgtcatcatgctcaaaacgtatgtatcatcaatcaactcaatatataaagcacttgcgacagctcagagtagccttctcatgactatacgagaggtataccctggcccaatatatactgtctgctga

SEQ ID NO: 20275 - DNA, 540 bp, A.fumigatus
ttgttcgaagtacacaatccgccattctcctcttccacctcttgtgctcgcatttctgatgatagtcttctgttggttgttaattctgcgaggatgatgagatcattgtcctgtgtttcctcctttggagatgctagttcttttacagctcttacctctagacaggatagcgaccgaccccggacagcaaggccagccacaactgctacaagtattgcatctcaggacatcatatgtgcaatcagcgagtctagaggagtatcatcaactgttgggcttgcattcgtcaatctttcaacagccgaaacagtgttatgccagatctgtgacagtcagacctatgccaaaacggtcaccaaaatcgctgtttttgaacccacagagatcctgttcatgagctctgccagagaatccaaactcttttacatcatccaggaaaacattccagatactgcttacacgttcttcgaccgcaggtattggtcagagaaggctggccacgaacatgtggatcgcctggccgtttccgcaagatgttga

SEQ ID NO: 20276 - DNA, 378 bp, A.fumigatus
ttccagaaggtgctaaagtacatcgaactcgagcttaaccgggtatttacatcacattctctgcgaatcagatttgaaccttctcaaggctccatgtcaatggacttgtcaaccatagtctcacttgaattgattcagaatcttcagaatgcaaaatcggaggatagcctccttggcctgctcaatgaaactttgactccaatgggtgccaggctccttagggccaacattttgcagccatgtacagagaagtcgaagttgttggcaagatacgacgccgtcgaagatctttcaaccaaagaggatatgtttatctctgtcagacaaggtccgttccagtttgatctgatctgctcgaaaaaaacactaatctcatga

SEQ ID NO: 20277 - DNA, 1407 bp, A.fumigatus
agaagcaaatgtagatgccgcggaccttcttggccaaagtatcaggtacattacaatggctctattttcttctggtcgatattaattacctgtccttacgcagaatcgcacaacctcactctagacctcaagttcgattcggctcgtcagtattatatcagtgtgtccgcttcggaggtaaaaactctctcaggaatcttcatcaacatataccgcaggaaaaatcgcatagaatgccagacccttgacctcgtcaagctgaaccagaagattatggacgcgcataatgaggtcatcaacatgagtgatcaaacgattcaaagccttatcaacgatgtctgctcggaaatatccgtccttttcaaagtgagcgaagctatagccatgctcgatatgcttgctgcctttgcggagctcgccacttgcaacgaatacatccggcctgaattgacggatgtccttgccatcaaatctggacgacacccaattcgtgaaaagatccatacgaagaagttcatccccaatgacgcttatgcaacgcagcaatcgcgtttccagataatcactggctcgaacatgagcggaaaatccacttatatccgctcacttgcactgatgaccatcatggcccagattggctgtttcgtcccagcagaatatgcatcctttccggtaatgcaccagctcttcgctcgggtctctacatccgacgatctcgaggctaatgtctcaaccttcgccgcggaaatgcgcgaaatggcgtttatcctccgtaatatcgagccgcggagcattgtgattgtagacgaactcggccggggcacaagtactactgatggccttgcgatcgccatcgccattgctgaagctctcatcgaaagccacgccctcgtctggttcgttacgcatttccgtgacttggctttgatcctggcggagcgcaacggcgtggtcagtctccatctggccgcggaaatatcgccggacatatctcagatggttatgctttacaagatcgcagaaggaccagtcacaacgcaattctacggccttgcggtggcaaagctcgtggatctgccgccaggtgtgcttgaacgtgctcagacggtatcggagaagttgaacaggatagcacaacgccggcatagcaggtccaaggcgctcatgctatcacgtaaacgtaacctacttctttcgttgagagagcagctcttacaagcgcgcaacggaacattggaaggggacgctcttcgagaatggctgaaggaattgcaggacaattttgtactgcgtatggccgccatcgaggatgagaccgctgagatgaacaatgaagaagtcgattatgattcaaatactgctccggccgaaagtgcgcaagataactttggacaactgtcttcctag

SEQ ID NO: 20278 - DNA, 3069 bp, A.fumigatus
  unsure (239),(1150),(1168),(1192): Identity of nucleotide sequences at the above locations are unknown.
ctttggaaatcaggatcttgtaagaggcctgattgccggagtacgtttccttctggtgagtgtcctgagtcgaatgatccaaagacaaggcaattgacagcggtccaggaaaaatcagaatgtctcacccgcgactcgttccttgtccgaaggcacgagggtctgcgaagaaaccgaaaagcattgctttcggacctaacagcgcttgttcgtacaactaagagtttccaagtgattgntagcggaaaccccttacaagacgaggtcgagtacatggtcgatgagatgcttctcaaagcgttccgcgttgtgacccgcggtgtgcggtttctcgatatctggaacgaggaggttggtctgagtcgaacaatcgcggagctggcgcaaagcaaggatcatacttctccccttacacgtgcatccgagacatttgtcatgtcggaaaaggccccctcggaggctgagactgaacgaaacgagtcgcgagttctcaaccgcagccgcatgtcgatgagttgctgttccacccgggtagacatgtcggagcagccacggcccgtttccgtcgctacaaaacggatatccatctcccaccgggtgtcttactcgggacctgctgcagcttcccgaaacccgaatctcgcatcggaacgactcaacgccacgtacgatgctttcctcggcgtgcttggttcattcattggtctccacctgcagtctcgctcctcaaccgagctagtcgtcaccaccgagcaggctgtccggtcctgccggggtctgctcactgtggtcgaggccgtctgcgaacacaactctcaaggctgttcgctcctcgagagcgccaaggatgcgatgtatgagcgactgtccgagctcgttttcgctgcacgggaacccttccgacccgcccaatcccccgatgacgagcttgtcttcatgcccgatgaagggaaagcgactggtcgacgccgccaccgactgcgtccgagcggcagggaactgtctggccaaagctcgcctgggtgcgggagccaggttggagatttcgaactcgaggcactgccgcaagacgttgcgacgccattggtcggtgctggacccgagtcgcaatcgcaacagcagaaaggcgaccagcctgagctatccatgngactcccaccacatcccntgcagatcccccagaacgcagatntcgagtcttcccatcccaccccaggtcttaccgacgataccactccatcttcttctttcaactcccgcaacctcagtaaccccaccattgctgcaactgacgaggcgtcattgccatccgctaacatccctccccccagcccagcgaagtcctcgttctcctcgtcttgtgatgcggcggctggtgtcaaggtactcgagaaccgtatcagccatcccaagtccgagatcggcgagtcgtttggccgtggagtgaccagtactggaagcagcttcacctaccacagccacctccgggactccgaaatgagtggagtgtctcaaacttctactcgcgccacatccccagacattggcagctgctaccaggctccatcgctcaagagctgtgtcagccactcgacgctggcggaggagggagaggagaccgaagtgaatattctggagaagacttatgcgcatgaattgatcttcaaggacggtcaagtcatgggcggcagtcttcgggcactgatcgagaggctcacctctcatggatcaacgccagacgccatgtttgtctcgaccttttacctcaccttccgtctatttgcgacgccgctggagtttgccgaggcccttgttgagcggttcaactacattggcgatacgccgcacgccgcgggacccgtgcgtctccgcgtgtacaacgtgttcaagggttggctggagtcacactggcgtcatgactgcgatgactcggctctagattttattgtcaattttgccaaaactactttgatgcaatccctcccctccgccggaaaacgccttctagaactgacggacaaggtttcgacgctccagggacccgttgtgccccgtctcatctcgtccataggaaagaccaacaccgcaaccgcacaatatgtgcacccggacaccccgctcccccctcccattctcagcaagaaggaggtgaaccttctgaaacagtggaagaatggcgaggctgcgatcagcatcctggactttgatccattggagctggcccgtcagctcaccatcaaggagtcacgcatcttttgtgcaattctccccgaggagctgttggcgacagagtggatgaaaaagagcgcttcactggccgtcaatgtccgtgccatgtcgactttgtctaccgatctcgcccatctggtggctgattctatcctgcagctggaggaaccgaagaagcgggcggctatcatcaagcagtgggtcaagattgctaacaagtgcctggaactcaacaactatgacactttgatggccattatctgctctctgaactcatcaatgatctcgcgcctgaagcggacctgggaagtggtatcgcagaagaccaaagccactctcgagaccctgcggggcatcgtggatgtgtcgcgcaactacgctgtcctgcggcaaagactgcaaactcatgttccgccatgtcttcctttcgtcggcacctacctcacagatctgaccttcgtagaccacgggaaccagccgctgcgaagcctgcctaccgatgacggcgagatgaccgtcatcaactttgacaagcacatgaagaccgccaagatcattagcgagctccagcggttccaggtcccctaccgtcttaccgaagttcccgaacttcagacctggatgcagaacgagctggtgcgggtgcgttccaatggcgaaaaaagcctgcagactttctatcgtcgctctctcattctggagccgcgcgagattacgccgcggccgaatttgcagcctgagtctagcgcctcctctatcatggagaacgccagggacaaatttgacctcttcgcttggacgcatccctccaaggccaagtcggtcgctaccaatagttga

SEQ ID NO: 20279 - DNA, 654 bp, A.fumigatus
ccttcgcgccggctaatcgctatcggaacgagaaagcgaacgaataggtcgctagagaatagagacatggaaccaatgaagcgacacattgcgccgttaaaagtcgaaaagacaatcaccaatccttgcgggtcgaccacttcagagtctggagacccttctagcaatcatcactattctacacagcacagtctgcagttgtcaccacctctgacgccttactgcgcaacctcgtccaaagacaacagcatggatcggacggaggcccccagggccgtcttccacaactatctacgcgcattctatccgttccatccgccgggagatgtttcgccggatacgattaccctgccattggaccaaggagatatcattctggtgcactcggtacacacaaatggctgggctgacggaacgcttctggacaccggagcccggggctggctacccaccaattactgcgaagcctacgaccagctacctatgaggcctcttctgaaggcattgaccgatttctgggatattatccgaggcggatgcgggtcgtctcttcgtgactttggaaatcaggatcttgtaagaggcctgattgccggagtacgtttccttctggtgagtgtcctgagtcgaatgatccaaagacaaggcaattga

SEQ ID NO: 20280 - DNA, 237 bp, A.fumigatus
gcgcaaaggagacaatattcaaagctcaagggtgcaacatcaaaagaatcgactcaagaccaagtctacgtccaccttcgccgactgatggatgtgattatgtcagcgttccaggtcgcgtctgctcaaaacaaatctatcaacttatccaacgccaccccaggtcagttcagtctaccaacgtctaccccattttccccccaattgagtcgctgtgtacatggctcctgctgctag

SEQ ID NO: 20281 - DNA, 234 bp, A.fumigatus
aggaaatcagtgcaaacacatattctatggtatgtcgacgacatttctttcaacattgtgaccttgtctactcttctttcgtactggcgttccgtctctattctattcttacagtcgctaactactatggcctatcaagtcctaataaacgctcttaaagccccggcacatctacagtatcagctggcattcttatcctcggtaagcgttcgcgcaaaggacgcagttgtatga

SEQ ID NO: 20282 - DNA, 228 bp, A.fumigatus
aaatgcaacatctgcctcaagacgtacaggtatggaatttctgtggaggaaggtttcatatatatgagcttagattacattgaagagcacagttatcaagagatggtagcattagcagtagtattcaaacggctaccttctcttggtgctgttatgccgggccagtcatctctatccgacgtcctcctcctgccgcgaggattccccaatgaccttggtaccccatag

SEQ ID NO: 20283 - DNA, 1374 bp, A.fumigatus
  unsure (1166): Identity of nucleotide sequences at the above locations are unknown.
tataaagaggatcaattcatcgcagaaatggcgcgtccaaaggctatccgtgcgcctacagccgccagtctacccaacactctgcgtctcccctcctcgacctcgtctctcataaagtcattctcacgactatcacgccacgctctgctggacctagtcttccagtggctcgatgatcgcaacgcacaattgtttccaccatatcttcagaaagacgagatcgagaaccccgccgacgataaactcagcccgtacccggccgccgaaacgatcgaggacgtccggaatgcttaccaggatctacaagacaggaagggcggcaaacgcgaagtgattgatcgtatattggagggcgactggcgacacggtatcaccctgcgacaactggcaatggtggacattcggtacatggaagatcatcccgcaagtctgcgatggacagcatttgaactcagtcgcattggcatggacggaactcaatccgcaggagcaacaacgcccgacgtttccgcatgtctaccgcgcatccacgccaccacgttcctgagcaaccttcaacagcagatttctcctctggtgaaagcgcattaccatctcgtccgctcgtcctcgcttccgctctcgttcttgcgcattctagtgaccagttctccataccaaaaccctcgccagccacctgaggctctgatggactcatctcgagtgatgtacgtggctttccccgacagttgccctttcatctacacgtccatagcaacatcgcctgtcgcaaaatccaatacaaccaccaaccatgccgtcgcaaccgatgctcgaagtctgcagcgcattgtccgagacgctttacccaaagcattatcacgacctcaagagcgatatgccctgaaagcgacctctctaacagcgaagaacctgcaagcgctgctggcgctccgtggtcctggaagatccaacgtggcccatggggcgttcagtatattcgcggacgcggtactcgaagggagtcccttggacccacgtccgtcggatacgatatctcccagagagcacttctaccaagacttagacaaggagaacgaaaaccaagaggacggcaacacgagcaaagagacggagcctagttcccatgttgctaagaagcgcaaattaactgtccattctcgttntggcacaactggaaccctctcggctgcccctcttgaaccgctcgacgtgcgcctgcttgaacccacgacgatgaggatgacgaacatgaggtggaccacacgcaaccatcagtatcactcacatttgtcggctcggacgtcatcagtggtatccgcaagctcgccgaactgggtgtcgttgacccggagcgtatgccgtcctggatga

SEQ ID NO: 20284 - DNA, 213 bp, A.fumigatus
acccacgacgatgaggatgacgaacatgaggtggaccacacgcaaccatcagtatcactcacatttgtcggctcggacgtcatcagtggtatccgcaagctcgccgaactgggtgtcgttgacccggagcgtatgccgtcctggatgacgggcgaagaagcagtcagcgtagctgtcgttcatcgaggaaaacgtgtagtcaaagctggttga

SEQ ID NO: 20285 - DNA, 339 bp, A.fumigatus
ctaacgcgttccagacctacatacctccagaaagacaacgaaatcatgcctcgcggagcagaatacgataacggcatcccccagtccgacaacgccatcgaggccggcgagacaaaggtccatggcaccaactctgctgtatgtcccgccaaccacctgcagcaccctaagcacgatgtattgatattgagtatgatactgacgaacaacagaacgaccacctcgatcgcgtcaaccgcacagctgatctccccgatgtccctgccggcggcatgcacagcggcggcggtgcccccggccactcgagcggcaagggcggtcatgagcctcgtaccctag

SEQ ID NO: 20286 - DNA, 489 bp, A.fumigatus
aatcgaacgtacttctcccaaaaaccacgctaccaggtaaccgaagacaatggcctcattggtctccgtatccgacgcgggagacggaataccggcgatattccagaggtcgcccttccactcatccaggtacttgtatccagttcctgtatcgatgaggagaacccgaggggcaccctcaatcagccagcgaccatacaccatgccaatgccacgctccttcatggagttcatagtctccaccatgcgggggttcgagggagtcagctcctccacctccacggctgcggaggcccggttcaaaggcccgatcagggtgtaccgatcgccatattcagctgtagtgaccggagctttagatttcagcacggagtatataccaccgactcggttggcgacttcagtagcaatctcaaagaggatgtggttgcgcacatctctcttgggagggtcgggaccagtatcctcgctgtccatcgtgtgccttga

SEQ ID NO: 20287 - DNA, 192 bp, A.fumigatus
gatggaggacggttcgatttttcccccttcctgcatagagccccctcgtgcatgcagcatatgatctatctcgacagcgagtcaagtaacgcatgctcagctactcaccaattgttgttctctatctgcatcaagaactcttgcctgatgtgcctgaggtatcttctgtgtacttgccagttggtggggtaa

SEQ ID NO: 20288 - DNA, 537 bp, A.fumigatus
cagggctccgacatgcgcgaacccaacaaggaagacgagtcaataactttcctcaccgccgtccccaaatccggcttcgagactattatcagcattccggcgcagacatcccagaactacctgcgcgttcttggcctcaacgctacaggccagatcctcggcgcgacagcatggttgcactgggatccggagtctgaggaagtcgccctcggcccgggtaacagggacagcggcaacggctcctcctcctcctcctcctcctcgatcgatgtccgcgcgttcctgttctttgcttttgggttctcctctgctgttttcctggctgtgtgtgcgtggtttgtctggcggcggttctggactcaggaagctgaccgggaatgggaacgggaacgggaacggggtgggtggaagcctgttgatgagttcaatggggatgagcatgatcttagcgagggggagtttgagggaatggagttatcgttgttgcagggtaggcggttgtcgcgttcggattcgggaggggagtttgatggttga

SEQ ID NO: 20289 - DNA, 234 bp, A.fumigatus
ggtacggatgaggagcctgggtgggcattggaatataaacatccgagtgctctattccatcacatctatctattttataaccagaattctatttatgatcaagtatatgagaagaaaagctgttgcgccgtctatctcaagggagaatcacaatcttcccttccgcttcattttcttccatacaccgatgggcctcgacaatctgttccatccgcaagactcgccctatcttga

SEQ ID NO: 20290 - DNA, 204 bp, A.fumigatus
gcacgatgtattgatattgagtatgatactgacgaacaacagaacgaccacctcgatcgcgtcaaccgcacagctgatctccccgatgtccctgccggcggcatgcacagcggcggcggtgcccccggccactcgagcggcaagggcggtcatgagcctcgtaccctaggcgagaacaagggtcttggtgcgcataaggcgtga

SEQ ID NO: 20291 - DNA, 1020 bp, A.fumigatus
  unsure (780),(834): Identity of nucleotide sequences at the above locations are unknown.
tacgactacttgaacggggaaaaaatgtccttaatgaaagccatcatcctgcacactcccggtcccccagacactctcaagctcactcaccatcccatcccaattcctgaaccaggtgaactccgcctcagaatcaaagcattcggcctcaaccgctccgacctcctcgtccgacaaggccgcgccaatcaccccatcgcctacccccgaatccccggcatcgaagccgtcggcatcatcgacacagccccgggcctagaagacactttcccgccaggtagcaccgtagcgaccgcaatgggcgggatggggacagtgttcgacgggggctacgccgagtatgtatgcgttccagcgcggcagacacagctcctccagcctaagacgactctgccatgggagattctgggtgcgatccccgtgatggtgccgacggcgtggggtgcgctgattcggtcgctgggccttagggcgagggatcggctgttgatacgtggggggacgacgtctgtggggctggcggccgctgcgattgcgaaggcacatggggcgtatgtggccagtacgacaaagaaaaaagagcgagaggcgatgttgcttgagaatggggcagatcgtgtctggactgacgatggggcggttgcggaacaaattcgggacgcggactcgggctgttactatgataaagtgcttgagctggtggggacagctactctggctgactcgctgcggtgtgtgaaaaaagggggtgttgtatctctggtaggcaggttgtgtganaatggcgatctggaaaaggtggacctgatggagttgatcccctctggggtcaanctgacggtgtaccacgggacgtctgaagatttcatgaacacgccgctggatgcggtactgaggttgattgagcagggaagtttgaaattcaagatagggcgagtcttgcggatggaacagattgtcgaggcccatcggtgtatggaagaaaatgaagcggaagggaagattgtgattctcccttga

SEQ ID NO: 20292 - DNA, 261 bp, A.fumigatus
gaagaggtgaggcaactcatgcccccagccctttttcacttcttgctgactccaggtatagcctacccttcatccttcgatggtcccgaagactatttcgacgtcattggaggaacagagcagaagctctcgcgtccattgtcagtccccgggtctccacgggatcgatctggagtgatgactccgggtgattttgctaccattcaggaagtcaaagagggcctggacactgaggactatatcgcatggcgtcttccgtaa

SEQ ID NO: 20293 - DNA, 228 bp, A.fumigatus
ggccagcttgctaagtggtctgtcttgtgtaggcacgcgacgccctatcatgcgcctctgtaccttgcccacagcaagggttttttcaaggaagagggcctcaaggttgctattctggagcctaatgacccttccgatgtgactgagatcatcggcagcggcaaggttgacatgggcttcaaggctatgattcacaccctggctgtatgtagttggtcatgtcgttga

SEQ ID NO: 20294 - DNA, 270 bp, A.fumigatus
tggttcgatgctcacagtcaccaggccaaagctcgtaacttccccgtcacctcgatcggctctctgctcgacgagcctttcaccggtgttgtctatctcaaggatagcggaattaccgaggactttcggtccctgaagggcaagaggatcggttacgtcggagagttcggcaaggtttgtggtgtattttctttctccggaagaagggcatgcactcattggggtgttcatagatccaaatcgatgagctcaccaagtactacggcatga

SEQ ID NO: 20295 - DNA, 1236 bp, A.fumigatus
acatatccatctttcttggacaggctgtcgacattggtcagtcacaaatcaacgaaggaattgaagttccggtcggaacagacatctcaattgcccaagggggagtttctccggtatttcacactgaatcgactttttgccgacgaatgcgaggctatctctgggagaagcggcacggccatgaagactgttgtcagcaaccagatccgcgactacattaacagattcggggagaaccaacggcaccgtctcgtcgacgtgatggactctgaccgatgggacgcgcgcgattttggggaaactgagactgccattctcagcaaaattcttgaggcaagcaccaaggacgttgaagcctggttagctgcctctaggatctggtcgccacaggaggagcagaccgagaaggcgagacgcgattctgccgccaccaatggcacaggcaaggacagggtgcgcagtgctgtgattgacgagcagaaatatatccttcccgaatgcgctgtggcgatgatgaagagcatcgaggagtttcagtttcttatggccaatattcccagtatgatccaggatatcgcccctggtctgttggagtcattgaagttattcaattctcgatcttcgcagctcattcttggtgctggagccaccaggagcgcgggtttgaaaaatattacgacaaaacacctcgctctttcctcacaggccctgagcttcattatcgccttagtaccttatataagggaattcgtgcgacggcatgccccgtcgagccccctgatgggcgaattcgacaaagtcaagcggctgtaccaggaacatcagtctggaattcatgagaaactcgtcgatataatgagcggccggtcttctgtgcacgtcaacgcaatgaagaagattgactgggacgcggcggcgggaaataacgtcaacccgtacatggagaccttgacgaaagaaacaggcacactgcaccgtgtcctgagcaagcatctgccagagacgacagtcatgatgatcatggaccccgtgtttcgaaactatcgcgatcaatggacccgagcttttgaagaggccactgtccacacagaagccggtaaacagaggtacggctctctgccaacttcaagtttgaactgtactaatcatcctcaggatgcaacgggatgcggaacatttccagaacaagctgagcaagatcgacggcttcggagacttgggacagcgtctgcttga

SEQ ID NO: 20296 - DNA, 558 bp, A.fumigatus
tctctacgatattgcatactcctacagcttctaatctacaattcaaggcacacgatggacagcgaggatactggtcccgaccctcccaagagagatgtgcgcaaccacatcctctttgagattgctactgaagtcgccaaccgagtcggtggtatatactccgtgctgaaatctaaagctccggtcactacagctgaatatggcgatcggtacaccctgatcgggcctttgaaccgggcctccgcagccgtggaggtggaggagctgactccctcgaacccccgcatggtggagactatgaactccatgaaggagcgtggcattggcatggtgtatggtcgctggctgattgagggtgcccctcgggttctcctcatcgatacaggaactggatacaagtacctggatgagtggaagggcgacctctggaatatcgccggtattccgtctcccgcgtcggatacggagaccaatgaggccattgtcttcggttacctggtagcgtggtttttgggagaagtacgttcgatttcagggactcttagggtgcaaaaatag

SEQ ID NO: 20297 - DNA, 1548 bp, A.fumigatus
tttatcgctcacgaacgccggcgtgcagtagtcgctcatttccacgaatggcttgccggtgtcgccctgcctctgaccaagaagaggcacatggatctaaccactatcttcacgactcatgcgactttgcttggtcggtatctttgcgccggatctgtcgacttttacaacaatctccagcatttcgatgtggacgccgaggctggcaagagaggcatctatcataggtactgcattgagagagctgccgcacacagcgcagacgtcttcactacagtctcacacatcacggcatttgagagtgagcatctgctcaagcgcaaaccggacggggtgcttcccaatggattgaatgtcaagaaattcgcggcggtgcatgagttccagaacttgcactcccagtccaaagagaagatcaacgacttcgttcgcggtcacttctatggccacaatgactttgatctggacaacactctctacgtcttcacggcaggtcggtatgaattccggaacaagggagtggatatgttcatcgagggcctggctcgtcttaatcatcgcctgaaagccagcgggtccaagacgaccgtggtggcctttatcatcatgccagcccagacctcgtcgctgactgtggaggccctcaagggtcaagctgtcgtcaagtccttgcgagacacaatcgagatgatcgaaaagagtatcggaaaacggatgtatgagcgttgcctagcctggaaagaaggcgacaacatgcccgacgagaaggatttgattacaagccaagaccgtgtgctgctgcgtcggagacttttcgccatgaagcggcacggattgcctccgattgtgacgcacaacatggtcaatgaccatgaggatccgattctcaaccaaatccgtcgcgttgagcttttcaactacccgacggaccgcgtcaaggtcatcttccatccggagttcctgaactcctccaatcctgttctgcctctggactacgacgactttgtccgtggtacgcatctgggagtcttcccatcgtactacgaaccctggggttacacgcctgcggaatgtaccgtgatgggcgtgccaagcatcaccaccaacttgtccggtttcggctgctacatggaagaattgattgaaaactcctccgactatggaatttacattgtggaccggcgcatgaagggcgttgatgaatctgtcaatcagctgactgacttcatgttcaattttacccagaagagccgacgacagcgcattaaccagaggaaccgcacggaacgtttgagtgatctgctcgattggaagcgtatgggtttggaatatgtcaaggctcgacagctggctctaagaagaggtgaggcaactcatgcccccagccctttttcacttcttgctgactccaggtatagcctacccttcatccttcgatggtcccgaagactatttcgacgtcattggaggaacagagcagaagctctcgcgtccattgtcagtccccgggtctccacgggatcgatctggagtgatgactccgggtga

SEQ ID NO: 20298 - DNA, 672 bp, A.fumigatus
atccaaatcgatgagctcaccaagtactacggcatgactgccgacgactacactgccgttcgctgcggcatgaacgtcaccaaggccatcatccgcggcgacatcgacgccggtatcggtctcgagaacgtgcagatggtcgagctggccgagtggctcgcctctcagaaccgtccccgcgatgacgttcagatgctccgtattgaccaactcgccgaactcggctgctgctgcttctgctctatcctctacatcgccaacgacgccttcctggccgccaacccagacaaggtgcagaagttcatgcgcgccgtcaagcgcgctaccgactacgtcctcgcggagcccgccaaggcctacgaggagtacatcgacgtcaagcccatcatgggaacccctgtgaaccgcaagatcttcgagcgctcctttgcgtacttcagccgcgatctgaagaacgtccagcgtgactgggccaaggttaccaactacggaaagcgcctgggcatcctcgacgcgaactttgagcccaactacaccaacaagtacctctcctgggacctggatgcggactccaccgaccctcttggtgaccagaagcgcatggctgagctgcagaagcaggtcgccgctgagggcgggttcaagcgccttcacgtgtctgctgctgcttag

SEQ ID NO: 20299 - DNA, 645 bp, A.fumigatus
tatctgtctgatcacagaaattgcgatccaacactgactcctcaaacaggcccgtatacccgagcaagggcatcacattcgtccgcaacgatgcgaaatctttccgattctgtcagtacttactttttcatccaccccacgcacgacaatagatctaactcggttgcaggtcggagcaagtgtcatgcaaatttcaagatgaagcgtcaaccccgaaagctgaagtggaccaagactcaccgtgccgcccgcggaaaggaaatgattgtcgactcgtccttggtgctgtctcagttcgccaagaagaggaatatccccgtcaaatacgacagaaacttggttgctgctaccatcaaggccatggagagagtggaagagatcagagcccgcagagagcgtgctttcacaaaacgcaggctgggcggcaagctggcccgcgagcgcaagcgcgaggaagaccgcatggtcgttgcggagggccgagcacctcatccgcaagggaactgcgggagagagaagaggggccagcctttggatgtcagcaagatatcaagcagagtggtcggcgaggagaagctcagacagaagaagaagacaagattgttggtggatggaggtgtcgaggaggaaatggacctcgactag

SEQ ID NO: 20300 - DNA, 222 bp, A.fumigatus
gcctgcgacatgtgtcggaagaagaagatcaaatgtgacgggaagatgcccaaatgctcgcattgtaccaactacaagacggattgtgtgttcacccaggttgagaaaaagcggaatcctcctaaagggtatgcttacttctctgctttgcccctgggtgcccatgctgactttccgtcgcgattagtgccaagtatatcgagggcctcgaaaaccgattag

SEQ ID NO: 20301 - DNA, 606 bp, A.fumigatus
acacaagtatcttgcaattgtgctaatctgccacatagcatctgtctccgttccgggcgtccgccggtacaagacgatgacgacatgaatgtggaattaccaagcgacgatccacccgacaacatcggcaatgtcccattatctgacggtagaagcaagtttaacctgttccgatccatgtgtcgcttcgctactattgaaagcaaggtgtacaaacggctttattccgcaaaggcgtcaaaacagtctgatggagagcttctgaataccatcggagaactcgacaaggaacttgaagactggaaggacagtatcccactggattttcggccagaacatgaaatcaaggcttcgcacacacctctcattctccatgttgttgtcctacatttcgcctactataactgtttaaccaccattcaccgtatgtctgtgcatcacggttattggacaagccgtctctccaattacgccatccagggcctgaatgccaggcccttgaatcctagggtcttcttatcggcggtactctgtgtgactgcagccagggcgtctattaacctaatcaaatacattccacagggtgatttcgcctgtgtctggtga

SEQ ID NO: 20302 - DNA, 837 bp, A.fumigatus
tctaattccttgacctcgccttcgggctcatctacctcgtccatggccaccttactccgacggccaggcaatcttgctcgatattcgaggagagccgcagaatgcataaatcgcacacgtccgctgtctgcgcgtgctccgcagtcgagattatcatcgttgataacggcccaccgtgtcaggacctatgctactggaactcccgggggtccgaaccccccgaacgacaaacgcagccagaacaaagcagcgacgggaccggggaatgacggcgggaaatctggagatgggaagacgccgaacgatcccgaatcctctcttagcaaggaggagcaggaacaagtcaatctattcgtcgaccacctgaagaataaggtgccgccatcgcaacatcagatgctggatgatatccggacactcttgctaagagaggggttaccggcggagatgcggcagttcattgagaagcacgttcagtccggaaggccggcgtctctgatggattatgtcaagttaacacgatacatgtcgcagcacatgaccgactacgcctacaaactgaaccagatcgaggaggaacggaataaggagaaagctaagtcagagggcggtgcacagggcgagcagcaaaagcaacaacagcagcaggagcagcagcgagagcaaaagaaagggcgagatcaggcgaacaagcaaatacctccgaattttcggaccttcgagatcaagttcgaccccgcctcgtttttgatcacctcgctcatcacctactatgtataccgcagcttttttccctggggaaaactgccaaggagatcacatggccagagtctataa

SEQ ID NO: 20303 - DNA, 417 bp, A.fumigatus
tacctagctggtgccttctatggcttcaagactatcattatccctcacaacctcgaacctcaagtcctctccgaccacctagaaaaatcgcaggcatatgctttaattggcggaagccgggtgccctggaattgttccctgggggctaagaacaacaagcaattttctcaggttatttgggtcgctaaggttggaagccagcacatggactggaaccaagtgcctggggattttcagggaaactgggaggtagccgtatggcatgagttggttgaggaaaagaaagatctgaccggcttagacgttcccaagtgggaccccaactctccggccccctctgtgactcttgtatggccgaccaagtctcacgtgggcgatttcattgaattccagcccgaggttcgttgtctcatctga

SEQ ID NO: 20304 - DNA, 444 bp, A.fumigatus
cgacgcgcaggcctcctacctgttcagggagtcaaggccattacctatattgcaacctgccctgacaaacaagttgtcctcacattgctatgctcattgctaaatactgtatgtacagtggtgtatggttccaactattgcctcgtcctaaccacagtctcacgcagtctatcaagtacaatcctgcgtcatggagggttccatatgaccatgtggtctggaaagattccaagcagatcttcgttatatactgtctacaatttcttcttggtcttctactatatcctatcccagagggacggtcgtgggacaccgcccaagaactattatcgccattactttggtcggctgcaccgaccacaagacttccaattccttgtcgatggcatgaccagaatcttgaaccaacctgtgggtctgccttcttcagccggctatgcttag

SEQ ID NO: 20305 - DNA, 621 bp, A.fumigatus
cgtcccccaccaacaagtaagttagcttcattgcgtctggcttacggagaactgatgattatgatcagtggcgtcttcgacacttcagtctcccaaacgctttacctcttcattgatgcaaagaccgatggacatgagaccttcaaggctgtgattgatgccttggaaccactacgtaaacatggttatttgacgactctgaagaataacaggaccatcaccaatgggcccattactgtgattggcacaggcaacacgccttatgatatggttgcgcctgtcgcaaaccgagactacttttttgatgctcacctcgagtccttgaacgagcctgagaatgccggcatcacagacctgatctctcccatcgcgtctacaagctttgcgcgtgccattggcacagtttcggagggcgattctgaagcgatcttgacagagaagcagcttagtactctccgctcgcaaatcgcgaccgcaaaggaaaggggcattggagcaaggtattgggagacgcccagctatcccatcaggacccgtaattcggtctggagaactctgctgaaggaaggtgttgcgctcctgaatgccgatgacctcgaagctgcggccggttatttctga

SEQ ID NO: 20306 - DNA, 762 bp, A.fumigatus
ttctgggagctcccagagtcgacagaagatgtattcagcttattcactcccgcagatatacgacggacgcgagaccatgcattacctaactttgagacactattgctttcaataacgtctcgtcttacctttctgaagaatcatccgtcttttccagatcccgacctcgctcccgagagagatgttctcaactgtatccgcattctcacgcgcatccttcccttcatctatgaggctgagcatttagaagaatgggaggataaattcttttggggtcggcgcaagaaaaatactagaggagctcgaccgggagcagaagtcctatttgacgaatcgcaggctgaaggacgccaggaggagacgttgcctggaacaaatgactatgaagatgtgaagcccttggccgaggaattgatcgacaacctgctggatctcttattttatacggactttacgatcccaaagctcgcaacgactaagggtaaggtatcatactcgatatggcaaagcggtgtcggctgcaatacttccatgggctctagcaaagagctcgaaagcaaccggtgcgagattttgcgactattgcttacattaactggaaaggcgatgtacatgccgctgagtaagattcttgtcctcgttatgggacgcaacgctgacgacgcgcaggcctcctacctgttcagggagtcaaggccattacctatattgcaacctgccctgacaaacaagttgtcctcacattgctatgctcattgctaa

SEQ ID NO: 20307 - DNA, 1485 bp, A.fumigatus
  unsure (1395): Identity of nucleotide sequences at the above locations are unknown.
gagcttctgacggctcaaatgtcgaaagttgatgtcgacctgggagattccttggccaaggtgctccccacgggggtaaaggtgacgatccgccatatctcatcggccccaagcccgtgtgtggctctcttcgcagctccaccaggcgaagaacccgagtcgactttctgcgagaatcatttcctcgcagtctccattagtcccaatgaaaacgaggagtcggaagtgatcatctttgggatcgaagtgctggtctacggcaccgcgcatctgacaaccattttcgtctccaaagccgattcaactggctacctgcatctgctcaagaatgcacccaaggtctcacttctcagactgatttcaaatgcatttctttcatttcttgtgcagacccatcaacggccaggggttcggttgatggtgtccctgtttgcccgagcccagaatcagtacttgtttcctgggagcatcgagaaccctgaaaagcatgtcttggatgatcgtgggttaatcaagtggtggtgtcgagtcatcgaccccattctacgagaatatgagcctgagacgggttctcatgaaaaggcagtggatgatcaaactcaggagtcggcgaagagttcagcaacagccttcctgattgttcctggatgcgacaagttcgagactcggggcttcttcccaatcacagcgaggtctgatggcaaggatcgaccgagatggttaaatagctaccctctccatcagctctgcgataaccccaacgctccaccacggtgtctcgtccctcgcttcccagatgatcccaagacacgctttctgatcgacctggacgatgaattgccagagtcgacgggagctgcaggctccaaggagaattctggtcattggcgaagcgtgaagtctcttgcgcagttttgggagatgatgtcctttcgacaggaatgttcggccggccgattagttgggttcttgtggcttgtcattaatccgccaggccttgtcaattcggttcagatgacgagctctcgtgtcgcttcgcgggatgtcgagaatgttctttctgaatccgcaaagacaacccacgatgcgaccaagcaaaaggatgaagcagcgtctgtgtcttctccaccgcacccttccacaagtggtctccagacatcaccaatcgccctacccggtgtctcgtcttccgatacccatgccacagtacagcaagctacgggacccagtgcgttcttttggccagacacaggccggggacacgcagtcctgagtgaggaagactataaggcggcaatcaactttctcatcgatcaagactttaacaccaagcataaggctatcgccagcaccaaggcatgggccgagaaagtcgcctcgctcgctgatcagctntgggttggtcaacgggttgaggggagaaatgctacgacggagcctggtcagaaacatacggacgctacaactgtcattaacacagccttt

SEQ ID NO: 20308 - DNA, 192 bp, A.fumigatus
agttataataccatcaacccgcgccggtgtcgcttcgctatgggagcctcggagtcgaagttggtcttcaagcagggaatcttccgtctgtcagatgagaaggctatccctgctgatgatccttactggtccagaatttgtctctcttaccataatttctcatctgatcactcctcgctatctactcactaa

SEQ ID NO: 20309 - DNA, 801 bp, A.fumigatus
caaacaagttgtcctcacattgctatgctcattgctaaatactgtatgtacagtggtgtatggttccaactattgcctcgtcctaaccacagtctcacgcagtctatcaagtacaatcctgcgtcatggagggttccatatgaccatgtggtctggaaagattccaagcagatcttcgttatatactgtctacaatttcttcttggtcttctactatatcctatcccagagggacggtcgtgggacaccgcccaagaactattatcgccattactttggtcggctgcaccgaccacaagacttccaattccttgtcgatggcatgaccagaatcttgaaccaacctgtgggtctgccttcttcagccggctatgcttagctctaatgaagtggcagatgcaagttacgaactcgtaccttccaggtagccagaaatcgatcaaatgggctccggaaatgctcatcttgttctgggaggcccttcagtgcaacaagcgattcaggtcatttatcatcgactcaagtcgctcccatgactttgccattctctgtatcttttacgctatcgagtacaaaactgacgcatccaagcaaggcgttgtgagaatgtgcatctttattttacaaacaatgagcgtggaaccgaacttcgggaaaagcctcaacatgaaatttgaggctcaggagacgctacctcagaacatacgtattccgggcttcagaggtacctatggtgattacctcgtgatggtttgtctttcgccgaattcaacatgcgagaccgtactaaacgtgtcttag

SEQ ID NO: 20310 - DNA, 318 bp, A.fumigatus
tccatccatactttgcttaccgcaagtaaaggcaagctgaacgctgtctatccagcacttttagcgatcatcaacaacgtggctccttacttggaacatctttcacccgccacatgctccagacttctgcagctcttctcctcaatgtccgctcccagtttcctcctagctaacgaaacgaaccatgccctcctagcctcagtgcttgaatccataaactcaatactcgaacaccaattcaccagtaagtgtctctatgccttcacttttgtggcggctcagctcgctgacttactcctgcagaaaacccgtttctag

SEQ ID NO: 20311 - DNA, 777 bp, A.fumigatus
atgaccttccctccccctcccccttcctcccaatcgtcgattgcttctggcaccgataaattgtcttcgaacagggcggcgaggtcacagcaatctgcttggggtctctccgcatcccagtctagcattcgccgtgggttgactccgcttgcgactaacaacctttcatcgtcatcgattccgtctgcgaattcccgaggaccagttcagtcaactagtcccgctccaggtggttcaacctcttcccctttgacttcttccttctccgccgttctgagctccgcaaggggtcttcctggtggacggagcgtaccctcgcctgcctcaacaccgtcaccttttaccaccttccaatctggctcgcaacagcatcagcaatccggacagtctctctcgtctcctaaatttagggctcacaccccttcgtcacatctggcttccgcagcaggctctatcgcgggtggtggaggctccgggggaggcggtggtgggacgggatcttccagaggcgccaccttctctccgttattgtccggcaacaccgtgaattcacccacagggtttccctccgacaaaccgggctcagcagcttctggagctgcagctcacgcaggccagtcctcgttaactaaaatatccattgctcaagtcttccttcttctagactctatcacggagaaagaaggtcgagagaagtgggagaccaaagccgctcagatacacaaggtaggacagtccatcgcctttatgactttctgcaaatctgacatggagtaa

SEQ ID NO: 20312 - DNA, 243 bp, A.fumigatus
  unsure (76),(135),(154): Identity of nucleotide sequences at the above locations are unknown.
tgcaggctctcctctcttacatcggaagagcagctcaagccagcaaacatctcttatgttgccaaagacctctacnaaggagtgcttcgtattctgctgatcttgcaccatgacttcccaaagtatgttgcaganaatcattttcagttctgcnatgtcattcccgcccattgcgctcagcttcgtaatcttgttctgagcgcatacccgtcatctttcccaagcttccagaatcttttatag

SEQ ID NO: 20313 - DNA, 330 bp, A.fumigatus
cttgttgagtcgaacggaatggaggtcttctcgaagtatttccggcgtcttctgacgggcaatgccgctcaaatctttccaggggtcaacaagtctgtggaaaatgctggcaattaccccttgttggtccaagaaatgcagaaagtcactcaggacatagagcaagcccagaaaatcgcagaaacggttgatacctcagaaggagacatattccgtgatttcgatctttctaccttcctcgatcattttaagctggatcctgtcgctaaggtagcccttgcactggccttcaaaaccgccaataagtcggatctgcgtgcgaaaggttag

SEQ ID NO: 20314 - DNA, 4920 bp, A.fumigatus
tgctcaccccggaacgtcattgatcagcggtcactaacgttgctaccacttttagccgatgcaattctttcgaactctgtcaccccttttcttcaaagtttggcgacaccgtctgaggcatccaaggactacaaaaactcgttcattgggatgaccattgagcggtttatcctataccctccacgcaacttcaccgacgatgtgaaagccaaattagtgtacgcagcgaatctgcgctaccagaaattaggcgtggagatgccattcgaggttgcttctgcgctacaaatgttcaattttctgaatccaagatacacattggtccgtcagctccattctagaggaccccgagccacatcgaacgtcgacgccgtgaatgaagcagtcaattcagccgggcctgatgcctggaacgaagagcatattgccagcgcccttctgtttctggttctttctcagtattggcaggacttctccttggagactttcctccgagcggtcaagtcacattacgttgacaggcagattaattggtctttcattttccgaaactttgatcgagagggcctgcgacttgatccgaagcagtttgccaaactgtattcagtcctcttgtcggcggctgcggatgattccaccttggacatccagaagctttggggtggcgattgggaacatcgggacacacaaatgtctttcttgacggctctcattgtttcccgaacggatgtctctcagattcccaatcttcgagctaccttcccagcggatttcttcgctgacggtcccgagctcgttcgcttgcaaggggagcgggcaacgaagtctccgcttcgttctttggacgctatgaaagccatctttgacattgcgttgttctctcaggctgcatgggcagctgcggaaagtcaactactcatcaaggctgttgtccagtatgatcttcctgtctttttgtgctcagctctggctcttcctcagccgtggaccagcgttcaacaaagcttcgttcttcggacgctcgttgtctttatcttaaaacaagaagagggataccagcttgcgcttcatggagcttggcgtcaggatcgccaatgggtagctgagcagcttttcaccacgttcacccaagacccaacctcaacagccgcaatctacgagcatgctgtcgagtttgactggctggactacctgcttgggtacacaaacggtcttgctatggatctggcttgctatgctcatcgaaagggaccctttgacctcgagcaatgggttcgcaatgcagctcagaaaggtccaatggatatgggtaatctgttgtctaaatacctcaggatcaaggcagaagatgaattgcacgtccagaggaaggaacaacctgctccgcaaatggtcagtctttcagtgaagactgtctatactctgctgtctgttttggaggaatatgttggcgaccgtgaaaatctcacgccggtgcagcgaatatgcattcagacctaccctcggcttatcaattacggggaaggttttgatgatattatcgacgcgaatggcgaaaacggcaatgcgttacctgaaactattgacaaacagatgcaggagcttttcggcaagatgtatcacgaagaactttcgttgcgggaaattttggagttaatgcgacggtacaaaacatctcgtgatccggctgaacaagatcttttcgcgtgcatggttcatggactcatcgatgagtaccattgctaccatgaatatcccttggaagcgctcacaaagacagctgtgatgttcggtggtatcatcaacttccggctcgtcgacggaatcacgctgaaagtggggctgggcatgattctcgaggctgtgcgagaacatgacattcacgatcccatgtacaagttcggcgtcgaggccattgagcagctgatcagtcggctccccgaatgggctggcttttgtcacctcctgcttcaaattccgaccttgcagggcacgcccattttccagaaggctgaagaagtcctacgcgagcagggaagtcaggtgcgagactctgatcctggtagactagagaatgccactggcgcgtccataacgaacggtaccctcaatgagagcgcaccagacggacccacacgcaagttcctgtctatccatgtcgacccacctttacgacctgagatttaccatgatccagacgaggaggtgcaggacaagatcctattcgtcctaaacaacgtgtcggagcaaaatattgaggagaagctgcacgatctcactgacgttctgcgagaccagcatcatcagtggttcgcatcatacttggtggaagaacgagcgaaattacagccaaattttcagcaactctatctcgatcttcttgaccgcatcaacgacaagattctatgggctgaagttctgagagaaacatactcgagcgtgtgcaagctgttgaatgcagaggggacgattaactcgtccacagatcgcggccatctcaaaaatctcggttcatggctcggctcactgactatagcaaaagacaagcctataaagcacaaggatatatacttcaagggtcttctcttggaaggctatgacagtcagcgtctgaccatcgtgatcccattcacttgcaaagtgctggtccaggcgacaaaatccactgtcttcaagccgccaaacccatggttgatggatattctcgctcttctgctggaactgtaccactttgccgaactgaagttgaatctcaaatttgagattgaagtactgtgcaaagatctcgaactggatcataagacaatcgaaccctccgtcgttattcgagatcgctcggctcatatcgaggatgcgctgtcgacagcaaatatacccgaaggcctcgaagccttcgaagacatggctctcaccaccatcaatcagggaatgcggacagagaggttgtctcccgccgcgatcatgtccactcttccaagcttagacaagatccttgttttaccatcttccgcgagcagcatgattgacccgaacgtcctccggcaaattgtccacacagctgtcgaacgcgccatcgcggagataatcaccccagttgtagaacgctccgtcacgattgcatcaatttcaactgtgcaacttgtatccaaggactttgccatggagcctgacgaggaaaaggtgcgacatgccgctgccaatatggtgcgacagcttgccggcagcctggccctggtgacttgcaaggagcccttgaaggttagcatgacaaactatatcagaatgattcagcaagagtactccgagcagcccatgcccgaaggtttgattttaatgtgtgtcaatgacaaccttgatgccgcctgcggaatagtcgagaaggcggcggaggagaagtctctccctgagattgaaaaggttattgaaccacaattggaagcgcgccggcgtcatcgggctgcccgacctaatgaacctttcatcgacccgtcgatgaatcgttggggcttgttcattcctgaaccctaccgacaagccccaggtggtctgaataaagagcagttggccatttatgaggagtttgctcgtcaagctcgtggtccagcagcaactcacgttcagaacgtatcgactgattctggtcgacaactggcagatgttctccaggattcgtatgcgcagattcctaacctctttacgcctgcggaacagccagctgtacctcatagaactccacaggctcagcaagacacgcgtttgcagcaaaccggtctcgttggcgcacaaccgcaactaaatggctttctggaggcgccaacgcctcgtgacaaagtcgacagcatcgtttctgatctacagcaagcggctcgcaatgcacccgaggagcgcgtgaaggatcttggcagagatagtgctgtattacaggagtacaaccaggctttgcgcactatccttacgtctccaagcggtgaagagctggcaagattgacatctctgaagatctgcacgaccttgtattcccagacaccgagtaatcttgagatcgaggtacttgtgcatttgcttgcgaagttgtgcgatatgtcctcactcgtcgcaagatatacctgggttgtcttgtcagaagtagatgacgagcatatattcaatgtcccagtcacagtggcactcatagacgctggactgctggacattcgccgcgttgatatgagtctcactagacttatctgccagaagaacacgggtgctctcgaaatactggtcaatctgatggaccgagtgctgttcaacgaagagccttccgcattacggtctgacttctctggcagtctcgaagcaatgagccaatggcttgcagaagacgcaaatcttgctcctgcaaatgaaattatccgcaaacttcgcgagtccggtattcctgaagtcgtcaaccctctactcagcgacaaagcgcgagcaaagcgggatcagatggagtacattttcagcgagtggattggtatttacaaggctcccggcgccaccgaccgtacctattattccttccttaaggacctgcaccagaggcaagtcatggataatcaagaggactctgctttattcttccggctcagcattgacatctccgtcgcgatgttcgagcatgaatcacagaatcctaacggtagcctcgatgaggctttcctctatatcgatgcgcttgcgaaattggtcattctgctagttaaattccaaggagagagtaccggctcgtccaaggccagcaaatctgtctacttcaactcgattctgtcgatgctcgtgctggtgttgaatcatcaccacgttatccgcggagaggctttcaaccagcgcgtatttttcagactcttctcaaggtatcctctgcgagtattccctgagcggacttcagcagagtga

SEQ ID NO: 20315 - DNA, 249 bp, A.fumigatus
acgcgagacagatatgagcaggattgtttgaggatcaagggttacctcgcacaaggacatatggtaatggggcaggaggagcggaaaaacaaggccaagcttgaaaagacacaaatccagcttgcaaccagcagcagcgagtacgaggcagctgtcaagatcctcgaagagacgaccggtcgttggaataaggagtggaaggcagcttgtgatgcacgtcctgcactgaacatgattatggggagatga

SEQ ID NO: 20316 - DNA, 294 bp, A.fumigatus
ctgaccctagcaggcagtttagccgggacggacgtccaattctacattttggtaagtagtggagtgccgcagcactcgagcctgtctctagtcgacaaggagctaactttcattctcttcgtagcacgcgctttgtacagctataccgccgctataccggaagagctcggattttccaaaggtgacgtcctgtctgtcattcggcttcaggacgatggctggtgggaagccgagattaccactactcgaagccgtactggtttggtgcccagtaactaccttcaaatcatctaa

SEQ ID NO: 20317 - DNA, 186 bp, A.fumigatus
tgcggaaggctcttcgttgaacagcactcggtccatcagattgaccagtatttcgagagcacccgtgttcttctggcagataagtctagtgagactcatatcaacgcggcgaatgtccagcagtccagcgtctatgagtgccactgtgactgggacattgaatatatgctcgtcatctacttctga

SEQ ID NO: 20318 - DNA, 363 bp, A.fumigatus
agatctagcgcagatgctaccttatcagtcagacttctaacgaaccgtacagtccgcgctgcgatcgaagatgaatattcacggaagcttatggccctttgccgcaagccgctaggaacgcacgaaacaggctctctgcggtcgtcgtttgatgttgtccgtggtgagacggaatcgatagccaagtcccacgccgcaattgcaacacaaatgaagcgagaacttgaggagccattgattgcttttgcaggcggatcgaaggagagaaggaagatcatacagacaggaattgagcgccttctcaagaccaagatacaacagacccaaacagtgaacaaggtgcggcaacgttcggacttttga

SEQ ID NO: 20319 - DNA, 1938 bp, A.fumigatus
cattgtgaccagtcttgtgagaagattcgtctcgcgttggaaaattgtgaagttgagaaagacattgtctctttcatcaaggaaagaggaactggacaagacataccggatccgcccaagttcatcaacttcgcccggggcgatgtaaacgacacaagttcagagctttctgaagaagatggattttctgtggcccaatttcagcgtaccatcaatccagcatttcgcagttcctctccgcaaccgtcaacttacgaatcacatcatgagccgcgaggtgaatcggcggccaggccggataacaatagccctacaacccctgccagcagggaagctacggtcactccgcaaaaaccaacgcaaccgccggcccctctggaccttcgtcggggaggccatctcccaccaaactatgaccctaaccaacacggagagattgcgccggtgccgcacaatgcatatccgacagacggaatgaccatgttttgcagaacaggacccccttcagagcgtagctcgggaaccaacagtgcttatcggccttcgagccgtgagtcgcaaagtgagatctctaacccaacatcagtgtcgagccaggagcctcccagcgccaggcaatctccaacgaagccaaccaacggggttgcgctcccaggtcttggtggggacaagcagatccagaagagaagaagtgctttttttagcaacagccccttccgtcgcaagagtcgccatgataaggaccgtaattctggcccctcgcacacccctacccgaagcacatgggagtctcccacaaaacaggccactccagtaaaggcacctcagcctcagcctccgcaaccgccagcgcctgtccttgacaacgagcggcaggttgagagtcctgagccggcagaccccagggcaaattttcaacttaatgtcggtaacaatgtttttgatgtcgcttccccagacaaggctacggccaagaaggctgctcaaacggccaaggctggagaggaggagcttgatcctatcgcccgtgctttagcagatttgaaaggtggtggaaagcagtccatgaccagagtgtctgccgacaggtatcatggcattgccacacctgtgccgtccgctccaccttccaactacagcgacgcacctgtagcgactccccctcctgcctacaatgatccgtcggtcaagagacttgatgcaccacaacctgcctttacttcggcgcagatgcagaaaacgactcagaaatacacaggtcagaccaagagtatgctcaggggaagtggtaataccccgagtttggcaagcagaaatagcgcagaagttcctcgagccaaacaggaaattcctcgaccgaaacaggagacacctcgagccaagtcacctgttccgagacgcagcgccagcccacaagttccaagtccccaagtgatcagtccacagccgatcagcccccaggtttcgcctgctcgtgtggagacccggacgggccattacagtaggggcgcaagtccaagcccgagcacgtatcaggcaaacagtgtcagaagccgctatagccaatcgccctcggtttctacaccgcctcagcggcctgtcgatgcagcaccatcgccgcgtgaatttcctaggcgcagctctccaaacccggcggcggcacgtgccgtttctcctcaaccccaatttagacagcagaccaggccttccagcgccggtggtatggagttgcaactgtcaagcggtggtagtggggatatgtatggcaccagttatgacagctacagcgctcggggcagggactctggtcggcctatgtcatattacggcgatggtggtagccaggggggcagatccaggagcaggactgtggctgtagctgaccctagcaggcagtttagccgggacggacgtccaattctacattttggtaagtag

SEQ ID NO: 20320 - DNA, 393 bp, A.fumigatus
cgagatattagctgccggcctctagtggccactgttgaagttctttgtggactcgaaccgcgccacagcgtgatgtctgatcgtcatgagaggctgacagaaaccatgcgccgatcactccaagccaccatacgcatttttgtcgtggttgtaattgtcgcgatggctatagtattcccatccttcgacaaaatcatggccttgatggggtccgcattatgtttcacaatttgcatcatactgcctctcgcattttacttgaaaattttcggtaaggagatcgggatgggcgaacgtatactggattggtttctccttgtcacatcatcggtcatggcggttattggaactgcctgggcttttttgccacaagacatgatttttgcgaattga

SEQ ID NO: 20321 - DNA, 459 bp, A.fumigatus
atagcccccgccttcacgacagccggcatttacggtgtcctgggcctgatgatcccaatcatcggacaggacaagtcccccttgcagccgaacctctacctcatcatctttatgatggttgatttcttcagcctcctcctccaggccgtcggcggtggtcttgctggcgctgccttcagccagaacagctccccctggccgggaacttacacgatggtagctgggataatctggcaactggtctcaacctgcgtctttgctacattggttgagtacgtaccgtggcctaggaccgattgcgcagaatcaagccctgcggcggatctcgctgtcgttgatgattgcggttacgtgtatggtggcgcggggcgtgtatcggagcatggagttgatgaatgggtggcgagggtctctgtttacgcacacttgacaacaggcctggaaagtaccgccagttta

SEQ ID NO: 20322 - DNA, 906 bp, A.fumigatus
agaaccaccgtcgatccttccagccccgtggtgaagacatcttccgctgagttgtcgccccgcctatcgttcgcagatgctttcgccgcagttcagcagggcgaagctgactatgccatcattcctgtcgagaactcgaccaacggatcagttgtccagaatcttgatcttttaggagatcggtatgggctatacgaagatgtgaatgtatgcggagagcattatctgacagttcaccactgcctgttggttcgaaagggcctgtcgcaaccggatataaggtcaattacaaagctctatacacacccccaagcatggggtcaatgtgagaatttcctggggaaattcttaaaaggcgtcgaaaggcaggacgtttcttcaacctcaaaagctgctgagatggtctcacttgagacgcaggaacgcagtggtgccatagctagccggttcgctgctgactaccacggcctacatgtactctcggaaaatatcgaggacagggccgacaatacaacgcgattcctcgttctaaggaacacaaaatcagaacgtacagccagtcttccatttgacgctgtgaaggcgcccgcagtctcattaaaacccccgcccacaccgtctgcggaaaagactctgatctcgttcagaatccgtcaggattttccaggcgcactggcagacgctttgttgatattcaaggaatttggtatgaatcttaccagcatcaacacgcgaccgagtcaaaggagggcttggcaatatatattctttgtcgaatgccaacaattccctacggaccagaataaccagggggttactaaaattctggataagatgcagcaggttactgagggctgtaggcatcttggcacttggaaagaccagctttcaactagcaaggtctga

SEQ ID NO: 20323 - DNA, 1185 bp, A.fumigatus
atcacgacttgtccggcaatgaccagcagtcatatgaagggaggatttttgattccgatgcctacagccaagccagctcatcaagctacgatggacgtccgatcaatgatcacgatttgcagagacaaaggtgaaacatatcaggatcatctcgctcataaagctttctcccaattaacgtctttgtctaggtcgtcttcgttctctgcacgcttcagatttgcgggcggtcccaacagcattgatcactttgctcgctcatggcaacgagccgcttgtttccctgaagtcctccctcgacgttcctcgttcgcggcggttagaccggatgaagaatggacttctgggtggaatgaggatcttgcatcgcgaagctctttatcagccaggcaggagactgattatacacggccattgctgcatggtgacgaggaagaagacgggggtaatactggtcattcaaaaaaggcgttcccaagtaccaccatccttagctcatcattggatagaagtctggggacatcttacggtacgatctcatctagggtcagtgaggcgactcggagacacgcactacaactccatagggaacaactggcacatcgcaacgcagctgtagttcccgatggtgagcctctccttgtcaaacagattcagcgcgatgatggaacgcgagacagtgtcattgtaggccaatctactgtgccgcagactgttttcaattcggtcaatgtcttgattggagtcggcctgttgtcgttgcctctggcaatgaaatacgctgggtggctcctgggcttatttttcctcctctttgctgctgtgacgacttcgtacactgccaagatcctggctaaatgcttagacgttgaccgaaaccttgtaacatacgcagatgtagcctacatcagctttgggcatcatgcacggattgttacgagtctcttgttctgtttggagctaataggggcttgcgtcgccctagttgtgcttttcgccgacagtcttaatgctctgattcccggtctgagcatccttcaatggaaaattatttgcgggtttatgcttatgccgctcaacttcgttcccttgcggctactaagtgtcacgagtgtactaggcatcctgtcgtgtacttccagtgtgttattcctttctctgaacgatgctcgcaggatgtactaa

SEQ ID NO: 20324 - DNA, 192 bp, A.fumigatus
tgtgtgagtctaccacttcctttgtccatgtgccaacttgacttatttctcaattcagccccatggggggcacattcgtgcttcccgtgtatctatcgtgacatgaggcatcctcataagtacggcaagagcctttgggcgacatatatattcacagtatgtattgcagcacgcctgcgtgtcgaggactaa

SEQ ID NO: 20325 - DNA, 183 bp, A.fumigatus
cataatcaacagtattcgttggattgcgcaatggctatcgtgggatggttgatgttcggcgatggtgtcttagatgaaatcacagccaacgtgctgttaacgactgaatatccccaggcattgtctatatgtgtgatagtattgattgcaatcattccaatcactaaagtgcccttgaagtga

SEQ ID NO: 20326 - DNA, 297 bp, A.fumigatus
aaggcattgcagggcttcgtccgtccagaacttacttcctataccctcagcaggacatcatcaacgatcccatactacaggacggttaggtgccgttatcgatacacggccaaggactttcatcttgggcagctgggacgattgttttatgtagtggccgactatagtacgtttccagaggacacgatgatggttggcattaatcaaacaagaataagctggacgggctatgaaattggattcggaaaccaattgcacatcacaaacaagagtgaaacggtggccaagaaaggatag

SEQ ID NO: 20327 - DNA, 471 bp, A.fumigatus
gacgcaaccatggagaaaactcccgattgtcttccctatagcctaaatattcccactccgttcggctatcgcccctcccttgtggccggtataatcttcatgatcctcttcttgggggtaacaattgtccatgtgtggcaggcctttcggcatagaaatatctggcttgggctagccttctccctaggtacattcggcgaacttgtcggatggttaggccgtaccgtggcgtatcgctgtctgtattctgtcaagctgctcgagatgcaactggccgcgttaatcatgggtaaatcttccttttttttttttttctttcactgccaggaaactatctataactatatgaatagcccccgccttcacgacagccggcatttacggtgtcctgggcctgatgatcccaatcatcggacaggacaagtcccccttgcagccgaacctctacctcatcatctttatgatggttga

SEQ ID NO: 20328 - DNA, 894 bp, A.fumigatus
gccaccgcaattgattccgtatttcaaagtacgatggctgctgttaaaaagcggttaaagaggccaaagctgctctctcacacacgcccgccaacagctagagcgcaaaacccaaaactctcagcaaaggcgacccgaaatctcattcggacccatcatcgtctcttgaagtctcgagcccaggcattaaaagcaggcaacgaggacctagtccgggagatcgatgagcgaatcgaagcaaatggtggcttggagagctatcaacttgccagcaagttgggacagtcgctggaacgtggcggcgactcgagtaaagtccttgtggattggattgctccgagcttaactcagttaaaaaattccccttataagctacgaatgcttgaagtaggggctctgagcacggaaaatgcatgctctaaaaatcagtaccttgacgtcacgaggattgatctgaatgctcaggagccaggcattttaaaacaggatttcatgaagaggcctcttcccctcaccgatggtgatcggtttcacatcatcagtttgtctttggtgcttaactacgttccaaatgcaacagggagaggagatatgttgaaacgttgtgtagggtttctgacacagacacccccggctggctcctcaatcaccatccgacctagcctgtttctggtcttgccgttggcttgcgtcaaaaactcgcggtacctgacaccgagtcggttgcaagacatattgtccagtatgggatttacattggcaaagagtaaggagacctcgaaattgatattccagctctgggagcatgaccgacagggcgagcctcggccatttaaaaaggaaattctaaatcctgggaagatgcgaaacaatttcgctatcaatgttcaataa

SEQ ID NO: 20329 - DNA, 225 bp, A.fumigatus
gcccaggagccacccagcgtatttcattgccagaggcaacgacaacaggccgactccaatcaagacattgaccgaattgaaaacagtctgcggcacagtagattggcctacaatgacactgtctcgcgttccatcatcgcgctgaatctgtttgacaaggagaggctcaccatcgggaactacagctgcgttgcgatgtgccagttgttccctatggagttgtag

SEQ ID NO: 20330 - DNA, 273 bp, A.fumigatus
agtactctcacatcaagatgggcgctcgctgtgcctccaggattaggcttatgtcatccaggaaaaacaggcggcaccgacccatattattattactcattcgccttattattgtctgtcccctgccaccccacggagcctgatgaaatttgctccaacaccccgctggacctggacggcaaactgaccagctttaaggtatgtgactggattccttctctcagtctcttctctttttgtttttttctgattacgactttgtcattaaaataa

SEQ ID NO: 20331 - DNA, 291 bp, A.fumigatus
tctttgccagcatcggactgtcaagttctgaaccctattctgcctctggtcgccaatcaccgtcgcgtcgccaacatgagcgcgcctcagccgaacgaagctgagaagaacattgaaatatggaaggtgaagaagcttatcaagcggcttgaagccgctaggggaaatggaacttcgatgatttctcttatcattcgtgaggctcttcgcattcgtccttttgctagatggtttgctaacgtgattcctcagcccccaaagatcaagtctcacgagcggcaaagatgttag

SEQ ID NO: 20332 - DNA, 246 bp, A.fumigatus
ggtacggcttctaatatcaaatctcgcgtcaaccgtctctccgttctttcagccatcacttctactcagcaacgtcttaagctgtacaacaaggttcctccaaacggcctagtgatctactgtggtgaaatcatcacgtcagaaggcaaagaacgaaagatcaacattgatttcgagccattcaaacccatcaatacctcgctctatctttgtgacaaccaagttccatacagaagctttgagtga

SEQ ID NO: 20333 - DNA, 1110 bp, A.fumigatus
tctactgtggtgaaatcatcacgtcagaaggcaaagaacgaaagatcaacattgatttcgagccattcaaacccatcaatacctcgctctatctttgtgacaaccaagttccatacagaagctttgagtgagctcctcgagtcagatcagaagttcggcttcattgtcatggatgaaacggccgccttcttcggcaccctgagtggcaatactcgagaagtcattcagaagctaagcgttgacttacccaagaaacacggtcgtggtggccagtctgcgttgcgttttgcccgtctgcgtgaggaaaaacgtcataactatgtgcgcaagattgccgaactggctgtccaaaacttcattacgaacgacaaagtgaacgttgcgggcctgattttagcaggttctgctgatttcaagaatgacctcaaccagtcagatatgttcgatcagcgtctgcaagccaaagtcatcaaagtcgtggatgtctcttacggcggagaaaatgggttcaaccaagctatcgaactctcctcggagactctgagcaatgtcaagtttgttcaagagaaaaagctgattggccagtacttccaggaaatcagccaagatactggaaaggtctgctatggtattgatgacactttgaaggccttggaactcggtgccgcggagactctcatcgtttatgagaacctcgacgtgacccgatatgttctcaaggcgtcaactggctccgaagtcattgtccatgccaccaaagctcaagaagagaaccgagcgttgtttaccgacaaagacactggcactgagatggaagttgttgagcagacttctttcctcgagtggcttgccgagaactacaaagattttggtgctacgttggagtttgtttcagataaatctagcgaaggaaaccagtttgtgaagggttttggtgggattggagcactcttgcggtacaaggtcaactttgaacagcttgctgaccttgatgacgaggatgaattctacgacggtacgtctcgaattctgaaatatcttgtcatgtatgctaacgcaggccatctgtgcagattgacggttctgcggcctcgcagagagcgaggatga

SEQ ID NO: 20334 - DNA, 693 bp, A.fumigatus
gcaccgcatcaccttgtgtatcaaggtcacacgtgcataaccatttcccagtacatcgtctcccccatgtacctgggcgatttcaacgacccgctgggccgccagccgaaagacggctaccagtacgcgtccatcaccgcggccctcgtcgcccccgtctcgcggggcaacgtcaccatccagtccgccgacagccgcgatccgccggtcatcaacaccaacacgctgggctctgccaccgaccagcaagtcgccatcgccgcctttaagcgtctgcgagagattttcgaggctccagagttggcgcccgttcgcctcggtgacgagtattaccccgggaaacattccgttcggaccgatgcggagatcttacaattcatccagcagaacggcctggctttctaccacgctgggtcttcgtgcgccatgggggatcccgacgccgttaacagcacggcggtggtggacagcaaggcacgggtgattggcatcaagggtgtgagggttgtggatgcggcgtatgtcatggtttccgactgcacacggcgtgaccctacattggggtgtgggactaattctcatgacagagctttgccgttcttgcctcccagtcatattcaaagtgcgatctgtatgttcattgctctgtccccaggctcctcccaacatgtgctgtattgctgtatccactaa

SEQ ID NO: 20335 - DNA, 714 bp, A.fumigatus
  unsure (516),(533): Identity of nucleotide sequences at the above locations are unknown.
tcaaggccttgcagcactccccagacggcgccaccatcagcaccaacaccatctacccgctgctggaacgcacccagtccagcgtcatcctggcgctgcactacggcctgcgcatccctcaccccgacgagcgcattctgcaccaagtcatcgacatccaggtgcaagtcacccacctcgccgctaacccggccctaccggatctcatcccagccctgcgccacctccccgccatcctctccccctggaaacgcgcagcagaccgcctctacgccgcccaggtcgacctttacatgcgcctcttccaccacggtcgggacgcccgcgggctggaacgcaacaaagcaggccctctccaccgcagccaagtacgccctggctcctcctcctcttcgtcgtcgtcctcgtcctcgtcccaaatccccgaactcgaccttcgctttcacctcgccacctccatccagggcggcatggagatgtccccgcgccagctcatctggctgtttatcgccgcantgcaccagcagtccttngttgcgcgcgcgcacgccttcctcgacgaggtcgtcggccgggaccgcgtcccccgcttctcggaccgcgcacagctcgcatttatcgacgccgtcgcgcatgagctcttccgttggcggccgatcgcgccggggtccatcccgcgccgcgcagaccgggacgacgagttccagggcgtga

SEQ ID NO: 20336 - DNA, 480 bp, A.fumigatus
accatctcctgcctcctcatctaccctaaccccgactccgcgctgaattccacggccggcgctctcctgcaagaagactacgatgcgttcgcgcgtcaggcgaagctcatgacatcgatccacgcgccggtcccaccagatctaagaaatgcagttgtcgaggcgaaatcgaggggcgaggagcccggcacactcatcccagagcacgagggtgcccgctgtctgcgaccacgcaaaggaactagaatccagtccttgacgatgaaaacgaagaagcccagtgtaacaccgcggccatcgaaccaaaccaacgccgacaccaacgacagccacccagaatcagacgatgacagcgacaccacccggccctccacctccaaagaaaacgacccctccctctccccctcccccgtgaaactcgctcctcccagcccccgcaaaaatagccacggcaaacgacccctctccgacctcaccacc

SEQ ID NO: 20337 - DNA, 444 bp, A.fumigatus
ccatttcccagtacatcgtctcccccatgtacctgggcgatttcaacgacccgctgggccgccagccgaaagacggctaccagtacgcgtccatcaccgcggccctcgtcgcccccgtctcgcggggcaacgtcaccatccagtccgccgacagccgcgatccgccggtcatcaacaccaacacgctgggctctgccaccgaccagcaagtcgccatcgccgcctttaagcgtctgcgagagattttcgaggctccagagttggcgcccgttcgcctcggtgacgagtattaccccgggaaacattccgttcggaccgatgcggagatcttacaattcatccagcagaacggcctggctttctaccacgctgggtcttcgtgcgccatgggggatcccgacgccgttaacagcacggcggtggtggacagcaaggcacgggtga

SEQ ID NO: 20338 - DNA, 450 bp, A.fumigatus
  unsure (329),(346): Identity of nucleotide sequences at the above locations are unknown.
cccggccctaccggatctcatcccagccctgcgccacctccccgccatcctctccccctggaaacgcgcagcagaccgcctctacgccgcccaggtcgacctttacatgcgcctcttccaccacggtcgggacgcccgcgggctggaacgcaacaaagcaggccctctccaccgcagccaagtacgccctggctcctcctcctcttcgtcgtcgtcctcgtcctcgtcccaaatccccgaactcgaccttcgctttcacctcgccacctccatccagggcggcatggagatgtccccgcgccagctcatctggctgtttatcgccgcantgcaccagcagtccttngttgcgcgcgcgcacgccttcctcgacgaggtcgtcggccgggaccgcgtcccccgcttctcggaccgcgcacagctcgcatttatcgacgccgtcgcgcatga

SEQ ID NO: 20339 - DNA, 348 bp, A.fumigatus
cgctcatccttccgccgtctagctgcagatcacgctgcattgcacgaggagctccctccaaactaccttttcccgacagaagaatcatccgatgacctgacccaactcaccaccctgctggccggtccgcagggcacaccatactcccagggtctgtggcgattacacttgaagatgccggaggattacccgaagagtccgcccaaggcgacattcaagacccgcatatggcatccaaacgtggaggagtcgaccggcgccgtgtgtgtggatactctgaagagagattggaagtcgaccttgacattgaaggatgtcctcgtcgtgcgtgtcctacagtcaacctag

SEQ ID NO: 20340 - DNA, 831 bp, A.fumigatus
gctttggtctttccagcgccgtggtcaataccatatctgaaggaatgtgcagatctccccaacctcaccgtctatacagagaccgtagcgaagcgaattctcttcgatgacaccaagaccgccacaggagtggtggtggagatggccggcctggaacacacgctcgccgtcgacaaggaggtgatcctatcggctggggccttacagtcgcctcaactgctgatggtctccggagtgggcccggcgcgtaccctggattccctcgacattccgattgtgcatgatagtccgtacgtggggcagaatttgatcgatcacgtctggtttggagcggcctatcgcgtcaacgtcccgacgtggacccaatgggccaacgatgcgttcgacatgctccggctctacgtcgataattaccgccagcatcggcagggccccttgacggcgaacgcgggcgactttggtgctttcgaaaaagtccccagtcatctgcgtgccgcattcaccgcgaagactctccaagacctggcagagttcccggacgattggccggaagtggaggtaagcaccgcatcaccttgtgtatcaaggtcacacgtgcataaccatttcccagtacatcgtctcccccatgtacctgggcgatttcaacgacccgctgggccgccagccgaaagacggctaccagtacgcgtccatcaccgcggccctcgtcgcccccgtctcgcggggcaacgtcaccatccagtccgccgacagccgcgatccgccggtcatcaacaccaacacgctgggctctgccaccgaccagcaagtcgccatcgccgcctttaa

SEQ ID NO: 20341 - DNA, 1794 bp, A.fumigatus
  unsure (1144),(1161): Identity of nucleotide sequences at the above locations are unknown.
tcaataacatcttccacaaactcctcaccagccaactgcggcaactctgcctttgacattgacagcccaccgccaccttcgtccacccttgtccacatcacatcacatcgcatctcaacatcgattgacaacatccctgacctcaatatggctgccacttcggttgtggcggtcatcgtcataggactgctgacagtgttgtatatcagcagaaagaatggcaagaagacggataaagtactactgaaactcccactgatcggcgaccttcatagctcgcctattgagaagcccctggcaaactgggactcctgggcccaacagaatgggcccatagcagtccccaaactatttgggattatcccaatcgtcgtgctcaactcgaacgaggctgcgacggagttgttcaatcgccgtagccagtggtacagcaaccgtccgccgtcggtcagcatggagatgatcaccggcgctccgccaggccggtctcgcttcacgctgatgcacgactacgacgaccatctcaagctgcaccaccgcattctctcccccagtctcggcgcgctcgccgcaccaaagtaccagcccctgatggaactcgaagccaaacagctgctgcatgacctagtcaaggccttgcagcactccccagacggcgccaccatcagcaccaacaccatctacccgctgctggaacgcacccagtccagcgtcatcctggcgctgcactacggcctgcgcatccctcaccccgacgagcgcattctgcaccaagtcatcgacatccaggtgcaagtcacccacctcgccgctaacccggccctaccggatctcatcccagccctgcgccacctccccgccatcctctccccctggaaacgcgcagcagaccgcctctacgccgcccaggtcgacctttacatgcgcctcttccaccacggtcgggacgcccgcgggctggaacgcaacaaagcaggccctctccaccgcagccaagtacgccctggctcctcctcctcttcgtcgtcgtcctcgtcctcgtcccaaatccccgaactcgaccttcgctttcacctcgccacctccatccagggcggcatggagatgtccccgcgccagctcatctggctgtttatcgccgcantgcaccagcagtccttngttgcgcgcgcgcacgccttcctcgacgaggtcgtcggccgggaccgcgtcccccgcttctcggaccgcgcacagctcgcatttatcgacgccgtcgcgcatgagctcttccgttggcggccgatcgcgccggggtccatcccgcgccgcgcagaccgggacgacgagttccagggcgtgaagatcaacaagggcgtgacgatcatggcgaatgcgtgggggatcgggcgcgacgagcaggtgtttgaccctgcccttggggacctgcaggagtttgttccggagcggtggttgcgggcgggtgaagcgggagaagaaagattgcggagtgacctgccgctaccggtgtttgggcaggggaggcggatctgtcaggggaggagggtggcggttgatgggacgtttttgcaggttgccagtctgctttgggcgtttgacgttgcgatggtggatgatggggcggggccggtggatccgtgggagatggtggttgtgggattcatgacgatgccgaaggaacggcgattcaagctgaagccgagagggaattgggtgttggatgtgatcaaaagagagtgggagacggcagagaagagtctggataaggtcatggggacgaatgatgttgagtga

SEQ ID NO: 20342 - DNA, 375 bp, A.fumigatus
ccctgcacatcccctgacggggacatggaggaatccacctctctccacgtctgccagtacctcgcagctgtgtcgctttccgagatgacggtcatttttcctatacagacccgggaccaaagagccgtgcttgcggtggctttcacattctcgatcttggccgtcgtcgcggtgtccttgcgcttgttggcccatcatattgcgcataaaccatggactgcgagtgattactttctgattgccgcctgtgtaagacaagccctggctatgggatcgacaaataacttatccatcggtcttagttcttcgcggtcggtctccagtccatcagtatcactggcgtattccaggctggtatcggcttcgaccatatga

SEQ ID NO: 20343 - DNA, 891 bp, A.fumigatus
tatccttccaagatgatcggaatccctttgctcgcctcacttctcctcagcgggatagctcaaggtctagctattgcagaacgggctaccactccggtttggctcactctgccgccgacaccacccctgcctgccccaattagcgaggcccgaatatccgttgacggtgttgaactgtggattcaaaagtacaacgaagatgcccacaaaacacctttggttcttgatcacggtggccttggctactcggcctacttcggtgcagtcctgagccgactgatcgcgaaaggacactatgtgatcgccctcgaccgccggggccacggccgcagcacgttcaaggaagacgacgtcttcacattcgacctctttgccgacaatatctacgagcagctcaaggccgtgggtgtctccaagtacaatgtagtcggctggtccgacggcggcgcaaccaccatcgctgccctgctgaaccgcaagatatcccccacgatcgagaaggcattcctcttcggtgctttcatggtcccctccgattcgaacccaaattttccgaatacggacatcaattccgagttcgttagtcgctgcgcgaaggagtacagccaactccagccccaggccaacttcacctcattcgcgaccaaggtcgcgactctggaggctacgctgccgcaattcaccacggaccagctgcgcaccatcgacggctccagggtcagaattgccggcgcccagtacgacgaagcggtgaatctggatgtcccggccaagctgcacgccgccatccccggcagcagcttggtcattctcaataacgtcagccatttcgcaccgctgcaggaccccgatcaatttaccagagcgttggaagactttttctatgcatag

SEQ ID NO: 20344 - DNA, 240 bp, A.fumigatus
tcgtgcatcagcgtgaagcgagaccggcctggcggagcgccggtgatcatctccatgctgaccgacggcggacggttgctgtaccactggctacggcgattgaacaactccgtcgcagcctcgttcgagttgagcacgacgattgggataatcccaaatagtttggggactgctatgggcccattctgttgggcccaggagtcccagtttgccaggggcttctcaataggcgagctatga

SEQ ID NO: 20345 - DNA, 504 bp, A.fumigatus
ttcttcgcggtcggtctccagtccatcagtatcactggcgtattccaggctggtatcggcttcgaccatatgacgtccatcgtggccgtctacgggatggagccggtcaccaaactgttccagctgatcatcccgctgcagttcacatgggtgctaagcctcagttgcaccaagatctccatcctgctgttgtatctccgcatctttccggttgtgtcggtcgtgcgggtcgcctgggccaccatcggcgtcatcgtcgcttgggccatcgcgacaatcctggccgggtgtctcatctgccggccctttgccttcaactgggaccagaccatccctggcggatcgtgcggagaccaggttacctcgttcacagcgacgggggtgatcaatctcgttactgacgtggtcgtgctcgtgacgccgatgccgtcgctataccggctgcagatggcaacgtacaagaaggtgaccctgattaccgtctttggattgggagtagtgtaa

SEQ ID NO: 20346 - DNA, 261 bp, A.fumigatus
gttgccaaggaagtggctcataagtttcaaccgaacgcaaagctggaagcataccatgcaaatatcaaggacagccaattcaatgtggactggttcgcgacctttgatttagtcttcaatgcgcttgacaaccttgacgcccggcgacatgtgaacagaatgtgcctggctgccaatgtgccgttgattgagagcggaacaacagggttcaacggacaggtgcaggttatcaagaaggtaagcctttcctgtagcagttga

SEQ ID NO: 20347 - DNA, 438 bp, A.fumigatus
tgtcagcccctcaaagcacgcaagagacagtttggcccaagggacgccttcacgctccggctctgcaccttcaacacctacgaagacacaagcacttgtaaaagccacttcgacaccgcgacgccttcaaaatacaacgagcaagtcgacgcctctcaaactggctgccaatgcctcggacagagcggctgctccatcgcccactcctcagaaaaccagcaagctccgtcccaatggtctgtccggctctacgatcatccccgatgcacctgcgtgggtcatggattcaatccggattgtatgcaagacactttctactccagcaccgcgcacgagcacatggtctcggccgccaatctcccgaactctgccgccacatatctttgccggcgtatcatcgatcctctacctcatctcgaacctctcagcaaagaatga

SEQ ID NO: 20348 - DNA, 255 bp, A.fumigatus
tcgcgtgtgcttcttgtcggtgccggcggtatcggttgcgaactgctcaagaaccttctgttgtccggctttggagaaatacatatcattgaccttgataccatcgatctgagcaatttaaaccgccagtttctcttccgttacgaacatatcaagaagccgaaagcattggtacgtcttcgccgtctgaccggttcctctgccttccctcgttctctcgctttgcgcctcgatctcctgcgttacgcgatatga

SEQ ID NO: 20349 - DNA, 492 bp, A.fumigatus
gtgttatacatatctgcgcatgagcctcaagcatgtctaatgctattaagcgagctttttggtaccagtgaagacgaatcggaagaattcgatcattcggcagatgccgataacggtaagcacctttggtcgtcaaatgtgtcgcaagccagttataaccctgaagcagctgccgagatcgccaatctgcgtaaggaggcgcaagctctgaaagcaatccgcgagtcgatgggctcacccgagttctatcagaaggtatttgagaaagtcttcaaagaagacatcgaacggctgcggggtatggaggacatgtggaagtctcgaacggcaccccagccccttgacttcgaaaaactgcagcaagaatcctcctcaatcgagcccatcatctctgtcaacgatcaaaaagtgtggtcatcagccgaagacttcgttgttttcaaggataggttcgaaacgccgtcgcttatgacaattcttcacgaacaatag

SEQ ID NO: 20350 - DNA, 1482 bp, A.fumigatus
tactaccttatgttgttcttccttgttacgttatttctacacttacattctcactcctctctgacagcgctcattgggcggcgccaacaacccatccatattagcaccgccgcggatccttccagccccgtggtgagactggttatctgccttttttctgcgccgagacgacaattacttactcacaaaacttttaagggtgtcaccagacttctcctcctccgagtacctttcttccgcgacatcatcctcgaatctttcgaatgcgaacactgtggtcaccgagacaactctgtcaaatccgcaggtcagatccaagagaagggaacgaaatacacgctagacgttgagaacgaggaagatttccagcgccaagtcattcgaagcgatgtctcgattttcagagtcgaatcgctcggtattgagatgcccaagggcgaaagccagctgaccacagtggagggagttattcagcgcatctacgagaacctgtccagcgaccagccattgcgcaaagagcaagcgcccgagctgcacgatgcgttcgtgcccatcattgagaagctggagaagattctgaagcgcgagggcttccctttcaccatctcgttcgatgatcctaccggtaactcatggattgcgcccaatacacaggacaagacaaacaagtatagacgccgcgactacccccgtacacacgagcagaacgaagagctcggcattgctgccgacccagaggcccagaagaatgaaggcatcaacgtggagggcgagattgacgactcagaaatcgtcgaagggcaggtttacagtctgcccgcggagtgccccggctgcacaaaggcatgctttgtcaacatgaagaaagtcaacattccctacttcaaggaggtcttcatctggggtacagtttgcgaccactgcggctaccgcactagcgaggtcaaaaccggtggtgaggttccggagaagggcaagcgtattaccctgcgtgtcgagaacgaggttgatctgtcgcgtgatatcctcaagtccgacacctgcgcgctccatagtgaagagctcgaagtgactgtgcagcccggtacccttggcggccgcttcaccaccgttgagggtctgctcacggaaattcgcgatcagttacacggccagatcttcgatgtcgatgacactaccaattctggcggtgacagtatggcagcttctgacaaggaaaaatgggagcgcttcttcagccgtctcaacgatgccattagcggaaaaatgaagttcgtcattactcttgaggatcctatggccaacagctacgttcaggatctgtgtgctcccgcccccgaccctcaaatcacaactgaagagtacactcgtacggaagaggaggaggaggagctcggactgaaagacatgaaggtcgaggggtacgagcaggagcagaaggaagagaagcccgccgaggaggctgatgaaaggaaatcatga

SEQ ID NO: 20351 - DNA, 390 bp, A.fumigatus
cagtcgaatagcttagaacggcttagcagacgcttaaagactttgcaagagacagccaaggatggtctgaagccgatcttgttttttgacaaggatgatgtcgacactctcgactttgtcactgcgagcgctaacctcagagcgacgatctttggaatcgagcctaagtcaaagttcgacacgaaacgtaagcttgacgctatcactgattcatttctattgctgattcttgtatcagagatggctgggaatatcattcccgcaattgcgacaacgaacgcgatgacagcggggctctgcgtgttgcaggctttcaaggttctcaaggatgattttcaaaatgctaaaatggtacgcgctacgtccgaactggttcctcgtgtaatctga

SEQ ID NO: 20352 - DNA, 486 bp, A.fumigatus
gggctcctggaaatagacagaatgatagcacgcgccatgtcggacgacgaagccgaccccgagctcctggccctccttcgcaagtcactcggactagatggtgggcctgctaacccacggactgcggagacgaaagtcctcgaaaatgcgcaatttgttttcgataatgccgttgacgttgcgctgagtccggcgaaggttaaggaagcggcggagacaatatggcggctgatgcagaagaagaattactcaaccgagacatggacagatcacgagttgcaccctaaggcgaaagacggaagcacagttgacttcatattcacgatggaccttttgaacttcagcttctggtcggatcaaacagacccgtccaagcgattctgtattgagtatcgggggaaaaagtggacaggctattggagtctggtagccgcattgcaaagggctttagatgagggtaagtcctctgtcaaaatctttgcctag

SEQ ID NO: 20353 - DNA, 438 bp, A.fumigatus
cgactggcagattaccgaatcccgcaaatgctccatcaacttggttgtcttctgtactccccatcgttagagggtcacatcaggagcaataagctgattcccagtgggtccaattgggaaattgagctgcgcgcaaccagcatctggtgtgttgaattgattcggcgtgagattgaacgtcaacaccctgaagtgaagaagcagaaattattgaaaggggcaccaactgaaagctcagtgaatggagccacttcgttcgaaaacgagacaaatcttgctgcacaaaagcacatcagacaagcgagtacccacggtacatccggctcagggataaacgctatcttgatcgatttcttcttgtatgatacagcaaaagagatggagagggacggacgcgagacaattccgcatcacaggacgagaagcatttggtattag

SEQ ID NO: 20354 - DNA, 561 bp, A.fumigatus
aactttctcgccctctgcgcgtgcggcgcatacaacaatacccccttccaccgtatcttccccggcttcatgattcaaggcggcgatatttcgctcgggccagcacctggaacattaaatacactaaaacccatgctacccgtcaacgaaatccccaagggtggcacctcaatctaccaccctcgtgcactgaatcaggagatccacctgccagccctccgtcacaatgcgcgcggaattttgtcaatggcatcgagaccagtcaaagaccggacagcaccgggatcacaaggtgcgacgggtgcaacggtcaatgggagtcagttcttcatcaccttcgctgcggctccccatttggacggggcgagtactgtgtttgggaaggttctgaacctgagtccgcaggatgagggaggcgatgtcctgagtaagctggagaaggcgaaactaaaagtggacaagaaggggagagtgactcagccgaaagaaggggaggaagggggatatgaagcgattggtatcaacagcgtgacgatccatgccaacccgtttgcgaagtga

SEQ ID NO: 20355 - DNA, 1983 bp, A.fumigatus
ccacatctgctagagtgccgccatatcatctcgcgtatgctggttacggaccccaagcagcgtgcaagtcttgcggagatcatgaaccatccgtggatgaacaaggggtttagtgggccgcccgagaattatctcccagctcgtgaacctatacagcttcctttagaccccgaggttgttgagaagatgacgggcttcgatttcgggccaccagaatatatcacagcgcaactcaccaagatcatagagtccgaagattaccaacacgccgtgagaacaagcgttcgggagcaacctcttcaagttcatagcgagaagaagcgtggcatgtttgatttctacaaacggcggaattccgccagtagagacacactctcggctccttcggtcgaggctgttcagctggggaacgaccctctgaatgcatacagtcccctgctctcggtgtactacctagttaaggaaaaacttgatcgagagagggccgaaagcaaccccggcgctctcggtatcccgcattctgctggtgagaacgtgctcaggatgccagacttaccagctcccgaggcggcgcacaccaatcagtatcaactacctggcgaaaaagatacgggtagaagatctcgccctcgcgcgaggactcacggcgatgatgatcttaatgatggcatcaaggaccttcatcttacaccgcaagcagggcaggcaactcctattcctgcaattccgcctgagactcccgtgaaaaaggagagcacggcagcgggcatccttagacgattcagcacgcgcagggtcaaggatcgcagtcgggatcctgagcgcgagcgcatcaccagttctcaagcgccatcgctaagtgtccagcctcccgccgattcggcttccccactttcgagagggttcagcatgcggagaagcaggcgtgccgacccattaccgtccgatactcccggtggcggcagccagccgcaacaacaagatttcctcaaggctccaggatcggccgagccggcctcgcggtccaacaagtacttggagagatctacgagtgtcaattcggctgagtatcgtcctcggagagctgcacggaggaatgaccctgatgtgtcggatactgctcccgaccgccaaccgcctcagaccagtggctctgactactcaagtctgggtgggcagaaggtggagacctctgcgaaagaggtgaaacagcccggtcgcacgcatgcaacgcggaccatgtcacttgggcatgctcgtcgcgaaagcattcaagcccgccgagcgaggcgagacgcggcaagagaagctaatgtgcccgaggagacagacgcagacatctccggtgcaggaaacgctctggagagcgcgaatgagggagaagatctctctaagccggtatatctcaagggtctcttcagtgtctcgacaactagtagcaagccgctgtctgtgattcggacagacatcattcgcgttctgaagcaactttctgtggattatgttgagatcaagggaggcttcagttgtcgtcacgctcccagtattgagcttgataaagtagtggatgtcggccctccgagccctgatcgatctggccaagtgtctaaccacaggcgccgcatcagctttggagggttactgaaccatgacgacagcaaggaggatccccgatcgatgcatacgcctcgatctcaacgtcgaactcgggcgcctgataggagctttgtcagcaattctgagggatcggacgaatatatggctcctcgcgacagcaatgcacccgcgggagagcgtgtcatgggcgaaaccacgacgagagtccagagtgatacgggagagaatctggttctgcggttcgagatcctgatcgtcaaggtgccgctcttttcattgcatggtattcagttcaagaaggtctcggggggtatgtggcagtaccgagagatggcgaagaagatcttggatgctttgagactctga

SEQ ID NO: 20356 - DNA, 1074 bp, A.fumigatus
gtacaaagacaaagtcagcaagaatctcagcggagtccaaaagctactttcttttcaaacttgacacatcgcacgccatcgtcgtcgatacccctgaaaagaaagtctgatagaagttctgtcagcccttctcttgctgtgcctaaggccgatcacttgaccaacaataacatacaccaaactaccaacaaacagggtcttggcaaccacagcaaccccatcacctccaacagcaatactgccaacaacgccattgctaaagctaatacacccgaccctaatcatgtattcaatccaaagattcagaatccgtcgacaccaagtccaaccccaagttctcaacaggaggcagttggtgtcgttattccttccccgtccaggcagctgagaaaggagattgagaaatccgtttgggtcaaagcgccccctgtaacgccagagaagactgcgctttcgactgagtattatccgattgatgctcatgaaaagcgtgctctcagaggcgcgtatcctagcgctcgaaaggtcaagcgttctgagattccctttagcattgaaacgccaggccccattctagcagatagaattcctgtacaacgccaattgcacgagaccctgcagcggaagctgtcaaagatcaatggcccccccgtgacatttgcgccaggggaggaggacctgctggcggtttttgcttcaaacttcgagttcgttaattcctatatcctccgcaaaggtgtctcacacatcccggcggacttcatcgcaggctgtgattgcaagaagatctgtgatcccgcgcggtgcggttgcctcgagcaggatgaagagtcgaaagagattattgtgccatatcaacgcgcacaagacgacgcacggctcttagtcctgaccccggactttctcaaacgcacagatatcattattgaatgcagctccaaatgtacctgtgatgagcggaaatgctggaatcgagtcgtgcagcatggtcgtacggtccgtctggaaattttccacacagggaatcgcggcttcggtaagttgtacaaagccattgaggcggaagagtgctga

SEQ ID NO: 20357 - DNA, 471 bp, A.fumigatus
cccgtcgggatttcggggtttcacgggggcacccattccaactcttcccgccgcgaccactccaaggagcgctctagggagcgtccgacttctgctcaccgtaccgatccatcgccaagcaaacaccggcggaatttatcggtgcaaagccaccagcgggacagtatagatatggcttcaacaggccctgttgtggccgagcccgctccccctcccgcgcaggcggcttctggatcccatttgcatcctagttcatctgtgcagcccaagcgtcgcacaacaattaccactccgtccggccagtgggctcttggaaagactatcggcgcgggaagtatgggcaaagtgaaactcgcgaagaacatggaaacgggcgaacaggtatttcgaacggaagcaacagatctgaccttaacactaatgacaattgcaggtggctgtcaaaatagtaccgagacaatcggccgatga

SEQ ID NO: 20358 - DNA, 642 bp, A.fumigatus
caattgcaggtggctgtcaaaatagtaccgagacaatcggccgatgaacaccgcagctcgcgcgacaccgagagagcagaccgctcgaaggagatccgaaccgcccgtgaggctgcgatcgtgagtcttgtgaatcacccatacatctgcggcatgcgcgatgtggtgcggaccacgtatcattggtatatgctctttgaatacgtcaacggaggccagatgctcgactacatcatctcacacggtaaattaaaagagaagcaagcgcggaaatttgcgcgacagatcgcgagtgcgttggattattgtcatcgcaacagtatcgtgcatcgagacctcaagattgaaaatattctgatcagcaaaaccggtgatatcaagattattgactttggtctgagcaatcttttctcccctagaagcctcctcaaaacattctgtggaagcctttactttgccgcaccggaattgctgcaggcgagacaatataccgggccagaggtggatgtgtggagtttcggcatcgtcctttacgtcctggtctgcgggaaagttccatttgacgaccaaagcatgccgcaacttcacgcaaagatcaagaagggtcatgtggaatatccgcagggactcagtgcaggttag

SEQ ID NO: 20359 - DNA, 480 bp, A.fumigatus
ggcggaagagtgctgatgaggccaggtctccgttccccggactggatccgcgcgggtcaattcatcgactgctatctcggcgaagtgattacgaaacaagaagccgacgtgcgcgaggaggtggttacgtcgcagcacggccactcctatctcttcgagctagacttcttccacaacgacgacgagatctacgttgtggatggacaaaagtttggctcccccacgcgtttcatgaaccactcgtgcaaccccaactgcaagttgttccccgtcacccggacctacggtgacgaacggctgtacgacctggccttcttttcgctgcacaatatcccgcccaacaccgaactgacgttcgactacaaccccaactgggaggagggcaaaaaggtcgatcccaacgctgtgcgctgtctctgtggggagaagaactgccgcgggcagctctggccgaaccagcgcaagggcactaagtgctag

SEQ ID NO: 20360 - DNA, 219 bp, A.fumigatus
tctgctctctctgactatctggtgcttctctcggtcattatctcaatcatcccatccctggccggtggcatggactatcaccatatccatgccatagctgggtctatctacagcatgcaggggcaaatgaccgagactcgctggacagacttgtttcagagtccactttacccctctagatggacactggagtggcatgcagcttggcaatcgcaatga

SEQ ID NO: 20361 - DNA, 642 bp, A.fumigatus
aacatcagcacaagtcaacagcaacactcgaaccgcaccttacttcatcgtcatcatctacatactacctacactcagacatcaaccccaaaacgagagacagacaagacagcaaaaatgcaccccaatctttccctcactacctcattcccctcttcttcgcccaacaaccacctccccacctctacggcaacatcccccgcctcctccgcctccccatcggcctcctccccattcagcttccgccttttccacccctaccgcggtgccagccccagcagcaccggaagcataagcgcaaatcgaagcaggagtacaagccccctccgcctctcggcactcttcctctgccggcgcccctcaaaagtcgacctggcgctcagcgcagaacgaacccggtgcgacggcgacgctatcgagcgccaggggctggatctcatggagccaaggcctgttgatcctgtcgattaccggctgcccatggatgggagcatctttgcgtcttctgcgttgacgcaggggtttgaagcttcccggggaaggtcatctttgcacagtcagcttcacactcagccgtatgggtttgttcggccgcggtttgtgatggggggtatcttcgaggttatggaggggagggattag

SEQ ID NO: 20362 - DNA, 273 bp, A.fumigatus
tgggcaggaccgttcgacagaatttctaacagaaggtcatcttgcatttggaatgagcctgtttctcttgcattcccagtttcctactcttacagtttcaaggtccagactagtaaaaaattgtttgctattggtactccgttcttcgtagattcgcgtgatttaggacttaaaaggtacctgggcgccaagccacagcaggtgacgccgtggcggtgcgtatggatggaacaaacgtcccatggtttcaacgatgaggatgaacgtccatga

SEQ ID NO: 20363 - DNA, 585 bp, A.fumigatus
acccagaaagctgacgttggttcagtcattctgaaatacgctggccgtgatgccaccaaggcctactcagaggttcactctcctggtgtcatcaaatcaaatctaccgccagagaagtacaaggggatcctcgactcgtcctcaatcgatgaagaatggctcaaacagcctcccagcgagaatccacaggttgtcctggacgacgagaagccgcccttgcacactctgatcaactcacacgatttcgagcttgtggcgtccaagacggcaagcaaaaagacgtgggcattttattccagcgcctcgaccgatctcatcactcgcgatgcgaataaatcttgcttcgacaggatctggtttcgacctcgcgtcctcagaaacgttcgatccgtggattctagaacaaaagttctcggcgtcgattgtagcatgccgttgttcgtaagtccggctgctatggctaagcttatccatccggatggagagtgcgcgattgccagggcatgtgagcgcaaaggtatcatacaaggagtatgtcatgatcttatatcccattcagtctcattgcacaacgccaagctctag

SEQ ID NO: 20364 - DNA, 291 bp, A.fumigatus
ccaacagcgcctctcaatattcgtttcaggttcatttcctgcagttactcgagtataatcactctgacttggagtctccgaaagaatttgtctttcaaaccagtgatctgcgcgaatttcaagagagtaaagatggcgggcgagaagcttctatccactaaggaagtgtcgaaacacaaatcgcctgatgattgttggattgttgttaataataaagtatgggacgtaacagattttgtggaggaacatcctggagggtcaacaagtaagagttgctggttattatgctga

SEQ ID NO: 20365 - DNA, 792 bp, A.fumigatus
tcttatatcccattcagtctcattgcacaacgccaagctctagtgctcattattgggcaggtttctaacaattcttcgtacactctggatcaactgagagaagcggctccttcggcgaatttcttcttccagctgtacgtcaatcgagacagaacaaagtccgcagcgcttcttcgtcaatgctcggcaaatccgaatgtcagggcaatctttgtgacagtcgatgctgcatggccaggcaaacgggaagcggatgagcgagtcaaggccgatgaaaatttgtctgtgccaatggcaccggcgcgagcgaagaacgacaagaagggcggcggccttggacgtgttatggccggcttcattgaccctggattgacgtgggatgacttggtatgggttcgaaagcacacgcatcttcccgtgtgtttgaaaggagtgatgtctgcggatgacgcgatcttggcgatgcaggctgggttggatggcattcttctcagcaatcacggaggtcgcaatcttgacacgagccctccctcaatagtcactctactggaacttcacaagcgctgtccagagatcttcgacaagatggaaatatatgtggacagcggaatccgccgcggaacggacatactcaaggccatctgcttgggtgccaccgctgttggcatggggcgcagcatgctctttgccacgaattacgggcaggaaggagtcgaacatctgatagacagtaggtgctgtcccatgtataaccctatgaagctaaccagcaattgtagttatgaaagatga

SEQ ID NO: 20366 - DNA, 558 bp, A.fumigatus
caagctcggctgccagctggtttctgttacgcaactgttggtgttcatccatgtcaagcaaagctctttgatgaatttcctggcggcccagacaagatgttggaggagctgaagtctctggcgctggaagcaaaagcagccgggcatgctgttgcgttcggtgaaatcggtcttgattatgaccggctgttcctcagcgctaaagaacctcagctgaaatacttcgaagctcagctggatcttgcggtggaaatacagctcccgctctttcttcattccagagctgccagtgaggattttgaaaagttgctagctcccagactggagaaacttcctaagaaaggcttggtgcacagttttacagggacaatggacgagatgaaacggatgctggcgttgggcttggacgtcggtgttaacggatgcagcctgaagacggaggagaacctggaggtggtgaaagctatcccgcttgatcgaatccagatagagacagatggtccatgggtatggagttctcatctcccttacaacatcctcacattctttcccctctga

SEQ ID NO: 20367 - DNA, 195 bp, A.fumigatus
tgcgagatccggccctctcacgcatccgctaaacacctcgagggttctcccgcattgcccaaggcagtcaagaaggagaaatggcagaagggccttatggtcaagggccgcaatgaacccgttgcgatagcccatgtcgcccatgtcatcgctaaattaaaaaatattacggcagcggaggtttgcgaggcgtag

SEQ ID NO: 20368 - DNA, 231 bp, A.fumigatus
ttcgacgttccaggcgtcgatttgccaagttggcaccttctgacaaagaaagcagtctattttccaatcactacgaaagtgactcagcagagaagcgacttcagctgtgactgttgctccggccatgatatcctgagcctggactataacggactcaatatgaggccatctttgttgaagcaaaatgatgtgacagaagtggtagctgtgtttctcacttgcaatcgctga

SEQ ID NO: 20369 - DNA, 297 bp, A.fumigatus
catcggactggatgcattgtcggctgctttcggaaggttcagggctgggacatgccagctattcgcaaggaatacctcaatttttcgttgccgaaatcaaggcctctcgacgaacgattcattgaacttttcgatgacaccagactcgggcccctcgctgtttcttctggtgcaagctcctggcctgctggtgtaatgctcgatccgcttcgcgaagaagtagtcgaggacgaaaataccccgagaggcagtagacattcttctgccagtgtatttcacaagtccgacgctatgtga

SEQ ID NO: 20370 - DNA, 345 bp, A.fumigatus
attggaatcaaccttggtgaccctgtatttcgaggagaatatcacggcaggcaggttcatgacaatgaccttgacgatgtcattcagcgtgctcgcgatgtggggtgcacgaagttcatggtgacgggttcagatctagtagaatctcggcatgctatccagcttgctcaaagttaccgtaagttgcgcacacaacatccttaccctttgtttcttcgtgctatcaagcctaacaagctcggctgccagctggtttctgttacgcaactgttggtgttcatccatgtcaagcaaagctctttgatgaatttcctggcggcccagacaagatgttggaggagctga

SEQ ID NO: 20371 - DNA, 561 bp, A.fumigatus
aagctctttcccgcaaccttggcatttccaagcgctaaagaagctgggactcaggatgattgtgtaagcggctgccatataagatcattacccctttcttacgcttgtccacatagtacgttagttgaaggggactacacccaggaccaccaagtctttctcaaagagaatggtattgaacatcgtcgcattcttatcctggcaaacaaggatcccacgattcgaactccggaccatgtcgtgaaccgagtcttggaaatcatgctcaacaagaccaatcacccactccttctacactgcaacaagggaaaggtgagcgcaaatgccgataatacaaattcgacccgactaacaagacttaatagcatcggactggatgcattgtcggctgctttcggaaggttcagggctgggacatgccagctattcgcaaggaatacctcaatttttcgttgccgaaatcaaggcctctcgacgaacgattcattgaacttttcgatgacaccagactcgggcccctcgctgtttcttctggtgcaagctcctggcctgctggtgtaa

SEQ ID NO: 20372 - DNA, 1536 bp, A.fumigatus
acacttgggctcgtctcccccacggctgttcctttcacgcatgtgcgcttgggaaaaagcacttttcaaatcacgacctgtgtgggccgcgctctgcacacctatgatctacgccgagggctgagtttgattttcgtcagtcgaccacagacgccagaagccataactgccacctttgcatggcgtgagaaggtctttgcagcgtggggaaatctcagaccaggaacatgtggaggcatatgggttttcaaacgcggcaagaaggtcgctgcattagaggtgccttctggccgagctgggcctattatcaaagtacttgtttttggcgcttggattgtgggttgcactggcaccagcattgaggtctggaaaaatacgacctatgaacattacacgacgttgattccgcacggaattgaagcggtatccggagaccacatttacggcggtcaaatgtgcagtatgccaacgtatatcaataaggtcttcgttggaagggttgacggctgcgtggacatttggaatgtgaggaccggacagctactccataccatccctgcagcatggccaagtgttggagctgtgactgctctgcaaccgactcctgtgctatctctcattgctattgctcatgcggatgggtctctattcatccgtaacgtcgataccgaacagattattctgtcgttgcgctccggttcctcgcacatcacatcactcgccttccgaaccgatagtctaggcgctggcgcagatggccaatctccaggtgtcttagcaacagcttctgcagatagtggcgacatcactttgtgggacttgaacaacgcagggcgtgtcaccggcgtccttcggaacgcccacaggacacttcaaaatgaaatagcgtctggcgtaaattgcgtggatttcttggatggccaacctttgttggtatcgactgggaaagacaactctctcaggacctggatattcgatgagacgccattttcacctattccgagacaacttcatttcagaagtggtcattctgctcctgtcactgtgttgagtttcttgccctcagcaacggatggctcggaagccaatggtaaatggctactgagtgcgagcaaggactgcagcttatggggacttagtgtacgaaaggacagccaaaatactgaaatttcgcagggcgcagttgagaagaaagccaaaaaaatgtctgctcaaggtcctgtgagcttagacatacaacatcgcacacagggtgtaagagcttcagagataacttgcattgcatgctcactgaatcgcgatggtggcatgggtgtcaccacatctggtccgatttgggctaatccgagagcagcagatgcagctgcttcgaataagacgggatgggagagtataatcactggtcaccgtggggacaagttcgcccgtacttggttttggggtaggaaaagagctggacgctggacttttgaaacaagcgatggatctgtcgtgaaggtaaatgattgtcaacaatatgccactgaatatcgctaa

SEQ ID NO: 20373 - DNA, 348 bp, A.fumigatus
atgattgtcaacaatatgccactgaatatcgctaacactttattgcagagcgtcgctatcacgcaatgtgggactttcgctctcattgggtccagtatgggaagtatcgatgtgttcaatttgcagtctggccagcatcgacagtgtttcccagctcgcggtttgaaaagtaggcgaactggcgagcttggtttagcaaatggttctcaagaaaagaacattggacatacaaaggcagtcactggcttagtagtcgattctttgaaccggactgccataagctgtgggttggatggtaaagtcaaggtacggtatacgactcctcaacataatcataatactgactga

SEQ ID NO: 20374 - DNA, 693 bp, A.fumigatus
ttctgggattttcattccgggttactcctagatgagcttgattggcatccaatgacagcaatcactggcctgcgttataacagcagcagcgatttggttgcgttcagttgtgatgacctctcgattcgtgtggttgacatcgaaacaagaaaactcatacgcgaattctggggttgcgttggtcaaatcaatgacttcattttctccaatgatagccggtggattgtggctgcttctatggactcacgtgtccgcgtttgggatttgtcaacaggacatctcattgatatcttccgagtgcctagcacttgtacctcgctatccatgtcagcgactggggagtttctggcaacggcccattcggataatgtcggtattcgtctctggacgaatcggagtctgtttattccaatttccacccagaatctggacgaatctgtctttgctgattctcatatccccatcacatccgcagaggagcgtgctggagctcttgaggctgcgtttgccgaagaagatcatcaggatgaggcggaggggccagtgctatgtgatgaacaactgagtacggagatggtaacactcagcgccattcccaggagtagatggcagactctactccacttagatttaatcagggtatggtcccacgcttcttccaccatctgctttatcattgctgattgttgttag

SEQ ID NO: 20375 - DNA, 342 bp, A.fumigatus
gaacgcaacaagcctaaagatcctccgaaggcacccgaaaaggccccatttttccttccatccgtttccgagaaatcgagcattgaaattagcgacagaagtacggtgttgtcggttgaacacacgctcgccgaacgctcaaggatagccagacaccaacgatctcagactgtggacgactcgggttctttattcacagtccttctgcattccggtcgtcagtctaacgattttgcacccttcatagactatttgaaaagtctatcgccagcaaggactgacctggagattcgatctctgtggtccaccacggggctggaggagccacagccgcagacccag

SEQ ID NO: 20376 - DNA, 1452 bp, A.fumigatus
gttaatgtagctcaaatttgggcgtgttcttttctcgaccagaaggagctcccggatgattttatccaagtgcgaaaggaccttctggatgactccaacgctgcaaaagatgttatggataaggtgaaaaagaagctgaaacttctcttgcgcgaaggatctgcaccttcacagttcacttggcccaaggataacattcctgagccatcagttgttctcgctactgttgttgagttgatgaaatttcaccggaatgtcatgagacacaattttgagaagcttaacaattctccacattgtgcttcgtcgatatctcccctaagtgacaatcctacttctcaggatgtcattcagggcacggttagcccaacccttacctctatccagggacggtggtgtactggtgaagatcccatgctcttcaaagaacgatgggaaaagctcttcgcagaattttgcgacacggagaaggttgacccgagcaaactttccgaattgtacgacagcatgaaattcgatgcactgcacaacagacattttcttgagtgggtgttcatgcccccagatgaggggaccaacgagcatgaacggcacagctccaattccaataatactaaccgtcacgatcttgctgaggacagattacccggacatgacagtttaacaagtgaaggaatagaggaaaacgtggaaaatccgaccttatcacatctgctcagattcaagaagcgagcacatgcattcgactcgataccgcatctaagggcccttgacgactcatatgatcactatttcaagctgtacccaggctctagtcctacgaaaactaaaatggatggacgactctcaaaacttcgggagttgtacaaactggccaaagttctatttgactatgtgactcctcaagagtacggaattaccgactctgagaagctggaaataggcctgttgacgtccttaccccttcttcaagagatcgtcagagacctcgaagaagtccaagcgtctccagatgcgaaatcgtttttttacttcactaaggagtcccatatttataccctcctgaactgcatcatcgagggcggaattcagacgaagatagccagaagcgctatacctgaattagattacctatcacaaatctgtttcgagttgtacgaggctaaggattgtgaatcatccacaagttcctattcaatccgtatctctatcagtcctggctgccacgcttttgatccgttggatgtgcaacttgactcgcggcatgcgatcggttgcgctccgagaagaagcctaaccgcccatcaggattggaaagaggtcattgaaacactcaaagcgaaattcgacacgtgcgtttcacagcccaccttcatccccctacgtttcatagggccaacgactgatcagaattctttagggttaaacttcccaagactttcattgccgtaa

SEQ ID NO: 20377 - DNA, 2610 bp, A.fumigatus
gcactacacatcattttctccttagaaaacctggctcaaacacataaacacaaaaaggagaacaaactttacagagcagcaacggaaatttgggatgagagctttcaagcacagcctcagtctttgagattcaggttctacgagcaaccttcaaagatgacgcagagcaattctattcaagatttcccaccttccgcaacccaggataattgctcttctgatattggttgtgctacaggcagtgacgagcgaaacgcactgattgccacgcctttaccaaacatggtgcctgatcagactggtgacaaatcatcttttacccttctttatgacccggtttcaccatcttcgagggcaagtccaagtaatgggcaatttcaccagaacaaaccccagacctcagatgtaatgacagatcatgctggcggcgcgagagttgctctttcagctcgttcctccagccgaacgcctaggagacttagtggcagcacagctaccagctcagtcagtgaagctgaaactggcccctcaagcatcggcaggattggtgtctgcgctctggatgtgaaagcgcgcagcaaacctagccagaacattttaacccgcctgcaagctaagggtggttttgaagtgattgttttcggagacaaggtgattctcgatgaggctgtagagaattggcctgtatgtgactttctgattgcattcttttctgacggcttccccctggagaaggccatcgcttacgcgaggcttcgaaagcctttttgcgtgaatgacttacccatgcagaaagtgctgtgggaccgacgactgtgcctgcgaattctggatcatatgaatgtccccacgccaaagagattagaggtcaatcgcgacggcggaccaaggttggaatctccggagcttgctcagcacgtttacaggttaacgggggtcaagctcgagggccctgaagatgggactggaggaggctctcagaaaactcaggtggtaacaatgtctgaggacggtgaggctctgattgtggatggaaaatctatcagaaaaccctttgtcgaaaagccagtgaacggtgaaaatcacaacatccatatatacttccctaacgatcaccagtatggcggaggaggcaggaggctttttcggaaagtcgggaacaaaagctccgaatacgatcctcatcttgtggtgcctagatcagtgacggaaaaggacacaagctacatttacgaacagtttttaagagttgacaactctgaagatgttaaggcttatacagtcgggccagatttttgccatgcagagacacgcaagtcgcccgtggtcgatggagtcgttcgtcggaacacacatgggaaagaactcaggtacataacgaaattgagccaggatgaggcagcaattgcgtcaaaaatctcgaatgggtttggccaaaggatctgcggcttcgatatgcttcgagtcggcgataggagctacgtgatcgacgttaatggatggagtttcgtcaaggacaacaatgactattacgacaaatgtgccagtattctgagtgacatgtttctgaatgaaaagcgcaagcgcgagggactacaaaggtccctagaaatggtttcaccggatacaagccatcatgtgaggcattctgtatctcacaggcataccttgaaaaccttgttgaaatctccatccacgtccaaactctacggcggccataagagcctcgacaatagtttccaagaccttgcggcgttacctccagcatcttgtggagcagaaagtatggactacaaaagaagtcgaacaagcccggatgcgcgccagatcgattcggatataggtgatctcgaccagaagaaccgcgagttgaccgggcatcccgacgaaacgattccgccgcctccacctccagcatctaaacattcctggaagcttaaaggcatggttgcagtcataaggcatgcagatcgtacgccaaagcagaagttcaagttcactttccacagccagccatttattgatttattgaaaggccaccaagaagaagtggtgatcaaaggacaggcagccttggctagcgtctcggatgctgtcacgcttgccatggatcaaaaactggaacatatggaaaaactcaaactgcttcgaacatccctggagaagaaaggcggctggcctggaacgaaggttcaaattaagcctatgtttcgcgagcgaacgcaggaggaattgagcatgcatagttcagagaactcgaacagcgacggagcgcagattaattggacccaggtcgccgatgacgccagcggggataaggaaaattttcctcgaacatctactcggagtgactcaatatccggcacaacattctcaagattttctgctgccgagaacgatctcatcctagacaagctgcaacttgtgatcaagtggggtggagagccaacccacgccgcaagataccaatcacaagatttaggtctcaatatgcgtgacgatctgaaattgatgaacaaggaggctctgaataatgttcggatctttacaagctcggagcgaagagtgagtaccagcggtaggtctttcccaaagcacgtttctgtctga

SEQ ID NO: 20378 - DNA, 201 bp, A.fumigatus
gtctgttcgatagccatcaaaatatttgatgtgacccagacaatcgcatccaagcgtcaactggttagcattgagaccaaaaccaacatctccaacatcaaaagcctgtttccggtgataaggggcccggggatctgttgcaatccagttgatcagtacagtgctcttactcttcgtctcatggccagctcacctccatag

SEQ ID NO: 20379 - DNA, 282 bp, A.fumigatus
ccactcgttactcctctaactctgcatctcggtctgataagcgtgatagtcgcttatcggtttagtatacaaggcggcagtattatctgttggcatagttcctttctcgtacagattgaaatgactcaatttactcccgcatataacgacttctcgctgagaaacgaaagctcagtaccgtcaagaaagaaatgcaaaagggagggtgggaagtggactcggtcaggttgtctgacctgcaaaaggcgccggaagcgctgtgatgaagctaagcctgggtaa

SEQ ID NO: 20380 - DNA, 414 bp, A.fumigatus
gcccaccgtctccttacccaggtcgtcgtcacgggcgctcgagttttcggtcgagccttcgcagaagcttacaagcaggcctccgcatcgtccaaatacgcccaggcaaataagggaaagggaggaagctcaagcacatttgcatcttccggcttgacactcgaagaggcttgcaagattctcaacgtcaagccaccggctggaggagaaacgaatctggaacacgtgatggagcggttcaagaagctgttcgatctgaatgatcccaaaaaaggcggaagcttctatctgcagagcaaaatcttgcgcgctcgcgagagaatcgagatggagatccgacaagcggagcgcaaagccgcacaggagaaagaactccgggaaggctggaatcccaaggtgtacaaggaccggtga

SEQ ID NO: 20381 - DNA, 306 bp, A.fumigatus
gactcgagtcatacactggccgatgccgacgatgccagagcttacttctctgaaaagtataaacacgattcggaactgccctcacaaggctacgacacttgcgtaaatatgggcgacaaatacatcgtgaatgaccatccgcattttgccggatgcttgtccgagaacattcttgtaaagacttcgaagtatcctcagattttgtttgaaatgtggatgatgtcattaatgatatatgcttctgaatgttattatatactcggaaaagtaaccctgttttctgacgagaaaccaaaaaatggatga

SEQ ID NO: 20382 - DNA, 903 bp, A.fumigatus
caaatatttctttccttcttatctccacgactgatcactggcttgttgatagtctcgtcagtgaagattgtagcgcactactcttcttacctccaggaactccgtggaggcttacaagtggcaatcacaatcatggggcgtccctcggtccctctgtcggcggatcttccgccactcattatgggcaccgcaaccttcaattctcagtacaaccaggatccatacgccctccccacgacggaactagttcatcgtgctcttgagaacggtgtccgcgctttcgatacgtccccatactacggcccagccgaggagcttctcggtcgtgctttggctactgactacgttcgctccaatttcccccgtcatacataccgattgctcaccaaagtgggccgagtggcagcctcttcctttgactattcttcaagatgggtgaggtacagcgtgaagcgcagtttgcgccgcctccataccgattatctggatgtggtctattgccatgacgttgaattcgtgagccccgagcaggtcatcgaggcgattcgagagttgcgccgcattcgtgatactgaaggcactattcactacgttggcatatcgggataccctgtggatgtactgtgcaaccttgcagaattggtcttgcgcgagacaggcgagccgctcgacgcggtgcagtcatacgccaatttcacactccagaatacccgactgctgacccagggtctccctcggctagtggccgccggcgtggacgtgattcccaatgcgtcgccattagggatgggccttctacggcgcaagggtgtgcccattggaagcatgggcgactttcatcccgctccagacggtcttcggaaagccattcgtcttcaccacggggctggaaggagccgcgcc

SEQ ID NO: 20383 - DNA, 246 bp, A.fumigatus
gattgtcagaggttgggagatcttggaagatggaagacttctgctagcagtattgatggatggtgcctgggatgggatcgatcgatggatcgattgatcgaccccagggcggtggtgagagaacgccgagaaaagttaaaaccgaactcccgctacactctgtacgcatctcctactattaaagaggacaagagatataccctgaactattcctgttctgtcattgtccgggccggcagtatatga

SEQ ID NO: 20384 - DNA, 1323 bp, A.fumigatus
tccatcgctcccttactctccccagcgaggaagaaacaacatggatccggtttggtcgaagagtatacaggagatgctgatgcggtggtagaagatattccgtggatagattccatggccccatcatacgcgcaggatgatggcttacagcctgattctcagccaccaacggttgctgctttttcgcccactaccatttcgggctcatccttgacgtccagacaacgttccagcataatcgtacatcgcaaatccccccttcttgtggctacacctccggccatcactcgagctctagcctattctcatccttttatacttcctttgaataaactcgccggcttactcacgtggacaacggacgacccatggcaaagctttcttctggtggcggggttttggacggtggtcctgtacagcgatgcgattattctttggggcggtccgattctagtcgtagtcgggttaatcctaggcatgtattggagacgcttttctccgttatcgacagcggcattcacgggcgagaaacgacagcaccaaaagagtgtctccgagggttcctcacatcagcatgagactttggatgagattgtcgagacattgagaactttcacgactcggtgcaacatactcctggagcctctccttgagcttacggatttcctatcgacgcagagaacggcgacgtccgcaactacaagacccgctctcactactatgttcatacgaattctttttgtgactcccatctggatcgcattgacccttccgcccttttacataatcacaactcgccgtgttgtcatgactataggcaccatcattctcacctatcactcccgaccagcaagagtatcacgagtcattctatggagatccttgactgttcgccgaatatgttccatgattactggtctttcattttctctaaacgccaatcaatcgcagtccctctgggctcagagccacggtcatgctgcatccattgcaacgaggcggcgaggggattcctcgggagttcgcttcacttttgtactctatgagaatcaacgtcggtggctgggaattggatggacatactccctgttcccctctgagcgtgcggcatggaccgacgaacatctgaacccagccccgtccaaggatgactttgagctcccgcatgtacaggcagggaatgccaagtggcgctgggtcgagggcagcgagtggcgtattgaaggagctgacgatacgaacagcaaggcagatggtaaagctgcggatggtggaggatggatctactatgataacaaggtgagaccccacctccgtccgtga

SEQ ID NO: 20385 - DNA, 621 bp, A.fumigatus
ggacctattgatgtagacgaggtgactgagattgaggcactctgcatgcggcaccctgctgtgctggcagaaatagagaaactcaagctgccgccaggaatggcagtctgcaatgatccgtggatgtatggctcagacagtcccaatgaaacgagacggctcttccaatgctttatgtacatggttgaagtggaccaccctgagaacaaccattactctttaccatgcaagttctctcccgtctttgatgctagtacccgggagctggtccgcatggactatcttcctggtggcacagacacaaaagtcacggagacgcaaccatggagacccgttaaaacaattcaatatgctcatgatcttttggacgagccgctaagaaatgaccttaaaccctacatcgtccagcaacctgagggggcatccttctcaattgacggaaactctgtgtactggcaaaaatggcgattcagagtcggcttcaacaaccgggagggactggtgctctacaatatcacatacgacaatcgcaacgtcttctaccggctttcggtctcagagatgacggttccctatggaggtgagctggccatgagacgaagagtaagagcactgtactga

SEQ ID NO: 20386 - DNA, 633 bp, A.fumigatus
tggaatgatggccgtcgtgggcaagatggttgggatcgttatactcgtcgtcggaagtggtgccgcgacgctgaactcgtcgagataccacaagcgactgaaaacacgccggctacggccaagtctggtttaacacaggcgttggataaacagagggagtcggggaacattgacgcttcaacagtcgataccgatgccgtgagtctctccccgtcagcgtcctccaagacgcggaaaagacgttggttcgggggctcgaaacctgtaagcgacaaagccagtagcacttcctttgcgctaccagccttcaccaatacatcctccgtggacgctggaaaaataacctctacccccagttacagcccatcgggaacccacgtcgcgagaccgattgacatcgcacactctcggaagccatcgaactactccggcaacgcaagtcatggcagtgtgggccgagacagcagcgttgcgggtagtgtctcgcacagtgacagtgccagcattcgagataaggaaattatccacgctcaagatcatctagaccgctggggtactcgagctacgggtggtattgagcgagcagagcgagaactggggctgggtgacgaggtcaatatgggattgagttaa

SEQ ID NO: 20387 - DNA, 237 bp, A.fumigatus
gtcaacgattgcatgatcaattctcggtcgatcgtctcttcgcactcgcatcctgtgatgaagagtggaaaagtaagcgcggaatactcgcagtggtcgtcgagtggcgatgaacgaataattctgagacaacgctctactgccccccgctttgataatgatatgaaggaagtccaaaacgaggatgctctttgcgtgaacccccgcatcattctttctagcgtggaatggagataa

SEQ ID NO: 20388 - DNA, 414 bp, A.fumigatus
tatacgaacccaagtctctgcagtatgctggcatctcagagctctccttcgaccacctcggtcagcctccatcctttcgatccaattactccggaagagatcaaacttgccgttcgcattctcgaagctgcctttcctggtgtgactcttcggtataagcgaattgacctgcaggaacccatcaagaaagatgtcattgcatatatcgaggcggagagattacggaaacctttgcctcagaaaccccctcgtcttttattctcctactttcaccgtttggacagtggtgtcttccacaaggccctgttaaatgctgacagcaagtcagtaatccatatcaaggagctccccgcacatgtgcaagtgagtagatcattcctctttccctttccatccgcctgtcctgatagctga

SEQ ID NO: 20389 - DNA, 1254 bp, A.fumigatus
gctggccatgagacgaagagtaagagcactgtactgatcaactggattgcaacagatccccgggccccttatcaccggaaacaggcttttgatgttggagatgttggttttggtctcaatgctaaccagttgacgcttggatgcgattgtctgggtcacatcaaatattttgatggctatcgaacagactcaaaaggtaatcccgttcatttgaaaaacatcatttgcatgcatgaacaggacaatggtcttcaacacaaacacaccaattaccgatcgggcgctgcgacagtggtgcgaaaccgtcagctggtccttcagatgatttgcactgttgcgaattacgagtacatctttgcatacatctttgaccaagctgcaaatgttgaacttgaggtccgagccaccggtatcttatccaccgttccgtttgacaatgagaatggcgaaacagtcgcctggggtactaacgtcggccctggagtcatggctcctttccatcaacatatgttttctctgcggattgatccggccatagatggtttcaagaacaccgtctactatgaggacagcgtaccactccctgaagatgagaagaatccttaccttgttggctatactactgagcagacggtcatccgcaagtccggctcagccaacactgacatcaaccgccatcgagtattcaagatccgcaacgataatatcatcaaccccgtgacctataaacctgtggcatacaaactccaaacggcacctagccagatgctcctgttgagccaaaacgcaatgggttaccgacgggccgagtttgccagtaaacctatctgggtcaccaagtacaacgatgacgagctgtacgccgcaggcgagttcaccaaccagagtagacgagcggaaggtgttgagacctgggtacaaaggaacgactcgacagagaacgaagatgtggttctatggcatagtaagttacctcgagccctatgggtctcccagtcaggactgaccaggtcggcagcgttcggtctcacccataacccccgtgtcgaagacttccccgtcatgcctatggagcgaatcagcgtcatgctcaaacccgatggtttcttcaccaaaaatccggccctggatgtgcccccgtcaactcagtcattcaacaaatccaccctccatgctgagcctgctcccgtggcaagatgctgctccaacgggggtgccagcactaaagcgaaactctacaagcgcattgaatag

SEQ ID NO: 20390 - DNA, 186 bp, A.fumigatus
tattttccgtttgatttcaacagtatcaagaagcctaagactcaccgttacccttccctcaagggtgttgaccccaagttccgccgcaaccacagacacgcccttcacggcaccatgaaggctctggtacgttggccttgctgctgcttaggtcgaaagcagccggatgtcggaggacatggctaa

SEQ ID NO: 20391 - DNA, 921 bp, A.fumigatus
cccactgtatcaataatgctttacgctgaaggtgataagctcatctaccgatttgatgaccacattctttggatccagccatggagcgagaatgcttttcgtataagagccacgaagctggcgtctatgccctctgaagattgggcactctccgcaaaaccgagcacacagcagccgattattgaaacccccgctggcaaagaggcccgcatttccaatggtaagatcaaggcagttgtctcccagcgaggcaagatcacaatctacaactcgaacggtaaaaagcttctggaagagtatgcccgtcatcgtcgtgatccaatggacccgaaatgcagcgctctcgagattgaagcgcgtgagctgcgaccaattctgggaggggactaccatctgacgctgcgattggagtcgctagacccgaaggagaagatctacggtatgggccagtatcagcagccttatctgaatctcaagggagccgacttggagttgggacaccggaattcccaagctagtgttccgtttgctctgtcctcccttggctatggcctattgtggaacaatcccgggatcggacgagccgtactcggaacaaacatcatgagctttgaggcatattcgaccaaagtcctcgactactggatcgttgcgggggatacgccggcggagatcgaagaaggatattgcaaagtgacaggttatgtcccgatgatgccagagtatggtcttggattctggcagtgcaagctccgctattggaaccaggagcagttgctcaacgtggctcgagagtacaaacgacgcaatgttcctttggatgttattgtagttgacttcttccactggaagcaccaaggagagtggagttttgatcctgaattctggccggatccaggtgggtctatttcggccacatga

SEQ ID NO: 20392 - DNA, 240 bp, A.fumigatus
  unsure (101),(104),(128),(153): Identity of nucleotide sequences at the above locations are unknown.
cgcggccttccgagttacctatgcaatgtgatggcgacgtcacacatttttgacccgaacaacccccgagggttcggcaatatatcttggaaaaaggcaanaanaactactaacaacaagggatcaanaatctctgggcttgacaaaccgaanctgaaatacccaatctatgactttgaatatttaacggtaccaaggcttggcaccaccctacaattcggtaacctcttccccccggga

SEQ ID NO: 20393 - DNA, 354 bp, A.fumigatus
ttgtctctaccatcagtgtttattcgaccctacgtgtctgccgattttcttttcttttcttttttgcccacgtatcttgtctcctccgtcatggaggttgccagcatgacacagcctgacccgacaaacggtgctcacttaacttccatcgccatggacgcctctatggatatcgacatggatattgacctcgggccgctcccagagccggaatcaattgaaatagtgagcgacaatggccccattttgtctgcttgcctttcccttataactaacgtgtctcaaccttccttaggaacccgcgacgacaacagttactactcaagacggcttggtcgatcccacaacggctga

SEQ ID NO: 20394 - DNA, 201 bp, A.fumigatus
gctttgcgctgcgatatcgtgggaccacgaagatgtcgcattgcttcctatagcatcgcactaacgagtatgcgttcttcagtttctggtggtttcgccgtcgttcagcctgactctgctctgagcatcaacgccgtggaggcctaccccctcgaggacttcagcgccgatgtaagttgtggaaacgaagaaatgtcttga

SEQ ID NO: 20395 - DNA, 1296 bp, A.fumigatus
gaacccgcgacgacaacagttactactcaagacggcttggtcgatcccacaacggctgaagcgcagtacgagaaagttcacatacgaggcgttgatgatttaactacagataacatcaaacaattcgcgacggattacttctccggcgagaccccttcccgcatcgagtggattgacgacacgtctgcaaatatcatctactcatctcccgaagttggtctacaagctctggcagctttcacacaggccagcgaagaggaagatacatcctcatttccgcctttgcgcttacggtccgccaaggcattgtcaacccaccccgaatccgtgcttcaagtgaggtccgctgtgaagaccgatcgcaaaaagccccgcgcatacgaagccagtcgattctatctcatgcacccagaacacgacccccgggagaaactacgacgagaactcgcagaaagacgtcgtcaaggtggccaaggctcaagcgatggcgactatcaacgaagacggtttgacggccgggagcttagacggcggagagaccgtgacgcggacgacaacttcagtgccaatatgtacgacgacgaaggcccgcgtgctagcaccgactattcagactcagagagaggtcgcaacggacgaacacggagaggccagcgggaactattccctgacgaaggtcgtttatctggccgccttcggaatcggagcgcctctccaggtcgcgataccctggccgagagtggtcgtctagaacaagaggaacgcggcacgcgaagtcgcttccgggagcgctcgccacagcttatccgtcgcaacgaaggcaaagagcttttcccctctcgtactagcgacagtgactccaatgcccgcgagctctttccaaacaagccagcgtcaagttacctcaagaaagagctttttccaagcaaacatagcaatcatcgccgctcagatgcgatcgatgccgcggatgagactgcagatctgttctcgaggagaatctctgtgccccgggcggatggcgctcgggaccagaactcgtcgcgcaataagaacatcgagttgtttccggattcggaggatcaaaccggggtcagcattcgcggggcagctggccaagaccagggtatctcaattcgaggtgctgccaatggcatgtcaatcaagggccgaggctcatctgtccgggagctgttcccttccaagtacaattccaatgccggcaaagagttattctctgataagatagaagggcggggcggtcctcgacggagggcagaggacatgtttggctaa

SEQ ID NO: 20396 - DNA, 1227 bp, A.fumigatus
cacgacccagcaccttcaacaccgaatgtcatccaaacgccatcctctgccaatctcctagcatgttcggtagaaccatggcagaatcctagccaggaggagaatcaagagggcgcgtcacattacattgtcgctacggacgcagatagacaagtgcaccttttcaaggcagacaaaggcaacgacgttgtcacttcgtttgctggacactccgactccccggtgctatcgtacgcgacgattcagaatggcaaatacgtcctgatgaccaatatgtccggccagctccttctccaacggggagctgagattctgtcgcgccgtaaagatcatgccaaatatgcagtcaaggtgatcgcatatgaagacgaacagccaggcgaaactgcgtccaacgccgtatgggtcgctaccgctggctgggactccaagatcctactctaccgtctccgtattcccagcagagcaggagatcctgccccggtggagctcaaggagcccatcacctccatcaacctgctcaccaacccagaatcgatcctcttcgtccgccacccagatacaaaggaactcgtcctgctcgcctcgcgccgcgactcgacctatctcttctactacgccgtcccgccgtcgacgcctaccgaggctcccaccgagtgcaagctcctcggcaagcagaacctagcccctcactctaacgcctgggtcgccttctctccttcatgcctagctctgagcccgcacgatcccggcctcatagccgtcgcggcctcgaccctcccgcacatgaaagtcatcatcgtgcgcctgctattcccgaaccaggggccgtcggagcccaccccgtccatgggcggtacgtccgcgcagccagagacacaagccacgcaggcctttgaggcgcttgcgcttcagaaccgcgaagatgcggccatcatgatccaggctaatacctttgcgccgcagacggtctactccactccgcaggtggtttggcggcccgatggttcgggagtgtgggtgaatggggatgatggggtgattcggggggttgaggcgaggacagggaaggtgacggcgacgttgaaagatgggcatcaggttgggtcgaaagtacgggctatctgggctggttgggttcaggtgcagcgagatggcaaggtggtgaaagaggagtggcttattagtggtgggtttgataagaggcttattgtttggagggtgtag

SEQ ID NO: 20397 - DNA, 399 bp, A.fumigatus
agaccgatcgcaaaaagccccgcgcatacgaagccagtcgattctatctcatgcacccagaacacgacccccgggagaaactacgacgagaactcgcagaaagacgtcgtcaaggtggccaaggctcaagcgatggcgactatcaacgaagacggtttgacggccgggagcttagacggcggagagaccgtgacgcggacgacaacttcagtgccaatatgtacgacgacgaaggcccgcgtgctagcaccgactattcagactcagagagaggtcgcaacggacgaacacggagaggccagcgggaactattccctgacgaaggtcgtttatctggccgccttcggaatcggagcgcctctccaggtcgcgataccctggccgagagtggtcgtctag

SEQ ID NO: 20398 - DNA, 234 bp, A.fumigatus
ctctgctctgagcatcaacgccgtggaggcctaccccctcgaggacttcagcgccgatgtaagttgtggaaacgaagaaatgtcttgatatacttttttgacccaatctttcaattacaggctgtcaaatcccagatcgccgaggcccagaagattgccaatggtagtggcagtgagcaggacattgctgaggctaagattgagctcgaggtaggtcaaccacgaacgcgctag

SEQ ID NO: 20399 - DNA, 210 bp, A.fumigatus
ttagtgaatatgtctatcaaaattagatatcccggctgcttaagtacctatgaattcgctgcccttatcggcatacacaatgcctcctgttgtgtgcatggttctgtgaggtatttgggcaataatggtgctgtctgcaacattaaggaaggttttaactcttgtctaagaaagcgcggccacagaatagaagggattacaaagcactaa

SEQ ID NO: 20400 - DNA, 438 bp, A.fumigatus
aaaaggggaatctcaatttacagcttccgcctcctagctatagcgatgttccgtttgaatcttcgaagatccaagtcatggttcaagcattcggctgaaggatgctttatatcttgcttgcgttatcctcaagcaagaacaatggtttgctctcaaggggctcctccacaacagtctccttcgggaaacatgaaaatggatcccttgcaaagcattgaagaagaggaacttcctctatataagccagagaattactatcctgttgatataggcgaagtgtttgtctccagataccaggtagtttcgaagctcggatatggcacttcttccacgttctggctttggagagatctcaagtatgtgttcaaaggaccttggatgcagataaatgatattttacagagaaaaatgctacaagacgctcaaaatatgtgttag

SEQ ID NO: 20401 - DNA, 315 bp, A.fumigatus
gttccaagattttctcccgacaacatgtttccgaatgacctcattcaaaggagtactcagctcactttgatagcattggccttcctacatgagaataatgttattcatactggcaagtatatagcacaaggcgcaaatgttcatgctaaaagaaaggtagatatttcaccgaacaacatactccaagggatagaggatacctctatcttgtctgacaattactccttaatatatcttcttgtatgcatggcagtcactgcatggtctctcgtctataagatgtcctttctaaatgttctcgcggctgaaaagtag

SEQ ID NO: 20402 - DNA, 780 bp, A.fumigatus
ggcacaccaaagtgcgaaagtgtgtacatgtcaaatgcccctacggccagcattagcgccatagtaaccgagaaaaaccagggtgcaacctcccgtcaacatctatcgaacgaaacccagccacccaagatgtccgagtctgctcatcgtgagtacaccccaaagcctttgccaacgactccagctagagacacacggtctcccttacaaacccaccaccctctctctattacaatgttgcaagaaccggattcgaccgctaacgaacagaagcagctttctgctcctgttgttaaagcacagcatgcaatccaaagcctagttagctcccagccggcccaactaaagaacagacaatgcgcattacaaccgcggcaacctctcaccgttctatcacaagcgtcgaacgctgcggttaaaggggaacagcacaccgggaagcttatcaaacaacccgcgccaaggatattccacttgggcatgtttgaagtcaggaaggcgttgggtaagggaaagtttggacgagtatatgttgctcataagcaaagcactggctttgtgtgcgcattgaaggttctccacaaaagtaaaattcagcaaggcagggttgaaaagcaggtagctcgcaagatcgaaattcagagcaacttacggcatccgaatgtccttcggcttttcagtcactttgacgagagcaaacgaataatcttaatactggagtatgccggcaaaggggaattatataaacatttgcagagagaggaccgtttcccagagtag

SEQ ID NO: 20403 - DNA, 513 bp, A.fumigatus
tactggagtatgccggcaaaggggaattatataaacatttgcagagagaggaccgtttcccagagtagaaatctgcgcagtacattgcacaaatggcgaatgctcttgtatatctgcatcgcaagcatgtggattcaccgggatattaagcctgaaaatatcctcgttgggatccacggggagctaaagatgtcagactttggctggagtgtccacgcgcccagtggtcgcaggcatacacaatgcgggacattggactacctgcccccggagatggttgacccgcggaagtgtgacaaaccttatgatcagaaggtggacatatggtccctaggtgtcctgctgtatgagttcctggtcggaagagcaccattcgaggatacgcccgtcatgacgcaaaggaggatagcaaagggtgacatgacggttccttcatttgtcagccctgaggcaaaggatcttatcaaaaaggtaagtcaccgacttctctttaataaccaaaacgactgctaa

SEQ ID NO: 20404 - DNA, 255 bp, A.fumigatus
gttgctctgaatttcgatcttgcgagctacctgcttttcaaccctgccttgctgaattttacttttgtggagaaccttcaatgcgcacacaaagccagtgctttgcttatgagcaacatatactcgtccaaactttcccttacccaacgccttcctgacttcaaacatgcccaagtggaatatccttggcgcgggttgtttgataagcttcccggtgtgctgttcccctttaaccgcagcgttcgacgcttgtga

SEQ ID NO: 20405 - DNA, 543 bp, A.fumigatus
aactctcaatttaacatggccgatgaacctggacaaccccccgctctcaccacattgagcctggccgagaaggcccccgcgtccaaggcagtcgctcaggttgtgactcctttcgatgtgtctggtggtgtcgacgagtcgggcaagcttctccccgttgactatgataaactggttcgggaatttggagcgactcgtatatccaaagaactgcttgagcgcttcgaaagagtaactggacgtcggcctcatcgatttatgcgcagaggaattgtcttcagccaccgtgacttgaacctgattcttgatcgctatgaaaaggggcaaccattttacctctacactgggcgtgggcctagcagcgacagcatgcacgtcggacacacaattccctttgagttcaccaagtgcgtcgtccattttctacttgacgtttctgaaaacgaattgaccaggatggctttaccagatggctgcaggatgtctttgattgccctttggttatcatgcttacagacgacgaggcgagttttacatcattga

SEQ ID NO: 20406 - DNA, 855 bp, A.fumigatus
aaatacatgcattcgcaaaagatcgaggtcgacgatgctaagaaatatgcaaaagccaatgcaaaagacatcattgcagttggattcgatatgaagaagacatttattttcagcgatttcgatttcgttggcggcgctttctatgagaacatctgcagaatggcgaagaggatcacaataaactccgtccgaggaacctttggcttcaacgacagcaacaacgtcggagaatttcacttctgcgcaactcaatcggccacagcatttgcaactagcttccctcacatcttcggtaccgacaggaagaaggtctcgtcaattccttgcctgattccctgtgcaatcgaccaggacccgtacttccgtcagtgccgtgaacacgccgagaagatgaagtacaagaagccctcgttgatccatgctatcttccttcccgctcttcaaggcccgggctcgaaaatgtctgcgagcgtcgagacatccgccatcttcatgaacgatgcgcccaatcggatcaagaacaaaatcaacaagtacgccttctctggagggcaggatacagctgagcttcagcgtcaactgggcgccaacaccaaggatgacgtcccattccaatacctcacgttcttcatggaagatgatgaggaattggagcgaatccgtgtggcttatgagaagggagaaatgcttaccggcgaggtaaagcaaaaatgtatcgcggagctacaggcttacgttcaggccttccaggaacgtagggcccaggtcaccgacgagatagttgccgagttcatgcggccccggtccctcgagtggaaaggcaaccccaaccccatcgttgttgagaagaaatag

SEQ ID NO: 20407 - DNA, 909 bp, A.fumigatus
cgagctctcagtataccattaagcacagcatccatagttcacttgctctgcgtccatttcgttatgacagatgcaatggctacaattacacaatcgcaagcctcggagtccttccagataatttcctctcttcgttatgagcctgctcttcccgagttgctcaaagcacaatgcaccgacgcctacccagatcccctgcgatcaccttactaccttctcccttatcaccaggaacgacttcgaaaagctgcagattgtttcgggtggcgcaaagcggccacgttcctacaacaagatgtcgagtccttcgtcgaacaccttaacagcttcataccagaccggacgaaaccttggcgtctccgcattgtcattgacagagatggcacatgcaccgtcgaggtcaacgcagccctgcaaatggatgcgctaaaccttctcctaccttccaaaatgaatcaaacagacacgccctggcgtgtcacggtagactctcaaagaaccgtgccgtcgcccttcacaacgcataagactacatcccgagacgtctacactgctgcgcgacttcgagccaagatcacctccccacaagatccggctgaagtactaatcgtgaatcctcaaggggaaatcatggaggggagcataacaactccatatttccgacgccgaacgtccgcatccacacaagcgaagattgatcaagaggattccgggccggcctggattacgccacccctctctagtggaggtaacgcgggtacaacaaggcgatacgcactatctcaggggttctgctccgaacaggcgatcactatcgccgagctgatcgacggtgaagagtgttggctcagtaatggtgtgagaggattctttcgtggcagaatcctgctgaacgagtctaaaccatga

SEQ ID NO: 20408 - DNA, 957 bp, A.fumigatus
caggagttgcttccgaccactgacaaagctcaaggatcagacgagcaccatcttcctcagacgtccggtttctccgtcgccacatcagctccagcatcgtcatctagattctacggcctgttatatgcatcagcaaccatgaaattcttcgagaatgtctttacgtacgattattccttccctgccgtttcgctcgcctactttcttcgatacccgaatccgtattctcgccatgttctgaccaccgatgtgatcgaccgttatgtggatccgaagacggagcgacttcatacagttcgtctccatttgaagaagtcaaaggtcccgtcgggtattctgaagttacttccgaaaggaattgggggctcggacaattctggccagagttatatccttgaaactaccgtcgttgacattaaggaaggatggatggaaaccgaatcgcggaacatggaatggacgggtattctaagtgttgttgagaaacaactctacactcgccaaccaattgagggttcgctcgaaagcttacaagggctttcactagatgcccagagaaacgagcagacccaagtgaaaaccacggtcaccttccgctctcgcctgggacaaggaaagttccttgggaaaaagaagaccatcccgactgccgatcagaccatcgagtttgatgaagagacacctaagaagggattcttttcgtcgctgtctactgctggaattcagagaaccattgagctcattggcgtgagccgaacacgagatgcagtgctcaaaagcaaggaaggcatgaatgtcgtcctggagcggttgcggaatggcggcatcgtcggtgtccttgaggggatgcggcaggatcgggaagcagcgttcggacccgatggtccgtggaagcgtgtctggcttagagggaatggcctcaaagatcgagcctttactgatgatgacgacaactga

SEQ ID NO: 20409 - DNA, 477 bp, A.fumigatus
aagttatcaatgtccctacaactcggatcagcctcggtctttcgacctggctgggcgctttcaatattggtggtgttggccgctttgccgtcagccatcgcccagttttgcaccttttgggacggtggctgcgtcgatcctctcgctcagacagccatcaacttcgatttccctcctctattccttgatgatctcactttgtactatggcttcgacgcgaatccctcgggtaaagggcaagagccgatggtcaaggccagtttctggcttgcgtacgacccgcatcgcatcgacagcaccgtgatcactgcaaaccgaacctccgagattgccttccgggtaggaaatctgaccgggacgccctctggacctagtaacggctgcgacggtgtttggggacctcagtgtactcacgacctgaaggagctgctagtcttcaccaggcagtggcaatcgagctcattggaaatcaatccg

SEQ ID NO: 20410 - DNA, 282 bp, A.fumigatus
agaaagtttactgacgacttaaaacaggccgcagtcgacgtggagacggatgcactgctccaacgtaccctgcgcagcagcgtcttccaggaacgcacaatcatcacgattgcgcaccgtatcaatacgattattgactctgatcgaatcgtggtcttggacaaggggcgagtcgcagagtttgacacgcccgcaaacctgatcaagcgtggcggcaaattttatgagctggtcaaggaagctggtttgcttgaaagcgatggagcagcgcttgtgcagtaa

SEQ ID NO: 20411 - DNA, 234 bp, A.fumigatus
ctacattgttgcgcaggatggatgtgtatttatgacttggctctcacgtacaatgtaactgagagcatcaatcaagagagtcgagccatttgtcgaacatgtccgtctaaacggttaccttctttgcatatgcgacccaacagtgaatatggcttcgcttgggactctcctgcctccacaaaacctatcaacttttacaactcttcttctcctcgcagatggagtttacgttag

SEQ ID NO: 20412 - DNA, 432 bp, A.fumigatus
agagggctcctggaagccggcttcttgcttgctgatgcctccgcctcctcagctgcctgggatatcctggcctgccttctcagcaaggccgagagctgctcgtcttcgttatcatcttcctcctctgacgactcggagccagatatcgactcatccaaatctccaaccgctttagcaaattgtgcctcgtctaatgtagggttgcctcgagattgcgctttgacgttgaatctatggtggtccgaccgaacgtgctcccgttgttcttgtacatttagaaaggagactttgcaaagtgcgcaagatgtggagttagcgatcaccgggtctagcgtcgacggatcaagcggttcactagagagttcgacagtgtcttcgacagctatgggttggtcttcgcccttggctgttaaagtcgaaagaagttcctga

SEQ ID NO: 20413 - DNA, 2895 bp, A.fumigatus
attgtgcttggcgccctgatcttcacgactgctctacaagccgcaatccaagccgagtccgctcctcgtctctttttggctgattttcgcttctggagttccattctggtgatcgcttctctcggtgttatatttgcggttcaatattatgaacactggcgcagcagacagccgaatggagttgtcctgttctactggctcttctttaccatcgcttatggtgtcaaattgcgatcgctggtctcgcaaaaggcgtatcaggatcaacttccgtactttgtttgcatcaacgtcagccttggtctggcgctgttggaattcggactcgaatacctggtgccgaaaaaacagagtgcgtacgatgccttgggtgacgaggatgaatgtccatacgagtatgcggatatctttgccgtcctcaccttcagctggatgacaccgttgatgaagtttggttacaagaactatcttactcaggatgatctgtggaatctgcggcagcgcgacaccacgcgcgtcacaggagccattctggaggaaaagtgggcggaagagctgagaaagtcgaagccttctctgtggctggcgttgatgaaatcgttcggtagcccttacctgcgcggcgcaatcatcaagtgtggaagcgatgtacttgcctttgttcagccgcaactcctgcgtcttctaataagattcataaagtcatatgggactgatgaacctcaacccgtgatcagtggtgtggccatcgcgctggcgatgttttcggtctcggtaacacagaccatttgtctgcaccaatacttccaaagggcgttcgatactggtatgcgcgtcaagtcagccttgactgccatgatctacaccaagtctctcagactttcgagcgaagggcgtgcatccaagaccacaggtgatattgtcaaccatatggctgtcgaccagcaacgcttgtctgacctgacccagttcggcatgcaactttggtccgctccttttcaaatcgttctttgcatgctgtccctctaccaattggtcggtttaagcatgtttgcaggtatcggggtgatgatcctcatgatcccgttgaacggtgtaattgcccgaatgatgaaaaagcttcagatcgtacagatgaagaacaaggattccagatcacgactgatgactgagatcctgaacaatatcaagagcataaagctttatgcttggaatacagcattcatgaacaaactcagccacattagaaacgacttggagctgaacactcttcgcaagatcggggcaactcagtcgattgctaactttacctggcagtccaccccgttcctagtctcgtgctctacattcactgtttatgtcttgataagtgatcatcctttgactacagatgtggtgttcccagccttgactctgttcaacctgctcacgttcccgctctcaatcctgcctatggttatcacgtccatcatcgaagcgtccgtggctgtgaggcgtctgacagactactttaccgcggaagaactacaaactgatgcggtcaccttcgaggagccagtgacccatgctggtgacgagtccgtccgtattcgcgatgcggcgtttacctggaacagataccaaggcgaaaatgtcattgagaacattgactttagcgctcgtaaaggggaactcagttgcattgttggtagagttggtgctggtaaatcttctttccttctgtcgatgctgggtgacctctggaagaccgaaggcgaggttgttgttcgaggccgtatcgcttatgtagcgcaacaaccatgggtgatgaatgccagcgtccgtgaaaatattgttttcgggcatcggtgggatcctcagttctatgaactcacagtcgaggcttgcgctctggttgatgacttccgcaatttgcccgatggagatcaaactgaggtcggtgagaggggtatctccctctcgggtggtcaaaaggctcgcttgacacttgcgcgggcggtatacgctcgtgcagatatctacttgctcgatgatgtgctttcagcggtcgatcagcacgtcggtcgtcacctcatcaacaaggtacttggtcggaatggtcttctcagcggcaagaccaggatcctggccaccaacgccattcctgtattaaaagaggccgactttattgccctcctaagaaataagaccttgatcgagaagggaacctacgaacagttgatggctatgaagggcgaggtgtccaatctcgtacgcgcaaccatgaacgaatcggaggacgaagcttccagcagtgacgaccatgatctggctagtcctgaaggctcggaaaccaccactgtccttgagaatgcggagtcagagccatcagatacggaagctgagcagcaaataggatcacttctccccctgagatccggcgctgacactacgcggcggagatccagcactgtcacgctacggcgtgccagtacggcgagctggcacggtgttcggcgtaagcttggggacgaagagaacgtcctgaagagtaagcagacgcaggaaacttcgcagcagggtaaagttaagtggagcgtttacggagaatatgccaagaacagcaatattatcgccgtctgcttctacctgctcacgcttctgggagcgcagacggcgcaggttgccggtaatttttggctaaagaagtggtctgacgccagcgaagtgcaggctcaaccgaaggtcgccaagttcattggtatttaccttgcttggggtctcgggtcttccatcttagttatccttcaaaatctgattctctggattttttgctcgattgaggtatggcctgaatcgtatcacaaggttaagaactacattaatacgacagcaggcttctcgcaaactgcatga

SEQ ID NO: 20414 - DNA, 231 bp, A.fumigatus
tcagcatgttttcaaactgtagcagacactatggcccaccctcatctcgactctctgcagcatatcaaagtgatcctccgatctgtgaccgtcacgccggtacaaaaggtggacactcggagacagtttcagagtatcaccatcactgaggagaaagctgccatttccctttcccatgggatagttgttccacgatgtgccgttcagcgagatatcttgagcatatactaa

SEQ ID NO: 20415 - DNA, 186 bp, A.fumigatus
ttctctggattttttgctcgattgaggtatggcctgaatcgtatcacaaggttaagaactacattaatacgacagcaggcttctcgcaaactgcatgaacgcatggcattctctattttccgctctcctatgagctttttcgagactactccatctggccggattctgaatcgattctccaggtag

SEQ ID NO: 20416 - DNA, 789 bp, A.fumigatus
ctgttcaataactcggcaaaggcgatctttacgatgattgtgattgctacgtcgactcctgccttcattttgatgattttccctctaggctatgtttacctgcggtaccagaagtactacctgcgaacctctcgtgaattgaagcggctggacagcgttactaggagcccgatctatgctcacttccaggagtcgctcggcggtatctccaccattcgcggctaccgacaggagaaccggtttgctcttgaaaatgaatggcgcatggatgcgaatcttcgcgcttactttccatccatcagtgccaacagatggttggctgttcgcttggaatttatcggttctgttattatcctggcttccgcggtgcttgccatcatctcagtcgccagtggcagtggcttatctgcgggcatggtcggtttggccatgtcctatgctttacaaatcactcagtccttgaactggatcgttcgacaaactgtcgaagtcgaaaccaacattgtgtctgttgagcgggttcttgagtacgcgaacctgcccagcgaggccccggatgttatcttcaagaaccgcccagctatcggatggcccgctcagggggcggtgacattcaaggactatagcacgcggtaccgtcctggacttgatctagtgctcaaggatatcaacctggacattaaacctcatgaaaaaataggcgttgttggccgtacaggtgcaggaaagagttcgttgactctggcgctcttccggatcatcgaagccgctggtggcagcatcaggtga

SEQ ID NO: 20417 - DNA, 237 bp, A.fumigatus
ctgcccgatctagttgtctttgcaatttctaacgtcttttttagtatcgatggccttgatatttctactattgggctatctgacttgcggggacgtctcgccattattccccaggatcctgccatgtttgagggcactcttcgtgacaatctggacccccggcatgtgcatgatgacacggagctatggagtgtccttggtacgttgggcctgactcgctgcatgcccaagcattga

SEQ ID NO: 20418 - DNA, 1887 bp, A.fumigatus
  unsure (1750): Identity of nucleotide sequences at the above locations are unknown.
ccctcattagtgtatgatcttcctcaggaacttctttcgactttaacagccaagggcgaagaccaacccatagctgtcgaagacactgtcgaactctctagtgaaccgcttgatccgtcgacgctagacccggtgatcgctaactccacatcttgcgcactttgcaaagtctcctttctaaatgtacaagaacaacgggagcacgttcggtcggaccaccatagattcaacgtcaaagcgcaatctcgaggcaaccctacattagacgaggcacaatttgctaaagcggttggagatttggatgagtcgatatctggctccgagtcgtcagaggaggaagatgataacgaagacgagcagctctcggccttgctgagaaggcaggccaggatatcccaggcagctgaggaggcggaggcatcagcaagcaagaagccggcttccaggagccctctttactggttttcaagctctctgttgccatccaacacatcactaggtgtctatagagctttgttctcaaacgacgaacaagatgagcctaagcacctcgttgattcgttgcgaaagaagcaactatcgccgctaccgacacaaagaccgaatgcacaaccacaaacgaacggaaccacgcccagtccgcatatcttcatgtgcatgataggaggtggccattttgctgccatgttggtctctctgactccccaaattcatcgcaaacaaggtggtgttgaggaacggcaggcctgcgtcatcgcccacaagtcatttcaccgctatacaacgagacggaagcaaggtggttctcaatctgctagtgacgccgctcgaggagcggcacattcggcaggttccagccttcgaaggtataacgaggctgctctggagaaggagatcagagagctcctgagagactggaaggagatgatcgatagtgcacaactgttattcatccgagcgactggcaataccaaccgaaagatcctgtttggtcagtatgagggtcaatttctaaaacagaatgatcccagaataagagggttcccattcagcactcgtcgagccacgcaagatgagcttatgaggtgcttcaaagaacttactcgcgtcaaagtaagtcagatcgatgaagcggcccttgcagcagtggtggcaaaacagagggcagaagcggtcaagcctccaacaccacggccacaacaaaagcccaaagtgtctaaggaggaggaggaagctatactgcatacatctcagatccaagccctaattcgaaggtccaaagtaccggcgttgatgtcttatctctccaaaaactctataccctcatctttctcattccgtccaccagattctccgcaaaatttccgctgtcctactcccttgcattttgcagcgaatttgaactccccatccgtagtttcagccctcctcacaaaggctgacgcagatccaacgatagccaacggcgaaggaagaactgctttcgaacttgccggtgacagagctacccgtgatgcattccgtgttgcacgtcacgaactgggggagtccaaatggaactgggacgctgccaaggtcccagcggcggtatccaaggaggaggttgatagtcgcgcaaaaagggagcggaaaattgcagaagaggaagaggcaaagaggcgcaagaccgaattagagcgactaaggaaggaggaagctgctaaagcagcctcactgcaagaaacgagaaaagtgggaggccgagcattangagcgatggaaaagacggcatctgaaaagagagaagaagaaatgaggggaatgacaccggagatgaggatgagactggagagagagcgtcgcgctagggcagcggaggaacgcattcgaaagatgcagggaaggtaa

SEQ ID NO: 20419 - DNA, 222 bp, A.fumigatus
caaactcataggaaaggtgcgctcttcagtggcgatgatcaagttaagacacaaatccgatttgagttaagctatcaaccaatattacctagacttaacacattattagatgaagtgaaagaactacttttagcagaggatctaatttcagataagtacatttcagtttcctcaactaaccctcatatctattactgtactaaattcctgtactcggattag

SEQ ID NO: 20420 - DNA, 396 bp, A.fumigatus
gttttcgaggatcagtacccgattacacagcgaaaattaggatccggggcgtatgggcaggtgcatatggcgttcaacaaagtgactggacagcagctcgcctgcaagatcgtcgacctccgaaccccgaaagatagggttattgaagattttgaaggtcagaaatccagattctttgggatggatacggaccgcattgttgcagcgcgcgcgcacaatgggtacatcgcaaggaaaatccacgagaaactcgaaatatatgaccgggaagccaggatcctggcaaggctctgccatgtaggtttgctcgaatctcatcagaacggcactaacggacaatcaaagccgaatattattagagtggaaaaggtgctccggtcaagcaatacgatgtga

SEQ ID NO: 20421 - DNA, 747 bp, A.fumigatus
aagaatccgctacaatcaggcattctcaagaactccagcggaaatgtccctcagacagctcacgcgacagagaatttcttcatcaacccagcacgcatggacaacgtcgatacgaaggaaattaccctgcagaacacacttcagaatgctggccggcgccggtcgtcatccaacatgggcgctgggtcgtcctctcgacgacaatccttggcgagcatccgcggccatgacgagcagatctctccgcgcttgaagtgggacgaagcgaacctgtacctgaccgagcaggagaaaacagccaagatgaagatcgacgagccgaagacaccgtttgctccgcactacgatcccgccgaggatgacgaggaactgcgactcgcagaagcagaggagagcctgatcgatgcgcaggacgtggtggtcgatgaactggacaagactaagaagggcactcggaaggggatctccgtagatgatattcccgacctggaactcggagagcccgaagagccgtcatacatggtgggcagcggagaggggaatcggatcatccgcgagcgcagtctgagcaacgagtcgcaccgcagcgacaaacatgttgtagtcggcacaggggaggagaacggtgtcggtgcggatggggatcatctcatgacgacagaagaggccaaagagaagcatcgccagtttgagcagatgcgcaaaaagcattatgagatgaggaatatcaagaaacttctggcgtaa

SEQ ID NO: 20422 - DNA, 219 bp, A.fumigatus
aaaggggtgtactatacgttactccatagctacctaacggagtacctatactctgttggtaaaaatagaacctataaggtggatgtagaaggactaacagaaggacgggataataataattcaggggatagggaagcatcctattcattattttttattttcaagacagacattattacgcagtctatgtactctgtagaagggaataggagtagatag

SEQ ID NO: 20423 - DNA, 3315 bp, A.fumigatus
ttttcatatcagaaaagatgccagagaaaagctccttggccaggttgcccttcgggcatattcgcaggtctttgctattctacgctcaatgtaagtcctaccatttttggactttctgatgaaaaaagagtgaattgttccaactcattgatcctccccgacaggcatcacttttcaatgactcgtcctgcggtccggcaacatgttgagaatatgcttcatcagttccagacaacggacaacgacaacatgcaatttgcccagcgctcacaacccaagagtcatcaagaatcaccatgcgcatttctcatgctttctgctacagacgtgctaaccctactgggcgccctgtttcccacagcgacatcccccgcatgtagctctcccactccctccgccgcatcatctgcgttgtctcccagctccttgcagtcgttccctgatagacgtaccaataccgtcccagaaccagggttctaccggggtaatctgagtggtggctcttctccacaactttcctcaacagcattcccctccgcagacattcacttctttacttgctcagaagatcacctgagtcgcaacgctgaccgtatccgttttgaattgtctgctttggtcgagcctgatggtcgtcccggtcttgcatacccctccacggaagaatgggccatcttctctgtcaccgatggcggccatcgcctagtctggggtctattcgccgatggccagctcagcgatgctgggaacttgtccgctgatacctgtccgtccaccactctaggcatggaggacaacttcgaggctctccacacagcgatcatcaagctcgtccgggaataccctaccggagatcgctcagactactgcggggagcggggccaaatggccccttcacagtcctcctcgctgcagagcagattcaaccaggtcatgtcacactgctaccataattctgattttatgggtgcccactattggtggaacgctagtcgtcagctccgtcgcagtatcgccgacgtaccctctcgccttggtgatgactcttggatcctggaacctatgcacacggcatgctcacgctcgctccgggtagctcactccgtgatcgagcgctgcgaagccgactttgtggcactggatcgaagtttgtggcaactgcagggaactgtgaaggagatggtcaaaaccatcacgaagttgcgaaacaagatgtggtacatgaccgacgtcaagaattcgatgcggtacgaggacgcaaggaatgtacccttggcactgaagacgatggtctactccgctcgtcttcatcaaccaatctctaccagcgaccgtcgaacgcgcagcagcccccgcgcattgggaggatccgttctgcaaaagccagagttgcaagtgatgaatgtcatgaaggcacccagcagccaaggcggcccgaataaattgtctgatgaacaagttgaattgactcggaaatggctagcacagaacaatatcgacaatttttgcaagggtgaagagcgtatccaccgcttctgctatgaggtcaaagttagtatcaaccgactcgtcggtgatacaatggccgaggcgcctgttctctgggccagtgaattgttccaaaaggagcgagtcaagttcgaaggctccagcaaccgaagcttccttggcctgtcttcgtcaagtttgcgcccaatgagcactgctggtgaagagttgtcgtttgcttcccaatcctctggcggcagtctccgctcgtccgattgcttctccatatacactcaatacctgccgccactaaatcgcaaatcctcctttcaaagctcgatttccgataagtggaggatgccccgagacccctctcctgctgatggactttcgattggagactcgccttccaaggcaacctccgaatcaacagctgacacatacagtacgttttggtctgtaccacatcagaatgcgccctatgcagcaagtgcgtcaagcttctactcccgcccgccgtcgatgctcagtgagaccgttgttcagccggctccccagaaggatttcaaaggtcaaggcaaagccgctttcctggacgaattaaaacaggctctgaccagtctacttctgagtgatctgggttcacccgtctggagctgtggaagcgagacagacgcctggtttggaaacgcattggaccaagagcgaatccgggtacaaatgaagaagcgagagaagatccagtgcttctatgcagagtgcaatgcacgcacagtccgccaaatacccagacactaccagtccaggggccgaagaagcaggtctctggggccgcccttgtcgggaagggctcaagagtcggatgatacaacctcagtgcccatgtctgagagcgctcgagcagctgaagatcaatctccattttcgtacggagttgttttccgccaattgatcgagatattttcgcgccacgggaacccgttcgtcaagctaaacgcattgcgggatttgagagcattggtcattgcatccttgaacgtggataatgataaggcctatgcacatgcggttcaggaacgtacgcactcgagggaactcggactccatggcaaacgagctgcacggcatagcttctcagaagtaggaaccctccgtggagccgagaagggcttcctacaaactccgacgtctccagcagccgagtctgttactttggactctcggccttcggaatactccgcacctacggagaaccaaattgtggacgcgctgcgtagccttctcttagaagtgaagcccaagactcttttccgagacctacaatttatttcagcattcgttcccagcgagacactcaataaaaccgacagtggaaccgcctttttgcaatttggcttggcagcgttaagtctcaaggaagaagtctgcaacagcatggttgagattgccgacaggattgtctctcaggaattgagccgacggcatgtgcctcaaccctttggcttcaacgcccgaccgagccacgctattgaggatgctgcagggatgtggatcatcaccgcaaaagaaggaaatcctgtcgcccagcgggagctggcgattctctatttaacccatccggagcttcttcctcgtgtcacgctcccacttacttcccccagagatacattcaaggctgagatgatgtaccgccgtgacaaggacagcaaatctgatccgcagagcatgtgcctggcgctgcactggatgcagctgtcagccaacggaggcgaccaactcgcgcggaacaggcttcgcgaacgagaggagtttgattccatcgcatga

SEQ ID NO: 20424 - DNA, 702 bp, A.fumigatus
ccttcctattatttcatgtcagtcaccatggccgaccaacagcccgaaaagactactgctcctgcttctgatgtcgcagactcgcagcctgccgtcgtttccaacactgacacccgcaaggagacaaccgagactgcggagccacaatcagaggacaagaccgcaaccacaaccgcgcaacctgccgttgaaaccactgccacccaatccggcaccgcagagactcccgctgaggccgacaaggctcccgccgaagtgcagcaaccgccccaggccgaagaggagaagcctgtcgctcagcagccggaacagccagcctatcttgccaaaaaccctgccctctcacagttcttcgagcgtctccctgccattgtctccagcagcggccatgcagaaatgtggggtgtccccctcaaggactcgaacgatgctcccactgtcaacgttctgatcaagttcctgcgcgcgaacgagggcaatgtcaagctggctgaggagcagcttaccaaggccttgaagtggcgcaaggagacgaacccctcagcgctcgctgagtcgaccagctacagcgcgaccaagtttggtggtctgggttatttgaccacctacaaggaagctaatggtgcggagactgttgtcacctggaatatctacggtggtgtcaaggatatcaacaccacttttggtgatatgaacgagtga

SEQ ID NO: 20425 - DNA, 612 bp, A.fumigatus
tcattgttttacacttgtaggtttgtcaagtggcgtgttgcgcttatggagctggcagtcaaggagctgaagatggcagaggcgacctctgtgattgactacgatggcgaggacccctaccagatgattcaggtccatgactaccagaatgtgagcttcctgcgcctgaatcctgccatcaaagcagctaccaagaagaccattgaagtcttcaccactgcttaccctgagctgctccgggagaagttcttcgtcaatgtccctgccatcatgggctggatgtttgccgctatgaaggtcttcctgagcaagaacaccactcgcaaattccaccccatctccaacggtgccaatctggctcgcgagttcccttctctgaaggaccaattccccaaggtctacggtggcagcgcccctgctcttcaggagggagcgagaaccgtcagcctcattcaggacgagtccgccccggccgccacggagcagtcaaaggagcaggccaacaaggaggaggccgctcaggaggagtccaagcctgagtcagctccagagcagccaaaggctgaccctgatgtcattgtccaggaagctcctgctgccgatgctaagtga

SEQ ID NO: 20426 - DNA, 183 bp, A.fumigatus
ttatctgcctatttcccatacgacggatcatcactgtcattgattgacagcttcaccctctttctggattcctgcatcacactagcacagcgcctctctgaccatcactcttcgtataaccgcgacaaaatccccaagcttcctcgcgtccaccgcttcgtcttactcgctgcctttgcatag

SEQ ID NO: 20427 - DNA, 1602 bp, A.fumigatus
catgcaaaagtctccccccttgttcagaccctcccgctaataatcgtcttttttcttttctactttgaggcgctgatttccgactttgatttaactaacatccctatttcagacctgttacccctatcatctcaggctactgcaacatgtaataccgcgagccgcgcgcaagattccccttcggtgcctcagccatctactgctccaactcccagcatgtcgcccatgctgttggttcccgacgacgggagcgttgatcgctcctccgtttcacaggttgatctgactataggtgagtctgaggactcgggccgttccagtgcgcaattcatagcagctcccatgcgctcggatagccgccaggcaatggatctaccaccaccaccaacaacaacacccacacttccatccatatcaacggagccccccaaggtctcatttgaggattttgcaatccgctaccgccaaaaccagcacaagcaagcgcgtcgcataacgctggaaaaccgtcttcatgccaccaagatatccattggtatctccacacgcttggttcgcgttggaggcgtcgtgcagcgcggtttagtcgaaagtctgaaacatgaagataaggcgaacttcctggctttgtatcataccttcttggatctccaggattcccatgacctggccatgcgtcaccacttctacaggcaggacccttcggaagactggtcatctgcgcaggaatctactgtggagcgttccccggattttttccttcagctcagccctcagtcaaggtccgatcttcttaggattttgcagttggtccggaccaaccctcagttcctttgtgatagattatgcagtttgacgtccgcgcagctgaatgccttattatccacgtcaaccacatctctggactctggtgatcacacattccttcctgcggcccgttcacggaaccagtattctctacctaaacgcgcttctgctgcatccgttcctttccgagatcatgctgtcaattttgagagaacagacgctatttccaacctggtcttcaatgtttttgctactcccttggactctgataccccagaggctcgcttgcgcttggatgtttggtcttctgtttgttctgaacttatcacccaaggaggcaataggttctatcccctcattggccacatcctctcatcctggaccatgggcagtgcctggcaagccagaccaaagttcgagctctacctcatggacatcctccagactggcgcgttcctcctggagcatatcgaaaccccagccggactgggttttgacgcggggtcccttgatccgttgaaaactgacgttgctgaggaatatttcgcctctgctgtagatgccctattcaaactccttgatgacccagacgcaagcttccctcatacagtgttcaagtttgctcgcgccattttgcagaaactgggttctccggacagtcgtgcccgttttctagagtatttgctcctccagtggttcttccctaaatttctctctggggcactggcttatcccgaggtctgttccagcccgtcttctaatgttatgatttctggacttggggaggggaactga

SEQ ID NO: 20428 - DNA, 621 bp, A.fumigatus
atagggaatttgtctcatctatatttaccatctcgtgacgctgcatgtgattcctgtttgtcttcctgcatcaatcttcggatttctctgtccttctctcccacccaccagcccaaaggctctcttcttgagcaagacattctgtcaatagtcattttagcacttcctgaccttcctattatttcatgtcagtcaccatggccgaccaacagcccgaaaagactactgctcctgcttctgatgtcgcagactcgcagcctgccgtcgtttccaacactgacacccgcaaggagacaaccgagactgcggagccacaatcagaggacaagaccgcaaccacaaccgcgcaacctgccgttgaaaccactgccacccaatccggcaccgcagagactcccgctgaggccgacaaggctcccgccgaagtgcagcaaccgccccaggccgaagaggagaagcctgtcgctcagcagccggaacagccagcctatcttgccaaaaaccctgccctctcacagttcttcgagcgtctccctgccattgtctccagcagcggccatgcagaaatgtggggtgtccccctcaaggactcgaacgatgctcccactgtcaacgttctga

SEQ ID NO: 20429 - DNA, 219 bp, A.fumigatus
cttttcagggaaaccattaagtggggattgtggtgcatcaaagatgctcgagatgttcctgagagctggccctttgaaccaattgagtttagtctctggattctatatgacaaggtgagcacaacctattcatacatgaatgatgtcttgcgtattactatttctgaggataattatatatataatattatcatgagcatcataatatttttgcaataa

SEQ ID NO: 20430 - DNA, 429 bp, A.fumigatus
ttcatcactagtaacatgatctgcgcagttgccggtatgactgcagacgccaatattctcatcaactatgcccgacaagccgctcaacgctacctcctcacttatggcgaagaaattccatgcgagcaacttgttcgtcgattgtgtgacctgaaacaaggatacacccagcacggtggtctccgtcccttcggtgtctcgttcatctacgcaggttacgatcctctgagagaattccaactgtaccagagcaaccccagcggaaactatggcggctggaatgccactagtgtacgagcaaataacgcgagcgcccaaagtctgctcaagcaagattacaaggaagactgcgatctgaaggaagcgtgtgcccatgccccgtcaggtcttaaggcaggacaatgggatccaacaaagcttgagccatga

SEQ ID NO: 20431 - DNA, 504 bp, A.fumigatus
atcattggacaatctacaaatctcagattttctctgaagcaagctgacggaaatctgcttacagcggaccaactcataggtaccggcggcggctctcgcaatgcgcagcttcagattacagatcctaaggtctgtcgctcgtacctggttggaacttgcccgcacgatctcttcaccaataccaagcaagatctgggtccttgtcccaaagtgcatagtgaaggactgaagacggagtacgagaccgcctcagcggccgagaaggcgaaatggggctttgagttcgactacatgcgcgatatgcagaaatatatcgacgattgtgatcgcaggattgactccgcccagcgacgattagagaaaactcccgatgagatcagacagacaaataaccttgtaagggcgaagcacttccatcgagctatcggtagaatattcgctgactctcacacagctgaaacaaatctccgacctcacaaagactatcaatactggtctccttga

SEQ ID NO: 20432 - DNA, 882 bp, A.fumigatus
caaaactttgttgatcttactgaagcactcccaggattttattgtactcactttcctcttgttagtctatccattggaatggcagatgttcgctcgttacttcgaagtgagcttgctgctcggaagggcgcaccgcaagcaggaactaccggtaatcgagttaccaagaagcggaaggtcgatatcacggatgacttgacgcggaaaaagattaagcctggcgaaaaaagtgcagatcccctatcaccgacagtacatactgtgcagccaccaagcgcccaggcgatcgatggagtggatgatgttgaacaaagagcacgagaaactgctagcctggaacttccaccggactcgaaagcttcgcaaaagcagacccaggcacaatctgagccgttgcttgaatcgaatactcctcaagcaattgatgaggacgaatgggcagcttttgagcgcgatgtggtggcgccaactcgtgtaccccaggcgcctgctgcagttgccgctgcagcgacgatatcggctgcacccatgtcggccgagcaattggctgcccagcaagaggcagagaagggaacatcgatacaagcacgtgaagctgagatcgaaggggaacgagaggacgccgctcggttcttggaggatgaatttgatgaaatggagcagcttgaagaacgaattaggcgattgaagcataagagagaggaattgagacggaaacgagccaaggaagcttcagagatccctcaggcagaaggatcgtccgggaaaacacagggggaacagcagattgatgagactagacagagcgacgaagaagagaacgatgatgatgacgacgatgatgcggatgacgatgattgggacaactggcgatttaggtaa

SEQ ID NO: 20433 - DNA, 420 bp, A.fumigatus
tcatcctcgtcctcgctgtcagtcacttcaacttcttcatactcatcgctgtcttccatcgcatgtgcggctgtaccaggatcctgtacgctaccaggctcctcggaagggcgaacttcgtccaatatttccctcctgttttctccggatttctcagcttcttcggagcgagccttctgttccctcttctctctttccaaacgatcatactccaccactcctttcattactgcgggaggaaatttccagaaactttcgttcgtttcagggttgtggacaaatcttctccccagtcttgtcttcacaagcacccacggctcgcacccgggtatcgcgtgtttcgacttcggcctatcctcgggccctcgattgttacggtcgcggaacccttttccacctcgaaatccacccctagaatga

SEQ ID NO: 20434 - DNA, 519 bp, A.fumigatus
gggcgaagcacttccatcgagctatcggtagaatattcgctgactctcacacagctgaaacaaatctccgacctcacaaagactatcaatactggtctccttgaagtttccgtcctcggtgaaactggtgccgtggcccaagcgcttaacgaactacacaagattcgtaccgccaaacaccaaaaagagacctgtgagcgcgaactcaagaatctccaagatacctccggtccatccggtcatcaaaagctgcaggtttgcgacgtctgcggagcctatctgagtcgtcttgataacgatcgccgcttggccgatcacttcttcggcaagatgcacatgggttattcagacatgcgcaagacgtacaaaaagctcagcgaagagctcaaggggcgcccacctcctgtccgccaccatgatgacgacgaaggcggttggggtggccgctcaggtggtggacgaggcccacgttacggtggtggtggtggcggatacaggaaacgaggcggacggtggtga

SEQ ID NO: 20435 - DNA, 243 bp, A.fumigatus
aagcttctccaagatccccacaacctaacaaccacgctttctaacaaaactttgttgatcttactgaagcactcccaggattttattgtactcactttcctcttgttagtctatccattggaatggcagatgttcgctcgttacttcgaagtgagcttgctgctcggaagggcgcaccgcaagcaggaactaccggtaatcgagttaccaagaagcggaaggtcgatatcacggatgacttga

SEQ ID NO: 20436 - DNA, 249 bp, A.fumigatus
acaaccatcttctcccccgaaggtcgactttatcaagttgagtatgcgctcgaagctatttcacatgctggtacagctctagggatcttggcgaaggatggaatcgtccttgctgcggagaaaaaggtgaccagcaagctgctagagcaggacacatctgcagagaagctctacacactgaacgagtacgcttttcccaacggagagaagcttctcatatcctttactccgttactgattcatcactag

SEQ ID NO: 20437 - DNA, 1785 bp, A.fumigatus
  unsure (306): Identity of nucleotide sequences at the above locations are unknown.
tggtcagaatgctcaaatctacctacactccccctcctccattaccaccggggtggacagaacatagagctccttcaggttagtttccttactgcaatctttagagctcaagtcactgactatgagacaggacatctctattattacaacgcagagacgaagcagtctacatacacaagaccgcagccgcttcctgttcaatcgcaacccgccgcgcccacccaaattccttttgtcactccagacactcttccccctttctcttccacaccgtatgcgcctgaaggattttccttcagcgaccangcccgtgggcttcctcatcatggtcattctaggggtggatttcgaggtggaaaagggttccgcgaccgtaacaatcgagggcccgaggataggccgaagtcgaaacacgcgatacccgggtgcgagccgtgggtgcttgtgaagacaagactggggagaagatttgtccacaaccctgaaacgaacgaaagtttctggaaatttcctcccgcagtaatgaaaggagtggtggagtatgatcgtttggaaagagagaagagggaacagaaggctcgctccgaagaagctgagaaatccggagaaaacaggagggaaatattggacgaagttcgcccttccgaggagcctggtagcgtacaggatcctggtacagccgcacatgcgatggaagacagcgatgagtatgaagaagttgaagtgactgacagcgaggacgaggatgatcaaccctcgaaacggccgaagaccgaagacaccaacgaccaacagcaacccttagaattcacagaggaagatatcgagtatcagcttgcagcaatgggagaagaatacggtttggatccgggagaatacggtgaacctggtcaggaaggctgggaggagggcgcagaagggttgccacttactgaggaagatgctacagcgcttttccgtgacctcctcgatgactatcacataaatccctattttacgtgggagaaaatcatcgaagaaggccgcataatagaggacagccgctatactgttttgccgaacatgaaggcacgccgagaggcctggtctagttggagccgtgatcgcatacagcagctaaaagaacagaaagagaagcaggaaaagaaggatcctcgtatccgctatctcgctttcctccaggagcacgcgactcccaagctatactggcctgaattcaaacgcaagtacaggaaagagcccgagatgaaggattcgcaactatcagacaaagaccgtgagaaactctatcgagacctggcctcgcgattaaagctacctgaaagtacccgaaagtctgatttctcggctttgctgaaatcagtaccattacaagagctaaaccgatcatccaatctagaagctcttccttcatcaattatcaccgacctgagatatatctcattgcctccaaaagtgcgcgacccattacttgaggcctatatctctaccttgccaccggcgccagagcaagatatgactgcagatcagcttgaggcactaaacaggaatagactggagcgtgagaagcgcgaaagggctctagctgaacgcgagaaacgagttcaggaggaaaaaagaaaacaacaaagcgatcttgtccgcgggaggcacctcctcagagaaggtgaggcggagatccaggaagccatgagagttagaaaggaaggtatcaggagctacttggaagccgaaaaccaagactcagtgaaagtatctcaggagaagagccctgaagcttcttga

SEQ ID NO: 20438 - DNA, 426 bp, A.fumigatus
tcccggagcaatctcacacgagcttgggcccctcgggatgaaccggtcttgagtgcggaacgcacgattgttggccatggccaagaacgaggcggcatgcgtattatttttggcaacccatcggatgcgcatcctgtcgacttcatctattttgagactctgccctggttcttgcggccctatgtccacacattacgcgcgacgatcacagggcgcaacggaaccactagatcggttcccgtctcgcacattgtgaaagagacattttacagaccggccatcgatagagaaagaggaacacagttggaacttgcactctctgtgcctgctgcttccatcgtcactctcacctatgacttcgagaagccaattctacgtcttctaccacaggggggccgaggcatccgcgcaatgctaatgcggaag

SEQ ID NO: 20439 - DNA, 2724 bp, A.fumigatus
ctactgagatcagaagaaccgcgacgctctggacgctctacgaaaggtcaacacaaaaacctagatatggtaaccgagacacctgcgaagaaatcgaaagcgaaagctcaatcgaaggataaatctgagaagcccccgaaaccctccgtcgagccgacacctgccgtcagtgaagaagaagaaattattcgatgtatttgcggagaatatgaagaggaggaagacattgaacgagatatgatctgctgtgaccagtgctccgcctggcaacacaatgactgcatgggcctcacatttgcgaaaggcgaggagcccgatgaatacttctgtgaactatgccgacctgagaatcataaagttctcttggacaagattgcgcgcggtgagaagccttgggaggaagcagccgagaagcgacgccagcaggcagaagaaaagaaggccgcacgtcgcaggaaaggcaggaaaggtggtagaaagggccggccaagcgagcccaaaccggatacaggcaccccagcccgcaataaagcggcttctgccacgcccgctcagactcctgttccactggcccctccgcccgttgtgaccccggtcccggagaagaacggtgacgtttcagacgcccacccatcgagcactcagaagaggaaattcgaggtacatcaagaggctccggcctccgatacggtaagacttgactattactgtttgaaaatagggacagctgctcatgtctaccagcagggaccaaaaccgaagcaaataaagatgacctcaccagctgattcagtgactcctctcaacgacaagcctgctcaggcgaaggaagattcgactgctcctccttcgcgccaaagctccgtttctgaaaagactacgacgcaggaatcgggcactttggacgagatctcaaacccagcaagaagaagtgctgccagtgctctagtcaagttatttgtagatcaaatttctgatgcacagaagcaagggtctttcaaattacctgagggaaggtcggcgaaagagatagcgcagcagctcggtttttcaatcgagaaggctatgtatcagaatatttgcggaggatctggggaacccactgaaccatataaattacaactgcggacgatcttgttcaacgtaaagaagaatccttctctacgggatcgcctgctcgtaggtagtttgcttccagatgcgctctctaagatgagcagtcaggatatggcaagtgaggagcttctgcagaaggatgccgaaatcaggcgcgaggccgagaggcagcatattattgtggaggagcaaggtccgcgaataaggcgaactcataaaggcgaagagttcattgaagatgagaatcaaaccgtcgccagcgagccagtgttttcggtagtgccgacacgccgaagtttggctgatgttgacgcaagcccttcaaatcaaagtccagcgagtccccaggctcatcagcagccggatgacagtgcgccaagggctgccaaaccgctgcctatcgacaccaaagcgaaggataccaaggcccgaaatgggcctacggtgcattctcccggcgccgctgatcatgaccaagtctttccagaggtctcaactcacatacatgaaatgttgccgactgggaaggcccaggctgatgcagagattgacaagctattgaaagacgtcgaacccgaatcgcctccatattccccaaaagacttcaacgacgaggcgattatctggcgcgggaaggttgtcatgaacccggtggctgaattctcgtctttagcaaagcatgttggaggagctgaactaagtgacaagataccgtggagtcagcttgcaccgtcgaccttggtggtcgacgggcgaatcgacattcagctagcgagcaattatctctgtggtttgcgtttcagttcctcgacggacgtttcagtcatctccattagtcgcccagaatcccccaaagatcaaaaagggttcgacaagctcttcaactatttccaagaccgaaagcgatatggtgttgttggaaaacatccgttgccggccgtcaaggatacctacgttattcccatcgaagctggatccacaaagaagcccgaatttattgagcttttggaaaacaatacacttgaagaccctactccagagcgagtactattggtggtctttgcagtcaaaaccggcgaatcgaatcctccttcagtacagctatcatcacatcatccaagtcaagagcctgcgtcttttgcaagccctgtcaccgtcgcagcgactccccagcaacagcagtttctgacacctggaccgaggcagatgtcgcagatgtctcccaccactccgccatctgctatctcgggcataattccgaccctcaattcatttgcttcccagcctccacaatccctgcaaccgcagcagccgcagttaccaacccaaccggcctctcagtcccaagggtatcaacctccacagccacatagtcagatggctgtcactggtatggccgccgcagtgaaggtacttggtgctcaggcaaatgctccagcaatccagcaactcctccagcaggctccgaatgctgatgtctcccaactgggtgttgtccatggcatcatctcacgacagccagaggcggcttcaaattacgagatgttaatgcaggcgttgtatcaagctacaacgaatggacatggtccacagcaaaacgccagctag

SEQ ID NO: 20440 - DNA, 192 bp, A.fumigatus
ataacccatgtgcatcttgccgaagaagtgatcggccaagcggcgatcgttatcaagacgactcagataggctccgcagacgtcgcaaacctgcagcttttgatgaccggatggaccggaggtatcttggagattcttgagttcgcgctcacaggtctctttttggtgtttggcggtacgaatcttgtgtag

SEQ ID NO: 20441 - DNA, 432 bp, A.fumigatus
  unsure (271): Identity of nucleotide sequences at the above locations are unknown.
gaaaggtcaagatcataccgcaatagaaactcgaagcttttagattgcaagaatgacgtgatggttgtccgctcctttttccccctactgtcccttctgatcgcgttggcgaccttcacatccgcctcatcggactaccatgaagctttcgtcctgcagccgcttcctcaatcctccctgctagcgtcattcaatttcaggggcaacacttctcaagaagcctttaatcagcggcattttcgctacttccctcgtgctcttggccaaatcntacaacacacccacaccaaggagctacatattcggttcacaacagggagatgggatgctgaaagctggggtacacgtccctggaacgggacgaaggaaggaaatacaggtgtagagctatgggcatggattgatgcgccggacagtgaaaggtgggtttag

SEQ ID NO: 20442 - DNA, 423 bp, A.fumigatus
ttttcgtccagcgcatttgcccgatggatatccttgacccagtcactgtctggtctgttctgcgcatcgctgaatttcattgattcgactcgaacgactcgaccggttgtatcatttgagcctaccgggaatcattacccttccagtgacctgcatctgctgcatggaacgcttcctggagaagttgtctgtacggagaacctgacgccctttctgaaattacttccctgcaagggcaacgctggtgtttctagtctgctggatggacacaaactatttgatgcttcctggcagagcatgtctgttgatgtgcgtcccgtctgccctcaaggcgggaagtgtcttatgcaaatcgaacaaacagtagacattgtgttagacattgagcgctccaaacggcctcgaggtgagttgtcaaagtaa

SEQ ID NO: 20443 - DNA, 951 bp, A.fumigatus
ttaattttgcttcggcaattggtccgatacctgcacgatctgcatgacggcccagcgatgaattgcccttcacgaaccgacgacactctaaagcatccgggctggaaccagaatcctcccgcgttgaatgcagatatgactactcgaaatgatctcaacggcattgccaactccaaagtacaccggaggcatgcatcagggatgggaggagtctcaggagaaggcattatggagacagactctcagtcacacaatcaagactgtaccgaatccgagatcgtggagacgaagacactaggcggagtgattgctgctgcctccgggtacgaaaatccccaaagtcacagggaatcgccccgccgttacacaaatttgactacaataatcacctcccatattatccacgtcaggcagagtcttgccaagttcgctcgcttcgtgggccccgggttcttgattgctgttgcttacattgatcctggaaattatgccaccgacgtggctgctggtgcagagttccgatatgcgctgcttttcattgtcctgctgtccaatctcttcgccattttcttgcagtctctgtgtatcaagcttggaagtgtgaccggcctcaacctggcggagaactgtagggaacatcttcctaaatggttggtatacattctgtacttcttgtcagaagccgccattgttgcgactgacattgccgaagtatggcctgcctactcgactgtactttcattccctttccgagccctgactgaccttacgtctaggtcgtgggttcagctattgctctcaacctccttcttaaaatcccgctggttgctggatgtgccatcacgctcgccgatgttctcttccttctcattttctatagacccaacggatccatctgggggctgcgactttttgaatactttgttatggcattggtcctgggggtggtag

SEQ ID NO: 20444 - DNA, 894 bp, A.fumigatus
tacagtccaaagggtgagtggattcccgtgcaagctatgttaaggcctatggtactgactgaagctattttccaatccagtttataccagagctgcggtatcctcggcgctacggtcatgcctcactcaatatttcttggcagtggtgtcgtccagccgcgattgaaggagttcgatgtcaccaagggatatgtggacccggccgtctgtcttggaagcactgacgggaaagtcgagtataggccgtccattcacgccatccgaggttgcatgaagtactcgatcattgagttatcgctgtcgcttttcacctttgctctttttgtaaacagttccatcttgatcgttgctggtgcctcgttatacgggagctccggcgctgacaatgctgacctttggggaattcacgacttactatccagctccatagccccggttgccggcttgatctttgcgctggcactgctcctgtcgggcatttccgcgggaattgtgtgcactatggcaggtcaaatggtgagcgaggggatgctgaaatggacgatcaggccctggcttcgcagactcattactcgatccatcagtatcattcccagtatcattatcgcagcagctgtgggaaaggatgggttagacaaaacccttaccgccagtcaagtagtactgagcgtaattctacccttcgtgacggcaccgttgatctatttcacttgccgcaaccgttatatgaccgtgccagctgatcgcgttggcggagaggaggcggacaatctgtccgaaggagtcaagatgcgaaataattttctggtttctgcgctagccctcctgatctggttggtgatcgcggtgatgaacgtggcgttgctggttcttgtcggattgggcaaggcctga

SEQ ID NO: 20445 - DNA, 1431 bp, A.fumigatus
cacccatcacagtggctgaaaacacagaacctgattcctattcttttgtcattcttaacacctgaacatccagcctccgtacaaacctctgcaggagactttctcaaggccattatcactatttcggcaaatgccactcagaacgaccaatcctgcattggacccaatagcctgactcgccagcttgtctccgcgcagtgcgtagagaccctaatcacagccatgttgcaaggtggaaatccgttgacagtgggcgttggtatcgtaattgaagttattcggaaaaataactcggattacgatccagagaccatcggtggccctgattcgcctcctacgacatacgaccctatctatctgggcaacctgcttaggatttttgccaaacatataccggacttcatggcattgattcgaagttccaagcatacaatcagtgacaatgggaaagtacgaagtgtggagagaggacagcttagctctgcttggggcgctaaaattgagcctctcggctttgaccgtttcaagacatgcgaattgatggcagagctgctgcactgcagtaacatgggtcttctgaacgaacccggaagtgatgaatatgtccgccaacgcgacgctgaacgagagagactgttccgcgaaggtgccttcaatccgcacaaggagttgtctgctcttgaaggaaacgattccaccacagactttatcaatggttctgttattgactgtggctcccctgaagattctcgagtcattgaaattttgaacgctggtgaggatgggttcgaggatgtcgattcttctggcgtcctggtcgacaaggagaaactcgccgagagaaaggagtctgatagtcagcagacggagccggttgtgggtgataaatcgagaacatcagccacaacggaagacgacgtaaaacatgccggcgaagctaacgatcatgaggaagctaaaatggacacaaaagaagaagacagctccgacaaggatctcccgtccacagtgtctgacctaacagaccaactttatgcaatggatttgggagaccaatgggcctccaagggagccacggcccaggaagatatcgggaagtctgagactctcccctcgaacgactcgaatactccctctgctacacaaatgccgtccaaccctgaagccgtaccagaacctctgttctccaaaactcaacagcaaaaggaaccagtaacgtcaacaccggatcctgctgaccaggccgggaatgctcaagattccacggaccatggatcaacatcggtgccctcaaacaccgatgctgaagacttgcgggcgcacatcaattcctacgttcaactcgatccgaacggccagcctgtcgtcggtgattatctcaaaattatgtttgtgaagaatcaggtcgtacccacgatactagtaagttag

SEQ ID NO: 20446 - DNA, 213 bp, A.fumigatus
ctgggtacgcttctcctttgcggccaccaaggacattctgtggccatgcactcgttttgcggggttatactggaccttgaggctaatatgttgtgcttaacttcgctgcagctgatttccgagatcaaggcctctggtctgcgtggccgtggtggtgctggtttcccctcgggtttgaaatatgtaagttttccaccatgcgaaatacggtga

SEQ ID NO: 20447 - DNA, 861 bp, A.fumigatus
tctttcatgaacttcaaggattgggataaggatcccagaccccgatacctggtcgtcaacgccgatgaaggtgaaccgggcacatgcaaagaccgtgagatcatgcgcaaggatccccacaaactgatcgagggttgcctcgttgtcggtcgtgcgatgaacgccaccgccgcctacatttacatccgtggtgaattctaccacgaagcaaccgtcctccagcgggccatcaacgaagcctaccaggctggtctcatcggtaagaacgcctgcggcacaggctacgacttcgatgtttacatccaccgcggaatgggtgcctatatctgtggtgaggagacctctctcatcgagtcgatcgagggcaaggccggcaagcctcgcctgaagccccccttccccgccgccgttggtctgttcggctgccccagcaccgtcaccaatgttgagaccgtcgccgtctgccctaccatcatgcgccgtggagccagctggttctcctcgttcggcgccgagcgcaactctggtacaaagctgttctgtatttccggtcacgtcaacaatccctgcacggtcgaggaggagatgtccatccctctgcgtgagctgatcgaccgtcactgcggtggtgtgcgtggcggctgggacaacctcctcgccgtcatccccggtggctcctccactcccgtcatccccaagtccgtctgcgataaccagatcatggatttcgactccctcaaggactcccaatccggtctggggactgccgccgttatcgtcatggacaagtccaccgacatcgtccgcgccatctcccgtctgtccaagttctacaagcatgagagttgcggccaggtcttc

SEQ ID NO: 20448 - DNA, 753 bp, A.fumigatus
ttcatgatgttttggcgcttcgggggatacgcgagtgtctccactattgataccctgctcgacaagcctgatgtcagtctcgaagagttgttggacgagtcagagttgatccaggagctcaagcaacataatacgaaactcatagaatatctacgagaagataatgtcttgaaacgccttatggactacgtgattgcacccagcctggtgaacgaggatgatgatgatgacgaggacgattcgaacgactctaatgcccctcaaacgaatcaagatgcttcaaccggaggagagaagaaagtcgaccctctgaaggagatcttagatcctgaagatctggaccgagctgagaagaaccgtttgaaacatgcgtacatcgcgtgcgaaattctctcgtctgaaacatggtcgatattggagtcaataatggcgaacagaagctatctgcgcgacttctggggctttgtgaggagacgaccatctctggatcctatccaggcaggctactttacgaaagtcaatgaaacgttgtttgatcgaaagaccagtgagatgctggagtttttcaagtctctagagggtatagttccggcgatcctccagcatgtcgacaatcccatggttatggacctcttgttgaaaattatcagtctggagaaggccgaaggaggccagggaattgtggatgtgtgttcatcagaaaataatcccctgctttctatggtccagactgacacccatcacagtggctga

SEQ ID NO: 20449 - DNA, 720 bp, A.fumigatus
gatttcttcttccgcttcccatggaacaacttccttcacaacgttgtgtatgatgttgttcagcaagttttcaatggacctatggagcgcggatacaacagatgtctagcgatcgatctttttgagacagggcgcatcacacaggcgattgttgccggacaaaaacgaagcgatgaagcgcagcggacgcaacgcatcagactcggctacatggggcatcttaccctcattgcggaagaagtggtcaagttcagcgagcgtcatccgcccgaactactttctcctacggtgatggaaagcgtcttgaacccggagtggatcgattatgtggagcaaactctttccgagacgcgagagcgagataatgcaatcctcggcggtgtacgaccagatatggctatcgggcaccgccagggcctgctgaatcaaggtcaaagcatgaacacttcttcagcactcgccgaggctggcttgaatggcggcatcagcaattcaggcttccaaaacttcgacatgaaccagggcagtgtttctggtggcgcttttggtcttggtagcggcagcagctctctgctgagcggctttggaagctccagcgacgatgaggatgaggaaatggacgaacaagacgacaaaaacctaaccgagcaatccgccgaaggcggttctgaaaacgtgagtgatgatttatttactgacgttgacatggacgatgcatga

SEQ ID NO: 20450 - DNA, 273 bp, A.fumigatus
gtcactcagttgtctggacactgttctagcccggatgacttgactcatgcagaccctcttgcgccccgcattttcatagttgactctatctcttttgctgtaacacaagccacagcacatgctgacgtctttatgaacttagggatctacgaactcaacgagtcaacctataccaattcttcctccacctcctgctcccctcagcctcggaccatctcgcgcacgacggcaactggcagcacggcttgccgctcagaaacagcaagctgctga

SEQ ID NO: 20451 - DNA, 459 bp, A.fumigatus
agctcaacgacggtgatcatcccccaattgaccttccacctctctcctcgagacaatccctctatcccgcgtcaattcccagcaactgggccatccaccaccatgatatctcgagcggcggctccatcgccttcctcaatcgccaacctttcctcccgctctctccgcattcagggttcggctgcccgctccttcgccagtgtccaggacaccacacaccccgtacggcaacatggcggtctgcgggaccaggaccggatattcacaaacctttacggacatcacggcactgatttgaagtcggcaatgaagtttggagactggcacaggactaaggatatcgttttgaagggtcatgactgggtacgcttctcctttgcggccaccaaggacattctgtggccatgcactcgttttgcggggttatactggaccttgaggctaatatgttgtgcttaa

SEQ ID NO: 20452 - DNA, 222 bp, A.fumigatus
agccccccttccccgccgccgttggtctgttcggctgccccagcaccgtcaccaatgttgagaccgtcgccgtctgccctaccatcatgcgccgtggagccagctggttctcctcgttcggcgccgagcgcaactctggtacaaagctgttctgtatttccggtcacgtcaacaatccctgcacggtcgaggaggagatgtccatccctctgcgtgagctga

SEQ ID NO: 20453 - DNA, 276 bp, A.fumigatus
gtcgtgggttcagctattgctctcaacctccttcttaaaatcccgctggttgctggatgtgccatcacgctcgccgatgttctcttccttctcattttctatagacccaacggatccatctgggggctgcgactttttgaatactttgttatggcattggtcctgggggtggtagtatgcttctgtatacagctttctcttatcagggaacaatccgttcgcgatgtgtttagaggctatttaccatcttctgccatagtacagtccaaagggtga

SEQ ID NO: 20454 - DNA, 519 bp, A.fumigatus
cccagaccaccagcaggctccttgaccttggcttgttccggaggctcatcgataaattgcggcggcgccacctcatcttgcatgaagctaggcaaggaactctcgcccatcgcactctcaaacatggactcctcacccaacgcctccaactccgcatcgagctccgcctcatccacatcctcggggatatcatacgctcgcgaaatactctcctggatttcattgccaatatccatcagatccgccatctcgtcctgcatgcgctcgatcttgtctatgtcgaccttgccatactgcttcttcagctccttggtcgtcgtcttcatcgcgtcaacggtcgtcatcacgttcttcaagttatcctgcatcatccctgcctgttccatgttccaggattgctgggatagctggtcccgttgggcttcgtactgtttccggcgctgcaggaccttgagtgccttctggcgaagcgcgttcttgcctggtccgtcgcgcatcttggcaattttggcttggtag

SEQ ID NO: 20455 - DNA, 237 bp, A.fumigatus
ccagtgtcaattatcgcaagcgcgacattatcggcgtttcttttctctgtgtttgttgatagtctgcagtcttccgtctctcctctttactggactttgtacgataactcagccgaaatcaattcattgttattttttttttttttttttttttttttttttttttttttttttgcgcggagtatattgtcaaaatttgacattccacgattgacggctttaggactaaagagctaa

SEQ ID NO: 20456 - DNA, 303 bp, A.fumigatus
tgtgttaacaaaaccaacgatagggacctctacctctggtcttcatccatactggtgtcgcgggcgttttcagctaaggtgcttgctgagccagttactgatgtggaactgcctgaagatggtgtgtcagtactcctgccctgcattgacttgatgaaccatcgacctcttgcaaaggtagaatggcgtgctgggaagcaagatgtagcctttgtggtgctggaagacgttgcctccgggcaggaaatctcaaataattacgggcctcgcaataacgaacagtgtaagtcgcaagtggaatga

SEQ ID NO: 20457 - DNA, 882 bp, A.fumigatus
gaagacctggccgcaactctcatgcttgtagaacttggacagacgggagatggcgcggacgatgtcggtggacttgtccatgacgataacggcggcagtccccagaccggattgggagtccttgagggagtcgaaatccatgatctggttatcgcagacggacttggggatgacgggagtggaggagccaccggggatgacggcgaggaggttgtcccagccgccacgcacaccaccgcagtgacggtcgatcagctcacgcagagggatggacatctcctcctcgaccgtgcagggattgttgacgtgaccggaaatacagaacagctttgtaccagagttgcgctcggcgccgaacgaggagaaccagctggctccacggcgcatgatggtagggcagacggcgacggtctcaacattggtgacggtgctggggcagccgaacagaccaacggcggcggggaaggggggcttcaggcgaggcttgccggccttgccctcgatcgactcgatgagagaggtctcctcaccacagatataggcacccattccgcggtggatgtaaacatcgaagtcgtagcctgtgccgcaggcgttcttaccgatgagaccagcctggtaggcttcgttgatggcccgctggaggacggttgcttcgtggtagaattcaccacggatgtaaatgtaggcggcggtggcgttcatcgcacgaccgacaacgaggcaaccctcgatcagtttgtggggatccttgcgcatgatctcacggtctttgcatgtgcccggttcaccttcatcggcgttgacgaccaggtatcggggtctgggatccttatcccaatccttgaagttcatgaaagactaatgcagataagagattaa

SEQ ID NO: 20458 - DNA, 231 bp, A.fumigatus
atagcctctaaacacatcgcgaacggattgttccctgataagagaaagctgtatacagaagcatactaccacccccaggaccaatgccataacaaagtattcaaaaagtcgcagcccccagatggatccgttgggtctatagaaaatgagaaggaagagaacatcggcgagcgtgatggcacatccagcaaccagcgggattttaagaaggaggttgagagcaatagctga

SEQ ID NO: 20459 - DNA, 183 bp, A.fumigatus
cctggggcatcttcccgcatctttaggcggcaacatctggtgctgatcccccatccctacatcactccgcactgtactcactaccctatctcgtacttgacacacaccctcaagaaagatgaatcgactatttggaacaaaaaacacggctcccaagccaacgctcgacgatgctatttctaa

SEQ ID NO: 20460 - DNA, 603 bp, A.fumigatus
caccccgccatcacaaaggtagacaaccgcatcgcgagcatcgacgttaaactagcctctctcaacgccgagctctcaacctaccaagccaaaattgccaagatgcgcgacggaccaggcaagaacgcgcttcgccagaaggcactcaaggtcctgcagcgccggaaacagtacgaagcccaacgggaccagctatcccagcaatcctggaacatggaacaggcagggatgatgcaggataacttgaagaacgtgatgacgaccgttgacgcgatgaagacgacgaccaaggagctgaagaagcagtatggcaaggtcgacatagacaagatcgagcgcatgcaggacgagatggcggatctgatggatattggcaatgaaatccaggagagtatttcgcgagcgtatgatatccccgaggatgtggatgaggcggagctcgatgcggagttggaggcgttgggtgaggagtccatgtttgagagtgcgatgggcgagagttccttgcctagcttcatgcaagatgaggtggcgccgccgcaatttatcgatgagcctccggaacaagccaaggtcaaggagcctgctggtggtctgggctaa

SEQ ID NO: 20461 - DNA, 801 bp, A.fumigatus
ctcgatacaatcaaactcagtgaaatcaacgctggacgatgcccaaagctactacatcaattgacagtctgcagcactgattcgggacgagtgcttatcaaattggagatgaatcatgctatcatagatggcggatcagttgacctgcttttgagggacctagcaatggcgtacaagcatcagctgccagaaggatccggtccgcacttcagtgactacatcaaattcgtccgcgggaaatctcaaagccaagctttatctcactggagacaatacttgtccgatgcacatccctgccatctcacgttctccgaaggaacaggtggtagtcgtcaattaggatcagtgatggtgccgttcagccggtattctgagctgcaacaattctgcgagaagaactccgtgacactcgcaaatcttactcttgctgcatgggcgatcgtcttgcaaagctttacgggctcgaatgatgtttgctttggttacccttctgctggtcgtgacgccccagttcccgggattcaagacgcagtcggaatattcctcaacatgctctgctgccgagtcagggttctcaccaggggaagactctgttggaggtttcaaagacagtgcaagatgactatatcaagaaccttccataccaggattgttccctcgcaagtattcagcatgaacttgggcaaaaggagctgtttaacacgacaatctcgattcaaaaccaccacgctgtctcagaagaatctggaaatgacttgctctcttttgatgtacagacggcgcatgacccgacagaggtaa

SEQ ID NO: 20462 - DNA, 2031 bp, A.fumigatus
  unsure (161): Identity of nucleotide sequences at the above locations are unknown.
agatgttcagcgttgcgcgcgaagaccgggctaacactgaccatggccgatgttatcaaaattcctgtcttagaggacatgctggcggccatcagtgcttcccacagttcgtctgttttggaacctgactttccggccgacagcaacaatgagagacttgntgaacttcctaggttggttgagttagagcggaacccacccccaccggagatttcactcttgaaaaccgttcctttgaacgacagtgctctgcaagatggaatttgcccgaagattggcgtgtttaaaggaggaattgccgatgttttgcctgttacggacttccaagccatgtcgataacggctacattgttcaagtcccgctggatgttgaactacttctttttcgacggacgaggatctctggatctgagaaggttgagagagagcctcttgcgcgttgtcgatgctttcgacattcttcgaacagtctttgtctgtttcaatggccaatttttccaagtggtgctcagaaagatacggccaaacatctttgttcatgaaactgagaagaacttggatgagtatactgagtacctacaacagcaagatcgcgagcaggaggcgcggcaaggcgaacagtatgtgaagttctacatcgtgaagaagaagggcagcaaccaccaccggatcttgattagaatgtcgcacgctcaattcgacggactatgcctgcctaccatcatgtcagccattaaattgggatacgagggcagtactctgccccctgctccttcctttgcgaactacatgcgcatgctctcgggagcaatcactccagaccactatcagcattggacaaacctgttgaagggatcgaaaatgacgcaggtaattcgaaggaccgaggagaatacctatcgttatattggtgcttttagagagcaaagaaagacactggagatccagccctcggtcctggaaaatgtcaccattgctaccgtcatgcaagcagcatgggcggttacgctggccaagctgtccgctcagtcagatgttgtcttcggtctcacgatcagcggcagaaatacttcaatcccaggcattgaaaacactgtcggtccatgcctgaatgtgattccgattcgagtcacatttaaagagggctggactggagttgatctgttccgctacctacaagatcagcagatagccaatatgcccttcgaggccttgggtttcacggagatcatcagacgctgtactgactggcccagttcgacatactttaccacctcggtgttccaccagaatgtcgagtacgagggccagatgcagttagacaacactacatacagaatgggaggcgcgggtgtcgtcgacaacttcactgacatgacattgttctccaagtcatccagcgacggcaaactgggcgtctctctgggctattcagacaaaggccccatcggccccaaatttgctgccaaggtcctaagcatggtctgcgacaccgtgcaaagcctgttggccaactcgcgtgttgggcttccctccccatctatgctgcgctcattaccttgtcaatccgtccacgacgtccccggaatgaccgatgagatgtttttgtccacacatctgaaggaccggagtatctcggatatcctcgtccactcggacgtcgtgacgcaagcctggcagcaagtcctccctcgcaataatgctgacgagcctcaatcgtcattccagctcgactcgtccttctttgaactgggaggtgatgttttcgacatggctcaggtcgtctggcttctcgagcaggaaggactgcaggttcacatcgaggacctccttgaacacccgaccttccttgggcagatggcagtcttgacactgcacaactcacggacgagcgattccatggaagaaattgtgcccgtcgatgagatccccctacctgcagcgagaacaggcacttcgagttctctaggcaaagccttgactctggcgaagaaggtcacaaggtggagcgcactgtcggctcgagggtga

SEQ ID NO: 20463 - DNA, 216 bp, A.fumigatus
tcactcgttcttattattttcctttattattttggcgtgcatatcctgtggtcgtacacattttctttatcttggatattttactctcatgctcgagatggtttcggtcattctgtgtatattggcggtttggctgctggactaaattttattttatttacttgttttgcaaatatgcattgtttaatgaatctagtatgtaattatatctattga

SEQ ID NO: 20464 - DNA, 297 bp, A.fumigatus
ccagactacctgtctctctgcctaatatttataggattcttttcacgtcagggaaacacatcgacccaatctctctcgcctaaccggtttcattcatcctcacacaacgccgccatgtcgaacacaacacagacaaaggataagcccgaaacctccgaacagtccacacagcagaagcccaccgtactagaggaagacgacgaatttgaggatttcccagtcgaaggtgagcacctatccaaccccgctcacggcgaggcggggcactcgcccaatataatcacgagctacttctga

SEQ ID NO: 20465 - DNA, 315 bp, A.fumigatus
tttgattcaggacaatattctgtcgtttacttacttgatagggcagcaacatcaggcagctccttgcattccagaagctccagcgaggcaccaccaccggtggaaacgtggctaagcttctcctcagcgccgtacttggccgcaacagtagctgtgtcaccaccaccgatgataacgatggcgccgttcttggcggcatcaacagcagcatccagagtctgcttggtaccgttggcgaagggttccatctcgaagacaccaggaggaccgttccaggaggatgtattcagcccagcgggctggaagatcagagtc

SEQ ID NO: 20466 - DNA, 474 bp, A.fumigatus
ggtaagagctgctcacatggaggagtcgcagacgagcccactaacccattgattcagtgcgttgacctaaattcttggtcccgctcattgtattattatattgctgggtcctgtcatctctcgttataccgggacgtgaaggaaacagactctgctaaagccgcaaagcatgccgaattggctgagaaatatttccgaatggcccccacagtagcgggaaagaagcgtttcatggcacgacaactgcctttcgatgtatttgtggctcgcaagtttgctaaatgggaggcacgcgccaaggagtggaaggtgtctctggtcgatgcggtgggcgttgacccgattgaggaaatgattttcttttggaacggccatagccgtatgacggatgagcagctgcaagagtcgttgcagaaactggcctggagtgaatccagcgcgaatacgacctggtcccgagaaggtcccgagtag

SEQ ID NO: 20467 - DNA, 459 bp, A.fumigatus
attggccatcttgctgttgcgatcgcatgttgcttctatgaagtcatgaccgataacgaccatttctcccgcacatcttccacgtctacgacaggcagtgatatcgactctcagagtgaacaaaatggtttcgaccagggccaccgtgaacccaacaactcagcgctggaaaagcagaccactgcggcctcgggactgtcagtactcgagcagcgcgcacagtcagtgatatccagaatccgaagtcgagaacctggacaaactgcgcgtttcacgcaccctttgtcgcatagcaaaacgtcggaagatgtcattgtggattttgatgggcctgatgacccatacaggccattgaactggggatttaggaagaaggctgtcactaccgtgctatacgggttaacaacaatgggtatgcgcaggccgctctcagaaatgcaaaccaccagggaaggctga

SEQ ID NO: 20468 - DNA, 516 bp, A.fumigatus
agacagttattccacgggcaccattcaagtttccaagcatttcggcgttggagaggaagttggcacacttgggacaaccttactactatttggttttggtatgtgattgtcaccgctatctatgaggacggcaaggtttgcttattggcctttccaggacttggtccgcttgtatttgcacctctctccgaagtatacgggcgtaaatcagctgttctcataccctacttcatcgccgccatcttttcgttcggcactgccacagctaaagatctgcagacggtcatgatcactcgcttcttcacgggattcttcggctcggctcccgtcaccaacactggcggcgtcttgggcgatatctggtccgcggagcagcggggtgcagctattgttggctatgccatggccgtcgtcggtggtcctgtacttgggccaatcgtcggcggtgctatcatccagagctaccttggctggagatggacacaatacgtgagtgaggctcatacggcttggtaa

SEQ ID NO: 20469 - DNA, 897 bp, A.fumigatus
gcaacagctaatacaggcgtacaatcaaagatcaccggcatcatgatgatgttcttcctcgtcatggacgtgatcttcctcgatgaaagctacgcacccgtcctcctcgtctacaaagcgcgccggcttcgatacgagaccggcaactgggctctacacgcacggcacgaagaatgggacgtgaccctcaaggaactaggcaacaaatacctcgtccgtcccttccaactgctagccaccccgatctgctttctcgtcgcgctctacgcatccttcgtctacggaatcctttacctgagtctcgcctcctttcccgtcgaatttcaggaagtccgcggctggagcccagtcgtcggcgccctccccttcctcgcctacctcatcggcatcctcttcggcgcagccctcaacctcttcaaccagagattctacatcgagcgcttcaaagccaacaacaatttccccgttcctgaggcccgcctcccgcccatgatggtcggatccgtcttcttcgccgccggcctgttcatcttcggctggaccggcgcaaagaacatccactggatcggccccaacgccggcgccgtctccatgggcttcggcttcttcaccatcttccaggccgccctgaactacctcatcgataccttccagcagtacgctgccagcgccgtcgcggcaaatactttcctccgcagcctgttcgccggctgcttcccgctcttcgcgggcatcatgttccgcaagatgggcgttaactgggcagccagcaccctggggttcgtagctgtcgcgctgattcccatcccgtatttgttctacatctacggacgacggatcagggcccgcgggaagtggtctcaagcttctgtttacggtcctgtccgtggccggtag

SEQ ID NO: 20470 - DNA, 1206 bp, A.fumigatus
agtttatctcctgttcttgattgcagtcaactgcagtcaggcctgtcgataactgacgctcttgtagcatcggagcgactgaacgaagccgagacgagtgcgtccgtcgaccagcacagagcacagcacaactcgtatgcgccgaacacttaccactcgccgatgtatttgccaggaaccgagtttgcgttgtgccaggcaatagcgcaactcatgagcgccatagtcggggtgctgaatgaaagcctcacagagagtataaaggcattctatcgactccggaaagcctacatcaccctcgatgccattctgaagatggaacagaaatacatggaggaatcgcgcgcggcgacgctggtagaatccacaacgtctgggtccgttccgtcttccctgcgtcacagctctagcaaccttcattcctcgagctcgtcgatctcctcggccaaaggcaaagaagcggccgcggacacacttgcggcacctagcaacgataccgatgtccaggaaaggttggccgatttgagtctctcgggcgaacccgccgttgcggaagaccccggtcaaactccgaccccgatcaacaccgatatcctcgaccatgaccctgactccgacatcttccagaatcagattgatgtctttgtgcactctggttcgaatttctgttttggagtcctgcttttgctgatctcaatggtgccaccctcttttagcaagctgctcagtattattgggttccacggcgataaagaaagaggattgaaaatgttgtggcaggccagtaagttccacaacttaatcggtggtattgcagcttttgccattctcggctactacaacgggttcgtccgttattgcgacatcatgcctgattctatcccgggcaaagacggggatgtgcagggttatccgcagaagcggctggaattgctgcttgcgaatatgacagagcggtttcccaagagtcagctttggctgctcgaggagtcgaggatgagtggagccaacaaaaatcttgacagggctctggagttgctgtgtggggaggaacgcagccccctgaaacaggttgaggcattgagggttttcgagcgaagcttgaacgccatgtatctgcacaaatatgaactgtgtgcagattccttccttgaggtaagagctgctcacatggaggagtcgcagacgagcccactaacccattga

SEQ ID NO: 20471 - DNA, 270 bp, A.fumigatus
gtgatcctcggtgagggttgccgtcgagtcggacagatctctttcacgatgcatacctctcgcctttactgtaactttagcaggttgggcccgggtcgtgcccttgaactggccctttccattgtcagctgccggtatggccagagttccttcctcgagcatttgactgattatttcagtgacacggcgatcgataagttcctgaagggacttgctgtcaatgaactgaccgcccttcatcaattgtcccccacggaggtccagctctga

SEQ ID NO: 20472 - DNA, 288 bp, A.fumigatus
actctgatcttccagcccgctgggctgaatacatcctcctggaacggtcctcctggtgtcttcgagatggaacccttcgccaacggtaccaagcagactctggatgctgctgttgatgccgccaagaacggcgccatcgttatcatcggtggtggtgacacagctactgttgcggccaagtacggcgctgaggagaagcttagccacgtttccaccggtggtggtgcctcgctggagcttctggaatgcaaggagctgcctgatgttgctgccctatcaagtaagtaa

SEQ ID NO: 20473 - DNA, 558 bp, A.fumigatus
aagctaagtcatactctcttatccagatacgaagactccgaagtaggcgaaagtgaagaagaaggtagcgaagaagaagaggagttcgaagaagacgagggcgaaggcgaagaagaagaagaggaagaggaagagccctccaaggacaaaggtatttccatctctatatctacccttctctgcccatattcaatactcttcgcaactaacgttcttcaccaccagctcctccctccaagcgaagaaagacagcccctgagggcgaggccaaggagaatggcaacggtgttcctgccaaagacgaggatgaagaagaagaagaagaagaagaagaagaagaagaagaagaagaagaagaagaagaagaagaagacggagaaggcgagccagaggatgaagagcctgcggacaccgccaaaaccagcactcctgctgcagcagcgaccaaggctaaggggagcgctggtcccgcggaggccgaggttgaagttggggaggagaatgagaagtaatttattatcattttgttgcaataggcttctggtgagcagatactaa

SEQ ID NO: 20474 - DNA, 543 bp, A.fumigatus
cccatgaagactaagcaatatatacaggtatactccgtagcctggcttttggattttctcgttcccacactctttggtacgatgcttgttctggttgtctggcctcaatctcggaaggtcctgttccctcccgcacctcttgccctggtcgacaaatctactggtggagtacagaaacccaaagcgggagtgctcggttcccatgacagcgtgacgggggctccggagaaatataaaggtgaagccgccgaacaagaagcaagtaatctaatcgccagcgttgccacggttgctgtgggaagcgctgccggcaaacatgatcaaggcacacccgaaaatgctcccatggaatcgtcagtcccggacgcgatggatatcgtgtccaagacagccgatgcacaagctgctgctggtggagaagtgccagccgatactcacgacaagaccaggcagcctatgaaggagacggtgctgaacggcgcaaatctggcaatgcgagtcctcagtgatatcattgatacttacgagaggtttggaaagtaa

SEQ ID NO: 20475 - DNA, 240 bp, A.fumigatus
ccccaactcgggcggggtcgaatcttcgtccctcccacgtctcctatcatccccccacgccctttcactcgcacctcttcgacccatctgctcttcttcatgttgatgcaaaatttgaatgtcaacaattcgcgtatcattgatcatcatacgcacgcccatagatcgccccacttccgacagctgatcgcagggttacaaatcgcgagtcagcgacggttggttgcattactcgcatag

SEQ ID NO: 20476 - DNA, 780 bp, A.fumigatus
gggtttacaacgttgcggttgatcagtggcgtctcctctggcaaccacgatcaggtaagccagtatgccatcagtcccagagcactgtctaatcatcgcggtgcagccgacagcccatatgtaaggacgtatccatcaaaaggggtggtcctgcattaccatttcgccaagttccagctgaattcgctttctcttcgtgcgttgtctccgtccaataccccagtgttctccatggatcggaaagaatcggccaacatcgccatttcatccgccatggcctgtctgaatatggtgttggaggaacaggatatccgcgacgccattgtgggtgttcctattttcacccataccatggtcacattttctgcagtcttcctgctcaaggttgccgtgaactggaattcagcctaccttagtatcgacggccgccaggtgcgccgtctggtggagcgagttatcgagttgttgaactgtgtgtccgcgggtgaaagacatcttacaaggcacattgcgcgtggcctgagcaagatgctagagcgattcgattcatgggaaactgcgtggcaggctggccgacctgccaacgctggaggactccccgtgggaggtacaggagctgtagaccgaccagagggtgaggtaccaggcggtgcgaatgccatggcccagggatttccgccgccggacctcatttacgacatggttggcacttatggtttcgggttggacgagaatctgcttgaccccagcatggccaattttgaatttctggcgcaatag

SEQ ID NO: 20477 - DNA, 303 bp, A.fumigatus
cgttcttcaccaccagctcctccctccaagcgaagaaagacagcccctgagggcgaggccaaggagaatggcaacggtgttcctgccaaagacgaggatgaagaagaagaagaagaagaagaagaagaagaagaagaagaagaagaagaagaagaagaagaagacggagaaggcgagccagaggatgaagagcctgcggacaccgccaaaaccagcactcctgctgcagcagcgaccaaggctaaggggagcgctggtcccgcggaggccgaggttgaagttggggaggagaatgagaagtaa

SEQ ID NO: 20478 - DNA, 981 bp, A.fumigatus
cttgatcaaacgtcaagtctcaatatgcaaatcctcatcacaggcgccgccggcttcatcggccaattgcttgcaaaggagctcctcaatgacccctcttaccacctcacattgaccgatatccacgagccccccatccccaagggcgtcaaatacccccagaatgtaaagattatcaaagcagatctactcgccggcgcagaatcggtagtggacaaaagcctcgacgctgtcttcgccttccacggcatcatgtcctccgggtccgaagccaacttcgacctcggaatgagcgtcaatgtcgacgcgactcgcaccctcctcgaggccctccgcagaacctgccctggtgtccgattcatttactcctccagccaagccgtttacggccgaccgcttcccgacgtagtcgacgacagcgtcacccccacgccacagggctcatacggtgctgagaagctaatctgcgagactcttgtcaacgagtacacaaggcgcggctttatcacggggttcacgctccggtttcccacgatctcggtgcggccgggtcaaccgactgcggcggcctcgtcttttctttccggcatgattcgggagccgttggcggggaaggagtgtgtgattccggttgaagatcgatcattcaagtcatggctctgctcgccgcggactcttgcacagaaccttgttcttacgttgtcgttgccgagtgatgcgttgcctccgcatatccggtcaatcaatgtgcctggtatctgcgtcacggtgcaggaaatgatggatgcgctggagaaggtgggcgggaaggataagctggcgcttttgaaggagaaggaggatccaacgctgaggccgattctggattcgtggcccacgcgttttgacaattctcaggccattgctttgggattcaagcgtgactcgtcattcgagcaggctgttcaagattattacgagcaggaggtattggggagatga

SEQ ID NO: 20479 - DNA, 1218 bp, A.fumigatus
cattcacgactccaaaagattaagcgagatagctgttatagtgcactctttagcgacaagatctcaggtataaattctcccctcttctcatgcttctgctcccccttctctctttccctccttaccctgcttcacatcaataatcttctctttcttgttagaatcttctcactctcatcgatcaacaacatcttcgctcatacatcccttcttgtgacgacttgtcaagcttcagtcacaatgaagttctccactttcgcgctcggcatgtttgctggtatggcagcttctgctgctatacctgcttctgtcgttgatggcatgaacctctctgacaatggtcttggtacgttcttacctcttgcgttctgtcttatcccaattgagtctctttcctcttcttttcaaccttccaaccaatcgtctcatcctactaacatctttttttctccaacatcaataggccttgtcaacgctggtgatcctgtttgccacaaaaattctgactgcggtcccggcattggttactgttacaagggcatctgtgttgccgacccccccaaggttgaacgcgacgatcccatctgccacaagaactccgactgcggtcctggtgtgggttactgctacaagggaatctgtgtcgccgaccctcccaagctcactcgagatgatgcttctatcgttacttgccatactaacaaagattgcttcaacggtctttgcattgctggtatttgccattggggcattggagagagttccgcctcaaacactgcgaaccagaattctgcctcccttgttcagacttctgaacctgcggatcccgtttgccacaagaactccgactgtggtcctggcgttggttactgctatcatggcatttgtcttgcggaccctcccaagctcacctctcgtgacgaccccatctgccacaagaactccgactgcggtccaggtgttggttactgttaccatggcatctgtgtcgctgaccctcccaaggatgctcgtgaagtgtcggccgaccccgtctgccacaagaactccgactgtggtcccggtgtgggttactgctatcatggcatctgtgtcgctggtcctcccgttgttcctcgcggcgaagaagccgatcctgtgtgccacaaggactccgattgcggtccaggtgttggctactgctaccatggcatttgccttgctgagcctcccaagtga

SEQ ID NO: 20480 - DNA, 660 bp, A.fumigatus
gaagagctaacaagatgtacagttatgtacctccccctccgcatcctgtggaagacaaagatgaacctccaccagaaactgggcctggcaactgtcttctgtcttggctttgtcatcatcgctgcagccattatccgtgccgtggcaatcaccggcaaagcgtactcggatcaagctgctctggccatctggggcatcgccgagtcctcaatctgtatgtactatatccagcgtcgactcgtgcagccaacgctaacctgcaaagccatgattgtcggctgcctacctcccttcaaatcctttatcacgagcggttccagcagcgccaactacaattacaattacaactataactcgtcccagcgcgcggcaaaccactacaaccgcagcgcctcctctgcccgtatcaagaaacgctccatcaccaccaccagctggagcggattgcctattccactgcaggagaggaatctaaacgcataccagaatctagagtatgaatcccaagggaaacatgacgtacacattgcagggggtgtgaatacgcgtgctgccccgcccccagagccctcccgcctgagtctctcagaggatgacgctgggcatggtgaaatcaggatggtgaaagaatttgtgagaatattcctattttctttctga

SEQ ID NO: 20481 - DNA, 828 bp, A.fumigatus
gccttgtcaacgctggtgatcctgtttgccacaaaaattctgactgcggtcccggcattggttactgttacaagggcatctgtgttgccgacccccccaaggttgaacgcgacgatcccatctgccacaagaactccgactgcggtcctggtgtgggttactgctacaagggaatctgtgtcgccgaccctcccaagctcactcgagatgatgcttctatcgttacttgccatactaacaaagattgcttcaacggtctttgcattgctggtatttgccattggggcattggagagagttccgcctcaaacactgcgaaccagaattctgcctcccttgttcagacttctgaacctgcggatcccgtttgccacaagaactccgactgtggtcctggcgttggttactgctatcatggcatttgtcttgcggaccctcccaagctcacctctcgtgacgaccccatctgccacaagaactccgactgcggtccaggtgttggttactgttaccatggcatctgtgtcgctgaccctcccaaggatgctcgtgaagtgtcggccgaccccgtctgccacaagaactccgactgtggtcccggtgtgggttactgctatcatggcatctgtgtcgctggtcctcccgttgttcctcgcggcgaagaagccgatcctgtgtgccacaaggactccgattgcggtccaggtgttggctactgctaccatggcatttgccttgctgagcctcccaagtgaggagttttgttggctcactggaagcaagtggttgttgctggtaagctttcttctcttctcttctctgacatga

SEQ ID NO: 20482 - DNA, 186 bp, A.fumigatus
ctttcagtgatctcgttgattagttacctgaccattaatggcaaagattctatcagtctcctattttgtgataatcggttgatcgtcctgactattaagatcatgatatgtgctgtctccagcaaaacaaatgtcaagatacaaatggcgtcaagtctgcacggtggtcaactgcaacaccgttga

SEQ ID NO: 20483 - DNA, 288 bp, A.fumigatus
atgcggagacctatgacgtggcacgatttgcagtggggtaattgtggcttgagcacagctccctcgatgctagctagctccaaacggtcaagattcaaaactgcccctccttcacaattttctcttcccctctctctcctcatcatcacatacacacatactttcgttcttactcagtggataaaatcagcaaccatggttgtcaagactttcttcgatatcaccattgatggccgtaagtttccctgtggttctattctatctgtcagagtgagggacatgttgtga

SEQ ID NO: 20484 - DNA, 303 bp, A.fumigatus
tatcctgggaaagtatgtgtctgttcccgctgcgcctctgcggaaacggctgacgaaacaaggtcggagggatatggagctctccaaatctggatcaagtacattcagaagggtatcacgtaccaggaaagctacaaagcgtcggatgggtgtggcaagagtcactgggttggtgctgcctttaccgtcgctggaggttacgtctggcaagacgtgtatgccgaagtcttcaagcgcaacttgaccatcgttggtggtggcgatcctgtacgccgttccggcttccatttgagcagtgtatag

SEQ ID NO: 20485 - DNA, 309 bp, A.fumigatus
gggacatgttgtgacagtaatcattctctagagccggctggccgcatcaccttcaagctgttcgacgaagtcgtccccaagaccgttgagaacttccgtgctctctgcactggtgagaagggattcggttacaagggttccagcttccaccgcatcatcccccagttcatgctgcagggtggtgatttcaccaagggcaacgtgagttcaattgtcaagcctactctggcgcctttgcagagagaaaaccccttatggagtatactgatctgtactttagggcactggtggcaagtccatctacggtga

SEQ ID NO: 20486 - DNA, 639 bp, A.fumigatus
gctgacctctcaaaggcaccaggtgattcctgctggccttccattgatacctggaatgcattgaactcttccgtctccggcaaactcattcttgatacgccgcccgcgatctcctgctacccaggtccttaccagaatgcggaacagtgcgcctacgtgaactcgcaatggtacaattctacgttccagtctctgtctcccgtcggttacgtttacccgactgatgactcgtgtcctcctgtcgatctgagctccggcgaaacccccggaaagtgcaccctgggacaagccccagtgtacacaatcaatgcgacagaaccagaggagctggcaacgggcattgcctttgcgaaaaagaataacgtgcgtttggttgtaaggaacacaggacatgatatcctgggaaagtatgtgtctgttcccgctgcgcctctgcggaaacggctgacgaaacaaggtcggagggatatggagctctccaaatctggatcaagtacattcagaagggtatcacgtaccaggaaagctacaaagcgtcggatgggtgtggcaagagtcactgggttggtgctgcctttaccgtcgctggaggttacgtctggcaagacgtgtatgccgaagtcttcaagcgcaacttga

SEQ ID NO: 20487 - DNA, 945 bp, A.fumigatus
accgtcggtgtcattggtggttacgcccaaggtggcggccattctcccgcgagtcgcgattacggtctcggcgccgaccagattctcgaagcgcaagttgttctcgccgatggcagcattgtcacggcaaacgcttgccagaactctgatctgtactttgctatccgtggtggtggcggaggcacctacggcgtggctatctccatgaccttgaaagcgtatcccaccctgcctgtcgttgcacagtctctcaccatcactccgctgaccagcaacactgacccactcctggatgctatcaccgacatctatggtcaatatcctgctttgtcggacgctggctactctggctacggcacctggtctatcaacggacccatggccctctttggcaaccagaccattggctacgtacatgccattgcaaccatgggcaagtcgctgagtgcttcccaagctgcctttgcgcctctgttgtccaagttgcaaaaatacaacggcacctccctctttatcaccgtcaactactaccagttccccagctatgctgcctattacaccgccatgtcaggtatgcaccagcccgtcggttcggccaattccgccttgacctcgcgcatgttcgacaagagtgctctgactgtgaatccttccatcctccgctccatgattggcgccatcgctggcaagcccgaggagtacaccatcaacagcttggagatggtcggcggcggaaaggtgctcacggacggctctgatccttactcgggcgtgaatcctgcctggcgctcaacctacattgttaacgtcgtcgcacgaggatggcccgagggtgcggatgccgccaccgctcaggctgtcaaggacgacattacatacatcaagggcggcgccatgagactactcacgccgttcttgggcagctacatgaacgaggtgcgttag

SEQ ID NO: 20488 - DNA, 192 bp, A.fumigatus
caggctgaccgcaatgaccctctctgggctacggactttttcggcaccaactacatccgtctcgcgctgatcaagaagaagtacgatcctgagggagtgttctactgccccaagtgcgttggcagcatgacatactaccagaagaacttggatggattggattacggcccactgtgttctattggcttctag

SEQ ID NO: 20489 - DNA, 183 bp, A.fumigatus
cacaacagcaacggctcccagttcttcatcaccaccgtcgttaccagctggcttgacggcgctcacgtcgtcttcggtgaggtcgaggacggcatggaccttgtcaagaagattgagagctacggcagcgcgagcggtacccccaagaagaagattactattgccgactgtggtcagctgtaa

SEQ ID NO: 20490 - DNA, 792 bp, A.fumigatus
tctctctcggacgcaatacttccagtccggtctgtacatagtcatcagcactctgtccgtgcaatcgctgcgcacggtgacactttggttagcgggagttatgattgtaccgtgagagtgtggaaaatatcgactggagagactattcaccgacttcagggccatacactcaaggtatacagcgttgtacttgaccacaaaaggaatcgatgcatcagcggttcaatggacaacacagtcaaagtgtggtctctcgatactggctcgatcatttacaacctagaaggtcatagttcacttgtgggtcttcttgatttgaagtgcgaccgtttggtctctgcggctgcagactctactttgaggatctgggatcctgaaactggtcaatgcaagagcaggctgagcgcgcatactggtgccattacctgctttcagcatgatggccagaaggtaatctcgggatctgatcggacgttaaagatgtgggatgtgcggaatggggagtgcgttcgagatctacttacggacctgagcggtgtatggcaggtcaaattcaatgatcgaagatgcgttgctgcagtacagcgcgatgctctcacgtatattgaggtaagtcgtggaagtgtctgtcaatctgccaccatcatcattaaccatcttcaggtccttgactttggggcttctcgcgacggtgtcccggaggatcagttggggagacggatagttgtcaaccgatggggacaggagatcggtgacaatgctgacgaagattacgatctatctgacggctga

SEQ ID NO: 20491 - DNA, 183 bp, A.fumigatus
ccattcacactgttctggtttctcatacccgaggaaggcgaaaatagctttcgaattgcacccaacatgatcaacgccgtcctcgtcttcaacaataatgggcaaccgcgcctcactaaattctatacccagatcgtgagtggcctggacgtcgcagttcctagggaaatcggtcggaaatga

SEQ ID NO: 20492 - DNA, 240 bp, A.fumigatus
caaactccagaaccctctcatcgagcgccgcccccgcaacttcggtattggccaggacgtccagcccaagcgcaacctctcccgcttcgtcaagtggcccgagtatgtccgccttcagcgccagaagaagattctgaacctccgcctgaaggtcccccctgccattgctcagttccagaacactctggaccgcaacaccgctgcccagaccttcaagctcctcaacaagtaccgccctga

SEQ ID NO: 20493 - DNA, 189 bp, A.fumigatus
aacgttctccatagacacaaatccattatcgcctatcttgcctcggtgaacctaactgagagttccgctgctctgcgagcggaactaggcgattcggtttcaattgacgatgctacgctgaagaagtatgaggggctattagagaagaaatggatcttcaccaccgaggctggccggtaccgcgcttag

SEQ ID NO: 20494 - DNA, 270 bp, A.fumigatus
ttgtcaaccgatggggacaggagatcggtgacaatgctgacgaagattacgatctatctgacggctgacgccattgattcagactactgggctcgtcagtgcttcgccagctggcatggctcggagcacttcggtcaccagattagcaacgtttgccacttttattcttttcacctgccctatttcctcttcctctctgcccctcaagccatgaaatgtttagataccctttatccacagacttgttatttatcgagaggctttgcatag

SEQ ID NO: 20495 - DNA, 489 bp, A.fumigatus
gatacgcaaacgaaacagtcactgattgcccaaatctacgatctggtggcccagcgtccgccgagtgcctgcaacttcctaccactgcctccattgctttcgcaaggcgcgcgttcaagcgcagcaaatggtccttccgatgctcctacgcaagtcacctaccgcacctatgccaccttgtcctttatcatgatatccacatccactgagtcaccacttgcgctcatcgatctaatacaagtttttgtggaagcactggatcggatatttgagaacgtttgcgagctggatctcatctttgggttcgagacaatgcacgcagtgctcagtgagatgattgtcggtggcgtcgtagtggaaaccaatatcgacaagattgttgcaggcgtgcgagaacaggaaggcaatctaggtaagaagaaggctattcaagcagccagctccggtcttggtcgaggagggctttcagggcttggtgcttggcgttga

SEQ ID NO: 20496 - DNA, 576 bp, A.fumigatus
ggtatgcagtcattcctcaaatttttggaaagaattggtttcgctaacaaactccagaaccctctcatcgagcgccgcccccgcaacttcggtattggccaggacgtccagcccaagcgcaacctctcccgcttcgtcaagtggcccgagtatgtccgccttcagcgccagaagaagattctgaacctccgcctgaaggtcccccctgccattgctcagttccagaacactctggaccgcaacaccgctgcccagaccttcaagctcctcaacaagtaccgccctgagaccaaggccgagaagaaggagcgtctccacgctgaggctaccgctgttgccgagggcaagaagaaggaggatgtctccaagaagccctaccacgtcaagtacggtctcaaccacgttgtcggcctcgtcgagaacaagaaggcttcccttgttctcatcgcccacgacgttgacccgattgagctggttgtcttccttcccgctctctgccgcaagatgggtgtcccctatgccattgtcaagggcaaggctcgtctcggtaccgttgtccacaagaaggtaagatag

SEQ ID NO: 20497 - DNA, 225 bp, A.fumigatus
cgtacactaatgtcgcactttcagaccgctgctgtccttgctctcaccgaggttcgcgccgaggacaaggctgagttctccaagctcctctctaccatcaaggagggctacaccgacaagtacgaggagtcccgccgccactggggtggtggtatcatgggctccaaggccgttgcccgcatggagaagaagcgcaaggctgctgaggctgccgtcagagtttaa

SEQ ID NO: 20498 - DNA, 657 bp, A.fumigatus
gggttcatagcacgctcgcccattattttcatcaaagtacccaaaatctcagctcctcctgcacggttgacttccgtggactcggtcagcaattttgtggcggcatcggcaatggctttcacttcagctttcgatggaacatctctcgtggttcggaggcagcgaatcaggaatttcagggtttcctgcttcacctgtgggttcttatgtttgagaaattctaggatctcctctagacaatccgataaattcgtagatgcaaagacagcatccaaagcttgccccagagcatctgcgacggtttgctttttctccttcaatcgttccatgataggcggcatgatggtggaccgatgtttcgcgaatgccccccgcaggccctttgcgaggagatcgatacagttggcggcaacagtcacgactgcgacattcgcgtctttcatggattttgcaagacttcgcacaatatcgtcaaacggtccgtccttgattcgcggaacgttcagtgcagtatacagagcgtccagcgtttccttcctgtctttccacttcgatgatgccagttgctcattaaagtcctttggtattttggggaagacgtcgactggctcagcgagatcgaatgcatctacctcgccatcatcttcatctgcgtag

SEQ ID NO: 20499 - DNA, 516 bp, A.fumigatus
agtatcttcaaggacggcgccagtgagtcgctcctgttcattgatgatgggcaactggtactgactttggccgcggcatgtaggcttcgtcgggcatttattttaatagatagcctccacgggatcaaaaagacagacgaggacattctcatgctatttcgaaagtacgccatcccccaccagattatcctatcgaaagtcgacaaggtattagcaaagagaaaaaagcaggttaagagcggcgcatccgtggccaacgtcgctgcgctaagaagcctgcttcaagatctcaggccaatagttcaaccggacggtcgtgacgaaggccctggcgctttgggtgaaattctcacatgcagtgcagaaacacctactggaccggggcaattcctaggcatcagtgccatacgatgggcgatcttgtctgctgctgggttcgatggcactgtagaagtgaaagctgagtccataccgtccagctcgtccatccgaggcgcgtcagcagctccaccatga

SEQ ID NO: 20500 - DNA, 225 bp, A.fumigatus
aattggaaagtgagaaaggaaggttacgaagatgccaagcaacagtttgaaaagacgcccgatgagtcggatccagtttttgtaccatttctacaagatccaggtctctggaaaggcgcagtgtcagattcgaatgtagctgctcaacaagagggtcttgcgtcatattgctcttttctcaaatatgggggtgtccaggcttgcacacggtatgtctacccttag

SEQ ID NO: 20501 - DNA, 2496 bp, A.fumigatus
caggggttgcgcagaactcgcggatccacgattggtcctattgtcgaaaaaggacttccttcaaccagaccggcggccaaagcaaatgcgcttgaagctcttctactctgtgtcgaattagataaggcagatccgattattgaggaaatcgttcccatcttgtcgcacaaagtaccaaaggtgattgcagcggcattaagcggattgaaagccatctatcacagcttcggctgcaagattgtcgatcccaaaccggtcttgaaagccttacccaaagttttcggacacgcagataaaaacgtccgtgtggaagcgcagaatctcacagtcgaactgtatcggtggctgaaagaggctatcaaaccgctgttctggggagagcttaaacctgttcagcagcaggatctcgaaaagctgttcgaaagcgtcaagcaggaaccagcgccaaagcaagagagattaacaaaagcgcaacaggacgcgatggctgcagctaatgctgctcctgaaagcggtgatggcgacgcagaagctggggaggtctacgcagatgaagatgatggcgaggtagatgcattcgatctcgctgagccagtcgacgtcttccccaaaataccaaaggactttaatgagcaactggcatcatcgaagtggaaagacaggaaggaaacgctggacgctctgtatactgcactgaacgttccgcgaatcaaggacggaccgtttgacgatattgtgcgaagtcttgcaaaatccatgaaagacgcgaatgtcgcagtcgtgactgttgccgccaactgtatcgatctcctcgcaaagggcctgcggggggcattcgcgaaacatcggtccaccatcatgccgcctatcatggaacgattgaaggagaaaaagcaaaccgtcgcagatgctctggggcaagctttggatgctgtctttgcatctacgaatttatcggattgtctagaggagatcctagaatttctcaaacataagaacccacaggtgaagcaggaaaccctgaaattcctgattcgctgcctccgaaccacgagagatgttccatcgaaagctgaagtgaaagccattgccgatgccgccacaaaattgctgaccgagtccacggaagtcaaccgtgcaggaggagctgagattttgggtactttgatgaaaataatgggcgagcgtgctatgaacccttacctggacggacttgatgatatcaggaagacaaagatcaaagaattctatgagatcgccgaggtaaaagcgaaagacagaccgaagcccatcgttgggccgccaaagaccgtgcctgccgctggcaagaaggtcgttggagggaagaagccagctctgggaatgaagaagccggctccagctgctgcggcgcctccaccagaggagcctgcaccgaccctttcgcctccaaagcctgctacaaagtcgatcccctcgaagttgggtggggttcccaagcctggtggacttcccaccccaggcgctggactcaagcttcaaaggaagcttggtggtcctggtggccttgcttccccacagcgtcgggtcatatcccctccttcggaagaacagcctcccgcgccagctgcaccgaaatttggtcttggaagagggcttgcaggccgtcctataacgaaaccgtcagctgctcctgaaccagctccagctccagctgcgccaccccaagtgagcgggatttctgccattgaaagggctgaactcgatgaattgcgccttgaaagagaaaggttccttcgaatgattgaggacttgaagtctgaaagaactcgactcaactcgcaagtgacggagcttcaagatcaaaatgcacaactcattgaggatcatacaagagatgttctaagtatcaaagccaaggaaacgcagttggttcgagccaggagtgatgcagaagcggctgagcagacggttcagaagcagcagagggaaattgatcgtctaaagcgtgagttggccagagctctccgggccagcgctcagagtcctcccaacggcttttcggataatatgagttttccagtaccggagacgtcgatatattatgaaaccggtatcaacggctataatgccattcccagaaccggcctgcacatgggaagtcgctttgatggtgggcgacctcggagctacgtggctgccagtccaagtgaggagaaagaaaacaccgatctggagtcaccaggacgcggtagcagagacggaggccttggtcgacggaagctcagcccttcctttggaactaactactcgggtatgggcagtccgacgagatcatccataccaggctctggtagtgcttccggagaggaacaaccgatgagaagttcagaacccgcggaaaattggaagagagccgcagaagtcaccagccaactcaaggccagaattgaacaaatgaaggtacatccatactctctgttcacttgtggacatgtctctgaccgatcttactag

SEQ ID NO: 20502 - DNA, 600 bp, A.fumigatus
tgtacgttacaagacatgaataatggggattgtctatcttaccttcttgtggacaacggtaccgagacgagccttgcccttgacaatggcataggggacacccatcttgcggcagagagcgggaaggaagacaaccagctcaatcgggtcaacgtcgtgggcgatgagaacaagggaagccttcttgttctcgacgaggccgacaacgtggttgagaccgtacttgacgtggtagggcttcttggagacatcctccttcttcttgccctcggcaacagcggtagcctcagcgtggagacgctccttcttctcggccttggtctcagggcggtacttgttgaggagcttgaaggtctgggcagcggtgttgcggtccagagtgttctggaactgagcaatggcaggggggaccttcaggcggaggttcagaatcttcttctggcgctgaaggcggacatactcgggccacttgacgaagcgggagaggttgcgcttgggctggacgtcctggccaataccgaagttgcgggggcggcgctcgatgagagggttctggagtttgttagcgaaaccaattctttccaaaaatttgaggaatga

SEQ ID NO: 20503 - DNA, 663 bp, A.fumigatus
tgcagcggggccgtatcagcggagacccctttgcatctccgcccggatcactttctcattcaacggcatcatgatactttttggctagctcgatctcaccttacagacaagaaatcatacatcaaaatgaagacaagactctacgtctgtacggcctgtatgcgcagaaatttctcaaccgctcttactctccgagattcaccaacagctgttgcgccatcgaatcctccaaatgcacccaaactccagcttcgcgatctgacgccgtcagacctctcttattactgggatacacgaataccgaatgaatcccagctttcctacgcggataagttcttcactccgtcgcgtcattctccagtcaaattatggtccgccagcaaattccgcacaacccccctctcgtccctcgaacccgaagtggctttccttggccgctcaaacgtcggaaaaagctcgttactcaatgccatcatgggaaaggagatgtgctggacttcatctaagcctggcagaactcgggagatgaacgcattcgggattggagggaccaagggcggcgaatccaaaattgtccttttggacatgccagggtatggaaagggaagcaggacggaatggggtattgagatcttgaagtatcttcaaggacggcgccagtga

SEQ ID NO: 20504 - DNA, 1530 bp, A.fumigatus
gagggatggggggagtcgcccagctcgcctaggtcgccgagccgaccgcccagtatccgtcatcgtcgaagtatgcaacatctccaagaactcgaagctcgtcttgatcaactcatctccgaaaatcgactcctcattgccgctcgtgaggccgccgaggacaaacttcggaatgctagtgtcgcccgtcggaagagcgaccatacactcaacgagcgcagtgccgacctacgggacagggaagccgaggtggaaaagctcaaaaaatccgtggaatggcttcaaaaggaagtgactcgcctgacagaagagaacgaagggcttattacgacgaactccaacctgactgcagcccatgccaaggaaattgagtcggtgcgcgaatcgtcatctcgccaattggacgacttgcgctcgagatatgagcagctctctatggaagtgcagaacacagtgcggcacgagattgagactgcgctggcgcgaaaggataatgaactgcgacggctgagggaagagcttgagacggctcgggataaggtgtcgcagttacaacaaaaaattgcggcatccttgcatgacaacgttctcgtcttccgcgatgaggattacttcgatgctgcatgccaaaaactctgtggacatgtgcaacaatgggtgttacggttctccaaacactccgaccatcgacgctgccgcaaacttgctgagatacaagatgaaaagatcgcggaccgcttcgacaatgccatcctggatggctacgataccgatacctacctcgccgaccgtgtccgtcgccgtgatatcttcatgtccgtggtgatgactatggtgtgggagtttgtattcacacggtatctgttcggcatggatcgtgagcaacgccaaaagctcaagtccctggaaaagcaactgaacgaggttggtccacgaagcgctgttcatcgttggcgcgcaattactcttactctcctgtcgaagcgaccggcatttgctcgtcagcgcgaaagcgacacggaagcggttgcattggaaatctttgagactctgtcgcgtctcctcccacccccaagccatgtcgaagtgcagctcttggagtctttacgcaaggttctacgggttgcagtcaacctatcaattgagatgcgcacgcagctggccgaatacattatgctgccgccactccaacctgaatacgacacaaatggagacctagcacggcaggtctattttaacgcctcgctgatgaacgaacgtagcggggagacaacgtcgaatgaggagctggagtcgcagcaagcagtcgtccgggtcgtcttgttcccgctagtggtaaagaagggcaacgacacaggcgaaggtgaagatgaagtagttgtctgccctgctcaggtgcttgtcgctcgacccgacaaggatccgagggccagcaaaatcttcagcagcgaccgcatgtctctggatggaaccaagtctgttcacagcgtcgccccatcatcgaccatggatatcagcaacgtgatctga

SEQ ID NO: 20505 - DNA, 378 bp, A.fumigatus
ctcaccatggcttctggcaagtcgtcacgaagcaatagttctcagaccgagacggctgcggcaacaggagcttatcctagcgctgggggctacgagacgccagccccacacacccatcacgacgccgcatcggagggccgatctgtgacgaacaagcccaagcggaggaagaaccgtcatcggaagcgtcgcaatcgtcggcagtccttccttgcccctgaagaatcccataatggggctgcggcctcgggtgctgacgcggatgccatgattgcgggggatcagccctattctcggccggcacttccattctataatctgggaagggatctgagcagtacaagcttggagagtgaggctctgttggaccataggtag

SEQ ID NO: 20506 - DNA, 267 bp, A.fumigatus
gcagtacaagcttggagagtgaggctctgttggaccataggtaggtttagttttggtttgggaggaattgcctcgttatctttcgcattgctaatgatgcgcctccttaaatctatgcagaaatcaacccaccatgcgacctcggagagaaagccgactggcacagtcctttcgacctgggtctatgacgattccgtctcgttctatcgatttagcttctcgtggtacaccctccggtaccagggtctttcaggccggagacgatag

SEQ ID NO: 20507 - DNA, 870 bp, A.fumigatus
ggagcggctccttccagccccgtggtgaagaccaccgaaccacacggaggtgacgatgaagatctaacatggactgatcacatggtatcttcgcaggtagagcaacaacaaggaacgccttccgatcgtccgtccgaacccgcgcctgaaaccgagccaatttccacacgcgaagcagcaacatctattgatgttgaacaacttgataacaacgcacacgatgcttcgccggctgttaacgataggttagagcgatctggtgaagaacgtacgagagtcaaaaaagagattgtgtccgaagaacccgaggtgcagtatgagggtctacttgggattccacgagaagaaaaggcggagatatcgagccaaggagaagataccattcaggtcaaaagcgacgcagaagtggaggagtcggtgaaagcaaccgttgaagggacacctgaggattctatgagtcaggaagacgctccaatatccgttttagatggcggagatgccacgactaaggatcagttcactagtattgaggtaaacgatccttcgcagtcgaaggacatcctcgagccggagaacgaagagttgccattaccaattccagggaagaaaaagaaagcgcaacaggagacaaagattgatgagacatcgcaggatgattctgtagatgccgtgcaagaagaatcaccaacaagccgtgagatgaccgataccggcttacctgttgccgagtcccaggcagatccaattgccgaaccctttcatgagcttcccgaaccacagaaagcagtcgagattgcggttgaggacaaaagcatgcaggagaccctaaagtttaaacaagatgtgacacctgcggaggatgttttttag

SEQ ID NO: 20508 - DNA, 2847 bp, A.fumigatus
  unsure (712),(806): Identity of nucleotide sequences at the above locations are unknown.
gagccacccgctcttggacggaagaagagcaagaaggataagaagaaggacctccttgctcaaaatactgctgttgagtcacgcgagaataaatttaaggagaaacaactggcgactgaagaacccctcataacaccttcagatgctcgaacaacagtgctcgccactcctgtattcacccaagcgctggagacacctaccaagaccacggtagacgctggggaaagggaactgcatttgagtgccgttcaatccactgttccagtggaagacaatataaatgccttagaaacctcgggagctcagacacttgaaagcttccgaacactagaggcccccgaacagccattggagcggaatattttgctgaatgattatgcagcaaagactccagaggaactacctgctgtggaaaagtcagccacttatgagacagctacggaaccaataatcgaagaagcagccctgagtcataagaactccaagaagaaatcgaagaaggcgaagaagcaagctcaagaacagcaagaaaagagtacaactcccactcctgctgagcatggagaagagagcattgtggagactacagccgccataccaagcactcccggtccagcggagaattctgatgatattcctgaggcgaatatttcggaagagcaggtggcacaacttgaacattctgagcagttggttctatcggacgccgctngacctcaagagagacttgggcagactccgaatatggacaatcaaacggatgatgtgcaatcaacagaacagggaaaagagggcaatgttcaggntgaaccaagacaagtcgagtccgaggatcccatcgagagccagcctggatccacagcagctgttgcaagaaaattgtccaaaaaagatagaagaaaagccaagaagaaatctgccaaggatgccatcgagccttcagacgagccggagctgcgaaatccaacagaacccatcggggcatcctgttctacctcgaaccaagccaagattgaccaagatcaatttttgacagttgcctccgacaagcaaatggtcgaagaggttccacgaccacttgaggtcgagcctgcggcttcggaggtgtaccaaggtgcaaccgacgaaaatgactggcctgcaattgactgggagaaaggtaaagtcgaattcaaagaacagacgccactgtcatcacccgaggctcatgcggttctttttgagccagccattgcagagttcgacgagactgccatcccagagggattgcttagacgacaaagtctatcacgtgaagagcaactagcgggaggcaaggacggaagttcacagcatactcgggccgatgaaatagctgctccgcaagaaggtgcagtgatgatagagccttctgccgtagccgagacggagcagtctgctggactacaagcaaaatctgtaagttcgcaaggggctcctaagacaattcaggacgatatgcagcatcccgagaacagattggcccgggatcaaacaaagagcgagacgggagtggtgccgtctaagcaaagcaaaattgggagcatcttcccagatcttgagcgcggatcatttcgacgacctgttcccggccaagtattgatgccggtaaaagatagggctgaggatgagactattgaccaaaatgcagacgacaacagcgcaatcaaggtctcggaggcgcctatcccggccggcgaaccggaagagtcccatttacagagccagcaagatgagaagggcccagagcccacgactacggtttctacactagatctatctctagaagagcctacgaagatgcaggacacaagcaacaccccagtcaaccttgctgtcgacattgaggttgacccctcatacaatgtttctgtgatatccgacggtctggtgaacgaaacaaaatctattgaaatcgaatggaagaccgacggcgataaagggacccaggaagctgaaacaccattgtacgcaccattgcctgtgcatgaacagaagtcgtcccttgtcagccaagcttctccccttgacatggaccgggacgagccgattccgagaaacgactcttcctgtgggcttcgtcgcagcccgtcaattcatgggcgacataatcacccaccgcgaacatggtcgctggaggatacaccaatcaccaaggcagtgacaccacctctatttgggggaccagtaggggccactgcggacatgagctcacctccacgtactccattacagccaattgcggaacaagagccagaggttcgagtggagcaagcaagcggattcagatccatggtttccgaacacgggactccccgtctggaaatgaagcccgaacatgtacttccacgtcccgaaactcccatcaggaagtttacagataatgcattggcacgtcagacatggccagtggcggagaacgacattttcaaaagctcagaagacgaggatgcggctcttactgtcaagaaacaacggccaggtaacaaatggcccgcagaagtattaaaaactcccgacaaaggaatgcccatccttaggcctagcagtgtgagcagtgtcaaaagcgtacagagcacccacagtgtcactggcgggcagagatcactacgacgcactagtcgcaacaccagtggggatttgcgggctgctagccaggcacaggaaagccacggcacccagccacacgctacgccccagcctcctcagcccccaccctccgatctcaacattgagcacatcgcttcgtcttcctcctatgaccccgtcacggacaagggcaagcgccccatacgagccatgacggacgtctacgtaagtgtttattga

SEQ ID NO: 20509 - DNA, 2019 bp, A.fumigatus
tgcgcctccttaaatctatgcagaaatcaacccaccatgcgacctcggagagaaagccgactggcacagtcctttcgacctgggtctatgacgattccgtctcgttctatcgatttagcttctcgtggtacaccctccggtaccagggtctttcaggccggagacgatagcgatggatcagacggagcagatgatcatacgccgttgatacgaccagcttcaggccaccataacaacaaatcctggtatggaacagatgccaaggcaagcccctttgcatcgcgccagcgacgtacctctgtgcagtcagcttcctcccggtgctctcctcgcggtctcgcgacgcctgaccctgatcgagattatgacatcaataaccctccttccatcccgagctcaccgaagctggggggtgagatgaactacgacgacgcggtggtaacaggtgcagactttgactttgctctcgccaaatcgattgataatcgcaatcaggcgggctcccggcccaatgacatggtaattgacgtggacggtcgttccactcagcagaagccttctacacagtcctcccccgtttcaccacacctttcgcctcacgaggctcttcgtcggcgccgcactgtcgcattaccggtagaggaggatgtctgctttcccatcgaagaggcgtcagagctcgccgaggaagatgcacggagaacatcccgcgaggacgggcggcggcggcggcggaccaaggaatggccggacttgtctgttctggaagaatggagtcgggaggagaaagaggaacgaaatggtgtgcttcgcgccaagaaaatcagcgaacccgtgctgattgaaggacgactgagacctcagtaccgagtgtggcggcgtgaggaggacgaggcgccgtatcgtttcacatatttcaacgaggagtttcagagtaccattcatgcccagagcatatccgagctggtacagcctggtggtagtttccgggagttattcatccccgatcccccggaactggaggactcatcggatgaggaggactttgaggatgaaaataatcacagtgatcctgtcaccgattccaaccacgacggccaggacaacgccagggcggaagaccacaggccagcacaggccggtggacacaatgtgaacgctgcgaatggcccaaaggcgcaacataatacgtccataatcagcgaaggcatgtccgaagcccgcgcatcagtcgaagcctcaccggcgcgcaaggtctcaacaccgaagcctaagaaatttgggcctcgccccactttctggctggatgttctttctccgacagatgcggaaatgcgcgtcattgccaaggcatttgggatccacgccctgacggccgaggatatcatgatgcaggaggcgcgtgagaaggtcgagctattccgaagctactactttgtcaactatcggacgtttgagcaggatcccaacagcgagaattacttgcagcctgtgaacatgtacatcgttgttttccgagagggaatcttgagcttccatttctcgcagacgccgcacccagcgaacgttcgtcggcgcatccgccagttgatggattacttgatcctcagctctgactggatctcgtatgcgctgattgatgacatcacggatgtttttggtccgctgatccagtcgattgaggacgaagtggacgagatcgatgagagaatcatgaagatgcactctcctgggcgtatagataccagcgttaaccctgccaaccgccgagaggatggcgacgatgtgccagaaccaccggctcccggtgagatgctgcgacgtgtgggagaatgccgtaagaaggtcatggggatgtaccgattgctgagcaacaaggcagacgttgtgaagggattcgcaaagcggtgcaatgagcattgggaagtggcgccgaaatccgagattgggctgtatttgggagatattcaagatcacatcctgactatgaccagtagcttgacctactacgagacgtga

SEQ ID NO: 20510 - DNA, 312 bp, A.fumigatus
cgagtgccttacattcgggagagggggccagctaatcagggccacaggctactgtcacgagcgcattcgaactatctagcccaaatcaacatcctgatgaatgaacgacaagagcagacagcagatgttctcgggaggcttactgttctcggaacgatcgtgcttcccatgaacatcatctgcggtatgtgggggatgaacgtcaaggtccccggtcaagacatagataatttgtggtggttttggtcaagtaaggactcattgcattatgctctctttttccggggattctactatgagatggtcatatga

SEQ ID NO: 20511 - DNA, 1278 bp, A.fumigatus
aaatgcaagacctggctcttgaattatgtcgtctcgtcatctaaccgcgtgggtgtctgggccaaatacctggttgctttgtccagttcgtttaccagcggggagaatggacatacgtccaagccgacagaggttcgccctggcacctcgtcgaaaaggaagaggctacatatcctgtatctgatcaacgatcttttccatcataccaagtaccatacggatacccctgcgacattctccactctgagtggttcactacaaccgcatatcgtggaactgctgggttacgctgcatcctacgatcgattcaagaacccaaagcatcacaggcgcttagacgatctgctgaacatatgggagaaaaatgggtactacggtgccgattatgtcaacaagctgcgcgaggttgtgaagaactcggctgagtctgggccagtcaagtcattcatcgatgtggagcagaacaacatggacacggtcaaccgatccgtagagaagaatgtcccttttgtaatgccgtctacccacggagattcttctactccctattatgacctcccagccggcaaccttataccacacatcattcccgattcgacggttcccctacggccagataccatcaagcccctacagttcctggctggatcagcggatgagaaattggtgaccgcgcttaaggccttcctcaaggatgtcgatcggatgtacaactcggggcaaacagaacagaaagagaacgaagtagtggacattgatgaaatgggccagacaattatccgagatagctccactggagagattgtgggcggtgacacgtactacggatggtcgcgtgccttttgtcagcagatgaagaaaaggcgggccaagggcagctcgagaaatcgcactcggagtggcagccgcagccgtagcgcctcaaggagacgccggtacagtggcagttcagagagtggcgacagccgatggaggagctcaagctcgcggagtcgatcggctccgcgcagacatgaagctaacgaccggcgttatgactctcggtctcgttctccacgaagatcacggtcccgagaaaggtcatattctccacgcgcaccgtcccctcctcgatatccaccccccgaacaccaaacctcccagtacagcaacacagggcctcacggatttcactcttctcaccctccgcctcccccacctatgcatttcgccccaggcgggaacgtgccacctgtgccaccagtgccacctgcgtttcccccacgaatcgcaccaggc

SEQ ID NO: 20512 - DNA, 297 bp, A.fumigatus
aagaaatttctcaaacgtcatgcctcccaaacgcaaggctacagacagtatggacttagcgacgaaaatatgtctggatggaaggctgaccatcggctaggcggtcggtcaagcagggcttcgaaacgcgcgactcctgtgccggggatcgaggacgtcggcagcagcgatgaatactcagactatgtggatgagaaggacgataatctgaaaggcaagcgctcccatatctgtaacaggcgatgtcatactcctgaccgtcttttatacagatgttgtggaaaaattctcccttga

SEQ ID NO: 20513 - DNA, 585 bp, A.fumigatus
gcatcgcagccttcaggagctcataccggctactacgatgggcttccagatcgatggttattaacgatccatgaagcttactttacaggtgccgctcagcgaccgcccaagcaggtcaagcttgacttcttcttgatgcactgcgtgacttcttcgatattcctttccaaaatcgtcactcttccgtatctggatacccggaccaagctgcgtctgcttgagtggaaaggccgtgcagatctggtgttctacgtatcccggggagttcccgatctgctgctggaagaagtgactacatatgaagctccgaacgactggaagacaatcttctatgagagcagtgtgcacccgcgcgacgacggtcatttgtccaagcttgtcagagctctagcaaatggcgagaaagtctgtcgtccatttgaggctcgagcagaagagctaggacttttgatcaccggtgatatgtggctgaagattgcaaacatgggtaagccagacgcccggatacgccttactcttcggaccatgtttcagggcttcgctgacgatcgtcttcgcaccagctatcaattcaaccaaaggtga

SEQ ID NO: 20514 - DNA, 375 bp, A.fumigatus
aaggcaagcgctcccatatctgtaacaggcgatgtcatactcctgaccgtcttttatacagatgttgtggaaaaattctcccttgagtcttttagcaataagaaaaacccgtctgtttcgaaacatgatcccaactttggttacaaagacttctcctcgctcgccctaaaaccggaccatgcgaaccgtcctttgtggattgatccgctgaaaggcacaatcacgctgggagagtttctccccactggcgcctcaggcccaagactttctgaccacgatcgccgagcccctttcacgcccgacacacttgcacgaataccgcttgactgggaacagtttgtatgcggccgtgtccgtcggcctgcagcccactga

SEQ ID NO: 20515 - DNA, 1530 bp, A.fumigatus
actacgtacgccgaatttccaatcttcaacacgatggcaggcgaagaagaagacatcaacaggacaaacaaccctcctccattcaccgaaagagtccacgaccacaatccgttcgtggcgttccgccgttatgctgatgaacagatctcatccatgttgcaggctgtaatgggccttccatcttcgatttccgctcctcattcaaatcactgggctatctttgctgaagaacacaattgtagagagcccaactaccgccagcgacagactggcgaaggcaaggaaggtgaatatcccgcgagctctgggacgggcgcctctggaaacacagacaatattggtcaggacgataagccacctgcgagctctcggtggccgcggtctgatgatccttggcactcgcttcaccatggacgattcgacaggccctccgatttcttcagccttgactccttcttcgactctttcttcgatcggttctggttcgatgatcacttctcctcccgcttcttccatcccttccatcagccattcttctttaacatgctgaacgacgactccgcaacttggcccctggcatacttgatgttcagtccatactcaccactgcatttggaacgtcaggcatcctatcgagcacacagagagcgaggggtattctcttcactcatatcgtcattgaagccttcttctgaacgcgaccctgccgagccgcagtggcgtgaggcctttgaggatcttcttcgactcgaaaacggaaaaccgatgctggaccgcgaacctaggacaacactggccaagaaggaatctgggactgaatggctgaagggcctggtacaacgcggcagccttggcgatcggtggaagtatgtttcgggaccggatggccagggttggtcagggatcacgctggagagtatcgagccggcagacaaggatccccctcgaactaatgaaagtccgactcagcaaacacaggctgtggccgattggaaagacacaaagtccgcacccgaaaccgaactagacatgtacgaccgatttcttgcagacatcgaaacgcgcgagcgagaattcttcaaaggagcttatgaaagtccccttctgcggtctctcctggagggaagacggcgactaaaggaagagatcgagctgtttgagaaagagggccccagcaaagataccgattcttggatagatcttgtttctgatggcgacaagaacaccgttcctgaaactgcccctcaatcgacctcggggtcatcgaccactggcgagactcgtccaacggcctcggcaacagaacaacagccctacgtagtttccacccggacgtcgacagagcgcattcgtcttcctgatggttcgatccaaacgaagacggtcaagaccaagcggttcgcagatggccgggaagaaacaaatgaatctgtcgaagttatgaacccccctcccacatctcaagattcggttgctggtcaggaggcgcttgagaatcagaagaagagaggctggttttggagagattga

SEQ ID NO: 20516 - DNA, 2181 bp, A.fumigatus
aaggcacaatcacgctgggagagtttctccccactggcgcctcaggcccaagactttctgaccacgatcgccgagcccctttcacgcccgacacacttgcacgaataccgcttgactgggaacagtttgtatgcggccgtgtccgtcggcctgcagcccactgacatcatcaactttcttgatcggttgtccaagacgccactgccagataccgtaaagtcgttcattattgacttcaccaagtcctttgggaagattaaggtggttttgaaacacaaccgcttctttgtcgaaagtacggaccctgcgatgcttcagatgctcctccaagatgaggttattgggcaacaaagagtgaatgggtctgaggggatcatccagcaagcggctccaaaaatgggtgggcttgtgattcccggaaccaaggatgctgctggtgtacaacaaacttcggaggaaaagccggcgaacggcgtcccgggccaagagcgtaaagaggatgatattctcctcgctatccgcgatgatgatgacgacgatgaacaagcccaagtgcatagctttgagattccgaacgaagctgtggagtctgttaaagcgcgttgtcaggccatgggctgccctgcccttgaggagtatgattttcgaaatgacgaaattaacccgactttggatattgatctgaaacccaatgcccggattcggagttaccaggagaagagcttgagtaagatgttcggtaacgggcgtgcaaagagtggcattatcgttctgccatgtggtgcgggaaagacgttggtaggcatcacggctgcctgcacgattaagaagggaacgattgttctctgcacgagctccatgtcggttgtccagtggaggaacgagttcttgcgctggtcaaatattgacccaggtgacattgcaatcttcacctccgacaataaagagaggtttcgtcgatccaccggtatcattgtgtcaacgtactcaatggtatctcaaacaagggctcggtcgcacgatgcccagaagatgatggactggatgcaatcgcgcgaatggggtcttatgattcttgacgaggtgcatgtcgtgccagcatccatgttccggaaggtcacatcggccattgcgacccaaagcaagctgggtttgaccgcgactctgctgcgtgaggatgacaagatcaaggatttgaatttcctgatcggacccaaattgtatgaagccaattggatggaacttgctgagcaaggtcatatcgccaaggtccagtgcgctgaggtgtggtgtccaatgactacggagttctacacggaatacatgagagaaaagtcgcgaaaggccgctttactctacatcatgaaccctcgaaaattccaggcctgccagttcctgattgactaccacgaaaaacgcggcgacaaggtcattgtgttctctgacaacgtgtacgcccttgaacggtatgcgctcaaattgaacaaagcctatatctacggtggaactccccagaatgaacgaatgcggatcttggaaaatttccaacacaatgagcaagtcaacacaattttcctttctaaaattggagacacttcgttggatttgccggaagccacctgtctgatccagatttcctcacattacggttcgcgacgtcaagaagctcaacgactcggccgaattcttcgagctaagcgccgtaatgatgaaggcttcaatgctttcttctattcactcgtgtctaaggacactgatgaaatgttctattcctcgaaacggcaagcattcctcgttgaccaaggatatgcatttaaagtcattactcatctccaaggcattgagaatctggaagggctcgcatatgccacccctgccgagcgccgcgaactattacaggaagtcatgctgcagaacgagacgtctgccgaggtcgaaaatgtcacggacgatctcttctcggagcgctctggcggaccgaagggtagagccaagggtggtgttaagaggagcgcagcgactcttagtggactggctggtggcgaagacatggcctatattgagtacaacaagagtaggaacaagcaattgaaggacaaagcaggccaccacccgctgttcagaaaactggaacgcgagcgcctgaagcggaagaaggaacttcaagatattatgcggtga

SEQ ID NO: 20517 - DNA, 333 bp, A.fumigatus
ctttgtctggttattagattgtctgcagaaacgatacccattccgacaacttcctttacttccacccaagagaattgcaggtacgtcagagcacaggcttgctacaagctctcctcaaagcttactcacctatttccatttgaagtcaatggcactcacctttcagcggattcaaactcgttccttgaaaagcggcgccgaggcctcgtgcggttcaccaacgcgctcgttcgtcatcctgttttgagccaggagcaactcgtggtcatgttcttaacagttcctacggtgtgtatatctgcctgtatcaatggcaacgagaaactgacttag

SEQ ID NO: 20518 - DNA, 600 bp, A.fumigatus
gagctctcggtctggcgcaaacaagccacgatctcggtacaagacgaattcacaggccgagtcctccctcctgatctcgaagactctttgcctgctaatttgacggatatttttgagacggttcgtagtggcgtgaagcggtccgccgaaatctacatcaacttgtgcacactgctcgagcgattagccaaacgtaacgagggtctcgccgcggaccacctacggttttcgctcgcattgcagtccctcacagaagtgactaaggacacatacgctgtggataccaacgatgttcctatactcaacgagggcattatggctacggccaggcacctctccaacagccagagtttgttggaggacgaagccagggcgtgggaaaatggtatactggaggacttaaagttccagcgggactgccttgtcagtgtgagagagatgtttgaccgacgggaccgatatgcacgtaacaacatacctcaactggaacgaaggatcgaaagcaacgagcggaagctggaggaattgcggacacgccctcaaggggcggtgaaacccggagaaattgagaaggtcgaagaatcgatattcaaggtatga

SEQ ID NO: 20519 - DNA, 1149 bp, A.fumigatus
  unsure (1026): Identity of nucleotide sequences at the above locations are unknown.
cgcggttccttccagcccccggggctgaatacaggatgcggtaagactgcctccgtgtacgcagtggccaaggagcttgacttcgaagtattcgagatcaaccctggtaaccgacgaagtgctaaagacatcctggagcgtgtcggtgacatgacacagaatcatcttgtgcataaagtggccgccagtgaggatatttcaaatgatcactcgctgggagtccgcctcgaggctccagcaccagacgaaagcaaacagaacaagttcatggggtttttcacgcctgctgctgggaagaaacccaagaaggacaagaaagccggtcaaaaagattcgcagcaggagagcgattcaaaacgggctcggagtcagaagcagtccctcattcttctagaagaagcggatattctcttcgaggaggataagcagttttggtccggcgttatggccctcgtcagccagtccaaacgtcccatcatcatcacctgcaacgatgaaaacctcgtccctctcgaagaaatcccctttcatgcaattctacggtataagcctccaccccagcgtcctactgtagactaccttctcttgcttgcagcaaacgagggtcatatgctcaagagggaagctgtcgacgacttatacctggctacgggaagggatcttcggagaacgatcatgaatttgaacttttggtgccagatggccatcggaagcgagaagtcagggttagactggataatagatcgatggggaaaaggcgcagagattggtcatgatagtgacccattgcgggtcgtaagtttgaatacatatgaaccctctatgggctggttcagtcgcgatatgctgttggacaacacactcgacagccgcattgagtcaacacgagaattattgcactggtggcaaattagcctgcaagaaacagatgaaatggcggactctagctttgagaatgtgtcctcggcagggacaaccaactttgaccacactaacctcgaacatcttcagaggttgaatgttcantctgactatgccgatctgcggagcgttctggatgtactttgcgctcgatgctctctcgaccagaagcaggtacgttgtgttggcctagaggacaattccaaaactaattaccaatttccatag

SEQ ID NO: 20520 - DNA, 699 bp, A.fumigatus
gactcgattaataacacaatacctgctatgtctgagaagcaaagaactaactatgtcgagggttacccactgctgcaggcagatactgtgcccgattattcttcctttctggccagcattggaagtacattcgaagtcttcatgggtcaaactttccgagaggagcaacaaaaagatatagaagcttctcaggcacggaacgtcttggagactgttgtcgcaccccggcgtgtcaacacatccaaagcgactttcctaacagcgtttgagcctcttaggcgagccgatcatcttttccctccccctccgggtcggctggcgccctcatttgagaatagacttgggcccctctctgaggacctagctccgtatatccgtgctatagtggcgttcgaccttcgtctcgagcactaccgactacagttgagcggtctcctctccgagaacgatggcggaagcaagagaatgcgaaagacaagggcaagtcgagcagccctagaaggaggtagcaaggcagaaacgcgaaaagaacgatggtttccgcctggtacaaacccagcgttggttctagctacagggaataaggagtggcaggatctcttggttcgaaccgggcattttacggtgacctcgataagagagtctaccaaggagtgtagcgatcttgcgtcagagagctcaggtgacggcgggatttaa

SEQ ID NO: 20521 - DNA, 351 bp, A.fumigatus
cgcatcgcgcactcgagattatccataatgtccttatttgggacgtcgccagatgatccctctatgggtgattcggttcaccagaggtccaggtcttcgctttttgcagatgagccattgcccggtggagctggagctggcaactccgccaacctgggctcgtcctccctcttcgccgatgacgacgggttccagtcgagctcgccctggaatagcaacgcgaacaaacgagccgcccgacacgagctcgtgaagactttgctgcccgacgcggatgtgccagagagttatattgacgcttatgaccttgtgctgaatgaggggatcgtgtcgggggcgtcgtgggcttga

SEQ ID NO: 20522 - DNA, 930 bp, A.fumigatus
acgtttgctaatgcccttgtagagcttccgctaccgaaaagttcctaccttgacagactgcgcgacaggcaacagccctctgcaccttctcatcccgaagagcggcccaccactccgccccctcctcccgcggccataaatgatccgccttccgcgcgctcgcgacagtccagagaaactttgggtggtttggatgctgatccatggggtagcccccagctacaccgtggtcataaccatgtgcaaaccgaacccgagcctccagtcctcaacggcttcggaagtgtgcgatcggcgaccaatgcctggtctagcggggctggcgaggatgagacacaacatgaagtaccgagtggtctccgtgccaacgggcggacagacggtgcgccctccaccagttccggatctggatggggagggagttatcgcaatacaacagctggtgatggctttggcggaccgatccgagctggacttggaaacctcggtgcccccagtagtgggcaggaagagcccaatgcccgacggcgactcggcatcggcatctctacgagttcacaagtggaggagactgtgacagtcaacctgctccctgagaaggagggcatgttcatgtttcagcatcgcaactacgaggtgaaatcgtctcggagaggtagcacagtaattcgacgatacagtgactttgtctggttattagattgtctgcagaaacgatacccattccgacaacttcctttacttccacccaagagaattgcaggtacgtcagagcacaggcttgctacaagctctcctcaaagcttactcacctatttccatttgaagtcaatggcactcacctttcagcggattcaaactcgttccttgaaaagcggcgccgaggcctcgtgcggttcaccaacgcgctcgttcgtcatcctgttttga

SEQ ID NO: 20523 - DNA, 234 bp, A.fumigatus
cacaatgctttgctggcactgcaggacaaggaatcaattgtgcagcaacatgcgagaggggtcttcatcaaagagtgcatccgagatgagctggtacatttccagcggagtcagtatcacatcagccgacttcatcaggattggagccaggagcgagtgaaatactccgagctgcaggccgacaattggcggtcattgagtgatcaggtggaaggaatgcctttgggcgagtga

SEQ ID NO: 20524 - DNA, 3264 bp, A.fumigatus
  unsure (1531): Identity of nucleotide sequences at the above locations are unknown.
gtgaatatggcgtggcatcacttggacatcgataagcctcacctggcgtacatgatcctcggcggcttcacggggctgttcatgctttgctcgctcttcgtcaaggagaaactatacattggtgaagcaactgtggccacgctgtgtggtatcatctttggtcctcatgccgccaatctgttcaaccctgccgaatggggcaacgtcgacaaaatcactctcgaatgttcgcgcattgtcctcgtcgttcagtgcttcgccgtcggcgtcgaattgcccaaagcgtacatggaacgtcattggaaatctgttagtcttttgctcgttcctgtgatgacttggggctggttggtcactagtttgttcatttggtggatggtacctcctttcaactggctagagagtctcgtatgcgccgcttgtgtgacagctaccgaccccgtcttggcctcttcggttgttggtaagggtaaattcgccaagcgagttcccaaacatctgcgagaccttctgtccgccgagtccggctgcaacgacggcatggcctttccgtttatctacctggggttctacatcctgcgctatcgccccgatgcaggaaaggtgtcactcaactggttctgtgtgacgattctctatgagtgtatctttggcgcaatctatggatttctcattggatatattgctcgccatgccatcaagttcgccgagcgtaagcagttgattgatcgggagagtttcctagtcttctatttcgtgctggccgtgttctgcgccggctctggaagtttgctgggtatggatgaccttctgataggctttgcttgcggcgtcggtttcagcaacgacggctggttcactgagaagaccgaggaatctcacgtgtccaacgtcattgatttgcttctcaatctggcatacttcgtctatttcggatctatcatcccctgggaggactacaacaacccggagatcggcctcgtgccctggaggctcgtagtcatcgcgatcctggtcatcttcttccgccggattccgatcatgatgttattgaaaccagtcatcccggacgtcaaaacgtggcgtgaggctcttttcgcgggccatttcggacccatcggtgtcggtgccatcttcgccgcaattctaaccagggctgaactcgaaaccgatagcacccagccattgtcggagaaagagctgccccaaccagggtcacccgactattatatagtgcagctgatctggcccatcaccacctttatggttatctcctccattttggtccacggttcgtcgatcgccgtctttacccttggaaagcgtatcaataccttgaccgtcacgctgtcgtacacgaccgccaacgaagagggtccctcttggatgaaccgactacctcgcgtacagtcgttggccaaagggtcaatgtccttccgcaagaccgacggagacgacttgggtgattcgtccactgagccggaattccctcctggaactctgccgccgattggcgttcccgggaactttntgcgacgggttcgtgaggaagagtccgagacccccaccggccgaccctctagccgcaagactcgaaggcgccgtaggcgggatgatggagctggaggtccgatcagccagtcggccattatgcctcaaaggccggccgaggctggtgaggagactgaaaaggctggtggggaggctgaaaaggctggtgaggaggctgagaaatcaaaggaggaagcccaggagcgagagaagattgaacggggaggatctccaccgacccacgagcgtgatcggtttggccgggaacctgtcgtagaggtgtacctggaaggccatacgatgatcatcgaagacgaagaaggcaatgtcttgaagacagaagatattagtcataaatcgcccgaggaacggcaacagcacgttgaagaacaaaagcggcagctgcagaaggataagtcgggcgaattgtccaaatcccgaagccagccacatgagaagactgaaggggaacaaatccaacatgcagtgggagatgcggccggaccctcgctaggaaaggctcgcaaacagttcggcaaatgggtcggctggggcaaaggtcgtggcgaacaagcggaaagcaaggaggcgaagaaagctgcggagaagaaatcaaccgaatccggcaagccggccaagcccaaagctcgttcggctcacgcgtatcaattcggcaataccatcatcgtcgaggatgaggatggcgaagtcatcaaaaagtactccattcccgccgctggcaaggttgaaggcggagcccctggccgccgcggcctaggacgaatgggaacctggtttggtaaagacggcgaggcggaaacctcgcaagctgcacagaacaagaagacaagcaaggacgagtggctagcggacgatggcctgcggttcaccctggccaacgacgacgaagtcagcaagcgaggtgtcggtcacaagggccgtcgcatgacgaaacatgagtttgccgagcagatcaagaacctggaccctaaggctcgtcgccagttggtcgaggagactgacgttcctgagcgtgtgaagaatgtggctcgggacgaggccgaacagcgagaatcttcccgagcacaacctgttgaaatgccggtatcacctggcacacaggttgaaacccgcggcatcgaccagttcgactctgacagcgagaccaccggcgatgaatcggtacaggacattcccgggcccgacgtggctgcttcggtcgctcgggtcactcgaggctcggctgcacaggagcgacgcaatcaactggagccgtcggactcgccttccaggcatcgtccgcggtcgagaagagactccgaagacgatggtaccgagcggatcccgccagctcgcctccgagaagcagccggtcttgcgcctcgcccccaagaagccgacttcgacgacacaggtgaaacacctgcagagcgtcgtcgtcgtctggcggccctgggagaattgcacaacgactcggactctgatgacccggaggccgcagtcgaagacacggacagcgatgacaataatgaattccgccaagtgcgaggaagagttcagtttgcggatggctctcgggcatctccgcgaagagacgatgctggaattgtaagcggacttccgtcggcgtcaccggaccaatctcaatccccgggtcgtaggggacaccgtacacgcatttcatggggtggagagaaaggtcgcgagagttga

SEQ ID NO: 20525 - DNA, 840 bp, A.fumigatus
ccacaagaactacaacagggcatctactttgtcgttcccgatgaacatatcgacaaagcacgcgacatcctggtggaagccggcttccccccctgccagctggggaagttttgcggtttcgattggcctaaatccttccatgggattccctctgcgcgcttcaacatcgtggaccaaggccccttgaactacagcagacctgagttatacggcccagatccccgggagtggtacagcctggaactttacaagaagtctgagctgatgtggggagcgcctgagatcccacttggcccacctgctccgaacaaccccgactactggacgatcaatgatgagcgtcttccagaagtcgccaggggactccatcaagtccgtgtggttgaggcggattatccagttaagatcccttcgccagcgcgctatgcggagatgctgacccttctgtacttccgggacaatcatccggaggaaactttcagagggagcttctgggaggttttgatgatcgacatgcaaacggtgctgaagaagcaccgcctctttactttaagtgatcttccgcctcgtactcgcagctggtggaaaattctgaccaaaaacatacgcgaaagaacgcatggggatgccgaggaaaggtttggcgacgagatgaagaaggcaggcgaagtgcccgagaaaagtccctggccgtcacaacgtacaatgcccgatggatggcgtgaagagcttaaacggttggaggaggaagaggagaggagaaagaagaggaaggaggagcaggaggaagagcagctgaggaagaacaaagaaaaggtgaaagaggagcagaatgcgtga

SEQ ID NO: 20526 - DNA, 405 bp, A.fumigatus
tcgtctgtactcaccctaaggatagaaacgaagcaacaagtaaagaaggaagcaaatgacaggtcaaaaaaacagacccgagcaagcacaagcggcgacaagaaaggacaagagaggacaagagaggacaagagaggacaagagaggacaagagaggacaagagaggacaagagaggacaagagaggacaagagaggacaagagaggacaagagaggacaagagaggacaagagaggacaagagaggacaagagaggacaagagaggacaagagacagagaatggaggagaggaaagacaaagacgctgggcgcagacgcaactcaccacgaagcgggccaattcaaggacctagagccaagacgacaacgacggaacccaagaccacaaccgggaaactcataa

SEQ ID NO: 20527 - DNA, 261 bp, A.fumigatus
ataaacggaaaggccatgccgtcgttgcagccggactcggcggacagaaggtctcgcagatgtttgggaactcgcttggcgaatttacccttaccaacaaccgaagaggccaagacggggtcggtagctgtcacacaagcggcgcatacgagactctctagccagttgaaaggaggtaccatccaccaaatgaacaaactagtgaccaaccagccccaagtcatcacaggaacgagcaaaagactaacagatttccaatga

SEQ ID NO: 20528 - DNA, 3417 bp, A.fumigatus
cactactcgagtgacgagccggactggagttccgtcaaaccggtgtccgagacattcaagcctattctctgtgcgactaattcctcaaagaccatcaagcaggagaagaagctttggaacactgctgaactgctccctgagttcctcgatatcgctgcccgctccgttcccagagacacctttcgccgacagacacatgaggctccctggttggagaccctctttgttgcggttgccgagctggcgttctcgattgtcaaacaagagagttcgggttcatcggccgcctacgtttccgagtttgtcgtcgttctggaacagctgttccgtattgtcctaaaccggaacgtgcagctctctctacacacacttctcacccatgccgcatacacggggctactcaaggagggtctgtccccagttgaatggggcttgacggccttgctaattgaactgggagcggatatcttcttaccgaattctggcctcaaggattcaaccaagttgctgagggctcttcttgagaagatacttcttcattggcgcagtggcgtgcaccccacagacagcaattacgatacgatcaagaacgggatagtgatccccttgctgcgcgcgttccttgccgcaagagatcttccaactttcatgcaattatggtacgagcagttgatcgacgtcgaagaggcgcgcctcgtggatagcagtttgagtctcttctctatttgggaggacgatgatttgtgtaacgtttatagcgatatcttacgaagtcccctcacacacgccactgctgatgcgcagatgcgagcagctgcagtggaaataagaggcgaggacgggaagatttcgtctgcgcctggtgcttttgctcaattcgtcctcttagaagctggtctcaggaaccgagccctcggtgctgcgggcgcgagagaagagttgaactctattcttggcaccgtgacggcgacgctgtcctcaaagcagagtttccactggcgttggcgtttgtggcgactggctcgcaatatactcgcgaataatgtgcaatcagcggaggatccgctcatggtcgcgacttggaatctaaccgatgcggcggtaaattcaatccagcgtaaccataaaaatcgaatgaagcatacatgctctgcattggaatcgttcgaagcgtatcaattcgcgctggctgctgtcaaggaaacaaccgacacaggtcgtttggagagcttccacgtcctaacaagcgaggttaaggactatatcggtacaatcaccaagcaagataccttgggatccctagcttcgccttggaacggtcgggttgaaacattggattcatcagtgtctcttgccttaggctacttccttacgctcgtcagaaaccctgatatttggcctcagctgaagactgatgataggcgtgctcttttcgagaacattctcggcctagcagcgtcacagtctcgattgccctctgcgagcttggagacttacccgctaaatgcaagatttgtccaggcatggacctcagtcgtctgtcatgaatacctactcaactcgccggcaatcgctgtggatctcgttcatgtgctttccaagcagctgaaagaggataaggagtatcgcaagctctatattgaaagccttcagagagtgcccggaccattaatcatgcggcaccagagaggtgtgctactggatctgcttcagggaattcttgtccaggaggatgacatggcggagatcaagctcggactcttgtcgttgatggccaagctggccgatatgcccaagaccgcggcgacttgcacgagtgattgggagcccatgttcaccgcagccaaagccgttacgttgcaggggactgaaaacgatctacatgttatgaaagcgttccgcaatctacatcgggcagtgctatccaagctgcttgttctgtcggaggaagatcggaataaactgttcaaaaagatgtatcgcaaggtttcagccaaggtcctaaagttgaaatttcttgatcacgactcaatggagtgcttcttcttcagaatttcactatcgcaattctggctccatcgagaacagctttctggcgcatttgttgaacaggagctcgattcctgccgccggtatatgtttcacttgattgtggctgaagttcggtctgtcaaggatcagttgaagaagaagaagattgaggaaaccgttacgttgatcaagatccttgatgccctggaggactttgaggacctggtggtggatagcattgaggttgagaaattcttgacaaagatcgagagctacgtcgaaaggtctatggactcgcgctcttcgttgcggaggctcataagacgccgtgtcttcactggtcgacgatcggacagaagcatcacaggttctgttgttcaatgcgctgaaacactttccctcaagcatatgtttggcgaggagcagcaacttttcatccgagcgactacagagaagttcaagtccatgagtgtggatgaagtgaccgcggtgattcgagagttacgcgagcttggattcgatggtgatcgtgccccttatcacctacttgcagctggcgttgcagtcgcttcactaccgtctaccgaagacaaggagacctctgcagcaaaagagttgtcactcctatgcacggcagttacagggtctctctcgcagagtacttccattgaacattttactttcgccacagagtgtctggacattctgcttcgcaaccacacccgttgcatttcgcaatggaacatcgacagcctcctggccgctattgctgtatgtgcctcgaaagctggaccccgcatcaacccggagtatgctgcaacaatctacgtccggctctgtaagctgatgggagtgctgctgggtcttcaccgtcagaaactcggcgggcgtttccacttgatccttccggccatgcagcggcttttgaactgcctcttcgcccgctccaggaagagaagtcgatccatgctttccgcaaaggggcacacacagcagccgtactggcttgcaccattgcaggcttcacatgctgtccatttcacccgtctgctcacctcgctctgcgatcccactgtctctgccgtctcacgacccacacaatccgggggcaaccgtgacgctctcacggaccagaccaagaaagccaagcgcattgccggtcagtacttgcagtacttgatcatggagtacgcgcagagttcactccgcggctccttggtgccggaagtgaaagcagcaatccttcctggtctctatgccgttctggacgtgatgtcgcgggagaccatgcgagccatgaatgcaggcctggatgtttcgggacgggcaatcttcaagggtctctatgatgactatgtgaagtttggtaaatggaacaagggttga

SEQ ID NO: 20529 - DNA, 285 bp, A.fumigatus
aacacttggatgatctcctcttcgatgattgtcgacggtctttcatggtggcagtcctggatctgcgtttgggtcggatacttcatcgcagccatctttatctgtcttactggtcgcatcggtgcgaaataccatgttccatttcctgtcgctgtacgatctagtttcggtatctggggttccttttggccggttctgaaccgtgccgttatggcggtcatctggtacggagtgcagtcatacattggaggtgagtgtgttttggtgtcgaccagtaagcgttag

SEQ ID NO: 20530 - DNA, 795 bp, A.fumigatus
ttgttgaccaggcaatgtgtcactgtgatgattgaggccatctggcctagctatgcccatcttcacaactcccttcccgccagcgccggtgtcgagaccaaggacttcgtcagctttttccttttctggctcctatcattacctgctctttggttcccaatccataagattagacatctgttcaccgccaaggcgatttactctcctattgccgccatagctttcttcgcttggtcgattgctcgcgcaaatggtatcggaccggttgtccatcagccggctacagtccacgggagcactcttgcctgggcgatcgtgaaggcaatcatgagctgcctaggaaacttcgccgctctcatcatgaatgatcccgacttctcgagatttgcgagaaagccaaaggatgcattgtggtcgcaactgttgacaatccccattggttttggtatcacttcgtttatcggcatcatcgcatcctcagcctccgcagtcatctacaacactgaccctgtgtggaatccgcttgacctgctaagaatgttcttggatggagctagctctggtgaaagattcggcatctttgtgattgccactgggtttgccctcgcacagctgggaacaaacatttcagccaactccgtctctgctggtaccgacttgactgctttgctcccgcgttatctcaacatccggcgtggtagctatatctgcgctgcagttggcttggctatgtgtccggtatgccgctcttgctcatctgtacttggctgcgttaggacaaggactgacatctga

SEQ ID NO: 20531 - DNA, 525 bp, A.fumigatus
tggaaccttgtgtcttcgtccaaccagttcaccacatatctctcggcctattcgatcttcttgtctgccattgccggtcccatgatctgtgactactatctcaaccgcaaaggctaccttcaggtcaaagatctctatagcgccagcaagggagggccatattacttcgtcttcggattctcctggcatgcgtatgcctcgtatctctcgggtatccttgtcaatatcgtcggctttgcgggcgctgtcggtcgtaccgtccccctgggggctcagtatatctacaacatcaattacttttcgggcttcttcgtctccgccgtgatgtactatatcctcacccgcatctttcctttgcctgcatccagcgacagatggaacgaggtggactccgacgatgaggtgtcttatggacaggaagtggacgcggatgacgtgcacacgccagggaaagtgcgctcgctggataaggactcggattgggatcggaaaggagccaagattgcctcgggggcaatggtttga

SEQ ID NO: 20532 - DNA, 489 bp, A.fumigatus
gtcacgcttgatggtgaggaatcgagtttcgagcatttgaacggctaccgcaatttgcaatcgaatgacaaccctgatgccactccgttcaactacaacttgaccaatttcagccatttcggccatgaaaaccactcggaggccatacacaacacggacaacaccagtccaaatggcagctcgccttctacagagtatccctcagagcaacatctaatggtaccctccgaatattacaccatcgaatatcctgtgcaactccccaatgcttgctcggatgtgactggcagttgcctctgcggcaacgattgtgcctgcgttggctgtcttacacatagtggccacaatggctttgcggtcgaatcctcagcgatcgagaacaacaatttgtctccatcgagtccttctgcaaagcatgagagcgtcggctcccctcttgtacctgggcacacacatgccaccgttcaatcaccaaacccaatgctctag

SEQ ID NO: 20533 - DNA, 2049 bp, A.fumigatus
actgcacacatcgccaccatggttctcgcaaaatccaaaaactcagtcgggttgggaaataccctcatgaaggataggttcggcaagggcaaagcatcaaaccagaagaaagtatcgcacaatgcggctattactcgtaccgcgcaggatggcagtacatatattaccaatgctgccaaagaagcgtcgtgggtgaagatgcgcagtatcacagagcaggccgccctcgatgagtttcttagcactgccgagctggcgggcaccgactttactgcggagaagatgagcaatatcaagatcattcactcggatcaaaagaacccttaccttctctccgcgtcagaggagaagtcggccagaaagaagcatcagcagaataaggggaagttgaccgtgccgagaagaccaaaatgggatgccacgacgaccagggaccagttggaggcgatggaaaaagagagttttctagagtggcgaagaggacttgctgagcttcaggagaacaacgaccttctaatgacaccctttgagcggaacttggaggtctggcgccagctatggcgtgtcattgaacgttcggacgtggtcgtacagattgtcgatgctcggaatccattgatgtttcgctcggaggatcttgaaaactacgtgaaggagatcgaccccaagaagcagaaccttttgcttgtcaacaaggcggatatgctcactgagaaacaacgagagatgtgggctgattactttgagcgcaacaatatcaactttcgatttttctcggcccatctggccaaggagcggaacgaggcccggcttctggaagaagaatcagacagtgagagtgaggaaaaggaggctgaggatctcgccaatgcgacaagctcgatgaacatcaatgatccacaagatgccaagaatgcatcaattgaagatggccaacccgagcacgatggaggactcaagcttcccgaataccgcaaatctcggagaacggatattctcgatgtggaggagctggaagaacttttcctgtccagcactccggacacacttccggatagtggcaatggcgcgggacagcgcaaacagaagacaacaatcggtctggtcggttaccccaacgtaggcaagtccagtaccatcaacgccctccttggagcgaagaaggtgtctgtctccgctacaccaggaaagacgaaacacttccagacactctacctgtcgccggagatcatgctctgcgattgccccggtctggtcttccccaatttcgctacaaccaaggccgagttggtggtgaatggtgtcctccccatcgaccagcagcgcgaattcactggtccagctggtctggttgcgcagcgtatccccaagcacttcctggaggatgtctatggcgttaaaatccacactcggccgctggaagaaagcggcacgggcatccccagcgcccatgatctcctacgagcctacgctagagctcgtggttttgctactaccggccaaggccagcccgacgagtcgcgcgcggcccgctatgtactgaaggactacgtcaacggtaaactactcttctgccaccctccccccgtcccagacggtgaagagcccattgatccgctcgagtacaaccgcgagctgtacgacaccgcccacctcccagctcgccgacaggcaatgctggcaagaaccgcccaggccaacgcaggcggcgaggaattcgacgacgaagcggagcttctgtccgtgggctcatcctccaaacaaggcagggctgttgaggggtcacggtcgcggaatttagactcaggtttcttcggccccggcgcgaagggctcagccggacggctcaccctgcccttcaacgcccaatacaccgaacagggccagcaaatccgtaagcagctgaccggccgcaaggagcgactaatgattgcgctggaacgaggagtaaatgtgtcggaggtgcgcggcaactcgaagaagcacttcaagggcaacaagaagagggccaaggccaagcgcacgaaagcggaagatgacgactactaa

SEQ ID NO: 20534 - DNA, 570 bp, A.fumigatus
atgactcttgggcttctggaatccattagccaacagcaaccgctccgcctcctccttctgatacttgagcttagcgacaatggcgtcctggcgcgacttgttctcgcgtctaccaagctgctgcaggtggacctcatcgggtccgtcggcgatgcgcagcgtccggatcatggcccacagattggccaggggcgtatcctggcagacaccggcggcgccgtaggcctggacagcgcggtcgatgacggtcagggcggtctgggggacgaggaccttggcctgggcgatctccttgagagcggacttggcgtcgccctggtcgatcttgatggcggcgttaaggacgatgaggcgggcggcgtcgatctcgatgcgggacttggcgatccactcgaggatgacgccgtgggcggacagcggcttgccgaaggtcttcttgcggtcgtcgttgacacgggcgatgagccactcgagggccttttcggcggcgccgatggtgcgcatcgcgtggtggatgcgtccgggccccaaccggccctggataatctcgaagccgcggccctctcctag

SEQ ID NO: 20535 - DNA, 864 bp, A.fumigatus
cttccacctcccttgcaacagcacctctctctcagtctgcagcctccaatcggtgagaacggcgggcagccgaggttcaaaaggagtgctcggctgcttctccgcaaactgcgagtactccgcaaatcacctccatctcgaccctcgtatgatcctgtcagtctcaccctcttgctcaactttataatcgtccacttcccctgtttattgcgtctggatttatattctctagcccacagcagattgctagattcccttcgtttttcgtcgattcactacatacacgacatgtccgcctccacaaggattccccccatcgctcagccctttgtgagcgaccgggcaaagagggtcctcgacctggtacgttgtctcttcacaatatcgcctggatacaagttttctaacacttgccgcggtgttcaggttgaagaattcgtcgagaaagactgcatcccagccgaagctgtattccaggcccagctcggcgaaggcgagaagagatggcagactaacccggctgtgctagaggagctcaaagccaaggccaggaagctgggcctgtggaacatgttcctgcccaagaatcacttttcccagggtgctgggttcagtaacctggagtatggtctgatggccgagtatctcggcaagagcaaacttgcttctgaggtgggtgacttgagtcgggtacttgcaaagagtgatgatgggggtgctgactggtggattttcaggcgacgaataactctgcccctgataccggtaacatggaggtgctggccaagtatggcaatgaggcgcagaagaagcagtggcttgctcctctgctcgacggcaagatccgctcggctttcctcatga

SEQ ID NO: 20536 - DNA, 336 bp, A.fumigatus
  unsure (55),(163),(277): Identity of nucleotide sequences at the above locations are unknown.
ttggcggattttgcaaccgacgacccgcgaggtgtttcctgcaagcgccaaccgngagctattcggacccccttcagttcaaaccggcatttgcacacccaaggggattctttcccgtgggccaaagtttggcaaaccagccccccacaagccatccgccagntgtttgttattcccgacaacgagagatactccgaggactttttccttgcctcggaaactgctggtacttcctggttctccgttcatcagggcactccatctatggcatccgttntggactccgcattgggtgagtctttcaagttttattgcattccgtccggttgcccctag

SEQ ID NO: 20537 - DNA, 2385 bp, A.fumigatus
ttcggtgggcggttctgcatcgagacccgctggagtaggtcaggcattacggtcgctgggggaccttctgttacgatgtcttctatttcaagcaattcgccgccgactagcaaggccagccatacggctgtacaacaacattctggcaaggagcaggagcaggacacggattcccccctcgataatgccaagtttctctcctttgaagattggaagaagcagaatctggcaaaggttggccagtcggcggagaatgtggggggcaaccggcggagtggcgtgacagggaacgagagccgacgacggcctacggggatcagcaacgctctagactctcttggagaagacgcggagattgaacttgactttggtggattcggtgctgacgcgccagaggccgcacggccgccgtcatttggctcgggggtgcaggtggggaagagcgcagggtcggtggacagcaaaactggtggagatgcgaatggcccgtctcctgggatgatacggtcaggcagctcgcgtaggaaagacgctgggactacgtgcaaggagcgtttcaattatgcctcctttgactgcgctgctacagtgctcaagaccaaccccgagtgtcagggctcgtcttctgtgctgatcgagaataaagacagctacatgcttaatgagtgtcgggctaaaaataagttcctgattctcgagctgtgcgacgatatcttggtagacaccgtggttctcgcgaactacgagttcttcagttccatctttcataccttccgggtcagcgtctcggatcgatacccggccaaaccggaccagtggagagaactgggggtttttgaagccaggaatacccgcgaagttcaagctttcgcggtagagaacccgctgatctgggctcgatatctgaagattgagtttctgacgcactatggaaacgagttctactgccccctgagtctcatacgcgtccatggaacgactatgctggaggaatacaagcatgatggcgaggctagtcgagttgacgatgagattgttgacgagacattggagccggaccatgctgtcactgcagcgattgcagagccatccgaaaattcgtctgatcttggtgcggagaatcgtgaaagcatgcgcaggaaactgcaggatggactccaggatgcttgcccgaacccagcacaagggctggagaggcttctggcaaattacctagattcagagatatgcagtgtgcaggctagaccgacgagaactgctggccaagaaagagctgacgcagctgttcaacatgactcgccttcgacggacaccacgccaccgggaccggaggcctccgggcctattgtgcccggcgcaggtaatggtaccaaattcgcacctgatgctcgacgagctgctgggcagtctggagctgacggtaaccctttacccgcttcgatggcaaccatgtctgagcctgtccagcatgacaccacgtcggaagcagaccagaaatctacagcctcatcccaggaagaacaagttccttcagtagactcagccaagttctctgcaactcaaccaccatcacccaatccgaccacgcaggagtcgttcttcaaatctgtcaacaagcgactgcaaatgctggaatcgaattcgactttgtctcttctgtatattgaggagcagtcgcggatcctgcgtgatgcatttagtaaagtcgagaagcgtcagctgtcgaaaacatctaccttcctggaaaatctgaacgtgactgttatgaacgaactgagacagttccgcgaacagtatgatcaggtttggaagacggttgcgctggagtttgaaactcagcgcatccaatatcaccaggagatattctccttaagtgcgcagctgggtgtcctcgcagatgaacttgtcttccagaagcgagtcgctgtaattcaaagcatcatggtcttcttctgctttggcttggtcttgttctctcggggtgcaatgagcagctatatggagttcccaagcgtgcaaaacatggtgtctcgatcctacagtttacgatcgtcatctccaccattcagctcgccctccatgagtccgagttcaaccaggccgtcgttcacatatcgaagtcgccacaggaggaatggtacggacgacacgcaggatagtgcgccgagccccactatctcatactcgccgccaacgccaaactcagagacatcagtaccattagagtcgatagagaaacaggaatcaccaccatcccctggcgatcttgaattgccagacatcgaacttccccagttccggtcgcaaagcagccctcctgtcttgaagagtggcgaagacagcgacggcgaaatttcagagacatccggatccatggaggtgtga

SEQ ID NO: 20538 - DNA, 198 bp, A.fumigatus
agcgcatctgaaaaatccgcacctttgtatacaatggactccacacccaccgcccctctgaccgaccggtcaacaaacacccacctcgctgcgaaccaggacaaagtgaacgatctcaaaaccgcggcggcgaatctgaactcgatggagtaccatcggtcagttctgcagggtaaactgcagaacgaagataagtga

SEQ ID NO: 20539 - DNA, 810 bp, A.fumigatus
aaatggtggtcctccggcgctggtgacccccgttgcgcaatctacctggtcatgggcaagtccgacccgaccaacccagacccctaccgccaacagtctgtcatcctcgtgcccgccggtcttcccggcatcaccgtgcaccggatgctgaccgtatatggctacgatgacgccccgcacggccacggccacatctccttcaacaacgtgcgcgtgcccgtctcgaacattgtcctaggagagggccgcggcttcgagattatccagggccggttggggcccggacgcatccaccacgcgatgcgcaccatcggcgccgccgaaaaggccctcgagtggctcatcgcccgtgtcaacgacgaccgcaagaagaccttcggcaagccgctgtccgcccacggcgtcatcctcgagtggatcgccaagtcccgcatcgagatcgacgccgcccgcctcatcgtccttaacgccgccatcaagatcgaccagggcgacgccaagtccgctctcaaggagatcgcccaggccaaggtcctcgtcccccagaccgccctgaccgtcatcgaccgcgctgtccaggcctacggcgccgccggtgtctgccaggatacgcccctggccaatctgtgggccatgatccggacgctgcgcatcgccgacggacccgatgaggtccacctgcagcagcttggtagacgcgagaacaagtcgcgccaggacgccattgtcgctaagctcaagtatcagaaggaggaggcggagcggttgctgttggctaatggattccagaagcccaagagtcatctatga

SEQ ID NO: 20540 - DNA, 1251 bp, A.fumigatus
  unsure (225),(333),(447): Identity of nucleotide sequences at the above locations are unknown.
gggatccccagtttttttttgagaaatttttcacccaatagttcccagggaaactttggaaaatctggaggaattcccttggccaataaatcccggagaaagcgtttcgcttggggggttccgaagagcccctggggggggtgtttcccttcaccacagaggaggggtaattggcggattttgcaaccgacgacccgcgaggtgtttcctgcaagcgccaaccgngagctattcggacccccttcagttcaaaccggcatttgcacacccaaggggattctttcccgtgggccaaagtttggcaaaccagccccccacaagccatccgccagntgtttgttattcccgacaacgagagatactccgaggactttttccttgcctcggaaactgctggtacttcctggttctccgttcatcagggcactccatctatggcatccgttntggactccgcattgggtgagtctttcaagttttattgcattccgtccggttgcccctaggtacccgcctccttcggatcctgtgccaatcacaggttctcttccgaaccatgcagctaaaccgataccttctctgtccatggtgtttgggcggaacaagaacgaccagatttcgaagagctggagcgacctttgggatgaagatgaggaattcgaacacgaggatgttgtctttcaagagagacatgaggcaaattcacgtagctggagccatgagagcagcagcatggacgttcctactccctcagctggacttcgtgagtccaagtcgtcctcgcttctcaatgctcggtcgtctgcgcaacagaccccatccaccaagcctgtcaatattgctactaagtcgactctcgacgatgttggtactcctgctgtgatttcagctcctcgcttctcgcaaagctcacccaagaagtcgaatctggacaagtgggctgcgctgggcgacagaagaagaaactacaaacctgcagaaaaatctttcggtcagccgaagtcttcaattaacatgagttggcgaaaggattggggccttggctcgtccggattcgactacggatcttgggccaagaaagataacctcgcgcatcaggaccgtcgccgccgcccgttcctggagaagggtaggcgccgtgatggcgtggaatctcctaaggccgtcaaacctgtcactcccagcagttacgatggaagcattgacgaagatcttgatcttgtgggcggctggcacgatcttcacctttaa

SEQ ID NO: 20541 - DNA, 438 bp, A.fumigatus
ctggtggattttcaggcgacgaataactctgcccctgataccggtaacatggaggtgctggccaagtatggcaatgaggcgcagaagaagcagtggcttgctcctctgctcgacggcaagatccgctcggctttcctcatgactgagcctgatgttgcgtcgagtgatgccacaaacattgagctgaacatccggcgcgaaggcaatgagtacgttctcaacggatcagtatgtagacgtttctctcccttctccctagagcatccatactcaccaattgccgatagaaatggtggtcctccggcgctggtgacccccgttgcgcaatctacctggtcatgggcaagtccgacccgaccaacccagacccctaccgccaacagtctgtcatcctcgtgcccgccggtcttcccggcatcaccgtgcaccggatgctga

SEQ ID NO: 20542 - DNA, 636 bp, A.fumigatus
tgctcgccagttacgaggctaactctcgagcacagtgataagaaaaatgctaccacttaccagctgtttcaccgatctcaaaatgatcctttgattcacgaccccgaagccgacgatcgtgtcctgcaccctgtgtctgggccgtcgcttccaatttcagaaggcaagaagcgcagcaaaaatctttcggatctgagcagcgaattcggatcggactccattaggcacaatgagggcgaggctgcgaactatggcatctacttcgatgacacgaaatatgactacatgcagcacttgcgagagctgggagcaggtggcggtgagtcatacttcgtggaggctacgagcaagggaaagagcaaggccaaggggatgaagctggaagatgccctgaagcaacaaatgactctggatgatacgaggagcgagtttggcgccggcagtgtctacggatctgaatatacctcggacctgcgttcgaccacttcatcatactctcgcaaaccaacatatcaggatcagcaagacgtccccgatgcgattgcaggtttcaagcctgatatggatccccgtctccgcgaagtgctcgaggcgcttgaagacgaggaatatgtcgatccggatgatgaggaggat

SEQ ID NO: 20543 - DNA, 357 bp, A.fumigatus
tgtacgccgaagacctgtcccaaccataatgatatcgttgctaactgtgcgttgcagtcatttacggtctccgtagacccataccaccatgtgaaacgcttggatctcaaggcattcgatgagaccccaatgccgccaatgtatctcatttttagacctcctcagatgctacccacaactaccttaaacccggtcagctcggagacagggaagagtaagcgccatattgcccgagatatagggtctcctgtgggcatagacactctgcggagcgatcacatcggcgacccggaccgatggctatggtttggtattctgatgactgctatggggggaattgctttgatctattcttga

SEQ ID NO: 20544 - DNA, 687 bp, A.fumigatus
tcgccttggttcttctttcggctggctgacagtcccttcgcagaaggtttctcttctgattacgacatccccacctcgccgtcatgggcgcccttccaaaaagtgaagatgtataatatccctgaccagatcttcgatcagtataatcgagcacaggtttcgacaagtatgggactcttcgccgagttgaatcacgcctgggttgctattgacaacgcgctctacatctgggactatacgcaccccaatccgcaactggtcgggtttgaagaccagcccaatagtatcaatgccgtcaagctggcgaagcctcgcgccggtgtgttcctgccttcaatcacccaccttcttgttatatcaactactgcggaggtcattctgctgggaatgggttgtgaaacaacgccggggggtgcgcgacaagtcagcttgtatcagaccggcatgtcagtatctattcgtggtttggacatccatgtgatcgcttcgtcggacgcgaccggccgtatcttcttcggcggctctactgacaacgatgtctatgagctcacatatcaacaggaggaacggtggttccaggggcagatgctccaaagtcaaccataccagttcgcgcatcgcggctttcacgcccagtctgagtttcactcagaagactacggagacggtggagcagatggagattga

SEQ ID NO: 20545 - DNA, 264 bp, A.fumigatus
gtctcgcagtgtcgtgacaggcccggtaggctctctgcaggcgcacagccgctcatcttcccgagtggtcttcatcagtctctgacgtcttgttttatcttgcaggatttctacgacccaatcaacgacagactgcttgaacctcgtcttactggcatctcatattcattaccagctgatggatactatgaacaggcgtactaccggggccgtttccaaccgtcagttgctccccacgctttcccgtctgaggctgctttctga

SEQ ID NO: 20546 - DNA, 273 bp, A.fumigatus
cccgatttgtattccccagccacaacgccttcgtgtcctaaaggtatcatgctgtggcagcatggcaaatacgacgtgatgccagatggatccatccagctgaccccaatcgggctcgacgtccgccagttggtgtcagatccatgctcaaaggaggtggccgtgtacgcaagatacaaccagaccgaggcttttagtgtacgccgaagacctgtcccaaccataatgatatcgttgctaactgtgcgttgcagtcatttacggtctccgtag

SEQ ID NO: 20547 - DNA, 2058 bp, A.fumigatus
tcgcttcgtcggacgcgaccggccgtatcttcttcggcggctctactgacaacgatgtctatgagctcacatatcaacaggaggaacggtggttccaggggcagatgctccaaagtcaaccataccagttcgcgcatcgcggctttcacgcccagtctgagtttcactcagaagactacggagacggtggagcagatggagattgacgacacaaggagactgctctatactctgtcgtcatcttcaactattagagttttccacatgaaacctgatggtaccttggctttggctattaccaaaccagccatggacatctacgcgaacattgggcacatcatcgcgtccaacgaaaccctcaacccgaaagttccaatcgtgtcgattagccctatcccagctgccgaggcctcgagataccatctaatggccacaaccgcaaccggctaccgtatctatctcagtgcgactgcgtcttatagctggtcgccagctccaaatggtacgaatgcgccgacaagcatgcaggcgcatcatgtgaagactccgccttttgacaaccccccttctaccccagtggagctgggtcagccccggttccagacctccggagcatctagggttcccattcattctctcaatccgaccagatttaccgtgcgatacccgccaggatatttcttctgcttcacgtgcaaggatccaacgcaaaagaccgacacacttttcatctcttctcccgactctggccgagttgctcgctctcaagagaatgtcatccccggaaaggcaggcgagactggcatctggctctctttgggtagcagagcggaggacgttggtctctgctccgcgcctagcgcggctgcctcgactccgggaggatttggcaacgagcttgccgttcagtttgacagcgccgcggctgagattgcgattctgaccaacactggtattcatgtgattcgccggcggcgactcgttgacatgtttgctgcattggttcggggtggtggtactggcggtgatgagggtctcgagggcgaggtcaagaacttcatccgcacatatggccggagcgagactcttgcgacagcgcttgcagttgcgtgcggacaacgcgtcgaagtctccacggattcacgactgactcagatcaatgatcctgatgttttggagttcgcgcgcaaagtgttcatcgagtatggaggccggccgacggtgaatgaaaacgcagtcgcagacagctccacaccagccatcgacacggttatcctatcgcccaggcatgcgggaatcgctctctacatgtcaaggctgctacggtcgatctggaagaaagaaatcgtaacggtcggcagcgggcccaatggtgcacagacgatctcggcatccgtgccgacaacgaaactgcagagtgtacagcgtgacctgtctgccttgcaagatttcttcaaggcgaataagagtttcattgagggattgagtggccctgaagccttggcgcgcgtgtcgacgaagcaggaagaaacggcgctgcaagccgaacacagagcgctgcattcattggttcaattggtttcacacaccattgaaggtatttcattcgtcctggtgctgttcgacgagcgcgttgatgagattgttgcaactctgccggacgagtcgaagcagcggttcctcaagctcacttttgaggagcttttcagcaccagcaaggggcatgacatcgcaaaagaactggtgaaggggatcgtgaatagaaacatcgccaagggctccaacgtcgagaccgtggctgacgcactcagacgacggtgcgggagcttctgtagtgctgaggacgtggtcattttcaaggctcaagagttgttgaagagagcgaccgaagccggggccaactcggaaatcggtcggaatctgctgaatgagagtctccatctgttccagcaagtgtctgacagcctgcccatggattacctggtctcggcggtcgagagctacatctccaatcagttctttgcaggtaagtcttcatacctcagccatggatgttga

SEQ ID NO: 20548 - DNA, 732 bp, A.fumigatus
agatgtaggagtccacttgtgacattgtctggtaggcaacaagctaatccgccgccacaggattctcgacgcgattacttttacttcagaaagcaatgctatgatttgatattcaaggtcatcatcgccgttgacaatcttgcagcgcatgacccgggtgtggttgatgggcaactcacaatcattgccaaacgcaagaatgaggcctatggcgtgatctcagattcgaccgacgaggtgttcttgacgagtttatatgactggtacctcgagcaggggtggagtgatcgtttgttgcagaacaattctccgtttgtggttacatacctcgagcgcaagtcagccgatgacatcgctcatgcggacctgctctggagatattttgctcagtcgcagcggttctatgaagccgccaacgttcagtaccaccttgcgcagagtgcttttgctttgcctcttgctcgcaggatcgaatacctgggccgggcccgggcgaacgcctccattttcactccagatgtgggccggcagtcccggcagcgcctcgtgcaggacatctcgaatctcatcgatattgccaacatccaggacgatctgctgcagcggctgaaggatgacacgcgtatcgcacccgagcgccgaacggaggttctgaaagaggtggacggtcccatcatggacatcagtacagtacgtttcagttctaatcatgcattcgtaagggcatactaa

SEQ ID NO: 20549 - DNA, 621 bp, A.fumigatus
tccgtgttacagctgtttaaccaatacgccgaccctgctagctattacgacatctgcctccagatcttctaccttgcggactaccgcaattcggcggatatcaggtcgacatggcaacatttgttccaagacctgcatgatgagacactggcaaagggggaaccacaaccatacgaagctgtgattgagaaggtgcgtagtctcggcagccgtttgcgcatgtccgagaccgtcttcccgatcaaggacctcctaccgatgcttgagcggtatgcgctcgagcaccagcgcgatgtgggcccgccgacgtggattgttgatctgttcctggatctgggggttgcgcacgaaaccatctacgccgtgctcgaagcgatgtattacacagacgaggcgccattccacggatcgaaccgcaaatacattgccagggatttgctatacctgatcgaggtgtggtaccacgagacagtccggctgggagggattgtgttcggaagcgacgcagtcgcggagcgtgtctcggagacgcttctcctgttgcaacagggcggcattgcacccgagcagatgcaagctgcgcatgagctgcgcacgcggattgtagaaattctgcggtaa

SEQ ID NO: 20550 - DNA, 417 bp, A.fumigatus
aatacgtccagattgaatgttcttcgcgcgctgatttccgaaacaaataactccacaaagacctcatcgccgatccagacagacttgcaattgctatcgctcatccgaaagcgtgtggctgctgccaaagaggcagcaaaccaattcgcagaagccgatcggcccgatctgaaggagaaggaagatgctcaggtcgcaattctggaggagtatgccggcaaagtggagacgatgagcctggaagacatcaaggccgttgtctctcaggaagtttcgaaattgaaggaagccggcaagaaggtcgaggtcggcggtctgctcaaatctctctttgctcctggaggtgccctggatggcaagcctgcagagagagctgaagttgcaaagatcgccaaggaggccgtcgcttccgtgtga

SEQ ID NO: 20551 - DNA, 1188 bp, A.fumigatus
ctggcccttttttttcccgcagtatccctatctaaacttttctcccccgtcatctctcccctctctggcattccgttcatcatgcctgcttcagcccccgtcactccacctagcaaaccacaagctgtaaatcctcacgaggatgagatccccattagctacgacatcaacatcccctatgtcgatgtcgcaaaggaatccacttcacacaccagatacccagagtacctccccacatgggacaaggtctggtttgatcctctgccccccttcaagtatgaggatccggcgctgcgcgtaaaagacaagagcaagcgcaacctgctcacccctggcgttaaagtctcgcacatccagccccagatcgggagtattgtggaaggcgtgcaactgagccagctctccgacgccgccaaagatgaactggctctgttagtcgcggagcgcaaggtcgtcgtcttccccgcgcaggatctcattgacgctggcccggaaaagctggagcagttcatgcgccatttcgggaaaccaaactaccagccggtctccgggacggtgcgcgatcacccgggattccatatcattcaccgcgatggcaaccgcgaagaaatcgcgcgcttcctcgagcagcgcaccaccaccacgctctggcatcaggacgtgagctatgaaatccagcctccaggctatgtcatgctcggcctgctcgagggcccggaagtaggcggcgacaccgtctttgcagctacagacatggcctacaagtacggatttcccccttcctcttcctacgcagaaaaacaaaaaactgaccgcagcaggcgcctctccccaaccttcacctctttcctcgatggcctccgcgccgttcactcctccgccaaaatgatcaaccacacccggctgctgggcggcctcgtccgcaaagaccccgtcgacaccgtccacccgctcgtgcgcatccaccccgtcaccggtgaaaaatgcctcttcatcaacggcgagttcatcacccgcatccagggcctcaaggagcccgagcagcgctacctcctcgatttcctcatgcagcacatcatgaccggccacgacttccaggcccgcgtgcgctggcagcccaagaccatcgtcattttcgataatcgctgcacgatccgtaagctcttccttccctcccatgccttctag

SEQ ID NO: 20552 - DNA, 627 bp, A.fumigatus
ctgagcatagccagagttgctacggataagctattctctctctctgagtatcaaaatgccaagaggatcggtgtctacctgtccatgccttcgggtgaactttcaactacggccatagtccaagacgccttgactcacggcaaagaggtattcgtgccgtatatccatagcatagactcaccgtcttcgacgcagaagaagacctccgtcatggacatgttgcttctgaagtctatggaagaatttaactctcttgaacctgataagtggggaataccatcgctcaccaaggcccaggcagagaacaagaggaactgttttgggacaataggggtctccacaaacatgggggaggattctacgcagagatttgaagggcttgatttgatagtcatgcctggaatggctttcgatcaagggttccgaagactgggtcatggtaaaggttactatgatcaattcttgacgaggtactcgataaaggtagccgagaaaaagacgacaacatcaaaaatgcctttactcggtgaggagcagccacatccgaaacccaaactcccgttaaatgaccttactgattccattagttgccctttccctcaaagagcaaatgcttcccttgaatga

SEQ ID NO: 20553 - DNA, 258 bp, A.fumigatus
cgattgcacccctgcttcctccacatccatctgggcgagttcgcgctgcaactcctcgagcgacccccgagcggaatcggttcccgaggacgcaagatcatccaggctgttacggacggactcgaccgttggcggttggtacccatgaggccgagatcgtgggccgcccggaccactggtattgtcggcattatgcagcaatccctgtcgttccgcatcgtcgctggcttcatcggggccaagatgagatcgcgatga

SEQ ID NO: 20554 - DNA, 1188 bp, A.fumigatus
cttttcgcctccccagacatctactccattgctctgaccacctgctcctccctccttcgcaaatacaacatcgaccccaagtctatcggccgtcttgaggtcggcacagagacccttcttgacaagtccaagtcggtcaagtcggtgctgatgcagctgtttgcccctcatggaaacaccaacattgagggtgttgacaccgtcaatgcttgctatggtggtaccaacgctgtgttcaacagcatcaactgggtcgagtcttctgcctgggatggcagagatgccattgttgtctgcggagacattgccctctatgccaagggggctgcccgccccactggtggtgctggtgccgttgccatgctgatcggacctgatgcccctattgtgttcgagcctggtctccgtggcagttacgtcacccacgcttatgatttcttcaagcccgaccttactagcgaataccccgtcgttgatggccatttctcgctcaagtgctataccgaggctgttgatgcttgctacaaggcctatgccgctcgtgaaaaggtgcttaaggccaagattcagaatggcaccaacggagttgagaatgatgagaccaagactccccttgatcgctttgactatgtcctgttccacgcgcctacctgcaaactggtgcagaagtcctatggccgcatgctctacaatgactacctcgccaaccccagccaccctgcctttgccgaagtaccctctgaactgcgtgacttggattacgagaaatctttcaccgacaagactgtggagaagaccttcatgggtctgaccaagaaaactttcgctgagcgggtgcgtcccggtcttgatgttgccaccctctgtggtaacatgtacacggccaccgtgtatgctggtcttgccagcttgctcagcaacgtcaccttcgatcccagccagcccaagcgcgtcgccctcttctcgtacggcagtggtctcgccagctccatgttcagtgtcaaaattgttggcgatgtctctggtatggttgagaagcttgacttgcacaagcgcctcaacgccagaaccgtcctgccacctcagacttatgatgaggtaagaaaccaatgttttccccctcctgtaatcatatggactgacatcgtttcttcaagatgtgcatcctgcgtgagcacgcccacctga

SEQ ID NO: 20555 - DNA, 342 bp, A.fumigatus
ttcactggcgtcaagctggagcctcctccatgtttcaggttattctattctggatctgtctatcgtatgctttttttggccctgggtcggatggcttctctacgaagagcatttaatatccaaacattctccatcctgatgcctccacaactcatcattttcgctcttatagaacatgactcagctgtgctagcgtttcaattggaacatctcaacaccctcgcttctgtccttctttaccacttcgttggtggacattactccttgacggctcgcaggaagctggctcttccagatagctactcgctgatcattcgttgtgaaagaaagaattgtgattga

SEQ ID NO: 20556 - DNA, 192 bp, A.fumigatus
atcttcagtttcatcgggtctttctttgtgtttaaaatcttcacttttatctcccacaaacacagggagtatgtcgctcactgtcgctcctttctcatccagatcatgatcccgcttactccggcatccgtgacgttgtctaacttctacggctcccccgagccacatccattccgccatgggcaacgataa

SEQ ID NO: 20557 - DNA, 1461 bp, A.fumigatus
agaaacgatgtcagtccatatgattacaggagggggaaaacattggtttcttacctcatcataagtctgaggtggcaggacggttctggcgttgaggcgcttgtgcaagtcaagcttctcaaccataccagagacatcgccaacaattttgacactgaacatggagctggcgagaccactgccgtacgagaagagggcgacgcgcttgggctggctgggatcgaaggtgacgttgctgagcaagctggcaagaccagcatacacggtggccgtgtacatgttaccacagagggtggcaacatcaagaccgggacgcacccgctcagcgaaagttttcttggtcagacccatgaaggtcttctccacagtcttgtcggtgaaagatttctcgtaatccaagtcacgcagttcagagggtacttcggcaaaggcagggtggctggggttggcgaggtagtcattgtagagcatgcggccataggacttctgcaccagtttgcaggtaggcgcgtggaacaggacatagtcaaagcgatcaaggggagtcttggtctcatcattctcaactccgttggtgccattctgaatcttggccttaagcaccttttcacgagcggcataggccttgtagcaagcatcaacagcctcggtatagcacttgagcgagaaatggccatcaacgacggggtattcgctagtaaggtcgggcttgaagaaatcataagcgtgggtgacgtaactgccacggagaccaggctcgaacacaataggggcatcaggtccgatcagcatggcaacggcaccagcaccaccagtggggcgggcagcccccttggcatagagggcaatgtctccgcagacaacaatggcatctctgccatcccaggcagaagactcgacccagttgatgctgttgaacacagcgttggtaccaccatagcaagcattgacggtgtcaacaccctcaatgttggtgtttccatgaggggcaaacagctgcatcagcaccgacttgaccgacttggacttgtcaagaagggtctctgtgccgacctcaagacggccgatagacttggggtcgatgttgtatttgcgaaggagggaggagcaggtggtcagagcaatggagtagatgtctggggaggcgaaaagttaacattccgtgcgtacgaggatcagggaagtgggacaatcataccctcacggtcatcacagaagctcatcttggtctggcccagaccgattgtgtactttccctcactcactccatcgaacttctccaactccgcctggtcgacacactggacatgccatcagccctgttgtgaactggagatgttggacaggacaaggttcaaaggaagtagaccaacatacctgactggggaagtagacctcaatggccttgataccaacgttctggggacgagcagacatggcggcggtgggagtgcaaattga

SEQ ID NO: 20558 - DNA, 2769 bp, A.fumigatus
cgttgtctaacttctacggctcccccgagccacatccattccgccatgggcaacgataagaaattcgaatatgaatcacttcccattccaagttacgaagaagctatttcctcccgtccaagctcatcgcgatctcatcttggccccgatgaagccagcgacgatgcggaacgacagggattgctgcataatgccgacaataccagtggtccgggcggcccacgatctcggcctcatgggtaccaaccgccaacggtcgagtccgtccgtaacagcctggatgatcttgcgtcctcgggaaccgattccgctcgggggtcgctcgaggagttgcagcgcgaactcgcccagatggatgtggaggaagcaggggtgcaatcgtcatctcgacggtcccggctgggccagcatttctcgaaacgattcaacagtctgagtcggacgctctctgcaatacagtttccttttcgccgcttcctaccaaacttccgattcacaattaacctcgatggagcccgtccacgcttccaagaccatagctgcattatcatgctacgggtgtttgggctgctattggtagtcgctcttgtatacgtgttcttcttttcgaacctcttcaacctgaattctcgattcatgatgggtcagtcatatagcgccgcttcggtgcagaatttccttcagggccacatcaacgagacaaacatcgcggataatttgagaaaggtgacgaagttccctcatatggctggtactgagggaagctttgcgctggcagaatggattgaacaggaatttaaaaatgcaggactcgatgaaattgaaatggaggaatttcaagtttacctcaactatcccaacgaaggcggaaggagggtggcgattgttgatccgcccggcatggcctgggaggctgctctcgaagagaagaacgaacagactatggttttccatggacattcaaaatcgggaaatgtgactggccatttggtctatgcaaactatggttcccgagaagattttcagctcctagcggaccagggaattgacatgaagggcgctatcgcacttgtgcgatactatggctcggagacagatcgtgccctgaaggtcaagcttgcggagatggctggcgctgccggatgtatcatctactctgacccgcatgaggatgggtttcggcggggtcccgccttccctgacggacgctttatgccggatgatggtgtccaaaggggcgcagtaagcttgatgtcatgggttgtcggggatgttctttccccgggttttgcctcaacccctcaagagaagaaacgactttcaatcgaagaaagccccggattgcccggtataccaagtatcccgatcgcctggcgcgatgctcagagactcttgcaggttctcaagggtcatggtaccaaggtacccaaggagtgggttggtggtgttcccgaagtgcaggaatggtggacgggagacggtggctcccccaaagtgaacctgatgaatatcctggacgaagtggaacgacagcctatatacaatgtcattgggcgcatcattggattggaacagcctgaaaaaaaggtcatcgtgggcaaccaccgcgactcgtggtgtcttggcagtgcggacccaggcagtggcactgcggtcttcttagagcttgttcgcgtctttggtgaacttcggacgtttggatggcgtccgctgaggaccattgagtttgtcagctgggacgcggaagaatacaatatgatcggttcaacggagcatgtggaaaaagcgatcgaagcacttcgagagaatgcattcgcttacctgaacgttgacgttggggtgaccggcaataactttgatgcctccggatctccgttattccagcggattgtgatgcaaatccttggtcgtattgcggatcccatcaccaacgagacactcaaggacatctgggagagagcccagaagaagttcagtcctcttggttctggaagtgattatgtggcgttccaggacatagctggcacctcaagtgtggactttggattcactggcgagcgtttcccctatcacagctgctacgagaactatgactggatgaccaagttcggagatcctgggttccaataccacaaggctctaggtcaattctgggctttgctccttattgaccttgctgataaccctatcttacagttcgatttgcaagtgtacgccgatcatgtgcatacttatgttaccgatctggtggcctacgccaagtcaaaaaacgtcccggttgccccccagcttttagaggaccgcgccgtcggagaagcgtccgtcagcttccaacccctctttgacgctgcgtccaagttcaaaagcgacgcagaagaattcgaccaatgggcccagttatggcacgacaccgtctggggtgctggtgggttcgaaaacaacgtgatggccattcagcgactgagccataattctcgtttggccagctttgacacccaacttctggatctagatcatgacggcggagtaagtacccttccctctcacatcaccagtgtccccgacactgacagtttccgtcagatccccaaccgcacgcagttcaaacatgtcatcttcggcccccagctgtggtccggctacgacgccgctgtcttccccgccatccgcgacagcatcgactcgggcaactggactctgacccaggaatggatcgaccgtgtcgccaagatcattcaccgcgcaagcaacagtctcgtgcacaattag

SEQ ID NO: 20559 - DNA, 351 bp, A.fumigatus
cactccttaagtggagggctcggcctcacaggcggcatcgctgatgttggcgggctctatgactgcttgtatggcctatacaccggccgggcgacgccggatatccttgatatgtacgaccgagtgcgacgcaaaaagtacctggaggtcattgacaagctctccagcgacaatctgcggcgcatgttcgaaactgatccagataccgtgattgaatcgggaagtgatgagcttttcaacctgtgtctgaaggccgagaaagatgttgagctggccaagcagctggtgacaggaatcaatgtgatcaaatacgacttcacccagcattattcagaggcggggaagatttga

SEQ ID NO: 20560 - DNA, 876 bp, A.fumigatus
attatcgtggtgggggctggcccagctggcctcttactcgccctcatgctttcccgccaggcgatcccggtcacggtcttggaggccgcggagcagctggacacccggccacgcgcaacacactacggaagcccagctgtctacgagctccgtcgcgcaggagtcttgcccgacgttctggcggagggtttcacccccggagtgatctgctggcgaaaactgtacggcacctacttggccggaatcgacaaccggatcatggccaacgacccggaccaagtcgcctgtcttcccctgggccgcctcggccagatcctcttggaccatcttgcacgacagcccagcgcagagatcaaatggaatcatcgtgttaccgggctgggtcaggaccctgaccaggcatgggtaacggttgccaccccaaccggcgaggtcacgatgcaagccacatatatcgtgggatgtgatggggcaaactcgcagatccgccggtccctatttggggacggggtctttcctggaaagacgtgggacgagcagattgtcgccacgaatgtctactatgatttccaccagttcgggtacgaggatgccaactttataatccatcccgagcactggtacatggcgtcgcggatcacaaaggatggcttgtggcgagtctcctatggggagaaagggggactgacgcatgagcagctggcagagcgccaaccgaagaaattccaagccatgcttcccgggcacccaacccccgaccagtacagactcgtgaactttagcccttatcgggttcatcagcgtctagcagagaagatgcgagttggccggttcctcctggctgcggacgccgctcatctatgcaaccccttgtga

SEQ ID NO: 20561 - DNA, 249 bp, A.fumigatus
gtttcttcgcctttgagtttcttgatcaagtcgccgatctccagatacgccttcctcctagtcgtcacttgggtggtctttgaaatgaatcttctcctgatattcaaacgcgttctgagactggtctcctcccatgttctccattgtgcgcgcacgaagctctgcgtatatcttatcaacatttggcaggccttgaacatccctcgtgcgattgaggataacaatgtgcgcttcgctctttgtggttga

SEQ ID NO: 20562 - DNA, 231 bp, A.fumigatus
tggaccgccgatgtgcggaaagttaaatcacacggtcagctgaacctacacagtccagagatctgttcaaagcttcgattctattccccaaggccctctggcttatcgcaaagtcctccaatcctcaaagaggcctacttcgcatatcttgatttgaataaagactacggatactctattacaggtgtcgcgagaagccctagtctttgcgatacgatacgtctattgtaa

SEQ ID NO: 20563 - DNA, 303 bp, A.fumigatus
catctgtcatccggatcgcggtacggttttacgctccactcgatggcctcgcaaacgcagacgggtcaacgacccaaggtccagccttgccggtacaagactgggaaaacactcggagctggctcctactcagtggtgaaggaatgcgtacacatcgatactggtcgctactacgcagcgaaagtgattaataagcggttaatggctgggcgagagcacatggtaattctctctgaaactgaaaacccggctcttaaggtcaacgtggacatcaaacgggggctgatgtgtggcatggtataa

SEQ ID NO: 20564 - DNA, 198 bp, A.fumigatus
cttgacgcgaagctaatccgtcctagcgcaaatgccggattcgatctcttcgatgatgaactgattaacgagtcaagagctaatagcaatatgaatgcaagtgattatattattgatattcgagaatatgatgttccctaccatgttcgggtggcaatcgacaaaggtgggcgactaaatccccatatttgtcaataa

SEQ ID NO: 20565 - DNA, 3963 bp, A.fumigatus
acaacgactgacagatccaaagatattcgaattggaaaatggtacactgttgaagcgaagcacggtgttatctcattgacctgcctagaagaacgacttcagcgtgctgatccagtgattctcgccttcgatatcgaaacgacaaaattaccactgaagttccccgattctgtgatcgaccagatcatgatgatttcctacatgattgacggccaaggatttctgataactaatcgagagatagtgtccgaagacattcgcgattttgagtatacgcccaagcccgagtacagcgggccatttatgattttcaacgagcccaatgagcgaagcgtcatcgagcgctttttcgagcacatcaaagaagcgaagccgacggtcattgccacgtacaacggtgacttcttcgattggccattcgtcgaagctagagctagcgtgcttggaatcgacatgtacaaggagatcggctttcgcaaaaacagcgaggatatctaccaaagcgaccactgtgtgcatatggattgctttgcctgggtcaaccgtgacagttaccttcctcaaggaagccgtggtttaaaagcggtcactgttgcgaagcttggttacgaccctgacgagcttgatccagagctgatgactccttatgcaagcgaacgcccccaaactttggctgaatattcagtttcagatgctgtggcgacatattatctgtatatgaaatatgtgcacccgttcatcttctcgctttgtacaatcattccactcaatcctgatgacacgctgcggaaaggaaccggaacactctgtgaaatgctgctaatggtgcaagcatacaagggcgaaattgtacttccaaacaagcacaaagatcccccggagtcgttctacgagggtcatcttctggaatcagagacctatgtcggtggccacgtcgaaagtatcgaagcaggtgtatttcgaagcgatatccctgtcacattcaacatcgataccactgctattgacgaactactccgagatctcgatgcggcattgaaatttagtattgaggtcgaagagaagaaatccatggatgatgtggtaaattatgaggacgtcaaggcacagatcgcagaacgcttggtcaatctcagggagaagccacacagggacgaggtcccttccatttaccacttggacgttgcttccatgtatcccaatatcatgatcaccaaccgattgcaaccggactccatgatccaggaatctgattgcgctgcgtgcgacttcaataggcctgggaagacgtgcgataggagattaccgtgggcttggcgtggtgagttcctaccagccaagcgtgacgaatacaacatgatcagacaagctgttgcaaatgagctgttccctgggcgaactaagaacagcccgatgaggtcctttggcgagatgagcgccgaggaacaagctgctatcatcaagaagcgccttcaagattatagcaaaaaaatttatcacaagatccatgatagcaaaaccattgtgcgcgaggcaatcatctgccaacgtgagaatcctttctatgtggatactgttcgcagctttcgtgatcgacgatacgatttcaaaggaaagcagaaagtctggaaaggaaagactgaagccctcaaagcagcaggtgcttctgcagcggagattgaagaagcaaagaagatgattgtgctgttcgactcattgcaacttgcccacaaagtcatcttgaacagtttttatggttatgtcatgagaaagggatctcggtggtactcgatggaaatggccggtgtgacgtgtcttactggcgctcatattatccaaatggcaagagaactcgttgaacgtatcggccggccactggaactcgacaccgacggtatttggtgtatgctccctggaagttttcccgaggatttctcgttcactctgaagaatggcaagaagcttggtatatcatatccctgcgtcatgctaaatcacctcgtgcatggcaaatacaccaatcaccagtaccagacactcgttgacccgaagacgttccgatatgaaacgcatagcgacaactctatcttctttgaagtcgatggcccttacaaagcgatgatcctccccacgtcgaaagaggaggataagaacttgaaaaagcgctatgctgttttcaatcatgatggatccttggctgaattgaagggcttcgaagtcaagcgaaggggagagctgaagttgattaaaatatttcagactcaaatcttccgcttctttttggaaggatccaccctggaagaaacctatgctgctgttgctcgagtcgctgatagatggctggatgtcctctatgaccatggcgcaacactggccgatgaggagcttattgaactcatttctgaaaataggagcatgacaaagactctggaagagtatgggaatcagaagtcaacgtccatcacgacggcgcggcggttagcagaattcctgggagagcagatggtgaaagacaaaggtctcaactgcaagtacatcatctctgcgaagccaaaaaacacacctgtcacagagcgagccattccagtgacgatattttcagcggaagagcctgtcccgcgattctttttgaggaaatggttgaaagacgatcccggagatatggatcctcgaagcgtcatcgactgggactattacctcgagcgattgggctccgttgtacagaaactgatcaccattcccgctgcacttcagaaagtccgcaatccagtcccccgggtagcccaccctgactggctccaacggcggatcaatatgaaggaggacaagttcaagcagacaaagatgaccgatatgtttgggaagacagaaaagaacccactttccaacatctcaacaaacatcctggatcatcgtgtccaacatcacggcgacattggggaagctgttgcgaattcgacgcagaaattaaagtcgtcaccaaacggcaagatctcacagaaaagaaaacaccccgagggtctgacaaagaccttgcttgatccttttgccagccttccagccataatgccttcgttgaacgatgactacgttggattcttgaagtatcagaaacaaaaatggaaaattcagaagcaagctcgggctcgtcggcgccagctctttggagaacgcgtaaatgtggcaaccgattctttgagcaatctcttcaggaatcaagcagagctgctgtacatcaatacgtggcaaattcttcagctctgtgaaacaggtagacctggccttgtccgggcattcgtcttgattgaccggaaaatccatgcccttacaatcaaggttcccagacagatctacgtcaatctgaaacgggactctctgccagatgttgatgttccagactgtgaggtggaaaaggtcaatcacactttgcctaacggccatccatcggttcatctattcaagttgacgttgtccgaagacacgtacctgcgagaaacagacaaaatagacgctcttctccaacaccccagcatcgaaggagtgtacgagaagaacatccctctgagtgtccgcgctgttttaaagctaggcagcgtatgcaccttcgatgaagaacaacgcggagttcttggtgagggattggatcgaggattcaatctctcgacgttatgccatacaactcctgatgaaccttatcttctgaactcacccttggtttaccattacctctaccatgtcctctcgggtgataggcagatattcgctttattttcaaccacaaagagcgaagcgcacattgttatcctcaatcgcacgagggatgttcaaggcctgccaaatgttgataagatatacgcagagcttcgtgcgcgcacaatggagaacatgggaggagaccagtctcagaacgcgtttgaatatcaggagaagattcatttcaaagaccacccaagtgacgactag

SEQ ID NO: 20566 - DNA, 999 bp, A.fumigatus
cagtgtctctgtgatgttacagtatacctcgtcacagagcttgctctggggggagagctgttcgaccgcatctgtcgtaagggcagctattacgagtccgatgcagctgacctcatccgtgcggtcctctccgcggtggcttatctgcacgatcatggtatcgtgcatcgtgatttgaaacctgagaacctgctgttccggacgccagaggacaatgcggatctgctaattgcggactttggcctgtccaggatcatggacgaggagcagttccatgtcctcaccacgacatgtggcacgccaggttatatggctccggagatcttccagatgagtggacatggaaaaccagtgtacgtttttgtccgtgtcttacctctcgccaatctgaattctatggctgactttccgcttagggacatctgggccattggtgtcatcacttacttcctcctctgcggctacactccctttgatcgtgactccaacctggaagagatgcaggccatccttgcagccgactattctttcacgcctctcgagtactggcgtggtgtttcccaatccgcccgagatttcatcaagggctgtctgacagtcgaccccaaggcccgaatgactgcccatgaagcccttcagcacccctggatcaacccgccctatgatctcaataacgacagtggctcgggcgaggacttgttgcccaccgtcaagaagaacttcaatgctcgtcgaacgctgcacaaagccatcgataccgtccgcgccatcaacaagctccgcgagggaggagggctcatgatggatggtgtcatgagccttgatccgaagccagagcatgtcaatggcaacgaggttaccgaggagcaacatgacggacggatggagattgacagccgcggcgacgcgcgtgggcaaaccgagcagcagattcgggagcaggagcgaaaggtcaaggaaactgtggctggattgtggagtcagtccgcgaagaaatga

SEQ ID NO: 20567 - DNA, 2265 bp, A.fumigatus
actcacccttggtttaccattacctctaccatgtcctctcgggtgataggcagatattcgctttattttcaaccacaaagagcgaagcgcacattgttatcctcaatcgcacgagggatgttcaaggcctgccaaatgttgataagatatacgcagagcttcgtgcgcgcacaatggagaacatgggaggagaccagtctcagaacgcgtttgaatatcaggagaagattcatttcaaagaccacccaagtgacgactaggaggaaggcgtatctggagatcggcgacttgatcaagaaactcaaaggcgaagaaactcagcccgtcatcatggtcatacagtcccatcaaagacaccgcctgtgccatgatattcccatcttgaaagagtacccggtgcttccggtaaagcccgaagtgtcggatatggaccttccacctttgggctggcaatcatttattgctaagcgactggtgacacactacttgtatcttgcttcttggattcaccacttgaccatgctagctagatatggtgacgtacctctttgcaatctcgagaatgacgatcctcggtatctcattgatatttcatatgcaagacgactccagcaaaacaatgttgtcctctggtggtctaacggtccaagacctgatcacgcgggttacgagaaagacgatgtcacaggctccctggagagagtttcgatgccgtcagtcaacgtgcccagcgcatataacactgtctgcattgaattggaggttcggaacctctcaatcaacaccattctgacctcctcgatcatcaatgaattggagggggcagacactcttctggcatcgtcggagccctcagcggacgcaaatggctctggcgttctctactcggagaaggcatttgcttcagctggcgctgtcgtgctccgcgaaatggtgaagcattggtggtcagaggcttgtgaagggaataatatggccgacattatggtgcagcatctgattcgatgggttgagagcccggtttcatgtctctatgatcgatcattgcatgattatgtgcgcatgctgtccaggaaatcatttcagcggctcatggctgagttcaggcgcgtcggttcaaatgtcatatttgcaagccctacccgtcttttgctccagactacaaagacagaggtgggaaacgcatatgcatatagccaatatgtcctgaagtccatccgcgcgaatgcgtcattccattttatcgatcttgagatcaaagagtactgggattatctcgtttggtacgacgaatacaattatggtggcaagggatgccgaaaagtaaccggatcggaggaccaggagctggagactgtgatgcattggcagcttagtcgctttctaccagctcccatgcaaacgattttccatgactgggttgtggaatatatcgaactcatgcatggtctcaaacggaccgattcggatgattcatctacacctcgtcttacacagcttccagtcgggaaccacaacgaagataatgacgaaattacgtcaatcctggcggagaagttttcaaagcctctcaagaaacagatctccggcctcattcggcgccaacgagatgagctgcttcatccggagctggcatccgactacgtcttccctgtccttcctggagtcctagtggatcccaacaacgacaagcgcaaccctgttcttgaacttgtcaaattgttgatgcaggtattgagtctgtcgaagacaacaactctagagactcggcttctacgtcgggagctcttagcgatgttcgaagtacgtgagttcagcaaagaaggccggttcgagaacccaggggcaagtctaaagcttcctgaactttcctgcaatgcctgctgtctgatccgtgatttggacttgtgccgggacgaagatgtgctcccagagatggggtcagacccaaacaaagcagcgcccaagccttggcggtgccctttctgtcaaacagagtacgatcgactagcacaggaagaggctctcatcggccaagttcaaggcttgattgtcggttggcagacacaggacctcaaatgctccaagtgcgggggtctcaagatcagcgatttcatggaacattgctcatgcagtggccactgggtggaaacaatggaccgaaatgaggtggagaagaagcttcttcttttgagcagcgtatccaaatttcatggtttgaagctcctggagagtgttgtgcagggtgtccttgagcaaatgtaa

SEQ ID NO: 20568 - DNA, 258 bp, A.fumigatus
cgcttcacagtgaacgatgctatgatcatcgttcgtgacatggctggtgatgtctcgcagcaagctgccgacaggcttcgaccttcacaggagcagctgtctcaagtggaccaacctgctgaggagaatgtctggcacgagaagcccaatatccccaaggaacagctcaagtctcgctttcaaaaaagcaaggtaagatcttctcctgacagcttatatgctcacatgctcacttctctcataggaagaagctggtga

SEQ ID NO: 20569 - DNA, 1041 bp, A.fumigatus
tctcggtatccggtattcaagccgatctcagaggtaggttcaatatcgaaacatgacgatattgtgaggttatgctttactaactcctcgttagatgtcagttactatatcaagaagaagcagggattcccttcaatcacagacaagggggtcatggacatcttcctcggtaacgagggctttgggttcaagatcgcagcctccacagctcataaggaggaccgtcagcactttgtcaaactggacaaggtgacggtgaagattcacgatctcgacatcaagttgaggaagtccaagcacaagattctctttgccatcttcaagcctatgctctttaacattgttcgacctaccctggagaaggtgctcgaaaagcagatccatgacgctttcgtcaagggcgatgcgtttgcctttgaagtcaatcaagaggttcagcgtgcaaaggaagctaccaagcaggatcctgcaaatgctcccaatatctactcgcgctacgtggacgctgcacgagcgaagctgaccgagaagaagcaaaaggctcaagcagttgcccagcgcgataccaagatccagaccgtcacaactcttcacgactcgatgttcccaaacatcaagttccctggagcagtctccaacaaggctactgaatacactgaactcgcgcgcaagggagagcgctgggaatccccagtcttctctatcggcagtgcctccgagtccaaggacatccccaagctcgcttctatccaacgcaagcctcaccggactgccgagggccgacttagagagaagcctgatggccgaccaatggagggaaccgatggtcgagcgacccagggtggtcaggtcggtgctgacgggtatccaaagactgggtatccctcgcgtggattcgccgatgaaatggacaatgccttcactaacggcgccaccaatggccacacgaacggccatcaaaatggggctgctacaaaggtcaccgccgaggggcttaccgtccgaggcacccccgaagccttcaacccacaaaccgcttaa

SEQ ID NO: 20570 - DNA, 510 bp, A.fumigatus
cactcgttcttcgtaggtctcgtcccaggtgattcattatcattggccacgcaaacatcacaaccagagcaggtccaacagcaggctcaggatccgatagcacagacccaatcctccgaaatgacagcacagaacgagacaatggttggtgctagccccccgccagtcgattcgtccgaggagatccctcacgctcggggcccgccgatcgtaggagtagaggatatgggcctacaggacggcaagggagtcgagatgactttggcgcaagacgcaaatgcgcctgcggatcagtcgtcggcaccgaccgaccaacctaggtctacggctgacgaacaaaccgagaaccagaaaccggcgtctcgggcaaatgcagacagcgacggggatatccagcttgacgatgtgaaagaggcaggggaatcggctcctgctgcaacagcaacaggagcggctgcagaggcagaagctaatgaaactcttcagacgactgagaacaaagatttttag

SEQ ID NO: 20571 - DNA, 612 bp, A.fumigatus
actggcggggacggacaggagatcatccggccgcataagcacgatgtcggcggcttccatggcgacgtccgtccccgaagccagagcaatcccgatcgatgcagttgccagagccggagagtcgttgattccatcacccaccatggcgacacgatcaccggattcttgcatcgatgcgattatggattgtttgtcggacggggaggcagaggcgtgaacgaattcagagggtatcccaacgaccgaagcgatggacaaggcagtagacctggtatctccagtgatgagcgaagtcttgagtcccatgcgatgcaaagcagcgatcgtagccacggcagtcgattttacagtgtcgcggaggaagatagttccggcaaactggtgatcaatggccacatgaatctgcgtgatgctagcagtaggcttcgggctgccggtgagttgatcttcagcttcaacagattcaggaaccgatacaccttgagaccgcaagaaagcggcgttgccgattacagcacgataccttgtccgctctccattgaacgcgggctcaatcaatgcagatattcccttaccaacatgggcattgaagtcacccaagctgcctggtag

SEQ ID NO: 20572 - DNA, 300 bp, A.fumigatus
gaagaagctggtgatgtagcaaacactgcaacacaatctgcaaccggtggccaggaccctgctactgcgaaggatgttgatgtccaggctggtgtcggttcggcagcccagaaggccaaagagaaggtcccagaggatgcctcccaggaagcgaagagccgggcccaggagcttaaggagcggactcgtagctacatggagcaaaaaatgccgaaggagagacgcgagcaagttatctggcgattgaagaagatggttattgagatccagggtcatcctgactgtaagttcaatttgtag

SEQ ID NO: 20573 - DNA, 525 bp, A.fumigatus
caaaatctaccgcgatgcagacagggacccggaactcagaggctggttcaagaacatggacaccttcatcaggtaagtctgaccgccaaggtagactatacggatcatcctgactcgagcaggaaagccttgcaggaacaaggctacatcatgcaggaggactgcaaccgtgaatgggaccgattgtacgatcacggtcgttacctttttggcgcgatcgcctataaggaccataccgatcggatccttgatgagattagattcataggcgatcagtttaatcaagaccctcagaatcgagcattccgctcagctttggagaagctcttcaatgacctgggtcgagacgctagtggcaatgtcgctttcaagaagcacctgctcaaagatatcagagacgttattttgccttcggtctttgagaacgttcgctatgtccctgtgcctcgcatcgaggtgtccgatccgatggccgacgtggtgagtctgcttcaagatactgtcttgaggattttcggtaactaa

SEQ ID NO: 20574 - DNA, 474 bp, A.fumigatus
gtactcggccatgaacgttggggtgcgatgggcggaggtgatgtcgacggcgggctcgatgccgaagtagtcacggaggagtttcaggcccgggacgagtgtcttgaggtcgctatcggagcccatcatcacagcaacggtgggggcgggcttcgacgggccggacttgacgggctgtgtcttgatgtcgctgcgcttcgagcggatctcgtcaacaacgtcgatcaggggctggatgtatttctcggcttcgtgcatcgtggacgcggtaacggtgacgtggcccatcttgcggccgggcttggcggcgcccttgctgtagaggtgaatgctggcgttggggatggagagagcggcctcggcggctttcaggtgggtgtctggggcggcgccgccaatgatgttgagcatgatggacggttggcggatttcgaggctctgagggggaatggggaggtcgagaatggcacgtag

SEQ ID NO: 20575 - DNA, 693 bp, A.fumigatus
aatgtatacaacgcgtttcctatgcccaaatttcacgtcgaaacccaatcaccagccgcgcagcaacagccatcttccttctcgcaagaacccaactcagtaccaccgagtagcaaccaagaaaatactcctccaacagagacagagaacccttcacactcgacaatacccgcatcagctgccacgccgtctccatcagacgagcgtgtgccagactctaaaccacagtcggtagttgattccccggccgataccctccctccaccgcttgtgttactcctggattccatcaagtcgacattaaagacattttttgcatcaaagcccccgcacaccatacagagactggcagaactagttctccgacctaatgcacactatcgaactctccctgcatacctgcgcgccgtcgaccgcgtcgtctccgttacaagtaccgctgatatattcccacttcaaacagaacccagcgccggtcaggtcaacggcgtcttgaacggaggagggcatggtttcatgtttccagatcatgccccaggaagtgatgagtccctgggtggggccttgcttactcccatcccttggttgaccggggcatcttcccctgacaacgacggtggagctactctcagtgaaggtaacgctttcagttccttgtctccatacattgctgttaacactcgttcttcgtag

SEQ ID NO: 20576 - DNA, 531 bp, A.fumigatus
gaccgcaagaaagcggcgttgccgattacagcacgataccttgtccgctctccattgaacgcgggctcaatcaatgcagatattcccttaccaacatgggcattgaagtcacccaagctgcctggtagtccatcgctttcggagtggcctgattccgccttggctgctgagaggatggccttgccgatagggtgttcactgttcatctccgcgagacccacgatcaaccaccaaagtcggcgacgcccttcaagccactggcgttcaattctggcctcagcaacagtcatcttccccgtagtcagggtgccagtcttgtcaaagacgacgtggttgattttagtcgcgccttcaagcacagcaccacccttgactagaataccttgctgcgcaccaacgccagtaccaaccatgacggctgttggagtgctgaggcccaatgcacatggacaagcaaagacgatgacagagatgcaaagcttcaggcaaaccatgacttttccgccactgccttcagcgacgaagatctga

SEQ ID NO: 20577 - DNA, 417 bp, A.fumigatus
aacaagcaatgtgatgtcgccttaaacagtgccattacctccaaagctctgtcttctccccttaaagaactgtccagcgagggccaggccctggttaaggatctccgggtggtcattgacgaagctaagaaactcatccttagcaagaatgagggtcagttattgcaagactttatatgggaagctcaaaagattggcactggggaagcacctgtacagccagatgttccagtgagcaaagaatcagcccaacaggacgccgacagggccgtcgaaggtttaaaaaccctgggtactctcctgatcacaaacggagagttcagaaagctctgtaagtgtattccgttggaactgagtgccgagtcaagttccgtactgacgcttcacagtgaacgatgctatgatcatcgttcgtga

SEQ ID NO: 20578 - DNA, 192 bp, A.fumigatus
ggattttcggtaactaacgttgaatgttcacaggttgtggagaatctcgtcattgagagtgacaatctcatgccgaatgtcgtggaatttggtagtgataactatatccgctggggtcgcaagaatatcagtaacaagagagacaacaaggttcgtcacgccttgtccagctatgtccgttgcgcaaactga

SEQ ID NO: 20579 - DNA, 519 bp, A.fumigatus
attctgttacatctgttcaaagtacttttcccatccgagttcctgcatcttggtccctttcaactccatgttctcgtgtttagcctgctcggcatacgcctccaccttacgctggatagccgggtcgaatgtgccaaggatacgagctgccaggagggcagcgttgatgctgttgttgattcctaccgtcgcgacgggaacacctgtacggatgacggattagtgggctgtccacagaatggaaaatatgataaaagaaaagaagataacatacctctaggcatctggacgatgctgtacaggctgtccacgccgtctagcgagctgcccttgaccggtacgccgatgacgggcaggacggtgtgtgcggcagccatcccagggagatgggcggcgccgcccgcagcggcgataatgaccttaatgccgcgcgcggctgcgctggctgagtactcggccatgaacgttggggtgcgatgggcggaggtgatgtcgacggcgggctcgatgccgaagtag

SEQ ID NO: 20580 - DNA, 183 bp, A.fumigatus
gccagtcacatggccgtcgtgggcgctaatttgtttcgcaggggcgttaccggcgtccagaacattgacctggatattaagtcggttcgccgactcaacaagcattcgtcccaactgacctccaccgaggacccccacctttggagagttccacattttaacaagactggcaatgaaggataa

SEQ ID NO: 20581 - DNA, 450 bp, A.fumigatus
aaagtttgccccgacgagaagaagccgacatcatcaagcgcggcaaaatttggtccaggtcacaaagtgatcccaactgagctcattgaaattggcgacatagttgtgcttcaccctggtgataaagtttctgctgacggggtcgtcattcgaggcgagagttacgtggacgaaagcatgatcactggtgaagcgctacccatttataagaagaagggtagtaccgtcattgctggaactgtgaatggcactagttcgattgacttcaaggtcactcgaaccggcaaggacactcagcttagccagattgtgaaattggttcaggacgcgcaaactagccgggcttctatccagcgggtggcggatattgttgccggctacttcgttccggcgatcatcagtctcggtctcatcacgttttttggttggatgttcattagccacgtttag

SEQ ID NO: 20582 - DNA, 1218 bp, A.fumigatus
tcccatcctcctcagatcttcgtcgctgaaggcagtggcggaaaagtcatggtttgcctgaagctttgcatctctgtcatcgtctttgcttgtccatgtgcattgggcctcagcactccaacagccgtcatggttggtactggcgttggtgcgcagcaaggtattctagtcaagggtggtgctgtgcttgaaggcgcgactaaaatcaaccacgtcgtctttgacaagactggcaccctgactacggggaagatgactgttgctgaggccagaattgaacgccagtggcttgaagggcgtcgccgactttggtggttgatcgtgggtctcgcggagatgaacagtgaacaccctatcggcaaggccatcctctcagcagccaaggcggaatcaggccactccgaaagcgatggactaccaggcagcttgggtgacttcaatgcccatgttggtaagggaatatctgcattgattgagcccgcgttcaatggagagcggacaaggtatcgtgctgtaatcggcaacgccgctttcttgcggtctcaaggtgtatcggttcctgaatctgttgaagctgaagatcaactcaccggcagcccgaagcctactgctagcatcacgcagattcatgtggccattgatcaccagtttgccggaactatcttcctccgcgacactgtaaaatcgactgccgtggctacgatcgctgctttgcatcgcatgggactcaagacttcgctcatcactggagataccaggtctactgccttgtccatcgcttcggtcgttgggataccctctgaattcgttcacgcctctgcctccccgtccgacaaacaatccataatcgcatcgatgcaagaatccggtgatcgtgtcgccatggtgggtgatggaatcaacgactctccggctctggcaactgcatcgatcgggattgctctggcttcggggacggacgtcgccatggaagccgccgacatcgtgcttatgcggccggatgatctcctgtccgtccccgccagtctatcactctctcgcgcagtcttcagacgcatcaagctcaatctcatgtgggcctgcctctacaacgtcatcgccttccatttcgccatggtctcttcctgccctttggcggctttatgcttccccccatggccgccggcgcggcaatggcagcatcaagcgtctccgtcgtcgtcagcagcctgctcctga

SEQ ID NO: 20583 - DNA, 276 bp, A.fumigatus
acaccaacgatggctatgtccctctacaggcagtggagcctgtcgtttgattacctctgtttcactctttgcatgtttttggggtgctttgtctcacgtgcattgttcatagctaggattcggctcatgaagtacctgtatgatggatggctttctacagctattattacaatgaatgacataaacatatatggtcttcgagggccttacagatgttcattaatacgattatctctacagctccatcgctggtatcatgcaaaaatccaaggatag

SEQ ID NO: 20584 - DNA, 267 bp, A.fumigatus
gagtctggcagtaatataagcttcaccgtcagcgctattcttctgggcacccaccttcaggttggcctccatcgatctgattctctcgttgccacggagttcctttgtggttccagcaccttgtttggagatgtctctggtgtgacgaccgtacttctcagcgagagaaaggagagtgccgacagcttgctggtctattataggccgcaaaaagttagcggctatccagagcttctgacctacaaattgaacttacagtcaggatga

SEQ ID NO: 20585 - DNA, 525 bp, A.fumigatus
cctttggagcagaccaattccaatctcttatccttcattgccagtcttgttaaaatgtggaactctccaaaggtgggggtcctcggtggaggtcagttgggacgaatgcttgttgagtcggcgaaccgacttaatatccaggtcaatgttctggacgccggtaacgcccctgcgaaacaaattagcgcccacgacggccatgtgactggctcattcaaggatcgtgaagctgtgcggacgttggcgaggacctgcgacgttgtgacggccgagatcgagcatgttgatacatacgctcttgaggagatctccgcggaggtcaaggttgagcccagctggcaagcgatccgaacaatccagaacaagttcaatcagaaggaacaccttcggaaatatggcataccaatggcggagcaccgggagctgcttgagaacacgccggctgaactcgcccagatcggcgaacagcttgggtatcccttgatgctcaagtcgaagacgatggcctacgacggacggggttag

SEQ ID NO: 20586 - DNA, 213 bp, A.fumigatus
tccgtcatccgtacaggtgttcccgtcgcgacggtaggaatcaacaacagcatcaacgctgccctcctggcagctcgtatccttggcacattcgacccggctatccagcgtaaggtggaggcgtatgccgagcaggctaaacacgagaacatggagttgaaagggaccaagatgcaggaactcggatgggaaaagtactttgaacagatgtaa

SEQ ID NO: 20587 - DNA, 474 bp, A.fumigatus
tctcctgtccgtccccgccagtctatcactctctcgcgcagtcttcagacgcatcaagctcaatctcatgtgggcctgcctctacaacgtcatcgccttccatttcgccatggtctcttcctgccctttggcggctttatgcttccccccatggccgccggcgcggcaatggcagcatcaagcgtctccgtcgtcgtcagcagcctgctcctgaagttctggaaacgtccaagatggatggacgccgagaagctggagaaggcagcccagttcggcagcgccggcccctacggctcccggaagaagtggtgggcggctgcgctcgtctccggtcctggcagtcgtcccagctggttggattgggccaggcggacgggcgcgagagtctggtcgactgtcaccggacgaaatccgagaacgatagacaccaacgatggctatgtccctctacaggcagtggagcctgtcgtttga

SEQ ID NO: 20588 - DNA, 1050 bp, A.fumigatus
gaattggccgtaatggttgtgaaaaccaaggacgcggtcctctcataccccacagtcgagacagtacaagaagattcgatatgcaagctcgtctacgcacctgcccgcaatgtctccgacgccatcaaccagaaagcccaggagctagcccgcaaggctgtcgcagcctttgacggcaagggtgctttcggtgtggagatgttccttctcgaggacgacagcatcatgctgtgcgaaattgccagccgcatccacaactcgggccactacacaattgaaggttgtaccctgtcccaatttgacgcccacctacgtgccattctcgacctccccattccccctcagagcctcgaaatccgccaaccgtccatcatgctcaacatcattggcggcgccgccccagacacccacctgaaagccgccgaggccgctctctccatccccaacgccagcattcacctctacagcaagggcgccgccaagcccggccgcaagatgggccacgtcaccgttaccgcgtccacgatgcacgaagccgagaaatacatccagcccctgatcgacgttgttgacgagatccgctcgaagcgcagcgacatcaagacacagcccgtcaagtccggcccgtcgaagcccgcccccaccgttgctgtgatgatgggctccgatagcgacctcaagacactcgtcccgggcctgaaactcctccgtgactacttcggcatcgagcccgccgtcgacatcacctccgcccatcgcaccccaacgttcatggccgagtactcagccagcgcagccgcgcgcggcattaaggtcattatcgccgctgcgggcggcgccgcccatctccctgggatggctgccgcacacaccgtcctgcccgtcatcggcgtaccggtcaagggcagctcgctagacggcgtggacagcctgtacagcatcgtccagatgcctagaggtatgttatcttcttttcttttatcatattttccattctgtggacagcccactaatccgtcatccgtacaggtgttcccgtcgcgacggtag

SEQ ID NO: 20589 - DNA, 3762 bp, A.fumigatus
ctcttcgttcaacaggatgagattttcgtttatgaccgccgttttgttagcgaacccgagaacgttgagctcccggagcttccttctcccgaacctttcaccccggacactcctcctgataccttgaccaaccagaacgatctccaagcatggcggaacctttacatggccagacggtcatgggccttaggcctggtagagaggtgtggagctatggacaagagcatccacgaacacaacgagcggacggacatcatccatcgggcggcaggcgtagctctcgagaatctaaagacccatgttggcaatctggaaaatcggtttcaagaggctcagacgtgggcaaatgacttgttgaaagagcagcgagccgctctggatggatggcagcgtgctctcacgacactcgaaagcattcccgcaccaaaagtctttccttttctgggacgtccatcaacccctaaagagcacagagaccggccaacagggacgcttcgggatttcgtagatgcaaatgaggtgcaaaaggccggagcggaagcggcggctgagtcttcgcgctttgcccgtcaaattgatgatgttgctgaagctgttaggggcatcactgcagacacgcaacgcttgatcgacgatcagttgccatctggagccgacgccgccgacggactgcaggagatgattaccatcgcgaagaaaataagctccgactatgagcacgttatagctctaccgaacaatcagaagacgttagcaaatatctccaggcttgcgctaactcatactcaagatctcctcccttcaatgttggatattagtgccgagatccatgccgggcttgaggaagctgtcaggcgacataatactgcaatgaaagtggctctcgatcatatgcggactatctcggcaattgagctacgccttgcggacgtacaatctcaaatcatcaaccttaatgtccagagcgacgcgtttgatgttgtcttctccgtctaccacatgcctatggtctacggctctatcttagtggagtccgtgcggcgtcgtgagttcaatgaaaagatgaaggccgattctctgacgctggccgaggagatggctgtcttcagggatgaggagcagcgccggcgcaagaaatggctcaagagcatgggtgacttcatctcccttacagagaccacgactccgggagtcgagatcaatctgcagggcctcgactatgaatggcccgaggtcagtagaaacgatatcgaatcatatatcgaacatctcaaatctcgaccagccatggctagtctagccgatgggcttacacaacagtacaaggacttagatgcacctactcgtcaccaacgccgcagggcaaaggcttttaagcagggcagcatcttcgacttaagccgaagctccctcctcctccggagcgacgatatgctgcggagtctgagggaggagaagtccaagctggaagagaagttgaagggttcggaaagtcggattcgaaagctcgaggacctgcttcaccgccagagccagctcagtcggccggtcagcggaaacttcaatctggaattccctagctctccggcctcgccgtatcccgatgagctttccaggcgttcatcagtgtcgtcgcgaaggatgtctgccaaccagtcttcagaggacaaaacgctagcgcagcggattgtcacactggaggcagagctaaacgcagagcgggagactgtgcagaggctccagaaggaggcgcatgcggagagattgtccaataccgataagatacaggaggctcagtctacgaagagagatctcatcgacaatcttgaagcccgccaacgggagttcgacgaagagcggcgttatctggagggagaattgaaaaaatacagacttcgaacggaagaacttgaggaggaactggataggattacagacagccgcgaccatgcgaaacaagacgccgacgaacggatcaatcaactcgagaccgaactgcaaaaccttcacattcatacagaggaagagctgcaccgagcaaacgatttgctcgagcaaatgcaggctcagaagatgacggaagagagcctccagcaacgaatcaacgagcttgagaagcagcagtcggagatcaaagcgacagagcaagagaatcttcaaaccttgcaggctgcttttatgaacctgtcccctggaggcgctgtgccggctgaaatccctagtattatcaaggcaattgaggtactctcagaggggctctcgattcacgtcaagaatgccgaagaaaagatggctgaggcagtagccgagaacaaagccctcgaagagcggatgaatcaactggagaccgaggttcaagacgccaagcagagcgcggagcagcgcgagtcggaactggcccaggtccgaggagagctagcacaggaaaaggagaaactagccgcagtgcagtccgaactccacgatgagagatcgaagcttaatgctctacagtcccagcatgcagatggtgacaccggtactgatgccttgcgccaacgtgtggtagaagacgaaaggaaattaggaatcttgtctcaaagattagccgaggtcgaggctcaagctcgcgagtccgaaaaggaagtttgcgcatggaagaacaaactcaaggccatttcagaatccgagcgggaagcgacaacgcgcattgagattcgtggctcaagagcaaaggagctctcccagcagctctttgaacaggtcgagaagatggagcatatgctcgagcaactgggcttcactgtgattcggcaggacggggagatcgttgttcagagagcgtcgaaagtcaatgcctcctcgggtattggcgacagtcttgcgcagtccggagtcgtctccgtcaagccagaccccagccttctagactggatgcaagcagagactgcgcaagaggagacggatcggtatatggcctttttggagtctctgtaccagtttgacgtggacgtctttggagatgcggtcgtcaaacgagtgaaagatattgagctccttgctcgaaaatggcagaaagaggcaagaggatacagggacaagtaccatcggatgcagagcgaggcgcatgataagatcgcgtatcggtccttcaaagaaggggatcttgctctgttccttcccacccgtaaccaagccatccgctcctgggcggcgttcaatgttggagcaccacactatttcctacgcgagcaggatgcccataaactgcagacccgcgattggctgctggctcggatcacgaagatcgaagagcgtgtggtggacctttcaaagtcaatgaatggagcccatccggaccgtcgatccataggggggaccagtgacgcggcttcgatcgatgacgagaatcccttcgaattgtcagacggtctccgatggtacctcttggatgctaatgaagagaagcccggcgcccctgccaccccgggcctgggtaaaagcaccgttgcgccggcacacgtagatgcccgaggtagcattcgattgaaacgtacatcaaatggagggaacgttgccaaaacgttgacgaagagcctagacagtcgacgcaacagctcgagctccaaaaagggaccgccgttcgcaatttcccagcgagccaacgagtctacagcggaactcgcccggccagctgaggcgaatacccctgtctccccgagcgcacaagaggcagcgtccacccctgaagaggttcgccgtgaccagctccagggaccgtga

SEQ ID NO: 20590 - DNA, 1653 bp, A.fumigatus
  unsure (563): Identity of nucleotide sequences at the above locations are unknown.
agggattatcatccattcactcgaggggcctctctgtttgtcgtcatgcccacccccgagcgcaacaccgaccggctaccctcgtcgcgtcgcatctatgagcagcgctcacctttcagtcgagctcgtggtaattcccgagcagctgaagattttgacgcgtcgcggattcccagtccgtcctacaaatatactactcagcgtcgcacgaatttcaatgagaccaatacactaacaggagcgttcaggaaagcggggcgctacgcaacgatggcagagaacgagggcatttcggcatccgttccatatacgagagggacgccgagtcctggaagaaggcgcaacatctacaatgcccagtcccccgagtcgaatccgccgaacgagcttgcagaggcatatcgacagatagacgacgcggacagcctggtcgatctagagccagaggacgtctatgaccggggagataagattggacggtcatcaggctattatgcgcgagattacgatgtgtctacgacctcagacgcgagctttttgcccgaaattcaagacgagtcacnccgccgaaggttgtccgatcgtattcaggatgagaagcgcttgaggcgagccacgaccagccattctcctgtcttgtcgaatcgcggcggaactaagaatgccttgacagcggagaaccttcaacggcgtgaggaggaggatcagctactttctggagacgatgatactttccagcgcggactcaatgtgccttccaattggggcagccgagcgaaacgcaatagcgactggctcaggaagttgaagcgacgcgatgagcctgagcctgaacccgagcctgaaccccagcagaggccggagccgcctgccaatgtgtcgccaccagtgaagaagctcaatttcgacttccgtaccagccccggccgatccctagaaccggcatcgagcaggtatagcaggatccctctatcagacgccaggaacaaattgtcctcagaacataaggaagacaaggctatcggaggaacttcggagcctatcgccaatactccggtcattgtctacaagaactccagtttcaccaagccaagtccctcgaagcgcgactcgcatgatttgcttcgcagactggcccgacgagagagccctgaccagaatcgaaacgagcaggagttgaggactcccgaagcaccaaagggcggccagcgtcggatatatgacaaaacccctgtcgtgacaggtgcctggatagacactcccatgactgagcgcatttctgaacgcaccaccgagatgtcagagaagctcacgaatggttccatgccccaagttgcgtcaaacgagccgaaccccgttattcccccggtgcaagaggcagaggcagaggtcaaaggactcgagcaggagacggacggggacaaggagagggacaaacaagagcagctggagagagggggggaaagggggctagagaaagcaaagatggaggagggccaggaaaaggcaaggaacgagaatgaagagaaggacaaagaagcgaaaaaacaggaggagcaagaagaaaagaccaaggaacgagagaagaagatgaaaccgtcactcatcaaacccgatctgccgaaaagtgccctcgagtcggtcatacaggaa

SEQ ID NO: 20591 - DNA, 588 bp, A.fumigatus
tcctgtatgaccgactcgagggcacttttcggcagatcgggtttgatgagtgacggtttcatcttcttctctcgttccttggtcttttcttcttgctcctcctgttttttcgcttctttgtccttctcttcattctcgttccttgccttttcctggccctcctccatctttgctttctctagccccctttccccccctctctccagctgctcttgtttgtccctctccttgtccccgtccgtctcctgctcgagtcctttgacctctgcctctgcctcttgcaccgggggaataacggggttcggctcgtttgacgcaacttggggcatggaaccattcgtgagcttctctgacatctcggtggtgcgttcagaaatgcgctcagtcatgggagtgtctatccaggcacctgtcacgacaggggttttgtcatatatccgacgctggccgccctttggtgcttcgggagtcctcaactcctgctcgtttcgattctggtcagggctctctcgtcgggccagtctgcgaagcaaatcatgcgagtcgcgcttcgagggacttggcttggtgaaactggagttcttgtag

SEQ ID NO: 20592 - DNA, 1173 bp, A.fumigatus
caggggaaatatctgacacatcttgcttatatcgccttgaaaccactctaccgtggcacccccccaacacccgacctccaacaagaccacatcacaatgaccaagtctgcacgacgctccggcaagggtaaagcatcagcatcgcgctctgcctcgtcctccggatcgtcaactcccagctcgcaagcaggccctcttccacccttctccaaggcacccgccgccctccggcccttcctcgagcccctctcaccacaagaggtctacctaatccacatcgacacctccccgccagacctcaagaaacagaccttcatcgtaccagccataatcaatgtcgtgattgtcgccatcttcgccctccgcatctacatggtgcgcaacacctaccccgccatgatcgccacggtcatcggactcaccagctccgcggcggtagacacctcgcgactctcctcagccgaaacaagcagcctcatcatccgccgcaccttcagcctcatgatcgactacttcctcataacagtcttcctctcctggccgatacgtttcatccgcgggcccgtacaatggcgccgccgaatcggcttccaaggccgcgaaatcatcgtccgccgcagccagcgcaccctctctcagaccctggagcgaaaccgctggatccgcgataatgacgaagcccgcgacaagatcgtcgcggccattactcccgaccgcatccgcaagacgggatatctgctcgtcgacgcggactgggacctggactacgacgctatgatcaaggcgcacgagatggtcgatcctgcgcggaaagacgaccgtgtcgccttgtctgagttccgcacagccgtgctggtcaataccgatgcggacgggtggctgatctggcgggtggaagacgaggacaccgcggaggcgaggaagcggtcagcccagagcgaccagatcctggcgttcaaggacaagttgactgccatgggcaaggaggatctcttcttccggtgggtggagctaatccagtacgagagcacgcagccgggcggcttcacgccggaaagacaacgctccgctatgctgcaggcaaaggagctgttcgaaagggagaacgtcgactttgcgcgcttctggcaagaagttggggggatggaggggttttcggatcagctcgattga

SEQ ID NO: 20593 - DNA, 288 bp, A.fumigatus
ggcgactcgtatatcacttccaatagttcatctcttcccaggagggagactagcgacggcgcctttcccggtatctgtcatcatctcgacgatcacgtcgctcgtcattgtaggacctttcacgatttctatcgcgataggagtcttcccgccgaggacttcgactgtcggatctatcgcggtagcggttccgatgcaagccgcgcttggggctgcgactgtctcttcttgagcttcttttgggactccgactgtaacgtcgctctcgagaaaccggccgccttctag

SEQ ID NO: 20594 - DNA, 189 bp, A.fumigatus
gaccgtccaatcccaggctttggaaagcgcaaggatgttgactcgtccataatagccaagcagtgctacaactgccagggactaggccacgttcaggccgattgtcctactttgcgtctcaacggtggagctaacggccgctgctacaactgcaaccaacccggccatcttgctgtacgtcgctgttga

SEQ ID NO: 20595 - DNA, 285 bp, A.fumigatus
atcaaagcgttggctgacattttgaagggtcacatctcccgtgactgcactgctcccaacggtggccccctgagctctgctggcaaggtctgctacaagtgctctcaagccggccacatctctcgtgattgccctaacaacgacgctgctaaccagcagcctgccgagtcggctactgctcctgctgctgctgccgctgctcctgccgctaccactgtcaccgctgaggtcagcgccgaagctgctcctgtcccggcccctgctcccaccgccgctgtcgcttaa

SEQ ID NO: 20596 - DNA, 375 bp, A.fumigatus
gggaagcccattcttactcctcctttttgtattaggggtttgcggaactcggtcttgatatcttttctttcttttcttttttttttttttcccctctcacaattcttccattgcatatattatgcccccggtttcaggtttctcagcaccggccttttttataactattatgtatacgacgaacaaaagtttcacgatgtccctaggttcctgacgacttggatcctacacatggctcaaggttatcatgattggcgtctattgttctccccgggtatctttctcatttatcacatggtgcggcaaggaaagaaggagacgtggcgaggcgaaaggttaattgagcgcaggagagacattggtggaccggagtga

SEQ ID NO: 20597 - DNA, 483 bp, A.fumigatus
cttctctctagtggttttcagagcatgagtatcagtgaagtctttggggaattccgttgcggtaaaacacaactgtctcacacaatgtccgtcgtcgcccagcttcccaaggagatgggtggtgcggatggcaaggttgcctatatcgacactgaaggcaccttcagaccagagcgcattgctcagatcgcagagagatttagcgtcgatcccgattctgctcaagagaatattgcttatgctcgagctctgaacagcgagcatcagctggaactactcaatactctgagtagagaattcgctggaggcgagtacagattgttaataattgacagtatcatgaactgcttccgagtggattactgcggacgaggagaacttgcggaccgtcagcaaaagctgaaccagttcttgatgagacttgcacatatggccgaaggtctgtcgctgtcaatatcctttacggaactttacaggaactaa

SEQ ID NO: 20598 - DNA, 459 bp, A.fumigatus
gtcgggttattgaggacttctcttttaaacagcctcttaacaagggacactacaggtatcaaagctgtcagaaagctggcggaaatgccaccatatccaaacgcagtcaaagaggcggccttcggtggcgtagctgagcttgagaagaagcggcagtatcgggcgactgacaacgtccgtgagcaggatgcctatggcatggtttttgataaaggtgaagctagaaggcggccggtttctcgagagcgacgttacagtcggagtcccaaaagaagctcaagaagagacagtcgcagccccaagcgcggcttgcatcggaaccgctaccgcgatagatccgacagtcgaagtcctcggcgggaagactcctatcgcgatagaaatcgtgaaaggtcctacaatgacgagcgacgtgatcgtcgagatgatgacagataccgggaaaggcgccgtcgctag

SEQ ID NO: 20599 - DNA, 198 bp, A.fumigatus
tcggtgaaactgggtctgcagatggtttgccccaccctaaaggatacagaggcccaaagagccattcagggagctcgaatcgagacaaccagagctgacatttatatcattcgtagaactgggtcggtcaagccagctaaaaataattctaccaagaagatcaatggtttcgtcttcctggcggtcaacggatggtga

SEQ ID NO: 20600 - DNA, 801 bp, A.fumigatus
gacttactcatcaatatggccgtagctatcaaagagacagtctccaacttcatggagagattccatggtcatccagagaaccttccccgtgaaccatctgctgaagagttccagcagcttaggaaaaagtacaccgatgccggccagggtcatgtcttcgcatttgttgacgaattacaaaccggcgagaggtcccagctcttccaccagctatcaagcttcgaccctgtgcgaattaacgaactcgcagacaaggctctgaaccctcccaaagcagacgatgggcccgcttcgcttgaacccctgccggatatcgccacggcatcgattctcgactcagatcccaaggatctcgaacaatggtatgaggaggggctcaaacttgtggcgggtaacaaggttgcggtcgtcctgatggcgggtggacagggcacccgtctgggaagctcagcaccgaagggctgcttcgacatcgggcttcctagtcacaagtcgcttttccagatccaggcggagaggatcgctaagctccaactacttgctcagaggatttcaggcaaggaggctgtcatcccttggtacgtcatgaccagtggacctactcgcaagcccacagaggagttcttcgaacaacacaaatactttggattgaacaagagcgatgtcatcatctttgagcaaggcgtcttgccatgcatctccaacgagggcaagatcttgatggagagcaagttcaaggtacgtttgcagtcgcatactaacactgtgctgcgcttgttgggttctgacatggaaaaatag

SEQ ID NO: 20601 - DNA, 774 bp, A.fumigatus
gtcgctgttgctcctgatggaaacggtggtatctaccaggcccttcttacatccggtgtgcgagaggatatgcgcaagcggggaattgagcatattcacacttactgtgtcgacaactgcctggtcaaggtggcggatcctgtgttcattggttttgccgcatcgaaacaggttgatatcgctacaaaagtagtccggaagcgcaatgctacggagtcggttggtctgatcctgcaaaagaacggcaaacccgatgtggtcgagtactctgagatcgacaaggagacggcggaggcgaaagatcccaaacagcctgacgtgcttaagttccgtgctgctaacattgtcaaccattactattccttcaaattcttcgaatccatcgaattgtgggcacacaaactgcctcaccatgttgccagaaagaagattccttgcatcaaggagggcactggcgagttcttcaagccggaaaagcccaacggtatcaagctggagcagtttgtcttcgatgtcttccccatgactcccttggagaagttcgcttgcatcgaggttcgtcgtgaggatgagttctcaccattgaagaacgcgagaggcactggagaggatgatcccgacaccagcaagcgggatattatgagccagggacaacgctggattgagaaggcgggcggtattgtcattactgagggcgatgtcgttggtgttgaagtatctccactgatcagctatgtaagttcctcccttccccttcatttccggtctttttga

SEQ ID NO: 20602 - DNA, 258 bp, A.fumigatus
gtggctctccagcgcaactgccccgctcctgcctctggtgccggtcgtggtgtcggtgctccccgcgggggatttaacggtggattccgcggtggatacggtggttaccctcgtgccgctacttgctacaagtgcggtggtcccaaccacttcgctcgtgactgccaagctcacgccatgaagtgctatgcttgcggcaagcttgtaagtgctctcacatgcagatgccttaaatcaaagcgttggctgacattttga

SEQ ID NO: 20603 - DNA, 264 bp, A.fumigatus
acaaaccaagtccaaagtgacccaggcgccagtgctctatttgcgggagctgatggccgtaagcctgttggtggccatgtgcttgcgcatgcatccacgaccagagtcctccttcgtaagggtcgtggtgaagaacgtgtggcgaagattcaggactctccaggtttgtctcgttccgacactctcagcaggactagcctgaccatctatagactgccccgagcgagaagcgacctatgtgattaccaacggtggtatcaatga

SEQ ID NO: 20604 - DNA, 210 bp, A.fumigatus
ccatccttatacagcacaaacgtcggcatcgcccggatattcatctcctgcgccacagagcgcaccttatcgacatcgacctggataaatcgcacattggagtacttctcgctaagctctcccaccttaggcgctaccgcccggcaaggaccgcaccacgtggcgaagaaatcgacgacgacagggccggacgaggtaagcgctttgtag

SEQ ID NO: 20605 - DNA, 255 bp, A.fumigatus
ggacattcacatcataagtacgacacaatgtccaaaagagctgccgacgcgtccgaggagcactcggccgctctcaaggccggagagcggccggtggccgatgacattccggacgaggtgggggagttcgaagatgagtttgaggacgaattcgagagtgaggacgagattttggaagcaggtgtcgatggaagacctgacgcagagcgcgaagaagaggagaaaggtttgcttgccaatttatctgttgcttga

SEQ ID NO: 20606 - DNA, 1302 bp, A.fumigatus
attgttactgacaggaatgcgatgacaacagacgctatggaggttgacaaacagacattcatccctggaagaacaaaactggctcctggagaggtattgtctccggatccgtctacttatgacatgttacacacgctcagcacaccatggccttgtctctcatttgacattgtgcgcgattcccttggcgacaaccgaaagacataccccgccacggtctacgctgtttctggtacacaagcggcgggaggacgagcaaaggagaacgaactgctggtgatcaagatgagcggtctgagcaagatggagaaagagaacgagacagactcggagagtgattcggattcagacgatgattctgatgagccgattctcgagtcgaagagtattcctctcggttcaacaacgaacagaatccgcgcacaccagaccccttcccagtccgccgactactccaggccgccacagaccattacagcgaccatgctcgaaaactcccaggtcgtcatccacgatgtgactcctcatctgaccagcttcgacgtccctggcacagtattgtcgccgtcggcctccaagccgctttcaaccctgcgcatgcacaaatccgagggttacgctctggactggtccccactccagccgcttggaaagctgttgaccggtgacaatgacggattaatctacgttaccacccgcacagaaggaggaggctgggttacagacacccggccattcaccggccacacatcctccgtcgaagaactacaatggtcaccaaatgagcgaaatgtgttcgcttccgccagcagcgacggaagcgtgaaagtctgggacgtccggtcgaagtcacgcaagcccgccgtcgacgtcaaggtctccaacacagacgtcaatgtcatgagctggtcgaagcagacgttccatcttcttgccacaggtgctgatgatggacaatgggctgtctgggatttgagacactggaagccgaatgcgtccgctccctcatctcagatcaaagcatccccagtcgcggctttcgacttccatcgtgagcccgtcaccagtatcgaatggcaccccacagacgacagtgttgttgctgtcggttctgccgataataccgtcactctctgggatctggctgtggagcttgatgaagaagagaatcgcgaagctggcctggccgaagtgcctccccagctgttgttcgttcattacatggagtctgtgaaggagattcattggcaggcccagatgcctggtaccatcatggcaacaggcagctccggattcgggtaa

SEQ ID NO: 20607 - DNA, 462 bp, A.fumigatus
aatgtgtgtccatacttgatcactgctaaacaaccaggcaacaccgatgtaaacattgcatcgcaagcagatgcagactccatcgcctcatgtcacaccgtccgtggtagtgtgaccatggcgagctctgtgagcggagcagtcaacctccacggagtcgagacaatccagggccctctcacagctcgcggagcctcggacctcagtgccttgatagcgtcggacctgaagaccattactggaacattgaccgtggcgaacaatgatgcgctcaatcaaatctcaatgtccaacctacagaccgttggaggagacttcaaagtggagaacaatcgaaatctaaaagatttgtcgttgagtgatctggacgagatcagagggggggtgaccgtctctggtgaattgaatcggttcgttttggtatattcttcttgtatttcgcacagacctgacgaggcgtag

SEQ ID NO: 20608 - DNA, 699 bp, A.fumigatus
actgacatctgcgactcacgttctcatttttcgaccgaggtacctcgccgggcactagaagtgcctatggtcctcaaggcaattctagctctcgcagccagactcgacgccatcctatcaggcgctagcgactgggaagcggccgaatatcacggccaatgcttggaactcttaatcgctgcactggcgcagccggaggatacctacgatgacaacctccttatcacagttgtgattctacgcatctacgaggaactggaaagcagcaacgacgaaaagtaccatttgttcggctcaaaccgtctcctcaacaccatgtccagatcggcgtcatccgggggcctagccgaagccgtgagctggcagttcctgcggcaggcgatatatgcatctgtcgtccagtatcaacccatgcaattggacctggagaactatgagcgctcggctgtctttcaccggcgagacgatgctgcgtatgccaatgtcatcatctacctctgtgctcggattcttcagggcggaggagcgtacacccgtggcatggacgaggagacatggcgtcaactctccgatagcgttgagcaatggcatcgagaaaagccagtcagttggcaaccgttgaagtacaagccggcgaacattgcggagaatcgaccatttcctgagatctggatgatgtctccgccagcaggtatgtaa

SEQ ID NO: 20609 - DNA, 690 bp, A.fumigatus
  unsure (347): Identity of nucleotide sequences at the above locations are unknown.
atcggttcgttttggtatattcttcttgtatttcgcacagacctgacgaggcgtagaatctccctctcgaatctcgatacagtctggggaccgactgtaatccatagctcaggtaccttcaactgctcaagtttggatagtaaactgtctggagaggacagagttttccagagctcgtactcatgcacgaccggcaaaagcaacaagtcatccggcagcgatggcctcagcacgggtgcgaaagccggaatcgccgtggcagtggtgatcgtcgtcctgctgattctcttcttcctttggctgctcatccgccgacgaaagccgccaacagaatcgacggacagaanagacagtgacggacgctatcgcatctcaaacaccagctcccacgggccacgaatccaacacagaaaagctgacttcaacgctcacgccgccccaagaggacgtcgagaggggtatcccccgaaagccagtgtcccccccaccagcggcagacaggaggtcctctgttccagcatccttgctcccgggatcggggaggttgtctgttcctgtatcattacttcctgggtccaatccatcagtgtcttcggcttctgcgtcccaccgaagagtcacgtccgacccctcgctatttttacatcatatcgcaccttcagcgccacagcctccaccgtcggagattga

SEQ ID NO: 20610 - DNA, 189 bp, A.fumigatus
ttactcacgcaatggtttcaaattcggatcccagaatgcgctacagccacactttcgcgtcttgggctagctgtcgtcaaggttcccatcgaacccccaccggaacacctccgattctcagagctgtccctggatatttctatcctcttctaccgctctgatcccattcttttgtctctactcccctaa

SEQ ID NO: 20611 - DNA, 234 bp, A.fumigatus
gtttgcacccgtttccaattaggcagacacactgactggctagaactcgagcaaaaccactgttccatcacgcagcaactcgccgacatcactaaaacatactcatccaacagcactatcgccctggtgctagccgcgacagaatcggaaggtctgacctggctgcgggattactgccgtgaccagtacgtcatattcgtccctccagtttcttcaaaccaagacatatgctga

SEQ ID NO: 20612 - DNA, 363 bp, A.fumigatus
gcacttctagtgcccggcgaggtacctcggtcgaaaaatgagaacgtgagtcgcagatgtcagtctattgatgtcagaacgtactaccactataccatctatgaggggagcctttatacccaaggagctatcttggagatgaatgaacgtaacaagtatgcttcgcgagaggacagctttggcgaattgattgcccgggggcttatcggactccaggaggatgtctgctctgtccagactgttgacgccaaaggagatactatgctatttagtgccgttggcgagatggcagtagatgagggaagtatcagttgggtctcgtcaggtattgatggggtcggtgctgggaggtccagcgggtga

SEQ ID NO: 20613 - DNA, 1041 bp, A.fumigatus
gaaagcctgcccgctaccggcagttctgcaactaggtcagtttcagcttccctcgtgctccccgctcggtcatgcgatcggagaattaacggcagatgtatcatttcaggtcgtggagtcattcgtaacaagcttataatttgcgacatggatgtaccgcagcctgtgcctggtgtcccggatgtcgcagaaaccggtcgccaacagaatcttgagatctctggtcccgaactggcggctacgggggagtcaatgggacctccggagtttcacaatggatacagcagcgactctcgcgctcactacacctcacataatggcggtttcgattccccatccacacatgtatctcggaaccaggagaatgatcagtctcgagttactgaatctccaacattaacccaacaaccacgcccgccgtcatcatcgaggccgggttccggattgtctagcggccctgaacagcgacaaggaatatctcaaacatctcaagatgtcagtcagagaccaccatctcaaccgacgaaaaatagtgtggtgatcaaggttggaatggttggggatgctcaaattggcaagacaagtttgatggtcaagtatgtggagggcagctgggacgaagactatatccagactttgggtatgttgttcttttggacttgtgccttacttattctgacgttatcaacaggggtgaatttcatggaaaaaacaatctccatcaggaacacggagatcactttctcgatctgggatctgggcggtcaacgcgaattcgtcaatatgcttccgcttgtgtgcaatgacgccgttgcgattctgtttatgtttgacctcacccgcaagagcacattgaattccatcaaggaatggtaccggcagggccgtggattcaacaagacagctattcctttcctggtcggcaccaagtatgaccatttcgtcaattttcctcgagaagaccaagaagagatttccattcaggtaggcaagttgacccgagaagatgacaagcaatgtgctaatgatttctcaggttaa

SEQ ID NO: 20614 - DNA, 771 bp, A.fumigatus
cctggctgcgggattactgccgtgaccagtacgtcatattcgtccctccagtttcttcaaaccaagacatatgctgatattgggcaaaacagcgacgccatccccttcatctacaccaccgaccgcaaacccgttccgcacctcctcgtcccccacaccacccgcggccgcgaagcagccgcctacctctcctacgtcgtcgacttctacgaccaacttcccccttacaccatcttcatccactccaatcaagaccaatggcacaacgacctctttggccccaaaaccaacgtcgcgctgcgcaatctccgctttgaggccatcgctgcacagggctacgtcaacctccgctgcgaacacgaaccaggctgcccaacaaatgtgcacccctggtccccaacgcagattgatatcgataagaaggatatccgcgcgtactttccccaggtgtaccagacgctgtttggggttggcaaggagcgtgtccccgagcatattgggaatatctgttgcgcgcagtttgccgtcagcagggaacggatcctgcagcgcccgaagcgggactatgaacggatgctggcatgggcggcggagacggacctgacggatagctttggggtcgggtgggtgtttgagaaagtctggcatgtggtgtttggcatggaggatatctattgtccgcgctttgagcagtgtcggtgtgatgtgtatggatggtgtgggccgttggccaatggggagacactgcaggcagtgagggtgaagtcctag

SEQ ID NO: 20615 - DNA, 273 bp, A.fumigatus
tgtaaaaatagcgaggggtcggacgtgactcttcggtgggacgcagaagccgaagacactgatggattggacccaggaagtaatgatacaggaacagacaacctccccgatcccgggagcaaggatgctggaacagaggacctcctgtctgccgctggtgggggggacactggctttcgggggatacccctctcgacgtcctcttggggcggcgtgagcgttgaagtcagcttttctgtgttggattcgtggcccgtgggagctggtgtttga

SEQ ID NO: 20616 - DNA, 309 bp, A.fumigatus
ctaacattattcagtcccgtcatctacaaagcgcttacctcgtccggccctgtcgtcgtcgatttcttcgccacgtggtgcggtccttgccgggcggtagcgcctaaggtgggagagcttagcgagaagtactccaatgtgcgatttatccaggtcgatgtcgataaggtgcgctctgtggcgcaggagatgaatatccgggcgatgccgacgtttgtgctgtataaggatggtcagcctctggagaagagggttgttggtgggaatgtgagggagttggaggagatgattaagagtatttctgcttaa

SEQ ID NO: 20617 - DNA, 1701 bp, A.fumigatus
  unsure (1673): Identity of nucleotide sequences at the above locations are unknown.
attagtggccttacttcccattcttcaacatattatttattcattctttttcttcccgttcgcctagggggttcttcttttttaaatgtcgtcgttgcatgcgttcttgagggtgtgttagcttactattatttgttgtcttattctctctctttggtatatgcattaattgcatcttgtaaaaccgaggacatggccgaagaaacgccagtcctgacgattcaggagagaatcaaagcactcaaactcgcgggatcacagccgactccgttcttacgagcccaaacaattaacaaccctcccgccaacggtcacggttctgtccttgagcactcggtgatcggcaatgagccaggagcaccccctacacaggccccacgatcaccatcgacagggccgtcgatcgccttgaaatccaaggtgccgccgccgctgccaacacggaaagcttccaatcagcaacttgcgccttcgctgccacctcgcaggccatcggtgaattctattgaatcagctgcatctgatacgtcccggtcaaccgtatcgacaagtgtggggagacctgtgccagggcgatcatcttcctcaggtgaatctgggaacgttcatacggtgcgtgcacctcgatatgatgaggcagagttgcctgtcctccctccgagaagagaggaagagaaaagtcccaaggcgcctccacggccgaaaccgaccatgctaaagagcagagatggtctaccgccttcattaccatcgataagagagccgccatctcttccctctgctcgacctgtattgcccattcggcgagcgtcaagcaacgtcaatttgaaaaatggggatgcagcccctctgccgcccccacggatcccgtcgcgagacagtcagggccagtcgccaagtgcagaaggcgaaagcaagccggcgagaaagctgccccctcctcccccttcggggtctgctctgggcaaattgcatcagtcaggttttggaggattgaacaaaactgcgcactccacgctcaatggtgcaccgcctccgatccctatcgcgtcaaagccagagaaaccggacctttccaaattactagcaaccaaaccgcgtgtcgagcgaaatactacaaatacagagccgacagcgatgtgcttgaaatgccgagacttctccggccccgactcgcacgccgccaggtttccgcgggagagtctcccaacacatgatcttgcctggctggctcgcgagcttacagcaccattcccttcaccgacagacaaggcgagagccttgttcacctggtgccatcataatatatgctatgatgtcgatgcttttttcaacaattgcgtgaagccatcaacaccggccagtactcttgcttccggtgtcgccgtttgtgagggctacgccgggctctttgccgcccttgcaacccatgctggattggaggcgattgtaattggcggtcacggcaagggctatgggtatcgcgctctgggacccgggcagagtattcctccttacagcgctggccatgcatggaatgcagtccggatcgacaatgggcaatggaagttgatcgatgtgtgctggggagcgggagtagttcaaggaccaggacaaccatataaaaagctcttcaacccgaccatgttcaccatgacaattgaagaattcancggcaaacactattctgaaggcaaataa

SEQ ID NO: 20618 - DNA, 579 bp, A.fumigatus
ccagtacgtcatattcgtccctccagtttcttcaaaccaagacatatgctgatattgggcaaaacagcgacgccatccccttcatctacaccaccgaccgcaaacccgttccgcacctcctcgtcccccacaccacccgcggccgcgaagcagccgcctacctctcctacgtcgtcgacttctacgaccaacttcccccttacaccatcttcatccactccaatcaagaccaatggcacaacgacctctttggccccaaaaccaacgtcgcgctgcgcaatctccgctttgaggccatcgctgcacagggctacgtcaacctccgctgcgaacacgaaccaggctgcccaacaaatgtgcacccctggtccccaacgcagattgatatcgataagaaggatatccgcgcgtactttccccaggtgtaccagacgctgtttggggttggcaaggagcgtgtccccgagcatattgggaatatctgttgcgcgcagtttgccgtcagcagggaacggatcctgcagcgcccgaagcgggactatgaacggatgctggcatgggcggcggagacggacctga

SEQ ID NO: 20619 - DNA, 210 bp, A.fumigatus
ttgttgtgggcagtccactattttatgctgaattgcactgcttactcatcaacacatcacatcggcgtctttccctctaattcacggacccatcttttgcttcaccactcctctgtcagcatcatggattacacccgcattatcctcgctctcgctgtctacatcggtaaacactcccgcccctccttccctcgcaacccttctcattaa

SEQ ID NO: 20620 - DNA, 195 bp, A.fumigatus
gcagtattctcgccccatcgaacagatcacctcgctattttgacggctgcggccattgtcccctcctacctgcagctcagtttccacagggcacagcttgtcaagatcatccagaatcacaaccgactggccgccaagacgagcacaccaagaagcagacatgaacaggcgattgagggtctccttgatatttga

SEQ ID NO: 20621 - DNA, 357 bp, A.fumigatus
attggcttgctccattgcctcacgatggctctcgttcagtacccaccgccagtcgactatgcggcgcaactcaacgccttcaaagactttttgcagcatttcaaaacattcgaatcagcttccgaagctgctgcaaccgaggcgattgaagatctccacatcgacggagatgctaccagcgatgaatatgacttcatggacgatgtggaaaatgagaacgggcaacaagggacaagagcacgtcgcgggcgtcgagaaccaaagctcaagtacatgcagatcctgcaggacatagcagatcgggaacggtcaaacgttctgattgaattggatgacttggctacagtaagactctag

SEQ ID NO: 20622 - DNA, 624 bp, A.fumigatus
tttggcatgtcgcagagtagagacttgtccagtcgtccgggccggagcaacgcagggtcaattaggtcaggccgagacgtggcagcaagaacatacacgcctgagaggccttccgcaccatccatctgtgtgagaagctggttgacgacacgatccgtgacgccggtggagtcgtggccacgcttgggagcaatactatcgaattcgtcaaagaagagaatgcacggtcgagcggcctgggctcgttcaaacagatcacgcacactcttttcgctcgcaccaatatacttgttcaggatttcgggacccttgacgctaatgaagttcaggccacattcgcctgctatcgcacttgccagaagggtcttcccgcatcccggaaagccgtacaggagcaagccggaacgcaaacgcagaggacattgcgcgaagataggcgcatacttggttgggtactgcaaggtttccagcagcatcttccgggtctcgtgcagaccaccaatagctgaaaatgttgtggtagaggatgtgagcgtgacattgcgcagagatgccggcgtgaatcctctgatggcgttctcaaagtcctcagcaccaagagtgactgctttggatgcggcctga

SEQ ID NO: 20623 - DNA, 2139 bp, A.fumigatus
  unsure (1351): Identity of nucleotide sequences at the above locations are unknown.
agtttccatctaacagcctacagcttcaaggacgatgttctcgatgtcatcatgtcgcaacgtgaaaagcggaatgaggctatggcgatggctgcggaggccgatatggatgcggctgcggctccctcgatgtttcctcccgagttgactcgtcgatacacactcaatttcaagcctcttactccgtctgggtcgagcagcgaccggtactccaaggctctcgcagtccgtaatgtgcgagcagagcacctgggtagtctgatcacggttcgcggtattacaactcgtgtctcggacgtcaaaccatcagtccagatcaacgcctatacttgcgatcggtgtggatgcgaagtgtttcagccagttaccacaaaacaatttctgcctatgactgagtgcttgtctgaagagtgcaagcagaacaactcgaagggacaattgtttctttccactcgtgcctcgaaatttgttcccttccaggaggtcaagatccaagaaatggcagatcaggttcctgttggtcacattccacgaacactaaccattcactgccatgggagtctgacacgacaactcaaccctggagatgttgtcgacgtcgcgggcatcttccttcccacaccttacaccgggttcagggccatccgtgccggcctcttgaccgacacatacttggaagctcagcatatcacacatcacaagaagtcgtacaatgatctgacgatggacagccagacgctccgaaagattgaacagtaccaaaagtctggaaatatgtacgagtacctgtctcgttccatcgctcccgagatttacggccatcttgacgtgaagaaagccttgcttcttctacttattggaggtgtgacaaaggaaatgggcgacggcatgcatatccgtggtgacatcaatatctgcctgatgggtgatcctggtgtcgccaaatcgcaattgctgaaatatattgccaaggttgctccacgaggcgtgtacactactggacgaggtagcagtggagttggtcttaccgctgctgttatgagagaccctgtaacggatgagatggtgctggagggaggagccctggttttggcggacaatggcatttgctgtatcgatgagttcgacaagatggacgatgccgatcggactgctatccatgaagtgatggagcaacagaccatctccatttccaaggctggcatcacaacaaccctgaacgccgtaacttccatttctggctgcagccattctttttttatggacggaacaacccgcgaattttttccagtggagaacatcaccttccccgccgcattgctctcgcgtttcgacgtcatgttcttcatcntagacactccacagcgggaagccgatgaggaattagccaaccacgtcgcgtacgtccacatgcacaacaaacaccccgaggtcgacgatgccggagtcttgttcacaccaaatgaagtccgtcagtacatcgctaaggcgcgcacatatcggcctgtcgtgccttcgtcagtttccgattacatggtcggagcttacgtgcgaatgaggaagcaacaaaagagcgacgaagccagcaagaagcaattctctcatgtgactccccgtactttacttggtgtcgttcgtctctcgcaagctcttgcccgtcttcgcttcagcgaagaggtcatcagggaggatgtcgatgaggctttgcgtcttatcgaggtcagcaaagcatcactggccaatgacggtcattccggcatagaccagagccccagtagcaagatctacaatctcattcgcggtatgcgcgagagcggtgctgccgctgttggggacggtgaagagggtgaacttagcatgagaaggattagggaacgcgttcttgccaaaggcttcacagaggatcagctcacaatggcgatcgacgaatacgaagagcttaatgtacgtgttgtcagcttgaatagtccttggtggctcttactaatgtctttgttcctttgcaggtttggcaagtcgttaacaacggaactcgcctcattttcttggatctcggaggcgatgaggcaatggacatataataggccagcaaacggttgcagtttagactggcaaaaagtaatcactgtagtctgctga

SEQ ID NO: 20624 - DNA, 327 bp, A.fumigatus
actacctttcaaacatccacgacaacagccaccaagatgaagaacctctccatcctcacctctctcctcctcacctccgcctccctcgtcttctcctccagtattccccccaagtgcggaacctgcaacccgctctccggcgagaaccactgcgacattaccaaccttctgcatcaacacaggcactcgcttccattgcgcctgccgtgccggttacaaggcctcgaaggacaaccacgacgtcagcaaacagttccgtctgaatgtccccaactaccagttcctggtcttcacccccgaaagcaccgagtgcaacaccctctgtga

SEQ ID NO: 20625 - DNA, 207 bp, A.fumigatus
gtaacagcgccggaagatggcgcccagaaaaccctcgagcatagccgatgtcgcactcgttcctttgaagaactgtctattgaaattgcctccgtcacttgtctcactgctggttcatgccaacactgtacgtccccttcccctaaaacccctggttttgactttacaccatctaatctagttgctaggctgcccaaaatgtcatag

SEQ ID NO: 20626 - DNA, 3243 bp, A.fumigatus
atgatcgcgtccgctgacaacacgttgccaatagttattgagcttcatgcgaatttcctggagctcaatctcctgtcacaaatccgcgctctcccgaatcctacatacagctcggcacagtcggagcacatgcatccccttgcgctgcacctttccccgacatccaccgctaacatcatcactacctcgcttactcctgcaccatcaaatacatcgccatttgtgaaaatagcacccgatgcagaagttattgtcgcgccaaaggtacgccctaaatctgcctcaagaggtccaaggggcgatagccgaagcgtgaatggcagcagcaggaaaagtgtcggtgggagaagcagtggaagcacggtgcgacccaagagcggccgtgactccacaagtagaggcgctctcttttttcgaggggtggatcgccgcttggttgagccgtacttcgatgaagaattcgaggatgataccaatgagggcttccgcgtgtgggtcgaccccgacatgcttgcaacaagtgagctccgtggggccagctgggtctgcattgctgtcgtccaacctgcgggattaaaggcgccgccggatccccagcaacaaatgaaccaggccgagcagaaggcaagcgaagcagggctgccggcgacaaatctggtggctaggttagcgccctgggtagactcgccagacagtcagcatatcgccatgtctactatgctatgctctgcgctgggcgctgaaggtatggttgggggcattattcgtgttgaagcagctcctccgcagttgcaaccatctattgtcaggacgcttaagatctacccgttcatgtctgattctgctaagaaaaaggacggactcaaatttgggtcagacactgctgcagccaaagatgcgcttcttgagcgtatcaaagtgatttatggtagcaccgggacagataaagggctgttgtctggccctttaaccgaggggatgattttaccaaggttcgaaaatccaacagtgtccgcgttcgatggcgctattgtccgattcgatcctcccctgaaaagcagtcctgatggccccaagcagatgctcggctgggttttggggtccgaagcgaagctatcgctggaggtgcaagctgagattccaagacctgctgaacaaggtcaattgtccttccccaccgaggagccgcttcccaacagtattcccgagatggttggtatcgatcaggtcatttctcagtcccttgacaacttgaccaaatcatcttctgtcttggtgacgggcggtctcgggtccggaaagacagcgctgacgcatttgctggcacatcgtctgcgaaaagaccatttgttcaacgtgaaatatttctcttgccgtaaacttgtcactgatgaaactcgaatctcaaatatcaaggagaccctcaatcgcctgttcatgtctgcttcttggtgtgctcgtcttggcggccagtcggttgtgattctggatgatcttgacaagctgtgccctgtggaaactgagctgcaggtaggaggggacaatggccgcagccgtcaaaatagcgaggtgatctgttcgatggggcgagaatactgctcaatgaactcttctgtggtgctgttagcgaccgctcaatcgaaagagtccttgaacaacgtcatcatcgggggccatgtggtccgagagatcatccacctaagagcgcctgataaggaaggacggcgcaaagtgcttgagaagctgacgagccatgatcgagcctccaccagcctaaccaatggacatgcacgaacggcgagcgcgtccactcaagactcctggttagatccttcgaatcccggaagccgtccgagctccgctggtgcagatggctttgttctcgcccgagacatcgatttcctcgatctggctgggaagacagatggatacatgcccggcgatcttgtcttgcttgtcgcccgggcgcggaatgaggctctgatacggtccgttcgagaccctcaggccgcatccaaagcagtcactcttggtgctgaggactttgagaacgccatcagaggattcacgccggcatctctgcgcaatgtcacgctcacatcctctaccacaacattttcagctattggtggtctgcacgagacccggaagatgctgctggaaaccttgcagtacccaaccaagtatgcgcctatcttcgcgcaatgtcctctgcgtttgcgttccggcttgctcctgtacggctttccgggatgcgggaagacccttctggcaagtgcgatagcaggcgaatgtggcctgaacttcattagcgtcaagggtcccgaaatcctgaacaagtatattggtgcgagcgaaaagagtgtgcgtgatctgtttgaacgagcccaggccgctcgaccgtgcattctcttctttgacgaattcgatagtattgctcccaagcgtggccacgactccaccggcgtcacggatcgtgtcgtcaaccagcttctcacacagatggatggtgcggaaggcctctcaggcgtgtatgttcttgctgccacgtctcggcctgacctaattgaccctgcgttgctccggcccggacgactggacaagtctctactctgcgacatgccaaatcattcggaccggctcgacatcattcgagctgtgagtacaaagctggtgatggacgccgaggttgctgctcgtatggacgaaatagctgcgagaactgatggcttctccggagccgatctgcaagccgtcgtgtataatgcccacctagaagctgtccacgatgcacttggcgaccattcgggtacaaacgacaaatccaccgcaaagagcagttccaagcctacatcgagcaccagcagcaagtcatttatccagtttctgtactcgacgccggagcaaagagctagtgccgtctctttaccgccaccagccgtcgttgctgccaaaatcgaagccatcaagaacgcccggcgtcgtcaacggcagatcgaacagggtacaactagtgccgcgccgactacaaatggggctactactgaagaagcgccgcgcgaggagatcgtagtccgatgggaacacatggaacgatccctttccaacacacgctgctcactcagcgaaaatgaacgcaggcggttgcaagcgatctatcgtgaatttgtggagggacgtaatggtgaaatgccgaatggcgaagcaggtcgggagatcggtggtcggacgagcctgatgtag

SEQ ID NO: 20627 - DNA, 354 bp, A.fumigatus
agaacctctccatcctcacctctctcctcctcacctccgcctccctcgtcttctcctccagtattccccccaagtgcggaacctgcaacccgctctccggcgagaaccactgcgacattaccaaccttctgcatcaacacaggcactcgcttccattgcgcctgccgtgccggttacaaggcctcgaaggacaaccacgacgtcagcaaacagttccgtctgaatgtccccaactaccagttcctggtcttcacccccgaaagcaccgagtgcaacaccctctgtgacaacccctacggcgcaagcccggacttgtgcgctgaggttcctatccaagacaagtgcgctatttga

SEQ ID NO: 20628 - DNA, 249 bp, A.fumigatus
gagccaccaaggactattcaagctgacaacacgtacattaagctcttcgtattcgtcgatcgccattgtgagctgatcctctgtgaagcctttggcaagaacgcgttccctaatccttctcatgctaagttcaccctcttcaccgtccccaacagcggcagcaccgctctcgcgcataccgcgaatgagattgtagatcttgctactggggctctggtctatgccggaatgaccgtcattggccagtga

SEQ ID NO: 20629 - DNA, 189 bp, A.fumigatus
caaagaactcaagggttgacctgccttgtttcacagaacatctaccaagggttacaactgtatgttctgggcaaattccaactcgaaaaattgtgttgccatgtgcaaaattaccgtatcacgtgcaactacgttgtggccccggtcgtactgttgctcggcaaacaccccattgtcgaacaataccat

SEQ ID NO: 20630 - DNA, 624 bp, A.fumigatus
ggaagggttcccaacggggtaaaggtacagagggttgttttttgccccccatgggcaaggaattcacccgattggttaaggccgtggcatttaggttcacagtcaggcaaagctgcagcccagactgatgaaagcgacaagaccagcaaagaatcgcaggcttgcgagcaactttcacaggccttgggcggtgtgacaattatccagaaaggaccgcatgatgtaatttcaaacggtgtgacgaccctgatctcggacttgaaaggaggcttgaagcgcagtgggggccaaggagatacactcacaggatctcttgggacactgctggcttggagagctgcttaccataacaaattatgggactccggcgagcaagagaacccgaaagaagcgcagtctaagcaggatgtgttggctgagcttgagtcagagaacaagagaatgtccccagcgacaaccctactactggttgcatgggcaggcagtggcatcactcgtgaatgttctcggcgggcgttcaatgccaagggcaggagcctgcaggctagcgatcttactgacgaagttcatgaaagcttcttggaattgattggggaaccggaagcttccaggacccatctgtag

SEQ ID NO: 20631 - DNA, 660 bp, A.fumigatus
  unsure (122): Identity of nucleotide sequences at the above locations are unknown.
cggacttcatttggtgtgaacaagactccggcatcgtcgacctcggggtgtttgttgtgcatgtggacgtacgcgacgtggttggctaattcctcatcggcttcccgctgtggagtgtctangatgaagaacatgacgtcgaaacgcgagagcaatgcggcggggaaggtgatgttctccactggaaaaaattcgcgggttgttccgtccataaaaaaagaatggctgcagccagaaatggaagttacggcgttcagggttgttgtgatgccagccttggaaatggagatggtctgttgctccatcacttcatggatagcagtccgatcggcatcgtccatcttgtcgaactcatcgatacagcaaatgccattgtccgccaaaaccagggctcctccctccagcaccatctcatccgttacagggtctctcataacagcagcggtaagaccaactccactgctacctcgtccagtagtgtacacgcctcgtggagcaaccttggcaatatatttcagcaattgcgatttggcgacaccaggatcacccatcaggcagatattgatgtcaccacggatatgcatgccgtcgcccatttcctttgtcacacctccaataagtagaagaagcaaggctttcttcacgtcaagatggccgtaa

SEQ ID NO: 20632 - DNA, 645 bp, A.fumigatus
acagtcatctacatagacgctgacacaaagcgacaatatacctaccaagatgtgaaagagacggcgcttgcattcggcaatggcctgaaggccgttctggactggaagaagggggatgtccttgccctcttcacacccaactgcattgatacgccggctgtgatgtggggaacgcattgggctgggggtgtggtatctcccgcaaaccctgcatacaccgtggaggagctggcgtttcagttgaagaactctggagcgaaagctctcatcactcagatggcgctgctaccggttgccagggcagctgcaaagcaggcaggcatcacggaagaccgaatcatcctcatcggcgatgagcgcgactcccaggccaaatttaagcatttcagttcgatcaggaacatttcaggggcgaccagataccgcaagaccaagatcaatcctgcaacggatctggcattcctggtctattcgtcggggactaccggtgtgcctaagggagtcatgctgagtcaccgaaacatcgtcgccaattccctccagcttgcggcaggagaggctaagcagctgagttggaacggtggtgcagatggaaaaggagatcgaattttggccttccttcccttttaccacatctacggttag

SEQ ID NO: 20633 - DNA, 237 bp, A.fumigatus
tggctggcggccaacatggtggtgagctccttcgccattggcgtcctcggaaagtcgctctttgatctcggcttcgtcgatgcaattctcacctgcctctttttcaatctcttgggtgtcttgaccgtttgcttcttctcatgcttcggtgctgccttcgggttacggcagatggtgctttcgaggttctggttcggctgggggcccaccaagttcagtatgtatttttttgcataa

SEQ ID NO: 20634 - DNA, 1269 bp, A.fumigatus
ccgtttgcttcttctcatgcttcggtgctgccttcgggttacggcagatggtgctttcgaggttctggttcggctgggggcccaccaagttcagtatgtatttttttgcataatctcacttattgtcttttcaaagtagcaggtgctgacatcctcgttccttcagttgctattctgaatgtgctcgcttgtgtgggctggtccgctgccaacgccatcgtcggtgctcagctcatcaatgcagtgaatggcaacgtccccggattcgctgccattcttataattgctatttgcacgtttgtcatcacattcgctgggtacaaggttgtgcatgcctatgaatactggagttggatccctaccttcatcgtgtttatgattgtccttggtaccttcgcccactcaggagacttcaggaacctcccaatggaagttggcacatcagaaatgggcggtgtcttgtcctttggttcgactgtgtacggtttcgctactggatggactagctacgccgccgattatactgtgtaccagcccgctaatcggagccgtcgcaagatatttctctccgcctggattggcctcatcattccgcttttgttctgtcagatgctgggaatcgcggtcatgaccgctacaggaatcgacgatggcaataacaagtatcaaatgggctacgacgcctccggaaacggaggcttgttgaatgctgtgctagagcctctcggcggattcggtaaattctgcctcgtcatcctagcactctccattatcgccaacaactgtccgaacatctattcggtggccttaactcttcaggttctgagccgctactcccagcgtgtaccccgattcgtctgggttttcctcggctcctgtgcctctgtggctattgctattcccggatactctcacttcgagactgtgttggaaaatttcatgaacttcattgcgtactggctgtccatttattccggcattgcacttaccgatcatttcctcttcaagcgtggatttggtggatatcggcctgagatttacgacaagcgcgacaagcttcctcttggaatcgctgcctccattgcctttggattcggcgtggctggtatgatcactggtatgagccaatcatggtgggtcggacccattgctctccatgccggtcaagctccattcggtggcgacgttggttttgagctgggattcgctttctcggctgtgatgtatgccgtcctaaggcctattgagataaagattttcggtcggtaa

SEQ ID NO: 20635 - DNA, 720 bp, A.fumigatus
tccttttttttttcatttttttccagccgcgccgccgactgggccgacgacgaggagttcgatgacccctccgcgctccccgcgcaacaagtcacgacgaacaaagatggcacaaagaccgttgtttcataccgcttcaacgatgagggcaagaaggtcaaggtcacccgccggatcaagacgaccgtggtgagggagcacgtcaacccgcaagtcgcggagcggcggtcgtgggccaagttcgggctcgagaagggccacgcggccggtccctcgttcgacaccacctccgtcggtgagaacatcgtcttcagacccagtgtgaactggcgggtgcaggccgcggaggctgagaaggctggccccgaaaagggcagcatcaaggaccagctcaaggacaagaaggtcaagtgtcgtatttgcagcggagagcatttcactgctcgttgtccgttcaaagatactatggcacctgtcgacgagaccgctgccgctggtgctgagcccggcgctgatgatgtccccgctgctggtggccttggtgctggaacctcgagctacgtgcctcctcacttgcggaaaggtgctgctgctggtggcgagagaatggctggcaagtacgagaaggatgatctggcgactctcagagttacaaacgtgagttttacctcctgcccgtctgctctacatcccagtatcatcttttggaataaatactga

SEQ ID NO: 20636 - DNA, 576 bp, A.fumigatus
gtgagcgagttggcagaggaatcagaacttcgggacttgttcgagcgtttcggtcgcgtcaccagagtcttccttgccagagacagagaaacccagagagccaagggcttcgcttttatcagctttgcagatcggaccgatgctgcacgtgcttgcgaaaagatggatggctgtacgttctcttcccctctcgcctccttttttctttcattttacgaaatacagttgctaatatctttccccttctgcagttggttaccgtcatttgatcctccgcgtcgagttcgcaaagagggcgacttaaattcttgcttcctgatttcctttcacggcccctgggtgttttcgtcaggcagagctcgcttcatgactagagatcttccccctttttctttgtactgtatgactcggtcgataatgatgattataagaagacatgcgtcgtgtggtttgcttgctcgaggcgcgcggccattggatacaaagaaaagctatcgtttcagagggtttatattttcaccattctcatctgaatggaagcgtccaaaaatgagaaaaagttgtcatagtctctaa

SEQ ID NO: 20637 - DNA, 246 bp, A.fumigatus
cccttattctgtccgccagcaacccttttgcagagcccgttcctggagggatctgtcaccagcgacagcgattataccggggcaccacgacaatttgctggccctaccggcttttcgatggacgatgaggacaaccgccgacgaaacggtgctattggcccttccctagcgcagtcagtctcaatccctgccaccaacggcttgaggtacagcacacaacagtctgcaatgcaggatgtagcgtaa

SEQ ID NO: 20638 - DNA, 1215 bp, A.fumigatus
cggctctcgctaatgctgtatgcctcatttcagggccattttctcctgcatcaggctctatctattcacattcaaccagctcgccatacgagagaatgccggactttcggccacaacgtgtgcctgcactgtaggtctagccttttgcctgttaataccccatccgtcgaagcgatattgatgatactgaccagtcctcctagtcagccgccgcccgggttgtcgtccgctcttcagtctcaaggacagggcctttctagttcttcttcgatcctaggtcgccatgagaactacgcagctcagtacgcccttcaacggggaagtacttgtccttccctatcgagtctgagcgaaatgtcgagaatttcttcgtatacaagtactccacggggcctcgatcactcgtttgatgccccccacaatctgttcttcggacagactgggaatatttacatggactcccaacagcgcttaccccagccagtagcggacgcacctcccttccatgagactgatatactcttgccgatagtagcagggagtcaagcgatcaaaccagatattcacgccaagatacataaaggcttctttcaagtggacgataaatggacctgctatcggcggaactatttctcagtctcctgctcgttttccttacatccatggacgcgtgctcctctttacctgaagctttctgatcagacgacggagcgcatcctaaagttttccatgtgcatatcggcagttgtaaatgcacagtacggtgagactcgagagttggttcaacacactccgaaacgtgacaaacaatccgaaaggaagccggggaaagtcgttttgcaaccttgccagccgccgccgccattgcttctcaatcacggcgcagcgaatagtggtggtgggcagcacgcgtttgcgctgaactctcaatcggccgcattgtcgatggactacagttcttcatacaccggagctccgcagcagtcacagccgccgacgcagcacacattcgagcgtattcagttccagaaggcgacagcgaacaacggcaagcgccgggcgcagcagcagtactacaacttggttgtcgagctatatgcggagattacgaatcctaacaacgggagtgagacgcagtggatgaaggtcgctagaaaactttcacatcccatggtcgtacggggtcgttccccaggtcattacaaggacgggtct

SEQ ID NO: 20639 - DNA, 243 bp, A.fumigatus
gattatgcaaaaaaatacatactgaacttggtgggcccccagccgaaccagaacctcgaaagcaccatctgccgtaacccgaaggcagcaccgaagcatgagaagaagcaaacggtcaagacacccaagagattgaaaaagaggcaggtgagaattgcatcgacgaagccgagatcaaagagcgactttccgaggacgccaatggcgaaggagctcaccaccatgttggccgccagccactaa

SEQ ID NO: 20640 - DNA, 231 bp, A.fumigatus
cctggcgtaccacgaatcgccatatacaaaggtttccccaggcacagcaccatcgctgctactgtcgaaaggcctcttctctacctggggggctttctcaaggtcgtgctcaacgccaccgaacattatgatggacgtggtgcgattgcaccgtgtcttaacctggttgaaaaaactgagtcaatccccaccacctggggaggagaaatgaagttaatgataagagtatag

SEQ ID NO: 20641 - DNA, 855 bp, A.fumigatus
caacgctcagggaaacgctcgatgcctatcctacacgaacacttcgcgcccggatcacagatcaaggaaatgcaagcccatactgacatggtgacagccattgacttcgattacccgtttggtacgatggttagcgctgctctggatgacaccgtcagagtttgggaccttaatactggccgctgtacggggttcttggagggccataatgcctccgttcggtgtttgcaggtcgaagacaatattgtcgctacaggatctatggacgcttcggtcaaactctgggacttgagccgtgctcggactgtgacccgtgacaaccgtctcaacaaaccttcagagggtgaaggggaggacgacaatgcgtcagatgctttctcattgttttctgcaactactttggaggactgctatgtgttttcactcgacgcccacgttgatgaagtgacagcgctccatttccgagggaacacgctgatttctggctccgcggataagactttacgccagtgggatcttgtcaaaggacgttgcgtccagacattagatgtcttatgggccgcagcccaggcatccaccctcgctgctgacacacaatggcgcccttcgggacgcctcccggacgcatctgcggatttcgtcggcgcactccagtgttttgatgctgcgcttgcctgcggtactgccgacggtatggtccgtctatgggatcttcgcagcggtcaggttcatcgcagcctcgttggccatactgggccaatcacgtgcttgcaatttgacgaagtgcacttggtgacgggaagtcaggaccgcagcattagagtaagtcttctttctgtatgtcttttctcctag

SEQ ID NO: 20642 - DNA, 282 bp, A.fumigatus
ctgcagatatgggatctacgcatgggctccatcttcgatgcctacgcctatgacaagccaatcactagcatgatgttcgacacaaagcgcatagtcgctgcggctggagagaacgttgtgaaagtatatgataaggccgatggacaccactgggactgtggagccggggttggtgcagatgagtctggccccgcgcctgcaacagttgagcgagtacggctcaaggacggatacttgctcgaaggccgcaaggacggtaccgtggcggcctggacttgttga

SEQ ID NO: 20643 - DNA, 186 bp, A.fumigatus
tttctttatctttctgcccatttgcccacagggcttattttctgtggaagcatgatcggcgtttacttgacttacaaagagctttgggtttcggagggcgctttgaaggctgagattcccccttactacaatagaaatgcttcaagttctttcttcagcttctctaaacttctctgtatcatatag

SEQ ID NO: 20644 - DNA, 318 bp, A.fumigatus
ggtatagactcaccctcctgctcctgtcgcatcttcgtgctaacgacattttgtgaccaggaaatggatatagtgaatgtagatttcgaatggtttgatccacagcccgcagtggatttccatggactcaagaatcttctccgacaactgttcgatgccgattctcagatctttgacctgtcggcgttaacagatctgatactagcacagcccttgctcggatctacagtgaaggtggatggcaatgaatccgatccatatgccttcttgaccgtattgaacctgcaagagcacaaggtacttccacttgttctttga

SEQ ID NO: 20645 - DNA, 645 bp, A.fumigatus
tgtatgctgatactgcttcaacatgtacagagccgacatatcgaagccttcgggagaaaagtcacatcaactgcagggcatttgatgggaccgatcacagattcaagcaatggaagccattaccacactgccatggccgacatacatcgcgagttacgacggccgacaactcagcgcaaagttttttccctgacacagacctctcccaccgacctcgttcgctccaagctctcaacatctgaaattcaatcgcgcgccctctcttccgttcccgacgagctcctcgcaaacatccccgaagactctagctcctactctctgttcgagggtttcaaagccacccaagacgaccatgaattcaggaaagcccaccgacggcgcagctccaaagggaagaagctgctgaaagacggtgaggcggctggggcgcttccatccgcgccgacggacttgaagaaggaacgggacctgttaagccggcggctggaccttatgggtgtgcgcaagaatatgtgcagctcggaaattcacgagattgacaacaaaatcgccaatctgcacaacataaggaaaatcgtgctggatcggttggcggcgttagagatggaagaggcggagctcgaacatcaatgtgggttatggtga

SEQ ID NO: 20646 - DNA, 243 bp, A.fumigatus
ctcggtcgtttcggaagacgcggctttggatgcgtctttcatgtcagaatccatttatcagaaactaccttcacattctccaaggagtctgaaacagcgttctataagtactgtttatcaaagcttgttactctaccatccgccgctaacaacgctcagggaaacgctcgatgcctatcctacacgaacacttcgcgcccggatcacagatcaaggaaatgcaagcccatactgacatggtga

SEQ ID NO: 20647 - DNA, 624 bp, A.fumigatus
acctgcaagagcacaaggtacttccacttgttctttgaggaccgagaggagctaggcttacttgttcaggataaacccgtgatcaaggatttgacatcttacctacaacgcaaagcctcgtccaatccttccctcgcacctctttcgcagcttctttctcaatcacccatcccgccaattggactgattctcaccgagcgcttgatcaacatgcctgccgaagtcgttcctccaatgtataacatgcttctggaggagatcgcgtgggccattgaagacaaggagccctacaatttctcccactatttgattgtctccaagacttacgaggaggtcgaatccaaactggacatggaagagtcgcggccgcagaagaagaagaagaagtctggcagcaatgtcgagcgattcttctttcaccccgaggatgaggtgtttgagcgacatgcgatctgctctggctcgatagagtatacacataagcacgacgacggcctttcagactcaaaacgggcttttcaggatctcggcatcaagacatcgggaagtctgatattgatcgacggcccgaaactggaagctgcagtcaaagatgtgacggattatgtgaaacctcctgtatag

SEQ ID NO: 20648 - DNA, 2262 bp, A.fumigatus
tttctgttccaactgacctcgcatagaaaacgatatacagctgtacaaagtcacttgaaacagatgccgcctaagcgcacacggcgtgccggagctgctgctcgctccgaggcctcaatcatttttggtcattcaagcccaagtgtcagtaaccagccgctgccagatgtgcctactcagccaagctgggcctatggctcgccggcagcacctgtccttcctcgtcgactagttgcgaaggacattggcttggccgaagtggccgaatcgattgatcagaccatcagagacgctgagaagcgagatcgacgaaatgacccagacgaagccaatgatacagatgatcggcctcatatgaacacccgctcacggagacggccatctgctgctaacgcatcgccagttcgccggcgaaccaagcgagaaccgactccagatcaggtgcaattgcttgatgcgttacgcgaggcgactgtttccccgaatcagcgcaacggagaaaatgaaacgcaagccgagagatctactgcaaccccaacacctcctatcccccacacactttccaccatgtccagtccgacctctcagatccttccggatcccaaatatccctctctgccaatagagcagctgtatccttccccgctgcagcgcattggctcccccactcgtaacgatgcgtctctagaaatgtcgcaaaatacaggcatagatgacaacgaatcggtcatttcgtggatggtagaacgtgatatccatgatgatgacctgcaacggacacgttccgctcgctatcgcagagagccagtcgggaagaatatcactgcgccgcctcgtcgcttttctgggcttgctttcgcaaatgagaccattgtagaggaagacgaacctgattcgcgtctttctgtctcgaaaacacctcaagaatcgacagtggaatcagaggcacaatcagaccatcaaaccgagtcggatcagcctctggtgtctctggagcctcaaaaggagccgccaccgcaggtggaagaagtgtcttcagcacctgcgcggactatcattccaaatttcttcacgaaggaccagtcattcaataattctaccacgcagccatcagaccaatccttcacagaccacgctcgatcaacagcagccgattctttcatacctagaatatcagtttctcttccatggacacaaattcttcgactatctggtgctatacttctgaccgccatatctcttctcacaatttattcgttcagtgacagcattgctaacataccccacgacatcgcctctcactttccctttcgcaatcccgccccctcaatttccctgaacatttccgacatagaggcgctgaatagtctcaacaaccaagtgatgagattaggagcgcaagtttcttctatctccaaggaactgagcgtcgtcaaatccgaggtcaaaaatgtcggtggcccaaccactatcattgagccagtcaaagtgcccaagaagcccaattttctcagtatagggaccggcgtattgatagatccgcgcatgacaagcccaacctacggagagaagaaatccaggctgcccaagtggctgcgggaccgggcgtcagtctggggtgaagctccgcgcccaaagccaaacccaccacttacagccttggtgccttgggacagtgtaggcgattgctggtgtagcgctccaagaaacggtgtgtcgcagctggctcttcacttgagccggcccattgttccggaggaggtggtcgtcgagcatattcccaaacatgctacgcttaatccaggagccgcacccaaggacatggagctctgggttcaatacacaatcaacaaaagcacgtctggggaacttcccacggacgcgggatctgctggctggtacaaatcctacctaaactggctcctctcgtttgagtctggggtactcgaaacagagtaccagtctccgatgctgtcggagcgcttctcactacacgactatataatgagttatcttcgtcccgcctaccacaatgaaccagagagtgcttattggaacgctactactctgggtccgacattttaccgtgtagggaagtggaagtatgatatccacgggcaacaccacgtccaggagttcagtctggatgcgatcatcgaccagcccgatatccgtgtagaccgagtcgcatttcgcgtcaattcaaattggggggcaaactttacctgcttctatcgcttgaagttatacggtcacctatga

SEQ ID NO: 20649 - DNA, 669 bp, A.fumigatus
gtcttcacagtcggtggctttttgaatgtagtgagcgcagcatggatcaactggttcaacgccattctcttcgctgccctgctggtcctcgaactctttctcatgcccgaaaccctgtatccacgcacaatcatgctccagcgcatgccgcgggacggccataaacccccggcctcttcagatatcgaacaaagcccaacagacgagaagaccgggagcatggcaacagcagctaggcctgccattccaagaaccagagaactcggcttcttcaatgtcagaccggttcccggcatgcggcatcccaaaccatgggactctgtcgttcgctttgtcctcactttccgatttcccgtcatcgttaccagtgttatcggatactgtttcctgtggtactggtggattttgtcggtcatcacaatggttcctgcggcctacgcgtcctacaccccgttgattcagggactgctgtttctcgggttgtttctggggacagtgacctcggagatctgttgctcgggtagactgagtgactatatcgttgaccgattggcgaagaggaatggcagcgtgcgcgtcgcggagatgcggttgtggctggcctatcctgcaatcctcatcacagccggtgagctgattgttccgttagcttgcacaaatggaggctaa

SEQ ID NO: 20650 - DNA, 705 bp, A.fumigatus
ttgagatttaaaaaatttctactctgtttcagtcgtctggaggatacaatcactttccacctgatcgagcgcgttcagtttcccctcaacaagaccatttatatccccggcggggtcaagatcccaggcgatgaggtcagtctaatggactacctgctccgagagcaggagcggctacagtcccgcgttcgtcgctatgagtctcccgacgaatatcctttcttccctgaggtgctcgaaaagcccatcctgcaacccctcgaataccccaagatcctccacgacaacgatgtcaacgtcaacgagatcatcaagaagcgatatatcgagaatattcttcccgcagtatgcgcccacctcgaacgcgaggatcgaggagaagcaaaagagaactacgggtcttcggcaacgtgcgacgtaaacgtgctgcaggcgctttcgcgtcgcattcactttggcaaattcgtggcggaggccaagttccagaaggatcctgagttgtttgtcaagctgatcaaggccaatgatcgggccggaatcgatgcggccattaccgatgcaaaggtagaacagaaggtgctggagagattgggcctcaaggccaagacctacggaaccgaccctgcgttcccgtcggagacagggccgaagatcaatgtggatgcggtggttgccatgtacaaggtgcgtgacaagtttgactga

SEQ ID NO: 20651 - DNA, 261 bp, A.fumigatus
cagtcctcagtcgctgctggaatccagatgggaaacaccgtcacaagcagctatatcatcgacagctatccccttcagtcaacgagcataatcaacttctatgccgtcttcctcaacttgagcgccttcatcaacccagtacgtccctttgaatcactaattgtgactgctgggtcgcagctgactgatacctccagttctttattgcgcaatggcaggccaccgcaggatacacatggacgtttgccacgcaggctttga

SEQ ID NO: 20652 - DNA, 423 bp, A.fumigatus
tacacggctttcgcagactctgtcgaggacgaagacgaagtcctaaccgctctgagcgatgagctgggtagtttcgttgaatatgttggcggttcggaatttggtcatgtactcctttctcccctggagaacttggcagccattgaagagccattggtgcgggagaaggtaaaactcatctttgaatctgtcgtttctcttgctgacagaaagctaggccgtcgagtcgctcaacaagatcggggaggaattatccgagaagcagatcgaagaatacttcatccccatggttattcgcctctcgaaagcagattggttcacatcaaaagtctctgccactggtctctattgcgttccctacaggaaatcacaaccgccactgcagcaaagtctccgccaatatttcggaggccttgtacatga

SEQ ID NO: 20653 - DNA, 198 bp, A.fumigatus
tcgatacgagaaggtaatttgtccttggtgctgctctggttatcctgttcagattgtgctgatgttccacgacagatcgctaaggctgtacacgaagaagttgttactcgtgacatggtgccctcatttgttaagcttctgaaggacacagaggctgaagttcggactgccattgcgggccagattccaggtatgtag

SEQ ID NO: 20654 - DNA, 393 bp, A.fumigatus
ctaatcgtttcagtcatcggcatcgaccttctttcgcagtcgcttctccctgccattgtccagttagctgaagacaaacaatggagagttcggcttgctatcatcgagtacatccctcttctcgctagtcagctgggtgtcaagtttttcgacgaacagctcagcgacttgtgcatgggctggctcggggacactgtcttctcgatcagagaagctgccactcaaaatttgagaaagctcacagaagttttcggagtagaatgggctcagggctctatcatcccgaaggttatggccatgggacaacacccgaactatctctacagaatgaccacttgctttgctatctcagtgagttttcccgggcctttccgagtgatgggccattactga

SEQ ID NO: 20655 - DNA, 339 bp, A.fumigatus
actcttgcgcccgttgtctcgctggacatcatcgaaaactcaatacttcctattctagacagactcgtaacggatgaaattcccaatatccgcttcaatgtcgccaaatcctacgctgtattgatcgacacactacgtcgccttcctgcccaagggacactatccgagctcgagaaagctgggaaaccagcgatcccgtcacctcggggtcaggagcttatccagcagagaatcctccccagtctagagaagttgcagcaggatgaagatgtcgatgtccggtactttgctacaactgccgcgggcggccacgaggaggccatgcagacttcaccctag

SEQ ID NO: 20656 - DNA, 195 bp, A.fumigatus
accaagggtggtaatgggcattgttcgctttccgaaggatactataaatactggagtctaatgtcgaatgtccctaaatcgaaattctgtcatgctacacacagtactgcctgttgtaaacatatctgggtcctccaattctatccacacactatgtcctgggctccttgtactcatggcaaggtcggcctgtga

SEQ ID NO: 20657 - DNA, 201 bp, A.fumigatus
aagacccgctacaagctcctcaacggtctggccgtccgcagagcctgctacggtgtcctgagattcatcatggagagcggtgccaagggttgtgaggttgtcgtttccggaaagctgcgtgctgcccgtgccaagtccatgaagttcacggtacgtcaagagtgctttggggaatctgctcaagggaaagaggggctatga

SEQ ID NO: 20658 - DNA, 621 bp, A.fumigatus
gccgtcgagtcgctcaacaagatcggggaggaattatccgagaagcagatcgaagaatacttcatccccatggttattcgcctctcgaaagcagattggttcacatcaaaagtctctgccactggtctctattgcgttccctacaggaaatcacaaccgccactgcagcaaagtctccgccaatatttcggaggccttgtacatgacgagacgccgatggtgcgacgacaggcggcaaataaccttgccaagtttgttaaggaaatgcagacacaagtgatcattgaagaaataatacccttgttccaatatttggcaagtgacgatcaagacagcgtgcgcttgttgactgtggacattctcatctctatcgccgaggaaatccccaaggagcaacaacccagccatggtgtcctgctgacctccctgcgcaatcttttcgaggataagagctggagagtgagatacatggttgctgatcgatacgagaaggtaatttgtccttggtgctgctctggttatcctgttcagattgtgctgatgttccacgacagatcgctaaggctgtacacgaagaagttgttactcgtgacatggtgccctcatttgttaagcttctga

SEQ ID NO: 20659 - DNA, 213 bp, A.fumigatus
gctagtaattggtacaccctattttgttcatgtatttcaataagtttgagcacctacaccatcgatccttggcacaccaaactctggtcggcacttgaatggtctggaatgcccccctcagaggccttgcagaaccttaaagttcctaacggtgagtgcgctggcgcaaatagcgcgttttgtggtcggacaacatattacgtatctaggtag

SEQ ID NO: 20660 - DNA, 477 bp, A.fumigatus
agttcacggtacgtcaagagtgctttggggaatctgctcaagggaaagaggggctatgaaggaagatgcatgatgtggtttcgaaatagaggaagtgcaagccacgatacaggaaccgtaactgactctgtcctctctgtacaggacggtttcatgatccactccggtcagcccgccaaggagttcattgacagcgctacccgtcacgtccttctccgccagggtgttcttggtatcaaggtcaagatcatgcgcggctccgaccccgagggcaaggctggtcctcagaagaccctccctgactccgtcaccatcatcgagcccaaggaggagcagcccgtcctgcagcccatgagccaggactacggtgccaaggctctcgccgctcagcagctcgccgagcagcagcgacttgctgagcagcaggccgctgaaggccaggagggtgctggtgcggaggcttacgcccaggagtaa

SEQ ID NO: 20661 - DNA, 270 bp, A.fumigatus
ctttgccttatctcccatacaaaatctcgttatatcaaggggttcttattagctaatatgcctcagaggaagcctatctcaacgtcccagaaggctgctttgcgagcccaaaaatgcctccatccaaacgtaacacagaaagaccttcgcaaatggtttcaggagacctacgatcatactctttcatctggtctcatctctgatatcttatcccgcaaatacgactatcttgatgctgattctgaggaggagcttgaaattctaccataa

SEQ ID NO: 20662 - DNA, 195 bp, A.fumigatus
tggaccgactctcgagcttcctgccccgtggaacgcccccgccgatccctgaacgatgatgcgccagataatgtcggagcctacgacggtggtgatccaggctttatctacaataccactgccttttccgatatctgcaatacgccctcactgaaaaaaacctacggtttctttgatcgcccaaatggcttttga

SEQ ID NO: 20663 - DNA, 198 bp, A.fumigatus
aaatcacttggcttcggccgcataggttcgagtcctatcgctgacgtttctttttttcgtctgctctttccccaattctactctatttcttataatatctcgtcaacttccaaaccctacgccaagaatgtttctgtccaggtctcaaatacaggatattgctggtttcacaacggtggaacaaagactacttcatga

SEQ ID NO: 20664 - DNA, 264 bp, A.fumigatus
agatcgaaatccccgccaaccggtacgcatatttttcggcaaacgttggaaactccaatcgtatatactgagcctctctacagttatgatctgctatgtttcgaaggtatccagctcatgctaaacatcttcctgggccggaagcctcttcccaactaccgactggttgagcccgccaatggacaactggagaaaatcattgtcaaggaagatgtaagtcggcgtggttggaaattctatgtcgcgtcaatatggactaagtaa

SEQ ID NO: 20665 - DNA, 1500 bp, A.fumigatus
accatgaaagtaaggccgttggtttccggggcaattcttcgcaacatcaaattcgacaaagcccgctatgaatccttcattgctctgcaagacaaactccaccagaaccttgccagacagagaactcttgtttcgatcggtacccatgacctggacactattcagggccccttcacctatgaagcactgccaccaaaggacatcaagtttgtgcctttgaaccagacgaaagaattgaacggcgaggaattaatgtccttctatgaggtatggactgaccatctctggctcatcgcaattaatacttatatctataaacagaaagacaagcatctgggcaaatatctccacatcatccgcgactcacccgtttaccccgtcatctacgactctaagaggactgtctgttccctgccgccaattattaacggtgaccattcaaagattactttagacaccaagaatgtcttgattgagattacggctcttgacaagacaaagctcgacatcgtcaccaagatcatggtcacgatgttttcccaatatacctccaagcccttcacgtatgtacggtctgcttcgccttgtacacatgatactaactcattcttgtgcagtgttgagcctgtccagattgtctctgaacacaataacgagaccagagtcgagcctgacattgcacctcgtaccactcaggccgaggtctcttacatcaaccagtgctgcggactggagctttctcccgaggaaatttgcaagctactgactaagatggcataccaagcaaggccgtctgcatcttcgcccgacctcattgacgtggatgttccccccacccgcgcggacgtgcttcaccaggcagatattatggaggatgttgccattgcgtacggtttcaactcgctcccacggtccttccccagcaagtcgggtacgattgctcagcctctacccatcaataagctgtccgatattgttagaatggaagctgcaatggcaggctggacagaggtcttacccctcatcttgtgttctcacgacgagaacttcgcctggctcaaccgcaaggatgacggcaccacagcggttaaactggcaaaccctaagaccgtagagttccaagttgtccgcacaagcctgcttcctggtctcctcaagaccattcgtgagaacaagcatcacgcagtacccatcaagatcttcgagtgcagcgatgtcgccttcaaagatctgaccttggaacgtaaaagccgcaatgagagacactttgctgcagcctggtacgggaggacgagcggcttcgaagttgtgcacggcttgctcgaccgcatcatggccatgctcaagagcgccttcatcacaggtgaggagtgtttcgagaacccagccgtcaacgacttgcattactggattgaagagctcgacggtaagttttatatgctttttttttttttttttttttttttttttttttttggctacgtgtatatcaggtactaa

SEQ ID NO: 20666 - DNA, 441 bp, A.fumigatus
ccttggaacgtaaaagccgcaatgagagacactttgctgcagcctggtacgggaggacgagcggcttcgaagttgtgcacggcttgctcgaccgcatcatggccatgctcaagagcgccttcatcacaggtgaggagtgtttcgagaacccagccgtcaacgacttgcattactggattgaagagctcgacggtaagttttatatgctttttttttttttttttttttttttttttttttttggctacgtgtatatcaggtactaactcggtcttagaacccacttacttcccgggccatgcggcgtccatccaccttcgtattgctggcaaggaccacgtcatcggtgccttcggtatcttacaccctacagtattggagaagtacgagctgaaataccccgtgagcacgctggagatcaacattgaggctttcctgtaa

SEQ ID NO: 20667 - DNA, 246 bp, A.fumigatus
aagaccacctgcttaatgattggagaaagcccatcccgtaatactcgtacaaatagtcgcaacaagaacgacttccccattccgcaatctcatttcatttcaagcatcacttttggtatcctacctaggtctttcactaggaatctaggagagagctgtaagccgagagagattctccggcagttgcaaacgttattgtcggaaagggaggcaactgaagttcatgtagtgttctttattgcgtga

SEQ ID NO: 20668 - DNA, 867 bp, A.fumigatus
atgcgaaccgaggcgccaaaatcatcctgcactggtaaccctctctcccagtgcgcccgctctcaagctcacggtaccaggttggagaagtcccgcgcccagcgcataatgtggctcatggaagaactgaacctctcctacgacatcaagacctacaagcgcggtcccaacggcatcgctcccccggagctcaaacagatccatccattggggaaatcacccatcgtctcggtccaaccgccggatgcctccccaatggttcttgtcgagtcggccgccatcatcgagtacttcctcgaccatttcagctcccccagcacccacctcgttccccagcggtacaagcccgggcgcgagggccaggtagatggcgaaacagacgcctggatgcgctatcggttctttatgcactacgccgagggaagtctcatgtctccgattcaggtgcaactcatcatgaatggtatttccgctgtcctcattcccgtcatgcccctggctaatgcgggaacaatagctgtcagagacgcccctgtccccttcttcatcaaacccatcaccggcttcatcaccggcaaagtcagcgccgagtttctggaccaggaacttcgcacccatttccgcttcctcgaggaccagctggcgtcggcgccggagaatgggccgttcctgtgtggttcgcggttgacggccgcggacatccagatgagtattccggttattgcggcgctcaacctttccatcatcccgcgggaggagtatccgcggttggatgcttatgcgggggcgattcagaatgagcagggctataggcgggctgtggagaaggtggagaggattgaggggaagccttttgtgccgatctag

SEQ ID NO: 20669 - DNA, 681 bp, A.fumigatus
ttccattttgccatcgcaaacatgaagcttacttccatcgctgtcgctctctttctctccctctccgctacggcgatgcccgtcgccgacgccgaaggggacaatgccgctactccgttgcccattgccgatgtcgaagcggacactgccgctgcgattcccgtggccaatgtcgaagcggacactcccactactgagacacctgtcgccgagatcgaagtggacaatgccgacatcgaagaggacactcccgatgtcgaaggggacgctcccgcagccctagaggcccgccgagtcaagtgtcgtttcaagaagatcggctggaagaacgttcggtgcttctatcagggtggtgattggagccagtacgcattctttctgcttgagcgacggcccctatcgaatgctaacttgtggtcgatagctcgtggtttgagatcagtgcgaattctgccgtcaatgccaagaatcttatcttcacttcgtgcaatatcaaggacatccctgcttgctaaggtttggattccgattcaatcgggggtatggttgtttactaactgtactagggcgctgtattcgacatgcccagaactgtgcatcgtaccaggcctcactgggagaaagtcatcgggtatggtcagggatcacagggctattcgttcttcgttcttttcaatgtaa

SEQ ID NO: 20670 - DNA, 1023 bp, A.fumigatus
tgttccccgactgtgagtttttcgatgagcaatactaaatcatcgacaagacatactatgtacagtcttcacgagcacaaacatctctgtagaagagctatgaccttcagtgcatcaggcttggacactctcctgcaccgtccagcacgagaaagcatcagtagccgcttgctgagggccccagtgcctgttcttgcggaacttctttacacgcgattcgttcaaacacgcacgcccacgcctactgaccatgatggcccaaccatccgcgtggtttgcatctcagatactcacaacacccagccgcaactgccagagggagacctcctcatccacgcaggcgatctcacccagtccgggactcacgccgagctagaagcacagatcggatggctcgatcgccagccccatcgcttcaaggtagcgatcgcgggaaatcacgagctgtgtctggatccgaaaacaccagctgaagcacctggtggcaatgatccagtcgactggaaatcaatccggtatctggagaactcgtcgacaatcctcgactttgggtacagacgcgtcaaagtgtttgggaccccctacaccccgcaacacgggaaccgggctttccagtatccgcggaatgagaatatctgggacaagatatggatccctgaggacactgatattctggtcacacacggctcgccgaaaacacatttagatttgggacggtatggatgtaaattccttcgggaccggtcatggtcagccaaacaaaagccttggctgcatgtgttcggtcatgtccatggggcgtatgggaaggagactctctgctgggatgagtttcaacgagcgtacgagagcatcatggataatgaggcaaaatggccaagtatgatccggttactgtggcatgcatttctacggcttatacgcctgagcgatacatgcgaaaggactgtgatggtgaacgccgctgcaattggaggactccgcgacgaaaagagacgggacgctatctgtgttgatatctaa

SEQ ID NO: 20671 - DNA, 216 bp, A.fumigatus
gataatactgaccgaataggatggattgtggagtacctcgtcgatgtgcgggaccgtgatctcaaggatatgggctatgtcccggctggcttctatggaggaggcttcctcggtcgactcctattggctgagccaacctaccgctggggggagcgacgcatgatcttcctctacgtagtgttgtgtgttggtctgcagctgatgttctggctgtag

SEQ ID NO: 20672 - DNA, 219 bp, A.fumigatus
ccacctaacaagcgtcacagcgtgatagtaataagaatttatctctttgtccagtcacccttcttgagcttactctctgatgtggagcttggaggatatccagacttagttaacgccagtttatcccccagcattgtatctaagctgagggaatatatctactcaattaatattaggtcactcctagataagcccattcaagcagttagctacacctaa

SEQ ID NO: 20673 - DNA, 594 bp, A.fumigatus
tccccaaaggtcacaatgcgtcttcctctcctatctttcttcatcctccccctctatgccctgcccactcccagccactcccccaaaccgccctttttcctcttagccggcgacagcacaaccgccaagcaatcctccaacggtggcggctggggtgacggattcctcaacacgaccctcttccacggcgccagcggcctcaactacggccataacggcgccacgaccgtcagcttccgcgccggaggggactgggagacggttctaagcaaagtagccgagtacaaggaccgttacgcgcctttcgtgaccatccagttcggacacaacgaccagaaacccgccgccaacatctccctcgccgagtacacacgcaacctcgagcaattcgtcagcgaggcgcgcaacgcaggtgcgacgcccatcctggtgaccccactttcacgccggaattacgagacttccaacgtcaccggcgagcctactatcatcttgagtctggccgaccagcgcgcggcgacaattgcggcggcgaaaaattccgcgtgcggcgtacatcgatctgaacggtgcgagtacgcggtatctgaatag

SEQ ID NO: 20674 - DNA, 654 bp, A.fumigatus
tgtacgttctcgtgtcatcctcaaatattcataataacagtcaacagatatggcacgacattctgcggctggcttgtcgccgcgctgtccaacagccatctctgccagtaccttgatctgggggttctcctggccctaggggcggtacttcaggtcctcgcccacgccttgcggacatggcttcctccgtttccattgtttgcggtgactttcttctttgcaagtctcggccaggcatatcaagatacacacgccaacacatttgttgcatccgtcaaagccgcacatcgatggctggggtttattcatgccatgtacatggccggttgtctggtgggtccgtttgtctcgactgctgtggcctcagcgggtatgcattcccggtggaatctgttctacgctgcgccgttggggctaggcgtgatcaacctggttctggtgatcggtgcattccatgattggttgaaggtgaacgccgcagtttggtcaatctcctccggagtcaaggcaaaagggtctgcaggagatgaagcagactctttgcacgccaagtgtgtggttgttgagtctgtatttcttcttcttcctgggcgccgctattaccgccggtggtatgtaatgctccctgcgtctgagataatactgaccgaatag

SEQ ID NO: 20675 - DNA, 282 bp, A.fumigatus
agcttcttatgtgcggtcgtcagcttgttcggcatcttcaagctgaccgtcccaagtaccggcgcatggctcttcgtcaactttatcttcgatctgttgatcgttttcctccttttggctaatattgctctttcttgctccgaggttgcaagctggggacaatgcgttgactattctcgaaagtttccagctccagggttcgaggggagatgtaacaggtttgcgaacgcgatcaaggcgctgatactcgtgggactcgtattcgagatggccctcatgtag

SEQ ID NO: 20676 - DNA, 183 bp, A.fumigatus
tccgagtctgcgctatccggctgtcaatactccctcagcggactgtgctccgttttcagcaagctggttatctatgcgatgatgatccgcgggcggcattggggtctactgtaccagctggatcgggcgattgtgctcccgaacgagcggttggatgatagtctgggagagttgatgatgtga

SEQ ID NO: 20677 - DNA, 390 bp, A.fumigatus
gaacctctccgtgggaaaactcacgaagttcgtccttacgtcgagattcttcgctgcgtgggaccaccacggctatacgaccaattgtttttccatcgaacagccaggaaagacgacatcgccaagccgcaatcagactttgtcctcggttatgtcgctgccaattcaagtaaattgctcgggtatcgggctcccaacggccggtctgtgctccactatattgctgccgctgggaacgaggccctgctggcggtttcccagaaagagggcgcagatatctctgtgagatgtgacaagggcgaggcggccctgcatgtggctcttgagacgggccaagacgctaccgccgtgcagcttctcgaagctctatttactctgcgagcctggtga

SEQ ID NO: 20678 - DNA, 324 bp, A.fumigatus
cggaatttcaatggggtgttatcttgcagtccgtacgacaaacagaccagtcctgctagctcgaagtatctggtgagcgtgggactactgaccagggtcgatcagggtctcagaagcaatgactatgccaaaagtgtcacgtctctcatgcattctactgatacagcactagacgactatgtctaccttgtggttgctcctagatcggcacaaaaggcttcccctcaatcctctccaccttctccacagcccgcctatagccctgctcattctgaatcgcccccgcataagcatccaaccgcggatactcctcccgcgggatga

SEQ ID NO: 20679 - DNA, 321 bp, A.fumigatus
actagatcacaccttgaccgtttcttctcccaactctcctctcttccctttcaacgcacccacgcattgaggttcgacatggacgaaacaacgcctctcctgcctggacaaaatgaccacaacgacgaggatactaccgcaacacgactaacacgcgtctcaagaatcatcgccatcctcatctggtcgtctatcattacatctgccgtgaccttcttgtacagcctcaccgtctacctggtggtcaaactctccctttactatgtctttttctcttggggaatgcgagataccatcgaaatgttgctccctctggtatga

SEQ ID NO: 20680 - DNA, 246 bp, A.fumigatus
ttggttcaggatcttcaggtaggcgttctcaacgtgaggctgttccagggaatgctcagtggcgggggctttggcgctgccgatctcgagattctgaataggggaggaagagttcaagttttgaacgataccgcgcagtgcctgaactgcagtagacggctcgacatatccaagtctgtacccaacaatttgaggggttggtctgccagcagggggggtcaagctggacaagagatccatgaatga

SEQ ID NO: 20681 - DNA, 399 bp, A.fumigatus
cggaccccacttggtagtcttgcgaacctgctcgagaacggcaatcttctctacagagctgggaatggaattcacaatctggcctccgacccaaggacggtaaagacgagcggtgatgagtccgatgttctcgagctcactgttggcttccgcctttgcgagaacatcaacgaatactccggtggagccaaagatgaaaatggccgacttggcatccgagggaccagtgtattcaatcgcgcggtaggtgcgtccagtgctctgggacagaatcctccagatctgggcggtccactcgaagatgtcggcagcgctgaccggacggaccgaagttgcagcatcaacggttgtggctgcagagctggtggcatggctgtccgtgctgctatctctccgtga

SEQ ID NO: 20682 - DNA, 822 bp, A.fumigatus
aatgcagtgcaaaaagacaatgacaggtttatctgcaggcatgacgagcatatctcggagcgggacatttatcatcaaggtgaaatcgcaagggcacgcgtcctgctatccaacaaggaaattaatcgtaactttttatcatccttcactcttcatcctcctcagcaacctttaaacgaggttagtaactgctcaaaagccttaagaagagtgattgataggccaacataccccttcgtggaaattggtgccatccgtggtcttgttaatgatgccagcccggatacaccagtctccgaatcgctccggagtctcaccatcagtgttgcgctcaagtgcgtaccgcttgagcagacccttcatgatctcgaggatctcatcctccttgatagactggcggtacagcttgttaagacgctgtccgtggtaaccaccgccaaggtacatgttgtaagcaccgtaggccttaccgacaaaggcaacctcggcgagccagggcctggcacaaccgttcgggcaaccggtcatacgcatgacaatgctgtcgcgtgccaagccaacctcttcaagggtcgactccagcttagagatcagcacaggaaggtagcgctcagactcggccatcgccagaccacatgtcgggaacgcgacacaagcagaggaagacagacgcagaccgctgaaggaagtgttgtcgagcttgtgcttggccattatctccttgacagcgggcaagtcctcgtctttgatgttggtgaagaccagatgctggttaccagtcaggcggaactcgcccttgtcgagcttggccaattcccgtag

SEQ ID NO: 20683 - DNA, 1164 bp, A.fumigatus
gcccgaacgcatggtgaactcagctgtgtcctcaacacgaccgttctcgatgaaaaaggtgaagtggttcaagcccttctcatccttctgccagccaaaggtgtcgacgttggaagtaaacttgaacgggcggggttcagcaaatcgcaaaccatcgggaaggagggcctccaccttgcccttgaaggtctcaactcccatgtcgtcaatggtatacttgagacgagcgtgcttacggttcttgcggtcaccaaagtcccgctggacgagcataatcttctcacagacaatgtgagcctgatcagctggcacgtaaccaaacatacgaccggtctgagggtaagtcttcttgttgttgtgagttgtacccataccaccaccagcgaggacattgaagccctcaaggtgtccgtcagcgcccttgatggcgatcagaccaatatcatgcgcatagacatcagtatcgttgtgaggaggaatggcgatggtgatcttaaactttcgaggaaggtacgtgggaccgtacagaggctcgtggtcctgaaccgcatctcctgccacttggaccttgttgtcgtcatcatccttcagccaaatctcatgataggcggtagtggcaggaagcaggtggtcgctaatcttcttagcaactgcatgggtttcgcggtgaaagtaggaaagctcgggcagagaactgcacatgacgttacggttgacatcaccgcaagcagcaatagttgtcatgagcgccttgttgatagcacgcatggcggaacgaaggttacgcttgatgacaccgtggaactggaaggtttgtcttgtggtgagcttcatagtctcgtttccgtatgcgctgctgatctcgtccatctgaatccattgcaagggagtagcaacaccaccaggaagccgacaacggatcatgaaactgtaggctggctcaagaccctgagccttccgctcatcgcgaacatcacgatcatcctgcatgtaggtgccgtggaacttggtcaactgttggtcactagcggaaatggcacctgtggtctcatccaacaagccctcagcaatggtaccgcgcaggtagttggactggatcttgatgtcctcattggtcaggggcgcgggctcctctggaagaccttctaccttgtcgacgcctag

SEQ ID NO: 20684 - DNA, 945 bp, A.fumigatus
acatttctttatgtaatgagcctggagaccggagcttctttaatcacactttccctgctgctgaacaagatcagtggtctctatggcttgctcgccttattgaccggctaccatctgtcgccagtccagctctctatgtacctctattcgcttattgcgctcggtcttacagcatatctcttcccgcatattcggaagcagtcgcccctgcagtgtctcgccctcgcttggctctacctccttgacacggtcattaatgccgcatacacagctgcgtttggtgtgacatggttcctcgttatctcacagcactacgataacgggaccgcaaagggaccgggcagcgacacaatctcccaaaccgccggcttcaccaaccccaaatacagctcctcgtccaccaatgcaaactccgcacgaagcccggatggcctcacgaatgccgtcacccagcccgagagtttccaaagcattgtgttcatctgcttgctgtggattatccgcatttacttcgtgttcgtcatgctcgcctttgcccgccagaaattacgtctctacgtcgcaatcccacgccacacacagctccccacgcacagccgcaatacctccatcgctagcgttgctagtgttgctgatatcgaccgggagccgttctcgccatatagccctgatggccaaggctggcagggcaggcttggccgtcttatgattggccttggtcgcagttactggctgggcgaagatgaggacggtgcctggttggacagcttgggtcgcaagtttcgtgctcgcggccaggagcttcctggtcctttggaacgagaaagaagacgccggtcgggcaccgggcctccacagccctcgcaagccactgttcaggccgctgcactccagcaaccgatcccggagaatctgaagatgcatgactggactgacggccggtga

SEQ ID NO: 20685 - DNA, 273 bp, A.fumigatus
tctcattccccagtgcatgctattgtcatgttccaactggaacattctccctgcgatcagtcgctaatttttcaaacagctgcacgagttgcctaccttgtcagcgacaccatcctctccgttcagccatctctgcagacagattctttgttttcaaagcccctcaaggctctgaaggcgagcaatgctcgtagcatccttcctagatctgcacctgaggtgagtgaactcgcgacataccccatcgcgaagatttcgcagaatttggattga

SEQ ID NO: 20686 - DNA, 1554 bp, A.fumigatus
cactgtagacaggtggtagcggtacgctctaatgaagaccctctactttctgccttccatccactgcaggcaggcgacgcagtttccgtcgtcaccggctcctctgtcctgctttcatccgttcctcgcctctaccgtttagcgaactccccaatcgtcattcatgtcgccctggagccctccccattcccagatttctccgtcatcagctcgatacgccagtgtggctttaccttcttgcattccgagacaatccaggaggcacaggatattgccatcaccgctcatgctctagcccacagatccggaaagggtgttattcatttctttgatcccgccaactccgcgaatgaggatgccattgaagcagaaaatgtggacgttatcaaatctctgctcaacctgggcagaagcactgagtctcagtctggggcacagacattatatgccgactccggtcgcgtagccaccgtgtctgacgagattgcggagagctccgctgcccaaggtggcattgcttccacccttgcgccgccagcccagactccttcaagcgtcagtgttgataactcatccgtcggatcgtcacggagagatagcagcacggacagccatgccaccagctctgcagccacaaccgttgatgctgcaacttcggtccgtccggtcagcgctgccgacatcttcgagtggaccgcccagatctggaggattctgtcccagagcactggacgcacctaccgcgcgattgaatacactggtccctcggatgccaagtcggccattttcatctttggctccaccggagtattcgttgatgttctcgcaaaggcggaagccaacagtgagctcgagaacatcggactcatcaccgctcgtctttaccgtccttgggtcggaggccagattgtgaattccattcccagctctgtagagaagattgccgttctcgagcaggttcgcaagactaccaagtggggtccgtcattcatggatctcttgtccagcttgaccccccctgctggcagaccaacccctcaaattgttgggtacagacttggatatgtcgagccgtctactgcagttcaggcactgcgcggtatcgttcaaaacttgaactcttcctcccctattcagaatctcgagatcggcagcgccaaagcccccgccactgagcattccctggaacagcctcacgttgagaacgcctacctgaagatcctgaaccaactatttgctgagcgcctttacattgcaaatcagttgggctctcagaatgctggcatttcgtccactatcgcggcgagccctgaatatggattcggttcgctgatcgccagaaaggagcgccgtcagcgcttcgtccgggaagtcgaagaagcttcaaagtccactgacttcacctcagattccagatcatcgttgtccaattgggcgctgaatgtcaaggacgcttcaaaggcgaacaagctggcttcagaagtgattgagactctgtccaaggacgagtttcagctagtaagaggctctttgagtcgaagaagctcttcttga

SEQ ID NO: 20687 - DNA, 423 bp, A.fumigatus
catggttcctcgttatctcacagcactacgataacgggaccgcaaagggaccgggcagcgacacaatctcccaaaccgccggcttcaccaaccccaaatacagctcctcgtccaccaatgcaaactccgcacgaagcccggatggcctcacgaatgccgtcacccagcccgagagtttccaaagcattgtgttcatctgcttgctgtggattatccgcatttacttcgtgttcgtcatgctcgcctttgcccgccagaaattacgtctctacgtcgcaatcccacgccacacacagctccccacgcacagccgcaatacctccatcgctagcgttgctagtgttgctgatatcgaccgggagccgttctcgccatatagccctgatggccaaggctggcagggcaggcttggccgtcttatga

SEQ ID NO: 20688 - DNA, 447 bp, A.fumigatus
ccaccgtgtctgacgagattgcggagagctccgctgcccaaggtggcattgcttccacccttgcgccgccagcccagactccttcaagcgtcagtgttgataactcatccgtcggatcgtcacggagagatagcagcacggacagccatgccaccagctctgcagccacaaccgttgatgctgcaacttcggtccgtccggtcagcgctgccgacatcttcgagtggaccgcccagatctggaggattctgtcccagagcactggacgcacctaccgcgcgattgaatacactggtccctcggatgccaagtcggccattttcatctttggctccaccggagtattcgttgatgttctcgcaaaggcggaagccaacagtgagctcgagaacatcggactcatcaccgctcgtctttaccgtccttgggtcggaggccagattgtga

SEQ ID NO: 20689 - DNA, 2883 bp, A.fumigatus
gtcgaagaagctcttcttgaagagtcccaatggctcatcggttcggacgcgtgggcttatgatcttggcaactctggtgtgcatcatgttctcgcctccggagagaatgtcaacatgcttattattgactcccaaccttactcggagcgtgctgctgccgacccaactcgcaggaagaaggacatcggattgtacgccatgaactttggcaatgcttacgtcgcctctgttgccgtctatggctcctacacccaggttctccaggcaatggccgaggccgagcaattcaagggtccttccgtcgttgtcgcctatctaccctacaaccaggaaaatgactctgctctcaccgttcttcaagaaacgaaaaaggccattgaccttggatactggcctttgtaccgctggaaccctgagaatgaaacgaaaggcgaacccaaattcgctctcgactccgatcgtctcagacgggagctcgaggagttccttcgcagagacaaccaactcactcagctcatgaaccggaaacccaagttctctgctgttctctctgaatcatacggcactgaagtccgcgccctgcagaagcgtaaggccaaggattcgtatgagcagctgcttgagggtctttttggagcgcctttgacaatcctctttgcttctgatggcggtaacgctcaaactctcgccaagcgcctcggaaatcgaggtcgagctagaggattgaagaccatggtcatagccatggatgactacccggctgaggatcttgcgacagaggagaatgtggttttcattaccagtactgctggccagggtgaattccctcagaacggtcgcagcctctgggaagtcataaagaactctggtgatttggatctctctactatcaagtactctgtctttggtcttggtgacagccactactggccccgcaaggaggataagatctattacaacaagcctgccaaggatctcgacgctcgtatcgctttccttggtggccgcaagctcacggatattggtctcggtgacgatcaggacccagatgcttaccaaaccggctactctgagtgggagcctcgcctttggcaagctctaggcgtcgacaaggtagaaggtcttccagaggagcccgcgcccctgaccaatgaggacatcaagatccagtccaactacctgcgcggtaccattgctgagggcttgttggatgagaccacaggtgccatttccgctagtgaccaacagttgaccaagttccacggcacctacatgcaggatgatcgtgatgttcgcgatgagcggaaggctcagggtcttgagccagcctacagtttcatgatccgttgtcggcttcctggtggtgttgctactcccttgcaatggattcagatggacgagatcagcagcgcatacggaaacgagactatgaagctcaccacaagacaaaccttccagttccacggtgtcatcaagcgtaaccttcgttccgccatgcgtgctatcaacaaggcgctcatgacaactattgctgcttgcggtgatgtcaaccgtaacgtcatgtgcagttctctgcccgagctttcctactttcaccgcgaaacccatgcagttgctaagaagattagcgaccacctgcttcctgccactaccgcctatcatgagatttggctgaaggatgatgacgacaacaaggtccaagtggcaggagatgcggttcaggaccacgagcctctgtacggtcccacgtaccttcctcgaaagtttaagatcaccatcgccattcctcctcacaacgatactgatgtctatgcgcatgatattggtctgatcgccatcaagggcgctgacggacaccttgagggcttcaatgtcctcgctggtggtggtatgggtacaactcacaacaacaagaagacttaccctcagaccggtcgtatgtttggttacgtgccagctgatcaggctcacattgtctgtgagaagattatgctcgtccagcgggactttggtgaccgcaagaaccgtaagcacgctcgtctcaagtataccattgacgacatgggagttgagaccttcaagggcaaggtggaggccctccttcccgatggtttgcgatttgctgaaccccgcccgttcaagtttacttccaacgtcgacacctttggctggcagaaggatgagaagggcttgaaccacttcacctttttcatcgagaacggtcgtgttgaggacacagctgagttcaccatgcgttcgggcctacgggaattggccaagctcgacaagggcgagttccgcctgactggtaaccagcatctggtcttcaccaacatcaaagacgaggacttgcccgctgtcaaggagataatggccaagcacaagctcgacaacacttccttcagcggtctgcgtctgtcttcctctgcttgtgtcgcgttcccgacatgtggtctggcgatggccgagtctgagcgctaccttcctgtgctgatctctaagctggagtcgacccttgaagaggttggcttggcacgcgacagcattgtcatgcgtatgaccggttgcccgaacggttgtgccaggccctggctcgccgaggttgcctttgtcggtaaggcctacggtgcttacaacatgtaccttggcggtggttaccacggacagcgtcttaacaagctgtaccgccagtctatcaaggaggatgagatcctcgagatcatgaagggtctgctcaagcggtacgcacttgagcgcaacactgatggtgagactccggagcgattcggagactggtgtatccgggctggcatcattaacaagaccacggatggcaccaatttccacgaaggggtatgttggcctatcaatcactcttcttaa

SEQ ID NO: 20690 - DNA, 894 bp, A.fumigatus
cggtgttcgtgcatcatgttgtcccgagtcgctcgacaaaaaactgccatcagcctattgcggcagtcgaacggacgccgtctacagccctcggtggcagggctacgatttcatggtaatgccagcaaaccatcattgctggcaagtgcatctgtgaccactccacaggaacaaactcatcgaccttcgtttcaatccaaccggactcttgccactgctgccgaccagtctgctgtcgatcaaggatcctatgcatcattcgacgactcgcactatgcaccagagaatttctatgacccatcacagcagtggtctaaactgttcccttcactgcctgctaaagaactcgatccttcgtccctgatcatcgtgggcgagtcattacaaaccaaacccaaagtatcacggaaggtgagagggatcggcggcgatgaggatgaaatgctggccaatttagatgtctctcttaaggttggacgctttgatcgggctgccacgctcattaatcgattgggacaacattaccccgtcggttcatcggagtacctagctattcacaatcgctatctggaaaagatggtatctcacatgattgttacaaggcagcataatatggtgctgccgatgcagaggtggtttgaacttgatatgccaaacgggggcgtaaaagcggatgcaacaacatatgcgatcatgatacggatggcacttcgcatgcttcatggctcgaagcgagacagagctgtgcgaagatattggcaattcgccaagaaggataatatcgaggaggaagtactggcagtccctgttctctcggaattggagctcggagaactctcagaggttcgttctttacatctaattacgatgcttcccttcagttttagttactga

SEQ ID NO: 20691 - DNA, 933 bp, A.fumigatus
atctgctcatctgaccttcaacgcgttgccatcggcagtattggatctgaacccgcacccgctgtcgccgtcagctcgcagacggataacttggcggaagttaggcctgttgagcaaaagggtctcgggctttcctcactcaaacaatctctctccctctttttaagcgagtctagtccctcggtgcccgctgaccccgaacagaagctggcctttgatgaactcaaacagcgtcaactggaagctgactcgatacggtctgcgatgaatcgttggcgtcaggagtttgataacagacagaaattgggcctcgacgccaccgctggtgggaagaaattaggagccattatgacggagtggcactctagcctcgttgctaggattaaggaggaacttgagcttgttgctgaagcggaggcgaatcccattcgcactctcgagcagaaagagcgctgcgaatatggtgtgtacttgcgatgtctggatacagacactttggctgcgcttaccattctggctgtcatgtctactttcagccgcggtgggatggaaaagggtttgaaagtctctgcagttgtttcaactattggtaaagatctccaggacgaattgatagcggaggctgccctcaaaaatgaagccggcacagactctcggcgactcaaggcactgaaggaactcctagcggggcgcaagaagaagggcggtcgtgccaaatggcatgcgctcgttcaaaagatgcagaaagaggatgcgacgatcatgtggtcgccacgggagactgcaaagatcggcgcggtattgatgagcctgctattcgaggtcggcaaggcaccggtgaccatggaagatcccgaaacgaaaaagaaaacggtcacgatgcaacctgccttccagcacgcttatcagatcacctttgtgcactggcagtga

SEQ ID NO: 20692 - DNA, 537 bp, A.fumigatus
ttaggacacccagtcgtcgatccttttgaaaattcgagccgccaaatttcacccctcatggacgactcggatcctgtcatcgcatcctacgatgtgtacctaacagactccgagatttccagattcgttctccagtacctagatcgatccgccgaacatccctacgacgagagacacgagcagaaaccgaccgctttccgattgaagccgaacacaggtctcgtggaggttgatgtgccgatccagacacgagtgaactacgatgtcagcaagggactgcgatatggcgatgccatgaggaggtctcgtagcgcccgggatggaggctcctacggtttagctggcgggttcagctctggggctgctgcaggtggtgggaaggtgaagatggaggggaacgtggatgtggaaatggccgggatggatagtaaggaagggtctgatattatgcgggtgcaaacacttggagggcggattaagggtcctgaggatggggacccggtgtatatgcttgcggcgttccgtggacgtgggtga

SEQ ID NO: 20693 - DNA, 228 bp, A.fumigatus
cttgctttcaaacagaccgaggaagcatggcagacatacgagagctacatgatccagcaggatctggagaatgttccgcagcttgaggcggccattgatagtgaagactacctggaccggatgagcgcacctcgtatcgacccagctcgaccggagatgacgggctgggcgatgaagcaaaatcggaagaggcaaaaggaacaagctagcatcaatgcgcaagggtga

SEQ ID NO: 20694 - DNA, 216 bp, A.fumigatus
cacacctgctatcgatcatgtgagctgcagcataccaggataatcaccttaccttccaacctctccctgtcccgcggtgagggaacactttcctattggattatcggatccatcatatacggtatctacttcatcaccggttgtcaatcaagttctcaggtacacagtggaacgaatgcctattggaaggttgagtacgccgtaccgatacattag

SEQ ID NO: 20695 - DNA, 216 bp, A.fumigatus
ttcactccgtgtcagcgactctgcaagacaccaactagtattcggtatctacacgtgattaagatgtttatcaccacgtgccactatcgcaaagccaagatgcaaaagaagcttcaccgacgacattttgtttcatattatctctctcttttttccgagtggaaagtcaggaatgccgttatcttgcgcgaattagatgtctatgccctagattag

SEQ ID NO: 20696 - DNA, 711 bp, A.fumigatus
tacggcaactggacctgcggtcctgacctcgagctcctcccaatgatcgatatcgccaatattgcctgtggattccatgggggcgacccgcttattatgatggaaacagtgcggaactgcaaagctcacaatgttcgaatcggtgctcacccgggtcttccagatctgcaagggttcggtcgtcgggagatgaagctctccccagaagagcttactgcaatcaccatctaccaggtcggggcgctccaaggcttcctcgaccgcgaaggagtgcccttgcaccatgtaaagcctcatggggtgttgtacggtatgatgtgccgggattatgaagtcgccaaggcggttatgctgggaattccaaaaggtgtgccggtgtttggactggcaggcactcaaatggagaaagctgccaacgacctggggattgagttctgggctgagttatatggagatgtgaaatacgactcgaacggcatgcttgtgatcgatcggaagaagaagccctggaacctcgcagatgttgagaagcacgtcagacagcagatcgaagagcagtcagtcacggcggttgatgggactgttgtgcaactgccgctgaaaacgtacccagtctcaatatgctgccactctgactctcccggatgcgttgacatcatcaggacgacgagaaaggtagcggatgaattcaatgccaaacacgggagatga

SEQ ID NO: 20697 - DNA, 1704 bp, A.fumigatus
atcaggccaaggctgcgatctgaaataatgacttcaagaacaagtcttttgttctcgtttccttctgtcctacaacgaaccgcgcgaccactaaacacagaaatatcccccttgagagtaccttcgattcgcggtagatggtacggtagcgatcggggttcatcgcaaccgaaggaacgatcaatcgccgctcaagatgccgaaaagtcgcctgacctttctcacctgaatccaccgcctgacgattactctcggttcatattccaggacaaatgtcgctcgacaatatatgctggctctggtggcaacggatgcgtctcgttcctgcgtgagaagtacatcgaggaaggtccaccaaatgggggtgatggtggaagcggcggaagcatctatatccaagctgtcgagggcattactagcctgcacaaacttgctcgtcgaggagtaatcaaagccggaaggggcaaaaatggacaaggaaagagcaaaggaggcaggcgaggagaggatgtcctgcttcaagttcccgttgggacagtcgtgcgagaggtagaccgatacgatccagtggctgaggaactcaagcgtcgaaagacacctgcagctgatgtcgacgagctcgatgagattgggctgccctcagtccgtcatgatcgctgggtgctctacccgggctccaatccttccgacttcctgaccacggtctttccaaagaatccgcctcgaaggcaaaatatcgccgctatggaacccaaggcgcccatatacctcgacctctcaaaaccaatggataagccgattttgctggctgctgggggtgtcggcggtctgggcaatgcccactgggtatctcgttcgatcactcggccaaagttcgcgtcaaggggagaagggggtatgcggctggaacttgagtttgaattgaagctgcttgccgatgttggattagtcggcaagccgaatgctggcaaaagcacacttcttcggtcattgaccaacagccgcacgcgcgttggaaattgggcgttcaccacgctctcccccagtatcgggactgttattatcgatgattacaagggacggccgcttgttgaagccaagggaaaagcaatgcggaccaacttcaccatagcagacattccaggtctgattgaaggcgctcatctcgaccgaggtcttggattaggtttcctgcgacacattgagcgggctggtattctggccttcgtggtagatttgagtgcaggagatcctgtgcaaggccttcagaatttgtggcacgagcttagcgaatatgaacgcatccgtaacaccgaatctgtcctcaaaagtgaagatgagtggcaaccgattggaggtctccctgaactcgcttcacaaaatcctgtggaccacttggattctacaagggattctccgaccaatatccctgacggcacaaaagggcagctcccttcccttgaacttccacctattcacacaaaaccttggtttgtcgtggctacgaaggcagacttgccagaaactcaagacagatttaagaccctgcgagactacgtcgctgccgtacaaaatggtgtggttgaccacccaggaggatacccagatggttggaaagagaaggtctgcgcccttccagtaagcgccatcagaggcgagggagtcagtcgaattccaaagcttgtgatggagttgttggactga

SEQ ID NO: 20698 - DNA, 1749 bp, A.fumigatus
cttcatgactctctaatccttccttgtgcgaagatgacgcatctcccctctgtggtcgccaacgcgctggccgccctcactaacccagctcccgaagattccatcctcgaatgctgcgacaacgatcttgctgcactacgcgagcttcttctgaagaacacagaccgtgccctcgagcttgccgacgcaaaactacgcgttttcccattcaaagatgtgaagacatgctggcgaagactctatacggacgcgagcattgcaaaggtgtgcctggctatctgcagaaactgtggcttctcctgcgatggaataccagcagacaacaatccccgaattgcagatggcactgaacatgcgtcaacgctcgacccaaccccaagacaagccgagtacaaacttgacccggacgcgccatggctcctgtcgtcaatacacgccctcgacaatgcactgattatgacgggcgcgcccctccgcgagaacctggtcgaatccctcttctccgctcttcatctctctacacaagcttaccgcgaagggaagacggatccgcgctcaacccacgattacgccagtgattcagagctcggtggccaggcctttaaacgcaggaagctctccccccccctcttccctcccgatgctgtgccagcgacgaccctgaaacatcctgtccctcgggtctccgcgccgtcgttcgacgctatcgagcatcatatccagcatgtcagaactccgctggtcatcaccgacgccgtggaccactggccggcgctgtcgacccggccctgggcttcacgcgactactggttcgatcgtaccctcggcggccgcagactcgtccccgtggaggtgggcacatcctacacggacgaaggatggggccagcgaatcatggagtttcgagactttgtggacaagtttctctggaggggagaaggcaagacgtctaagactgggactgggaaggagcgcgaggacgacggcaacgatacaggccaaacgggttacatggcgcagcatgatctgctctcgcaaattccggctctccggaaagatatctgcatccccgattactgcttcatcgagcctccgggtccggagccagaaacgccggtctatcttaagaagcagcgagagcgagaagagaaactgaaatccagcaatgcctcgtcaggcgtcggcgaatcgcatacaaagtcgcacgagcagcaacagcatgaaaacgcagcctccgacgacgagtcctctgtcctgggagtccccagtgacccgatcataaacacctggataggccccgcatggaccatatctcccctccaccatgatccataccacaacatcttggtccaggttgtcggcgcgaagtacattcggctctactcacctcatacgccggcctcgcggatctatccgaagggcatggaggccgtcaattcattgtccgggtccaatgcgtcagcaggcctgtctgactcggcccagctgcaagggaaaggctcggaagccagggtcgaaaagcaaacgcagctcatcgacatgtccaatacttctcaggtcgacctggctgccattgagctttccccagctgagtccgaacagtgggaagaaatgtggccgggcttcttggaggcggagtacgtcgagactgtgctgaaggacggcgaatgcttgtatattccagtgggatggtggcattacgtccgtggcgtcaaggctggaattagcgtcagcttctggtgggaatag

SEQ ID NO: 20699 - DNA, 834 bp, A.fumigatus
tgggtggtgcaggtcatgctgaaagctaccgctggtggtggtgggatgggtttgcttacatgcaattccgacgccgaagtgcgcaagtcctttgcaactgtcaagtcgcgaggggaagcattattcaagaatgcaggcgtgtttattgagcgttattatccggcaagccatcacatagaagttcaggtgtttggcaacggggatggtaaggcaatttttattggtgaaagagaatgctcgatacaaagaaggcatcagaaggtgattgaagaatgtcccagccctttcgtctccagaaaaccagggttgcgaaagagcttgggtgaggctgccgtccgtctggccgaatcgatcaagtatggttcagcagggacgattgaatacctcgtggatgatgagactggcgcattcttctttcttgagatgaacactcgcctacaggttgagcacgggataactgaactctgctatggcctggacttggttgaactcatgctaaatcaagcggatgcccagctttctgggaagaacggggttgaagcatcttttcttgaagccttgcccgtggaaaccccttctggcgctgctattgaagcaagagtgtatgctgaaaatccgaccaaggatttcgccccctgtcctggaaccctgcaaaccgttgaatggaaggaaataccaggctcgaggatcgatacatgggtctatcgtggcatcaaggtatccgccaattacggtatgtctcacgagcaaaatcctctttttggtactttggctgggctgacagtaacatgtagatcccctactcgcgaaggtcatgtaccactcgccagatag

SEQ ID NO: 20700 - DNA, 303 bp, A.fumigatus
ccaaggtccccctccccctcccccgagaagtcgacactaacatgttcgttccttgacacagaccccgaaatcatcccaatcgaggcacccttgaatgccaatgtgtggaaagtcgaggtcaagcaaggggacaagcttgacgagaaccaggttgtggtcatactcgaagcgatgaaactcgaaatcgctgtacgagtcgagccttctacagcgggtgccaccgtggagaaaatcttggcgccaccaggagaaccgatcgaggctggcaagccattattacttgtacgcaaaatcaagagctga

SEQ ID NO: 20701 - DNA, 1350 bp, A.fumigatus
catgtagatcccctactcgcgaaggtcatgtaccactcgccagatagacagcagactatactgggaatgagggaaattctaaaacaatcacgcatctgcgggcctccaaccaatctggatttcctggttaagattctagaagaggaggcctttgtcgtaggcaacacattgacaagatttctggacaatttccagtacaccccgtcagcaatcgacgtcatctcgggtggcgcctatacgctcattgaagactggcccggtcgaccgaccatagggaggggcttttgtcattctgggccaatggatccgctagctttccgcatcgcgaatgcccttgtcaataaccccgtcgggctcgaggctctggagatcaccctaagtggtccagatctacgcttcctcaggccagcaatcatctccctttgtggggcgccgattgaagctaaactcgatggagagcctgttccaatgtggtcaagagtcaaggtagccgctggtcagcgcctgactatcggtaaaactacaggaaacggctgcagggcttacctcgctgtctttggtggattcctcaacgtgcccaaatggtttgggtcaaagtcgacatctccaggtgtgggagttggagggtatcaaggtcggcagatttcatcgggggaccttctcacgatcacaagcgagattccagaagtcaatggtgatctccgtataccagaacaccttatcccagattacccaaatcactgggagctactagccatgccagggccctacgatgagggctatcttacccccgagagtatcgagatgctgtatgagactcagtggaagatttcacacaatgcggcaagaggaggaatccgtctccttggccccaagccacggtgggctcgctccgatgggggagagggcggcgcacatccttctaatttgatagaatatggatacgcaatcggctcaatcaactggacaggtgacgatcccgttatctttccacaggatgccccagactttggaggctttgttagcagccatacgatcgtaaaggcagatctatggaagttgggacaagtgaaagcgggggacaccctgaagttcagagcagtgtctttggctgatgccctggaggcacggagagatctggagaggttcgtagatgaactggtgcattgttgcaagcaagggcatggattccacagcgtgaaagtgctgagaggcatgcctcccgagcagacagccaagactcgcggcaaaggcgtggtacatcggatcgaggaacaaggaaatcagccccttgtgtcttacagacaggtatggtgcacttgtcgctgggtcgtatgggccaccagctga

SEQ ID NO: 20702 - DNA, 483 bp, A.fumigatus
gagctcgttcctgcagacgagaactttataactgactcactcttcgcagcgctgatgctctactacgacggcatgaaagtctcccagcaaagactaatcagctatctctgcaacctcgagacgcaactcggagatctcagtcaagcaaagatgccgagtcggctgttcaggcttcctctcacattcgagagtcaaagacaaaaggatgccattcagcgctacatggaaacacagcgtccgtatgcttcgtaccttccagataacatggagtttgtagccaaaaacaacgctttcacaaaggaagagttcgaaaacatcttcctgacagccagcttgatggtcgtctctgttggattcttcactgcacttccgctcgccctccctgtggatcctcgtcaacgcatgaactgcccaaaaatgaatccaagtagagtatatactccagccgggtcagtgtcgtggggtggaagctgcatggcgtga

SEQ ID NO: 20703 - DNA, 468 bp, A.fumigatus
ccacactcaaacagattatacaatgtcgattcgcctggcggatatcaactgaccgggatgaccataccgggggtcgacatcttgggctcgaaaaaaggctacagcgccgacagaccgtggctcttcgaagaatttgatcagataaccttctaccaagtctccgaagaggaatatgaaaaacagttggcgctgttcaatagcggcaaatacgaataccaatgggaggaggttgtctttgacatggcagagcacaaccgacttttgcaggaaacgcgtgacgaagtagcagccatccgagcacggcagcgccaggcgcagacagaaatggataaaatcgaagcagagttgctcgaacgctgggcgaaggaaaagtccgagaggggagtctctcaggatacaattgagagtttacttcaaggtaagcctagccaaggtccccctccccctcccccgagaagtcgacactaa

SEQ ID NO: 20704 - DNA, 186 bp, A.fumigatus
caggttacgatatctcctgagctcgttgttttcttcgtcctcatggttttcaatatggagaaacacgctatttacatgctaaaacaaccgtcatctcccgtgtttggcattgaattcatccgctacctttctcgtcgtcctgatgatgtcaacgcatccgggagagtcagagtggcagcatattga

SEQ ID NO: 20705 - DNA, 486 bp, A.fumigatus
tctgacccaggagcctccagtgatcaaataattcagattgcaaagcagaacaatgcgaatgctatcattccaggttatggattcttatccgagaacgcagattttgcgagggctgtggctgccgctggtctagtattcgttggaccttcccctgagagcatcgaagtttttggcctcaagcataccgcgagagaacttgcaacgaaggccggagttcccatcgtgccgggatcacctggtctgatcaacaatgaacatgatgccgtggaggtggctcagaagttggggtatccagtatgcatcgtgaaacaggagagaatccttttagcagggctaatgggtggtgcaggtcatgctgaaagctaccgctggtggtggtgggatgggtttgcttacatgcaattccgacgccgaagtgcgcaagtcctttgcaactgtcaagtcgcgaggggaagcattattcaagaatgcaggcgtgtttattga

SEQ ID NO: 20706 - DNA, 405 bp, A.fumigatus
tcatcgataataacagtcccgatactgggggagagcgtggtgaacgcccaatttccaacgcgcgtgcggctgttggtcaatgaccgaagaagtgtgcttttgccagcattcggcttgccgactaatccaacatcggcaagcagcttcaattcaaactcaagttccagccgcatacccccttctccccttgacgcgaactttggccgagtgatcgaacgagatacccagtgggcattgcccagaccgccgacacccccagcagccagcaaaatcggcttatccattggttttgagaggtcgaggtatatgggcgccttgggttccatagcggcgatattttgccttcgaggcggattctttggaaagaccgtggtcaggaagtcggaaggattggagcccgggtag

SEQ ID NO: 20707 - DNA, 1128 bp, A.fumigatus
attgttccgctaccggtgcgggccccacggtttattattccaataccctcccaaacccattcagcgagaatggttgagaacttgcgcccaaggaacgacccatttcgcggttcgaaggacggacaagataacaagaccaatgaatcaagctccagtgaggagagtggttccagctccgacgacgacgaggacgagcaccagcgccagcttcagagccagagccagagccagagtcacctcagcgggagtgtggtgtcgggacggcggtcgagtaatttcggcctcgacgatcatgtcgccatgtctgtttctcccggcggagattcccagcgcgctgggtcgatgggatcgggatccggtcggacgtcatttcgcaaacgaggcggcaattcagatgtcgaggaggattcaggtgcggcgtctgacaggcaagaggacgggtcgggaggagcgggtgggccgtatcgtccaccgtgggaatcgcttctggggctccctgccgatgtctgggagaagttattgagtccatcgcctgcgtggcataagcgccggttcgaggtcgggatcaacgatttggcgttcattggatggccggttttcgttcgggaggacgggacgtggaggaaacagagacggaagaaaaagaagaagcggcgtgctgactgggagggaggtgaactgggccataatgagaatgctgaggatgcgccggacgacgaggacggcgatgctggcggcaacgccagcggcggcggtgggttgatggccgcctcgactgagacattgagtcccaagcaggtgactctctcagaggccaaaagaggctcaggatctagcggcaaagccgcaaggtcattagttgactgcttggatggtgacgacaaggattcaatgacgatgttcaacgtggtcttcgtgttagaccctcctttactggagtactccatgcgcactaaggaggtctacgacaatatcataaagaaattcgctaaagccttgaaatgggaacaggcccgaacggattacgtttggagggaggcccaacatatatcacatctcaaagaaaaagctaaagagaggagtaagtcgcaatgttcaagaacattctctgagacgtccgaatgctga

SEQ ID NO: 20708 - DNA, 213 bp, A.fumigatus
gcgtttccacagaacctcgctctcataatgtttaaagtgattctagcagtctcctacattaggctacgctcagtcttaggaccctgtttgtatcacgtgatacaaatgtcatcccagcaccgtagggtaacttccacctggctgctcgtctggaataagcaagctatttttacggatgtgggttctgggtcttggatgtatttaaaatactag

SEQ ID NO: 20709 - DNA, 726 bp, A.fumigatus
actcgagtgtgcagacggagccagagaccacgggttcccaccgctcccaccgcagagacatctcaggaagcagagaaggccgctgccagtaccgacaaggactcggagagcacagcaaccgcttcttctaagaccaacgtttccgggacgtcctcaccgagcgtgggtgcttcttccacatccacagtatcaaaggaagaggaggggtcgaatacaccaaatggcactaccgagtccaactgggataagcagtcccaagtttccggaacagataagcaaggcaacgctcaggaagccaaggataaacctaatgcttcgtccgacaaggacaagaaaccccctctgaaggagctgaaagcagcacccttacctgcagttaacgtttggcagcaacgaaaggaagcccaggaagctaaggccaaagccaccgcggcactcaagtccgctgcatcttcgaaacccagtgcatcgaaaaccgcatccgtcgcctcgtcgacatccggagataaccatcaggagctgccgaaaaccgcccctaagaagaagggagcagacgctacatccgatggtcccaaggacagaaagagggccgacggaggcaagggacgggatgagagtaagtctaaatccggtcatttgtggttttttaccacgaatgtaatcgctatggactctgaattactggagagacctggagcccgctttagtccacaatcggcaagctaa

SEQ ID NO: 20710 - DNA, 1548 bp, A.fumigatus
aatgggaacaggcccgaacggattacgtttggagggaggcccaacatatatcacatctcaaagaaaaagctaaagagaggagtaagtcgcaatgttcaagaacattctctgagacgtccgaatgctgatgcttcttatgtaggaacctccctcaacaccctttatacggagttgatcacccaatcatcgctcgctagggccatatataccgtccacaccagcatatctgcatccaagattgcatccgttcccctcagcccggatgtttccatttcgcttcagatacctcctctgacgtcaacaccttatctgcctggaccaactgataaagcatacccgggtctctggctcaccactgcagacagcgtcaccccggtggaggaccctaccgccgatgagtataccgcaccacatcaggtgctcgccaaacactttgcgctgttgttgctggataacgaggcagcaattctcagggacgtcgaagcgtccggaggtgctctggcacctgctcttgctcactatcttcggtgctccaagccaaccaaatcctttgcgcagatatccgcatcgtccggcatacccctctcgaccattcaaatgttggccagtcatctggtttactggcgacgtgcacgcgccataccccccattcatcaacgtgatacgtacattgtgtctccgaattgtgacttgagcaagctagaagtagccactgctgcctaccaggcagcatttccaaccctccccagcttacccaagatgctttctgccctgagtgggacaccaagaccatatggaagttttatccccagcaaagaccataaggaaacatattttgctattttggcgtggctgttaaggggagggtgggtgactcaacttcgatcatttgcaagggtcaaagtcaccccggagataaagatggccgtagaagtcgctcttcgccgtgaagaagtggacaagtacctgcggaaaggcagatccttggaggcgcagaagtctactgatggcgaaaacgggaacgaggaggatgagaacgacgatgctagctcgtcctcgtcgtcatcgctggcaagccagggtagcggggaagagacgccaatgcctgggcgttaccagcaagagagcaacccacgtctctcacattctatgctagatcgaaacacgtcgctgagaacgtcatctttgatcctgttccctcatcgcgcctcaccactggagtcacgctggttggaacagattgtctctcgctttcctgagcaccctcgatccgccggtcgacatcgccggggagaaggatcgaatgccggtggaggtgagatagaccctgagtatgccgccctaagcactccaatgaaggatctatggccgacctatatcaagtatttcaatgggcttgacgcgcttgagaagatcccggtacgcgaaggcctcaagcgtaagtttgtgtggcaggtcctcacacgcttgggcctggtgacttcccaacagtcttctattgaactggatcccagggaacaggtgctggttagcgtgaggcattggtga

SEQ ID NO: 20711 - DNA, 279 bp, A.fumigatus
attcctcgtcaacgttcctttcgcgtccttgttatcaagacagcatttgcaatattcatcattctcaataggacgtcgttcagctattaccgcaacgagaccgctctcgacgactatcgatggtcctcgcgtgataaattctttctaccgagaataactttctacattgtcgccggctacggggtgtctcacggagatttgtttaccggacaacgtctacaggctacagtcgaggttggactgattccagtaccgggaagttgcagttcgacggggtaa

SEQ ID NO: 20712 - DNA, 1203 bp, A.fumigatus
tcgctatggactctgaattactggagagacctggagcccgctttagtccacaatcggcaagctaatcgtgattctgcagatgtttccattccacctgtgggcgatgcctcttcgtggcctacacctcaagttgcacaaggggaagagaagagaaaggctcaggagaagactgagaagactgaaaagagccctgtcattcggccgcatggaaaggagaaatggatgcctgttccttatgtaccaaccgctgtcttcaacacgcctttgccgtcatctgcgcgcaggggtggacgagctgggcgagtcggaagggatggagctcgcaatgccactcatggtgcgcctggtgctgacaaggcagccactggacaggcggctcaaggttctactgctaagcagaacggcgttggagacagaggcagaaatgagcctagctccgctcgcgctaactctctaccagccccttcgaagcgctctaacagcgttgacgctggacttgctgattcccgcaaaggcactcaagttgctgaccgaaaccgtgcgcctaagggagccgaaaatatgaatgggttgccggctggaagacaagctggtggcaacgagaatctcccaccacggcaccgcggcgatgccaagcctttcgtgagaaaccacgatgcagctcacaagggtggtgatagcacctcgaagagctcacatcccttggctgacgcaaacactggccttcgctctagctcaactcacgaccgtcgcttcgagaatggaccgaagtcagcggacttggcaggtttccctggggatcgtaaagagaaggacttctctcgtgaatcccgtgctgacaggggccggggctctcatcgcggccgtggaggacattctggctttaccggttcgcaaaactcacagtttcctaacaatcatatggggcaccactctttcgtccatcccaagtcctttggatttaatgagcgtcagcgatctcaccatggccttcccaacggctctcaacaaggacatagaatgtctctgagatcgccttctctgccaaactccgcttctatgtatggcgtttatcctttccctgctgatatcaacactatgtacggttatcagccgataccggctggcccaatgactgctgttccttatcagccgtacatggaaccgttctctctcatgagcatgatctcgatgcaattgtaa

SEQ ID NO: 20713 - DNA, 567 bp, A.fumigatus
gttatgtcttttgtttttatcgtgttgctcttgcgattcgcgacagaaattgatcctggcagggaatattacttttccgtcgacaatctttgcaaagatctttttcttcgcaagcaaatggactctcagggctttgtgccattgtccgtcattgctggtttcaaacgcgtcaagacactcaccgaggatttcgaaatgctgcgccatgcctgccgccaagtgaggaacattgagtatctgaccggcgaggatggcattgatcggttgcgaccaagagacaaatgggagcaatgggttcttcccgtcgagcagcgcgatccttcagcacagaatgagggtccatctctgtcagcagatgccggaaagttcgatgagcagaaccaagccaaggaaacaacaaatggtctaccgaacggtagcaccgagcctcaggtcctgaagacctctctatcttctaccgcgccggaattctcgccgtcgaacccagtaattccccaggctgaaattgcaaatgtaggatcccatttgatgaccgtcccttctcagatgttaaagttgagaagttga

SEQ ID NO: 20714 - DNA, 435 bp, A.fumigatus
ctcgtgagtgatacggcgcacgatagtctccacaaagatcattcgtcggtactctgggatggaaaacaagctattcaacccagtctcctgctgccctccgataattcagtccccgaatcttacagtacttttcaaaaacgagttctttacgaacaaaaactaacgcccgatcaagatgatgaccgcgagatggatattctgtaccaattctggtcacatttcttggtttcaaatttcaatgcacaaatgtacaatgaatttaagagtctagcgcttgatgatctctctttccaaaacgccagcaacgggttcaacaggatcggtcggtttatggtgcctttttgtcgaaccaaaaatatctccctgctgaggtggtcgaagacctctttgttctatgaaggagggaattgtctacccaccagagtgggcatatga

SEQ ID NO: 20715 - DNA, 258 bp, A.fumigatus
caaattgggttctgtctttactctcgctctcagtcttcggctcttccacatccctccgctattggcagtattattgctactttttcattttcccttttcccttcttatttcccttctctctctctctatcgttgtcttcttacccccctcctcccctctcttcccctcacatactgggacgtcctacggagtagtttctacagttccctccattctcattttgtttatcgtcgccctctcggcgtctgtgttgcttga

SEQ ID NO: 20716 - DNA, 2556 bp, A.fumigatus
cgtcatcttaccccgctacaggagacccgtcgcaccctcgaccaagcacagaagcagtacgattcccttctatctcgatatgcttcacagtccaaatcaaaagagccttcatccctgagggaagatgctttccaacttcacgaagcccggaaagcctacctgaaagcgtcaatggatttttcagtacaagcaccacaaatacgaaactctcttgatcgactgttagtccgagtttcctttgaccagtggagggaatttaagactcttcataatgacaatggtgcatccttcgccaaatggggccaagagatggatcgcataaagggttggatccatgaaatggagggcagcgagaagttctcaaagcgcgagcttctttctgccagaaagcatattgaagacgctgcagagctggcggccaggccgtctcgagagctggaagattattcagtatccaccgttccatatctagggtctcgccctctgtcggacctgaacatgaccaaggaagcacggcccgagaaacaaggctgggtttatctgcggacgttgtcaggcaaaccaacacgcactgtttggctgcggcgttgggcttttttaaagaacggtatttttggttgcctcgtgctgggttctcgaactggcggggttgaagaaagcgagcgtataggcgtgctactgtgcagtataaggcctgctttccaggaggaacgaagattctgcttcgaggtgaagaccaagagcaacaccatagtattgcaggccgagactcagaaagagctcacggaatggattgctgcttttgaagcagctaaacgaaaagcactggagaacccgactagcaccgacatctcggtttccggaagggttactatacaagatccagcctttgcaatctctcagcctccagcacctgaattcgccgctgatccggctgactcgctcacgccgcacgcaaatgatgagcatggaccatctgatcgtagcggagggttgtcagttccagagcgggagccatcagccttccgaaacagcagcgatctcggcagcccccggcgcatgactgggttggaacccgagagttctgcacgagagcatacttccagactcattcaaaaattagatcttcaccgcaagtccaacaataatgctgtcccaccatctatatcactgcccggtgcaggtggtggtatcgcaggcctgatctcctccagccatagcactttagggcacagcaacggtctctctgtgggcgggactgatgaagggaacagaagtcgcagtctgacgagccggagccttcctcctacgacactcgcaccttctaccttggcgaatccacctgcccctaccagtatgagcaaagtggctgtaatcgtcagcaatgaacgaggtattgggttggggcaagccgacaagacaggtgggatgcctagcggtatgatggccaacctgtggggtagttctaactggggtttcatgaaccgacttgaacgtgaacgtgatgctcagcttgctagggccggcgagctagcttctgtgggacaacgaacatcaactccggtgattgatccgtcaaagcaaccgcaatcatctgacgccgattcgaccaacggcacttcagcatccaggcagcagatgtccggccctcgccatagacagactgtaagtcttgacggcgatgcgtcaaaggtgcagagggcaatcttgggtatttcgcatgagtatcccagttactaccccgagcagcttcgatctcaggatgctcaatttcgcctgctctttcccgacgtcaaaagagaggagcctttggtcatggtcttccgagccacatggaatcccaacgatcagcaagaatttcctggaagagcatacgctacgactcgcaacatatatttttacagtcattattttggattagttctaaccacaggtgtcccgctggaaagcatcaaggaagtgactgctgcacctggcagagactgcgacttcttatttcttcatactatcccgcctcttggtgaggatactcctggacgaattacagtaaaaacattcctggagcctctaagacttcttcaaagacgcctgaatttcttgatccaagattcaacttcggtggaacccatggggttggaagcaattttcaaggctctgatcagaatggagactgacacaaggaaccgcagttctagcctgaacagctgggaagatgcggccgtttcggatgacaagaatggtattgaagaggacaaactcgctgccggacagcaaaaagatatccgccgaccgatttacatcgactatgacttagatccgcattcaaagcatggcaaacacggcaaaaatgcgccaaaattccggttgccaacacaacctgttcaatatgttccccaaggcaacctccgcctcgctgcagagaagatattcgatattagtccgaaggcgatattccatatcctttttggtgacaagagtgctgtttggcaactccttttgcacgaaagaagatcccgaggttcgtccctctacccccacccccgaatgatcgggtag

SEQ ID NO: 20717 - DNA, 1122 bp, A.fumigatus
ttacatttgtcgcgaaggggaaaagcaagcttgcagtatacacgaaagtggagtggcttgggtctcctcacggccttcagagtaagtggtccattagcaatcgcgagactattgtcctgcacaatcactaagttatttccaggaatcatcgagaagcaagcaacgagtgatttagagcaagacgctctggacctcgttgatcttgtcagcgatcaagtgcgaaaattgggcttccatagccgaacaaaaaaggccatcaccatattcggtcacatcggacgccaacaacacacatctcaactttcgtccagcgaatcagttctgaaacttgaacctcgaaagcctcggcgtcagaggaccttaactcaactcttactcgagacgcttctctccttcctggagagcgctgtgtcgtccataatcatgtggacttttgccttgcttcgctggacctggaaaactacgaatgcaaacatggtcattctggcgctgctaatctccagcgctttgatgaacggactcttcacttcacgatacacttatgactggtggcatgagaggaacgtgggaaacttcatggctcgtcttggggtcggtcccaaccatgtgatgagcaaagccatctatatgagggatatcgacgaggtgattgctaacgctactgtcggccaatctagcaacaacatgagtaaatgtttctctacattctaccagcagacagtgagcgaccagggaacagtcctttcctttggcgcctcaggtcctcgagactcagtgacacggagtgcagccaggcggatccatcaaacccgcgagcgactcgctatgtatagacacaacttgttagtggcgctccgggtagtgaacagcattgaaagagaggtcattcaaggcgagtgggagcgatggctccggcaggaattgagacgctgtcaccaagtcgaaaaacttctcggaaaggataaggaggatgacgggttcaacacgcaggttgaccaagcaagtcaaactgtttttgcagacctcgcgggtgacgttcagcagtggtacgataaatattgtaccagttgccaggtggaacaggagcagcttgagaggagcggtattgtatatggtaattag

SEQ ID NO: 20718 - DNA, 462 bp, A.fumigatus
agtctgtcatggggtgttcttcaagaagcgatcacaacggtcaatttcccagtccgtcctccaactgccgaagaaccaaacccgccgacggagcgcttcaccttctcgatcgttctcaacaccatacaatccacttttgctgcgatcactggcttcctctacctctatttctctactccggccggcaagaaggttccgtccatttttccgactcgcaagattctcttccctttgctcctggtcagtatctcctcgtccctggcgtcgccttttggatatgccagtcttgcgcacatcgactatttgacatttattctggccaagtcgtgcaagcttctgccttggatgtttttcaattggatattcttcggcaagacatatccgttgtataagtacggggttgtcttgttgtcaccccttgggagtcgcaactttcaccttccaccaccctggaaccagtaa

SEQ ID NO: 20719 - DNA, 771 bp, A.fumigatus
catttattctggccaagtcgtgcaagcttctgccttggatgtttttcaattggatattcttcggcaagacatatccgttgtataagtacggggttgtcttgttgtcaccccttgggagtcgcaactttcaccttccaccaccctggaaccagtaagaaggttgccgcgtcggcagcgaaaaaccagtccggttcatctctgtatggaatcttcttcctttccatcaacctctttctggacggcctcacgaacaccacccaagaccatgtctttagctcaccgcaaatctatacgcgcttcaccggaccgcagatgatggtagcgcagaacatcctttcaacaatcctgaccaccacctacttgcttgtcatgccccatttgtcctctaccggcgccttgcatgctcttcttcccattccaattccaccttctaccgaaactgagcttgcatccgccgtttccttcctctcacgacacccagaggtgatgaagaatgtgctcgggtttgccgcctgcggagccatcggccagcttttcattttctatacgctttctcgcttctcatctttgcttctggtgactgtgaccgtcacgcgcaagatgctcaccatgctgttgagtgtgttttggtttggacacacgttgtccgcaggccagtggctcggaattggccttgtatttggcggcatcggggccgaagccgtggtacagaagcgggagaagcaatccaaagaacatattcaccacaggggtcgaagatccgcgcaaggt

SEQ ID NO: 20720 - DNA, 1701 bp, A.fumigatus
  unsure (498): Identity of nucleotide sequences at the above locations are unknown.
cacagtctgagatctgttacagtggagtcaaaattaggaaagacttcagcgctcgggaaacgccatgatcgtgacgaagatgactccgacgattcggaagagtcgtcgtcagacgaagaagaagacgaagatggggaattggtaacgccggccgttgatgcagaaattatggcgacactgaacgcaattcgctcaaaagatcctcgtgtctacgacaagaacaccaaattctacacagccctcgacgaagaagaagaaaacgcaaacacgggaagtacagagaaaaagcaaaagcccatgacactccgggactaccatcggcaaaatcttcttagcggtgccaatctggaagaagacgatacctccgacactccgaagacctacgctcaggaacaagaggaactaaagaatgctattgtcaaagagatgcaccccaccgctgatcaaaatggtgaggataaggacgaggatgggggattcctgattccgaaatccatnaccaagtcagcctcggaacccaaggaggaaattaagctggacgttgagaatgcggacaaggatccggagaccttcctctcaaactttttgtcttccagggcatggattccagctggtagatccgagctgcagcctttcgagtctgaggatgaggaggagttggagcgggcagaagcctttgaggaggcatacaacttccgctttgaagaccctagcaagctgaacgcgaccctggtgacccacgctcgtgataagaccaaccaacagtctgttcgaagagaggaaaagagtgctagaaagaagcagcgtgaggctgagcgcaagcgaaaggaggaagagaagaagcagcgggaagctgagaaaaatcgtcttcgcaaattgaagatggaagaacttcaggagaaggtcaaaaagatcaaggaagtcgctggcttacaagcatctaaatttaccgatgaggactgggcacgcttcttggacgaggcttgggacgatgacaagtgggaagaggaaatgcagaaacggtttggcgaggactactacgccgaggaagacgcctctggtactgatggcgagggcaagcgcaagaagaaacgtccaaagaagcctacatgggatgatgatatcgatatcaaagatctggtccctgattttgatgaggaggaacccaagccggcattggaggattctgatgtcgagatggaggatgatgctgaagacacgaacaagaagagcaaagctcaagagaggcgggatcagaagcgggaagcccgcaaggaccgcctccgcatcgaggaggcaatcgatcgcaacctagatctcgacatttctcttctacctggcgccaccaagaagaacacgactcgcttccgttaccgcgagacctcgcctcaaagcttcgggttgaccgcgcgggacattcttatggctgatgatgcacagctgaaccagtttgcgggtctaaagaagctcgcctccttccgtgacccggagaagaaacgcagggaccagaagaaactcggcaagaaggctcgtctgaggcaatggcgcaaggaaacctttggcaatgaggagggtcctgtcttcagcttcggcagtgaaaagcctgtgggtaatgcggagcaagcagacgatggagacaaagtggatatccgggaaggggagcccaggaggaagaagagaaagaggtccaagaagcattga

SEQ ID NO: 20721 - DNA, 666 bp, A.fumigatus
caactcactatgccaactgtactcacatcaacaccccaggctccagagccctcggccctcaccaccctcctaacctccacctcttcctcctcgaaccctctatctgcaactgcaatccaagtcctccacaaccttcaacatcagcatctttggacctctctccaaatccatgacttgcagatatccaattcctccgtctcaccgtcgtcgacctcaacatctacagacaagctttccagctcaccctcgtacctgatctccggcatcccacctcacagaatctatacgcacccagacgagcagctgttcatgctcgagaggggtcttcgcgaggacgacatcgagctggaacgtatgttcgtcatacccacggctcacgggcaatcatggagtctgcgcaaaatggctgccgtgttcgatgcgcttcccgaggacgaggacgagtcgaatgctcaatcattagatgatgccaaagcatccggcaataatgcagagaaggcagcaaagctgacagagtactatgagtacagacgaaaggctcgggtcacaaaggagtggggtgggaagagacttctcttggccatggttgatcgaagcatgggtggggatggtaccatggtgtactatgtcgtccaagaaggtgctgtgaagccaagacagaattaa

SEQ ID NO: 20722 - DNA, 369 bp, A.fumigatus
aaagcattgcacaaatctgctgaatcggcggctctcggaatatttgtttcatcgtctcttatttttgccttcctgaattggacgaagatggagcctccagcgaagaaaccacgcaagcttcttgacgatgacagctccagcgattcgggagacgaatctggcggagttcccatcaccgatcagtcggagcctgccttcaagatcaacgaagaatatgctcgccgttttgaacacaacaagaaaagagaagagttgcaaaaatgtaagtctgcattgcttagatcaacgaccgtttcggtaacacagtctgagatctgttacagtggagtcaaaattaggaaagacttcagcgctcgggaaacgccatga

SEQ ID NO: 20723 - DNA, 183 bp, A.fumigatus
tctcccggactatgcggcccacatccgctcaaggtcaaccgttcatgctcacagtcccaaacgcctctcggtcttcagtggtcgatccaggagcaatacctcaacctccacctcatcctcccgccgctcgcccgcttcgtctatgacttctgcggacgctgcctcattgccctactccagtga

SEQ ID NO: 20724 - DNA, 249 bp, A.fumigatus
tcgtcacaatcatcatatctgctactctgtgctcctgtccgagctgatttcatcttatttgtttatggagtgtcaacggagtggctagatgacaagtacctgcgccgttatatgatcttactactagatcctgctcctgcccctcctcctattatcgttatccaaaatcctccactgctactatattttactcgccgttctggaccctcaaatctgagattttttcggtctatctttctccatctttga

SEQ ID NO: 20725 - DNA, 597 bp, A.fumigatus
ttgcaaaccatcacctcgctgcagtccatctgcacaaaagatcgtcttgttattgggatccatcaatctcactgtcccaccatgcttgcaaggcaagaagatgcggatctctctgaccggccatccaccagagcttccaatgatctcccggactatgcggcccacatccgctcaaggtcaaccgttcatgctcacagtcccaaacgcctctcggtcttcagtggtcgatccaggagcaatacctcaacctccacctcatcctcccgccgctcgcccgcttcgtctatgacttctgcggacgctgcctcattgccctactccagtgaagaccgagccagctcctccgcaggtactcgatcggacaggcatgagaggcatgagagtatgaccaaatcactctttacacgggggagccgaattctccgccgtcagggaagcaagttcaatatcgccgccactctggacgaggaggatgaagtagagcgcgaaaagtctcgtttcgaggtctcagagatcttcagtcgccaccacaagacgcgacaaagtaatgctcgtaagtcaaacgcccccgcccagagtaatattcgctggagataa

SEQ ID NO: 20726 - DNA, 1470 bp, A.fumigatus
tcaaccactgttgtgaacaggctctttttcttgactttccgtcctcgcagcccaccctcgaagtcgttcaacatggcctccactccatcgcaaacgttgaccaaacgtcaaagcgaacaaagtcttatgcccccccctcctccaccgaagcggattagacggccagccacggtcctggacgaagatgtctacacgaatgccttgtcggaaattattgctcgtgactactttcccggactgctggaggagcgagtgaagcaggagtacctagacgcgctggaatcgaaggacaaagcgtggattacgagttctaaaaagaaactcacggatttgttaaagactcctggcagagctcgtaccgttccacgcctccatggtacagaacgaccgtatgacaccccgactggctggcaaggagatacgccgaggtcggtgatctcaacaacgacggctgcaatgtctgagtccgctcctaaagatatcccagatgtgtccaatctggggctcatggcattccaggccaaatacaccagcgaagacaatgagtcgttcaataaactgctggacaaacagaatgccaagcgtcaggagaagtatgcctggctctggagtggaaacaagattcctacggcccggcaaattgcccaccgacaacgggaagcgaaacgcatcgcagcacaggggggcagtattgagcgacagctggcgatcaagacggatttggatgcccggcccgcaaagccggatacctggaagtcccgaccggaaaactcacttatgttcatgccgtcgtcgatagaggacacacacgagacgatttcacaaaaagctgaagctctttcgcgtgcggggcctaagcgagtggtgcacgagaataccaggctaccggagccaagtgtccagcaggagggcaacaatgtccctccctcgccatcgatatccgccattaaagatgccattgctggccggccccgactcacggaatccgaagcgggatatgccggaggagagacaccaagggttaacggatatgctttcgtcgacgaggacgagcctgaaccggactacggccatgctgccgcggaaagctcagagttgacatccctgtcaggtgacgatcttcgcctgctgggggcgagcgactctgctcccaaccctttttcaatcagggagaactgcaaacgggaagaactgcaccaccgcatggtcgaccgggtagcaagaacgaaacgcgccgagaaggcggcgcgcgagatcacaacgcccgtaacgccgcgtttcgcgagcagccctcggttggattttgggctacgtacccctgcggctgctgcgtcgagcggacagggcaaggctctgacccctgcggcgcagaaacttctgcaacgggttggaagcacacctcgaccggcagcaagctcgtcctcaagtctgaggaatatgtggaccccgacgccgaggaaagctaaatga

SEQ ID NO: 20727 - DNA, 1989 bp, A.fumigatus
catgggtatacagacgaacatttgaagagcctgatttccaatccctttgatttccaccatctgactcatacgagtccgtcccaatttcaggcgctggataaagccagagaaaatgacattgtcaccgaattttccgccatccgtgcctctcagagaccgatgacgggactcaagggcattcgggcagacgatctccattttcgaggcttctcatcagaagatctcacagatggcggggccgctactgcagagcaccaaacttctccgactctgacaagccccccagtttctccaggcgtttcatcttcggtcagtccgaaacagcacgatcaccgagccagaagagaatcgcgcgtctttgagaatttctctcggcctgtgccgagatatcccagggccggctccaccactccgccgccgagaacgatctcccctcaactgacagcttcaccagacttgtctgagcccgcaccacgcgccattgatgagattcttggcttgtcctcccagcccacataccctgaacacgtgtatggtaatacagacgacgtggaacagtactcctccatgccacagtttagggttgaagggatattttcgttccaaccggaacatgctgtcaccacagacgcaagcaccgaaagaatagacgctgagtcgtctgtctcccttcctagcctcaagtctgtgttgaaagaagtacctgaggaggagggcatcacttcctggcatgatagccctgaggcgaatgccgatacagcatcctctccatcctcatctcagatagacccttcagccaaggtgccaatctcgtctgttcaacatcgcaagtctcgactatccatctgcgttgctgaggagctctccagaaagttttccgcggcgctcggctctcctactcttccacagtatcgtctgttccaggatgctgccgaccaagcggttggaggaccaattcgccggcggtcatccgctcaccgcaaacctgcctatgaaaccatctatgagtcttgggatgctgatatcgattattgctacgagcatgcggcggaatcaacgtttgactttgactggtcaggtaattcgctggatgaggctcgtccggcagataacgatgatgactccagagcagcttgtggggggccagcaaacgagagcaaggacgtcgagcttcttcgccctacgcagctcaacatgccgcgtttacccagtccagagttggatcccagccaagcccgttcgtcactcagctcccaagtagctgtgactccgtccagcgccgagtatgagagcgaaatcgtttcgaccggcggagattattttcagccggtcaattcatcaatcttcccatctgctatcggaaaacagatgacgcatgacacactgtacgaggagtacctagcggctgatgcggaatctgatcggcatttctccttttgctcacagggagtaattcacgctatggaccatccggtgtctccccgaagcagtttttctcccatcagcaagtgcaactcacaggagagcctgatactttcccgtgccgcatctattgtccgcaaacatcgttcctctgtctcgacggccagcgtcccagagctggtgcatagcctggcaagcagccgggaactgccatccatggaacacttgccctccatggagcagtctagtcacacagcgccgtcattggcaggccgtacggaagttccttgctaccaccggcagaccaggagtttggcacgagagattgagacacagatcatgtcgcgatctgagaataacccaagtcccgggcctgcagacccggcgcgggcaagcggtatggttcacgatagagcaaaatcaacatctgaggtagatgttccacgaaccgtcaggactactaggagaaatgcttcggcaccacttcctccagtcccgctgaagagcccgaaccgaagaaagggcaggacatcatactcccttttccctacccctgcagcgaattga

SEQ ID NO: 20728 - DNA, 1341 bp, A.fumigatus
ggtggatatcgtccttcggagcccagttggttgatgcaactatccatgcggactgatttttcatctatgcattacctttcagttgcatatttcggcgccttaatattattatacggccctatctttcttgtcaagccgtgccttgctcttgatccgccctctgattccgccctcttgatcttcagcaacgacacgaatgtgattctacacgacgtcacaggacaattcacatccctccatggatcatacagtggacttgatgttcaggataccgggagcgaaaatggagaaactcgaggtctcgaccttgttcgcagggttccgcctggtgtgtcatctctagggaacaaccagttcaagaccagcggtatcaagctcggagagactcaatggtggtattttcccaaggagtccgtcaacggaaagaaatctaacgtcacatccgggctccctgagaggatttctgtcgaccggacaagccagcaaactgtcaggtcggacgaacttcggaagcgggacggagacaccgtcaagcgctcaacctccgtatatctctctctgacgatgtgctcaaagcccgatatcaacattaccaatggcactattcctgactctgtcccatcattaccggaattaaatttgtacgtgtctacctcggagtcactccaaaaaccgggcccgggacaagatagctcaaagcaggaagtgtttacggcggatgagggctatgtgggagcttctgtgcaggcagatggggatgtttttataggagtcgcagtgcaaaattcgacggcgtactccgggggctacacatatgagattgctgcctcaatcgacgcttattttcacagcgttgtggacgagccatttttacattttgttgacgcggacatccatgccgcactcttgacaacagacaatttgaccctttcagaagaggggagcgagaattatcagcagtggatgaatctgacaccgccgttcacaatgtttgctcataatgtgaatgatacagcaatctcaggccttcaacggtcgtactgtgctcttgagcaattggcccagcttagagaaggtgaccacggggtcgaaggtgggatgacgaaccgtggtctgggcaagaaaccgaaggagcagttctacatcaccggtctcaaccggacttccaattactctggaattctcgcaatggatggaaactccaccaactcagggaacgggattgttggcggaggagggacggtctggaaacccatgtactttgcaaccaagtcaggtgagcaagtgaccagcctatgctcttctttgaaacgatcgaaggtgctgacctggaacagatga

SEQ ID NO: 20729 - DNA, 696 bp, A.fumigatus
cctggaacagatgacaactgtgcggtccttttcaacctgacattctgctcagaagttgcgtatgcagttccatcaaaccctgaatttgggatcgcacaacttggtgcgaaatacgacaaatatgccgaggctctgtacaggaacttttcctattctctggaccagatccaatgcaacacaaccaacgaaaccagcttctctttggctgtgagttgcaacgactgtgcggatgcttacaagcaatggctttgtgcggtgaccatcccccgttgtgccgacttctcaagcaacagtgtgtttctccaggtccgaaacgcgggccaacagttcatcaacggcagttctctcagccccaccgaccccaggcgcagggatcctgcgcagaacaagtcgcgcaattccatgatagacgatcagatccgcccgggcccttacaaggagatcttaccgtgccaagacatctgctacagcttggtgaagcgctgtcccgccgctctagggttcagttgcccccagggtgcgcggctcagttctgcctacggccagcgcggttcgagcagcgagatcacctgcagctatccgggggcagcgtatgatttgaacgctggacgggcccgccgcgagcctctgggttggcttttacttgcaatggggagcttctggttttctttttgggctctcagggtggacgcctag

SEQ ID NO: 20730 - DNA, 312 bp, A.fumigatus
tcaaatgacaatcgcatgctgatagtcagtgaccgcatggtttccttgttcgtccgcctgcctgccttcccctctttccttcttcctgagtttctttctgcctttctttcgaagaatagtggaaggttgagcgggtctgaatcttggaggttgataaggccgccgaagtggcgtcaagcggatgacgacgtcacgttatttaggctgatggtttaccagctacagttgttcctattcgataccttcaagagacagcaacttttctgtacagaacaatcagaaggactcaacagcattgtcgataatatctag

SEQ ID NO: 20731 - DNA, 201 bp, A.fumigatus
aaaacaatcacgccaaggaggcagacgaaccatggcacaaaagaagaggcggcgagcgtgtctacagagtgggatgcctgcatcaaggggccaaaggctggcctgtctcctactccatacacatcaaggaggctagaaatgtatgtgaagtctcagagcagtctgcagggatatgatacagtgaaccaagtacctatatag

SEQ ID NO: 20732 - DNA, 186 bp, A.fumigatus; identical to SEQ ID NO: 10610

SEQ ID NO: 20733 - DNA, 384 bp, A.fumigatus
ccatggcaggtcgtatggctcagctcgatgttctatctggcctgtttgggcttcatcaaaacgtcagtctgctggttctacacgcgcatcggcgacaagacgctcacgcgcatgtccttgatcatgatgggcatcgtcggcacccaggcgacagtgttcgtcatggtggcagcctttcagtgtcgacccatcccgaaagcctggaacacgtccttgcctggtcagtgtgtcgagatcaacatcttctatctggccaacgcagccttgaacatcctgactgatttgctcacctactcgctccctatcaaagtcctcctccgcctacagatgccggtcaagcagaagttggccctgggtttcatcctctgcctgggacttttgtga

SEQ ID NO: 20734 - DNA, 489 bp, A.fumigatus
gtcactcgatcgccgcggcgaatcggcacactgacacgccttcctagtgcctgcatctcctcgatcattcgcatcagctacatcccgaccatgctcaagtcggccgatttcacctacgccatcagcggcgccatgtactggtccgtgatcgagaccaacgtggggattctggccgcctcgattccctccttcaaggcgattgcctcccgcttcctgccgcgactcatcggcgagtactcatccgggcgcaagtacggatcctccacgctcacggggtccaaaccaatccattggggattctcccgcttcaaagacagtgtgaccatgaactccctgaggaccaaggatgccgaggttatgccgaccgagattggaaaagggtacggcagcaacaccagcgaggagcgcatcgtggtgccgaatgggaagatctggacgaccacgcagatcgagacgaatgtggaaatcaccaacacgagtatccggtga

SEQ ID NO: 20735 - DNA, 249 bp, A.fumigatus
ttcagcgttgctttttctgcatcctttctctcaacgccaccgtggccgatctcacggattatttactccgtacgtaccttttctctcggtgttatcccctacatggccattatcataaggaccgtctactctatcctccatattatccggacctcggaagatgaaacggatcaccagtttgcagggacagtcagcttaaactcgggcaatggccaaaagaaccgatctcaatcgctgtccgtccgctaa

SEQ ID NO: 20736 - DNA, 627 bp, A.fumigatus
cgatgcgcgaggattcaggtgtctgcaacggccgccgaatccccctgtcccctgtccgcatcaacatcagaccagggcaagcgaaatcaccaccacaccgaacaaatgtcgactgcaagcatcggagtcatcgtcggcagccaacgggttccccgttccggactgcagatcacccagttcgtcctgaagaccatccagaaagcatacccgaccgccaacttgcgtctgatcgatctcgcgacctggaatctccccctgtacaacgaaccgggcatcccatcgttcctcaactcgccggaggaatacacgcacgagctgaccaggaagtggtccgaggagattgcctcgcatgcggcattcatctttgtcaccccgcagtacaactggggctatccggcgagcatcaagaacgccatcgactatctctaccatgaatggaagggaaagcccgggatgatcgtgagctacggcggacgcggcggtggcaaggccgcccagcagctgcatcaggtgctccagggccttggtatgcagcccgtcgagccttcttgtcgctttgacgtttcctacgcaggcgtttacggggagagcgatcaagggagaggatctgggagtgctggaggatga

SEQ ID NO: 20737 - DNA, 318 bp, A.fumigatus
gtcgttcaacgccgccatcaacccgcactaatttctcccagaatccgacatgtcaaatgcgacgaacaacagccagaatgtctgcagtgcgtcaagacaggacgcaaatgtgacggatacgatccccagcagacaaatccacaggcgcagcagcgagctgtcctcgatcccgcccccgtggcctggactaaacccagcaccgaccatcgcctggtcttgcgtccggggactcgaggagaacggcagtatatcgagttcttctgcacgcggacatcgcgcgcactttctggattctttgattcggatctctggcagtaa

SEQ ID NO: 20738 - DNA, 1752 bp, A.fumigatus
gcgagcggatcacgcaaccgagcggatcaccaaacgcgttttgacttctatttcaaaagctgcagtgctcagccagccactatgccaccaaaagcgcgtataaactcaaaaaattcagttgagcaggagggaagggtcctacttgcagtatcagctttgaaaaataaggaaattctcaatattcgtgaagctgcgcgtgtctataatgtgccttatactaccctccagcggcgcctaaaggggcatacttttcgagctgaattacgcgcaaatggccataaaatgactcagaatgaagaggattcacttattagatggattctatctatggatcaacgtggagcggctccccgaccgtcccatgtacgagaaatggcgaatatcctgcttgcgcagcgtggttcaactcctacccagactgttggagagaaatgggtatataacttcattaatcggcatgatgagatcaaaacccgattctctaggcgctataaccaccagcgtgctaaatgtgaagacccaaagattatcctggaatggttcaatcgtgtccagatcacaataatgcagcatgggattacactggaagatatctacaactttgatgaaactggctttgcaatgggcttagtagctactgctaaggtagttacaagagctgagatgcttagtcggcccttccttatccagccagggaaccgcgaatgggttacctctatagagtgtattaactctactggctgggtgcttccaccatgcattatcttcaagggaaaggtccatattgagggctggtatcaagatacagccttaccagcagactggcggatcgaggtcagtgagaatggatggacgactgatcagattggattacgatggcttcaaaaagtctttattcctgctactaccagtcgtacaactggtagatatcgactattaattcttgatggccatgggagccatctaacaccacagtttgatcaaatctgcactgagaatgatatcattccaatctgcatgcctgcacattcatcacatctcctccagcctctagatgttggctgtttctctcctcttaagcgtgcgtatggccgcttgattgaggataagatgcggcttggtttcaaccatattgacaagtttgatttccttgaggcctatccacaagctcgtacggcaatcttttcagcagataatattaaaagtggcttttcagcaactggattaataccactgaatccagatcgggtgctcagtcagcttaatatccagcttagaacacctacaccaccaggcagccgatcaactaattctgtcccaaaaacaccttacaatctcaagcagctgaagaagcaggaaactacgcttaagaagctacttagggagcgtacatacagccctcctacccctacaaaggctgtgctaggtcagattatcaaggggtgtgagatggcaatgaataacgctgcccttcttgcaaaggaaaatcatgatctacgtgctgcacatgaaaagcaccttcaaaagcagaagcgatctaggcggcagatagaaactgcagtgggattatctatccaggaagggcaggagatcattcaacgcagggatcaggctgctgaagctatcccaactatccctccagagcaggtagtagatacagaacaacgccctcaacgggcacccccacgctgcagtgactgccatattctaggccataggcgattgcaatgtccgcagcgcaagaataactag

SEQ ID NO: 20739 - DNA, 708 bp, A.fumigatus
atatcgcagctttcttcttccccgcactcttcttcctctcgcaaaccaccttcatcacagatctccctcgtacagtgtcctcattacaattcacaatcccacaatcagaaaatgtcctccgtacagtccttccgccaactgattggggtccctccctcgaccgcctctgccaaagattccagcctcatcatcatcgacgcccagaacgagtacgccaccggtcatctcaagaccgcgaacgtctcccagacccgcaaggcgatcgcagccctcctagagaagtaccgtgccggcggcgacggcaagaacatcgtccacattgttcatgaggtgcctcagggcgcccccgtcttcacccccgacaccgacctcgccaaggaattcgacgagttgaccccgcgcggtggcgagaaggtcatcaccaagcatttcccgagtgcctttgcgcagaccgatctcgatgaatacctgacgggtctgggagatgcgggaaagaaggttgtcctggtgggatatatggcgcatgtgtgtgtgtcgaccactgcccgggcggccagtgaacgcggctatgatgtggtcatcgccagtgatgccgtgggtgaccgagcgattcccggggccagcgctgagactctggtgtctgtggttctgagtgaactggccgatgcgtttgctactgtccttccttcctcggagatcaccgcatag

SEQ ID NO: 20740 - DNA, 360 bp, A.fumigatus
ccagccttggacgaaccttcgcctgcacaagagcagtcgaatcccaccgccagatgggcagacaccagcaccggcatcagcaacagcagcacagaaagctcaagcagcaacggcagcaacaacgcacccacccactctgaacccgagagatctgtcccagaacagcgatctcagaccatgcccggcggcgacagcagctcgcagcagaaggaggacggtggtgtggagcgcgctccgcctaccactacccagcaggtaagcgccgaggcactgaaggggccgcagggtcctgcgcctcgggaggcctatgagtttgaaaaggagatcgatgggcagccgtcgaagacgaagactggttag

SEQ ID NO: 20741 - DNA, 1008 bp, A.fumigatus
cctgcaacgtataggaaatatgaccgaccctcctacaccctcagtacgttcatcccgcggaaatctcagacattctatctcgccctccgagctctcaatgtcactctctccatgatccctgagaccacatcctcttacacaattggattaatgcgactgcaattctggcgcgacgccatcaccaagatcttcgccggctcgccccccaaggaacccatcgccatcctcttggcgtccgcaattacaaacctcaatgagcgcacacaaggtcaagcccgcatcagcagagcctggctgaacaagatgatcaacgcgcgggagcaaacccttacaaatgacccgtaccctactatcgcagcgctagagacctacgcagaaaacacctactcgaccctgctctacctgacattgtcctcgctgcccatgacgtccatcactgccgaccacgtcgcatcgcacatcggcaaagcagccggtatcgccgcggtcctccgcggcctgccgttagttgcgttcccgcctcctcaggcccagtcacccacgcaacctgcctcgggcaacttcggagggaacaagcaaggagcggtgatgctgccgctggacgtcatggcgcaggcgggcgtcaaggaggaagatgtcttcaggatgggcggcgatgcccccggactccgtgatgccgtcttcacggttgcgacgcgggccagcgatcatctgattaccgtgcagcagatgctcagcaacctccgcgctggtcaggatgtaggacatgactttgaacatgcggatgaggagggacatgagtacctcgcgaacagggaccaacgcgacgagtcacctttagacgaggtgaaccgggcatttggtgtcttcatgcctgcggtgagcacgcgactgtggctggataggttggagaaggtcgatttcgatatcttccggccggagctccttcggtctgactggaggctgccctggaaggcctacttggcattcaaccggaagtctctctga

SEQ ID NO: 20742 - DNA, 3252 bp, A.fumigatus
cacacatgtactaatcgtgcagtccctgcgttgcctagatttaatgagattggagttcaacagctgagcgaccatgtctattctcaagtatttccgaatcaagcaagatcgccagatccagtcctagttgcactgtccaaggaacacctttcaaggcacgatctgctaggaaaatctcaggatgctgcggaacctatcgcattcgacatgcctgcccttcaggggcaatccatggacgagcacttcttcaagctgggaatggatgcatccgaaccctacttgacctatgcaaaaagctatacaactgtcaattcgcctcagaagccgcgcgaatgggtcaagcgcagcggatggaccaaatataactctgacggttcttgggagcctgtagacgcaccaaatgagccaatgctcaccttcgataccgaggtcatgtacaaagaacattcctttgctgttatggcttgcgccgtgagccctacagcctggtatgcatggctttctccctggctgcttggtgaatccgagaatgaagttcaactcatacctttgggcgataaaaagcaacctcggattgttgttggacacaacattggctatgaccgagcgcgcgtcctcgaggagtatggaatggaacagactcgaaacttcttccttgataccatgtcactccatgtcgccgtcaacgggatgtgctcgcagcagagacccacatggatgcgtcataagaaaaataaggatttgagagacaagattgcaaacgagagcaactccgtcgagctggctgcgttgctcgaaagcaaaatgttgagcgaagaagaggaggaattgtgggtaggaaggagctcagtgaattccttacgcgacgtagccaagtttcattgcgatgttacgattgacaagtcacaaagagaccattttggcgaactgaacagggagcagattctgggaaagctggaagagttgctggattactgtgccgcggacgtcgccatcacccatcgcgtgtacaagaaggtgtttcccaacttccttgaggtctgtcctcaccctgtcagcttcggagctctccgtcatctgtcctcggtcatattgcccgtcaacgaaacgtggaaagagtatatcacgaacgcggaagccacatatcatcaacgagtcgatgatgtgcaacggaggctagttgaactatgcaacgaagctctcaaggtcaaagagaacccggatatttacatgaatgacccttggttgcgacagctggactggtctggccaagaaatcaaattggtcaagggcaagaagaagggtgatcctccgcgacccgcggccagacagaagaaaccaggcatgccacagtggtacaaagatctttttccttcagctacagcggacatcaacctgactgtgcgtacccggattgcccctatattgttgaagctgtcatgggacggttaccctctgacatggtccgataaattcggatggacattcaaagtcccgaaagaccaggtcaaaaaattcgaaaaccagcctgtggttctctgtgatatgagtgaagagaagaacctggagttgcgcaacgataggaaacatgtgtatttcaaactccctcataaggatggcccacaagcacgttgcgtcaacccattagccaagggctatctgcaattctttgagcggggaacgctttcctcgcaatacgccctcgccaaagaagctctggaaatgaatgcctcctgctcgtactggatcagcgcccgtgacagaatcatgagtcagatggtagtctacgaagatcaagtcaagcagtccgggtctacaggtgaaaagtcaaaccgattagggttcattctccctcagatcatacctatgggcacgatcacccggcgagccgtcgagaatacgtggctaacagctagcaacgccaaggcgaaccgcgtgggttccgaactcaaagccatgataaaagctccgccgggctatgtcttcgttggtgcagatgttgactctcaggaattgtggattgccagtcttgtcggggacgctcaattccaactacatgggggcaatgcgattgggttcatgacgttagaaggttccaaggctgctgggactgatatgcattcgcgcactgcccagatcttgggtatttcgcgtaatgacgccaaggttttcaactatgggcgcatttacggtgctggggtcaagttcgctgccacactccttcgccagttcaatccatccatgtcggagaaggagacccaagaagttgcaaccaatctctacagagaaaccaagggcacccgcacaactcgtcgtattctgagtgaaaaccctttctggcgcggaggcactgaatcctttgtcttcaacaaattggaggaattcgccgaccaagaaagaccgcgtactcctgtgctcggcgccggaattactgaagcactcatgcgacgcttcatcaacaagggcagtttcatgacttcccgaattaattgggccatccagtcatctggagttgattatctccatcttttaatcatatccatggattatcttatccggcgatttaacattgatgctcgactcgcaatcacggtccacgatgaaatacggtaccttgttaaggaagaggacaagtatcgagctgccatggccctacaggtcgccaatgtttggactcgcgccatgttttcgcaacaagttgggatcgacgatcttcctcagtcttgtgcctacttttcggccgtcgatatcgatcacgttctacgtaaagaggtggacatggactgcgtgactccatctcatccacacaagataccgcacggggaaagcttggacattagtcaactattggacaaggaccaggaagcatatttggatccttcagtagtcccggtttcgcctcctacgcctcagaagtacacctacacaccacgcgagtctgtgatggcgacacttcaggccaccaataatcctgctttcatcaaagctcagatcaccaaagatgacaaagagctacgagaaatcatcaaggaggtgacgaagaccaaggctgccacctcttcaactgcacgctcttttcgaaacggttccaaatcgaccaacttccctgcagcggagcctcaaaaagcgattttgatggacattgattctggactgtaccgtgacttccggtatctaccgcaggggagcaggcatccccctttcaacatcaatcgtcagacatggaaacccagaccggccgctcggccttag

SEQ ID NO: 20743 - DNA, 219 bp, A.fumigatus
ggcggcactctatcgaacaagttcaaggacggacttgggaagaacgttttcgaattggcagctaatcagcccacgagaatcaatctcgcggccatcatactctactcgttcaatggagcacacggacttttatattttaaaatagatccagatatcagcaaacccatcgtttgggatgtcctagagaaatggattgaaatatgccataacgcctgctaa

SEQ ID NO: 20744 - DNA, 3921 bp, A.fumigatus
caatttgaagccgcccataaatttattgaagaaatgacgtcggcccgcccgaagtgcggtggttcatcgcgtcgttctccgtctcggcgcgtctcccgtccatcaatgatcaggcgcatcgaattcgatgccttttgtgctcgttctctaacattcccttgtcataaattcggccatctgatctcaggtaagacttttaaaatggtttttggggatctgaatgaacggcctttgaagaaaagacgatttttcgttgatgaagaggatacacacccaccttctagtgaagccgcaccggttaccacgaatctcgacacgtctacgatttcctctgctggaccagagggaagtgacgttcgtcagcagcagctcaatggtgccgtcccatttccaaacgttaaggagtcttcccgagagagcccaggcttaggcccagaagataagcaggataacttgctcaaagaagacgaagagaacaacggaaccgttgactatgaaatcctcaaccactctccttcaatacatgctcagcaagatcaacgagttgatcaaggtctgacaaacggatttggtggacaaccaagtggagagaggacagtttccgaaacacaagcatttcaaagttcaggtggattcgatacttccacctttgctagtatcattggagaacatctttccccggaatcactggagaagattcgtaaagcctctggcgatgatctggagcgagcggtcaacatctactttgacggctcatggaagtcgtcgaacaacagtctgagccaacctcttgtggcccctcaccaacagacaccggtcaacgaatcgatttcccagacggtcaatacaaagattagcaagaagcccaaccaagcaccgtcaagccgctgtctttcgcaatcttcaagatacattggtgctttcggcgtcggcgcctgggctacaagaagcggcgttggtctactcaaacacggggagcatgtcaatgttgaacgggctaggtctcagcctgtatccaaacgcggccgaggaggcaagctcattaccaatcagaagggggatgtcctgactcgattcacaaataaatccggtcaagaaattggaagattaccccgagagacagccgaatgggtttcaactctgatcgatcagaagatctgcagatttgaaggtatttgcgtttttgcgcctgacagggtccgggtcaacgatacgatatatctgcaattatggtgctatttacgtaaagaggcgtttttgccccggaatctttggaatatgggcgacgacaaccggtcgaccgcgtttttcgaagagcaggaaagcgctgaagagaaacagttgcgacttcgtcaggtggcacttgtcaagctttttgatgaaattggtctgcaaccgaccactgtcaacgacatgaccaaaaaacacaagaaggaagggctgctccgtgccgcagagattgcagaacaatacgacaagacgaagagagaaggcaagtcaaacgaatcatccgaagatgaagaatcgccagagctagaagaagatcaactcgatactctatacaagaaggcgcagtccttcgatttcaacatgccggaggctcaacctcccccaagctttgtgctgaacctgcgcaagtaccagaggcaggctcttcactggatgcttgcaaaagagaaagataagaagtctggcagagaattgtcaatgcaccctctatgggaggaatacacatggccaacgaaggatgttgatgacaaagatttgccagcagtcgaggggcaggcacatttctacgttaatccgtactcaggtgagctcagtcttgactttccggcacaggaacagcattgtctgggtggcatactggccgacgaaatgggcttgggcaaaaccattgaaatgctgagtctcatacactctcatcgaaatgtgtctccgagccggcagggtccaagctcctccactgagctggtaaggatgcctagctcttccagcgccattctgcctgctccaaacacgacccttgtcgtggctccaacctctctcctgtcacagtgggaaagcgaggcgatgaaggcctcagaacagggaacgatgaaggtcctgatgtattacggtgtcgacaagtccaccaatctgcaagagctctgttctgctggcaatcccgctgcacctaacatcataatcaccagttatggcgttgtattgtcggaatcccgtcagctcgcaatgttcaattccaatactcaaggtggcttgttttctgtggacttcttccgcgtcatccttgatgaagcccatgtcattaagaatcgacgctcaaagacggcaagggcttgttacgagctgagagcaacacatcgatgggtgctcactggaacaccaattgtgaaccgccttgaggaccttttcagcttggtgcggttcctacaggttgagccctggaacaacttttcgttctggaagacgttcattaccgtaccatttgagtctaaagactatgttcgagccctcaatgtagtgcagacagtccttgagcctttggttctccgtcggacgaagacaatgaaaacccccgagggagaacctttggtgccactgccacgacggacaattgacattgtcgaggtagagctttctgagcaagaacgcgaaatttacgactatatcttcaccagagccaagcggactttcaacgacaacatcgaagccggtacgctcctgaagtcattctcgacaatctttgctcagatcctccgtctccgacagacttgctgccatcctatcctcacgcgcaacaagaccattgtagcagatgaggaagatgcagcagcgacagctgatgcagctaacgagctgaaagacgacatggatctgcaagagcttatcgaccgcttctcagccagcatggaaaacgcggatacggccgaggcgcaggaccctagcgccaaattcaccacccatgcccttaggcagattcaaactgaatccagcggagaatgtcccatttgctcggaagagcccatgatcgatcccgctgtcacagcctgttggcacagcgcatgtaagaaatgcttggaggactatatacgtcaccaaacagacaagggcgtgccgcctcggtgcttttcatgtcgagcaccagtcacctcacgagacatcttccaagtgatccgtcaccaatcacctagtccgacccctacggagacggatctctacagcagcacccctgcttgcagtccgcacccagcaccccggatatccctccgacgcatccaccccctctcaccatcagcacacacctccgccaagatccacgcccagatcaaccacatcaaccgcgtccatgcatacacaaaatcggtcgtcttctctcaattcaccagcttcctcgacctgatcggcgcgcaacttaccaaagccggcatctcatacgtccgtctcgacgggacgatgccgcaaaaggcccgagccgaggtgctcgcggagttcaacagaaccgagaccttccaccaagaggaaatcgacgaggacgaagggccggacacgccccgggtgaggatctcatccaagaacagccggtcgtcacccaaaagccccgccgtactactgatcagtttgcgcgccggcggcgtcggcctcaatctcacggctgccagtaatgtcttcatgatggatccgtggtggagctttgcaattgaggctcaagcgatcgaccgtgtgcatcgaatgggccagctgcgggacgtctctgtgacgcggtttatcgtcaaggactcgatcgaggggcgcatgttacgggtgcaggagcgcaagatgaatatcgcagggtcgttgggcttgcgggttggtggtgacggatcggaggatgagaagaggaaggagaggattgaggagttgaagttgttgtttgagtaa

SEQ ID NO: 20745 - DNA, 1695 bp, A.fumigatus
tcgttcgtcaccatgagcacccactcactcgatcaggcgcggaccattgagctgccacctgtcgctcccgacgaaagagacattgaggcaaatccgagggcacctatcgcaccgccatcacccttttccacgcccgccaaggaagtggctcctcattcgcctgagacgttcacttctgcggctcgaatcgcatcgcatgagacggtcagacatcgcgtgcgacgctccaacacagcccgctcgtatcatcccgacagcgttgctcacgaaccccactggcaaccgggaacagaaccaggcattgatccgaacaaatctcctcccgcctacagtgccgattgggcgcctcatatacctgctgaattacacagaaaatgcgagataatcgtggtggacttttcgcaacatgaaatgaggcagtacgagctggacaatgacacgctggaagcgttcctcgagcggcaaagagagccctgggtccagtgcaggtggatcaatgtcaatggactgagctgggatgtgatcagaattttaggaaaacacaagggccttcacagacttgcaatcgaagacatgatcaacacgaccaatcgtacgaaggcggactggtattcagatcacgcttatatcgtgcttaccttgcagaaactggtaaagcttagggaggagtctagcagtgactctgaagaggaagaagaagatggacgaatctcatttggtcgcgaccgcagaagttcgacatcaagtggaaagactcattcactgaagcgaccaaccaaaagatctctcgttgtggccgcattgaaggatctcttcacatttcggtcagcgaaggagacagacgacagatatgcgaatggggcgagcgttcgcccttcgtcggggagggcctcgtcaaaagcccagtccaatctgggtgacgttgtcaatgcagggcacacggcgcgcagcattcaacgcttccgcggaggcccgaacgaggacaggatcgcgttcatggaacgccacgctgttctggcatcgaagggcctgagtgtcacacttgaacaggtttcgctattcttgcatgcagataatacggtcacctccttcttcgagaccagtgccgacgacatcgaggcgcctattgttcgtcgcctcagttcatcggagaccatcttgcgccaatcctgtgatgccagcatgctcttgcaggcgatattggacgccataatcgacttggctattccagtgacgagtgcgtatcaagacgcaatcggtgatctggagcttgaagttctcacagatcccgacgtggatcaatccaagagcttgtatatactaacgtccgagattgctgttttgagaagctgcatgcagccgattgtgacggtcatcaatgccctccgcgaccatcgctcagagcccgtcagtacaccgggcttcggtctcaagcaactcggcaccacaacaccactctcaatgtcggggttcaactctgacgctcagctccaggtgggtgtagccacgccgaatctcaagagcttaggtggctccagcgtatccatcagcaacatgtgccatacatacttaggtgatgcgctggaccattgtatcaccattgtggagacatacgatcaaatgagacgcgctgctgataacatgatcgatctgatattcaacactatcggtaatttccctgggaggacgagttga

SEQ ID NO: 20746 - DNA, 204 bp, A.fumigatus
cgttggatgaagctcgccgacgcgtccaatgcccggcatcttggccacttgaccgatgagtttggaatgctggagaaggctccgcaggtcctgcctgctcacctggtgtcggccgctgtaaaagagaagaagggcggaagccttgctgctcagctcgccacggtgctttcctctctggtacaggctcataacgacccgatctag

SEQ ID NO: 20747 - DNA, 1977 bp, A.fumigatus
  unsure (436): Identity of nucleotide sequences at the above locations are unknown.
agacccggtgaattagatcccgatccggaatcgaaacctgcccgtcccgatacaattgatctcgacgaggatgagaaggaaatgttgagtgaagctcgagctcgtttggcgaacacccaaggcaaaaaggcgaagcgcaaggctagagagcggcaactagaagaatcccggagactagctgtcctgcaaaaacgtcgtgaactcaaaaatgctggcatcaatatcaaggttgtcactcgcaagaagggtgaaatggactacaacgcggacatcccatttgaaaagccagcagcacccggattttacgataccacggaggaggaagctcggaatgaaagacagcgagaaatgtttgatcctcgaaaacaacaacttgcaaacaagcgaaaaggagatcaggaagaggacgcggacaggaagaagagaaagaatgacnagaatggtagctcggctttcgctgctgccgcgagggccggccaaatgcagaagatccgtgaggctgagcagagcagtaagagacgagcgctcgtcctgccagctcctcaagtgagcgaaagcgaaatggaggacattatcaaaatgggcatggccggcgacagggccagtaaaatgtctggagacgacgaaacaactcgaggtttgatcggtaactacacttctatcgtcggtgggacgccgattaggacaccaagagcgccgccagaggaggatcatatcgccaatgagatcagaaatattagagcgctgactgaaacgcaatcatctttgctgggtggtgagaatacgcctctacacgaaggaggttcttctactggttttgatggcatcgcccctcggcgacaacagatcgttacgccgaatccaatggcgactcctttccgacaagctaatggtttgggtgcaactccattacatggtgggatcgggccaggggcaaccccgctcaggactcctagagatcagttcgcgctcaatcagatggaaggcggacagttgattggcaccacaccgagagatatcagattgcaccagaaagccgtcagtcaagctattcgtagcaagttggcgtcgctcccgaagcctaaagaaaccgaatgggaactcgaggaacttccctcagagtctgcggagccaactgttgcggcggagatttctgaaaaagatgctgcggagcgtgatcggagagagagggaggcacgggagagagctgcgcaagctgagttgaaacgccagacccaagtctatcagcggggactgccacgtccaagtgtcctcgatatagatgctctgatggcgcgtgcctcacaggttaccgatcccatcaatggcatgatcgctaaggaagccgctctgttgattgccaacgatgctcaaaaattccgccttcctaatggcaaggttgaaggcaaggcacggaaactggagcgactcaacgatgaactcatcgaagcagcacgtgctgctattgtagcggaagttgcttcgtctaatcagcaacaggaatggctgcagggttttgatgatcgttggtcgtcaacgcattccaacgccctccccggactcgccaactatggtgatgacgatgaagatgagaatatgtaccgacaagaacagcgaatgattgacgctttcgagaatgtgcaggcctctctgctagctaccgcagagcgaggaaacaagcttgagaagaagctagcactgcactacggtggctatcaaaaccgcgcaaagacccttcgaaccaagattgtcgaggccagctctgctctagaaaactcgaagtatgagttgaatgctttccagaccctgcaaatttctgaagaatcggctatctcgcgaaggctcgagaagctccgcgacgacgtcgccttcgttctaaagagagagcgggaagctcaagaaacgtacaggattagaaaggaggagctggatgaacttgttgctgggacagaggcagttgtcaatgggtggcactga

SEQ ID NO: 20748 - DNA, 411 bp, A.fumigatus
gtatccaagtacggcctgaaccaatgggcgcgagtctcttcgctccttgcgaggaagaccccaaaacaatgcaaagcacggtgggtacagtggttggaccctggtattcgcaaggtcgaatggtcgagggaagaagacgagaagctgctacatctggcgaagttgatgccaacacaatggcgtacaatcgcccctattgtcggaaggacagcaacacaatgccttgaacgttatcaaaaactattagatgaagctgaggcccgggaaaacgatgagctgggactgggagggccctctggcggcgaggcggctgcgcctagtgcggacgatgtgagacggttaaggtatgaggtcgcacctattggaaaagatgttcgttttgctgataattttgaagacccggtgaattag

SEQ ID NO: 20749 - DNA, 1287 bp, A.fumigatus
cgtatgcaattagaatggattgatgcttctcgactggacctgtctcatgaagttgagtggcctcagccggagaaaccagagaagaagaagaccggtgttggtaacaaagcaccaagcaaaaatgcgcagaaacgtgcaagagccgatagtcgtgatgtctctgcaacaccagatcttctcacaggcaagaatgtgaatgttggcaaggcacaacgtccgtccaaggcaggtggtaaagagaaccgtgacggaactcctctcagtatgcccatcgtcacagcagaggccatctcaacagacggaacccctaaggcggagtctgacgatgtcgaaatggttgacgtcagcttcacggacggcaaaagcatcaaagaagaggagagagcgttgggactcatgtcgcgcgaagaagagatcgaacgactgcgaacgagcggtagtatgacacagaacccaacggaaatccatcgtgttcgtaacttgaatcgtcttcaaatgggcaaatacgacattgagccctggtacttctcgccttatcccgcttccttctcagacgctgatatcatctatatcgacgagttctgtctgagctatttcgacgacaaacgtgcctttgaacgccaccgtaccaagtgcacgcttgtccatcctcctggcaacgagatataccgcgatgactacatctcctttttcgaagttgatggccgccggcagaggacgtggtgccgtaatctttgtctgctgagcaaactcttccttgatcacaaaaccctatactacgatgtcgacccattcctcttctactgtatgtgcacgagagacgagacaggctgccatcttgtgggctacttctccaaggaaaaggactccgcggaaggctacaatttggcttgtatcttgacactacctcagtaccaacggcgtgggttcggtcggctgcttatctccttcagctatgagctcagcaagcgcgagggaaaactcggttctcctgaaaagccgctcagtgaccttggtctactgggttaccgtcaatattggcgagaaacgctcgtcgaaatactcatggaacctggacgagaaacagtcagtgagaatgaactcgctctattgacttcgatgactgaaaaagacgtccatgagaccctggtcgtcctgaacatgctgcgttactatgtatgcgccctcaccccatcccacttgaagcctgatataccgttagaacaattaactgactacctcatagaaaggaaactgggtcatcgttctcaccgactacgtggttga

SEQ ID NO: 20750 - DNA, 999 bp, A.fumigatus
cctcacagtggtgttctagcagaaaagccttcagaagaattgttcgtcatcgataagaagggctccgccgagatcagaaatgcatacttcaaacagcacaagcctctgaaggccgatgagatcctagcccagcgttctgcaattcctgcagtggatactcgcaaacgtttgaactcgaaagtcacagacggtgtgattgaaccgaaatccaagaggcacaagagcgactgggtcactcgcaaggaatggctgcgcttgaagcaggtggccaaggaagcgaatccgactcagacggcggaagaaagcgagctttacgacccttgggcggattctgaagacccaacacctgttgaagaccctcaattcgattacctcgagaagcccaagcccaaagttgcacccccgacgattaagcaacctccaatttcacttgccgcgaacggaaagccaatcccgtctgttcgcaaaccagatgctggcatcagttacaacccgtcatttgaggattgggatcgtcttctgcaagagaaggggcacgaagctgtagaggctgagaagaagcgcttggaagaagagcgaaaggagcaagagaggcagcgccttattgccgaggcacaaaatgatgatggcgaagttaaatctgacgatgagagtgcctgggagggatttgaaagtgaatatgagaaaccagagtggctcaacaagaagcgcccggcgcggaagacgaaggcagagagaaatagaatcaagaggcgcaaggaggccgagaggaaagctagatgggaagccaagatgaaacagaaggaagagcagcttgagcaagccaaggctatcgcggaacaggtacagcagagacaactcgaacgcagccgggagtctggggatgattcttccgaagaaggagatgatgccgccctacggcgtaagccattgggcaaagcccggtatgtttttcttggtcttgattttcggatctcacacgtactaatttggcaatag

SEQ ID NO: 20751 - DNA, 618 bp, A.fumigatus
cccctcctcagtgcagaaataggtaaatatgtcgctatggactgcgaaatggtgggagtcggtcccaaccccgataacgattctgccctcgcgcgtgtcagtattgtcaacttcaacggcgaacaagtatatgattcgtacgtcaggcccaaagagatggttacagattggcggacgcatgtgagcggcatttctcccaagcacatggcggaggctcgttcccttgaacaagtccagaaggacgttgcggagattcttgacggacgaatactcgttggacatgctgtgagcaatgacttggatgctctgcttctgggtcatcccaagcgcgacatcagggacacaagcaagcatcctccttaccggaagatcgcgggtggtggctctccacgcttgaaaatactggcgtcggagttcctaggcttgaatattcaggacggcgcgcactctagtgtcgaagatgcgaaagctacgatgctcctgtatagacgagataaagagggcttcgagcgggagcatttgaagaaatggccaattcgcgtcgtcgtcgataaaaaggagaatggcgaggaccagaagaagaaaaagaagaagaagaagcagcctcgtaagaggtag

SEQ ID NO: 20752 - DNA, 3369 bp, A.fumigatus
catccaagttttacagccgtgcaacctacgccaccaaagcacttgacagatgaggagctcaagcagcaatacggaattcatatgacctctcgcatccaagaagacggtggtgggaccgaagcgaaatgggccgatatcgatgacgacgaagatgactgggctcctgagacgatcgaatggactgatggcaccaagacgagccttactactcatacggaggcagtacatgctccgggccaagacaccaagacggcgaacgaagcaaaggccgattctcctgcaccagagcaagcccctgccactaaagaggtgaccaaaatcgtcacgaagcccacaacgactatcggacccaatcctaccgttctcaggcttggcgcgaatgcggaaaggcaggcgaagagtgcaaccatcttgtcgagaggaccaaacgacaagacgtcgttgtcgtccacaagtccagctcctccatctaaatcaccttgggccccactgccgcctgttgaaaaggtatccccagtgatgccgcctgttcaagctcaacctcccggccgggctcctgtcagagagcaccaagttagcgaaccacctaccggaaatgtccatccaaaggagattgcggccgatgacttcaatcgatcgtggaaggacacgcactctggaacaactcgtgaattgtacaactctagatcgggtcgttatgagcctgtaccagagaggaaagcaccgtggcgagctgagcagcaaggcttccgcccttcttctcttttacagcggccgacaccaggtgagcaggcaggacctgcggagccttctccagcattccaaactcatcggtcaagtggccaagatgccgggcattggacgcgtcggcgagcttcatccaacgtcagcggaggaagtgggagctttggacgtcggatgtcgatcggccgccctgatgggccgcagagaacgtttgaagcaagaagaggctcgcaggtcaatggaattatggacccgtcccttcagaacaaagagtcggtgcatccaaaggacgcatctatgcatgaggcttcctcggcccgccatccaccaggtccaacatggcctccacgtgcagctgcgggtccgcctgacagtgttgctaacgcatctcgagctgcgtctcagtcatcagtgcatccggctccagaagctcaggatgctacagcgcaagctccgcaggaagatcccgtcgcgatgcaggaacgtatcatgaaggaaaagcgacttgaagcccggcagcgcaggttagagcaagaagagaaggaggaagctgcgaaacgtgaaagaattcgacagaagctggaggcattgggtccaccgcccgagaaaccaaaatcaaaaaacaaggagtctcgggaaggtgataaagctgaagctaaggcgaccccgaccgtcgcgcaggcagcacaatcccctcctaaacccccggtaccagagccaagcggcgaaccgaagcaatacgggatgatgaaagtccatcatcctgacaccgtcaaaaagctcgtcgccgcgaatgaaaaagaaagagctgccgaacggtcggctcccacggtaaatgctcgacgtcctgcttctccagctcgcgatcctaaattggaggctaccacaggacctcaggagcctagcgatttccggcagtcccgtcttcctgagaaattgcccgaatcaagaactgaagagccgagttcccaatggaagagtaatcttagcacttcgagctcatattccccttggtcttcgaatactaaacttggagccgcctcttcatctattgccaatccctggaagcctctcagtaacgataagaccctgggtaatggcatatttgatcaagccctcggggggttcccctcgagagacatctcccttcgtggccctctcggccttgatcaacccccaatctcttctggcccacaaccgttttctgccccgtctcgaccccagccagagcctacgtcaatctctcctttgcctcctacagatgttcgacatgcgcagtacgactctatgaccccggctgtccgaccagggccaatcgggcctccaagtgtacaccagtctcattggcaacaggaaccgcgcgttaccggtactaccgcttggaataatttccacgcggttgctgctaaacgtgaagcggaagagaatgagaagctcctaaacgagatgaacacgatgcgtgatagccagcctttgcatgttgcattcaatgaaacatggcgacaggtccgcactggcgaccagagtggacagaggcaggttgtcggtattcatagaccaaccgacacttcaagttcaatatctaaccatctgcctggtttcgatcatcctgtcgcgactctacccttcgctgatactcatgctcgtccactgagcagtgtgcccgttcgcagttctcgattcttccctcaggccacggagcaatataaacggccagcctttgaggaagatgagcatttccgaagcccgtctccaccaccacccgaggaactgtcgagtcatccggtatatatgagtgattctacccgacctttggtccaccttcccgctcctaagcccattgtcaaacttccccccaaggtagttgcaccaccaccaccaccaccaccacctcctacatttgcttccatggttgccgctcctcctcgcctctcagctcaagctcaacccgtctcaactgcaacctcctggcaggagaagattaactgtcttttcggcaagaaaactgtacatgagaagaaaaatgctttggcagtcacgtcagcatcgaaagaacctctcgatgttcaacttcatattgctgcggtgtctgtatctctcccctatcttgctgaggatatgactcaagttggcgacggaatagccagcgctaagcaagtcgaagagacggaggagatcttcgaggatcgtgaagcgggttccttacctgttgttcgagttcccaatgctgcgcctccagcagcttggcatgccgctccagcaccatcgcaatcccggttccggttcaagagtctcaagccgatgcaaatccacagcatcgagccctatattttgggcctcggtgacagggattcatctggcaattttcgggtgtctatccgcttccccggcgctatcgcagcgaaaactgtgactcttccaaagaaggcagaaagtcaaaaccctcgacagcgtgggccctcgactttcaaactacgaaagaatacaaaagctcgggaaggccctggaaactctattaacaagaagacaaccaccactcagcagaacggcgggagcgcctcttcgccccggcatcaaccgcggaacacaacatgggcaccgcgcacaagtagcgcatctcactaa

SEQ ID NO: 20753 - DNA, 207 bp, A.fumigatus
gggaagttcctcgagttcccattcggtttctttaggcttcgggagcgacgccaacttgctacgaatagcttgactgacggctttctggtgcaatctgatatctctcggtgtggtgccaatcaactgtccgccttccatctgattgagcgcgaactgatctctaggagtcctgagcggggttgcccctggcccgatcccaccatgtaa

SEQ ID NO: 20754 - DNA, 420 bp, A.fumigatus
tgctttagtatcgcacatatctttggcatggacgtcaataatctttccagtaattggaagaaacttcaggaaacgctgaaaaaacaaagcgcttcctcatcctcgaagaaacgcaagacatcggaccgcgagactcaaaatgttacgaccaagaaacagaaaatagagacaatagagcgcaaaaagtcctcattaaagaagaaaagaatgtccgaggggcaagagcatggaggggacgagagcgcacaggaacccatggtgaaaactatttcccacaaaagctctacagctacgatctccgagcaatcgcggactgagtccaagccaacaaaagttaacgagggccgttcacctacgttagtaattcctatccaatatatacaacctgcgtcatctgacccctcctcagtgcagaaatag

SEQ ID NO: 20755 - DNA, 264 bp, A.fumigatus
ctaagtcagtcaggaactccgcgatcgtatgataccacgggtgacagtggtaagctcaacaagcacttcttctgtggtgattgtggatcgagcctgtactcggagctggagatcatgagcgacaagacgggaatcaaggccggcacgctcgacggcggagaggcgcacctgcgcaacaaagtcgacgtcgagttctatgttaaagaccgtgtgcattatctgaatgctcttgacaatgtcagacaggaacctcgtcttgggtag

SEQ ID NO: 20756 - DNA, 690 bp, A.fumigatus
tattgtgaagaggatatattcgcctcgcaactcagggaaagcgagcgagaatgcaacgtgaagagcggtatggccgggaatcccgccgtcttatcaaccatccctctcgactaccacatctctatcatcaatcagctttttggccccggctccgccgctccgccggctgtccgcttgccgagctacctggttggtcttccggacagactgcacagtgatgatatcgagtatcttcgatgtagtggggcgcttgacctccccagcgagacgctccgcaacgagctactaaagagctacctgctttgggtccatccgcacatgcccattttagggctgcatgaatttctctcagctgtcgccggtgataacgaatctcatcggatcagtctgttgctatttcacgccgttctgtttgctgcatcagcttttgtcgatgagtgtcatatccgtgccgaaggatatccttcgcgcagtgttttccgtgagagtatatcctgcaaagtaaaggtacattttgcccctgccccgaccacggcggtccaaactcatttgtgcaggtgcttctcgatttcgaatgcgaagatgaccgactcgctactgctcaagcgcttctgttatgggtatctcatcctgagccacaccacgaccaaaaagaactcacccagcggttgggtatctgcatctctatga

SEQ ID NO: 20757 - DNA, 561 bp, A.fumigatus
cttgcgagaatgatctactaccttgttgaatgctgccatctttgcacaacatggatcttgcataccggctcttggcccaaggaacagacgttaacacgggtaaatgacctagggtggaccccattggtgcaggtggcgcaccatggacgagacgacatctttgatttggcggtgaaaaaaaagtctcgatgtcaatgcaaagattcttggggacggacagcactctcatttgcggctgagcatggcagcgaacataaagtacgttcattgctgaacaggaaggccgaccatcgtttcccccgttacaggacgcctttgacatatgctgccagaaaccatcatcttcaggtggtattgctccttcttagacacacagagggcgtggattttgctgatgaaagccttcgacccgcggtgacgtctgcggttgcctttagtgatgtagtgttcctggagttggtaattgagaagggcaaattgagcgactctatccgtacggtgagacgacacttcaacgcgcagcaagcatgggaatttgcccgtcgtaaagtggctgcttaa

SEQ ID NO: 20758 - DNA, 483 bp, A.fumigatus
gattctcgtcgagtagatgctgacttggaagcgaagaacacaatggacgagaccccccagcattgcgccgccatcaatggatctagatcagctgttcgcctgctcctcgagaaaggagtaaatgtcgagctgcacgacaagtcggcgcttgttcccttacttttagaggcctcaaagggccatacagcagttgtctgtcttctgttggagtacagtgccagtattgaccccaccaatgcagatggcgacacagcgttgatgattgccgtgcataatggccaccacgaaacgattctaagtcttttggcaaggtctgtcgcaatagactgcgtcaatcatgctcaccaaaccgctctgtcacgggccgcggaaaatgaccacgacaagattgtcgagatcttgctgcagtatggcacagaagtcgacttgccgaatcatacaggccaaaccccactaactttgagcgatacaaaaaagaaatga

SEQ ID NO: 20759 - DNA, 1281 bp, A.fumigatus
gagtatatcctgcaaagtaaaggtacattttgcccctgccccgaccacggcggtccaaactcatttgtgcaggtgcttctcgatttcgaatgcgaagatgaccgactcgctactgctcaagcgcttctgttatgggtatctcatcctgagccacaccacgaccaaaaagaactcacccagcggttgggtatctgcatctctatgatcagctcgagtcaaactcaaatagtcaaggcaaacgcaagaaaacaacaaatatggagacggacgtggtggtccatatacaatcatgtgcgaataacatcaagtaatcctcttaccttgaagcacgatccagaaaacggtgatctatgcgacacccctctgcccagtacgcacgatttcagatttggtgctttatcccccaacgtccaaacattggtagggaactgcgacttcctccgcgacgtgcagtatcagcagttcctagcgagattgttcattgagaaatccaagctctgtcaagtaggacaatttcctggaccatcaggagatttgtctgactcatccagtcgcgtggtaggacttgcaagtgcggagaacaaggcttgccctactgaaatcgcagagcttgcccggaggttgggcagatggcacacacagttgccaccggcgcttcgtcatcaatcaacgacctcaacggctgtcacagaactggaaaagttcattcttgtccatcgtgcctggctgctcttgctttatctcgcctcggcgtatgtcgtctgcacttgcagtgtggggaggaacagccacgcggaggaacacatcctaaacagaaccagcctcgtcttcgacgaactgcatcgcttgggcttcatcaatgtgcttcctaatcccagcgtcgctattctcatgcccgcagtggagtttcatatcacggctgtcgaatcggcttgccctcaaacgaacggagcgagtcaaagaatgctccagcaattctccgaaatcctgcatcagttgcaaggtagctctgctcttgctggtcgcatgatagagaaattgaacaatatcacggctactgaaactaaggacgacctgtccagagtaatcgcttcagaatccgccatagcagaacaatcggtttcgaatgctgattttgtcctagatgaaactgacgacttttacagtttcttggaatttggcatgtcctttgcaaacgttatcccgctggtagataacagtccaaatatcgggcttgatcctcctctatgtaacgagagctatttttcacaattgccgtga

SEQ ID NO: 20760 - DNA, 216 bp, A.fumigatus
agacagggcgaggaatggaaaagccttcgcaaacggttcaatcctgggtttgcgccgcagcatatattgaccttgcttccttgcatactggacaagacggtgccgtttttcgaaacgcttgatcgttatgccgagtctggcgaagagtttagcctagctgagacatgtaccaatctcacctttgatattattggtacagatctcactgtctcttaa

SEQ ID NO: 20761 - DNA, 1128 bp, A.fumigatus
aaattgtgctggtgctcacatagcggtacaggcgcagtgacaatggacgaggacttgggagcccagctccccctagataaacagagcgaaatggtcaggctctaccacgagctgactgcaagctatcaccaaaagagctcagtccgcgcaaaaccgtcgaaccccttggtgatatggcagcaatataaactggctcgcaaactcaatgccatcatcaaaaaccacatcaaacgcaaattcgcagaattgaaggaagccagcagtgacgaaaaaaaatctcgtagtgtcctcgccctcagtctacagggcatcgagaagttggatgcccatgtcctcgatcagacttgcgatcagctgaaaacttttctgtttgctggtcatgacacgactagcatcgttctgcagtgggcattttatgagcttagccgtacccctcgtgttcttgaatccatcagccgcgaactcgacgacgtctttggacctgatccttccccggcagtagttcgtgataagcttcttgcgccgaatggtggagaactcctcagcaagttgccgtatactaccgccgtgatcaaagagatactccgtgtatacccttcgtcgggaacggggagactggtgcccgagggatcggatgtgtatattcaactgccagatggaaggtcgctgtgcattgacggagtcctgatgtacaattgtgagacgctgattcatcgtgatgagactgtctatggggaatcgaaggatgattttttaccggagcgatggctcggtgactccggtgctgatcgcataccgtccagcgcatggcgaccattcgagcgaggaccgcgcagctgtattggccaagggcttgcgacaatagaggcccaagtcattctggcttgtgcggttagacagtatgaattcgcgaagattgggctcggtgaagtcgcgagggacaatgcaggggagccaattctcggtccgcaagggcagtacgaggttaagtcgaaattgttcaacgtgagtttgccagtctccttctgggacctttcaacagcattgacgtttaagctagacaatgcaagtgactgcaaagccggtagatggaatgataatgaaagtgaagttgtcctccggtggtag

SEQ ID NO: 20762 - DNA, 369 bp, A.fumigatus
cacaggcaatcgacgtcgatatcaacgatgaccgtatgtgttattttctgcaacctatattgccggactaacaccacagtagaatccatcaaaaacgctgccagcactgctgcttacggcgcgatgagttactaccatggcaatgagtccggacagatccctggtgcgtttccgaccaaatggtgggagggtagtgccctgttcatggcgatgctgcaataccagtactttaccggcgaccatacctacaacagcgacgtgagcttgggtttgcaatggcaagctggagacggagactacatgccttccaactacagtagctacttggtaagcacggtaccgaacaaactcaaagtgcgatgtgtctga

SEQ ID NO: 20763 - DNA, 372 bp, A.fumigatus
  unsure (363): Identity of nucleotide sequences at the above locations are unknown.
cgatccaagggaaacgacgatcaaatgttctggggtctagcagccatgctcgccgcagagttacaattccccgatcgctcggaaggttactcctggctttccctcgcgcaaggcgtctacaacacgcaggtcgatcggtgggatacgtcaacatgcggagggggcttacgctggcagatctatacgtaccaagcggggtatacaatgaagaacgccatatccaacgggggtttgttccagctagccgcccgtttggcgcgttacaccaacaaccacacatattacgaatgggcggagaaagtatgggactggagttgctcgtcgcctctgctcaatcttcaccacgggcatggaaggaccgcngattgcgtt

SEQ ID NO: 20764 - DNA, 471 bp, A.fumigatus
  unsure (322): Identity of nucleotide sequences at the above locations are unknown.
gactcagatgatgaggaagaagcctactttcccggagaattcgaaaacagaatttcccgcctcaagaccttgtcaaaagtgcaaaacgttgtcctacaatttgataagcgttgcggcgtgtctaggcatcattggattaccaaacctcctcaaacagtcgccttccgcaagaaggccctcagtgtcttgtttgaatggctgccttcactcgaggcaccattgcaatccttgggtattcagcatctgcaggatgtcaacatcaaagacgacgagctatctgagagaatcactaaagtgctgcggaatctgcgagctcttagcntaagcattgtgagcgagcacaatactgcgacaacagacgatcctcaaggactttgggaccgggacagattcagtctatttcctgagtcgcgatcgtttttttgcaaagcttccgtcagtgtggctgaaaccaaccacatcctctcttga

SEQ ID NO: 20765 - DNA, 327 bp, A.fumigatus
gacggcgggattcccggccataccgctcttcacgttgcattctcgctcgctttccctgagttgcgaggcgaatatatcctcttcacaatatcagtcatcctgattaataccctatatcttacggaaagtgacacaccgggacagtatgtgagcaacgagtttggctcttcggtgacgctacgagcactgcaacaatcagcaatgccatccatctatctggagtggttatggttactgagcatgactcacggtgtgctcccatgcgcgtcacagtccaatttggcccgacgacaggacgagcacgagcctccactgacgccaacataa

SEQ ID NO: 20766 - DNA, 186 bp, A.fumigatus
gatatcgtcaactttctcccatgtctctttaccttccgtgttgctcccgtgaaagtcaatggagctggtgtcacgttgcagccctttagctacgccattttgctcagttttttgccgatcctgttcaccagtcctcgattgagcgagattggccggctcaagcgtagggaatacagcgggaggtag

SEQ ID NO: 20767 - DNA, 249 bp, A.fumigatus
cgattcatattacagatcaccatccccgtttctgagaattatccgtggcacacgcagatccagcgcgatccattccattacaacactgctccaacctcaattgatccgcgactgatacttgatctgcgattctttggatatgtcatgcctgtctatgagaattatgtcgagttctcatctgaaatcactgaccttttcggcatgcctcaagtaaggccaccatttcaatttcccgtactgcgtgcatag

SEQ ID NO: 20768 - DNA, 417 bp, A.fumigatus
acttggtgcccatcacgcatagggatatcgaatactgaattttcgcctggcagcatgctaaacattgcctctgagcttggagattttatccctggtggcgagcccaaatttcttgctccaggcgcagcaacgcatatctgtgggaccacccgggcaggaaaggaagatgatggacactcggtggtggataaagactctaaggtttggcggctggaaaacttgttcattggaggctgcggtgtgattccgacgcaaaatgcgtgtaatccaacactgaccgcggcttgttttgccattgcgagtgcgagaaaagttgtcgaggagatacaagcgcttaaaggccagcagtatcaatcaaagcgtcttcaccacggggctggaaggatccgaagcgtgctcaaatcaaggggggttcta

SEQ ID NO: 20769 - DNA, 1146 bp, A.fumigatus
gtgactttcacattatctactcccgttaatgaaatctctcgtttcctaaataacttacaagagaggaagctatcacgacattccctttggaggcagactcttgttatctgcaatcccattgtcatttttctcaatcaggctcgaaaagactgttccgcaataatgactccggctcgttgcattgaggcttcgatgtcggagcaggagggttcgcattatgttcggactcatgaatacacatctggaagtgcaaagactcgtctgccaatatctgcaccttcattctatgatgatgataactcccttcaggaagtcattagccatacttcacatgatttccaggaaggggagttcgtttgcccgggattcttccagatggtaaacccggggaattttgtgcatcgagtcatggcgccagactgggactacatgatgcggagacaggcacaagcaatcctgccattcctctacttgggccctgtctcctgtttgaaagacaaagcctggctcgcccaagaggggttcaccttgctgctggcgatacgcaacaaacgctcagcacaggcgcgcctagtctctggtgaaaaagttggtgcggagctgggaatcgaagcagacgcggtcgatgtcatggacaaccaggaacttatctcggcatttccttatgctatacgccgcatcaacgaccatctcgtgtcgtgtgggcctgctgttcactccaacgcgccaaaaaagatctttgtcttctgtgagtctggcaacgagcgctcagccacggtagtcatcgcatatctgatggttatgctcaacttgaacatggcagtcgcgtcacatctcgtccagcttcgaagattctgtatctgcgttgaagaaccactgagagaactcctcgcgtccttccagtctatccttgacgccaaacgggatgtgtataaggccattcaagcgtctacgtcggactcgacttcaggaatccctcaagcgactgtgtctaggaaaagaaacattgctgatcgatttgatgagcctacaggttcaggtggtgatatgctgggactggagatggacatgaatatgaatattatggatgacggtgcaattgatagtagaaagcctcttgccccattccaagaccgttcagattga

SEQ ID NO: 20770 - DNA, 390 bp, A.fumigatus
  unsure (347): Identity of nucleotide sequences at the above locations are unknown.
gtcagtgatatcgagctccgttgcgctttgctgcgaacggtcttgcgcagtgcgaatcgtgatcatttactaactggactggctggtcaggaattacaagcagtccctcgagtattgcccgactggctcatccccgagacgaaagcccaccttgtccaagctggtcgtgcgctgagcgatcgtccagagcagtttgagcgcctcgaagatgaagacgactccccaggcttgaaagaacgcttcaactggtacatgaaaccctctgacaaatcaaattacaaagagattctatctgccaatcctaaccaccgtggcgagaattactgtttccacagctcattctcccncctaagcctattcgcaattaaccccccccccccccctccttaa

SEQ ID NO: 20771 - DNA, 1722 bp, A.fumigatus
tcaaccaccgaaccgccgataccaccgaaccgccgcttcgccgcgaatatcatcgaattcttggagccatctaatcaacacattatttctttaccactattattaaaaatgccactatccaaagagaatcgaatgcagatggccatatcagcatataaaaaggggcaattcaaatcaaaagcagccgctgctaaggtctttggggtgtctagagagacccttcgtgatcggcttcgcggaatcaaaccacgcgcagagacacgcgctaatagccataagttaacagctcttgaagaggaggcccttgctaagcgtctattagatgctgataggcgtggcttttcaattcgaccgcagttcctgcgtggaatggcacatattctactatgtgcacggacaaatgatccaacttcagtcattggagtcaactgggcatataagtttattaaacgccatccagcactgcgtacaaggtataatcggaggatctcataccagcgggcaaagcaggaagatccaaagattataaaacagtggtttgagcttgtgcatgccactattcaagagtatggtatccatgaaaatgatatctggaactttgatgaaactggcttcgcaatgggactctgtacaacctcaaaggttattactgcagtagatcgcagtgaaagacctcgtacagttatccagggaaaccgcgaatgggttacaatcattgaatgcgtgagctcgaagggaatttctataccaccagtggttatcttgaagggaaaagaacaccaggctccttggtatcaagaatcaaatcttcctccagattggaggcttaccaatagcaccaatggctggacgacagatgagataggccttaagtggttaaaggaggtctttaatcctttctctagcctacactcaactggtgcaaagcgattactcattcttgatggccattcaagccatcagaccgctgagtttgatgatttttgcaaagagaatgcaattatctgtctatgtatgcctccacatacatcccatcttcttcaacccctagatgttggggtttttgggccgcttaaacgctcatatggaaaactagtggaggggatgatggtggctgggaataaccacattgataaggaggattttctctacctctaccctcctgctcgtgaagcagtattaaaccagaggaatatatgcaatggctttaaaggatctggccttagacctttgaataaagatcaggtccttgagaagatcacctttcaactccgtacgccaacaccaccacctcttatagaaggatcaatctcatctgcttttcaaacacctcaaaaccctcgccagcttgatcacaaagttcgcagcttacagagaagcctgcagaagaggaagctttctagcagtccagtctctcatattcaacatcttgaaaaggctgcgcagatggcaatgagtatgaatcttcttcttcaacaggaaataaaggctctacgggctgagaatgagcggaaactgaagaagaaggtaaggaagcatgcttctctagggaatgacctctttttatctatccaggaaggtcgtgaccgcattcagcagcttaatgagcaggttgatgagcaggttgataagcctataccagagcctcgtcagcgtgctccaccacgctgcagtggctgctggactattggacatacaatacggaattgccctagcaaatag

SEQ ID NO: 20772 - DNA, 2172 bp, A.fumigatus
cacacgccatctattcgtgtgtccagaattgggctcaccatgcgactccgcgagagtatccggccacctgagcgcttcaactccgagctaatcattacaccatcaccaaagaagactttgcgcgaacccagaaacccgagaaaccctcgttttgtcgattacaatccgcacctacctcccgctgtattccctacgcttgagccggccaatctcgctcaatcgaggactggtgaacaggatcggcaaaaaactgagcaaaatggcgtagctaaagggctgcaacgtgacaccagctccattgactttcacgggagcaacacggaaggtaaagagacatgggagaaagttgacgatatctcaatcgatgagcttgaaaatatcatagcgagcaatggggaactcaatcctatctacgtcagaaacatgacaatcatggaagctgcagagacgtcgtcttcttctgatatggacatgtcagatagcgatcctgatgagccgttgacagacgtagatggccggcacgcagaggtatgcgtcttggcagagtatacgccctatttccgtgctgactcttcccaagtccatcaggttcattcaccatccagatggtctgacctttctctgagcttgcaagcagagatcgccatcaacctcagccaacactacggatggtccacagtctatagcaagcttgggttgggagaaaaggaacgcgaggagttacaggaactcatcagacgccgtgaccatcaagttgcgatggaatactcagcgctgcatgcgatgagggcaaagcaactcagagccctactcagaatcgataatagctcggggagtcgcaacaggacaccacacaagctgatctttcgcagaatttcccgcaaaaccgctcaaaggcttagaggcagcatggaaacagactatctgctgtgcgatgtcggagaacttgtgaacgccagacgatttttgcaaaggcgtgggatcgacagacattatgctggagaatggagtggcagtatcgtgacttggccgagggctgaagatggatctgatgccgagagaggggagagccagagagattcgattgtcacagggccagtgactccgttcggggttggttcgatcactgtaaacgaccatagacacgatttcgctgattctagtaggcctaatccggctactcctccccatcgcatcattcaaacaactgaacataatgaaggagctctggtacagtaccagaaaagagatctgcctcctcgcaaactttatcatcgtggagaacgtgatcgacgactgatcgtccgttttaaactcggccaaccacgagctaagtttttccaagcatggaagaagtctgctcatcctcgaagattgatacgatccgtaccacctctcgatgtcttttataaatcatcatcaagtcctggagaatttgacggaggtgctggcacaacatcaactttcgcttcaaattcaagtgattccgctttgaatattttcaagcagtcgccacgtaaagctattaacgaggattggaagcgaggcttactcgagctcgacgatacatctttgagttcctgttggaggaaattccagcaagagttacaacaggccacattcgaccccgacacaatcgagactgacacaatcgagactgacacaatcgagactgacacaatcgagactgacacaatcgagactgacacaatcgagactgtgggagtgttggactcgggtgtagacactgaccggcattcggagctttctgaggccataccatgcatcaatctcacagatgtccaccttccttcaaggctaacaacacccagtagagttatgtcacccatgagtgtcgattatatccagagtgatgaggatgacctcgcaccgttcagcggagcaagaacctcacgaacagaccctgtcttcgacagccctggaagtagctgctgggaaacatcttcggatggtgcagcggcatactcgcccacgacaccactgaccaccgtcaccaacactttcgaaatccttgaagacaataacagcgagaaaagtgacgatgactgggaagatgcagaagaggaggaggaggaggaggaggaggaagaggacgagatgattttggttccagccattggaccagtaagaagggcagctgctcagagatag

SEQ ID NO: 20773 - DNA, 315 bp, A.fumigatus
gatccggatttcgaagatatccaattgcaatatttccagttccggcgactccgtatctccgccatgtcaaacaagaagattgaacagtgggagattgagcggtactgggagatcttctcttcattggcaaatggccatccgcgtctaaatagctcccaagcggcttcggtgcttaggaacagccggcttagcgatgatcagcttgagaaagtatgggatttggcggatgttgacagtgatggagagctagacttcgaggagttttgtgttgctatgcgattagtctttgaccttgtcaatggggtaagtcagtga

SEQ ID NO: 20774 - DNA, 282 bp, A.fumigatus
aagcactctatatcaccttctcctttaactacttctattgaacctgcgaaagattggtcagagcgagctactcctcgagcacaaacaaggcaggatttcgaaaacattgacctcctgtctcagccgagcgttctcactgatgaaatctcggctcctaagcaacatacacctaaggactctaccttttgtgagccgagcattcttgtgcatcagaatatacctccagttcaaactacagggtctctaccatcttcaccacgggggtcgacggatccgcgctag

SEQ ID NO: 20775 - DNA, 240 bp, A.fumigatus
cctatctatactttgattgcagccaactttacaacctggtgtaagtatgaattatttgccactactttcaaccttggcctacgaatgagaatgctgccgtgcatcagctttaagcttctctatatcatgcacgtgactgctgttgacatcactatattcgggcgtttttggggttttgcattctatggataccgcaagggaggaagaggtagcaaagccccttgctcctattgcttgtag

SEQ ID NO: 20776 - DNA, 1395 bp, A.fumigatus
cgttcggtatgcgatccgctcagggatacgtgccatgggtactttagctcatcttctttcttcgatatggctctaattctcgtcttaatagcattggttttcttctctactggtgcatattatctaggatcattgaagcccgctagtctcccaacgtcgtcaaccaccaccctcttcgaaatcgagccgccgctccacaatatctcgccggcaaatttacaggccgcttgggcagacttcgttgagattcttggaaaggagaatgtatccacggaacatggtgacctcgatgtacattccggttctgattggtcgtcgtacactctcaaaaaagatgaaaggcctttccttgttctctatccatcaaccaccgaggaggtttcccgaattatgaaagtctgccatcaacgcgtcattcctgtgacaccctactccggtggtaccagtctggagggccattttgctcccacgagaggaggcgtgtgtatcgatttccgccgcatgaatcgcatcttggagctccacaaaaaggactttgatgttgtggtccagcctgcagttgggtgggaagaccttaatgaggaattgtctaaagatggcctcttttttccgcctgacccgggtcccggtgctatgattggcggtatggtcggcactggctgctcggggaccaatgcttacagatacggcacaatgcgagaatgggttctttctttgaccgttgtccttgcagatgggactgttatcaaaacaaggcaacgtccgcggaaatcgagcgccggctatgacctcaccaggctgttcattggaagcgaaggaactcttgggcttgtgacggaggctacattgaagctgactgtcaagcccaagagtcaaagtgttgctgttgctagtttcccctcaatccacaacgccgcagagtgtgtgacccgcgtggtggaagaaggtatcccagttgcgggggtggagatccttgatgacgtccaaatgaaatgcatcaacgatagtcggacaactcgtcgacagtggaaggagtcacctactctcttcttcaaattcacagggacccctgtgggggtcaaagaacaaattgagcttgttcggaaaatcgtctctagtagtgcagggcaatctttcgaattcgctcgaggggaagatgaaatgaaagaactttggagtgctcggaaagaggcgctctggagtgtgatgtccatgaggcgaggccccgaggaccgcgtttggacaactgatgtggcagtgccgatgagcaagctgcccgacataatcgaggcaacgaagcaggatatgacagaaagcggattgttagccggaatttgcggccatgttggggatggcaattttcacggtactacccctgcttttttccatcattaa

SEQ ID NO: 20777 - DNA, 363 bp, A.fumigatus
gtaaaagtacaaactaatatcttcccaatcttcttagcaattatcctgttcaatgaggatgaaaagaaaattgcggaaggtgttgtgcaccgaatggtcaagcgagcagttgaaatggaaggcacagtcactggcgaacacggggttggcctcatcaagcgggactatcttcagcatgaggttggggaaaccacggtggacactatgcggcgggtaagttatgagtctagctgtatgactgcttttgatcccgacgttgactctatgcagataaaaatggcgctggatccccttcgcttacttaattgcgacaaagttgttcgagtagaacaaccgacgacagtggaactaaagaagtggtga

SEQ ID NO: 20778 - DNA, 1809 bp, A.fumigatus
gaaggcgctggaggagattatggaatacatgcgaaatgtatatcaattctcacccaggtatgcacaaagtccagtgcgcttcgtctcccattcttgacaacgcaagattcgattacgtttctcattcacatttggctaagacatcgtaacagtaagcgcgcctttcagactcagtttaaacgatggggctttccttccaaacagaacccggcccacaaaaatgcagagcttgtcgctcgcatcaaacaactctgggagcggaatacaagccaacgggacatgctgcgtgtcttgaatgaagaaggctttgaaattaaagaaagagaattgatgcgagtacgtgcgaagaatcgctggctactccgtgttcccaatggaatgaagtcgcaagcagctatccgaccatctatgcagctaccagaagacgagggactactggcactccaacaggaagtttacaagtctacagaaccttactacgaccctcagaatgttcctgccgattcatcggtcatgcagcctccatcgcctagcttatcggttgatgtactcgcgaagcgtcaagagagacttgaacgcttgaaagcggagagtgctgaacgttgggcttccaggaagcggcgtcggcgcaccagggaatgggctgggctaccagccgacccgcctgggccacctcgctttccttctgagaccacaatcgatgagagtaagaaatacctgagcctagacaattctagttaccgtcaaataagagatcagtttcaaaggatatgtgaagaggcagggttcatcaagaaaactgttgctggacctgaaagatggcaggaagcaaaaaacagactaatacaagagtctgaacatcttcagcgggtattctgggaagatcccaatcggctggatgccaaatccctcgctcttgatgtcgtttgtacagatgtcactaaacggatgaggacattagaaaggcgaatgacaatcgcggaagctaaaaacgcccttgggatcaatcccgaagaaagccgccaaattcgaaacgcattttacaatacgctaaaagcggctcattttaccagcaagttggaggctggtgacgagcattggaagcaactgaaggaaatttggattcgagactctgagttgctgcaacgcatccttgcccctggctcggcggatccagagcatgctacaaaactgaaagctctcgaagtgctctgccgcgatgtaatgaagcgacttcgtgatgaccaaaccaaacgagatccctctcggaagaagtctattactcgcaccaatatctcaagtccagatgctcccggcacaaatgacaatagcacattcagcagcattactaatggaatcagcacgcttgcgtcgcaagctctcgccagcgccccgatgacgtcaggcgacttaagtgacatgcaaatagatccctcgcttctgcaagcggcaaatgatacctcgtttgcctcagcaactcatgatacggggaatccttttggatacgttgaccctattctagattcaacttcgctgcaagtgccgatctatgtgcgaatctatcctccagaccaggttcacgaggagactaagactatcgttgacaaactagcaacaaaatccgtcaccgagttacgccagctagttgtttcaaggtatcctggttctatcgttaccaagatacagggaatcgatcaggatgagcatggaaacgaagtcactttcaacatccatgacgataatgaactcgacgcttatttaacgcatgtacataggcggagagcatacattgtctgtcgcctagcttag

SEQ ID NO: 20779 - DNA, 303 bp, A.fumigatus
aaagcttcttcggtgagtatatatgatcctgacttcgcacgcagctatgcttatattctcctaataggtacaatcctgctgaaagagatcgggcaaaatctcaaatatgatgttttctgtcttccggctgtgggatttattgtgcctacatacccccaatatatccaattcgctctccctggccaacttgacagaacgaccgggttatgcccattgtgcaagacctttcccacagtgcagagccttgctagtcccgtttctgcggcagtaccgactttccatcatgcctctcgattaccatga

SEQ ID NO: 20780 - DNA, 228 bp, A.fumigatus
cagagcaggtccattgatgatcgccctgccaaacatggacttgagaccatggatatcttggactcttcactaacaattccttcacgcgaccagacggacgatgttgacactggcatctacgactcagaaagaccgcttacatctaaaatcactaaaccagagcagcgaatatctcacttcaaccagaccgaactcagggtgagcattatctatactcgaaagagttga

SEQ ID NO: 20781 - DNA, 201 bp, A.fumigatus
gggcatgactttggaccttcaatcaaggaaggacacaatgcttgggtgattattcggattgtcgatgtgactgagtatcacctctgggacaagatgtgtgaattgggaatccttcatgtatcagatgataaggagggattcttgaggatcgctcagttgggccgaagattggactggcaatgtagtatcatggcgaagtga

SEQ ID NO: 20782 - DNA, 951 bp, A.fumigatus
ctgtttcggatcggttgcattcaggtccactattgggagcatggttcaatcggccagtttgttgtgaaaggtcctatggtcttagggcatgagtcctccggagtcatcagcaaggtcggctcagctgtcacaggcttgaaagtgggagaccgtgttgccatggagccaggtattccatgccgtagatgcgaaccttgcaaggctgggaaatacaacctctgtgagaaaatggccttcgcagcgactccaccatatgatggcaccttagccaaattctatgtacttcccgaggacttctgctacaaacttcccgacaatatctccttacaagagggggctctcatggaacctctaggcgtcgctgttcacatcgtgaaacaagcaagcgtcactcccggccagtccgtgatcgttttcggagccgggcccgtcggacttttgtgctgtgccgtcgcaaaagctttcggcgccgctaaaatcattgctgtggacatacaaaaggcaagacttgactttgccaagaaatatgcggcaacatcaactttcgagcccgccaaagtaagcgcggtggacaacgcggaccgactgagaaaagagaacaacctgggtgttggtgcagatgtggttatcgacgcctcaggggctgaaccgtctgtccacactggaattcatgttctgcgccccggtggcacatacgtgcaaggtggcatgggccggagcgaaataatgtttccaattatggcggcctgcacgaaagagttggctatcaaaggtagctttcggtatgggagtggtgactataacctcgcggtcggcctggtcgcgtccggtaaagtcaatgtgaaggatcttatcaccggtgtggtcgaattccatgacgcggaacaggcattcaaggaagtcaaggccgggaaaggcattaaaacactcattgctggaatccaagattga

SEQ ID NO: 20783 - DNA, 2064 bp, A.fumigatus
cctctcaatccattggatctaggcctgaaaaactatatcgctagtgaagatctcagcatcgggacctctgcgggcctggtccgcagagtctttaagcgttcggttgagctgggacggcggtatgcaagatcacgtaatgatgatgagctccatgaggctcttcgtttgcttggtactggcctccattgcttggaagactatgcagcacattccaattacactgaactgagccttattgaattgggagaatcaacggtcttcccccacgtgggtcgtaacaccaaagtcaaagttgacggtgctcaggattacatctatcccattgtcactggcacttttggaggcgtggacttttttcactcagtactgggtgagctgtcggacaagacgattcaatcagaagtccagtctcttgaaggggtcatcaatgagtcgcaaagtggaactccgaccgagagcctcatacaggacttgctcaacaagatccccgagggactaattggaaacagcgatgatcaagccaacaaaatggacgagttcaaagccaagtctcaaaacgccaagcagcaaaatcaagagatcagtccccgtgagcctgaggagtggacgcgctacttggacaatgtgcatcagcagatttaccctgttcttgagtggcatgatgagcttatcaagtccatcaatcgcgccattgaagagattccagtcttgccggagctgattgaacagtttcaggagcagatcaacatctttgtcttttccattcttgcgccctatatacttcccatcatccggcaggtcaaggtcgagcttcaaaccggctcctccgaagtcattgaaagtagccgggcacagcagcacgttgtattcaatgatgatgattcctcaaaccccacccactcaatgctctctaaagatcatttctcgaacgtcctgaacgaaccggccggccagattgcctcccgagtagtcaagtggacagtacctcagctgatggagtgctgggatgacgaaaacattgatgtggacagggtactagaccgaatcatcaccggcgtcttccatcatccggctttacgtcaatatggcgaggatggagcatctgatatacgccaaatcatgttcgacactgtcgaggaatggtggggcaaaaaagatgaggcggaacgggagagtcttcgagaacagctctctcgtgagggtgttcgtgagggcaagaatcacaaagaaggagtgcatgattcaggacatggatgcggtaagcctttaacactccataaggctaaaactagcccaggggagagttataagccgagcacgagcggtcttggtaagattgcggctgaggctgcgggcggtggagccctcggaagcttagttggaggtcttgtgagtggggttggatcaattctactaagcgattccagctctcgtcggtctgataatgaaagacgcgagactgatttccaggaggatgggctccctggacaatctcgccgacagtatgggggccagagcggattcaaaacagaggctgacggcgaggttcgttattccggggaaagcaggtacgaaagggagtctcgacagggatggaatgaaggccgctcaagagacgatgatgatccgacatacgaaaacacctcgagctactcccgtggggaaggagagaatgatcatgagcgacgggaatggtcccaagattgccaaaggcatggtcctcgaggtggtcgacaaaattacgaggatgcgcacgcgaacctttatcgccgttcagacctcgaaagctacgagacttctgagagatatctttccgttgagaatcggagagttgtagagtacggtcgcgatcgaccagactatgacggtagtgaaagtctgtggtcccaaaagacacaggcgggttatgaacgtgcagacgatgataggatagactatacgaattccaggtacgattatgacagcgggcgttctacatatgacactgaacagactgggccctatgaacacagcagaccagagaggttagtgaaacatacgtcaggggactttggccgacgttga

SEQ ID NO: 20784 - DNA, 264 bp, A.fumigatus
gcgaaggggatccagcgccatttttatctgcatagagtcaacgtcgggatcaaaagcagtcatacagctagactcataacttacccgccgcatagtgtccaccgtggtttccccaacctcatgctgaagatagtcccgcttgatgaggccaaccccgtgttcgccagtgactgtgccttccatttcaactgctcgcttgaccattcggtgcacaacaccttccgcaattttcttttcatcctcattgaacaggataattgctaa

SEQ ID NO: 20785 - DNA, 258 bp, A.fumigatus
aacctgtcctttgtcctcgaaggtattcaccaggtcaaatttgaagatcgacctattccagaactaaaagaccctcacgatgtactggtgaacgtcaaattcactggtatctgtggcagtgatgtacgtatctgcgcattcagcctaaccctttatatccacctgccctgcggggccgttgatcaggctgactgtttcggatcggttgcattcaggtccactattgggagcatggttcaatcggccagtttgttgtga

SEQ ID NO: 20786 - DNA, 1722 bp, A.fumigatus
caggattcaggtaactacataatctcaggcggagatgagtcagtcatggtattgtggcagttagacaccggtcgcaagcagtttttacctcatctttcttcacctatttgcaatctagtcgtttctacaactgggaaagcttacatcgtgaagcttgctgacaactgtattatggtgctgtcagcgacagagctgcaaccttatgttactatcactggactgcaactttgccatcaagttaacaagcctgccgatgcagctatgccagagtcgcgtgtcgcacttcaaccccctgcagctgtattgcacccacaattccatgatcggcttcttgtggcggtaccagcttcgcgtcaatccgcacggaattatcattctacaacgagttcgtgcatgctacagacatacgatatccgcaccaactctcaaatttccagacaagctcttgcgcggaccaatgccacgactttgaggatcagtccagaggggaccgaaattgttacccccaacgtcagtcaccttggcatatgtcaggatggaaagtggatggcgacgatcgatgactggataccgcgccctgaagatatcagggctcttgactcgactagtgcttcgtcaggcagccatacacttcatcgggaaacatacctcaagttctggagatgggatgaagtgtccaatacgtgggagttaactacacgtattaacagccctcactccttcaacagcgtttcggtgcctattctcgacctcgcgtccagaccatacagtcatgagtttgcaacagtgggctgtgatgccgtgctccgcttctggtgcgcgagtaacaggccatgcctgggatcggcaacggaacgttcagaaaaccgatatcagacctggaaatgtcgaggtactatcgacctaaaatgcgcatttattggtggcggaactgagcccgcaaatgcagcttgtataggcttttccgaggacgggtcggtgcttgctgtttgcgtgcaaaccaggtccagtccggactacggcctcgtcatcctggtggatacgcaaaattgcagaattcatcacagtaggataggggtttactcgggtcgtccatgtgtatccaagttcttgggacgctatcttgttatcctatccctgcattcgacacatatttgggacacagttggcgacatagtcagaacgatcaattcatcaggcattcaggataacactccgtgtgacgatcaacttctggccgtgagctcaaagtcgcaaacctgtgcagttgcctcaagagtccctcgacatctggctggaacaagaaggtcgtccggatctctgttcgatatacgagtctatgatgtgcagaccttgtccctgcttactcgacagtctttgaagcattgtccggtatccctactttcagatccactcactggggattacatcgtcgttgatgccagggccaatgtcctacgcctcagttgttctgataaagctccccagtcagtaccgcaatccaaggacgggatctcttgcaattacgggcttgggggcttatttggaacacgttctcgcgccatgagtaggcatgataatcttcagcctcttccagtcaacggaagctcttcagccccgcagccatttgggctacccggggtctttactgatactcctccatttgtgttgcctcccactagtgttcttttcaaaaatctggtgcaaaatcttacaacttga

SEQ ID NO: 20787 - DNA, 966 bp, A.fumigatus
tccatttccatccccccttcttttctcctttgcttcgtacgcgcactctcacacactttctcttttttgtcttcccatccatacacagagagaatctattatcttatctgtttgtgggtagccatcaattgtcaaccattactacatcctcctctcatacctcaaaaattccccctcacacttcgaccaaaaggtagaaaaaatgtcatggcagctgccccgctagatagctctagcaccccgcccgacgctcctcaatccaccgattcgacgcgtccacacggcgacttcatggaagatctcgacccccaatgtacccggaaacgtccgcgtctcgacagtggaagcggtgccgttgagtcgttgtcgatagacgaagctgccatttctcgaatgtccgagtcgacgccggctgctcctgccacgcccggaacgacagatcacgacgtccctgtgtccgccgcccccgccagcagagtgaccatcaatgtgaaatctcccacctccgatactatggcgactgattccttaaaccctacctccgagcatcctggcgctggtccgcctaatgctaccccagccgctgattccccccaaatcgtctcaatatcgtcgacacctgaacagagtccggaaattgaggtggccgacttggaagatatggatcaggaccccaacacttcgacgtggagaaccctcggggaagctttgcaggaccctgtcacaccagaggtggtgcagctccaagaacagccgcctctgagtgctagctttcccaagctacgagacgccgatgacccacgggaaaatttggaggggatcagcgcaatcattgagaaaggtatgcaaagtgtatccaatattttgggtgcgtgtttgaagctgctcgggactaacggaacggggcctggcaggaaacgaccacgatgttggtgtcttcttggctgtgaagcactggttcgatga

SEQ ID NO: 20788 - DNA, 288 bp, A.fumigatus
ttgaaccaaatgctcagtttccgacccttactcaccccctcttctagcgaccttgccgagaagctcattgacaattacctttttcccaacctgtctgaggaatcagacaacctcatcgttccgcagattccagtcatgcacgctcagacccgccaagagctctatggcatcctcagtctactgtgcaaaaactctgacgattactgcaccgtacttgattgtgttaaagagctgatccctgcaggtacaactttcctgttcctagcaagtgcggcgtggctattttga

SEQ ID NO: 20789 - DNA, 696 bp, A.fumigatus
  unsure (627),(629): Identity of nucleotide sequences at the above locations are unknown.
cttgcgcccaggagtgacaaggaaaagaccatcgaaggagatctgttcaccgcattcgttgcggcaggcgccatctccaaagccaacgctgccgaccccaagaagtcatccttggtccgatgcgcgcgcacagacaagggtgtccatgcagcgggcaacgtcgtttcgctaaaactaataattgaagatccagacctcatcaagaagatcaacgagaagctttgcccccagatccgagtctgggacatccaggtcacgaataagggattcagctgctaccagatgtgcgactctcgtgtctacgagtacctgatcccaagttattgtttcctgccgccgcatcccagcacctaccttggcaggaagattgtcgagcttgcagagaaggatagagaccttgaagcttacagagcccgacaggaggaggtagctacttactgggaagacgtcgataatgagcgtatcaagccaattttggatacctttcctgaagatctccgcaaattagtggaaaaggctctatactttgacgaagagagggctccagaagacgaggatgctactcagaaaaaagaaccgcagcaaacatcctccaaaggcaaccctgcagattcggaacagaccgcncnagatctaaccacagatgcatcgtacgaagaagatgcgcgcaaaacgcgaatctccgaaggcggctag

SEQ ID NO: 20790 - DNA, 2172 bp, A.fumigatus
cattccacagtagcacaactgacgctgagttgtcggtatagggcctgtttgaaggaagtgccggacaacctaattttccacctcaagcgctttgactttgacatgatcacaatgatgcggagcaaaatcaatgatgaattccgctttcctgagcacattgatatgagtccattcaaagttgaatatctttctgaccagaactcaaatgtcccagaggacgtcttcaagctcgtcggggtcctggttcacagcggaacagcggagtcagggcactactactcatatattcgggagaggcccaacgctggaggaagaggctcttgggtggagttcaacgattcggacgtaagcaggttcgacccatccaagattgcagatcagtgttttggtggttataacgactcggtccaccctgccaacgtaaaccaagtgcgtttcaacaaggtctggaacgcttacatgctcttttaccaacgcatctccagtatggagtcggaaaaattgctatacaagccttccaaggccgaccatccagtgcatgtgtccttaccgattccgctatcaaaccacattgcgatggagaatgagatctttatacgaacttactgtcttatggacccttatcatgccttgtttgtccgacatctcctgtcccgacttcatgataacggaatcacgaacaagagacctaaactggatcaagacatggtcttcattgctttagataccctagaacaactgatcgcgagaaccagggagcctctgggtctcgatgtcctcgtctcagagcttgtgggagtgatcaatgagttgccaaaaggagctcacagagtgctcgagtgggtggtggagcgatcagcaggtattcgcaatctggtactgagaagtcctcatgcgtctgtccgagacagtacgatcaaggtcattatgcgcgctcttgaaaggcttcaagagctccgggacgaggcacatctcgatgaacgtgcgaaggagaaatggcacatgcgataccttgatggatttgagaatgtcgttgccactctggatgggctatggcccgttctccatactacaagccgttcatgggacgattactttacatttcttatttctcttgccaaattgggaagctatgagactgagatgatcttgaacagcgggtttcttctcaaatgcctggaaattgtgtggctcgatggagaagactcaaagaggttgaagcgtcaatatttgtcttactgcagactagtcgaaaagggcaggaaattttctcacaggagactcatggatcttttagcattccttttgacgaaggttgacctcaccgtggccccaacctcagatgatgagcggcgctccttaccgaatggcaagttttcacttacaattacagaaaatgtgttcgttcgttctcttggaagggatcgcgagctatcattgctgaagaaaattcttcatacaaatcataatcctcacgcttctatggctattgttgagcttttgctggactcagaacctgaagccggtctaatggatccgctatgcaaggttctggaagatggactcagggttgagcccgctgagctctgtgcaccgtttctggaggcgactttgattctttgccaaagaagccctgatgagaacagattcgttgcgctcattgactttgttgccaagggcattgagtcattcaacgatagtggcggtagagagcatctcgcattctttacaagcttactgacaagccgaaacgaacgccttggtcttgaaaaaaattggtttctggcgcagattgtggacaaaatacctgactgggccccaactctactcatctttcctgacaggacggtcaggaacaccactttggcgcttctacaccagatactcttcagcgtcgaagcagaagacatgggccctgattggcagtcacgtcatgccgagatcgtaaaggagctagtgcgcaacagtgtcgagaagctgagaaagactttcttgactgggtctgtcaacaatgtcgaagcaagggtgatcgagagtgtcaaagccgtcatagatcattgtttggttacgtacttcgatgacagcgaagaggaccaagagattgtccgtcaggcgcaaggtttgtttgctcccgattccctacctacattgccactttatcctggctcgtag

SEQ ID NO: 20791 - DNA, 597 bp, A.fumigatus
ccacagatgcatcgtacgaagaagatgcgcgcaaaacgcgaatctccgaaggcggctagaaagtcaagtccgccctacaccgaagccaaacgcgcataccggatccccgtcgcccgtctggaccgcctgcaagccacactagacaagtacgtcggcaccaacaatttctacaactacaccatccagaagacgtacaccgacccctccgccaaacggttcatcaagtccttcaaggtcgaccgcaacccgatcatcatcaatggcaccgagtggctcagcctcaaagtccacggccaaagcttcatgatgcaccagatccgcaagatggtcgccatggcgacaatgctcgtccgagccgggtgcgacccccagcgcatcgtggactcttacggacccacgaagatcgccatccccaaggcgccgggactgggactgctgctcgaacggcccatcttcgacgggtacaacaagagggcaaccaccacgctgggcaaggaacccatcgatttcagcaagtatcagaaggaaatcgacgagttcaagcagcgcgagatctatgatcggatcttccgcgaggaagagcaagcgaatgcgtaa

SEQ ID NO: 20792 - DNA, 2841 bp, A.fumigatus
cgattattcacccattataggcagcctctggagcctgacgatggccaaggaatctggtgttgtttggaggaatttcttatcaactttactttgcttggctttcgtctggtgcggttggatatactaaccttgaagcaactggagaagaacacagacatgcaggctgtggatcttatgtcaagggcgtacttgcaagcgttgggttggatattacaattacacggcattcccttctatcgcgccatggaacgcgcccacggttccgagattgttgatcttgtcgttcagctcaatagtcgagttgcgttccttccgatcggcacgatgcacctgctatctgagtatgctgcttgcctcctggctcttgtttctagaccccaatggtcgcaactctcctcgtccttggtgcacaccctcaccatcgtgcataacatcatggactccggagtcgaacaatggaagatccgcgaggaggaaagtatcgctgaatctgcgtctttcccttttttactgaagcaggtctatcaattcgctcgggatatcgatggacaatatcaggctcacatcgccaaaaaattgccctgggtcacaagcgatgcgagtgagtcgatccttcggtgcatctccggtatctatcttgccgtcagccgcgattcgagtttcacatcgcaggtcgccgaagacctcttgatcgaactccctgagcagagctcccaagatgagcgtgcctggataatttattatgcttggaggtttgccgtactacagaagcatatcaaggatggccgcatggaactgagagttcatggcatagaaaccatgcaagcggatctcgtcaacgtatggcggcaatatatccaacccaatcccacaggaaccgagcacccgcttgtccggttcctcgtcggcttcctgagggagaataagattgtcgattacattgtcggcgtcgattcacatcctcaactcattagtagaagtggaaatgttgtcggcttcctgatagtcacctctacttacggagacttagacacggatactgtctggaagacagtgacagagtcacaagatccccggacggtatccgaagtactcgggatgcttaccaggacattccacatgcattcaccattgtcctcagcattaatctacctgtgctccaagcttctggagctacctctatctaggtttgacgcacggatggtggagttctgtgagcaactgctctatcaggtccgtgaaaaacaaggcgagagaaatcggcacgacttgctggacgcatcccatgtggatgctgttcctctgcgtttatgtgtgcgcctcattcgagagagtgctgcatttgaagagttctcggtagagcacaaggctttcttgcagagatttgcgagctcgcagttgagctcattgataagtgtcgggttgagtgaaagtgataaaatggagacgtacgagcgctgcattcaggatatcgcggaaatgaaccagtttactgtcggcagcattcaagctttgaacgctctccttccggtgtacgatacgcaggagatacgcaagcttgccacagattttaatctttcggccctggtcattgccgaaatggttcacacagtggacttgaagcagacggactttgccgactccttttcgaagactggattcatatccaggattcaactacttgcacgcattattgacaaagtccctgattctgtcacggcggacctggctgatgtcctttgggaaaaggtgctcgtatcccaaacactggtggaacaaggccgccgagctgtgtgggacatgttgtgcgaacttatgagacgcagcccgaaacgcaatccattcattgagaggtgtatccaagagtaccttccaaagttgtctcctaatgactactctcccgagttgctcgcgttcgcaaagcaagcggtcaattacgaggtccgcttcaatccgccgccgatcgctaaagaggatgaggtcgtctcaattcctgggctggaccgtatctggaatttcattctcaccgctccacccggctcaatcgaaacggacgccataaattttgcgatcgaggtctaccttgatcactcggtgatcaatcgctctccgcgatcggccgttgaggcaactcatattgctttggtggatcgttgtgttgaacaactcaagtctgctgcggctcatttgaagccagccattggcagtgtcgccaatggtactgacgagtcaatggcaagcgacctcagcagaggtgaaagtcgagctgacgcactacgcttcagtcgttcactgctctttcttcgccagtttctccaggggctacggagtcggcctcaatatagcccgccgcaaaattcactccccaacttgcctgatcatccggtgaagggcgagctgattgaaattcggtatcagacgtttaacggaagttctcaaagtaaatttcgatcgttacgaattggagaccttgctacggcagctgagttagttgagaaactcgaacagctcacggggttctcgaagtttagtaccataacaggtggccggcggctggatcttttggaaaaacctaatctcacaatacgcgacctgaagatcggatctgggctgctcctaatccggaagaatgctgacagccgcgaggtggcctcgactggtagacgtccgtcacttactccggtagattctgaggtactcaagcattttgatgacctgtacgaccttctcaatcttcaggactaccttgctcgagaggtgagtttttttggtggggggggggccctcgcgtgtgtttcattgaagatctggttacttacttcggctaccacagatctatga

SEQ ID NO: 20793 - DNA, 699 bp, A.fumigatus
agagctgatccctgcaggtacaactttcctgttcctagcaagtgcggcgtggctattttgatactgatcaactgttgtgatctggcagattatacgtactcctccagctggtgttttgatcggcacaagatgattcgtgctcccgaaggctatgcaggacttaagaatctttccaacacctgctatctgaactcccttctaacgcaactgtttatgaacgttcagttccgcgatttcatgctgcaactccacctttcagatccggatacttcccagaggttactcgctgaaacgaagaagctctttgcttacatgcaagaaacgtggctcaggaacgttgaccctcaagggctggtaaataacattcgaacttatgataacgaaccaatcgatgtaacgattcagatggacgtcgacgaattctataacctgctttttgacagatgggaggcgcagatcactggtgccgaggacaaaaagaagtttcggtcgttctacggcggccaactggtccagcaaatcaagtcaaaggaatgccctcacatatccgagcgtctggagcctttctccgccattcaatgcgagattaagggcagggcgagtctcgaggagagtctacaggcctatgtcgaaggagagataatgcagggaggtaagggacttcgagagacaaagattgcagattggccgtcattctga

SEQ ID NO: 20794 - DNA, 288 bp, A.fumigatus
ctgtcatcgactaacctggcaagtcggcacatggtagacaagagagcgcgcaatgagcagcaaaacgaagccaaacggcgcaagcttgagaacggtgaagaagtttcggatcctatttatgcaacgcatttctcgccggaagatatcgaaaatgagcagcggcggccgaagaagaaggttgctgtattaatcggatacgctgggacgggctatcatggaatgcaattgtacgagccctggacacctatgggactttggactacgatattgacttgcgcccaggagtga

SEQ ID NO: 20795 - DNA, 267 bp, A.fumigatus
tccttccccttctctgagtcagacgctgacgaagtgaacaggttctcggtattcttcaaccacatcgatcacttcagtcaggagacattcctctacattacgtcgggcggtatggcagcttctaagctgcccgcgccacctactgatgcgacagagtcggaacagaaggaggccagtaagcgcaacccgaagtctcaacgcgaagcccttgctgctgtggaatccgagtcagatggcgagggtgtacaaggtgaggagggtggttga

SEQ ID NO: 20796 - DNA, 702 bp, A.fumigatus
aactgctcaagcagatcgactcggtcgagattccccccaacgacttcgagacggcatggcagcacaaggtcgacgtcatccgcaaccaacaaacacacccaaccagagccgccatcgtcgtcccctcgaaaaaacaagaagccgtccggggcaacctccagaccgatgcctccgcgctggaaatctccctcacctccaccgaggagaagagcgccgccgagcaagcagaagaagccgcgcgcaaggccgccctcgagaagcaaaacgctcttcccgtctggcacacccactcgaccgtttcaaccaccgccggcaacgtcagctacatcaagaccgagacagacgtcgccatcaaacctgaagtcaaggaggaagaagaccgcaaacccaagatcgaggacctggacgacaaggtcgccgcatactacgccgagatggaacgagagaaagccctgcaggcacaacgcgacgccagtagcgccgaggaggacgattcagatgacgaatttgacgaggaattcgaagacgtcggaggtatctccgctagcgacaccgcttctccagccgtcatgggcgggcctaccagtgcacctacctctgcgccagtcggcatcaagcgcgagttcgacacggattccgggacgagtgcgcctcagaccgccgtgggcacgcccaatacacccgccgacgagggaccggtag

SEQ ID NO: 20797 - DNA, 831 bp, A.fumigatus
aatacctcgatctaccactccccaagggtgagtatttcattcacttgtcttccaaccatccccctcccttatccgcgcgacaaacagatgctaactgcaggactaggcgagcgatcgtactttgctcttacgctggacaatggccttcattgtgtcaccactgcttggctggaactcgggaaaaccgctccgatcggacaagaattcgagctcattgtacaaaatgacctcgagttccagctgacactccaaatgaaagtcgacgatgctaaattcagggctcaggagcccgctgcccctgcttcccctgcgaaacagaaggcatccactttcagcagggtttttgcctcaccacgcaagcgcaaggaaatggagatgaaacagcaacttgcctctcagcaacaaaagaacaaggacgtaaacgctggcgtctgggataaactgcggacacttattgctcgtgacggcagctttggacgggcctacgttgcgctcagcgatcacgagaaatatgccttcggtcggccgtacactgtggatgtggcctgcttcaacgagtgggcggtcgacgagcaaccaagcagcgtgaaaagcaaaaagagcacgtctagtgcaacctctcaacgtcgtcctccatacaagattggcaaattggaactgcaactcttgttcgttcccaagcccaagggcggaaaggacgaggatatgccaaagagtatgaatgcatgcatccgcgagatgcgagaggcggaggctgcttcatcccgcacctgggaaggattcctttctcagcagggaggtgattgcccggtaagtgttccatccgactag

SEQ ID NO: 20798 - DNA, 369 bp, A.fumigatus
catgctgaaactgctcaagcagatcgactcggtcgagattccccccaacgacttcgagacggcatggcagcacaaggtcgacgtcatccgcaaccaacaaacacacccaaccagagccgccatcgtcgtcccctcgaaaaaacaagaagccgtccggggcaacctccagaccgatgcctccgcgctggaaatctccctcacctccaccgaggagaagagcgccgccgagcaagcagaagaagccgcgcgcaaggccgccctcgagaagcaaaacgctcttcccgtctggcacacccactcgaccgtttcaaccaccgccggcaacgtcagctacatcaagaccgagacagacgtcgccatcaaacctga

SEQ ID NO: 20799 - DNA, 276 bp, A.fumigatus
gtctgtacttatgtggtgcgatttcgacagtactggcgtcgccgcttcttcaaacttcaaggctcgaagctgacggcttaccatgaaaccacccgccaaccccgcgccacgatcaacctgtcgaaagctgctaagctgatcgacgacaggtcatctttgatccagaaagagacaaccactaaaggtggggggcgacgcaagtctgcgttcgctgaagatgaagaaggctacatgtttgtggaagaaaagcttccgtatccgctttggaaacggtga

SEQ ID NO: 20800 - DNA, 1152 bp, A.fumigatus
ttgacttttcccccgtgcagaagcacacgagccgagattcgagatgggtcaacccggcctgtcaaccgtgaatactactacatcccgttacacccggtcatcgacgcaatcaagttcaaggtctcgaaattaacctcgacaatcaaagctcagtacacgccaagcgaggaaaggaaggaatatgtatgcttgcgttgcggcgcagaatggacggagctggatgttctgagcctgtattcggacgagggcttcgagtgtcagaactgcggagccatccttgagcgaacggaggacgtcaagggagcagagggcatcgatcgcacgggacacgagaagaacagcaagctcatggcccagcttgataacatgctgaaactgctcaagcagatcgactcggtcgagattccccccaacgacttcgagacggcatggcagcacaaggtcgacgtcatccgcaaccaacaaacacacccaaccagagccgccatcgtcgtcccctcgaaaaaacaagaagccgtccggggcaacctccagaccgatgcctccgcgctggaaatctccctcacctccaccgaggagaagagcgccgccgagcaagcagaagaagccgcgcgcaaggccgccctcgagaagcaaaacgctcttcccgtctggcacacccactcgaccgtttcaaccaccgccggcaacgtcagctacatcaagaccgagacagacgtcgccatcaaacctgaagtcaaggaggaagaagaccgcaaacccaagatcgaggacctggacgacaaggtcgccgcatactacgccgagatggaacgagagaaagccctgcaggcacaacgcgacgccagtagcgccgaggaggacgattcagatgacgaatttgacgaggaattcgaagacgtcggaggtatctccgctagcgacaccgcttctccagccgtcatgggcgggcctaccagtgcacctacctctgcgccagtcggcatcaagcgcgagttcgacacggattccgggacgagtgcgcctcagaccgccgtgggcacgcccaatacacccgccgacgagggaccggtagcgaagaagatcaaaatggagcctgatgtgaaaaaggaggagtctgatgaggatgacgaagagtttgaggatgtctga

SEQ ID NO: 20801 - DNA, 360 bp, A.fumigatus
gaaccacctcctatgacagtcaaagcaggtcacgtgtccgcatctcaggcatgggacaagcattccttcaaccacttcgccgcatatcacacaaggaagcttgagaaacaaaggtcgatggggtttgcagtgctggcaggtaacagttacaggacccgtgttcaggtggttcctgccgttttcctcaacagcggtaggtgcgaagatagacatctgaagagcttgaccgcatttgatgcagtgccgctgaaggccaagtccctgaccttccctgtcaacgtctataagtctatcgtccttgtggctgcgactcgaaacgatcaatggcgcatctatgttgttgtggctcctttttcgtga

SEQ ID NO: 20802 - DNA, 402 bp, A.fumigatus
agaatattgtgttcaaatagcgagtttctaatgcgtataccaggtggcattttccgtctagagctctttctgccggaggattatcctatgaccccgccaaagatccgtttcctgaccaagatctaccatcccaacattgaccgccttgggcgcatttgcttggatgttttgaagagtacgtcgttctgttttcttaggatgagcgcacaagctaatagtatttcagacaattggtcccctgctctgcagatccgcacgattctcctctcaatccaggccttgcttggagctcctaaccccgatgacccgctcgccaatgatgttgcacagcgttggaaggaggatgagcaagctgcgatacaaactgcgaaggaatggacgagaattcatgcaatgacttag

SEQ ID NO: 20803 - DNA, 267 bp, A.fumigatus
cgaggccttctccgcaccgcaccacaattgtgtcggcctcacgaacagctcgccgcagcgaccgattcgactttaccacccaacgccaaccgacaaaacctcgtctcgaccggctgcgcatctccaacattcaagatgcgtacctacgacgattctttcagcggtcagaagatctaccctggaaaggtgcgttttgtcccttccggaatcatcaatcatccagcaatttccaccccgattctttacgagcgcgacaccgattcatga

SEQ ID NO: 20804 - DNA, 237 bp, A.fumigatus
tcacaggtcgccatctcgcttacggaacagcctagcgcgctttgcccacaagagtcgatcgaatcccacccgctccagagaagccctgaaagagttcaacctcagtcaacttaccatctcgatccgacaagctacacatcaccagcagccatgggtaaggttcacggatctctcgcccgtgcgggtaaggtcaagtctgcgactcctaaggtgagttcctcttgttcttcattataa

SEQ ID NO: 20805 - DNA, 831 bp, A.fumigatus
ttgaccatgagtccggaccctcacgctgctgatcgcaaagctcagaagcagcgtgaaaaaaagatgaacgccgagagactaaaataccaaaaacaacaaagcgaatatttccctctcactgacagtttcatcgtccccaagagtcgtgttgctcgcgctttggatacttgtgtcaggtatttgcagacaacatactgtgttgtatcttttccgactcatcattttgttgttagcggtatcaagaactcagggaagcagctcaaacttaggtctcgctccttcgagtctgagagcagattctcgtcttgcgacgttacgcatcccgcatctgatctccccacagtgccaaacctgaaggatctgcctgagaaggtgagaaagagaccagagaggtcatcgcaggtagtaaacaaggcaagtatttcgctgtctctgctctgttgcccaagaaactgcgggtcagtaaaactgactgtcaaacagaaggatcctgctaggacatcgccaaaggaaagttccttcacaaggaagtttagcagaacgatgactgatgactctgtcaagaaggtcagcagcatggacagaaagagctggcagactcagtcctcctccgcgggcagtggaggcaagactcgctctatccgctctgcttcggtcacggcgactggtacagatttgggtgaaggagatgccgcaacgcgtcttgaaggaggcctcaagaagctcacgatttccgagggcctgaagagagagggaaagcctgctgctatctctactgcgcagccaaaagtcatcaagtgcctcagatcccctggaggtaagaactattga

SEQ ID NO: 20806 - DNA, 501 bp, A.fumigatus
gagccgtggctatcctgtcagttggttcccgatagttatagacagctaacacagcgacagcttgaagtaatccgccacatcgtgaagaacatattccagggacagtcagacgaggataccaagactggaaaggctctgcagaatgccaaaaaatgggacacaaagaacacaaagtgcatcaagtgcttcggagactgcccagtttgcagcaaagcatgttgcatcttcgacgttgctcgccgcactgctgcccaggcagactccacccctgaacatgccgaagccgcaaaccagattcttaagttgatccagcgcctgggcaacagcgtcttggaggagaccacttactccctgtgcaccacacccggaggctgcggacggtatgtctgctccgactgctggggtatctgtccggtcgagctatgccacgatttccagtgcaaggtaagcaatatcatattcctcttctctccttgccaattgcccatgattgaatgctaa

SEQ ID NO: 20807 - DNA, 189 bp, A.fumigatus
tgtactctccgttttgttgactctacttcctctcctgctgaaaagcagcgcgatgttgtgggcatgatctggggaatttccggcttcaagctgctgacgcacactttggcatgtctgtcatctcacaattccgtcatgttgcttagaccttcctatatagaactatcggcccccaaaatgatcacttag

SEQ ID NO: 20808 - DNA, 324 bp, A.fumigatus
gcaattgctgacggggtctgttttcaccatgaacaggaagttgccaagaagcgcacccgccgtgtcgtcaagcaccagcgcgccatcgtcggtgcctcccttgatgtgatcaaggagcgccgcagcatgcgccccgaggctcgtgccgccgcccgccagcaggctatcaaggaggccaaggagaagaaggccgcttccgagagccgcaagaaggctgagaaggccaagaacgccgccaccgccgccaagggcactgctcagcgcatccagagcaagcagggtgctaagggttctgctcccaaggtcgccgccaagtctcgttaa

SEQ ID NO: 20809 - DNA, 984 bp, A.fumigatus
ttgcaaaggattgtagacatacctctcgtggaggagagtgttgattctgggctcgttagcctcgaggccttcgacaaggtgcttctcgaagctcttcatgccatcagagagaatgcgcacgctgtgcagcaggttgcggatcatcagaggcttgaagacgttcagttcgaactggccgttcatgccaccaacggtagcggcaacgtggttgcccataacctgggagcagatcatggtaagggactcgcactgcgtggggttgaccttgccaggcatgatagaagaaccgggctcgttctcaggcagaatcaactctccaagaccgcagcgaggtccagatccgaggtaacggatatcctgcgcgatcttgaagagggagcaagccagagtgttcagggagccggaggcctcaacgatggagtcgtgagcggcaagaacctcgaacttgttgggggcggtcttgaactcggtgccggtcagcttggtgacctcctcagcaataccctcagcgaaacccttgaaggtgttcagaccggttccgacggcggtaccaccctgggcaaggtagcggaggtgggggagggaagcctcaacgcgctcgatgttgcggtccaactgagcgacgtagccagagaactcctgaccgagagtcaggggggtggcgtcctgcagatgagtacgaccgattttgatgatcttgtcgaacttctcgactttcttctggagagcgttacgaaggctgcgcagggaagggagcagagtgttctcgagctccaggacggcggcgatatgcatggcagtggggaaagagtcattggaagaggcggacatgttgacgtggtcgttggggtggacaggcttcttggtgcccatggtaccgccaaggatctcaatggcacggttcgagataacctcgttggcgttcatgttggactgagtgcccgaaccggtttgccagacaaccagagggaaatggtccattag

SEQ ID NO: 20810 - DNA, 315 bp, A.fumigatus
cgagcccagaatcaacactctcctccacgagaggtatgtctacaatcctttgcaatcatcatttctgaagcgctaacctgccctagtttgatgcttgttacctgcctgaaccccgtcatcggctacgacatggcctccaaggtcgccaagaacgctcacaagaagggcatcacccttaaggagagtgcaatggagctcaaggctctgagcgaggaggagtttgataagcatattcgccccgagctgatgctgagccccaagggagaagaaatagaggtgatgaaaagctgtttggtggccggagctatgatttaa

SEQ ID NO: 20811 - DNA, 1065 bp, A.fumigatus
  unsure (38): Identity of nucleotide sequences at the above locations are unknown.
tccctaccctatgcccggttctcgcccctgtggagaanacctgaggtggctgagggcaagctaatggaccatttccctctggttgtctggcaaaccggttcgggcactcagtccaacatgaacgccaacgaggttatctcgaaccgtgccattgagatccttggcggtaccatgggcaccaagaagcctgtccaccccaacgaccacgtcaacatgtccgcctcttccaatgactctttccccactgccatgcatatcgccgccgtcctggagctcgagaacactctgctcccttccctgcgcagccttcgtaacgctctccagaagaaagtcgagaagttcgacaagatcatcaaaatcggtcgtactcatctgcaggacgccacccccctgactctcggtcaggagttctctggctacgtcgctcagttggaccgcaacatcgagcgcgttgaggcttccctcccccacctccgctaccttgcccagggtggtaccgccgtcggaaccggtctgaacaccttcaagggtttcgctgagggtattgctgaggaggtcaccaagctgaccggcaccgagttcaagaccgcccccaacaagttcgaggttcttgccgctcacgactccatcgttgaggcctccggctccctgaacactctggcttgctccctcttcaagatcgcgcaggatatccgttacctcggatctggacctcgctgcggtcttggagagttgattctgcctgagaacgagcccggttcttctatcatgcctggcaaggtcaaccccacgcagtgcgagtcccttaccatgatctgctcccaggttatgggcaaccacgttgccgctaccgttggtggcatgaacggccagttcgaactgaacgtcttcaagcctctgatgatccgcaacctgctgcacagcgtgcgcattctctctgatggcatgaagagcttcgagaagcaccttgtcgaaggcctcgaggctaacgagcccagaatcaacactctcctccacgagaggtatgtctacaatcctttgcaatcatcatttctgaagcgctaa

SEQ ID NO: 20812 - DNA, 3396 bp, A.fumigatus
tttctacttctagctcacgtccgaggtggacgcgagactgcacggtttaggaagcgctttggaacgaccaaccccttcggagttgcagcaataatcgacatgatggagcccaggcccttggcttcggccttcgaaagtcccacttttggggaagacagttcgtttcatgtggagcagcccgtcggatccatgtccatatctccatgtggaagagacgttgtgttggcttcgaaggaaggcctccatgttattgacttggattccccatattctcctcctcggtatcttcctcatcacacgccatgggaggtcgcagacgttcagtggtctccgttcgctgcgcgcgactattgggtggtgagcacttccaaccagaaggccttagtatggaatctggcgatgcagactggggagaattctatcgaacatgtcctgcatgctcatacacgagctatcacggatatcaatttctccgctcaccatcccgatcttctggcaacgtgtgcggtagacagttttgttcattgctgggatctgcgaaccccttccaaacctgccatctcattctccgactggtttgctggtgcaacgcaagtcaaatggaacagacaggacccaaacgttatcgccagttctcatgacaaatttcttcgaatatgggatacgagaatgggagcctacccgatcaaatccatcgaggctcatgatactaagatctacggggtggactggaacagagtcaggcctggagctttggtgacatgttcattggataaaacaataaaattttgggactacacggtagacgacgaagtacccgagaaggtcataaccactccatttccagtatggcgagcacgcaacaccccattcggatggggggtcttggcaatgccacagaggggcaacagcgaccttcatctatatagtcgcaggtcaagcgacggtactaatcttacagagaaccttccactagtgcacagttttccgggacataaaggccaagtgaaggaattcctttggagagcacgtggaggtgtggcggacggaatcgattacagggagtttcagcttgtatcgtggggcactgataaggaacttcgtctacaccgagtggatccagatatcttgcaacttgttggctacgagagagggaagtctttcgtttccaagttgaacgtcacacggcaaggcgctgtctataagactttccgcgacgcaaatggcgacgacggatatggcgaacacgattctattctatcacccaaccctaagcttgctggtggtaccggtatcaatacaatatctgttccttactcccggccatggactcaaggaggcaacgaagactctagagttggtatgcaaagaaggtcgaacttccgagctgatacaaaccctatatcctggatgcgtggtgtgaagatctcaggatgggatattgaaaccctgggtgatgagataacacatgttggagagaagttcaccaaggttgcttttgaatctgtggatattaggcaacggaaagcaacaatatcgctgcatgggccatggggtccggagggggattctctgtttctcaaagtggacatcaaattcccaagtgactatcccaagacttcaatgccgactttcggtgtgcagcggactgccgctgttactgaccagcttgctgataagctgataagcgagctgagaacaatcgcggaaacctatttgtctcataagagaggctgtctcgaaggcgttgtccgttaccttctaggggaaagcaccatagaggagagcatagctcacatactgggcgagacagccgagacaatcaagtctcctataaatggcgatttaggggacgacgaatccagcgatgaagatgaagtgggaatgtcccagagtcaagaactgggcatgagttctgagctacttcgcccggtcaataatgcgaatgtcatggttcccgtggccaaggcatgcggtgcgctctgggccaatgatggccgactagtatgtttctttcctagcaagaaggaaaagtcatcaaacttgattgagaatttgggactcaaagagatgtcgagactatcaagagcggataaagtctttgaaggttttggtcgtatccaaacaagctctcccggaccgaaaataagtggcacactggcgagcacggacgatggtacttcggaatattccgatgactctgatgctgagacttcaagttcatcaggttcatctgacatgttgtcgggcttgcaagcacgattcccaacatctcaaacatggcgcagcgctggaagtttgggtatctatcggcccaggtccaccgaccactcgcagcgatcaactgctggagcgctgactgcgaagtcgtccgattctgcccaaaatataatatctatacatgatttcagcgatctgttaccagcaaagcgtgaattggcccgaagatatcgcatctgtggcaaggtcaccgatgtatgtgctcataatgcctcggcggccctagatctgggctatcacgaactagctcggatctggggactggtcaagctgattttgcagcaccaaaatgattcattgtcttcgacgcgttcagagatgatgcaacgaccctcgggtatacagcggaaggatagtgcagtggacttgagcttcgatcagagtaatcaggagcaaagccgtaaggagtcagcaaacagcgccaatcaatggggagatcacccttatggtggccgttggttaataccgtctctgattgatcattttgaaaggattggtgatgtacagatgattgcaatgctctcctgcgttcttcaacagccaaaaagcgaagagatttcaaaggaagcaacccggaatagagatccggtatccagtgggatggggcaccaatcgtttcctatggatatctttcccactcaggcagccacccagaacaagtcgcaggcagtgacgccccttgcatccacaccgaaggaaggccatccgacaccgatcacccaaagctcggggcgatcatcttccgagttctggcgtgcggactctacgccgccatattcaactggtaccactccgccgttagcatctcgcgtaggtgcgttaaatgctgaacggaagactatgagccacaatatttcgatcgccgcttctcccgatcagcagtcccagccacgcagcgggtcaggatttggttccgctctggcctcttccttctcgcggtctttcacctttggcccttcgtcagcttcccccactgcagttccctcaggccagaaaaagcaaagtcctagtggcagtctgatcaccagtgcttttgctggcaagcctgcgacggcggttcccgactacctcgcaccgtcagctgcgcttacatctcaaacccactctgacatctag

SEQ ID NO: 20813 - DNA, 732 bp, A.fumigatus
atcccttgtttcgttcacccattaattccttggtacctgacttcccgagtccaaatcaaatccccatacaacaatagttctctaatcaacaccccacccgaaggcgcacaaagcacaacaaacccaccactacagaccaactcctcctcatctatactcaattgcaccgttaccgacaggatcaatcccaaaatgaccaacgcaaccattgctccgacgacgactgcagccccggtcaccaagtccgtcgacgctcccaccgcagatgagaacacccccctcttctccccctcgctcatctcccccgatgtccttgccgtccttcccgcagactacaccatccgcccgctgtgtcgctccgattacaagagaggctacctcgacgtcctccgtgtgctgacgactgtcggcgacatcaacgaggagcagtggaacagtcggtacgagtggattcgcgcccggagcgacgagtactacctgctcgttgtgtgcgacggggagggccgcatcgttggcacaggcagtctggtcgtcgagcggaagttcatccattcgctagggatggtggggcatattgaggatattgctgttgagaagggacagcaggggaagaagctgggactgaggattattcaggctttggattacgtggctgagaaggtgggatgttataaggtatgttctgtcttctgtcttctttttggggcctgtcgggttggcgattggggctga

SEQ ID NO: 20814 - DNA, 3555 bp, A.fumigatus
gttgtggtgacagctacagccgaacgcccacattcgcactatctcacccttgttctattcgcattcaagaaaaaacacgggctgaacgtcatgaaagatatttgcgatgtcttcatgcgagaggtcagggctctcacgcctcctgagtctgtttccgagtctgagcatgatgtttccgcacgacttacatctgcttatggaggcatcaagatcattctctctttcttcgcggagttagcctcgggtaaaaacattgttgattccagccagacacaggccattactactggtgaccgggatcgagatcggccagactattttcaacccggccaatttctggtcgatctccggatggaaatattgccaatggctcgagaattgtggaattccgactttgcaactcagtcgtcaagctctgtggtcaaatgtctagtcgacatccttcgttcatcactggacggtgaatatgagactggagctgctcgtcgctccgacactccacctctcctagcagaagcgacaaggaagacggttgtagtcaacaaagatcgcgtcactcatttacatggagaaaaaggattcgacaaagatttggctactgaagctctttatcgctgcaacaacgtataccttgcagctgaagagtactgcaaggcacagaagcggttgcgagctccaccgagagtcccaccaaacccggaagatattgattctgctggtggcgagacgtcagaagataccgctcttggtgacgcaccgcccttcaatagcggattcctggaacgttccactcttgccatgcttcttgctcaggcatccggacggtcaagtgatgacgcttctcgccagcagcaagaccaggacagacccgataatgaacttggtagtgggactgagtttctggccagagcgttaactcaaatcctcaatgatgagcaaagcgtggctggcgaggatcgtgatatgtcctcacatagaaatgttcgcaacgccgatccctcaggaaactcatctgagagttcaaaccaggcaggctcagggcaaactacaggacagtcctcaagacggcgtgagctcactacggttgaagacttggacggagaacgtgaaaaggttcgctcaaatctgattgagcgttgcttggatgttctgaatgagcatcatgacgtgtccttcgagttatcagacctcatcgcgtccgcgacaaagaagcacagtgaccccgagagcttccgcagagaggtcggtgagatccttgttcagtctttggtctcgttgcagatggaaaacttccaagttgctggtaaaaaggtagcagcttatgcccacttacttgcgttggttttgcaagacaaagacatgtatactgctacactggacgaactaaaggaatgtttcacaaccttccttgggttcatcaaagtttctccagaaaagtcagcggacgagtttttcccttggattgggcatgtgttgcttatcctggagaagctgctttcggatgatgcgcagccgcctcaaatccgttggaatctgcccgacagcgacagctcaactcctgatgacgcaggaccggcgcagcttgaggagcctctggtttccctggatcagaagactcaactttatgaagctatagtcgaaattttacctaggattgggaaggatgacactctagctctttctgtgtgtcgaattctcgtcattctcactcggagtcgcagcatagctgtcagacttggggagaagcgaagtttgcagcgcctcttcgttatggttaagcaactgtcgagttccacgaacgaaaaacttcagagcgcttttatgttgatcctgcgacatatcgtcgaggacgaagacaccattcgtcagatcatgaggagcgagattgtggccaatttcgagtcaaaatcatctcgtcagatcgataccaccggttacgttcgacagatgtaccatctggtcttgaggtcgccggaacttttcgtcgaagtatccaatgagaagctgaagttacagcggtacgataaccgtcaacgcccgcagattcttaccttgaagtcagacaagactagcagcgcaccgggatcctcatcggctcgagaaggtgccgaaggcatgagcactggcaataataacgtctcaaatggtgcaccttcgttggatgacaaagaaaaatctaaagctgcggatttgaagccacctgtggtagagaaccctgacggcgttatccactatctactgtccgagctcttgtcctacaaggatgtcgaagacaaggaaccaccagctgaagctggggatgcagctgtaaacgatcaatcagaaactcagaccgatatagaaatggcgaccgatgaacccaccccgtccgtttccagcgccgaactggcgggtgcccgtacctccaaaaaacaggaaaagcctccatttaaggcggatgagcaccctatttacatttaccggtgtttcctcctgcaatgcctgaccgaactgctgtcttcctataatcgcacaaaagtcgagttcataaatttttcgcgcaaggctgatccccttgcaacgacgccgtcgaaaccccgctcaggcattctgaattacctgctgaatgttctcgtgcctgtgggcactatggagcatgacgaatcaattgccttcaaaaagcgaagtaacacttctgcttggactatgagggtactcgtcgctctgtgcaccaaaaccggagagtttggaggcacaggaagacgtcgcaacgatcagactgcgaatgaggaagatgaacccgagctcgctttcgtgagacgctttgttttggagcacgccctacggacatacaaggaagcaaatgcatctaacgaacagctggatgtgaaatattccaggctaatgtctcttgcggacctgttcgacaaaatgcttagcgggtatgccttcgtttcaggtgacacgactttcccgtcgtccaccaggcagctcgcgaagaccatgtacgaaaagcatttcattgccgctttgaccgcctcgattgctgagattgacctcaacttcccggcatccaagcgggtcattaagtatatcctgcgtccactaaacaagcttacacaaactgctgtcatcctaagtgaatcatcggatatctcttcacttggagataccgaggaagacgaaatttcgtcggccacgtctgtctctgatcttgatgatgacagagaagagactcctgatcttttccgccattctaccttgggaatgttggagcctcaccatgaggaggagaccagctctgaagagtcagaggaggaggaagacgacgagatgtatgatgacgagtacggtgacgagatggattatgatgaagacatgcctgaagatgacggcgaggtgattagcgacgaggaggacgagatcgagggtgtcggacctatcgaaggccttccgggtgactccggcatggatattgaagtcgtaattgacgacgaagacgacgaagacgatgaagaagacgacgaggaagatgacgagtccgatttggacgacgatgagatccccgctgggtga

SEQ ID NO: 20815 - DNA, 3966 bp, A.fumigatus
cattgtaattcaatagaagaagacctaatcgatccgtggggttgggatggcgacgagcctccattgcaccgtggacatcaccagcgattccgcggtcctcagccgacctgggctgccgttaccggaatggtgcccaatcgccacggcatagttccaattcagccctaccgattccaccgtacacaaatcccagctcgtggtaccgacgacggcacgaatcctcttcttgttcgaaccgaccgaagtgcagaaactgcacagcctcgcttgcccggcaatgaagctttcaccgattgggttcatggcatggaacctgtctctaccggacgccttgttcccatggacagcccggtaagcttcatgaacgcaatcatgcaggcaatttccggacaagcgactccgggcttcggcgtgataactcgtccagacgggatacatgtccacgtcgataggcgggctattctgccaaatcgtagtattcaagacatcttcggcctcggcagaccacaggctcctccgtctcgaactcgcgacgatccttctcaagccgtaagcttcgctttggccaccaccagaagtcgctggcaagaggaggctcgcattctgttcagcagcacttacgtcgagaagacacagcgtgtcgtaaattctctgctgaagatccttgttccacccgcaattgaggaagagaagcaacgtgaaaaacagatggaagaggagcgcaagcgacgagaggaagagcgggccgagcgtgaacgtcaagaacgcatcgctagagaggaagaggaaaaggaacgtaaacgcaaggaggaggaagaaaacgctcgacgtcagcaagagatggagcagcaagaggcagaacgtcaagccgcagggatcgtctccgagccaatggacgacgttcaagaaacagctatcgaagaggccgcggaaccatcaacccaggctgaagttggcccgtccgagcctgttcgtcgagtgcacactacaatccgcggccgtcagcttgatattactggcatggaaatagaccccgagtatctcgaggcactgcctgaagaacttcgagaagaggttatcatgcaacaactcgcggaacagcgttctcaggctgccgcagctggcgaagagcccagcgaaattaaccaggagttcttggaagcgttgcctccggacattcgcgaagaacttttgcagcaagaagcagccgaccgtcgccgccgagagcgcgagagcgcacgcaggcaagcggcggttgccaatgccccagctcacgccgaaaatatggacgctgccagcttccttgccaccctggatccttccttgcgacaagctgtacttgcggaccagcccgaggaaatccttgctactctaggtccggaatttgttactgaggcacgcgctttgccaggaagacgattggctcaatttggcgatatcacccgagctgatcatcgtcctagaaatgaaccagctgaggatcaagagaccaagaagccacaacgacgccagattgtccaaatgctcgataaagctggcgttgctactttgctccgtctgatgttcatgcctcttcaaggaaatgcgcgtcatcagttgaacgacatccttcacaacgtgtgcgaaaatcgtcaaaatcgcagtgaggtcatcagccttcttctgtctatcctccaagatgggagtgtagacgtcccagcgattgaacgcagtttcgctcatctttcgctgcgtgcaaagccttcttcggtgcaaaaaactcctcagtccgtcaagcgtaatatggctttccacacttcatcgagtgtcagcagcgaagttactccaattatggttgtgcagcagtgcctgggcactctttctttcttatcccagtataatccccacattgcgtggttcttccttacggagcatgatcctacttccacgttgaaactgaagacatcccgcaaaggcaaaggcaaggaaatcaaggcaaacaaatttgccctgaatgctcttctcaatttacttgaccgcagcttgatcatggagaacccgaactgcatggaacagctttctagtctactgaatagcattacgcaaccactgaccttacttcttcgtcgtgagaaggaaaaacaagaggaggaagaagaagaagaagacaaaggcaaaaaaccggagcaggcgcaggtggtcgaaccaagcgctgaccaggagcatgcagtacaaccaagcgaatctacggaaccggcagctggcaccgacacaaccatgactgatgcacccgccgctacttttgaggatgcagagcagcaagttgctcagacagtagcacaagaagatgctgcgccggtcgaggcagacaagcccgaggcaacaaaggagacggtggaagatgaaaagccgaagagaaagactattgaacctcctgttgttcccgatcaaaatctccgcttggttgtccacattttggctgctcgagagtgcaacgggaagactttcagagaaacgctgtcgactatcaacaatctttcagctattccgggcgctagggacgtcattggcaacgaacttgtcaaccaggctctgagtctctgcaccacgattttgactgatttggacgaacttctatctcatatccaccaagcaagaacaggcacggacatgcagggcttggctctggtgaagttttcaccagccagttcggaccaagccaaattgttgcgtgtcttgacggcactcgactatctgttcgatcccaaccgtgcggataagattaaggcgcctgaacctgactctacggctaaagaagatgtcctgcaaacattgtacgagagctcgactttcgggcctctgtggactaagctcagtgaatgcctgactgtcatccgtcaaaaggaaaatatgctgaacgtggctaccatcctcttacctttgattgaggcgttgatggttgtgtgcaagaacacgacattgaaagacacctccatcgctcgcaacagccgagaactgtctgtgtctaccacttcggcagacgccggcttgaatatggaaggcttgtttttcagattcacggaagatcatcgcaagattttgaacgaacttgttcgtcagaatcctagactgatgagtgggagcttttctctattggtcaaaaatcccaaggttctggagttcgacaacaagcgtaattattttactcgcaagcttcattctcgtggtgctgagcctcgccaccctcatccgcctcttcaactttctgtcaggagagaccaagtcttccttgattctttcaagtctctgtactttaagacggcagatgaactgaagtacggcaagttgaacgtgcgcttccatggtgaggaaggcgtcgatgccggaggtgtgaccagagaatggttccaggttcttgctcgtggcatgttcaatcccaactatgccttgttcatccccgttgctgctgatcgtaccaccttccatccaaatcgcctgagtggtgtcaactcggagcacctgatgtttttcaagttcattgggcgcattattggcaaagctttatacgaagggcgcgttctcgactgccatttcagccgagcggtctacaagtgcattctcggccgttcagtctccatcaaggacatggaaacgcttgaccttgattattacaagtctttgctctggatgctagagaacgatattaccgacatcatcactgagacttttgccgtcgaaactgatgactttggtgagaagcaggtcattgatcttatagaaaatggccgcaacatcccggtaactcaggagaataaggaggaatacgttcaacgtgtggtagattaccgtttggtcaaatctgtgaaggatcagcttgacaatttccttaaaggtatgtcgctttcccttctttcctcttttctcaattcgatcatgacaacaaatgctcattatctttataggcttccacgacatcattcctcctga

SEQ ID NO: 20816 - DNA, 405 bp, A.fumigatus
attaatttgctccttttgctccctgcagtgttcatcttgcagtccacgaaaccgaacgatatcaatgacggattaatggagcttcttatcatgatcaacgcctgcaagactgcctcggcccgccgcatcacggctgtcattcccaacttcccctacgcccgtcaagataagaaagacaagagccgtgcgccgatcaccgcgaaattgatggcgaacatgctccaaaccgctggttgcaaccatgtcatcacaatggatcttcacgccagtcagattcagggcttctttaatgtccctgtagataacttgtatgccgagcctagcatgttgaagtggatccgggaacacttggatgtgaagaattgcgtcatcgtcagtcccgatgccggtggtgcgaagcggtaa

SEQ ID NO: 20817 - DNA, 441 bp, A.fumigatus
ctgtgtctttatagtgctacggggattgcggaccgccttgacctgcaattcgctctcattcacaaggaacgccctcgtcctaacgaggtctcgcgcatggttctcgttggaaacgtcaaggacaagattgcgatcatcgttgacgacatggctgatacatgtggtactctcgtcaaggccgctgacactgtcatgcagcacggtgccaaggaagtcaacgccattgtcgtacacggcattctctccggcaatgctattgagaacatcaacaacagttgcttaaaacgtctcgtcgtgactaacacagtgccccacaaggagaagaaggagctttgtgacaagattgacaccattgatatcagccctacgttggcggaggcttgcaggcgcacacacaatggtgaatctgtcagtttcctgttttcgcacgctgtcgcgtag

SEQ ID NO: 20818 - DNA, 1527 bp, A.fumigatus
ttcccgcatgcggatgctccaggcccgtggcgaatacagcacgtaaagtgtctaaaagatgaccacaatctcgtccggtcattgggcaccaccttcgacgagctggtgaggcatcatccagcactgaaggcgtcgatcatgaccgctatcattgtgatggtagcacgcgtcggtctgttatgcaagagcaaggcttgggcacatggcatgggaacgaagatgtgggtggaaggtcctcaaggaaaacctcagatttctggcaattacgatgtgctggccctcgagatcggtgccgcaatggacgcatccctggatgattttcgaaaccttggagtgcgagaattgacttccgccacccttcctaacggtggaaaactcaacctaggggatctgactcaacttctcccatcttccccggaatatgcagagcctcaggacgtggatgcggctggcctcacggttactgattacgtctaccctgttgtacgattcctcggcgctttctttgagaaccaagccaattgctcgtctttcatcgaatccggggctgttgaattcgttttggatttcgcaaccctgcagagtcttccattcgactttcacaattcagatgcaaaccaggagcttacggtactggtgcacatgttggcggaaaccaaaccgcacctggtcttgccatcccttgtcacacgagcggagactgctgtcaacagtctttcgggcttctggtctgaaccgaaggattcaggtttctttacacctctcattaaaccagccaccgaaaagtcatccgaggagaaaggcaaggagaccttggacatcgcgaagaccaatggaacctactttgcaaagcatatggctgccactcttgttctcacagatctgcttcgtgaaatcttctccatgcccttgtatcagacccgccctagccaacacacttctgcttttgctcaagtcaacctagccgatcgatactgcgtcctcgtctccgctttgggaagtttgcatgctgcttgcgtttgggaagaaattcttctcgagaagaatattcctgccacttgggaccaggctacaaaagcacaagcagttagctcggacaaggccaacgaaggggccaaacctcctactgcggaaggtagcactgctgaatctgcgccagaaggctcagcaaaccgtggacccgaactgcaaggctctgtgcagcagtccaatgataccaccaagataccagagggtggcgcagctttcaagaatgtgcaggcacttcgctatctccttagctccctgccttcttcgattaccggtttcttccacaatttggggctcggtctgataggaaagcggcgggtagactcataccagagacagaatgcggccttggtagcggacgccattgccgaggctgtgcttaaacaattacagtttagtcctccgaactcaagcgacaatcccaagcacagattcgcttaccttattgtcatcctttcgtcgttttcgcatctgctttatgaaggtaagttgctctaa

SEQ ID NO: 20819 - DNA, 393 bp, A.fumigatus
caacaaatgctcattatctttataggcttccacgacatcattcctcctgatctaatttccatcttcaacgaacaagagcttgaacttcttatctccggtctccccgagattgacgtggacgactggaaagccaataccgagtaccataattattctgcctcgtcaccgcaaatccagtggttctggcgtgctgtccgctcgtttgacaaggaggagcgtgccaaactcttgcagtttgttacagggacaagcaaagtgccgctcaacggtttcaaggagcttgaaggcatgaacggggtcagcaagttcaatattcatcgcgactatggcaacaaggatcgtcttccaagctcgcacacatgcttcaaccgtaagtcttcgctacgagattga

SEQ ID NO: 20820 - DNA, 189 bp, A.fumigatus
agtccctccaaggcttttctgcataacgagattttgttcttgttttggtctcaggataaaatcagtgctcgtcatcaagaccccttcaaagatatatacatgatcttatctccccttatctcctcttatctgggccttatcggccgctattatcaggcgaatggcgtagctctcatatattctttctga

SEQ ID NO: 20821 - DNA, 912 bp, A.fumigatus
tggttccgcggcctcttcgatagctgtttcttgaacgtcgtccattggctcggagacgatccctgcggcttgacgttctgcctcttgctgctccatctcttgctgacgtcgagcgttttcttcctcctccttgcgtttacgttccttttcctcttcctctctagcgatgcgttcttgacgttcacgctcggcccgctcttcctctcgtcgcttgcgctcctcttccatctgtttttcacgttgcttctcttcctcaattgcgggtggaacaaggatcttcagcagagaatttacgacacgctgtgtcttctcgacgtaagtgctgctgaacagaatgcgagcctcctcttgccagcgacttctggtggtggccaaagcgaagcttacggcttgagaaggatcgtcgcgagttcgagacggaggagcctgtggtctgccgaggccgaagatgtcttgaatactacgatttggcagaatagcccgcctatcgacgtggacatgtatcccgtctggacgagttatcacgccgaagcccggagtcgcttgtccggaaattgcctgcatgattgcgttcatgaagcttaccgggctgtccatgggaacaaggcgtccggtagagacaggttccatgccatgaacccaatcggtgaaagcttcattgccgggcaagcgaggctgtgcagtttctgcacttcggtcggttcgaacaagaagaggattcgtgccgtcgtcggtaccacgagctgggatttgtgtacggtggaatcggtagggctgaattggaactatgccgtggcgattgggcaccattccggtaacggcagcccaggtcggctgaggaccgcggaatcgctggtgatgtccacggtgcaatggaggctcgtcgccatcccaaccccacggatcgattag

SEQ ID NO: 20822 - DNA, 231 bp, A.fumigatus
ctcgaaattggccacaatctcgctcctcatgatctgacgaatggtgtcttcgtcctcgacgatatgtcgcaggatcaacataaaagcgctctgaagtttttcgttcgtggaactcgacagttgcttaaccataacgaagaggcgctgcaaacttcgcttctccccaagtctgacagctatgctgcgactccgagtgagaatgacgagaattcgacacacagaaagagctag

SEQ ID NO: 20823 - DNA, 333 bp, A.fumigatus
ttttctaagcgatgctgggcaattaaagtcatcgtaccatcatcgaagccttggtatgacccttcgtcctcatcaatgccctctaattcctcctcaagctcatcaatttcgtcatcctctggaatgctgtcagcaatttgcacaattcctatggcgaccagatcactgaccatcgtcatcattcagatcatcatcgaccatatcatcatgagcatcgccgagactatcgccctgaagatcctcgacacctcccgcggcttcattcaagacacggaacaagtcgtcaaaacgctggttatcaccgcgacgatctgcttgccgaatgtcggctag

SEQ ID NO: 20824 - DNA, 288 bp, A.fumigatus
cacggccatggtagcggtgacacccatgatgaccatcttcaagacttggacgaccttagtgaaggacaaatctccgctttgtaccgcaccttctttggtcaacacggtgatcgacgcaagcgaagcaagagaacaggctacattcacaagcggatcgccgaatctttgcttcgtccatcctatgaaacccaagccacctccgcagaacactgtcaggacaacggcatggccaaccgcgcgcatacccagcgtatcctggaagaacatgctaacacacatgctcgttag

SEQ ID NO: 20825 - DNA, 300 bp, A.fumigatus
cacccaacttgccacgccatggtcggggagatcccttgtgaggttccctatgatcgcacatataaaattgttgtgaaggtgttcggtcttctggtcggcgcaaattatgtgatcaacgcgcgacgcgagctcattttgattgagatgtcctgccacaaaatcggtcgtcagctccatggcgagcaaaagaggcgaagtaaagcaagcaggaagcaggcgcacatacccagaaggaatagagtcgtagattctttgtactcagcccagttttcaccgatagcagcttttagttccgtgtag

SEQ ID NO: 20826 - DNA, 1542 bp, A.fumigatus
tcaaatatgccattctcaaatccgaggtgtcgtgggcgaggcctatcgttgagtcagtctctcagggcgcccaaatcagagactgtgggcatgatgttgctgtgggaagcggtccatggcaagagcgcctctgaaatctctgaaatgctccagacatgggcattggaagatcagaacgtggagacagcgcttactgtctctcacatcaataatctcattcaatacgccaattccgtcaagaacccgcagcttgccaccgactttgccgccctactttctcaatggaaagttgtgccagatacgcaaacacgcctcctgcaattagaaactgaaattatcgctggcaatgagagacggacgatggaattggtggaagatttacaggacgtcggctcattcacacttgagaatttgccattaatgaataggcttataagtatgctttgcttgctggggaaagatgattccttgtacgaccgtgtttcggcttttctggacccattatttgaaaacaacgtccgtctagaggcagacaccctcgcagcgctgacgcacctcttgctctaccgacatgactgggaaggcatctcagaattgctccgcccccgccttgggtcgtatgactctgaggagaggacgaaaatccggcaggcccttactaattacattttggataccgctcaggatagtgcagatgcgtgggaggcatacggattgctgcaggtcgcctttccggaaacaggagtcagcatgaggactgacatcatgacgtccttcttcaagcgcaaaagaggcgatctcgcgttcctcgtgtttggacatatgcgccaagcagaggacttcgcgcgacggccgaagccggatacttatgcgcgctgttttcaaggcattgctaaaatgcaagatgctaaaaacctggagctcgtccacaacatgctcaaattggatgtagaagtggacctcaacacccgactcctaaacgagctaatgttggcttacgcgtgctgtgatatgccagataagagcatggagatcttccgcgacattctacaatcacaggaaggaccgtcaaccaggaccatctttgccttcttcaggatgtgcgagaagcatcatcatggagcccaagaggcgatcaggatgatggacaaggtcaaactactcgagatcgaggttgaccgccggctgtatacggcatatgtcgaagcgttggctgcacagtgcgagtttgagcttgcgacccaggcgattgaccagatgcaagaggaaatcggatatcctccgacttacgagtcgtatgtcaccttacctctgacagacccttattttaacgccgttgttgtggcaacactgctaacagttcatcttctaggattggccgcctttacaatgccattccgtatcagtattggaaagatgaggtcgaaaagtgggccaaagcgcactacccggggcaatgggcacagcttgagaaagtcgaacgcaccgatcatgaagagggcttcaagtttgagttggatagccgataattctggcctatag

SEQ ID NO: 20827 - DNA, 183 bp, A.fumigatus
agaagattctcctccgcaccatccttgcttctaacatggttgtatgagacggtaatactactactccaaaccatcctgaagaaaataaaagaaaagtcggaagaaaagatctgctattcatcaattactcgtaacctttttactcagcccatgttcccatgcaatgtcaatattaatgtatga

SEQ ID NO: 20828 - DNA, 834 bp, A.fumigatus
gatctgtcaaaattgtctcccgagggctaccgcgtcctggtggatgagagcgacgtcaagcttcccagcggcgaggtcgtgcgcaatggaatgctgttccgcaacaccttccacttgcgctccgaccagcattacgacatatttgtgccttgcggtggacggcccgagtccatcgacctgtccactgttggaaagcttattcagaatggcaagtctgtcattccgtacatcgtcgagggagccaatctgttcatcacccaggacagcaagttgcgccttgaacgcgccggatgcatcctgttcaaggatgcctcagctaacaagggtggcgtgacatcgtcatcgctggaagttctggcctcgctctcgtttgacgacaaggagtttgccgagaacatgtgcatccgagaagacggcaccgtaccacagttctacagcgactacgtcaagcaagtgcaggagatcatcaagtccaacgccacactggaatttgaggcgatctggcgcgagcatgagcagactggcattttgcgcagcgtgttgagtgatcgactcagtgttgccattacacagctggatgaggaattgcaaaagacgaacctgtgggataatgtagagctccgccgctctgtcttgagcgatgcccttcccaagcttctcctggacaagattggtctggacaccatccttcaacgggtgcgttacccccccaacttcgttacgctgaggcgagaaactgacagactttggataggttccggagaactatctgcgcgctatcttcggcagttaccttgcgagccgattcgtatacaagtacggaagcagtcctag

SEQ ID NO: 20829 - DNA, 306 bp, A.fumigatus
  unsure (257): Identity of nucleotide sequences at the above locations are unknown.
cttgtgtgtttagacagagtgttccagcgccgtcgcctaccaaaccgccaaaaattcctcgaggaccagaaggcccaaggcgaaagtagggccctagagaagtttcagactcgtgattggaaagcaggtgatatctacgctccccatgatctcagtccggcagaaatgaagaagtggagaaagcgccagggcccggcagcagatgcctttgacgctttgaacttgaatccgcttgatctttacaaggttcgcttganaatcagaacacaatactctcgctctcattcgaatgcaaaatcgcagtag

SEQ ID NO: 20830 - DNA, 237 bp, A.fumigatus
gtggctaaccagacactatttccaccacagaacttttctataatgtccgaatacatgaccgcaatgggccgcataaagcatagaagcgcaaccggcctacgacccgtcaaccagcgaaagattgcaaaggctattcggagagcaatcggaatcggcctcatgccaagtgtccacagacatcccgagattctggcagcggaagcgaaagcgaggatggagggaacccccatctactag

SEQ ID NO: 20831 - DNA, 1329 bp, A.fumigatus
tcttctaccacggagcgccgtttaagttcaatacaggtatcagggacaagcacacgaattacatatacggagttggattcagccccgatggctcgacattggttagcgttggtgccgatcgaaagatctggctctacgacgggaagactggcgaacctaaaggtcatattggagaaggagagcataaaggaagtatcttcagtgtgtcatggtcgaaggactcgaagaagtttgtcaccgccaagcgctgatcgaaccgtaaaaatctgggatgcggaggcaggcaaggtctgtcagagctggactttgggagaggagggaagctccaacgtccgcgaccagcaagtgggtgtggtttggccttccggcagaagcgacaatctgcttattagtctatcactcagcggtgatttgaactaccttgtcgaagggacgcctgagcctagacaagtaattcaaggtcatcagaagagcataacatccttgactcaatcccgctccgaggctaaggccgagacactgtggaccggcagctttgatggaagggtgtgcagctgggacgtatccactggagctgctgaggaggcggacggggactgccattcggcatatgtcgcaggtctcgcgtcgacaccggaaggaactggcaggatctacagtgtggcttgggatgatacgttacggtcggtcgatgttggcgccagaacatatactggaagtaactccaagctctctggacagcccaagagtgtcgccgccggtgactcgacagttttggtgggtacatccgaaggcgttgagatctataaagatggaaagaagaccggcgatttcaaaccaaaatccacagttactgctgtcgcggctcgtggcaatgtcgcggcggttggaggcgaagattcaaccgtgcagatctgcgagatatccaactcgagtctgtctccaaagacagatattaaagcctctcggaacccagtgtctgctctggcattttcgcccgatgggtctctgctggccattggtgactcgcgcggccgcgtactcgtgtaccaggtggccgacggcagactggtcactgaccgttggacggcacacacagcaagaattacttctattgcctggaatgaaagtggcacgctcctagcaagcggttctttggatacgaacctctttgtgtggagtttagccaaccaaggagattggttgcaagtgtccaacgctcacaaagagggtgtcaatggtgttgcctggcttgcagacgggtctaggattgcctctgttggcgctgatgccgcagtcaagatttggaaggtagaagggttggaatag

SEQ ID NO: 20832 - DNA, 1404 bp, A.fumigatus
cttttctattccatgcagcttcgacaagcgacgtttgttctaccaaagactggtcaacgtttaagagggcttgtcaatctccggagctcacatattgcaaccagcaatgatgatgaggagcgacgaggccttctctcgggggaggtctccacgaaccgtcaagacgttctatcgccagtctggagtcgattttcggatgtatggcactggacgcgtgattttgtcacctccgagcccggaataggggttttgaagtgcagtctggcctacctactcgggtctcttgctacttttattcccgtggttgcggctttcctgggccatcaagatggcaagcatgtggtggctactgtcacagtatatttccatccagcgcggacacaaggcagcatgtataaggcgctgatttgcgctctcttggccttcctatatgcagccttcatttctctaacgagcatgtgtgttagcatgttcttccaggatacgctgggtatgcgcgcggttggccatgccgttgtcctgacagtgttctgcggaggtggcttgggtttcataggatggacgaagcaaagattcggcgatccgcttgtgaatgtagcctgttctcttgcttcgcttgcgtcgatcaccgtgttgaccaaagaaggtgcggtacaaagcggagatttgtccttcactaaggtcgtccaagtcttgaagatggtcatcatgggtgtcaccgctaccatggccgtgtcattctcgatattcccagtctccgcgcggaaaaagctacgctcgaacctcgctattgtgacggagactctggcaatcatgctggtcctcattacagacagctttctgagtggctctgaggaggaactccagacgaccgagttcctcaatgcagctgagagccacaaaaaggcatattcccagctcgataagcttgtccgagaggcaaagctcgagcactacgtcgcggggacagagaaggaatacaggctagaaaagaacttagtccgatgggtccaagatatcacacacaatatggggggacttcgcagcgctgcttcgctgcaatttcaacttctgaagcaagcgaagctggctgaaccacaatcttgccgcgatagaaagcatgcgcccaatagcactgaccatttaccatcgccaactcagttaccctcgcacgggcacaatacacttctcgaatcaattgacgacatacctgaacaacgacttggaggagaagaagaggctgcagctgaagatgatcatcgagacagtggagaccactctgatcctaatccggcccgagacgaaggattttctgccgagcatacccttcaacccgaagacttgtttgcgctattcatcagtcacttagggccttccatggtatgtcgaccgctttgtggttga

SEQ ID NO: 20833 - DNA, 1131 bp, A.fumigatus
tggaaagattgtacagaacaaccgctacgggggccaacggtaggcgaaggcgtgactcctgtggcttctatcagtccctttgggctggaaggtagacagacacctccaacaaaacgcccggaaaaaccgcccgcgaaggagcgcctcagttatcggatctggaaatcgcttggagttttccgacgtgaagatactaagttcgcgatcaatgtcggcacaggagcagccctgtacgctttgccggccttccttgaacccacacggcctttttattctcactggagaggtgagtggggcttgttatcctatatgttggtgtgttctatgacaattggggcgtccaataccactggatattctcgattcttaggtacatgcctaggagcgatctgtgctatcacggcgtggtacgtgactgatgggaacgtgtctggactggccattctcggtctggtcatggcaacttggacgtcttatataatcgttgtcatggggaaaggaccgatgggtcgattcattatgctcacctacaatctttctgtactgtacgcgtactctttgacgcaaagagagggtagtgacgaccaggacgagggtggagactctcccatcatcaccgacataacgctccatcgagtggcagcggttttgtctggctgcatctggggcatcatcattacgcgcgtcatttggcctattagcgcgcgcaaggagcttaagaacggcctgagtctactatggcttcgtatgagcctgatctggaagcgctacccgttgtccctactggcgaaacgggaaagttctacaggctttatgactccaagagagaagctggagattgagcggttcctgtcccgtctggaagctcttcaagctgcagctcgtgcagaattcgagctgaaaggtccgtttcccgacgctgcatacagcaatatactccgccgtacaaggagcatggtggacgcgttccacgccatgaatctagagatgatcaaaaatgtaccggtttcggaaggcgaactggctctgctcagttatacagctcaggaaagagagcatttgtctgctcgcatcagccacttattatctggtagattcttgtccatccataacacttttgctgtgttctga

SEQ ID NO: 20834 - DNA, 255 bp, A.fumigatus
cacatgacagtcatggcgtcttctatgaaactggaatatccactgatggatgtacttccgaatattgagcatgcaagagatcgacttcttgcccgtatatttcactatcgcaagcacccccaggcttctcagctgacaacagacgaagattatgccttgctctatgcctacagtaagttgagcctggtcccttccaccacccatgaacgcatgggcgctctgtggagctgcattttgcaaattgatctgacgtga

SEQ ID NO: 20835 - DNA, 213 bp, A.fumigatus
ggttatatcggctattcgatggcgaagaagtccatcgcggtcgtcatgagaggatcgaccacggccacggatatcctcaacgacgtcgacaccatccaggtcaccacgaccctggctggcgttagcttgccctccagcgtcaccatcatgaacggcgtgtacagatcctgggccgccgtcacgacgaagtcatcgccgatgtccagagcctga

SEQ ID NO: 20836 - DNA, 519 bp, A.fumigatus
gcttatgctaacggtcaacagcggtcccttgctttcactttaaaagaaattttcaaagagatcccttttacgccggcgcctgactataaagtctctgtcaacagtaggttccatgttagtcttgatcgcgcgctggacctttatcaagaatcgcgagagaaagctctgaaggttatctataggcagaaggagcttttacagatccaaacgccggaggtagaagcggatctcgaggaagtttctgccagctgcggtcatttcagtttctcactgctagaatttggcgaacagctgaaagacctgctgcgtatcttagacgaactacaactcgaagcagaggagagacctaatgggagatcatggagctggttgaaagtatggcggtggagaacagctcaaacccagaacacgaagccgctcgattctggtaagttgtgtcgatctggcacaagcgcttcttatctacttggtcctaatggaaagattgtacagaacaaccgctacgggggccaacggtag

SEQ ID NO: 20837 - DNA, 732 bp, A.fumigatus
gttcatacacatcttgagcattacttccatcaagccggactaactggccggtgtccgccagattgggagttagagattcggaaacgctacgcacaacccttggcatcggaaactggcgagtttccagacgccgaatcaatacatgcgcgaatgataccgatttgctatgaggagtctgtagttagcggtgcaggcttcccgtgcgctgagtttatggcgattgcgacggagacttttgtcaaggaagtactatccgtggtgttttctcgtaccaggtgcaatggcccctcgggcacaatcaatggcatgatgatgcgcaaatatcgacagcaacttgagctagaggaactagcctatactcgcggcgagattgttaaagacagcgcgactgggcttctgcccgttgaggccagggaagctaggaatcggaagcctctcggggttcgcgatcttcgactagcgctcgaaattggaggaggagtgctcagtcatatgcctcttattgtcgatcatatcatgggaggttatttcgaggatgaattggagaccgacaaacaggaacaaattgatgaagttgccgacagagccgataatgactcgagaccaatccagttcacaaatgaaatggaagtggaggatgatgcagagatgttggactgggaaggagccaccgcggtagatcgggctcagttgggttcgttactggatgagtgcctttctctggcctcatga

SEQ ID NO: 20838 - DNA, 678 bp, A.fumigatus
ctgataatttttggcgtacagtccggtaaatcgatcttcttgcgttcgatcgataatccctctatcgctaggcagtataccgaacacaaggcacaaacgacagttgctcgcttctcgccttctggcttttacgttgccagtggtgacgctactggtctagtaagagtttgggattgcgtcggtgaaggaaccacaaagggtgaatacagcattgttaacggtcgcatcaatgatctcgcctgggacggtgactctcagcgcatcatcgctgttggtgatggaaagcagagatatggccactgtatcacttgggacagtggcaacactgttggtgagatctacggacatacacagcaaatcaattccgtttccatcaggcaacagagaccgctgcgagcggctgccgctggagacgacaagaatctagtcttctaccacggagcgccgtttaagttcaatacaggtatcagggacaagcacacgaattacatatacggagttggattcagccccgatggctcgacattggttagcgttggtgccgatcgaaagatctggctctacgacgggaagactggcgaacctaaaggtcatattggagaaggagagcataaaggaagtatcttcagtgtgtcatggtcgaaggactcgaagaagtttgtcaccgccaagcgctga

SEQ ID NO: 20839 - DNA, 309 bp, A.fumigatus
tcccacgcctccttactggcgactgacatctcccaagaaatgatcatttatggcaatgtcatctatacaatcggatcaatcctcgttgctgcagctactaccgtgcgctcattcaacttcatgattggcggtcgagtcatcctagcccttggagacatcgcaacacagatcgcccagtataagatgttctcttcatggttccccccaagcaatggatttgcttccacacttggctttgagttagcagttggaaaagtgcgaccctacttggcccttgttaacatatggtatgctaatgcaagcttctag

SEQ ID NO: 20840 - DNA, 993 bp, A.fumigatus
cgtctcgtcagccgccacaggctcctttcttgcaaatgccacaacctccaagtgctgaacaacatctcggaccaggcgacggtatacacatacgtcgacccgggccagacgtcctacacatacctgggggtccccgaaaccacatccctgctcacccagggcttcacagccaagacatacggtgctcgcacgcagtgccagctaatctcgtcgaaatgcaccttgcaaaatgcagcttcgtcggtcaaattcaactgctccgctgattttacaggtctcatcagcacgcccactctacaggcggcgttcttcgaagatgaaagcatgagcaaaaacctccggggcaaggtggtatccaactacagcaccggcaatccgtactacttcggcctcgcgtccgtggtgaacctctccggaggaaagacgcccaattccaccgagtttgtgaaaagtctccatggcgtcccgacctatgtcctgggctgccacacgaccatctacgatatcgagtacgaccgcctcaacaacaccgtgacccgtttccagcccgcggcgagcaacacctccgtcagcaacatctggcagacgagcatttcgcagacccaagattggttccccttcttccagcaggctgctggcaccgcgatcttcagcgatacggccgaggagttcgcggaaaaggtcgccctggctcttagcaaagcgaccattgccctcggggcggatgcactcggcacccagccggcgctggccgcccaggatcgagagacgttactcgtggcccgcattcctgtggtcccgcttgtcgccatggtggcggtttgtcttctgtatgtcgtgtgcggcttggttctgacggggatcgcggcgtggagtgcccgatatgaagtcccggatgtggaggcccggctttccattgcgggtctggttgcggaccggttcgaggaacctgggttgcggagcgacgccatgttcgccgagcatgcggggtaa

SEQ ID NO: 20841 - DNA, 471 bp, A.fumigatus
cccggacagaaaactggaaactttgcttgggtcttttggacctctgtcttcatgaacctcttcaccaatgctgcaaccgtcatattctggttcttcaaccgctactgtaatgtccattacagaggaaggcaggatacggctaccaaggaagtcctgacagagaagaacaagaagtttgaacttcaaaagatgttccagctccattggatgttctggactgtcatggcattctcgctgttccagacatctacggcctcggtctttagccagaatgcaaccgagctggcagagaggcgcttcaatgtggactcaatcacagcaggatggtacagctctctgtcacaatatgccggtatgatggtcccgcacctctggttgagtcttttccgtattgactctggcaggtttctttctggtcccatgtttgggtgtctttatcgatgtcctcgggaaccgcgccagtgtttgtaa

SEQ ID NO: 20842 - DNA, 255 bp, A.fumigatus
catatcccagtgtgcgtctgtggaatcggaatgttcctcagcatggttctggtcaactttgccgagaccaggtctggcacggccgcatcattcggaatatatgccatagccgtttcgctgggcccaacttccatcatcgacagcattcgcacaaccctatggcatcaatcagtctttggatctgcttatgccctcaaagttacaatgaacaatgcgtacgtcctgttcatttctgcgtatcagataaccgactaa

SEQ ID NO: 20843 - DNA, 213 bp, A.fumigatus
gaggacacatatattccacgtatgagcgtcctcaatccgggtcctttccccagccccgaggagctcatctccctagttggtagcaagaacaccttacttagagaccctctatttcttaccgtgcaacgatccgaaaagacccattctcgaaggtcgttggatgggcggagggctcatctccgaagcctcgagctctaccggaggcttgactaa

SEQ ID NO: 20844 - DNA, 834 bp, A.fumigatus
caacgtgagcgtagtggaacatattcaactgagccgggggttgacatgagagcaaacagaccagaacaggcgtttcagaatgcgtccagaatgcttggtcattacctggccacacagcagaccccaccgcatggccttcttgtcaaaaaactgtatatctataaagcagtcgacgtcgagcaagagttctatcttgcgttgacattcgatcgcgaacggtacagcccggttatcctcatctctgaccagggtggtgtgaacatcgagtccaaccaggacaagctgcacaggttctggtttaacctttcccggggcatcactggcgaaaccatggccgggatccagaagcagtcgtgcttcacagacaaggaaatgccgactatcgaatcaataatcagacagatgatcaagctgtttgaggaacgggatgctattctcctggaattgaacccgcttgtgcggactcccgagggaagctttgtctgtctggatgccaagtttgaatttgataacgccgcccagttccggcaaccggaggtcttcagtaaagaggaacgcatgccgggttttgaagacgaatacgaggctcaaatgcatggcctagtctatatccggctcaacggccacattgggaatatcgtcaatggcgccggcctggccatggcaactaacgatctgatcaatctccatggcggaaaatgcgccaacttcctcgacattggaggtaaagcaaccacagagacactgctgaaggcctttgagattttgagccgggatcaacaagttcgggggattttcgtcaacatttttggaggtatgtgtactcctacataa

SEQ ID NO: 20845 - DNA, 903 bp, A.fumigatus
ttcagtgccagatattgccagctgccccagcgtccgggtctccttcatcggcccccaccttcccctcggtgtgaaatcaatgcggaactgcttccacaatcatcgcaagacaccacattgacggcgcttgcgcagctcggagctttgcgattgaatgcccgacggtgcatgatctccctcttcgaccgtcatacgcaatatatcctcgcggaatcgactcgcacattgagtctccaggatgacagggtccatgtcgatggtgatggcttgtggctcggcagcagtgtcattcccaaagaagatgggatctgtcactattgctgcgaggaggatcagctcaacgccgggccaacgggtccgaatggggggtataccgcgttggtcattccggatatgaccaaggacgaccggtgcagcaagcgacagtatgtggtgaacgccccgcatctgagattctatgctggagtgcctattatgagccgtcggggcatcgccatcggcgcattcgcagtgagtgacggtcagcctcgcgcagggttagatccgctggagattcggtttatgacggacaccgcggccgccgtcatgaatcatctggaaatgatgcgctctcatgaacagaatcgccgcggggccaatatgattgcaggattgggaagctttgtcgagggagcgacgttaccgtcgagcagtctccgaagaccggtacatccgcacgatgaggaagaggaccaggagtccgagaactcgcagaacattatcccacagacgcgacggcatcacccaacactggcagacggtcgcccccccctcaaggaacgaggccagcacggggaggccgctgcattgccttcaggtaccgccatctgccctgctgacagcgttgaacagaagcatctctaa

SEQ ID NO: 20846 - DNA, 2031 bp, A.fumigatus
catgagcgattgagtctcaagggaaaaaaacagaccctgatcaaagtgttccctgcggcccggagtgtgaccatgttccctctctgggactcgcggcgaaatcgctggttttcaggactctttgtgtggacggctgcgccgcgcgtctttagtctgacaggcgagttggcttatctgtacgccttttccaacagcatcatggcggaaatccatcggctggatatcgagttggcgaacaaggcgcacgcgactctcgttggaagcatttctcatgaactccgcagtcccctgcatggcattctgggcagtacagaattactgaccgattccacgatgaaacccgctcaggtagctctggtcaataccatcgagcactgcggtcggtcgctgctggacatcatcaacaacatgctggactttgcgaagatcaaccaattcactcgcaaatcccgatcgtcccggttcaaatcgacgcacgcacttcgtcggcggccggggttgcctgcaggcatcgcgttcaaagataagcccggcttgggagtggtcaatctgatctcagatgttcaactggatgccgtgctggaagaagttgtggacagtgtttttgctggtcattgcttttccgccaagggggggctcgttgcccggccagcatcacaggctcctgcccgggatagggacggacatctaatcatgaaaggtgcgacagagcgaccgctttctgcttttaacgaagcactcaccatcatctacgatgttgagcccggtgtgcaatggctgtttgaaacacaggccggttcatggcgtcggatcctcatgaacctcttcggtaacgccctcaagtacacccagtcgggttacatctctgtgacgctgaggtgcagctcgacaccgtccaacgctaaaatgaaacgattggctcgcggagatggtacacgcgagggaatggggagtgtgactttgaccgtcagagataccggacagggcattgacaagcaatatttacagagcaatgtattcaagccattctcgcaggaggaccctctgtcgccggggagtggtttgggcctcagcattgtccatcagactgtggtatcacttggtgggaaagtcgacataacgtccactaagggtatcgggactgaggtgacggtcacgctggatttaccgcgcactcctcaggcagaggtggcggagaacgaacgcgacgccagcattattcgcaaagccaaagaccgagtacgtggcaagtcgattggactgatcggattcgaatcgtcctccgcagaagaggatgaggcactggttctcttgcgctcgtccctccttcgaatgtacaaggagcatttcgggatggaagttggcctcgtcccctcgaacgtgtcggatcagcaggtgtacgacatatatttggtccgacaatccaacctggacgaagtggatcagatttgccggcaggtcacaatggccgagagcgactcgcgcagcccgccaatgatcgtcatttgctcgacgcctcagatggtgcaaaagctctcaaccaccgcgagtcagcgaccgtcgacgtccatctatgagtttatcagtcagccctgcggaccgtccaagatggccaattcacttctgacttgcctcaagcgccaaagagaacggccgtcttgtatgtcggctggcgggcttgacactgcgtttctcaacgcggcttgcgcgagcaaacctaggcggcacagtgagaatgtgtcgcgggtcgacttctccttgatgccggagaaggccatcgtttctgtgacaaccactaatgttgatgattccgctatggaagtaacaacgatagaggcaaccaagagagttccctctgtccttctggtggacgacaatgacgtgaatctgaagctgttggtagcttttatgaaaaaggccaagtttccttactatacggcttccaatgggctcgaggctctggaagtatacaaagcgaatgccgggtacatccccgtggttctcatgggtgagtggtcctatcactgctga

SEQ ID NO: 20847 - DNA, 249 bp, A.fumigatus
gatgttgagatctcggaattttgcacatcaggccgcaatccttcccccgagatcgccatggcgcaggagcgagaattctacaagtacgtgtcacgtatctacgaactcaagagagtcaggtcatctaattcagtgccagatattgccagctgccccagcgtccgggtctccttcatcggcccccaccttcccctcggtgtgaaatcaatgcggaactgcttccacaatcatcgcaagacaccacattga

SEQ ID NO: 20848 - DNA, 399 bp, A.fumigatus
agacagtggaaatcgagattcgcctcctcgaaaaaggaaactagggaccttgcagacaccagctccttgtcttcagcaactctggagactcagaagctggaagagatcgacctgaaaaacctctgccggcggggaaaacattcagctgggggaaagtttgcccagaatatcaaagtaaatctatcacaagactcgacatactccctgttctggtcgcagtcctcgattcagatctgggatgtcagtacttgtccccctaccttcaaggacgccatcaccccggatggattcttcatccttgcggctgtgacaggaacccacgtggcctatatgacaggagaccgagatcgaaagcagacggtgagttcccctccaccttggtgtggtgatcgctcttga

SEQ ID NO: 20849 - DNA, 870 bp, A.fumigatus
ttcatctgtatgtggcagctgtggatccaaagtctcgagcggatgaccacacgtccggtggagtatcgtgtagggcccacgccctggtgcaccagcatgaccgtctcccccagcggaagcttcgtcgctgtcggattcgacaaatcgaccgtcggcctgttcgccccttcagaatggcagcaaccgcggctctatcgcgtgcacgctcgctatcaccaggactgtaaggattgtcctccaattgccaccgtctccttctcccatgatgggctcgctctggtgtgcagcacccgaagcgagcgaaacggaatgatccaagtgttcttgtctcatttccccttctccgaattccaggaggttttaccctgccggtaccgcgtccctctccgtgagtcagaagataacgggatttcatctgtgctttttcagccggggagaggcggtaaggaggacatcatctgcatcacaacatggacgcaatccggcgttcccattctggtccatcctaacggcggccaccgcacggagatccgtgtacagagttctgcctcgtccaaccacaagggaaaactcggcaatcgcatccaggctgctgccttttcgccatcgggacatgagctcgtcctggctaacgataagggctacgtatatcgagtatccaacttgagttctatcccgattgaggtccgaagggttgctacgtccaaggagtttacgaccaagactgaatcctttgcattggcatacgtgcatcagacggatgaagacctgattctggtctcttggtccgattcatccaaaggagtcggttatgtgaggaaaatcccgatcatgaccacagtacgtgctctcagaagacgcaccgcttga

SEQ ID NO: 20850 - DNA, 843 bp, A.fumigatus
catttttcaaagccgataacctccaatcaagaaacgcttcgtatctgtctcagaagctgtgccattgccgaccagttggctgagacctactctgtcaatgccaaaggtgactctaagatgtctcatgcaaccgatctttatccttcgatagtttgctgtgcatataaagagcctcgatactctcatggttcccaagaactccaatacttgttcttgaatcaatcaaaccgggatcaccacccccatacaatgcatacaccaactcctctcaccatctgcactgtgcttactgcccttgccagttgtatcaccacatcgtgggcgcaagatgcacccgccataaaggactctactatcttgcgctcgactgttagctgccccgactgcccagagagaaactgctacaagtgcacactcggacatgagaaaacccttcgcgcaagcacaggcggccgaggctgggagcgcttcctaattgggttcaagctccctgccccagttaccgatgcgacaaaatgcactgtgcagttccctgccttcgttcgtcctaatccgttcgccgtgaacgtaactgtcgcccgcgcgctatcctccgactgggacgaagacacagtgaatggcgagaatgctcctgaatccggtgatatctttacgagcatgtcgcttgagccgtatgaaaacatgcaggcaatcgatatcactgcagcatgtaagggtgcgcaggccaacggggaattttcgatctacgtgggcactcagtccgacagtgttgagctttggtcaaaggattctgatgctcctgcgattctccatgtcagcggatctgtgtgcaaggcatcctag

SEQ ID NO: 20851 - DNA, 5037 bp, A.fumigatus
cgcagagtgcacaggaccgttctacgagagatgatccagaatgcggcggacgcaaatgctaccaaggtcactatcaagtttgagactctgccttctacgactgtacccttgccttctagcgccgatcagactaccttgttgaagcacaccatatcccaccataccctcaagcgtttgttgatctcgaataatggccttccttttagcgagaaggattgggcaagactaaaacgtattgcggatggaaacccagatgaaactaagatcggcgcatttggtgtcgggttttacagtgtctttgatgactgtgaagagccttttgtgtcttcaggcaaagatgcaatggctttttactggaagggaaacgcgctatttacacgtcgcttgcaacttagcgaagagtcgaatccagaaacaacatttgtgcttgactatcgcaacgatacttctccggttccgtctctgatgcagctgtcccagttcttatcaagcagtcttactttcgtcagtctcgagagcatagaattatggcttgatgactgggatctcctgcgcctcgtgaagaagacggcacccagcgtcaatctgacgatccccaaagacatcgaaactaagacgccccaaggcttgatgaaagtaacaggtatcactcgagaggtcgttcaagtcgatgcagcctggatgcgtgtcgttgagtggaatccgaacgcaagcgtgtttcgcttggacggactgagagataccacaggctccttgcgtacctttttttcccgactcaccggccagagcacacaagagaaccctgtaaagaccgagaagccggaaaacatcatcgattgcggagacttgaccaccgtcttgaaagcatccgttttcttacatatcagcactgcaagtatccagtgttctgtcagtcactccctgagcagcgagcttgaacgagctacgcgcaagcctccacccaaacgaaccacccttgcgatacttacgccttcctatgacacggacgttgcatcgggagcgtcaacatcacgatcagatatcctatcctccattctacctaagaagactggaagggttttcataggatttcccactcaccagacaacaggattgaacgctcacatatctgcgccttcagtgattccgacggtcgaaagagagagtatcgacctcaatacgagatacatcagcaaatggaaccttgaaatgttacgagcggctggaatagtctgtcgagttgcttggtccgcagaaatggcatcgatcaagtccagaatcctgtccaagatagactcttccaagtcatcgaagatccgaaaaggtgacattgttggagtcttgcctgaagcgatatacaccgcgaatcagtttgtgttccgcgagtcgacgccgtcatcggtattaggtcaaactatcgaagacgccttctggacatgtaataaaaacgcgtccatcgaggtactgtcgacatgtggtattatacaaagtcatcaggcacgcattgctcccaaagacttgagcttcatggactctatcccggttctgccggatgagcttgtgtcgggcgcaaaagatttcgtcagaaaattaactgattttgggctggtctctgaagttaccgtctcggatatcaagcgagaactcgaggccagcaccttacggcccggccaggtcattgaatttcttggttggttaagtcggaaagctacttcagggcaacttgattcattctcaatccagagcctcttaagtgttgcagtggcaaatgatgaagatagctccggcaatccttcccgactacttgtctttggggacattaacaactttctgaatccccagcgtatacctgttgatctgcccgtgccgtcctcggtcatacctttcaaatactccaagtctctctcgaagcaggaactggaagcactcgggtggacggagcttcagacagtcccttggatccgctggcttgtcatcaatgctagtaatagggatgttctcccgttagagcaagatataacgcagtcgccgtccttctctgcgcaggttcttcctgtcctgtcgaaacaatgggataacagcctgagtcagtcatcgaagcagacgataatctcgttgttgcagtcgcagacagtcattccaaccaaacttgggatgaaaagacccgctgagacatatttctcttcagtgaggctgtttgacgacctcccagttgtccatggcctcaatagtgttaaggaaaagttcctcatggcgcttggcgttcgtaaaactgtcgagcttggcgtcatttttgagcggctcctcgataacccccaagcttccgatggcaagagcgacaatcaacgaaagtggagtcacgttgatctcatacgttatcttgcttctgttcgcgatgacatcccggcgaatgacatcaaaagacttaaggatactagcatttgcaccgccgaagcaacagaacactcgaagccagcaggtggaaagcgatataagatttctgagttgtttgagccgaaaggttcccttagagaccttggtctccccatcctcgaatggccgggaaaatatcagccaagcagcaatgaaggaaaattccttaccatgcttggtttgaggagtttcccgtcagcgcctgagatggtaaatgttatggcaaaggcggctgctgcggatgactgggatttgcacggaaaagctatgtcttactatatttctgagtatcatacaaacggttatgccacgttcgattgcagtgctgtcaatgttccgtttctgccaattgaaggggctcgcgacctgagcacgccaaacagatgtttcactgatgaaggcgcaacactgtttggttttaagattctccgacgtgaccttcaccctcatgcttcgaaattcggggtcaagcagcacgcagccatgacgaattgtctcgattacatgatccgtcatccaccatccacgaagcgagacgcaagagtgctgttcaagtatcttgccgggagagtagcggagctaagcgcacgggatatagagcgtactggtaatgcaaaaattgtcccgattgcaataagggatacagtcgagcaaggttcggttgttcgtcgtgttgcgccgaagctatgctacctcggagagggcgaagactaccgagacatctttgactttgtggatttcggtcaagaagccaatctcttcctcatggcagttgggtctaagagagagccaacgaagaccgaacttgcctacatgctagtcaaagaacctgctaggatttctgcttcttttcagagtgccgacaagtatctcaagctcctgagaagtcttgcagagcaccttgccgttctgagacgggacaaggaactctttactgagatgaaaagatccgcttttcttctggcgagtcgggatatcacctctctggctcagggaggcgccaagagcgaggatcttctgggctccgatgacgacgaggtagaagatcagagcatcaaggaatggacgttgaccgctgcgacagatgcagttgtggtggatgattttcagagtttcaaccttttcaaagagcacatactagctgccccgcaagaggaattgttagagaacttctacactgcactcggggctattccattaagcggactggtggaggaacgtgccaactggggagctgtggcccacgatcagcgtccagcggctaaactacataagctgatcaacgagcgttcaaggttgtttcttcatgatcaatccccggattcgattcgccacgacgtcagatggctggagaagaacctccaagtgcaggttgtgaactccatttcgctcacgcggtctctcaagggccgtcgggtgtcgcacacacagaaacggagtgccataatcacccagaacggacgaacttggattctctggatctgtcccggcaaatacgacctctacgagatcagtcaagctcttgtacatctcattctcgttcggccaaagctccattccacgctcaccttagagatgttgctgaagactgacctcctagaactgaaggcacgaggatataacgtggagagaatattgaagcaaaaggcacaagaggccaagatagccgaggatcggcgtcagaaacagttggaagaggaacgacagcggctagaagagagagaagccgcctgggccaaggaacaggctcaactccaggcacaagagcgggagatggaagcgaagagtcaacctctcatgccaggtgattttcccgactcacccaataataaggggtcgaaccccaatgtggaagccgaagcaacagagacgctccaggagcggcgtccgcgcggtttgtttgccaacctgaccaagcgatttggtttggaaggtggccggtcgagctggaatcctctcgggggacagccatcgccaccccagcctggtggaacaccggagcatacaggcacccctcctccgccatattctgcagacgaccctcagagaccgcgcccggaagaacccgcgcctgtgcatcctccgcatcggttgcagaacgagttgctctctgccattcaagcctgccggcctcatggatcgtcgagcttgtacagccggccggagacgaatgaggtcactgagacgaaatcctactgtgacgagaagccaagccatgacttggagttcgtggcgactctaccctgtggaatcaatgtgctgttcgtgaagactctagctgatcgatccgcattcctatccaagaacagtgctggaatcaatttgtttgctgccctgttgatcgaatgtgctagtgtcttttcactgcgtaaggacagtcttagtgttttctacgacccgggtggaaagactatagcattcaaccgggctggcagtatcttctgcaactacttctacttccagcagctgcatgaaaaggaattgcttcagaaccagtcggctgacagatctgaatcgatggtatactggtgggtcattctctgtcacgaattagcccataacctagtgggagaccatagctccgcccacagttactacaggtaa

SEQ ID NO: 20852 - DNA, 183 bp, A.fumigatus
ccatcaccatggccaccacacaaaaagacaagcctgcagtcgtctgcgtcttgtaagctaacccctcccctccccgccatctaccgaaaacgccattccctcctaaacaacaagctctccaccccatccatggcgaaaggcttattaacacagttgcaaacccttccagctgcggctcagtag

SEQ ID NO: 20853 - DNA, 555 bp, A.fumigatus
cactatgagaaacaatcagttctgttatatttcgcagagtcgcctttcttcgatgccacctcgaataacgcatccctcgctatccaggccaactacaatgaagcctttcgccatttcgtcgagacccgcgaagcgtttgaagggcgattgcggactatgcaaggcctggagtttgtcgtcgcttacgatccgttgcaggccgctgcgcagacagatactcagttcgctcacgagccctcgaacgtatgggtgatccgcaagcagatgcggcgaaagcgcgctggtcaggaagatgaggtggtggtcctggcgacattcttcgtggtgggagattgcatctacatggccccttcggttgcaagtgtcgttggtaaccgcattgtacgtcgacgatggttctgtttcgctcacgtgcggaagggcatggctgaccaactcgcatcagctctctgctgtcacatcgctaaccagtcttttgaaaaccgcctcgacgctgccaatcttcaccccggcccatgggcatacctatctaccaccagctccgaaacccgctga

SEQ ID NO: 20854 - DNA, 2505 bp, A.fumigatus
gtaccgtcggagcttgcgggccacagcaatatggcgccatttataggcgatgatgagagggcgtcgggttccggacagccgtccgactcgagtgtcgatgctcctgctcgaaggaatgtcctgtacattgatgcatacgattccttctcctacaatgttgtggcgatgctcgaagaggttctggatgttagagtctcggtgatgaccatcgattccgattggccagacggcaacatggtcgagtatctacagcatttcgaagctgtcgtgcttggccctggtcctggagatccgaatgttgctaaggatgtcggcatcatgcgggatgtttggaccctgagcggcgcagatatgttacctgtctttggaatctgtcttggttttcagagcctctgtctccatcagggcattccgataggacgattgccgtatccactacatggccaggttcatcgaatcaagactgtcaacagggacattttcgaaaacgtgcaagatgtcgaagtcacactttatcactcgctttatgccagactagattctccggaacagtcgactcggggggttgacagtggaaaccctcaagccgatcgattcgcttccaaggaccttgatcttctagcttggtttctcctagaagacggagagacgcagattcccatggctgtgcgtcaccagaagagaccaatctggggggtgcagtttcaccctgagtcttgcaaatctgacagggaagcttgcgtcaagttgctcagaagatggtgggatatggccctgaattacaacaaaaagacggggcgcggaggatatggcattctgctcaattctaaccactgcgccagtggtagtattactcttcctgatgctgcgtccacaatgttggattggagcaccagcacttcttcttgttcttcatatcgtacctttacagcgagaaacttggatgccgaagtcgtctgcgagaacttgaatgcccccaactcgccaaccgtgctattccaatctaatgggaggtatagtattatctcggtgcctagccccaacagctggaggctcgagtactattgtgagactcaaagcctgctgttagagaagctgcaggatcgccgagggacggaaattggtccgactaggcagtcagtggcagagagcattgttgagagatccttgacagtctctcaattctgggatgtgctgaggtttgtgacggacacgaagaaggttgactcaggaagtctcactgtgccgttctggggcggtttcctgggttacttttcctatgaaatgggactggcctgtcttgcacgtcccaaaacagctgcaggaatccatacgacctgcgaaaatgaaaatgccggagaagatcctgccgacgccagcttgctgtggactgaaaggagtatcgttgtcgatcacaagacgggccaaatcacattccagtcaacgcgggttgacgatgatctaccgaggggatggcttcatcaggccgtacagtttttgcaagacctcgccattaccaggagtcagtgcaaggtctacactagcgacaccacggcagagttcttggattccatcctcaagcggagcgttatcaaattcccaacccaggaaaattatcagaggcagatcagggcttgtcaggctgagttggaggctggtgaatcgtacgaactgtgtctcactggcgaaacgttgatcacgttaccctctccagttagtcaaagtggccgtgccagttttccctgggagctgtacaaacgtctgagaaagtacaaccccgccgcctttagtggttttgcgcgactaggtcacgtcaagattgccagcagcagtccggaatgcttcctcaattgggatcgggactctacgctggaaatgaagccaatgaagggcactgtgaggaaaaccgaagatatgaccatggagaaggcccgcgaaatccttggatcgacgaaggagatggcggagaatctcatgattgcggatttgattcgccacgacctctacggcatctgcggctcgggcggcgtccacgtagaaaaactcctggaagtggaggatcacggacgtgtttaccagatgatcactcatgtcaaagccaaggttgatcgaagtcggccgggatttgccgcacgggatatgccgcagttaccctcttcgaacatgtctggatacgggctaactgcgttgcaaagatgtctgccacccggctcgatgactggtgccccgaaggaacgctcatgcatgcacctcagctcaatcgaggaccgaaaacgtgggatctattcgggcgtgatgggcttcctggacctcggtggcgggggcagtttctcagtgctcatccgcacagcttttacctgctcaaatgagcaagatgacgagcaactctggcgaattggcgcggggggggccgtgaccactctgagtactcccgagggggaatgggatgagatgttgactaagttgcgtacggtctgtggaatcttcgctccgctgaacccatag

SEQ ID NO: 20855 - DNA, 798 bp, A.fumigatus
gctaacccctcccctccccgccatctaccgaaaacgccattccctcctaaacaacaagctctccaccccatccatggcgaaaggcttattaacacagttgcaaacccttccagctgcggctcagtagcaggcaatgaccccatccacatggaaacggcgcgcgcgctcgcccacgaattccacaagaacaacgtccagctcgtctacggcggcggcacaaaggggctaatgggcgagctggcgcgcaccctcgtttccctctccggcccacaagccgtgcacggcgtgatcccgcgggcgctggtccgcgttgaaccgggctacgacaacaagcgcgaggaagagaagccgacggcgagtagcgggaagagcgcggaacggaccatcaaggaaccgcttgacaagactgcgctgctgggggagtcggagtatgggatcacgacgattgtgccggacatgcatacgcggaagcggctaatggctgagaaggtcatggcggggggccctggatcgggcttcgtgtcgctggcgggtgggtttggaaccattgaggaggttatggagatgacgacatggaatcagctgggtattcaccatctggggattgtgttgctgaatgtccatgggtactgggatgggctgctgtcgtgggtgcagagtgccgtcaaggaggggtacattggggcagacaacggcaagatcctagtcgaggcgaaggatcctcgcgaggttctgccgaagctgctcgagtaccgggtcagcaatggcaggatggacctggattggggccaggaatga

SEQ ID NO: 20856 - DNA, 360 bp, A.fumigatus
gttcttgccattggctttcttctggtcatcctctcctccgctctttggcacaacttccttccgttgattgtggttgcgagatatgtcatcgctcctgtaccgaattggatttgcgctcgatgcgcaaatccggatgatttcatggacagttctggtaatgcagtcgctgattttgggcgattcttgactggcttcctggtgttgatgggtgttggtaagtttgttcagtctaatgccattcttcttcctctgtcgcatctgcatctcgtgggataccctcattatctgttttgcaaatttttaataagggtggtgtctaatgcggatgaatctagccctgccggccgtgcttgcgcatag

SEQ ID NO: 20857 - DNA, 444 bp, A.fumigatus
cgggaaactcctcaaaccaagcatggtaaggaattttccttcattgctgcttggctgatattttcccggccattcgaggatggggagaccaaggtctctaagggaacctttcggctcaaacaactcagaaatcttatatcgctttccacctgctggcttcgagtgttctgttgcttcggcggtgcaaatgctagtatccttaagtcttttgatgtcattcgccgggatgtcatcgcgaacagaagcaagataacgtatgagatcaacgtgactccactttcgttgattgtcgctcttgccatcggaagcttgggggttatcgaggagccgctcaaaaatgacgccaagctcgacagttttacgaacgccaagcgccatgaggaacttttccttaacactattgaggccatggacaactgggaggtcgtcaaacagcctcactga

SEQ ID NO: 20858 - DNA, 3285 bp, A.fumigatus
gtacccccggtctgctacccggtcgccgacaaatcctctaaagcaatccaaagcagtgctcttgaagtgggacagtctacgccagggaaccgcatcatctcccttcaaaatctcgctaaccttttacccgaccttgcgaacaatatccttcatctctacgatcgtgcttctaatattacagatgagccggtgcctcagcttgtcttttcggagacagtaatccggctctcaagattgctggtagccgcgcgaatccgggatggcgctctggacgataatgctttgaagcacatcgtaatgaacgagcctttgctgccactgcatcggcccgaacgtcctcgtggcttgatcatcctccgccagtcagagattgcgaatttcctgttccgtgctttgccactctcccctagctcaggtctgcctgcaacagatacaataccgattatcattggagtcgtgtctgtactgaatgcgcttgatctaccgcggaagaaagcgttcattttgcgggaatttctttcgataatagtcccaactctcgtccaggctcgcaaaatcggtgctgccgaagtcgggattcaccccgccgccgggttggcgtcgctcagtgatacggcatttgatattaacgcgcttgatgttggatcagggaatatggaaagcagcatgcgtgcccttttgggtctcataggggaaatatatggtgtacaaccatctccattctatgagtgggagaagaaacgctcctcgactgcaagtgggacggatccaatccctgagtatgattctatcgcggccattattgagcggtcatttcgccatgtggcccttgacagatatggcgacctgaatttgaaaatagacgctctcaaagcgtgcatcaactgctgcgaggcgcttcctgatttcactggtgttctccagttcacagttgaactgctccaaaccattcggggagacctgatgcttgctgaaaattattatcagcctccgttcctgccgcaagacgagcaagttcgcctattgaacaatattaaacgaacagtgagcgctgcccataagcttggcgcttcagacctagaagcagaatactgggatgacttcctcgtgcgtgacgtacggctccttgccctacctgactctaagcgacctgttcgacgttccaagtcacaccttgaagtggtctcaggcaacggcgacaagccctcaaaagacccgttcttgtacaacccattttctaagacaagcagtaaaatctcggagtcgctcatgatcgccggtgagcatgcagcattcacagttactcttcaaaatccttatgagttcgaaattgagatcgagcggattcgtctgcatggtgaaggtgtgccattagatgctgttacagagtggataacacttccaccgctttgcctacaagaagtgacggttatcggaactgcgcctacagaagggacagttaatatcaccggttgtattgttaaagtgcgatattgcagggaacgcaaattcccgattttcaaggatctctggaaaccagagattgaaatgaagttcaagcgaacaggtctcgcggccaaaagacctttgacagatcgacccctgtcgtggagctcaactacttcgaaagatgggaaacaacagccgaagaaaggcccccagacgacgtcctgtgaaatcaaagtcattggccaacagccggacctcgtgattgagtcgatgtcattgtcgcaatccgcggtgatggtgctggaaggagaaacccagtccttcgacatcacactgcgtaacgcgtcgagttgcccgcttgacttcataacttttacgttccatgattccactacaagacagatccagtccgcgttgacaaacaaagacctgctgccggtagaagtgtacgagttggagcttcaattatctatgaaaccaggcctgcgatggcgccgacagggttcctcaccagacaaccttgtcattgatgcgggacaaagtgcgacgttttctctcgatatcgttggcaagccgggcttgcaagagacgactgtgcaaattgattattcctatattgggctctccaacggccaattaccggaggagttctacacgcggcagttgttcgtaccgcttaccgtgacggtgaatgctagcattgaagtggctcgttgcgacattttaccttttagcagtgactttgcatggcggaacagccaggaatcggagctggattctgtcgggaacagctccacggacggcgacccatttgccccagtgctatctcaactgggacgaggcgcatacgggcacgaccactgcatcttgctacttgatttacgaaacgcctggccgaatcctttgtcagtcactttacaagtgagcgagcaaccaatagaagagagttctgcggaggaattcactcccaaggttggacagtacaccctcacgggagagcttcagccgggccagatctcgcgctttgttcttgtcctcccttgtgtctatgtagacaatccacatgctccgataccggttctgaatactggaatcaagaggcagtttgtcgtgagtgcaaacaagctcacttttgaggcagaagccgcgtcacgggaggctttctggttccgggaggaattgctcaaaagactctcaggcgtctggaaagagagcacaacgacttctggccacaagggagtaattgagctaagaggcatacgaatgaacgcgcggatggtggacgcctttcgactcgacgccatggatatcagcttttcccttagccctccctttccgaaacagaaggcatcctccgctgaaagcattgatgaagtgatgcagatagggcggtcaaaatataaggtgcagaccgacgagatgcttgatctcactgttaccgttcggaaccgctcctcgaagccaatccacccacttctccggctccaacccagtcttcgccaccaacccagtaatgttgctcttgatctttcgaagaggctggcatggactggcatgttgcagcaagtgctgcctatcttgcccagtggagagagcactagtgttaccatcggagttaccatcttctgccacggagagtacgaagtcggtgcaagtgttgaagaagtgcgaaccctgagatcgacagttggattggagaaggatcacaagccagcgtacgatgcgcccgtactacacgatgatgaggccatcagagactcgtttggattagacgctactcgacgaagacggatctggcatgctagagagacatgtatcatgcatgctactgattaa

SEQ ID NO: 20859 - DNA, 345 bp, A.fumigatus
caaccgattgattgggacagctcgccgcaaggccggatattccaggttgaatatgcacaggaagcagttaagcaaggatcagttgtcgtaggacttgtcaacaagactcacgccgtgctggtcggtctaaaggttcgaacagacttcagatttacttgctttcattcacagggagcagctgatatgctaaacgtttattttctgcaacctctagcgaaacgccgaagaactatcatcctatcagaagaagatcatcgaagtcgactcccatatgggcattgctatcgccggtctggcatcggacgctcgtgtgctctcaaactacatgaagcaacagtgccttag

SEQ ID NO: 20860 - DNA, 1023 bp, A.fumigatus
ctgatttttctgttagatatgttttcaccgcttgcatttccaactgggatgataatatatgaccttacattttccgtccctcccatatcacatttagagttgttcccattcgaaatcttccgagaacctttggttgtcatagctatagcggatggagccgagttacctgaagaaaatgaggagagtgaggcagattcagccacaaggtccggcgatcgaatgcaacccgggctagacgaactgttggacggactgcgcttgcttaaggagaaaaacactcgggcgctagttcaccagctcttgatctttgatcgtgagggcgtgagcaagctttcgagtggtcccgacggtatcatatggattccccgacctgaagcgtccaaggcgacgacgataaaaactgcgttgtgcgacatcacgtcgatactgctttctgaacttgacgagttcgcgaagacgattcaaagcgttccatttattgaatctcccaaggcctcatcttgggggccacatcgtggcccagacttgcgcacaaggcctgccgacaagctgattcaccggatgacactgcctacgcatctcccatcccaccctaatgatgcaccagagacttctttggcttccaacaagagctcgcctggtccgagtgagcatgaaacacctacgacctttgacgaaattacacggtctatccagctggctaaccgcgcaagtacctttggcaagcccaactctctaccgacctcgaaagagcatagtcgtgatcgaatgtcagtgagcggaatgagtgctactgatcgcacgaaaaaccggatcaaaggccgtacgggagtagtgattgggaccctctttcttcagacgggaagatggccagacgctcttaaagaattggtagaagcagcgacaaatgccagggctagcagtgattatgtgtggcatgccaaagctctcgagtcaatccttctttgtcttctcatgttcgcatgggcaggcatggatttccaggtgtgttctataccttag

SEQ ID NO: 20861 - DNA, 639 bp, A.fumigatus
cgaaacgccgaagaactatcatcctatcagaagaagatcatcgaagtcgactcccatatgggcattgctatcgccggtctggcatcggacgctcgtgtgctctcaaactacatgaagcaacagtgccttagctccagaatgacttacggccgcccactgccagtggatcgtatcgtcactcagattggcgaccgcgcccagaccaacactcagcaatatggcaagcgaccatacggtgttggtctgctcgttgcaggtgtcgacgaggctggaccccatctgttcgaattccagccctctggcatgacccaagagatgcttgcttgcgctatcggggctcgttcgcaaatggcgcggacttacctggagcgaaatctggacaaattcgccgactgcagccgggaagagctcattagccatggccttcgggctttgaaagagactctgtctcatgacaaggagctgacggtggacaacacatctgtcggagtggtgggacttgccggagaaggggctcagggcaagatcgagacgttcaagttatatgatggccagagcatctcaccattactggaagcccttgagcagacagattccggggagacgaaagaagaggagtcgatggaggttgattcatag

SEQ ID NO: 20862 - DNA, 1182 bp, A.fumigatus
accacgccctcgttgcctgtgatggtccagaaaagagcttcccaaggtagccggcggccttccgtgaccagcgtttcgtcctctacccccatcactccaagttttaccacctctgttattaccactactgataagcattatcctcaccaacaacaacatcgggatgcccgtcatacccgggcaacttcttggacttccggccacgatcagggcggcgaaccttcctttgccgattaccattcctctgcatctcactcacgacgccggcgcgaatccaacctctctctcgcagatctcactgagggctcttccccatcttcctcgctctccttcgaccaccccaatatggctatgaagaccacttcgtcagaatggaatccaggccatgcccgcagtcgctcccaaagtatggcgcagatgaatgcctcccaggctcattccataagtgaccccgctccccgccccggccccgtcacctggatgtccctgcctagaaagaaacaactggcgctcctgggtctctgtcgcgtcttcgacttcttgcagatcgcctccttacaagcgtacatgttctaccagctcaaatccttcgacgaaactctctccgactccgatgtctccacgcaggctggtatcctccagggcgcatttactgccgcacaattcgcgacagcaataccatggggtcgtgtggccgatgcggaatggggcggtcgcaaattcgtactgttggtcgggctggtaggcacggcggtgtcctgcctgggagtcgccttttcgacgtcgttcgcgcaggccgtgttctggcgttcgtttggcggcgcgattaacgggactgtgggcattatccgcacaatgattgcagagaatgtcaaggagaagaagtaccactctcgtgctttcttgattctacccattgggtttaatatcgctgctttgtttggccctggtaaagttctttgctttcattgctcttgcttgcgatttgacactgaccattacagtcatgggaggtatgcttgccgatcccgtcaagagctacccccggctgttcggccccaattcttcctttggaggtgcttccggtgtccagtggctcatgaaattcccctatgcgttgcccatgctggccaacgccgttttcctgtcactctgcgctacgtgtgtcgcagtgggccttga

SEQ ID NO: 20863 - DNA, 579 bp, A.fumigatus
ctcgcacctttgttgacgattgccagtgccttcaacaatctatggttgcttttcctatccacccctcgctatgattccagcgaccctgccagtcccgttcagagactgcccttcattttcaccgggggcttagggatgttgccccagagtgttggcttcgccacggcgatcctcgggatcatcggcatgctcctccaattcactgtctacccttcaatcaacggccgtctgggcacagccaagagctaccaatatttcctgtcgctctttcctctggcctatgcttttgccccttacattgctctggcgccgtcatccacaccccctccagggcaggccaacgggccttgggtgtggttctccatcattgttgtcctgttcctgcaagtcagcgctcgaacattcacactcccgacatccattatccttctgaacaactgctcaccgcacccttcagtgctcggtacgattcacggtatcggacagtcggtatcttcggcgttccggaccatcgggcctatcttttccggagcctggtacggttatggtctggagatcggcatggtcggctttgcctga

SEQ ID NO: 20864 - DNA, 189 bp, A.fumigatus
ctcgaccatctccatgacctcgacggcgatgtcggttgcgatgacattctcgacgcggatgcgggcggaggactcacggccttcgtccaggagcgtggcaagttcgcggcgctggatgacggacgaggcggtgtcctttctctggagaaggcggaggcgcggaatgaggaggcggagggtggaggttag

SEQ ID NO: 20865 - DNA, 549 bp, A.fumigatus
aacagcaacgtcttcatcatgccgtctagaaaactcacctggctcatcaccggctgctcctctggttttggtctatccctcacacgcaccgccctggccggcgggcacagggtcatagctacctcccgcaacccttctcgcaccccggagctggtcgccgagattgaaagccgagggggcagatgggtgcagctggacgttgacagcgcccagagcggcgacgtgatcacggagctcgaaaggggtggcgagcagatcgatgtcttagtcaacaacgccggctattccatctacgcgcctatcgagaccatcactgaggaggagatgcgctcgcagatggaaaccatgtactttggcccgctgcgtctaatccgcgcggttctgcctcatatgcgccagcgccggtccggcgtgattgtcaacatgagcagcggggcctccctcgacgggattcctacaatgggcgtctacgcgggtgctaaggctggtttggatggtatgcatctctttctcaaaacagttccaaagggcaatcagctaaccgcatag

SEQ ID NO: 20866 - DNA, 537 bp, A.fumigatus
gctcctctaacagacctatcgtacgttagtgatctccccgtcctgtttccttatccacgtatataccccgaacaatatgcctacatgtgtgatctcaaaaagaccctcgacgccgggggccactgcgtcctggagatgccatcgggcacaggaaagaccgtttcgctactgtcgttgatcatagcatatcagcagcattatccggaacacagaaagctcatctactgctctcgaacaatgtccgaaattgaaaaggcgctggctgagttgaaggagctgatgaagtttcgttcccagcagctgggatatacggaagattttcgagctttaggtcttaccagtcgaaaaaatttgtgcctgcatccgtcggtgaaacgagagaaaagtggcactgtcgtggacgcgaggtgcagaagtttgacggccggttttgttaaagaaaagaaggagagaggcgaagatgtcgagctatgcatctatcatgaggtatgcgccgatgttctgagaaagctttgggtagaacccctgacattttag

SEQ ID NO: 20867 - DNA, 219 bp, A.fumigatus
aacctcgaccttctcgaaccgcataacctcgttcctcctggcgtcttcactttagatgggcttttgaaatacggagaggaacacaagcaatgtccttatttttccgcccggcgcatggtaatatactgtttgaagtccttgtcggtgtgtgctaacacaggttcagatgccttattgcaacgtcattatctattcctatcattacctcctcgatcctaa

SEQ ID NO: 20868 - DNA, 456 bp, A.fumigatus
ttctacccattgggtttaatatcgctgctttgtttggccctggtaaagttctttgctttcattgctcttgcttgcgatttgacactgaccattacagtcatgggaggtatgcttgccgatcccgtcaagagctacccccggctgttcggccccaattcttcctttggaggtgcttccggtgtccagtggctcatgaaattcccctatgcgttgcccatgctggccaacgccgttttcctgtcactctgcgctacgtgtgtcgcagtgggccttgaggaggtatggagtttataccctgaagatgtgagaatcctactaacccaaccagacttcacaagcctgcaagggaaagcctggcctgggcgctttcgccatgaggctcttcgcccgtgggttgaaggctgtcgttccgtcgtcgtcacctctatattccagacttccattctccgactatga

SEQ ID NO: 20869 - DNA, 1827 bp, A.fumigatus
agtccttgtcggtgtgtgctaacacaggttcagatgccttattgcaacgtcattatctattcctatcattacctcctcgatcctaaaatcgcggagagagtgtcacgagaactttccaaggactgcatagtagtattcgatgaagcacacaacatcgacaacgtatgtattgaagcgctgagcatcgatatcaccgaagactcgttacggaaagctacgcggggcgcaaataacttggagcgaaaaatctccgagatgaagagttccgacgcagagaaactacaaaacgaatattcaaagctcgtcgaaggtttgagagaagcggagcaagcgagagacgaagaccagttcatcgcaaatccagttctaccagatgacttgctcaaggaagctgtgccaggtaatatacgacgggcggagcactttgttgccttcctcaagcgcttcatagaatatctcaaaactcgaatgaaagtcacccatactatatccgaaacgccaccgtcgttcttgacacacgtcaaggaccttactttcatcgagcgaaagcctctacggttctgcgccgaacgccttacttcactagtgcgaacactagagcttattaacattgaggattatcaaccgttacaagaagttgcaacgttcgcgactttagtctcgacatatgataaagggttcctgttgattctcgaaccattcgagtcggaaacagccacggtaccgaatccagtactgcacttcacttgcttggacgccgctattgcgatcaagcccgtcttcgatcggttcagttccgtcatcatcacttctggaacactctcgccgcttgagatgtatccgaagatgctcggcttccccaccgtcctgcaagagtcgtacactatgacacttgcccgccggtctttcctgcctatgatcgtgacacggggctcagaccaggcccagatttcgtcttcattccagatccgaaatgatcctggcgtcgtgcgcaactacggaaatattgtgttggaattctcacgcatcacacctgacggtattgtagtcttctttccatcttatctatacatggagtcgatcatcagcatgtggcaaggaatgggtatcctagactcaatatggaactataaattgatcctcgttgagacccctgacgcacaagaatcatcgctcgccttggagacctaccgaacagcatgctgcaatgggcgtggtgccatcttgttttgtgtcgctcgagggaaggtctccgaaggtatcgattttgaccatcattacggtcgtgcggtattgtgtattggagttccttttcagtacacggaatctcggattttgaaagcccgccttgaatttctacgcgagaattatcgaatacgagagaatgacttcttatcgttcgacgctatgagacacgcagcgcagtgcctgggtcgtgtcttgcgtggcaaggacgactacggaatcatggtgctagctgatcgtcgattccagaaaaaaaggaaccaactacccaagtggatcagtcaggccatgctggaaagtgaaacaaacctgagtacggatatggctgtggctactgccaagaacttcttgcgtacaatggcccagccgttcaaggccaaggatcaagaaggaatttctacatggagcttggccgacatagaacggcatcgcgagaagcagatgctggaagaagaaagagtgcgaagagaagcggtcgccaatggacgggccacgaacggtactcataacggtgcttctgccgccgcagacgaatttgacgacgatatagacgaagacctcatgatgttggatgcacagtaa

SEQ ID NO: 20870 - DNA, 498 bp, A.fumigatus
tcgcgcatggcaagcaggttgacaccctcggtgatgacatgtgcaggctcgcccttgactgggtccgcctccacatacgtgcagttgccgaggccagggatagactggatgacggcgctgcgagcggcctcttcgaccagaggcaggaggaggagcttgggggtggagatgtcatactgcagctgcacaacgcatgatgtgcctttgctggggttgaacttgaactgtgtgacttcgccatatttgcccttaatgtcctcctcgcgcaatttggtgtctttcgtctcctcgtctgtttcttcgtcggagtcgtccatgtcgacgtcagaatcctggcgacggtcctcgccactttcgtcttcatcttcatcatcttctacagcatcctgctgccggaccatgtctatttcttcctgctcgggaccttcgtacgagacctggttcgaccggttctggccgcgtcttcatccacaggggctggcaacgatccgcgcttag

SEQ ID NO: 20871 - DNA, 408 bp, A.fumigatus
cccaaccagacttcacaagcctgcaagggaaagcctggcctgggcgctttcgccatgaggctcttcgcccgtgggttgaaggctgtcgttccgtcgtcgtcacctctatattccagacttccattctccgactatgatgaggagggtcccctactgagccgaccaaacgatcccaccgagagctacgagcttgaagagaaggcggccaaacctaccaggcacgctcgcgtgttaccattccgacgaatctggacaaagaatgtcctgtgcactcttcttgcccaggcatttttcgatttccagatggggtatgtatcattatctcccgatatagctcgcacctttgttgacgattgccagtgccttcaacaatctatggttgcttttcctatccacccctcgctatga

SEQ ID NO: 20872 - DNA, 423 bp, A.fumigatus
actccttgccccagcgctcggcgagcatgccgcgcagcatggtcagctcgcgcacgtcatgcgggaagcgcggccacgcgtagaagatcacggcggcggcttcgtcgagcgctgcgtcaatgtagctcggggtctgctcctcgtcgttctcgtcggcggcttcctccgcctcggtcttgcggcctcggcccggcgtactttccgagatgtttggtgtctgcttcttcgacccaccccctgcccaaaatgaaaaccccaggaatgacttggacgcggtatccccacctccagatgacgcgtcctgagggtgagtgtgaccgtgcccgtgcttctgcgctcccatctccgctttcagggcctccttggcgcgactccgcgcgcgggcgcccttctccccgaacgcaagctgatcgaggacattga

SEQ ID NO: 20873 - DNA, 453 bp, A.fumigatus
ggctggtttggatggtatgcatctctttctcaaaacagttccaaagggcaatcagctaaccgcatagctctcaccaaaattcttgccaaagaggttgcccccttcaacatccgcaccctaaccgtcgtgctggggacgttcaataccaacatgatcaactccatcgtccttggcaagactcctctacctgaagactacaagggcaccttcaccgggcaggtccaaggcctgcttctgaacgggaagatcaagcccaacggtgacaaggacgcggccatgcaggctgtgtaccaagtggttgttggcgagggtgtgggagagggccacgaggcggagaaattgctgcctttggggagtgacatgactcctcgtctcaagggagtgcaggactatctcggtcacgccctggaggtgtttggttccgtgaccaacagcgttgatgtggataaatga

SEQ ID NO: 20874 - DNA, 861 bp, A.fumigatus
agacgcggccagaaccggtcgaaccaggtctcgtacgaaggtcccgagcaggaagaaatagacatggtccggcagcaggatgctgtagaagatgatgaagatgaagacgaaagtggcgaggaccgtcgccaggattctgacgtcgacatggacgactccgacgaagaaacagacgaggagacgaaagacaccaaattgcgcgaggaggacattaagggcaaatatggcgaagtcacacagttcaagttcaaccccagcaaaggcacatcatgcgttgtgcagctgcagtatgacatctccacccccaagctcctcctcctgcctctggtcgaagaggccgctcgcagcgccgtcatccagtctatccctggcctcggcaactgcacgtatgtggaggcggacccagtcaagggcgagcctgcacatgtcatcaccgagggtgtcaacctgcttgccatgcgcgattaccaggatatcatcaagcctcactccatctacaccaactcgatccatcatatgctcatgctctacggtgtcgaggccgcgcgcgcatctatcgtgcgagaaatgtccgacgttttccagggccacagtatctccgtcgacaaccgccatctgaacctgattggtgatgtgatgacccagtctggtggtttccgcgccttcaaccgcaacggtctcgtcaaggatagctcgtcacctctggccaagatgagtttcgagaccaccgtcgggttcctgaaggatgctgtgatcgagagggacttcgataaccttaagagccccagcagcaggatcgtggcaggtcggtctggcatggttggcacgggcgccttcgacgtgcttgctcctgtcgcatga

SEQ ID NO: 20875 - DNA, 549 bp, A.fumigatus
tcctcaatgttaataagctctagtgttcgcactagtgaagtaaggcgttcggcgcagaaccgtagaggctttcgctcgatgaaagtaaggtccttgacgtgtgtcaagaacgacggtggcgtttcggatatagtatgggtgactttcattcgagttttgagatattctatgaagcgcttgaggaaggcaacaaagtgctccgcccgtcgtatattacctggcacagcttccttgagcaagtcatctggtagaactggatttgcgatgaactggtcttcgtctctcgcttgctccgcttctctcaaaccttcgacgagctttgaatattcgttttgtagtttctctgcgtcggaactcttcatctcggagatttttcgctccaagttatttgcgccccgcgtagctttccgtaacgagtcttcggtgatatcgatgctcagcgcttcaatacatacgttgtcgatgttgtgtgcttcatcgaatactactatgcagtccttggaaagttctcgtgacactctctccgcgattttaggatcgaggaggtaa

SEQ ID NO: 20876 - DNA, 429 bp, A.fumigatus
tctattactccgctaccccacattactatgagcaaaaagttcaaatcgcaagcctcaagcagccgtgctgctgctggtgcatatggatcttttggtggattctccagtgccttctcgagtgcaggaagagccccttcctctctcacatatgtcaccgcgccaccagatctgtcgcgaattgcggatgcgaaactggccatttctttcaaaaacttcctgaagaaggatgaagttacgagaataaaagcattagatgagattaaagattatgtattgaccgtcgaaagtcgtgatgccactctggatgacgggtttttggatgcttgggtatgtctacaagcttatctagcagataggaatttgatgttgattgtatttcgcagatcaagatttatccacgggcctcgattgacctttcccgtagggtaa

SEQ ID NO: 20877 - DNA, 768 bp, A.fumigatus
atcggcataacaggcacctacgtccgcaccaccgccatcgaccgactcgttgcgcgattcttggaaggaccctcacagacgaaaaagcaaatcatctcgctaggcgcaggatctgacacgcgcgtcttccggttgctttcctctcgctcgtccgcctcaagctcagatctaatctatcacgagatcgacttctccgccaacaccgccgcaaagatcaagttcatccgtgcagcgcctctcttacaacggacactaggacttgggagtgcccagaatgtagccatacccgactccggcgacgcattgcactccccgacataccacctccaccctgttgatctccgaacactcgcagcatcagggtcggcaaccacgtcgcgaagcccatcatcacccaatccggcggaaaaggatcaaccaccctgtccgctacagggtgtcgacccgacactccccacgttactcatctcagaatgctgccttgtgtacctctcacctcgcgaagcggccgatgttgttgactattttaccaagactctttttccggcgagtgtgccattgggtttaattatctacgagcctatccgacccgacgacgcctttggacgaaccatggtcgccaaccttgcgacgcgcgggatccagctgcagacactgcatgagtatgcgtcgctcgaggctcagcggagacggttacgggagcccgggcttcatacgggacaggcgggggcggatattgatttcatctgggatccgtgggtgagttag

SEQ ID NO: 20878 - DNA, 192 bp, A.fumigatus
gacatcgatctgctcgccacccctttcgagctccgtgatcacgtcgccgctctgggcgctgtcaacgtccagctgcacccatctgccccctcggctttcaatctcggcgaccagctccggggtgcgagaagggttgcgggaggtagctatgaccctgtgcccgccggccagggcggtgcgtgtgagggatag

SEQ ID NO: 20879 - DNA, 1248 bp, A.fumigatus
gaagatacgaacactaacacagcatccaagaccagactaacctccaccctccgcctcctcattccgcgcctccgccttctccagagaaaggacaccgcctcgtccgtcatccagcgccgcgaacttgccacgctcctggacgaaggccgtgagtcctccgcccgcatccgcgtcgagaatgtcatcgcaaccgacatcgccgtcgaggtcatggagatggtcgagctatactgcgagctgctcctcgcgcgcgtcaatgtcctcgatcagcttgcgttcggggagaagggcgcccgcgcgcggagtcgcgccaaggaggccctgaaagcggagatgggagcgcagaagcacgggcacggtcacactcaccctcaggacgcgtcatctggaggtggggataccgcgtccaagtcattcctggggttttcattttgggcagggggtgggtcgaagaagcagacaccaaacatctcggaaagtacgccgggccgaggccgcaagaccgaggcggaggaagccgccgacgagaacgacgaggagcagaccccgagctacattgacgcagcgctcgacgaagccgccgccgtgatcttctacgcgtggccgcgcttcccgcatgacgtgcgcgagctgaccatgctgcgcggcatgctcgccgagcgctggggcaaggagttcatgacgctggcgcaggacaacaagctggtggacgtgagggtgccggagcggctggtcaagggactgcgtgtgaagccgccggcgcaagagctcgtcgagagctatctccgggagattgcaaaggcgtatgggagttcgtggggagcacaggcccagagccagagccagagcgagagcgagctcggcgaggcgccccgggagtttgtcggcgatcggcctggcgatactgaccaacctggcgatggcgatggcgatggcgatgctgccgtcccttccacgcagacccggccagtcaacatggctgaggcgcggcgcgcttctgagacctcggagttgaataaggcgacgccaccccgggggttccagtccgtcaagagccccgtcagtgttgcgccgccggggccgcggtcagataaccccaatccacgtgtcaaggttcccggcagtgagatccagtccgagacgcaggtggaggagcctcccagggcgcggaacggtaatgcgggtggttcgggggggataccggaattggatgagctggctcgacggtttgctgcattgcggcggtga

SEQ ID NO: 20880 - DNA, 531 bp, A.fumigatus
aagatgatgaagatgaagacgaaagtggcgaggaccgtcgccaggattctgacgtcgacatggacgactccgacgaagaaacagacgaggagacgaaagacaccaaattgcgcgaggaggacattaagggcaaatatggcgaagtcacacagttcaagttcaaccccagcaaaggcacatcatgcgttgtgcagctgcagtatgacatctccacccccaagctcctcctcctgcctctggtcgaagaggccgctcgcagcgccgtcatccagtctatccctggcctcggcaactgcacgtatgtggaggcggacccagtcaagggcgagcctgcacatgtcatcaccgagggtgtcaacctgcttgccatgcgcgattaccaggatatcatcaagcctcactccatctacaccaactcgatccatcatatgctcatgctctacggtgtcgaggccgcgcgcgcatctatcgtgcgagaaatgtccgacgttttccagggccacagtatctccgtcgacaaccgccatctga

SEQ ID NO: 20881 - DNA, 531 bp, A.fumigatus
gaatttgatgttgattgtatttcgcagatcaagatttatccacgggcctcgattgacctttcccgtagggtaaggcagacagctcattcagctcaaggatccattgcctctgttgttggcaaaaggatagccccgtatttgcctaaggtaattggggcatggcttgcaggattctacgataatgaccgacccgtgcatcgagctgccctagagtcgttcatgctggtgttcacaaccgaagagaaaagaaacggagtatggaaagtctaccagagctcaattctcgactttgtagatgatgttattctgcaacaaactcctcaaactctcagtgatgaaaggacagtgaagcctgatgatgcggaggcaaagtatgctcgtgtagtggggacagctctcctgctattgaatcgagtcataggtgtgtatatcatttcccaaaattgttcaccagttctgactttattcagcaaattcaactcacgaagacctccaaaaggatctggccacggtagagaatctactgaatag

SEQ ID NO: 20882 - DNA, 1491 bp, A.fumigatus
atgtttgctggaagtaacttcagcacgaccgcaattgtgggcggaagattactccggaaagactacgtcttccaagagactccttcaatacatccagaaaggctcccagggaggcgtggcctccttttggtcaatcttcgccaactactgcagattatacctgtgaaagtgctggcgaaaactgatccgcaggcatctacttgccgcatgattgggctatctagtgcaactttgttgacggaagcgtttcaacttggagtgaattcaagagaagagccgcggcaaaatcaagctctgggttggaagtcttacattgagacaggcatttggctaactagttccctacccgacagcgatagggacgcttttctacacacaaggctatctcctctagttacccagtacgtgagagctgagcaaaatgcgccgcaatggacgctcccgaatcagaatgccgtagctctctgcacagagtattctgtcgcgttagctaatggcaattacgggagcgaattccagcggctgtggaccgatttagcggatggtctgctcaaatccgtcaaactatctgctccagagcagtcaaaggaattcagatcgtcacaagatgccgtatgtgcgcaagctgaacggctctttgctctggaggcttcagtgcttgcaagtgtagccgactcagaggcgagagcctccgtgtccaacattcttagcaagacaaacttgccacttctggacaattgcttgcaagtattgcgctctcggaatggcaagccttatgctgctgctgcggtcgttgaagagatgatccgcaacgctgcagatattgcacagcaatctcgagaattggcggattttgttcagaatgatgcccccgaattgttgtcctctccatcggctgaccgcctcgtatcagtcatcttatcctgccgttcttgggacggattcggctctagctttgacacagtggtagaacgagtggcggaatccgaaccggagcaatcaaatacacatgctgtccagaagctactttcaactctcgatttcaaagaagtgcatgacaaaacaggtcttgactcattgatcaaacgggctttggaccaagcttgcagaggtagccgattccactggccgattgtgatcgcggcacttcagaaccagacatcgcacggcgaactaacagactcgatttttttgattatcgttgattcattgtctgagccaacgaaggttttcgaggcgctgcatgggctgtctcagatcgccaaatctgtcccggatgcgctcagcaaatttcaggccggagcccatggatcgaaattagctggaaggcttctgtttctggcagaaacttctgacgaggaagtggccagccttgcagagtcagtgctaacagaattcaaagagattggagtcggtgagacgagcgccaagtcgagtttcgagctcttgcaatacaatttcgatcacgtcaatgaggaatccctttcgtaa

SEQ ID NO: 20883 - DNA, 1422 bp, A.fumigatus
catctttcaaggattgggtccctgctaagcatagcagaagacttactcggtgccgctgacccggaggcccgggcctccatcgctaaagatatcttgccctctcgtcaaacgtgggagacggccttgcggccattcctggagcttcctcctcgcccatcgacagctatcacaagtccgcttggcgggactgttcatttagtaaaccctgagatatcagatacacttaaggaacagtaccacactattcctcgtgattccagtgggtgttcgtccgcgtttcgactcgcatatttcaccattcgtgttctttcatcgttcgatataatgggcaatttgtcggcagaggagcaggagacgctgtttcactacatacccttagctgtacagctgattgacgacgatttgagcattgaaaattgcaacggtattactggattaacacactcggaccaacgagaagaatacttggagattgtttacgatggccgcaaagtgatgaaccagtggacgggttcagacggccgtcagtctgaagcgaatgcgacagtcgccttaagaaccctgtccttctggcagaacaaactcgaagctctaaacaatacctctccgacggactatcgaattggagaagcctttgtcaggctgatgaacagcctcgactctgctaacaagagtaaatccacagaggatatcactaacatctgtagggaaatgcgaagcgcgaatgcgattcgatcggcatcctgggtggcagtcttacgggaatccattctaggaaatccgacgggcaaccggctgtgcaatgaactggtcgcagactctacgggcttgaagcctcaagatgagaagaaggaaggtaggttgccaataggatcatcccttggcgactctactgatgcgcttcaaggtctccgaaaactgtctttgcttaatcttcttcttgcgggggaaataaacgtggcgtcaaccattccgactcagcgtctagtcttccttgtcaagcatctcatacaatgtctccagtccaaggacttgccgctcaatattcaagccgagatcatgcataccctgacctttgtccttccttacctgaatgagatatatgggtctcattgggaagactgcatggaagctctcagcacagtttggcgcgagactagcgggggcgatgaagctctacccctactccttggttccttcagacttttcgcaagcctgaggtcaatcgttgctgaagaagacagcaatgatgatgtcaaagacgcctggtcagaacgcaagacagtcctttttaacggcttagcctcaacccttacaaaattcggtgagctagaatgcatccctcgcattgagatgtgcaacggactgattttgagcagactacaccattgctttccatcagccccgagatgttaccgttga

SEQ ID NO: 20884 - DNA, 291 bp, A.fumigatus
ccactttgtcaacgcggtatgcctcaacacgctttcgagtacacaatcaagcagttgctaatcttcatacaaaagtctctcccggttcaggagcaatatgttgcaagtatcaaggacagcgatagccttggtccattgctagagttcatgtttgatttccttcagcagcccaacaataaactggtggatgcttcgaagtttgacattcgctcttttgaacctgatcaatccgagactcaagagaaagaggcccccaatggcttttggtccacctatactttttgtgtctga

SEQ ID NO: 20885 - DNA, 528 bp, A.fumigatus
tctgagatctcgcctttgatcatcgaagactcactcaagggggtgaataagtggatgaccacgcaggatcccaacgaagagcgcgcgctttcagtgaagatctctcccaagaccgcggagatcatcgcgagcatccctgttgatgaagagtcgcccccagttgcgctgtcgatctcccttcctccagcgtatccactccagcctgccctcgtcgtggggcggagccgagtgctggtcgacgagaggaagtggaagagctggctgctcaccattcagggtgtgatcatgttctccaacggcaatcttgtggacggactgatggccttccgcaagaacgtgcagggcgctttgaagggccagagcgaatgtgccatctgttactcggtgatctcgacggacatgcagacgccgaataagcgatgcgccacttgcaagaacaccttccattcggtgtgtctcttccgctggttcaagagcagcaaccagagtacctgccctctgtgccgcaacaactttgtatatgtatag

SEQ ID NO: 20886 - DNA, 417 bp, A.fumigatus
gggagagacctagggacaactgtcgtcaggatgagattcgacatgatttccggcgcctctgcgctgctgtggttcgtcgccagtgttgaggcatccaagcatgcgcatcgacaccaaatgagaaatgaacacagtgccgtgcactccgttgcagaagttggagcgccattggagaagagaggagggaaatgccagttccccaccgatgccggcctagtcgctgtgactccgaacatgaagaacgccggatgggcgatgagccccgatcaggcctgcgagcctggcaattactgcccgtacgcttgtcccccaggccaggtatccatgcagtgggaccccgaagcgacctcgtattcgtaccccaagtccatggtgagttttccattgggtggtttcattccaacgggacgatcctga

SEQ ID NO: 20887 - DNA, 237 bp, A.fumigatus
aatggcggtctctattgcgacaagaacggtcagatcaagaagccgttccccgataagccgtattgccaggacggcacgggtgccgtgggcgcgaagaataagtgcagcaagcaggttgcgatctgccagactgtgctgcctggaaacgaggccatgttgattcccacgctggtcgaggacacagctactcttgccgtgcctgacctcagctactggtgtgaaaccgccgctcagtaa

SEQ ID NO: 20888 - DNA, 897 bp, A.fumigatus
gtgcatccggtgaggatactcttatctcatctcgtattgaccgttgtcagcttctatatcaaccctcccggctatgacaccgagaccgcttgtgtctggggtacttctgccaaacccatcggtaactggtcaccttatgttgccggcgcaaacaccgacggagacggcaacacgttcgtgaagattggatggaaccccatctatctggagcccaccacgcccttccgcgacgtcgtcccagactttggtattgagatcgagtgcgagggcgatggctgcaacggccttccatgcaagatcgaccccgcggtgaacgcggtcaacgagatgatcgggagcacctccgttggagccggaggcgccaccttctgtgtggtgacggtccccaagggcgaaaaggccaacgttgtggtctttgaaaagtccggcggcggcagcggcagcagcggtggtgatgacgattcccactccacaaccgcggcaccctctaagcccagctccaccaccagaacaacctcgtccagcatagagtcctccagcacgtcgacttctgcttcgtcatcctcatcgaaacccactgacacagactcgagctcgagcagcgccacggtcacgccctccgccagcagcgaccccagctcatcggccaaggcatccagcgccggacaggcttccgaatcggggacattctcgtacacgtacaagcctcatgtgttcgtcgagcagtcggtctcagtgcaggccatggcggacgaaacggctggtccggcacaagccacggccactcccacccctgcctccaaggagaaggagaaggagggcagtgccgccgatgttgccgtctccgtgctgactctgggcatgggcgccgttgcggccatcatgatcaacctgtag

SEQ ID NO: 20889 - DNA, 390 bp, A.fumigatus
gcgcggggcttgcctggccggaattcacaatttcacctttggggcgggggagtgattccttttgcaagagggattggaaaggacccagcggggtttcggataggcggttcaagggacccttgtttgatacggggttggttgggggttccgccccgatcccttggtgaggtttgggtggcaaaaaccttccccttcaacgggccccggcaggccccggggggttttgagggggggccccggacacctttctccggagacgcgggggggccaccgggggacggccggtcccctggggatctccacctccatggactctcgccagttggcccggccgagatggcccgcggggaccccggggcgccgccgccgcctggtgacgaagggcagtga

SEQ ID NO: 20890 - DNA, 408 bp, A.fumigatus
  unsure (343): Identity of nucleotide sequences at the above locations are unknown.
ccagttggcgggagccccttgggcaggccggccgccggcaggcaagggcgcgcgccatggacagacgctggccgagcgacacactcgcagggcaccgggggtgacccctttggccggggccccccctgggaccgacaccgggtcgagaaacacccagacggacacgggaagcgcccacaggtgaccaattgggccgggcgcgcccccccttgttcggcccggaaaaccccccgccctcctcggggacacttgcagcgaacacccccttgggccgttccgcctcaacgggattccggatatggcccgcccggggggttccctcccgtgggggaatccccaaacncccccccatccctcccattttttttttgttgcaatttgcccccccttctcccccccgaagttctg

SEQ ID NO: 20891 - DNA, 402 bp, A.fumigatus
tacggggttggttgggggttccgccccgatcccttggtgaggtttgggtggcaaaaaccttccccttcaacgggccccggcaggccccggggggttttgagggggggccccggacacctttctccggagacgcgggggggccaccgggggacggccggtcccctggggatctccacctccatggactctcgccagttggcccggccgagatggcccgcggggaccccggggcgccgccgccgcctggtgacgaagggcagtgaccagttggctggggcacatggccgcacgggcggcgcgcggtctgccggcgcaggtgggcctccccccggaacgacgttcggacccgggaacgtttgcgcgcacgatgatgggccgggcgaggtcggtgggtatgtgtag

SEQ ID NO: 20892 - DNA, 588 bp, A.fumigatus
gcgcgcgccctcgaggcgagcagagagtcgcgcgcgcgagggcgacgaagggagggcgaggagggcgaggagggggaggcgcgcaggcgagcgcgcggcggccagttggctggccgagttggcgcggcggggggcgccgcgcgggcgggcggcagggtgaccagttggcgggagccccttgggcaggccggccgccggcaggcaagggcgcgcgccatggacagacgctggccgagcgacacactcgcaggcaccgggggtgaccagttggccggcgcgcgccagggaccgacaccgggtcgagagacacccagacggacacgggaggcgccagaggtgaccagttggccggcgcgcgcgcgcccttgtcggcaccggagagccgcgcgccgtctacggggacacttgcagcgacacgcacatggccgtcggcctcgacggatgccggcatggcccgccggcggcatccatccgtggggatacgcagacacccacccatccatccatatatatatgtgcatatgcacccgcatccccccccgacatctgcacggaggtaggtcggcatggcccaccggtgccatctag

SEQ ID NO: 20893 - DNA, 450 bp, A.fumigatus
ccagctagcgagctaccgatccatccatcgcgatacacggacagacacacagaccccgcggccgatataggccgggcgcgcgcgccctgccgcagcgagcgatgggccgcgcgcgcggaggggaccggtgggcaggcgggcgcaggcttcgagggccgaccggccctgcgcgcgcgagacggcgcgagtgaccaagtccccttgcggcccaagcaacgggcgaacctgagaggcccactttgtatgggcgcgcgggccaacgcacggaccaccccatacagaatgggccccccgccagccagatccggacccgggaacgtttgcacgcacgatcatggcccggtcgaggtcggtggttctatgtggaaggcgagagccgcgtcacctctggtggcgtgcgagctctgcgccggccacttcttccctgccaggcaggccgcctctctgtga

SEQ ID NO: 20894 - DNA, 450 bp, A.fumigatus
tgggccgggcgaggtcggtgggtatgtgtaggagaagggccgccggcggcgcgcgcgagggtcccggttgaggggagtcggttgaggggggctgggggcccggtaggcgcgcgccctcgaggcgagcagagagtcgcgcgcgcgagggcgacgaagggagggcgaggagggcgaggagggggaggcgcgcaggcgagcgcgcggcggccagttggctggccgagttggcgcggcggggggcgccgcgcgggcgggcggcagggtgaccagttggcgggagccccttgggcaggccggccgccggcaggcaagggcgcgcgccatggacagacgctggccgagcgacacactcgcagggcaccgggggtgacccctttggccggggccccccctgggaccgacaccgggtcgagaaacacccagacggacacgggaagcgcccacaggtga

SEQ ID NO: 20895 - DNA, 579 bp, A.fumigatus
aaacgcccgggagcccacatcgctgggatgaccgaagcccgggggccgtttggtccccggcaccgatggagtctgtggatcgttggccgctggccagtcctgatacccagattcccggggggagccgccccgcgggagccgccctttgtgggcgtgtccgcggggtctggaccccccacccgagggccgtatgccgcagcccgccagcgcccgcgagggcgatctgacgggatcacctgcgtgcggaccggttctgaggggctacagtgggggcaattggatggtcgtcgtcgctcccccggtgcgccgggggcggtcggcgcggccgggcgacgcatgtcgccccttctggattcacctacatacactccgcccctccgggggctcgtgggcccggcgcggtcagccccgtttgcgcggtggtcggctggcgcgggcgcccatcaggtattaggtatctggttgattctgccagtagtcatatgcttgtctcaaagattaagccatgcatgtctaagtataagcaatttatacggtgaaactgcgaatggctcattaaatcagttatcgtttatttga

SEQ ID NO: 20896 - DNA, 426 bp, A.fumigatus
agtgaccaagcgggtcgtgtaagcggtcaagtagccttgttgctacgagtcgctgagcgtcagcccgatccttggctagatttgttggcaaacacctcccatcaacgggcccggcagcgccgggcgcttggaggggggcccagacacctttctccggagacgcgggggggcaccggtgacggccggtcccctcgggatctccacctccatggactctcgccagttggccggccgagatggccgcggggacccgcgcgccgccgccgcctggtgacgaagggcagtgaccagttggctggggcacatggccgcacgggcggcgcgcggtctgccggcgcaggtgggcctccccccggaacgacgttcggacccgggaacgtttgcgcgcacgatgatgggccgggcgaggtcggtgggtatgtgtag

SEQ ID NO: 20897 - DNA, 1107 bp, A.fumigatus
  unsure (66): Identity of nucleotide sequences at the above locations are unknown.
cagaacttcgggggggagaagggggggcaaattgcaacaaaaaaaaaatgggagggatgggggggngtttggggattcccccacgggagggaaccccccgggcgggccatatccggaatcccgttgaggcggaacggcccaagggggtgttcgctgcaagtgtccccgaggagggcggggggttttccgggccgaacaagggggggcgcgcccggcccaattggtcacctgtgggcgcttcccgtgtccgtctgggtgtttctcgacccggtgtcggtcccagggggggccccggccaaaggggtcacccccggtgccctgcgagtgtgtcgctcggccagcgtctgtccatggcgcgcgcccttgcctgccggcggccggcctgcccaaggggctcccgccaactggtcaccctgccgcccgcccgcgcggcgccccccgccgcgccaactcggccagccaactggccgccgcgcgctcgcctgcgcgcctccccctcctcgccctcctcgccctcccttcgtcgccctcgcgcgcgcgactctctgctcgcctcgagggcgcgcgcctaccgggcccccagcccccctcaaccgactcccctcaaccgggaccctcgcgcgcgccgccggcggcccttctcctacacatacccaccgacctcgcccggcccatcatcgtgcgcgcaaacgttcccgggtccgaacgtcgttccggggggaggcccacctgcgccggcagaccgcgcgccgcccgtgcggccatgtgccccagccaactggtcactgcccttcgtcaccaggcggcggcggcgcgcgggtccccgcggccatctcggccggccaactggcgagagtccatggaggtggagatcccgaggggaccggccgtcaccggtgcccccccgcgtctccggagaaaggtgtctgggcccccctccaagcgcccggcgctgccgggcccgttgatgggaggtgtttgccaacaaatctagccaaggatcgggctgacgctcagcgactcgtagcaacaaggctacttgaccgcttacacgacccgcttggtcacttcagtcgtctgcagaggattcatccccgcgcgaggtga

SEQ ID NO: 20898 - DNA, 1080 bp, A.fumigatus
atggcaccggtgggccatgccgacctacctccgtgcagatgtcggggggggatgcgggtgcatatgcacatatatatatggatggatgggtgggtgtctgcgtatccccacggatggatgccgccggcgggccatgccggcatccgtcgaggccgacggccatgtgcgtgtcgctgcaagtgtccccgtagacggcgcgcggctctccggtgccgacaagggcgcgcgcgcgccggccaactggtcacctctggcgcctcccgtgtccgtctgggtgtctctcgacccggtgtcggtccctggcgcgcgccggccaactggtcacccccggtgcctgcgagtgtgtcgctcggccagcgtctgtccatggcgcgcgcccttgcctgccggcggccggcctgcccaaggggctcccgccaactggtcaccctgccgcccgcccgcgcggcgccccccgccgcgccaactcggccagccaactggccgccgcgcgctcgcctgcgcgcctccccctcctcgccctcctcgccctcccttcgtcgccctcgcgcgcgcgactctctgctcgcctcgagggcgcgcgcctaccgggcccccagcccccctcaaccgactcccctcaaccgggaccctcgcgcgcgccgccggcggcccttctcctacacatacccaccgacctcgcccggcccatcatcgtgcgcgcaaacgttcccgggtccgaacgtcgttccggggggaggcccacctgcgccggcagaccgcgcgccgcccgtgcggccatgtgccccagccaactggtcactgcccttcgtcaccaggcggcggcggcgccccggggtccccgcgggccatctcggccgggccaactggcgagagtccatggaggtggagatccccaggggaccggccgtcccccggtggcccccccgcgtctccggagaaaggtgtccggggccccccctcaaaaccccccggggcctgccggggcccgttgaaggggaaggtttttgccacccaaacctcaccaagggatcggggcggaacccccaaccaaccccgtatcaaacaagggtcccttga

SEQ ID NO: 20899 - DNA, 867 bp, A.fumigatus
ggcggaacggcccaagggggtgttcgctgcaagtgtccccgaggagggcggggggttttccgggccgaacaagggggggcgcgcccggcccaattggtcacctgtgggcgcttcccgtgtccgtctgggtgtttctcgacccggtgtcggtcccagggggggccccggccaaaggggtcacccccggtgccctgcgagtgtgtcgctcggccagcgtctgtccatggcgcgcgcccttgcctgccggcggccggcctgcccaaggggctcccgccaactggtcaccctgccgcccgcccgcgcggcgccccccgccgcgccaactcggccagccaactggccgccgcgcgctcgcctgcgcgcctccccctcctcgccctcctcgccctcccttcgtcgccctcgcgcgcgcgactctctgctcgcctcgagggcgcgcgcctaccgggcccccagcccccctcaaccgactcccctcaaccgggaccctcgcgcgcgccgccggcggcccttctcctacacatacccaccgacctcgcccggcccatcatcgtgcgcgcaaacgttcccgggtccgaacgtcgttccggggggaggcccacctgcgccggcagaccgcgcgccgcccgtgcggccatgtgccccagccaactggtcactgcccttcgtcaccaggcggcggcggcgcgcgggtccccgcggccatctcggccggccaactggcgagagtccatggaggtggagatcccgaggggaccggccgtcaccggtgcccccccgcgtctccggagaaaggtgtctgggcccccctccaagcgcccggcgctgccgggcccgttgatgggaggtgtttgccaacaaatctag

SEQ ID NO: 20900 - DNA, 225 bp, A.fumigatus
caacaaggctacttgaccgcttacacgacccgcttggtcacttcagtcgtctgcagaggattcatccccgcgcgaggtgacattgcaatccgccagccagcccccgggggtttctccccgggggccgtcgccagcctgctgaggtacatggcccggaggcctattcgtatccaactacgacgtgcggggctacatcgccgcgttccggcacggattctgacttag

SEQ ID NO: 20901 - DNA, 249 bp, A.fumigatus
tctttcgcccctatacccaaatttgacgatcgatttgcacgtcagaaccgctgcgagcctccaccagagtttcctctggcttcgccctattcaggcatagttcaccatctttcgggtccccacagctacgctcgtactcaaatccatccgaagacatcaggatcggtcgatggtgcgccccgcgagggggctcccacctccgttcgctttcactgcgcgtacgggtttgacacccgaacactcgcgtag

SEQ ID NO: 20902 - DNA, 576 bp, A.fumigatus
aaaaataaagttgggtgtcggctggcgccggccgggcctacagagcaggtgacaaagccccatacgctcgaggaccggacgcggtgccgccgctgcctttcgggcccgtcccccgggagagggggacgggggcccaacacacaagccgtgcttgagggcagcaatgacgctcggacaggcatgccccccggaataccagggggcgcaatgtgcgttcaaagactcgatgattcactgaattctgcaattcacattacttatcgcatttcgctgcgttcttcatcgatgccggaaccaagagatccgttgttgaaagttttaactgattacgataatcaactcagactgcatactttcagaacagcgttcatgttggggtcttcggcgggcgcgggcccgggggcgcaaggcctccccggcggccgtcgaaacggcgggcccgccgaagcaacaaggtacgatagacacgggtgggaggttggacccagagggccctcactcggtaatgatccttccgcaggttcacctacggaaaccttgttacgacttttacttcctctaaatgaccgggtttga

SEQ ID NO: 20903 - DNA, 1164 bp, A.fumigatus
ctggctagatggcaccggtgggccatgccgacctacctccgtgcagatgtcggggggggatgcgggtgcatatgcacatatatatatggatggatgggtgggtgtctgcgtatccccacggatggatgccgccggcgggccatgccggcatccgtcgaggccgacggccatgtgcgtgtcgctgcaagtgtccccgtagacggcgcgcggctctccggtgccgacaagggcgcgcgcgcgccggccaactggtcacctctggcgcctcccgtgtccgtctgggtgtctctcgacccggtgtcggtccctggcgcgcgccggccaactggtcacccccggtgcctgcgagtgtgtcgctcggccagcgtctgtccatggcgcgcgcccttgcctgccggcggccggcctgcccaaggggctcccgccaactggtcaccctgccgcccgcccgcgcggcgccccccgccgcgccaactcggccagccaactggccgccgcgcgctcgcctgcgcgcctccccctcctcgccctcctcgccctcccttcgtcgccctcgcgcgcgcgactctctgctcgcctcgagggcgcgcgcctaccgggcccccagcccccctcaaccgactcccctcaaccgggaccctcgcgcgcgccgccggcggcccttctcctacacatacccaccgacctcgcccggcccatcatcgtgcgcgcaaacgttcccgggtccgaacgtcgttccggggggaggcccacctgcgccggcagaccgcgcgccgcccgtgcggccatgtgccccagccaactggtcactgcccttcgtcaccaggcggcggcggcgccccggggtccccgcgggccatctcggccgggccaactggcgagagtccatggaggtggagatccccaggggaccggccgtcccccggtggcccccccgcgtctccggagaaaggtgtccggggccccccctcaaaaccccccggggcctgccggggcccgttgaaggggaaggtttttgccacccaaacctcaccaagggatcggggcggaacccccaaccaaccccgtatcaaacaagggtcccttgaaccgcctatccgaaaccccgctgggtcctttccaatccctcttgcaaaaggaatcactcccccgccccaaaggtga

SEQ ID NO: 20904 - DNA, 969 bp, A.fumigatus
  unsure (67): Identity of nucleotide sequences at the above locations are unknown.
gcagaacttcgggggggagaagggggggcaaattgcaacaaaaaaaaaatgggagggatgggggggngtttggggattcccccacgggagggaaccccccgggcgggccatatccggaatcccgttgaggcggaacggcccaagggggtgttcgctgcaagtgtccccgaggagggcggggggttttccgggccgaacaagggggggcgcgcccggcccaattggtcacctgtgggcgcttcccgtgtccgtctgggtgtttctcgacccggtgtcggtcccagggggggccccggccaaaggggtcacccccggtgccctgcgagtgtgtcgctcggccagcgtctgtccatggcgcgcgcccttgcctgccggcggccggcctgcccaaggggctcccgccaactggtcaccctgccgcccgcccgcgcggcgccccccgccgcgccaactcggccagccaactggccgccgcgcgctcgcctgcgcgcctccccctcctcgccctcctcgccctcccttcgtcgccctcgcgcgcgcgactctctgctcgcctcgagggcgcgcgcctaccgggcccccagcccccctcaaccgactcccctcaaccgggaccctcgcgcgcgccgccggcggcccttctcctacacatacccaccgacctcgcccggcccatcatcgtgcgcgcaaacgttcccgggtccgaacgtcgttccggggggaggcccacctgcgccggcagaccgcgcgccgcccgtgcggccatgtgccccagccaactggtcactgcccttcgtcaccaggcggcggcggcgcgcgggtccccgcggccatctcggccggccaactggcgagagtccatggaggtggagatcccgaggggaccggccgtcaccggtgcccccccgcgtctccggagaaaggtgtctgggcccccctccaagcgcccggcgctgccgggcccgttga

SEQ ID NO: 20905 - DNA, 408 bp, A.fumigatus
agccaatccttatcccgaagttacggatccattttgccgacttcccttatctacattgttctatcaactagaggctgttcaccttggagacctgctgcggttatgagtacgacctggcgtgaaaactattccttcccgcggattttcaagggtcgtcgggggcgcaccggaccccgcaaaggtgcggggctctgccagccatggaaccctagctccggacaaaccgatttcagggtggaaggctgtcaagaagaaaagagaactcttcccaggacccccgccgacgtctccgcgttcagttacgttgccgtggagaatccacatccaggtgccggaatgttaaccggcttccctttcggcacacggcgcacgagggcgcctttcaaacggaacttccctatgccttag

SEQ ID NO: 20906 - DNA, 198 bp, A.fumigatus
ttcattcggcccgtgagttgttacacactccttagcggattccgacttccatggccaccgtcgggctgtctagatgaactaacaccttttgtggtgtctgatgagcgtgcattccggcaccttaacctcgcgttcggttcatcccgcatcgccagttctgcttaccaaaaatggcccactagtaacgcttcattctaa

SEQ ID NO: 20907 - DNA, 804 bp, A.fumigatus
acggcgcgcggctctccggtgccgacaagggcgcgcgcgcgccggccaactggtcacctctggcgcctcccgtgtccgtctgggtgtctctcgacccggtgtcggtccctggcgcgcgccggccaactggtcacccccggtgcctgcgagtgtgtcgctcggccagcgtctgtccatggcgcgcgcccttgcctgccggcggccggcctgcccaaggggctcccgccaactggtcaccctgccgcccgcccgcgcggcgccccccgccgcgccaactcggccagccaactggccgccgcgcgctcgcctgcgcgcctccccctcctcgccctcctcgccctcccttcgtcgccctcgcgcgcgcgactctctgctcgcctcgagggcgcgcgcctaccgggcccccagcccccctcaaccgactcccctcaaccgggaccctcgcgcgcgccgccggcggcccttctcctacacatacccaccgacctcgcccggcccatcatcgtgcgcgcaaacgttcccgggtccgaacgtcgttccggggggaggcccacctgcgccggcagaccgcgcgccgcccgtgcggccatgtgccccagccaactggtcactgcccttcgtcaccaggcggcggcggcgccccggggtccccgcgggccatctcggccgggccaactggcgagagtccatggaggtggagatccccaggggaccggccgtcccccggtggcccccccgcgtctccggagaaaggtgtccggggccccccctcaaaaccccccggggcctgccggggcccgttga

SEQ ID NO: 20908 - DNA, 192 bp, A.fumigatus
aggggaaggtttttgccacccaaacctcaccaagggatcggggcggaacccccaaccaaccccgtatcaaacaagggtcccttgaaccgcctatccgaaaccccgctgggtcctttccaatccctcttgcaaaaggaatcactcccccgccccaaaggtgaaattgtgaattccggccaggcaagccccgcg

SEQ ID NO: 20909 - DNA, 537 bp, A.fumigatus
aattatgaaagattaaaaaattttttttttatgaataatatatttttattaaacgattatattactaatggattcagaatagaatttgttgatatgatttatttaatttctattttgtttggagtattaactattgtaagtagaaatcctatcgtatctgtattatttttaataggtttgtttgttaatattgctggtttattaatattagtaggatataattacataggattatcttatattttagtgtatgtaggagctgtatcaattttattcttattcatattaatgttaataaatattagaatatctgaacttttaagtgaaactaataatgatatacctttagctgttttaacagttttacttttctattatattgtaggacaagtattaccttctaatttaacagataatacaattgtttcttatttatcaaattcattttctgaagtatataatgttcaattagataatgaattttttaatatagtagatttaaaacaagaaatagcttatgcaagtagtaaaggttga

SEQ ID NO: 20910 - DNA, 315 bp, A.fumigatus
ttaattgtgtgtaggatgtatgttgtatgtaattctatattagttaaggttaccttacttaaagggttgaacactaatatttattctaaaatgctacaagctgctaaaattattggtacaggattggctacaacaggattaatcggtgctggtgtaggtatcggtgttgtattcggtgcattaatactaggtgtcgctagaaatccttcattaagaggacaattattctcatatgctatcttaggtttcgcttttgctgaagctactggattattcgcattaatgatggctttcttattattatatgttgcttaa

SEQ ID NO: 20911 - DNA, 252 bp, A.fumigatus
tatatatttaggtgtagatggtttatcaatatattttgtattattaacaactataataatgcctatagcaatattatcaaattgaaattcaatacaatcacaaaatgtattgtcatttgtagtaataatgttattattagaaacattattattagcagtattcttagtattagatgtattgttattctatatattcttcgaaagtattttaccaccattatttttattaataggattatttggttcaagtaa

SEQ ID NO: 20912 - DNA, 183 bp, A.fumigatus
ttttgcatcaacatcacattttatcttaacattctcaatgagtttcactgttgttttaggtgcaacattcttaggattccaaagacatggattaaaattcttttcattatttgtaccttcaggttgtcctttagcattattacctttattagttttaatcgaattcatttcatacttatctag

SEQ ID NO: 20913 - DNA, 312 bp, A.fumigatus
ccaccattaggaatacaaggtgtaaatcctttcgaattaccattattaaatacaataatcttattatcatcaggtgtaacaattacttacgctcatcattcattaatacaaggtaatagaaaaggtgcattatatggtacagttgctacaattatattagcaataatattcacattcttccaaggtgtagaatatacagtatcatcattcactatttctgatagtgtatatggatcatgtttctactttggaacaggtttccacggattacacgtaattataggaacagcattcttagctgtaggtttatga

SEQ ID NO: 20914 - DNA, 1002 bp, A.fumigatus
aaaattgaaaaacaattaagaaaagaaagattacgtcatagattaagaaaattatctacaaatagaatctttgttagtgatggtgaatttaaacatactaatgataaagtaaatatcacattatatgtatataatagacaaaaacttaattacttattaaaattaaaaaaaagatatataagattatttaaaagagttaaatttgtaagaaaattacaattaataagaaatataggattgaatattttaaaaaaacaacaagaaaaaagtaaaatattaacaaatattttacctaattatagttcaaaaatatctagaattcaaaatttttactataaaaaatttataataaaatcttttaaaagattaaaatactatatgttttataaacaattactttatatcaataaagctaaatttgaaaattcatatttacaaggtttaattaatttaataaaaaaaatatataaaaaaaatgtagaatttaatattattaatttaaaatacttttattttaatagtgatatttttacacaaccattagtattaaaattaagaaaaaaaagaaaaccattaaaatatcttaaagctttagtaagaaaagcaaaaattaaaaaaattaaattaaatgaaagatctaaatatttctttgaattaaataatttatttactgtaaataatcttgatactactaataatttacttaataatttaatagaggaaaataaaacaagttcaaaatatcttaaaaaaatagtattaaataatattaaatataaaagagtatcaggtgttagaatagaagctgcaggtagattaactagacgttatactgcttcaagatctcaacataaagttagatataaaggtaatttagtaaatgcctattcttctattaaaggttatccttcatctgtaataagaggaaattataaacctaatttacaatatactaaattaaattctaaatctcgtattggatcttttggagttaaaggttga

SEQ ID NO: 20915 - DNA, 624 bp, A.fumigatus
tatttatcatctaatgctaaagacattggtactttatacttaatctttgcattattctcaggtttattgggtacagcattttctgtacttataagattagaattatcaggaccaggtgttcaatatatttcagataaccaattatacaatagtataataacagctcacgctattatgatgattttcttcatggttatgcctgctttaattggaggttttggtaatttcttattacctttattagtaggaggtccagatatggcaaaagaaaaaaaagaaatggatctccataggtttaatattagatattatagtaatgatttaaaaaataaatttaagggatatttagctggtttatttgaaggaaatggacatattagtattaaaaaatctagtaaaaagaaacacaatccaagattttatataacttttaatatgaaaaatcaaccattagctaaaaaattagtagatttaataaaatggggagatttaagatatgaattaaaaaatgacgcttgtgtattagttgtttcatctgtaataggtttaaaaaaagtagttgaattattaaatggtgaattaagaacaccaaaaatacatctactttataatttaatagattga

SEQ ID NO: 20916 - DNA, 321 bp, A.fumigatus
ttaagtggatttattgattcaaatggaagtttttctatacaacatactaaattaaaaaatggtataaaaaaaagaaaaatatcttgtagattaagaattgaagaaagaatattagatcctataactaaaaatagttatttaaaagtttttactgatatatctaattttcttaattgtagtttattaacaagaaaacaaaaatcaacaggtaatgaatactatattttaacagtttcaagtataatgtctttaaatttaatagtaaattatttagaaaaatatcctttattttcaagtaagtatttagattataaagattga

SEQ ID NO: 20917 - DNA, 189 bp, A.fumigatus
tttttactagtaatgacgtttaatatatttatattaattaatattttatttagtaaaaaaaagaattatttttatatttatattcttttatttttaattttttttttttatattatatatgaatttatatttgcaaaaaaaatatatatattttttattatacttttaaaaattagtaatttattttaa

SEQ ID NO: 20918 - DNA, 450 bp, A.fumigatus
ataattatatatttatttaataacagtagttctcaattaattaagcaaaaacaaatatgtttgtatattatgacaacaacaacttttttcttatttttaataccagtactagcaataattttgttagcggttaatttaattctttctcctcataacccatatcaagaaaaagatagtgcttttgaatgtggttttcattctttcttaggacagaatagaacacaattcagtatatctttctttatatttgctctattatttttattatttgatttagaaatattattagtttacccttatgtggtaagtgcatatacaaatggtatatatggtttagtaataatgttagtatttttccttgtattaactttaggttttgcctttgagttaggtaaaaatgctttaaaaattgaaagtagacaagtatttaattttaattataaatcttga

SEQ ID NO: 20919 - DNA, 363 bp, A.fumigatus
agttaccaatatcctgattttacaaatgaagataacgaatttattgagtttgattcttacatagttccagaaagtgatttagaagatggtcaatttagaatgttagaagttgataatagagtaattataccagagttaactcatacaagatttgtaatttcagctgctgatgttatacattcttatgcttgtccatctttaggtattaaagcagatgcataccctggtagattaaaccaagcatctgtttatgtaaatcgtccaggaacattctttggacaatgttcagaaatctgtggtattttacatagttctatgcctattgcaattcaatcagtgtctattaaagacttcttattatga

SEQ ID NO: 20920 - DNA, 195 bp, A.fumigatus
ataatgtatttaacattgataattttacctttattaggttcaataatttcaggtttctttggaagaaaggttggagtaagaggagcacatataataacatgtacttcagtaataacaacaacatttttagctatattagctttttttgaagtaggttttaacaatatacctgtaacaataaatgttgcaagatga

SEQ ID NO: 20921 - DNA, 198 bp, A.fumigatus
aatttcagatttgattcattaacagtttcaatgttattacctgtattaatagtatctagtttagtacacgtatattctataagttacatgagtcatgatccacataatcaaagatttttcagttatttaagtttattcacttttatgatgattatacttgtaacaggaaataattatttaataatgtttgtaggttga

SEQ ID NO: 20922 - DNA, 1146 bp, A.fumigatus
ttaggtgctataactacagtattcagttctttaattggtttattccaacaagatattaaaaaagttattgcttattcaactatgagtcaattaggtatgatggtaatagctgttggtttatcaagttataacttagctttattccatttagtaaatcatgctttctataaagcgttattattcttaggtgctggttcagttatacatgcagtagcagataaccaagattttagaaaatatggaggtttaagagaattcttacctttaacatattcagttatgttaatagcttcattaagtttagtagctgtaccttttatgacaggattctattctaaagattttatccttgagtctgcatatggacaatattatctatcaagtactatagtttattttgtagctacaataggtgctatgtttactacactttattcagctaaagtattatatctaactttcttagctaatcctaatggtcctttagtaaattataaacatgctcatgaaggtgacttgtttatgactataccattaattattttagctattttctcaatattctttggatatttaactaaagatatttttataggattaggaactggtttctttacagataatagtttatttattcatcctagtcatgaaataatgttagatacagaatttgctgtacctacattctttaaattattaccatttgtatttactgtatcattaagtatactttctgtattattatcagaattcttacctaaattacttattaattttaaattctcaagattaggttataatatctttagtttctttaatcaaagattttatatagaattattttataataaatatattgtagaaggtgttcttaaattaggtggtcaaacatctaaaagtttagataaaggttctgtagaattaataggaccttatggtttagaaaaaggattattagctttaagtaatagtataggtaatttaagtacaggtgttgttactacttatgccttatatatattaataggtttaatattctatatttctttaatatatttttcatataatgataataatttattaattttagttatatttacattatttgctttattaaatagtaataataataaattatctagctaa

SEQ ID NO: 20923 - DNA, 324 bp, A.fumigatus
ggtggtttctctgtaaataatgctacattaaatagattctttgcattacatttcttattaccttttgttttagctgcattagtaataatgcatttaatagcaatgcacgatactgtaggatctggtaatcctttaggtatttctggtaattatgatagattacctttcgctccttactttgtatttaaagatttagttactgtatttattttctttatagtattatctgtatttgtattcttcatgcctaacgcattaggtgatagtgaaaattatgttatggctaatccaatgcaaactccacctgctattgttccggaatga

SEQ ID NO: 20924 - DNA, 336 bp, A.fumigatus
tacttattacctttctatgctattttaagatctatacctaacaaattattaggtgttattgctatgtttgctgcaattctagcattaatggttatgcctataactgatttatctaaattaagaggagtacagttcagacctttaagtaaaatagcattctatatttttgttgctaatttcttagtattaatgcaattaggtgcaaaacacgttgaaactccatttattgaatttggacaaatctcaactgttttatactttgcacacttctttgtaatagtacctgtagttagtattattgaaaatagtttagttgaattagcaactaaaaaataa

SEQ ID NO: 20925 - DNA, 216 bp, A.fumigatus
gcggaatatgctagtattgtattaatttgtgttttaaatagtattttatttttaggaggttatttaagtattattcctttagattttattatatatattttaaatttattttttaatgtaaatgatactattttatatgatatatttattcatatatcatcttctcctttaaatttagcctttaaaacagctttcttaatatttgtattcatttga

SEQ ID NO: 20926 - DNA, 327 bp, A.fumigatus
ataaaatataaaattataaatatgtctttattattattattaatacctttaattggaataggtttagttacaatagaggcaaattatggtttatcattaatcaataatataagaattaaatctatagccttaataacttctatagttaacttagttgtttcattaattatgtttatactatttgattttagtagtaaacaatttcaatttattgaagaacattatcaaataagttattttgatatatatttaggtgtagatggtttatcaatatattttgtattattaacaactataataatgcctatagcaatattatcaaattga

SEQ ID NO: 20927 - DNA, 381 bp, A.fumigatus
aattcaatacaatcacaaaatgtattgtcatttgtagtaataatgttattattagaaacattattattagcagtattcttagtattagatgtattgttattctatatattcttcgaaagtattttaccaccattatttttattaataggattatttggttcaagtaataaagtaagagctagtttttacttattcttatatactttattaggatcattatttatgttattatctataatagctatgtcttctataatgggtacaacagattttgatgctttatcaaaagcaaattttagctatgtaactcaattatttttattttatggaatatttatagcttttgctgtaaaaacaccagtaatttttttaaatacttga

SEQ ID NO: 20928 - DNA, 780 bp, A.fumigatus
ttattaaaagctcatgttgaatcaccattatcaggaagtattattttagcaggtatagttttaaaattaagtttatatggtatatttagattaatgttacctttattacctaaagcttctttaaattatacatatataatttacgtaataggtgtaataacaattatatatgctagttttagtacattaagaacaatagatattaaagaacttattgcatattcatctgtatctcatgcagctgtttacttaataggtgcatttagtaatacaatacaaggtattgaaggttcaatacttttaggtttagctcatggttttgtttcatcaggattatttatttgtgcaggaggagttttatatgacagatcatctactagattaataacatattatagaggtatggctcaagttatgcctatattctctgtattattcttcatattaggtttaggtaatagtggtactcctttaactctaaatttcttaggtgaatttatgtcattatatggagtatttgaaagaatgcctatattaggtgttttagctagtacttcaatagtattctcagctgcttatacaatatttatgtataatagaatagtttttggtggttcatactctatttattttgtagaaaatataggtgatgtaactagaagagaatttattatgttattagtatttgttatactaacagtattatttggtatttatccagcaccaatattagatggattacattattcagtttcttctttaatatatagtataaactaa

SEQ ID NO: 20929 - DNA, 210 bp, A.fumigatus
catagaatagttatgcgtcatttagattttgtcttaagtcctttagaccaattcgaagttagagatttattttctctaaatgccaatttatttggtaacattcatttatcattaacaaatataggtttatacttatcaataggtttatttttaattttaacatatagcttattagctacaaataataataaaataataccaaataactga

SEQ ID NO: 20930 - DNA, 576 bp, A.fumigatus
tcaataagtcaagaaagtatgtatgcaacagtgcatagtatagtagtaagtcaacttaatccaacaaaagggcaattatatttcccatttatatatgcattatttatattcatattagcaaataatttaataggattagtgccatatagttttgcatcaacatcacattttatcttaacattctcaatgagtttcactgttgttttaggtgcaacattcttaggattccaaagacatggattaaaattcttttcattatttgtaccttcaggttgtcctttagcattattacctttattagttttaatcgaattcatttcatacttatctagaaatgtatcattaggattaagacttgcagctaatatactatcaggtcacatgttattatctattttaagtggatttacatacaatattatgactagtggtgtattattcttcttcttaggtttaatacctttagcatttattatagcattctctggattagagttagctattgcatttattcaagctcaagttttcgtagttttaacttgttcttacgttaaagatggattagacttacactaa

SEQ ID NO: 20931 - DNA, 210 bp, A.fumigatus
ttagctacatgttatggtggttcattacacttaacacctcctatgttatttgcattaggatttgttgtattattcactattggtggattgagtggtgttgttttagctaatgcatcacttgatgttgctttccatgatacttactatgttgttgctcatttccattatgttttatctatgggtgctgtgtttgcattatttagtggttga

SEQ ID NO: 20932 - DNA, 297 bp, A.fumigatus
ataaatcaaaataaaaattattatacaatgaatttttcaatctttttattcttaatagggatattaggttttgtgttaaatagaaaaaacatcatactaatgttaatttcaatagaaattatgttattatctataacatttttaatattaataagttcacttagttttgatgatatattaggacaaacatttgctatatatattataacaatagcaggagcagaatctgcaataggtttaggaattttagtagcatattatagattaagaggaagtatatcaatacaatataaataa

SEQ ID NO: 20933 - DNA, 795 bp, A.fumigatus
tttaaatttattttagaatattatatgcttttatcttcaatattctgtttattattatctaatgctttgtcttttagacgtgatactactattctatatagtagaattggaataatagcattattttattgtatctatttatcttataataatttatttataacatatttagataatggtattgggttatttggtggattattttacacatcttctataacacaagtatttcacatattaatatttataattagtctattgatattgaatatgacaggattttatcctagaaaacttatatctaatgagtatatgagtttatacaaattattatttacaaaattacaatttattaaaaatttaactgtatctaatattattttaaaaaaaggagaacaatacacaatattagaatatacattaatgttattttttataataacaggaagtgtattattaatatcaagtagtgatttagtttctattttcttatctatagaattacaaagttatggattatatttattatgtgctatgtatagaaattcagaatcttctacttcagctagtttaacttattttttactaggtggattatcttcttgttttattttattaggtattgcattaatttatgcaaatctaggtgttacatatttagatagtttttatcttataaataatttagcaggtatagttgatgaacaagaaataactacatatataccatattgtttattattaatatctgtaggatttttatttaaaatatcagctgcaccattccatttctga

SEQ ID NO: 20934 - DNA, 726 bp, A.fumigatus
actacaagtttattagtaagttctttattatctttaattataggaactattttaggtttaactcaatttagaattaaaagattatttgcttacagtacaatttctcatttaggtttcatgttgttagcattaactataaatagtgttgaatctatacaatcatttattttctatttaatacaatatagtttatctaatttaaatgcctttattttattagtagctataggttatagtttatatgcttataatgataaaaatattaaccataataatttagttgataaaaataactcacctatacaattaataagtcaacttaaaggatatttccatattaatagtatgttagctttaagtttatctataactttattctcatttgcaggtattccacctttaatgggattctttgcaaaacagatggtattctctgctgccttacaagaaggatttattttcttaacacttataggagttttaactagtgttattagtgcagtttattacttatttattgttaaaacaatgttctttgatagacattcttatacatactttagtaaattaaaagatcttaaaataccagctataatactacaaaaagataaagaagtaaatagaatatattttgattcaaaatttgctttatctagttctttaagtataactatttctatattaactttaattattcttttatttatggttatgcctaacgaatga

SEQ ID NO: 20935 - DNA, 441 bp, A.fumigatus
attattttattagtttatatatatatttttttttatgtaaataaaataaaatacaaaatgataacatcattaatttcaataattgaaggattattagtaatagttcctgctttattatctgttgcttttgtaactatagctgaaagaaaaactatggctagtatgcaaagaagattaggtcctaatgcagtaggttactatggtttattacaagcatttgctgatgctttaaaattattattaaaagagtatgtagcacctacacaagctaatattattttatttttccttggacctgtaataactttaatattctctttattaggttatcttgtagttccttttggttcaggtttatttatatctgactatagtttaggtttattatatgcattagctgttagttctttatctacatatggaatattattagctggttga

SEQ ID NO: 20936 - DNA, 528 bp, A.fumigatus
tctgctaattctaaatatgcatttttaggttcattaagaagtacagctcaattaattagttatgaattaattttaagttctgttatattattagttttattattaacaggaagtttaaatatgattactataatagaatcacaaagagtagtaaatttcttattcccattatttcctttatttttagtattctttataggttctatagcagaaactaatagagctccttttgatttagctgaggctgaatcagaacttgttagtggttttatgacagaacattcagctagtatttttgtattcttctttttagctgaatatgctagtattgtattaatttgtgttttaaatagtattttatttttaggaggttatttaagtattattcctttagattttattatatatattttaaatttattttttaatgtaaatgatactattttatatgatatatatattcatatatcatcttctcctttaaatttagcctttaaaacagctttcttaatatgtgtgttcatttga

SEQ ID NO: 20937 - DNA, 399 bp, A.fumigatus
cttatagaatatacgtgtactaaactagatactattaatacaggtaataacattgaaactgttaatgaatcaaatctgaaatttcataacacatataatgattctacatcaactcatcttgcaacatttattgttacaggtatattgttaaaacctacttcaaaaaaagctaatatagctaaaaatgttgttgttattactgaagtacatgttattatatgtgctcctcttactccaacctttcttccaaagaaacctgaaattattgaacctaataaaggtaaaattatcaatgttaaatacattatttatattgtattgatatacttcctcttaatctataatatgctactaaaattcctaaacctattgcagattctgctcctgctattgttataa

SEQ ID NO: 20938 - DNA, 267 bp, A.fumigatus
aggattgtatggtttagtgtatatatcatatatactatattgtcagatatcctctttttttctttttttattttgatcgtctataccaattatggctccaccttctggattagtattaccaccttggttatttccaggatcaccacctccaaatccaaaaaaataatttccttcatcaccactactcatattaagagtacttacatctatattaaaagtacttacatttatattaagagtacttgcatctatattaatttcatctga

SEQ ID NO: 20939 - DNA, 186 bp, A.fumigatus
actatacccaccttcatatatgaatatgaaaattttttttattatataaaatatttatttacctattttattagctacattatcaataattttgatatatttttcataagttgtaaaatcaatattaccccatgcctttttacacatagaactagccatcgaaagatttcccttaacacgtcctga

SEQ ID NO: 20940 - DNA, 225 bp, A.fumigatus
gtaattgttacacctgatgataataagattattgtatttaataatggtaattcgaaaggatttacaccttgtattcctaatggtggtcattgtgctcctaattctatactaggtgagattgcactgtggaaaaatgctcagaagattgctaaaaagaaaaatacttcagaaataatgaataaacctacacctaaatttaatcctttttgtactgcatttgtatga

SEQ ID NO: 20941 - DNA, 228 bp, A.fumigatus
agcggactttttattttcctttctttttataagggatttttcccttactttaaggtagccaaattatcttttactcacctgtacaccactactattcagtttattaaactaattagtcgttcgattagcatgtgtcaagtacttggacagcgttcaatcagagccatcatcaaactcaaaaaatttctcttagatttaatagtatatataatatacctatattgctag

SEQ ID NO: 20942 - DNA, 237 bp, A.fumigatus
tatgctactaaaattcctaaacctattgcagattctgctcctgctattgttataatatatatagcaaatgtttgtcctaatatatcatcaaaactaagtgaacttattaatattaaaaatgttatagataataacataatttctattgaaattaacattagtatgatgttttttctatttaacacaaaacctaatatccctattaagaataaaaagattgaaaaattcattgtataa

SEQ ID NO: 20943 - DNA, 327 bp, A.fumigatus
cctgatagtatattagctgcaagtcttaatcctaatgatacatttctagataagtatgaaatgaattcgattaaaactaataaaggtaataatgctaaaggacaacctgaaggtacaaataatgaaaagaattttaatccatgtctttggaatcctaagaatgttgcacctaaaacaacagtgaaactcattgagaatgttaagataaaatgtgatgttgatgcaaaactatatggcactaatcctattaaattatttgctaatatgaatataaataatgcatatataaatgggaaatataattgcccttttgttggattaagttga

SEQ ID NO: 20944 - DNA, 195 bp, A.fumigatus
aataacaatacatctaatactaagaatactgctaataataatgtttctaataataacattattactacaaatgacaatacattttgtgattgtattgaatttcaatttgataatattgctataggcattattatagttgttaataatacaaaatatattgataaaccatctacacctaaatatatatcaaaataa

SEQ ID NO: 20945 - DNA, 186 bp, A.fumigatus
  unsure (91),(158): Identity of nucleotide sequences at the above locations are unknown.
agatcctccaagcattccccaactgtcacagctttgttaccatattccggcattctccttaacatgtgctctgttaagttgtggaatgttntgctcctgcacgtcgtgagcaataacgacccggaactcctcgaaacttcccatgggcaacaaggcancaccaaacgtatttcttggaaaatgaaa

SEQ ID NO: 20946 - DNA, 639 bp, A.fumigatus
  unsure (28),(95): Identity of nucleotide sequences at the above locations are unknown.
ttcattttccaagaaatacgtttggtgntgccttgttgcccatgggaagtttcgaggagttccgggtcgttattgctcacgacgtgcaggagcanaacattccacaacttaacagagcacatgttaaggagaatgccggaatatggtaacaaagctgtgacagttggggaatgcttggaggatcttcaagaattctggtatcgcgaagctggcgagcccttcagcaataacgctgtcagaagttcttcatcaccagagcttcatgacgctccttcgactgtttctaaaccggtctcccctgatggtaagtgtggaaaggactatacatgcgctggatcaagctttggcccttgctgtagtagttccaactactgtggtacctctaatctacactgtggatttggttgccaaccagaagctggaaattgcttctccttagatgagccatcgcacaatgacaccaatgactttataagaaagccaacgccccggccgggttcggatcattccaatgacggcggtcttcctggtggtggatcagcgaggaagcccgtgaaatcgggggcaaatccagcggtccatgccttatcggctgcggcctgcctgatgttgtttatttgcgtgatggcaattgcctag

SEQ ID NO: 20947 - DNA, 291 bp, A.fumigatus
  unsure (281),(290),(291): Identity of nucleotide sequences at the above locations are unknown.
gaaagtaggaggcgtaatatctactgtttttgtttaagtagactgcccctcggtactctagttcgcaaagccgagatgggtagattcggcgtggggcaaaaggaccgtgtcacaatgtggggaatgttctactcctgcaatggaaacaacgacgatacgaacaagatgatcatacgagaagatgaggatgttagcaatgcttgcttaacaacgcgatctacttcaattgcccatgcaaatacatggtcttcaccacgggagcggaaggatcaagagcgggncttctattnn

SEQ ID NO: 20948 - DNA, 213 bp, A.fumigatus
  unsure (15),(76),(91),(92),(93),(117),(118): Identity of nucleotide sequences at the above locations are unknown.
ccggtcggcgatttntttctccggtgggtgcaattctccacctccgagcttgcttcaattttttggggttattatntgtttccgtgcgggnnnatatcctccgttctcttcgtctcnngttcgggccgagttgggatttggactcagatcttctctgccaaccatggaatccgcggcagatttcccaccgtttcagcaacggttaacgtttag

SEQ ID NO: 20949 - DNA, 492 bp, A.fumigatus
acttcgtcgtttctcagggcggccacagccggcacagatttactcgcacctaaactgcacgatgaggactcggtcgaagacaattggcgtggtgttgttgatgttatcgatgcgctgctagagagggcagacgcctgtctcgatgaatttacgggagtcatcaagaaattgagcccgtcgcagcaggagcagagcgcagcaaaggccgccaaaaaggcttcccccaagttcccctccgtttacgatttcggcccgtcgaagattcccaagccacaattgttgtttgagcgcccccccgacaacaccgatgtttctccttttaagcctcttcttcgaatcaagcctcacgcgattgttccgttggaggattcgttgaagttgacagatcctgcgcaaggttacaggaatccgtatgaaacggagattcaggctgccaagtacccggaatcgacctatactgtctctccccccggtcgagtaccagccgtttga

SEQ ID NO: 20950 - DNA, 306 bp, A.fumigatus
agtatctgtaggttgccccgttgccttgccttgcgggcaatgaatactgtcgaagggagcgattcgatactgactgcgacaaggtacaaggggatggctgctccggctcctggtggcggggcgcagtcgcctcgcaagtcggtgtctccgcagaacacggggttctcgcagattcaggcccggaatctgggtgagggcgggagcgcgcagcagatgagtgtgttgctgagctggcacgagaagttggttgagcttacggggactgggtcgattgtccgggttatgacggatcggaggacggtttaa

SEQ ID NO: 20951 - DNA, 378 bp, A.fumigatus
ccgctcgtcagtagacaaaggacactcgacgacgaggagttagattcgggcgacgacattgatcgctacgacagagccggagatctcatggatgaggatggtgtggaaggggattatcaggaaactgtgaacattatggacctgagtctaggccgggcgcctgagccggtgacttcgaatggggaggtaggtccagtagggccgaaaaagagcatgctgtcctgttggctgaccctatacacgcaggtctacacgatgccagtgccaactttcttatcgatagagacagaggagttcgacccggaaacgtacgtcgcgcctccattcaatactgcggcgacttccctgtgctggaggcatgacccgaacgacgaatct

SEQ ID NO: 20952 - DNA, 477 bp, A.fumigatus
  unsure (433),(434),(435),(436),(437),(438),(439),(440),(441),(442),(443),(444),(445),(446),(447),(448),(449),(450),(451),(452),(453),(454),(455),(456),(457),(458),(459),(460),(461),(462),(463),(464),(: Identity of nucleotide sequences at the above locations are unknown.
gccgttgagtctcccaatgcaatcatgggccaagccgatgcagccggattttcgggtagctctcacgggaacgcgacgcaaggcgctgaagatctgtcaagtgccgcttcagacatcgacatgaacgacgttacggatgcttgccacggtgacgtggctcctacatcgtcctcctcttttgaatcaatgatcatacgtaccccgaacgaagatttaccatatctctttgtcggctccgggagctgcaaccctcttgaccccaaggcctcaaactgcctgggtctggctcttgtccgctccatcgatgttccatcacgcaagctggaactcatcactccaatcccagcgtccaaacttcgcgatgccctagaacaaggccacggcatcgtgctcgttcgcggaatgctagataaccccagctgggccgtcttcnnnnnnnnnnnnnnnnnnnnnnnnnnnnnnnnnntntcagtcaca

SEQ ID NO: 20953 - DNA, 363 bp, A.fumigatus
  unsure (70),(115),(154): Identity of nucleotide sequences at the above locations are unknown.
agccccccaatattggcctttacgaaaattaccggtccggacaagcttaccaaatgggtgttcgcccagnacccaagcgtgttcaaggaggtcaacccggcagtcaagcaagagnaagagcgtgctttgcacgagcaaaaactcgccaagatgnaggcagagatgaagatggtcttccagcagaaggttgcagagaaggaaagcaagctgaaacagagcgaggacgaattatacgcgcgacatcgcgaaatgaaggaccaactggaacgccaacgccaggagctggaagagaagaaggcccgactcgagagtggaaggccaatcgaagagaaggggaagaggaagggcttttctcttcgttaa

SEQ ID NO: 20954 - DNA, 600 bp, A.fumigatus
gacgcgctaccttccagtcccgtcggcgtcgacgattactcaacgccacagcatgggaagattcacgatgcgaaggccaaaaagcgatcaaaatcgcgcctatcgacgtcccgcaggcgggaaatggaacttttgatcaacacaccaccgagcatcgcagaggaggagccaacagacgaccatgccaacttcacggcaacacccagcagtgaagccataaccagcgagtcggcgatctatgtgcagggcatgaacgttctctgcgcgccctttctctacgtggcacgcagcgaagtcgaggcctttgcattgttccactatttcatgaccagtgaatgcccaggctatatccgtggtgccatggacggtgtccaccggggtctgcggctggtcgatcgatgcctcgagattgtcgagccgaagctcgctgcctatctcttctccaaggggatgcaagcggagctctacgccttcccatctgttctgacactgtgcgcctgcacgcccccactgcctgaggtgctccacctgtgggatttcttgttcgcatatggcccacatctgaatattctatgcatcgttgcgcagctgatccggatg

SEQ ID NO: 20955 - DNA, 456 bp, A.fumigatus
  unsure (445): Identity of nucleotide sequences at the above locations are unknown.
accaacccacagcgcggtgtattcgccattttctctgcggcagattatcgagtttatagtcttcctacccttgaactttatccctgtcgcaggcactccgatgttcttgttgttgaccggctatcgcgcggggccactccatcactggcggtattttcagatgctggatctgtcgaagaaacaaaggaaggaaaggatccgtcgacggcagcttcaatacactacgtatgtacctcgtcttgcgcactgatctattcagccgatcattttctgatctgtggacgcagattcggaacggttgctttgcttctacagcttattcctggcttatcaatgttcttcctcatgtcaactgcggccgggtctgccctctgggtaaaggacattgagaacaaacgtgatgctttacgaggaacgtcttcaccacaggggcccggaaggtccngcgctaagcgt

SEQ ID NO: 20956 - DNA, 360 bp, A.fumigatus
  unsure (360): Identity of nucleotide sequences at the above locations are unknown.
tcccagggtatgcgatcacttctagccgccatttgcctatcctttgagggccctgatgatgacttaattcaacagatcttccctcggtgggtgagatattccgccctgctcactgtcaacgtgtttgtatttatgggcaatatgtactcagtacgtacagacgactcgagtcttcccgacaatcaaggactaacaatatttatacagtctgggatagctactggcttcgggagcttggcagaggaccttcaacttccctttgaaaaactgtcggacttgattagctactctgtgctggctatgggcttggcaaacattttctggatgcctctggcgctgtgttttggcaagcgtcccgtn

SEQ ID NO: 20957 - DNA, 600 bp, A.fumigatus
  unsure (599): Identity of nucleotide sequences at the above locations are unknown.
tactgtgggtggtttggatttcaacgtacgcctataacctcacttcattacatgatcttcgttcttgcccctttgtgccgtcattccatggcatgtgttcatcaaattgcatgtttgacgcacgacctggctaatgttttcctgcagaatttcttcaatatcatcaatggagaaacggtatctagtgctgtgactcagcatggcatcaacccagccaacaaggagccaaacccccccgttccggttgccagccccgccgagctcgacaaggctgtcgctgcggcgcaagttgcctttgagcaatggtcaccattcccgcttgaggatcggcgcaaggctctgttcgcgtactctgacgcactgaatgctgaaaaagatgggttcaccagcctgcttacgaaagagcaaggcaaacccctgtcccaggcggcaatggaagttgagatggcggtggcatggatcaagggcctggcaagcttggagatacccgaggttgtgctggagaattcatccgagcggaaaattgtccaacgattcacgcccattggagtgggtcttcaccaggggcggaagagcgtgcatttcaagggccctcaatna

SEQ ID NO: 20958 - DNA, 582 bp, A.fumigatus
gttacgcatagtgcggattcttcggccgcctgtggtgaagacggaacatgtatcttcatgaaccgtatctccagcgaaacaattttcactacggcccccgactcagaatctacaggcctggtcggtgtcaaccgcaaaggccaagtcctgtcggtcagcgttgatgagggaactattatccagtacctgatggagaaccctgccatgtctggacttgcggtgaagctcgcgtcaaaggctggccttcctggagcggatcacctctaccagcagcagttcgataacttgctggcgcagggcaattattctgaagctgccaagatcgctgccaactctccccggggcttccttcgtacacccgagactattaaccgtttcaaaaatgcgcctcaaactggccaacagatgtctgtcatcctacaatacttcggtatgctcttggacaagggatccctcaacaagtatgagagtgttgagcttgtgcgccctgtcctgcaacagaacaggaagcacctgctggaaaaatggatgcgtgagaataagctggaaacctccgaagaactcggagatatcgtccgacca

SEQ ID NO: 20959 - DNA, 210 bp, A.fumigatus
  unsure (172),(173),(174),(175),(176),(177),(178),(179),(180),(181),(182),(183),(184),(185),(186),(187),(188),(189),(190),(191),(192),(193),(194),(195),(196),(197),(198),(199),(210): Identity of nucleotide sequences at the above locations are unknown.
agcgccaataagctcggaaggcgaccatatttagtcgaggctgcacagggacttgagctcggccaattcttgtactcagccttggaggttgaggtctatgaaacctggtacttgggagtcaacatctgtcagagatatatcaacagactcctttctcgtcgtcacgtcttcnnnnnnnnnnnnnnnnnnnnnnnnnnnngcgtcttcagn

SEQ ID NO: 20960 - DNA, 369 bp, A.fumigatus
ccgctcgtcagtagacaaaggacactcgacgacgaggagttagattcgggcgacgacattgatcgctacgacagagccggagatctcatggatgaggatggtgtggaaggggattatcaggaaactgtgaacattatggacctgagtctaggccgggcgcctgagccggtgacttcgaatggggaggtaggtccagtagggccgaaaaagagcatgctgtcctgttggctgaccctatacacgcaggtctacacgatgccagtgccaactttcttatcgatagagacagaggagttcgacccggaaacgtacgtcgcgcctccattcaatactgcggcgacttccctgtgctggaggcatgacccgaac

SEQ ID NO: 20961 - DNA, 393 bp, A.fumigatus
  unsure (33),(40),(192): Identity of nucleotide sequences at the above locations are unknown.
aaaattccttcgggggggttcccttcatcgggnagtgatngttggaatcccaggaaaacccggaccttggttttccggatttgggggaatggggaacagctttcccttgggtttattgccatttgcgccagggccgggaatccaaggttttgccttttccattgttcaacgcgtgtatccggaatttttgcntggttccggcgggcaacttgtaatgttgggttgggctcgcgcatgattggggcaatgacaaccgatcaccagttgccccaggtatttggcaaggtgaccaagaagggtgttccttatgtggctgtcatcgccgcttggctgtttggaccgttggcctatctcagtaagtctcttcggctagttataattgcacatgactaa

SEQ ID NO: 20962 - DNA, 372 bp, A.fumigatus
tacattcgcttttatgccgcgctcaaagcgcagggcatccaccgcgacacgttgccgtggaagggccctctgcaaccgtatgcggcgtgggtgggattcatcggatccaccatcatcacccttgtggccggattccccgttttcctcaaaggcaactggaatacctccgacttcgtcgcttcgtatatcggtattcccatcttcattgtcccaatcatcggatggaagttctggcaccgcaccaaggttcgtcccagatccctgtatgtcggcaaggaagctaacggttgtagtttgctcgcgcagccactattgacctatggtctggccgtctccaggagggagaggttattgagaaacacaggccgatga

SEQ ID NO: 20963 - DNA, 237 bp, A.fumigatus
  unsure (4),(70): Identity of nucleotide sequences at the above locations are unknown.
gtangtggctcgatgaaggacattaacaaaggaaatgggatcatatactgggggattgaatacatgcttncattatttacttttggagtaactggcaaatggatgggcataacattgattgcccttcttgaaatttttacgtataacccatataagggtcggggccaggcgtccaatagcattaaaggttttcaacttaattttgaaagctttccaatggtattgcagaagggttaa

SEQ ID NO: 20964 - DNA, 204 bp, A.fumigatus
tattttgacccctctttttgcgcccattttgcaaagcttcgaggattgtgtggatgcaccaccgccctcatcatcgcgcaaagtggatggagtcgaggaggtcgaactagcagctatatggctctagcaatcgatagtgaccaccatgccgagtccctagtgacctactggatttacctgtattttttcactcgcaatggctga

SEQ ID NO: 20965 - DNA, 471 bp, A.fumigatus
ccgtatttgctcgatccaggtgccctcgtttatgatccatgcatcggccagttcgactacgtgcaagaagaagtgcctgcagtgcccttcgttcagcagaacgcgaacctgttcaacttcaatgcaagcttcatggcggagctggaaaggctccaccagacctgcggctaccaggatttcatcgataaatacctagtgtttcctccctccggtgtccagccgcccaagatgttcaactacacgagcgatgcggagtgcgacgtttttgatatgatcaacaccgccgccatggctgtcaacccctgcttcgacatctacgagatcaacctgatgtgtcctcttgcgtgggatgttcttgccttccccacggaactggtctaccagcccgccggcgccacggtctactttgatcgcgaagacgtcaagcgtgccttgcacgctccgagcatcaagtgggccgagtgcgcggac

SEQ ID NO: 20966 - DNA, 420 bp, A.fumigatus
gtcatcaaacaagacctgctcatcaactcggacgtgccggaccgcatcgggtgggctttcgggctgggccttgagcgcatcgccatgctcctcttcaacatcccggacatccggctgttctggtcccgcgacgagcgcttcctctctcagttcaaggccggccagatcacccgcttcgagcccttctccaagcatcccgcctgctacaaggatgtggcgttctggttgccatcggcggccgtgagcgggggcagcgcggcgggtggtgccgtgcctatccacgagaacgatatcatggagattgtccgcggcgtggcgggggatctcgtcgaggatgtccggctcatcgatgaattcacccatcccaagacgggaaggaagagcatgtgttatcggatcaactacaggagtttggagcgc

SEQ ID NO: 20967 - DNA, 582 bp, A.fumigatus
  unsure (529): Identity of nucleotide sequences at the above locations are unknown.
tctctttctaagtggcagtatgattcgcaaatcgctcatgagctcggcaaggtgccgccactggacatggcgagggagcttatgatggtctacttcaaagtgtggcatcccctgtttccgtttctgcatggccccagcttcctgcgggcgatggagttgctttactcagactcgcacggaactgagggccagaattatgggaatatcccgtctacatctacgtctacgtctacgtctatggaccaccggaacgcgtgctggacgacgatctttcagtgcgtgttcaacctcgcaagccatctgcggcccgatctgtcccttccgccggaatcccgaatcaaatccccgggaagcatgcattctctgcttgctattctaacgcggaggcaggatctcccgtccctgcaggctcttctcgcggcccagttgtacctggtggccaagatgtctcttcggacggcgtcaacggtaggcggtagtattctccggtctatgctgcacgctggtctccatccgatgcccgtttcgntatctacacgaccgggaaggaagcagcacgtgccggaactggaaggatcgcgt

SEQ ID NO: 20968 - DNA, 348 bp, A.fumigatus
  unsure (234),(235),(236),(237),(238),(239),(240),(241),(242),(243),(244),(245),(247),(248),(249): Identity of nucleotide sequences at the above locations are unknown.
ccccctcacccattgcggctccttccggccgtggtgaagactcggtcgtctgagggcctcagtcttgacaaaatcctttacggttttggcatcttctatgcccagggacagaagatcttcccagaggctgccacccttggaactgtcttctatgtaggttccatttcctgtctcagttggcagagggcgcgtagccttgtgcaccacttcggaaaggtccttaaagcggctatnnnnnnnnnnnngnnnagcgcccacgtcgccctttggtggctctcgcgacggctcattgaaacgttgtacctcatgaacacgtttgggcgcagtgtcaacaaatctagcatgtga

SEQ ID NO: 20969 - DNA, 237 bp, A.fumigatus
agaccaaacaacttgccccacctaccaaatgagattatccttgttattgccggctatttaaatccccacgatctccttcttctatacgccatacccggtatcataccattgctgaaccatgctcatcggacagctgtagatactgaaggaaacaccctgcttcatatagcggcagtgaacaatattgcttaccatagtatttatcagacggattggccgctactcagtcaaacctaa

SEQ ID NO: 20970 - DNA, 186 bp, A.fumigatus
gaccatctgttcaactactctgtacatatcaaaataatacatctatctattgcctctatccggattgattattgggtatactgtcttagtattctacaaatgaagatgcctattttcagctccactccctccactagtgttgtggatgctgtatccttgtactcaaccaccaagccactagtttaa

SEQ ID NO: 20971 - DNA, 648 bp, A.fumigatus
  unsure (639),(640): Identity of nucleotide sequences at the above locations are unknown.
cagatccttaaatacgatggggttgttccgcacagtcgacactctcgacatacgcggactccgtatggagtgcagcgtgtcgcgtcacccgttctaaagcagagtcaaagagccaaaactcccgaaaaatcaaccatggccgaacgaccccggccgacagtcctccggcgtgtcctgacggcaatcatcgaccccgttgatcgcgaggaacagggctaccatcaataccctacaatgcgcggactccacgacccagaaaacgagggtctatccatgggctccgcgaataatccccaactcgcccggcgcctgacggtagcaaccacccacgccagcaccttgatccccccgtcagacaaactgctcgttttccgcgctctcactggcatcgataccgtcccggccctagcaatcccgcaccatcatccacgtagcgcgcccaacgtcggcatctacacgcgcgtcgtgcgcgccgagcaagccgccgcacagcaattccgctttttcagcatcctcatgaacacctgcctgggcatccagatcgtggttgcggccgcgctgacggccctcggcgccgcgcgcgggccccacaacgccgtgtctcacacggggctggaaggatacgcggtgagtgctttnnaaaacccg

SEQ ID NO: 20972 - DNA, 768 bp, A.fumigatus
  unsure (463),(487),(579): Identity of nucleotide sequences at the above locations are unknown.
tgggtactatacctctacaactccgcaaacggggatactggttcgaaccaatggtccgaggatgacaagctggtcggtcgtgaggtctttacctggcaatcagttctggatgtgtggcagcgaggtgccgaggcaacccgatggaggattcatgatagccatctggtgtgggatcgatttttggacctgcaagtccaggacctttctcgtcgcccatcgcaagaacgtgccagccaagtcaaggccttcttcgatgtccgcttgcagaccccacatgctacctgggaccagaccttccaggccttttcgggattcgtgtcgacctactacaacgccaactacgaggagatcatggccgacacggcgggtcgacttgcgacgccagtcaaagagaagtacaacgcgcgggagcatctggagatcaagttgcgcaacgcggtcgatgcgggcgagtttggcctgnagtgggcggcgtactcggagtacnatgactgggaagtgagccgacaccggcggagacgccagtcggatttcgatcttgtgaacgctatctaccagcgtgcggtcctgcgtttcccngacgactccaacctctgggaagactacgtcatgttcctcattgaccagaatacgcacggcaacgcgggagcgaccacaatatcgacgctcgatagagccaccaggcattggccctgctctggtaccctttggtcgcagtacctcctaagctccgagcggggatggcaatctttccaaccggatcgctga

SEQ ID NO: 20973 - DNA, 360 bp, A.fumigatus
cacatcgcaggtatccggaacgctcccgtcccgttcttcatcaagccgttgacgggcatggtcgcgtcaaaggttgagcaggcgttcgtcacgccaaacttgacctcgcactttgagttccttgaggatcagctgaagactgtgccgggaggcggcccttacctctgcggtaaggagctgacggctgcggatatcatgatgagcttccctgttattgcgtccttgattaaaatgcctgatctccggggtcggtatccgaggttggcggagtacacggaccaattgcaggcgatggacggatacaagcgggctgttgccaaggtggaagagatagaagggtcgttctctgcttatgcctga

SEQ ID NO: 20974 - DNA, 528 bp, A.fumigatus
tattctgattcaggctctcagtatgccaaatccgagaattgccctctgaatgtctgctgcagcgagtatggcttctgtggaacaaccacgggcttttgcggcgacgctactgttgctgagccagtatgcgacggaacttcggcaacgaagaagactatcgcatactacgagggttggaactctgagcgtgcctgtgacaccatgccaccagagaatattccgattggcggttacacgcacatcaatttcgcttttctgtacattgaccctgatctttacacgataaagccgatggaaacttctcagcaagagctctacagtcgcgtcaccgcgctgaaaaagcgcaaaaatggcttagaagtctggatttcgatcggtggatgggccttcaatgaccctggaccgactgctaacaccttttccgagctggcggcatccaagtccaagcaatcgacctttttcgagtcattattgagctttttggacaaatacggatttgatggcgtggatctggattggtattgctag

SEQ ID NO: 20975 - DNA, 438 bp, A.fumigatus
acgaaagctgtcctcaaatttatcgccccgtacacgcgattttcgctcagcttcatctccaagcacatcaagatatctgtcccggaagtacaggatatcctgagttacttgatccttgacaagaagttaaatgccaagattgaccaagaaaacggaacggttgttgttgaaagtgccagcgatgtggatcgattgcgtgcccttcaggactggagcgcgtcgctccgaagcctctggcaggcgacattaatcgacggcgaaggattcaagagcgacgacccggcgcaacttcatgggatgagagggggttcaatgctccaatcagcgtttggagacgaggcgcctaccgcgggtttacgtgccagcaactttcgagtacggacagggtggaagggcaagggtggccagggttccaaggccggtgtaggagccttctag

SEQ ID NO: 20976 - DNA, 378 bp, A.fumigatus
tttcctgattcgcatgagacagtctgcggctcttgtggtctggtactcgctgaccgagagatcgacatgcactctgaatggcgtacgttctccaacgatgaccataataacgacgacccctcgcgtgtcggatatgccacaaatcctctgttgaacggcgaccagcttgagacccatatcgccagcggaggctctggtcgcgcgcgacaattgtaccgggcgcaaaacaagcagtcgagcgataaagcgaataaggctctgttggccgcctacaatgaaatcggggcgctgtgtgatggattcaacattcaaaataacgtcccggataccgtcaaatttctcttcaagatcgtggtacatgcccaggcgttcaaatga

SEQ ID NO: 20977 - DNA, 261 bp, A.fumigatus
agatcacatgaaattctcattggcggctgcatcttcattgcttgccgccaatgcaaaattcctcggaccttcaccgaatatttcgacgtcactaaggtccccccaaaagagatgggtatgatctacaaggctcttgaaaaattcttcacggttcaaaaactggaacgggattcatgcgtcgttttctattggtggtgttcccgaattccaacgagggcttatcttgccaacaatttctacaatccctctttgaactttctt

SEQ ID NO: 20978 - DNA, 273 bp, A.fumigatus
gcggccaacagagccttattcgctttatcgctcgactgcttgttttgcgcccggtacaattgtcgcgcgcgaccagagcctccgctggcgatatgggtctcaagctggtcgccgttcaacagaggatttgtggcatatccgacacgcgaggggtcgtcgttattatggtcatcgttggagaacgtacgccattcagagtgcatgtcgatctctcggtcagcgagtaccagaccacaagagccgcagactgtctcatgcgaatcaggaaactag

SEQ ID NO: 20979 - DNA, 552 bp, A.fumigatus
  unsure (237),(519): Identity of nucleotide sequences at the above locations are unknown.
gtgctcgaattcgttcagcgagccagaaaggccgaggtttcggctgttgagagcacacgagactttcccgaggatcgcaggctgaaccgcatacttgctgccgatagcattgtccttgtgaagaacgagtccgggctgttgccgctcaacccgcagacgttgacgagtgtcgccatgatagggccaaacatgaagactgcggcgttctgcggaggaggttcggcgtcgcttcaaccntactacagcacctcgccgtaccagggaatcacgagccagctcccgccgggcgtcgaggttctttacgagacgggcgctacctcgtatgctttcatcccggagctggcggcgtcagaggtgcgcacgccggaaggccagcctgggctgggaatgcgcttctaccgagacccgccctccgtccaagaacggcgcgtggtggaggagaccatcatccaggagtcctcgtggcagctgatgggcttctccaacccggagttggaccgcctcttccacgcacacatntacacgactgggctagaagcaaagcgtgcggga

SEQ ID NO: 20980 - DNA, 273 bp, A.fumigatus
  unsure (266): Identity of nucleotide sequences at the above locations are unknown.
gagaccatggccctggatggcgagaccaacctcaagagcaaacagccttgccagtcagtggcaaaagtgtgtgggacagtggaagacatgtgcagcaactctattcactttgctgtggaggacccgaatatcgatttatacaaatttgatggcaatgtgattgtgaacgcggataagctgcccctcacgaatactgaagttgtttaccgcggcagtattcttcgaaagtcttcaccacggggctggatggtccaggcagcagcgtntatcaga

SEQ ID NO: 20981 - DNA, 192 bp, A.fumigatus
tttacgatgatagaccagcccacatactaccatttccacatccacgtggtcaacgtcatgcttgaggcgggtgcgacacaagttacaggcaaagccttcggactggaaaatcttatttctcaatttgagaccctgggacgggatcaagacgcatgcatgacgggtctcacaacggccgagaggtcttcaatt

SEQ ID NO: 20982 - DNA, 576 bp, A.fumigatus
gagaccatgacatataccgatggtacttggcgaatacaggcgcaggcccagggtggacagcagtttcatgatctcaaactgaatctcatttggccttgcacggaacagcacatcaaaaagtactctgatcagcaactacgcatggtgaccgagacaccggagatttaccgtgactatgtgcgcccatatatgagcgctcagcgcgaagaagggagattgaactgggtcttcaacatccttgaaggccggacggagcaggaggacataattcttcgggacgcgggtgaaggccccgatgatgggtttctgatgctccctgacctcaactgggacagaaaaacaatgagctctctgcatctgctcgctcttgtgcagcgacgagatatctggagtttgcgtgatctcaagaagaagcatatcccttggttacggtatctgaggcagaggctgcttgagggaacagtgaagatgtatccagaattggagcaggaccagctcaagctgtatgttcattgtaagtattattcattaggtggttttgcctgggtcgacggaatgtgtactgatttacgatga

SEQ ID NO: 20983 - DNA, 213 bp, A.fumigatus
atcagcggattagaagctgatcagagggttcttgctgctcatggtgtttatgctctaacagcaacgacgggtttaaccgcccagaacaccttgggggtgcaagacatttttatcgtccctgcacagtttgtgaagaagcagatcaatgctgggttggaggatgtgggagcagatggtcttcaccacgggcttagaggcatcattgcttggatc

SEQ ID NO: 20984 - DNA, 804 bp, A.fumigatus
  unsure (29),(115),(801),(804): Identity of nucleotide sequences at the above locations are unknown.
acggttcttaacgtgtcgcttttcaaaanacctaaccccccggcaagagccacggtggcctgcggagatgagcttcctgagggcgtgaatgtcatggtctcattcattgttgatntgggagacagagatgcccgacaaggccttcatgttcagtctcgttcgtactgggcaccagccaacattgggccgtattcgcaagccatgtctattcctctgcgaggagccgaacatatagtatacattgcagggcagatacctttagagccggcctttatgcaaatggtctgtgatagtgcacctacggaggaacgatcgtggctttcggactactctctacgggcagtgctctctcttcagcacatgtggaggattggtgtaaccatgcatgtcgactggtggcttggagcagttgcatttattacaggtgcagaaaacatcgctgctaaggctcaagtagcctggcacatctgggagactatgaaccgcaaacgcgacgatgagtcgatcgacgaagaagaatcttcgttcgatgtgtgggatatcaaatacggacggaggacagaggagcagacccccaaggcgacggtctcggcttcgataccgaacttcgaggtgctacgatcgagcggagtaactcctcccttcctagccgtccaagtcgaagaacttcctcgcgccagtgacattgaatggcaaggcctgggctatcgctgcgatgggctggaattgaacgcagaagaaacagaccaaggacgtatcagtcttcacgcaccggggctggaaggaaacgcgctccggcgncan

SEQ ID NO: 20985 - DNA, 507 bp, A.fumigatus
  unsure (59),(70),(108),(116),(117),(233),(234),(290),(291),(301),(302),(309),(322),(334),(335),(336),(337),(340),(343),(346),(347),(348),(349),(353),(355),(356),(357),(358),(359),(360),(362),(363),(36: Identity of nucleotide sequences at the above locations are unknown.
ccaagaaaacagaggaagcagccaagaaggaggaaaaacccccccgagggacccccacnaaggaggaaangagggccccggaaacggaagaggaaaagacacacggancaacgaanngacccacaggggaaggcaagaaaaaaacaaagcggcccccaagaaaccagaaacacggggaggaaaccaggcaacgcagagaaacaccccacacccaaaggaagaagagggccccnncccccacaggaggaggggaaagacaaaccccaacccgaagcaagacgggaggcccnnaacagaaatnngacaaanaaacgacgttggnaggggagggggnnnnatngangcnnnngaangnnnnnngnnnnnannnngnnnngnnnnnnanaccacccccaaacccaccatcaccatcctcaatacctccctccgccaagtcccatccagcacaaagttcgacctcatcgtctcaccagcaaactcctacggccgactcgatggcgcctttga

SEQ ID NO: 20986 - DNA, 945 bp, A.fumigatus
  unsure (58),(69),(107),(115),(116),(232),(233),(289),(290),(300),(301),(308),(321),(333),(334),(335),(336),(339),(342),(345),(346),(347),(348),(352),(354),(355),(356),(357),(358),(359),(361),(362),(36: Identity of nucleotide sequences at the above locations are unknown.
caagaaaacagaggaagcagccaagaaggaggaaaaacccccccgagggacccccacnaaggaggaaangagggccccggaaacggaagaggaaaagacacacggancaacgaanngacccacaggggaaggcaagaaaaaaacaaagcggcccccaagaaaccagaaacacggggaggaaaccaggcaacgcagagaaacaccccacacccaaaggaagaagagggccccnncccccacaggaggaggggaaagacaaaccccaacccgaagcaagacgggaggcccnnaacagaaatnngacaaanaaacgacgttggnaggggagggggnnnnatngangcnnnngaangnnnnnngnnnnnannnngnnnngnnnnnnanaccacccccaaacccaccatcaccatcctcaatacctccctccgccaagtcccatccagcacaaagttcgacctcatcgtctcaccagcaaactcctacggccgactcgatggcgcctttgatgacgccatatcccgcgttttctgccagcccccaaagcacgaatacaacactctcaccgaggcaacgcagaaagtcctctacaagcagtggaggggtttcgcgcccccagggacatgtaccctcgtcccctttccggatgaactaatcggggaaaacgaatggggctgtcgctgggtggcgatttgccccaccatgcggtacccggatcgggtcacttgggaccgcgagatcgtgtatgagtgtgtgtggagtctgttgtgccaggtcgaggggtggaatcgcggctgcaagaaagagaagcggattgagtccattctgattaccccactggcgacgggggtgggaaaggtgagtgcggcaaagtgggcggcgcagtttgtgctggcgatgaggcattttgtcttcacccaccggggctggaaggacacgcgatccgga

SEQ ID NO: 20987 - DNA, 738 bp, A.fumigatus
  unsure (85),(688),(695),(713),(715),(716): Identity of nucleotide sequences at the above locations are unknown.
tgcggcactcttaatcagtactatttcggcgaagcttttgacgagcaaagggtcaccggtgcagaaatcgaaagaggtgtgatcngcttgtacagcaacttggtgcgtttcggttatttcgatggcaatgaaagcgtgtatcgggacttgacgtggaatgatgtcgtgaccacggatgcctggaatatctcatacgaagccgctgtagaaggcattgtcctactgaagaacgatggaaccttgcctctcgccaagtcggtccgcagtgttgcattgattgggccttggatgaatgtgacgactcagcttcagggcaactactttggaccggcgccttatctgattagtccgttgaatgccttccagaattctgacttggacgtgaactacgctttcggcacgaacatttcatcccactccacagatgggttttccgaggcgttgtctgcagcgaagaaatccgacgtcatcatattcgcgggcgggattgacaacactttggaagcagaagccatggatcgcatgaatatcacatggcccggcaatcagctacagctcatcgaccagttgagccaactcggcaaaccgctgatcgtcctccagatgggcggcggccaagtcgactcctcctcgctcaagtccaacaagaatgtcaactccctgtctggggtggatacccgagtcttcnccgaggntgcaaaggccctcaaaananngtcctcacttgggaggggctcc

SEQ ID NO: 20988 - DNA, 252 bp, A.fumigatus
cagagccattcgacgcttacggtgttggcggctgtccagctgaagagtgcggagttggctcgcgcggcttgggaccagttcttgcatacggatgggtatacggaggagcatgactggagggttgttgagacggcgccgccagagtactttacgcatggggaggaggctgagtggattacgacgaatgaggatgcgaggtacggtgtgtctgctatgttcaatctggcgaatatcagggagtatctaagatag

SEQ ID NO: 20989 - DNA, 183 bp, A.fumigatus
gatagactcggtctcttgatggccatccaaccttacacccttcctccccatagtaccccccacaacacccatacacaaacccctcaggatgatcctcccgattctcctccgtatcaatctcctcgtcttcccagagatcgataccgttccagtactccttatcatatacagcctcctctatag

SEQ ID NO: 20990 - DNA, 183 bp, A.fumigatus
gcgggagtatgccatctaaactctaacgattattcttgtacttctgcagccgccggtctacccaaaattatgtactactgtcgatttagattgatcgcgccgcttttcacctgtggtttccagaatgatcaacctgcggctgctccgagtcacagcccaggggtcgtttacccccagatgtga

SEQ ID NO: 20991 - DNA, 183 bp, A.fumigatus
gttccacgggggatctatcagcactccaatgcctcccttactctggtatcaacgatgcacgttagaatcctccgcggtggatgtgaagtggagcagtggaattgcgtcacatctgggggtaaacgacccctgggctgtgactcggagcagccgcaggttgatcattctggaaaccacaggtga

SEQ ID NO: 20992 - DNA, 315 bp, A.fumigatus
  unsure (208),(285): Identity of nucleotide sequences at the above locations are unknown.
gagttgcggaaaactacacttcgcttgccatcagttgtaataccccaccagccggacaccatggaaagtggttctgaggaagaaattgacatccagtacaccgactgggaatctgagacggacccaacggcttcggagtccgacgaggcgttcattgtttatgatgacgaacctattgagatggaagactacgactcgagttatgtcnctacagaaagcgaagaaatcgccctcgttcactaccgtctcagactatggagaaacattcaacgaagtaagatgacncttcctcgccggcttgccagctacttatga

SEQ ID NO: 20993 - DNA, 765 bp, A.fumigatus
ggacgcgttatctctaccccgcgtgaagactacgacgtcagcatgaagtacggggtacgagcgacaccgaccttcatgacgttcctcaagggcaagaaactcgacgaatggagcggtgcagacccggccaagctgcgcggcaacgtgcgtctactcatcgagatggcccatccgactcatcgccatcgccaactccatctccccagctttcagcgtcatctatccaacttcgtcatgtacaagaaggttcctccgctcgacaaagttgtccagagactccagcctcaccacgaggacccgcgtctcaagtccatgatcgccttcatcaccgcccgctcatcatcaaccacacccaccagcccagcagcagacgtcgccctccccgaagccctcccaaccttcgcctcctatctccaatccacctttcacgccctccctccagaaaaccagttcgccctcgtcgacctcgcccgtctcctcttcctcgacacgagggtatcaagcttctttgccgaacaacccaaccacaccaccctcctcaacctcctctccccatccacgaaactctcctcctgcccctacaatcttcggatcgtcatgctccaactcatctgcaacctcttcagctccccgctctacctcgaccatctcaccacaaataccgccaacaagaacaaactccacaccacagtcctaaacctcgcaacatcctccctcctagaaccgcatccaaacctccgcaccgtcgccgcctctctaacctaa

SEQ ID NO: 20994 - DNA, 522 bp, A.fumigatus
  unsure (43): Identity of nucleotide sequences at the above locations are unknown.
gacagatcggcttccctggagccatgtttggacgggttcaccntgagagactttctgtctgggctagaaaggacagtccagagaaatgaaacgacgttgaccgagtataatcgcattcgtccagatcccccaatgatcgaggcatctaacgaaaacgccccgctcactcgtaaagaaatgtcgcgacaggttcaaaccttgcttaccccagagacaacactatttgtggacacgggagactcgtggttcaacggaatcaagatgagattgccccatggtaccaagtttgagattgaaatgcaatggggtcatatcggatggtcaataccggcatcgtgcggctatactgtcgcagaatcccaacgtcaggtggtagtgatggtcggcgacggtgcattccagatgacagcccaagaggtctcgcagatgattcggtacaagaccccagtgatcatcatcttggtcaacaaccagggctatacaatcgaggtggaaatccacaatggtatctataaccagatc

SEQ ID NO: 20995 - DNA, 309 bp, A.fumigatus
  unsure (13),(20),(77): Identity of nucleotide sequences at the above locations are unknown.
caattcgttcgcngtaacgnccgccacgaagaggccaagatggtcctcgacgagttatcctcggatctggaatcggncggcatccactcgcaggcgatggcagaccgcgccactagccttcgagcacaggcacgcgcgcagggcctcatcggcatggagcggtccctgtccatgctcatttggaactactaccttgccagcgtggatcagcactcgtccgaggccgtcactctggccgaagacctcgccgacgaactgatgtccacccatacgacggttgacagtctcgcggggctgtctccagagtag

SEQ ID NO: 20996 - DNA, 486 bp, A.fumigatus
  unsure (457),(460),(461),(464),(468),(474),(476): Identity of nucleotide sequences at the above locations are unknown.
cgtatctacatccacagtctgatggacagcattgcgtcgtcgggcagcggtcgccattccacgtctgttctgagactgtgtcacgacctctgcaccctgcatggccgcgagggacagtggaaacagggcagtgactgcgcctggtcagtcctgaagcatgtctggccggatgtccacaatcctacctccgaggccaagttccgatcggaccgcgccccgttgattgcgaatatcgttctcgactacgcgtactgtcttttccgtcggctggacgttgccaatgccacgacggtctatggaaacgcgttcaaggcgtctattaccgcggagaaagtgaccgtgccacatctcacggctgttgtcaagaccgtggttgaattttatgaaaccacattccagttttctaaggcgctcgtcctgctgcgtcttcaccacggttgcaaggacgtccaaaaanganntcntaanaaaggngntcgatgggga

SEQ ID NO: 20997 - DNA, 609 bp, A.fumigatus
tggccattgcagcggctccttgaaccccgcggtgaagacgccggaaaatatggcgaggactccaagcttatctacgacctccaggatcaaggtggcgagctctgctctcttcgctacgatctgaccgtcccctttgctcgctggctcgccatgaaccccgacgtgcgcagcatcaaacgctaccacattgccaaggtgtatcgccgtgatcagcctgctgtgagcaagggccgcatgcgcgaattctaccaatgtgattttgatattgccggtgcttttgatcctatggtttccgatgcagaggttctacggatcgtgacagaagtctttgaggagcttggatggcaggggcgttatactatcaaggtcaaccaccgaaagatcctggacggtgtcttcgaggtctgcggggtgccgcccgagaagatccgtcctatctctagcgccgttgataagctggataaaatgtcctgggccgatgtgcggaaggaaatggtcgaggagaagggactgcatggcgaggtggctgacaagatcgagaagtacgtggctggcaagggcgctcgggatctactcgagtccctatggaaggacgagtctttaactgcg

SEQ ID NO: 20998 - DNA, 555 bp, A.fumigatus
cagtgccgtatcaccaccgaagacccggccaacggcttcagacccgatactggaaagatcgaagtctaccgttccgctggtggaaacggcgttcgtctggacggtggcaacggtttcgcgggtgccatcatctcccctcactacgactccatgctggtcaagtgtacctgccgtggttccacatacgagattgcgcgccgcaaggtcgtgcgtgccctggtcgaattccgtattcgcggtgtcaagaccaacattccgttcctcacctcactgctgagccaccccaccttcattgatggcacgtgctggaccaccttcatcgatgacactcccgagctgttcgctcttatcggcagccagaaccgtgcccagaaacttcttgcctacttgggtgatgtcgccgttaacggcagcagcatcaagggccagatcggtgagcctaagctcaagggcgagatcatcaagcctaccctgctggacgatgccggtaagccgattgacctgagcgttcccctgctttcttacaccagacgggaggcgaaggatcatgcgtaa

SEQ ID NO: 20999 - DNA, 270 bp, A.fumigatus
aacagcacgttgccgacgcggaagcagaagatcgcggggatccagagcatgacggctgttattgaggggatcacgccgggtagcggagcgtacagtaacgaggcgaacccgttcactatcaactggcgcgaggcgtggtggggcgagaactacgagcgcttgctccgcgtgaagaacaagtatgatcctcgggggttgttgaagtgctggaaatgcgttgggtgggaggagtctgatgctgccacttcgccttttgcggcgtttgtctga

SEQ ID NO: 21000 - DNA, 225 bp, A.fumigatus
acaatgatgttggatggtgtcccccaaccgccggaacccattgaggccaaacagaatgatcaggagaaggcacttgatgacggtgccgacttgaaaccaatcgacaataccccttacattgatcctttcggcgacgagcaaaatgcagaagtcaagtacaagaccctcaagtggtggtacgtattgcggtcccgatctatctacgacaagggtgtcgatagctga

SEQ ID NO: 21001 - DNA, 204 bp, A.fumigatus
  unsure (77): Identity of nucleotide sequences at the above locations are unknown.
ggaccatgtccggataatataaccgggaaagacatcggacatctatcgtggatatgtatgtctgcgctgatggctanggaatgtcaggctcgcaatgcactgttcatccctatcggttatatggctcctacaggcatcagcatcacttcagcttgtgcatgtcatacgaggaatgctaatgctaatgctaatgctctagtttag

SEQ ID NO: 21002 - DNA, 603 bp, A.fumigatus
  unsure (60),(67),(84),(115): Identity of nucleotide sequences at the above locations are unknown.
tcaccagttttactccccaaaccagtcgactggctaaccaatatcgacgtctggggttcnagcatgntgcccggtgcaagcagntatacgccgccggacgacgtggtcaagttcntgcaagacgggcccccacccatatatgtcgggtttgggtccatcgtcgtcgataacccaacgaaactcaccaggattgtctttgaggcgattgtcaaaaccggccagcgcgccttcgtcaacaaaggctggggcaacatcggcgcgggggaagccgaaatcccccagaacgtgtttatggtcggcagctgtccgcacgactggctgttccagtacgtctcatgcgtggtccatcacggcggagcaggaacgacagcagctgggctcgcgctaggccgaccgactatcatcattcctttcttcggcgaccagcccttctggggctcgatagtgtaccgagccggtgcaggccccgcacccatcccatataaacagctgaacgcggaaaagctcgccgacgcgatcgacaaggctctcgggccggagatgcaagagaaggcaggcgagatcggcgcgacgatggtcttcaccacgggtggaaatccgcgt

SEQ ID NO: 21003 - DNA, 249 bp, A.fumigatus
cctagggctatctgggcgcgttccctggactttacacaggcaacatctttccctccaatcacctccggtccggcctccggaactgtgctgccatgtttgcctaaagcgcctcacacccctgccgcctatccaccacggcccctgggatccgaaaatgaaagcctaaaaggaatggggttccccccccgccccccaaacctttccgaagccgaaaggattgcaccgggcccccaggcccccaagaaggcc

SEQ ID NO: 21004 - DNA, 456 bp, A.fumigatus
taccagaaccatcttacctcatacttacgcgatcagatctgcggcgtcaaaggcgccctggcctgtgcctcctacacggcggccaccatctggccctacaaactcatcatgcacctcctcgtcagcctcctagcttcaggaaaggtcaacctccaaacccacacgccggccaccgcagtcacaccatctgcagatggtaaattcacaatcgacacccctcgcggctccctccacgccaacaaggtcatccacacctccaacgcctacgtctcctccctcctcccgcagtacaaacacaacatcatcccctgcaaaggcatttgctgccgcatcaccgtcccagaagggcaaaccgccccacttctcaccaactcctacatcgaccgcaccaaggacaacgtcctatcgtatcttatcccccgcgcagacgggagcatcatcgtcggcggcgcgtcg

SEQ ID NO: 21005 - DNA, 294 bp, A.fumigatus
gggagcaagcacaataaagcgattatcctgtcctccatcccccatccctatccccaccagcagcacattcccgtcaacaacaagaccgaaaaccatccagtccgatttgcaatgcgccatccggctcacgaatcgatccagtcggactctacccctttgctctcagcgcagcggatgtgccagggtctcgctgtttgctacctgcgcagaaaactcattgtcgtgtctttgctattgtctagctgcagccatctcatcttgtcttacaccgacggcgatggaaggacacgagac

SEQ ID NO: 21006 - DNA, 477 bp, A.fumigatus
gccggtgtttctttggaggcagattcctataaagccgatgcgtctctgtctgagcagggagaggactacgcaaagaaaatgactgaacgtctcctgcagcatagggaatctgaaaaacaggccatgatcgaccgtggagagacggattatgaactcaaaccactgacagtttggacatccacaagacgcaggacggttgagaccgcgaaatatttatatgaaaaggggtacaaagtccggcaacgctcacaaatgagccagctgaaccctggtgtttgcgagaaaatgtctgagcgaagaattcgcgaagagtatccggacgaggtggctaagcatgagctcgatccttaccaccatcggtaccctcgagcggaggtcagtttaatttcagcttcaaatctgacgttgaccacccgagcttaccactatgacagtcctaccatgaccttgcggtgcgacttgaacccatcattttag

SEQ ID NO: 21007 - DNA, 210 bp, A.fumigatus
  unsure (5),(93): Identity of nucleotide sequences at the above locations are unknown.
cccantaacccaaaggtactgcgctacctccgtggggcagtctcttgggaccagaactgggaccacatgaggtcagaaggcgagactacttgncttgcgagctttacccttactactggaaccagactaaaaaacctggcccgggctggtatgccttggtgtcatccaagggccaaatccgccccggtcggttattttggggccccattg

SEQ ID NO: 21008 - DNA, 189 bp, A.fumigatus
caattcgcatgtacccccgagggttatataatgcgcgagtgtatcaccaacgatgcaagaattgcagagcccttggtcggccagtccttgatcatgagtgctatgcggaaagagtggcatactggctcaaaaaatggaatggaatcttcaccacgggggtcgaaggtccgccgctatgcgtatagtaac

SEQ ID NO: 21009 - DNA, 846 bp, A.fumigatus
  unsure (78),(102),(145),(178),(238),(279): Identity of nucleotide sequences at the above locations are unknown.
ggcaaccatcttttgggtcccaaggcctcctttcccatggccgaacccaaccaatttccttttctttccccaaggggncaaagcccggaaacccctccgtcngcaaccagtccctcctttcacaccccatcaccagcagcgccgnccatcatgaagactggcaccgcaaaaggctcgncgaacgccatcctcgagcatttaggctatactcccgaactgtcccgcaaccggtccgtcntgcaggtcgcctttatgtgctttatcctctcctccgtcccntacggtctggctaccaccttcttctacccactcgccgccgaaggcccgtccaccatcgtctggggctggattatcgtctccctcgttatcctgtgtgtagccatctcgctggccgagatcacctccgtctatcccactgccggtggcgtctactaccagacctttgccctatcgcccccctggtgccgtcgcgccgccgcctggatctgtggatgggcctatgtcctcggcaatatcaccattaccctggctgtaaactttgggaccaccctgttctttgtcgcctgtctcaatgtcttcgaatccgagcccggtgtcgggattgtagatgacatgcagacctaccagatctacctcatcttcctcgccatcaccctgttgacccatgcgatctcgtccctaggcaacaaatggctccccagtctggaggtatgtttcttttcttttcttttcttttttttatttattttccaatgttttccctccgttgcgacccgtgtgtcttggctcccaatgcgacttctcatgcgtttcgtctccccatatagatttcggccatcttcttga

SEQ ID NO: 21010 - DNA, 186 bp, A.fumigatus
agaaatggactcaatcagattgtcgtgattcgtcttactcaaggggaaatgagttccggggtaacacacactctctcaaccttgaacccagaaacatgccccgaggacaaggccaccgctcttcccgtctctaggtgtcgacaaatcgtcttcacctacaggagccgcggcaccgcgcatgctatg

SEQ ID NO: 21011 - DNA, 189 bp, A.fumigatus
atcaagctgttgttgatcggggactccggcgtggggaagtcatgctgtcttctgcgattcagtgaggattcgttcaccccctcattcatcactacgattggaatcgactttaagatccgcacaattgaactggacggcgaacgcgtgaagcttcaaatatgggatactgcatgtcaggagcggtttcga

SEQ ID NO: 21012 - DNA, 201 bp, A.fumigatus
  unsure (49): Identity of nucleotide sequences at the above locations are unknown.
cccttttggacgcgatactttccagccccgggccgtgtagacaggcttnggaaggtcaagcacatcatctggctggagaagcacctgaggtcgatgtgccgagagcgatcaaagggattgccactccaatacattctgggtgaccagccatttggagatcttgaaatactttgcgagagaggggtgctgatccccaggtga

SEQ ID NO: 21013 - DNA, 564 bp, A.fumigatus
  unsure (161),(167): Identity of nucleotide sequences at the above locations are unknown.
tttgcgaccaacctgactgcagatgctgctagtgcgtacacactattgtcatggattggagatacatcctggttggacatgacagcgtataactatgttccttcatatagccttactggaccatctacgagcacgaactcgagcactaccactcctgcttntactgntaccccctccgccaccgcaactgcaacgtggggtcatcctaccagcggaaccactcccccagcaggcgcggtcattgtctctcaaggagggtcggtgaactggtcgtatagcaacttgacagatgcattagctgctttacccaatgatgcttcgactcagatcatcttcatatatccagacacctacaccgagcaggttccatcaatcaatcggaaagggcctgttcagatcatcggctaccagtctggaaaccctggcaagacttacaggaccaaccaagttactatcacttttgcccgcggcctgtctgtgtctccactgccgacgggtcactctgacgcagagacggcgaccctgtcgacgtcttacacgcccggcggcggaaggaacgcagta

SEQ ID NO: 21014 - DNA, 213 bp, A.fumigatus
tctcctctttgccctcccctttatctctttttagtcaccatctctgcataccccaaactcgcagcttcctacctgtcactcttccccggtgacattccattgctcggagtggatcacctcgtcgccgatcctatcttctttctccctcttctcccaaccactcggctgctgcacctgagaattatctgtttatttatttttcgtcgtttctaa

SEQ ID NO: 21015 - DNA, 261 bp, A.fumigatus
acttgttactttccagccgccgtcgtgaagatctctctcgtcaacttctgcagtcttcttccctcctttcgccccccctcattccctctacccttgtcacgagcaatcagggtgacagctgattctttgcagcttctcttggttgactcttgcccccagctcacctatacccccctccccccccacatttccttaggactgtggttgtgttacatttacaagctgttaaatcccactcggttggacggtcttctctcttaa

SEQ ID NO: 21016 - DNA, 588 bp, A.fumigatus
cagcaacaagaggaggagaagagtcgcaatatcctgcccaagtcttcgtcgtcctccagcgttgacaacccacgaaaacagaccgagaagattgcgaccgagtgcatactttacggttacaggagcaaggatggcgagtggaaggtcatcgataagtacgagaagatctctcgaggcttgatctgtgaggattatcctcgtagcgatccgaactcgacgaatggcttcgcgcaactgcttagtggtggcgacgtggttatccggtctaatctatctgcggatgcgaaccgcaaatcgaaacgctacgctggaggtttccactggatcaaggtgacgtttgactcaacgatcgctgcggatcgcgcatgcttctactctccccaggagatcgacgggcatctcgtcttctgtgaactatatcatggctcgggacctgcagaggatgctccaattcctgtggactcatcaagagccgtccagttcaagtcgaaagcgccgcgcaccttaaccacttcgcactttactacatttctccacccgcaggataaagaccgtcttacacgccagcgggcggaaggtatggagtag

SEQ ID NO: 21017 - DNA, 216 bp, A.fumigatus
actgccgaagtcgggttcactgtaccaaattcgtggactcattggcaagatgcagaagctcgaggagagagttcaatctgcaaaatccaaactgccacccccgtcggattcaccatctcgtacgtcttctcgttcggggtcgatattgggcgagagtcctgttgcatctacaataacggcacgaagaaactcgcgcaaacggttgagtgggagtag

SEQ ID NO: 21018 - DNA, 1044 bp, A.fumigatus
cccaagttagccccggtcaccgccaatatccaattcgtcaaaagcctgggcaagccaatgaatgttaggccgggttcccttttcagaaggcctcgggtttctaactcgtcctttggaagtcggtcctgcaatgggtctcggactcagaaccatacaaaccattggcgtgcacaatcctacgcttttacgagcacccgtcccacgccgtcagttaggattcggcccggcttacccaagccgaaccccaagcccaatgaaaacaccaccaggcatattaataatgctcggtcgtctgaactgccgaagtcgggttcactgtaccaaattcgtggactcattggcaagatgcagaagctcgaggagagagttcaatctgcaaaatccaaactgccacccccgtcggattcaccatctcgtacgtcttctcgttcggggtcgatattgggcgagagtcctgttgcatctacaataacggcacgaagaaactcgcgcaaacggttgagtgggagtagttttagctcgtctgttcgagatggtgatagtgtgccttcttatgctccgcacagtcgaccgtcctttggtgctaggacccaaggggatagtcgcccaagcagtcgtactagttactcgagccacagctctgtcagccacagtacccatccgagcgtgactccatccacacgacccgagagccgtcagagtcggaccaagacaccgttggggcactactcgaccaacccgaccaccgagagccgtcgaccacgatcctcactcagtaacccatctaatcagaatggagttgtcaatgggatggcccacattgacgaggacgaggaccttgctatgcatatgtccttacgggccaggatcagcgagatccgcgagactcggcttccgtccatctccacgccgcctgggcttaagaaaagaaccccaagcgggatctctggtatcccagcgcctcgaacattgagaaccagcactggctttgaccggttggaaggcggtcttcaccgcggattgcgagggtccgtctatgtaaaa

SEQ ID NO: 21019 - DNA, 375 bp, A.fumigatus
  unsure (182),(362): Identity of nucleotide sequences at the above locations are unknown.
tatctttgtctccgggttcacgacggtatggttggatcaggcgtactggcagcgggcgattgcctcgcggccggagacttcggtcaaggcgtatctcctgggtgggatcgcgtggtatggtcggttcattatctctcctcgtctgtgactgcgcgtgttctgacgtccgcagggatcccgtntggctttgcaacagccatgggcctcgggtgcgcagccctgaccaacaatcccgcctttcccacatatccccatccgctatcgcccgaccaggtggcagccggactctctgccccggctacggctataacgctcctcggccacggaggcgcagtcctcatgctcattctcctcttcatggncgtcacgagctcc

SEQ ID NO: 21020 - DNA, 318 bp, A.fumigatus
agacatctggtctttgggtttctggttgccgcgcggattgagttgattgggagtccaggcagactgtatgacttgctgcaggaggcgtcgcgggagatgccgatcgcgcggaataccgacgggtcgtatctggcttttcggtcggttggcgggctggtctttgcgattgatatctttgtctccgggttcacgacggtatggttggatcaggcgtactggcagcgggcgattgcctcgcggccggagacttcggtcaaggcgtatctcctgggtgggatcgcgtggtatggtcggttcattatctctcctcgtctgtga

SEQ ID NO: 21021 - DNA, 540 bp, A.fumigatus
ccagatgtattggaaaacttggtttctcaaaccactatcgcggaaaagattggtcaagaatctactgtattatcgtggcttctctctcgtatacagcagaaagaaagtccagtcagtcaaaataagcagtacgctgcagaggttttgaccattatgctacaatcgtctcataaaaacaaagataaattcattggcctcgatggggttgatattttacttcaactactgagccactaccgcaaacgcgaccctgaaaaggactcggacgaggaggagtacgtggagaatcttttcgactgtttgatatgtctcgtcgacgaagatcccggcaaggagaaattcctagaaggcgaaggcattgagcttgctcagatcatgctgaaggaaggcaaattcagtaagcaacgtgccctgcgagttcttgaccatgctctgggtggtttggggggcggccctgcgtgcgaacgtctagtcgaggttgcagggctgagaacaatctttggaatgttcatgcgaaaggtaggcgttttattcaaatag

SEQ ID NO: 21022 - DNA, 351 bp, A.fumigatus
ggcattctcggcgatatcaaactcatcttccgggtcgcggattcgtttcgaagctctgttatcgagagatctcaagccggagaccgggctttcgtcgacagtatcgggaccatcggcaaaccccaaatcgatatactcttcatcgtcgagcggcaactcatcgtcatgctggcggagaatttcggctggagtatcatcctcgaactcatcatgattcttgccaaattcactagtgtcgtcgagatttccatccttgttcttagaacctttggaaggactctcgaacagatcttctacgaaaccaagcgtatcgttggcaggatctggagtatcacgttcttgtctctctga

SEQ ID NO: 21023 - DNA, 798 bp, A.fumigatus
tacctgcgaactcttatactgacacttgacaggctcggtgacaacatctccgagtggagcaagtaccgcatctccatctcgcagatgcttgcgtttgcctcgatgttccaggtgcctatgatcggatcagacgtctgcgggttcggcggcaacaccaccgaggagctctgcgctcgctgggcgcgtctcggagccttctacaccttcttccgcaaccacaatgaaatcaccggtatcccgcaggagttctaccgctggcccaccgttgccgagtccgctcgcaaggccatcgacatccgctacaggctgcttgactacatctacacagccttccaccggcagacccagaccggcgagcccttcctgcagcccatgttctacctctatcccaaggacaagaacaccttcagcaaccagctgcagttcttctacggtgacgccatcctggtcagccctgtcaccgacgggagccagacttcagttgacgcatacttccccgatgatatcttctacgattggcacacgggcgccgccctacgcggccgcggagccaacgtcaccctcagcaacatcgacgtgactgagaatcccatccacatccgcgggggcagcatcatccccgtccgggtcgagtccgccatgaccacaccgagctgcgccaagaaggcttcgagctcatcatcgccccaagggcttgatgggaacgcctccggccaattggtttctcgcacgaacggcgactccctcgaagccgcgcggcgaccctcgaactgggagttccacttaccgcaaagggcc

SEQ ID NO: 21024 - DNA, 459 bp, A.fumigatus
tcggatcagacgtctgcgggttcggcggcaacaccaccgaggagctctgcgctcgctgggcgcgtctcggagccttctacaccttcttccgcaaccacaatgaaatcaccggtatcccgcaggagttctaccgctggcccaccgttgccgagtccgctcgcaaggccatcgacatccgctacaggctgcttgactacatctacacagccttccaccggcagacccagaccggcgagcccttcctgcagcccatgttctacctctatcccaaggacaagaacaccttcagcaaccagctgcagttcttctacggtgacgccatcctggtcagccctgtcaccgacgggagccagacttcagttgacgcatacttccccgatgatatcttctacgattggcacacgggcgccgccctacgcggccgcggagccaacgtcaccctcagcaacatcgacgtga

SEQ ID NO: 21025 - DNA, 330 bp, A.fumigatus
ccaccaatggatcgccacgtcaatagtgataccacagcaacgagcctgacgagtatcgtgtacgaattagcccgccatcttgatgaggtcgacaaactacgagcggagctggatcctatcgaagcagatagtgacggcgagtaccagcacgacaccctcgccaaactaccacatctcaatggctttatcaacgagaccctacggttgcaccctcccatccccggtgtcattccgcgaaagaccccaccagaggggatccatgtgaaggatgtcttcattccgggcaatatggtcttcaccaagggcgcgaaagaccgcgctaagcgggaa

SEQ ID NO: 21026 - DNA, 462 bp, A.fumigatus
aaacggcggatgaccggtcgtatggttgacaagtacgcacgggaggtggatgattttgcctttctgccgattcgtggttctcggcatcgatccgaagacgaaagagaagctgcccatcaggatcaccggctgcgggttaccatcggcgtgaccggatggctgacagaggaggacaatttcgtgatcccgtggcgagtgatcggagcggaatcggaggtgtttggtctccgctgggaaaccgagcccctgatgaatctgggaaatgcgcttgaccttttggtaaccagcgccgcatggactgccggtgaacaagtcctgaagaagacattcctctcccaactcttgaccgctgtcgcgctgccgcttggccttctcaaggtcgcacgtgtggtggacaatccgtttagcgtatcgaaggctcgggcggacaaggctggggaggttctcgcggatgctcttatc

SEQ ID NO: 21027 - DNA, 183 bp, A.fumigatus
gtggttggtgatggtggtgttggtggcttgattgtacgaggtacctctcagctcagttgggttagctcgccagtgctgcctgtcaatcaagtctcggacctggactgggccttaatgccgtcggccggaatcacttatgacgacatgaaagagctcaatatatcatgtgacctattgtgttag

SEQ ID NO: 21028 - DNA, 456 bp, A.fumigatus
  unsure (105),(275): Identity of nucleotide sequences at the above locations are unknown.
gttcaccaccttctactactggcactcgtgtgtccgtggtgtaagtcacgaaccctattacgagtacaagagactgatgagaatagcccaccaaccccaaccggntgtgcgccctctcgggtacctccgatggccacggaaccaacgacaacagcttcgatgtatctggcgtcgacatctccagcatcttccaggttgccagcgagaaggacatcacctggaagaactacgacggcaccaacggcgccttcctctcggacgctctcttcttcaantggaccgcccaaaacgccaagcataacgtcgtccctctcgagaacttctaccaggacgcctatctcggcctccttccccagctctcctacatcaacccctcttgctgcgacctcgacaccaactccatgcacccctccgggtcttcaccacggggggcgaaggagccgcgctagcgagtag

SEQ ID NO: 21029 - DNA, 723 bp, A.fumigatus
  unsure (527),(697): Identity of nucleotide sequences at the above locations are unknown.
aagggaaaaggatgggggaaggtcgggggggtttccgctggaggattgccggcttcgacaacattcctgggtggtgttcaaggcgcaggggtggggacaacttggttaaacaacggtccgttgtggaacccccggaatggggggaatccccgcagcaccaagtggtgctcggtgtacagggacctcgattcagtcaaacatgaccccgatcactcggtcactggggaccacacggagttgtatggcacgtatactcccagtaaagatgccatcgccgacggcaccctgaagcccaccatgaacggctctgtggagcagcagctggcgcatcacaagggtcttgatcccaaggtggccgatgaggaagtcatgggctactactccgaggacgagatccccacgttggtcaacctggttgatgagttcaccaccttctactactggcactcgtgtgtccgtggtgtaagtcacgaaccctattacgagtacaagagactgatgagaatagcccaccaaccccaaccggntgtgcgccctctcgggtacctccgatggccacggaaccaacgacaacagcttcgatgtatctggcgtcgacatctccagcatcttccaggttgccagcgagaaggacatcacctggaagaactacgacggcaccaacggcgccttcctctcggacgctctcttcttcaantggaccgcccaaaacgccaagcataa

SEQ ID NO: 21030 - DNA, 363 bp, A.fumigatus
  unsure (19),(189): Identity of nucleotide sequences at the above locations are unknown.
cccaccaaccccaaccggntgtgcgccctctcgggtacctccgatggccacggaaccaacgacaacagcttcgatgtatctggcgtcgacatctccagcatcttccaggttgccagcgagaaggacatcacctggaagaactacgacggcaccaacggcgccttcctctcggacgctctcttcttcaantggaccgcccaaaacgccaagcataacgtcgtccctctcgagaacttctaccaggacgcctatctcggcctccttccccagctctcctacatcaacccctcttgctgcgacctcgacaccaactccatgcacccctccgggtcttcaccacggggggcgaaggagccgcgctag

SEQ ID NO: 21031 - DNA, 483 bp, A.fumigatus
gtgtccagtcaacaaggcgccacacatgagtccctgctcaaaaacgatatctggaatcgggacactgttttgcttctgctgacgtatctcatcttcgccctgggcaatgtgtctttcaattcgctttttcctatcttttcgcatgcctcacctcctacgggacgagcccttactccgagggagattggtctctcgcaaggttttgccggcctggccactatcctcttccaagtctgcatcttcggcagactacgagataagatgggcaaccggtggtcatatcgggcaggccttttcggtttcgttctgtcattcattctgatgcctttcgtcggatataaaggagacgatgctgacggtcgcctaaccaagaagactgctttcatggccattgaattgtgcttcgtgcttttggttaagacggttgctgcagttggcggtttgactagtgcacttttactggtaagattatccttttgctga

SEQ ID NO: 21032 - DNA, 387 bp, A.fumigatus
ccattggcccattccgcggaaacattttttcggatgccgagaagaaagtgtccgaacccatgcgccgtatataaataccaccccgacgaggctctttcattctggtttttcttttcttttggtaatttctggcatcccactactctcgcgcataccacaaccatgtcgatcggcaaactactctccaacggagccctgctcgtcgacgtgctcatcatcggcgccggtcccgctggtctctcaacagccaccggcctggcacgtcaactgcacacagctgtcgtctgcgactctggcgtctaccgcaatgcggaaacccaacacatgcacaaggtcctcggatgggaccaccgcaacccggccgaactgcgcgccgcgggtcgcgcc

SEQ ID NO: 21033 - DNA, 237 bp, A.fumigatus
atcttctctctccacgtgtacctctggaagatggtgtatcacctcggttatgcccttgaacgcgatttgctggtgcaggaagtcggttgtttggcgccaggaaccaatttttgtatagatccatcttcgatttattggggagtctcctattatttctcttccgaattccgcgtcatggcttcatctgtgggactgttgttcctttccttgacctcgttgttaccacgtttattgtga

SEQ ID NO: 21034 - DNA, 204 bp, A.fumigatus
  unsure (194): Identity of nucleotide sequences at the above locations are unknown.
ttgcaagaaacgggagactcacaaaccttgcaggatggaatcgactgcgctttgtgccacttccgccaggagactcccgagtctcccatgcatttcgagcttctacaaggtatgtcggacaatattctgagctacgacactgggtgtggtcttctaccacaaagggagtcgaaggatgcccgcgccattgcgtntaggagggga

SEQ ID NO: 21035 - DNA, 246 bp, A.fumigatus
tccctcataacctatcatctatctatctgtctgtctttctacaactatcgccctttccaccggtcgatttcaatctccctgacccatcctaccgttgctacgatttcgacccgccttatcccataccttttctccaccctttccattgatatcgactccttggttcatcatctcgacttcatttccctatccattctttcctcgaaggatatccttctagaacctcgtgcatacgcacatccctaa

SEQ ID NO: 21036 - DNA, 465 bp, A.fumigatus
agatttacccagccacccatgaggcgctcaccatctaccaaccggttctcttcctcacccatacctgaagcaagagtcagctcagaggaaaccgcagggccgtccatcatgtttgcgccaagctcatcgcctccgcgcttcccgaaccggttggaatcaatctacacccgactttcctcctccggggccagaagtgcttcgggatatcccaagcaggcgtctgttcctctgtcattcgacgatcttccgagtcgtgcgcagcacctgatccttaacgaactgatggcccggcaaagcagtcagacggccgtcatcttcacaaccctgccttccccgtccgagggtaccgcgggaagtgaggagacaagcgaatcttacttgagtgacttggaggttctgtggcaaggactgccaccctgcctgttggtccacagcaatagtatgaccgtgacgatgaacctgtga

SEQ ID NO: 21037 - DNA, 204 bp, A.fumigatus
aaaagagcccaatctcaatgctttccgagcgttatgaagcgtgggctaggtgatggaactatggccgaacaagctggctcgattagaacacctgcttttggagatcaggtagtaagcgcctcttcaaccacactgcttctgagctgcaacccttattcattgattaagtggggagctcccgccttcaaatttgcggatttctag

SEQ ID NO: 21038 - DNA, 189 bp, A.fumigatus
  unsure (21): Identity of nucleotide sequences at the above locations are unknown.
ccaaagaaacctcacttcccnccggagaggtcccagactgttgtgtttagtgttcgaaacagtgccttcccttacctcgacgggagcatgaccaaagtccctttagttctggtgaaggcattgtttgaagtgtatgccccgccaacactcggacggcgcaaatatacgcgagctctcagcgcttcttga

SEQ ID NO: 21039 - DNA, 450 bp, A.fumigatus
acagttccggtgtcgttttggcgtactggctggaattgtgggtccccttctcctctcccacttcgtctgaagaggtcgtttctaatgagtattagtggtctatcgttcatcgatggcgggagatctccgttccgttggagatttccaatcgcctttcagatcatcttcctgatcgtgttgttcgcagctgtctggttcttcccagagtccccaagatggctagtcaaggttgggagagagcaggaagcgcgctacatcctcggtcgtctccgtggcagcagcggcgatgacgcagtccgagccgaagccgagttccgtgatatccaaagcgtggcggagcttgagaagacaattaaccatagcaattcctacctttccatgcttttcggctacaagagcgggaagttgcacctgggacgccgtgtgcaactggtcatctggctgcagatt

SEQ ID NO: 21040 - DNA, 432 bp, A.fumigatus
cttattaaaaaaaacaatccaacaaatacatacccatattataccatctttaaaataaaatctcccattcacattacttataaaacatctctccccaatcctcaaaatataaatttcatacttccactaaccatactaattcatatcactcataaatcaatccctctctccgctcacacacacaaaaacctccctctttctccttctctctccattcaccttcccaccatgtccatccccatcatccccccgtactccctttactgccttcacaaacttgccctttctcaatccatcaaccaccactcccatatcaacatccctcgtccctccaactctactcttccgcgttcgcattccaacaaattcctcctcttcaccctggccaccacacccaaccagcctctcaacatcctcatcccaccgaattga

SEQ ID NO: 21041 - DNA, 396 bp, A.fumigatus
actccctcgtcgccagtactgtatgccctcataaatccacacatgaccctcctggctccctttggtacacaaaacaccgttgcctattcaagaataccacaagggctctcaacgccctcaaaaccccctcaaagtgcgattccggaagactccacattagccggtatccgaacagcgctgtcgcgatggcgcgatcattggttggcgctccgaaatacagtctccagccacgaatgggcgtccatgggcttctacaaaaacggctacaacttttggcttgtgtcgcagctcctcatcaccaagaagaagagtgtggatgtggtgatgcagatggaggtgaagtgcgaggataaactggagaagctcaaggtcttgctccaggatgagaacgattga

SEQ ID NO: 21042 - DNA, 240 bp, A.fumigatus
  unsure (201),(202),(203),(204),(205),(206),(207),(208),(209),(210),(211),(212),(213),(214),(215),(216),(217),(218),(219),(220),(221),(222),(223),(224),(225),(226),(227),(228),(229): Identity of nucleotide sequences at the above locations are unknown.
attcactacgcataccccaacttccaaaacatctcaatattcgtccctgtatcttcatcgatatacgccggcggctccgcaaacgtcacctcctccccgtgcaattctagcactttccccgtcaacgaagcgtctccaacaagctgcgcaaccgcccgcgtagcagtcgacatgggcgtaagaatcatagacctgaatagnnnnnnnnnnnnnnnnnnnnnnnnnnnnntctattctaca

SEQ ID NO: 21043 - DNA, 222 bp, A.fumigatus
atcactctgggagtcgacgtttcggtcaaccacgactcggtggttttgtatgctgtgacccttacatctgatggtggtattgcaaacgacaatcgcgattggggtgaccaggttgctcctgcactgccgatgtatgcgtcagatggcagtggcgagcttatgtttaatgatcctggttttgaggcaggtccttgcagctcatggaaatggaaatataaatga

SEQ ID NO: 21044 - DNA, 711 bp, A.fumigatus
atgactgacggtggaacaaaatccgtgtccccctttccagcaggtcctgtaggagaatacatttgcgaactttatcaaggccacaatcagctacgggagttgggccttattggttctaactgtcttgccaatgcgcgcgacttccaagcccctgtcgcgtctttcgaggatgaggaagaaccgaccgagtggcggctttacagcaagttcaacaacaccctcttttccgcacgccaggaccacactccctttgacatcgttgcctggcacggaaactattacccttacaagtacgaccttggtcgtttcaacaccatcggctccatttcctttgatcacccggacccctcaatcttcaccgtccttaccggaccatcagaccatgcgggtaccgctattgcggacttcgtgatcttcccgcctcgctggctggttgcagagaacaccttccgtcctccatggtatcaccggaacaccatgtccgagttcatggggctgatctgcggcaattacgatgcgaagacgggcggcggtttccagcctgcaggcgccagcttacacaacgtcatgagtgctcatggtcccgacgcggacgctttcgagggcgccagcaatgctgagctaaaaccccagaaggttggcgatggaagcatggcgttcatgtttgagaggtatgtagtgttacgctacattgaaagattcaaatactga

SEQ ID NO: 21045 - DNA, 234 bp, A.fumigatus
cattttgccgccgtttctttgtctgctaaagaactagccaactacgtgtccacatggagcttcctgctactaacctacggagtccttgctagccgccgctgcaaggatgctccaacaattacggagtacatgccaaaacgtcaagttggttccgaggctaccaaacggcaagttcgcgcacgaccatggttcgccaccacttggttcaggaaacaaaacaatatcaatggctag

SEQ ID NO: 21046 - DNA, 564 bp, A.fumigatus
  unsure (492),(521): Identity of nucleotide sequences at the above locations are unknown.
gttacgcttgcgcggattttccgcccccgtggtgaagatctagcagggagaacgaaaaccggcgttacgcttcaaaccctacatgtcaagcatttcgatcacggcgtcatcctccagcagactccagccccaggatttgagataccgaatcctgacacatgcaccgttccggaacttctaaacattgttgcccctaagggagcggagatcctcttggatggcattcgcaaaggattgttcgtccctcccatagaagacgcaggctggcgggcatcacagggcgatgagccattaattcatgcggcgaaaatcaagccagaggatcgacacatagactgggtcaattggacatggaaggacatcagcaggcggaatcgcgtgctcggtccgctatggaacaaaaccctcgcagttagcgatcctacttcgggaaatcctttgttccgacagcgcagagtgatcttgagcgagatggaggaagtagatacgatnaagggctgcgaggcattctctcttattcncgggttgccttttgtggatagcgcacatcccattgatcgccaa

SEQ ID NO: 21047 - DNA, 441 bp, A.fumigatus
  unsure (412),(417): Identity of nucleotide sequences at the above locations are unknown.
gctacgccagatgaaaaagtcgcagtccctcttcgggctcatgcattcacagcaacgcccgaatcaatgagactggcaaacgaggaaggaccaaaccagctggacccgaaggctataacgccgggtcatttagatggacagggttggcctgaatcgtttcttgacgacttcgaatcaaggatctggattacatacagatcgaacttccccccaataccgaagcctatcgatcgggatgcgttctccacaatgacactgagcgtgcgactgagaagtcagctcgttgaccagcatggatttacatctgacacgggatggggttgcatgatacggtcagggcagagcctcctggctagcgcaatgtccatattgttatttggcggaggtaccaatcagcgtcttgaccacgtgnccacnagggatactcgaacgtcaaatcga

SEQ ID NO: 21048 - DNA, 237 bp, A.fumigatus
acacctctctcttacaatgttattcttatggacatcaacatgccggttatgaatggactcgaagcaacgaccaagatccgtgaagtgaacagcgaggtacccatcatagcactcaccgggaatgcgctcaagggagacgcggagacataccttgccagaggcatgaacgattacgtcgccaaaccagttcatcgcaagcggcttgtgcagttgttgtggaagtggctcggttcgtga

SEQ ID NO: 21049 - DNA, 225 bp, A.fumigatus
cttaaagtgggcttggatgctccatcctttgcccgcacccctatctaccatagctctcgccctcagttgagcggtgtctcgctcatactaaacgaggcgctatctttggtcggctttgaactatccggctatgcatctttcatagcctcatcaatcgccaaaagaaatggccttgatggctatcagcttctcgagtcttcaccacggggctggaagatacgcgac

SEQ ID NO: 21050 - DNA, 579 bp, A.fumigatus
  unsure (337),(338),(340),(341),(342),(343),(344),(345),(346),(347),(348),(349),(350),(351),(352),(579): Identity of nucleotide sequences at the above locations are unknown.
tataattataaaacgaagtccgcatcttcgcagcagcgcacccatatcacccgatttacgctatgtccggacctgtataccctcacgatcacagacaaggcaccgaatgccgataatagtgttataacatactcttacataggcagcgtggacccagaacatgctacgtcggagtcccgcgagcggaatcttgtattggtcttcgatccggaccgtaaggtctttgttctagagtcgattgcgacgcagttgaatttcaatcttcggtcggcacctaataagaccgaaaagcaagtgacagagcagtatgcgcagctgcgaacattgcatgatgatnntnnnnnnnnnnnnngcgacggagcagttgaaacggccgctgacaccgacgacggtcccgctgatgccagcaatccctacgactaccgtcacttcctgccaaaagaaaacgctgacgatgacaagtctgtttcagatggtgcaatatcagctcatctcaatgccagtaaatctaatacccctctgatgaccgggactgccaaacctattttcaccacagggccggaaggagccgaaaaatgn

SEQ ID NO: 21051 - DNA, 294 bp, A.fumigatus
aatccaacgctattgtggccactgtcactagttcttgatatcgtcatgctcgtctctgtgattctaaccccagcgctcctgcttggagtggccaacgctgctacactagcaaaacgttggagtaacggtgacgttgccacaggtaccacagacccaaatgtggccagtgggtgcacgtactgggccaattctattgcttcaagtgacacctgcgaatctttgaatgcctattttggcattacgattgctcagcttgtttcatgggtgagagtcaacttgtctccactcagctag

SEQ ID NO: 21052 - DNA, 237 bp, A.fumigatus
attgttggtgctgtttaccaatgcaagtgcaatacgctaggagggcatagtgcttacctgcatattaatgagctagtgcaactcgcggccaatgcatttcacggtgtcgcctgtaatttccatatcaccaagggcaaacactcctgcactggtgactgtcccatgggcttaatgtcattaagacgacagttttcaaggtggcgctggatgatagagttcctgatctttttaatatga

SEQ ID NO: 21053 - DNA, 399 bp, A.fumigatus
agcctagtgagttattcgctgtcacgaacatgtcagccctctaaccaagtccaagtccttgcggtgtgggccggtctagcgctcaacggcgacgttgtccccgaagacgaactccacgtgtatgtgcaggacgccctcgatgagcttgagttcctcaccggctccgtggagaccaagtatggagcattgcgcgcttctgttggtcatcccgaaccctgggtcatcagatatgtcgaagttggcaacgaggataacctgaacaacggacttgcctcctactcatcttaccggtttaaagctttctatgatgcgatcaaggccaagtaccctgacattactgtcctggcgtcgaccattcatctgacgttttcacacacggccgggcgaaggaccagtgta

SEQ ID NO: 21054 - DNA, 528 bp, A.fumigatus
cgcgtttgcttccagccccgtggtgaagacatctcgccatgcaccattcggaacatctgctcgcaactcagttctggtcgtgtcagtacccgctgcttggtcagcaacagcaacatcaccacaatcacagacagccagtgcggaaatggcattgtggaagttggcgaggaatgcgactgcggcgccacctgtgatcagaacagttgctgtgatggatcgacctgccgcttacgagcgggggctctctgcgacgatgctgcgagtccgtgctgtaccaactgtcagtttgcctcggcggatacagtctgtcgtccaagcaccggcccatgcgatgttgaggagatgtgtaccggcaattcgaccatatgtcccgtggatcgggttctgtcgggtggacaacgctgcggggatggtgaggggggttccggtaacccgtcatgttccaacggagaatgcagacgaaatgagacctcctgggtggacagtcatcgatcactcattattggtctcgctgctgggattggcggt

SEQ ID NO: 21055 - DNA, 225 bp, A.fumigatus
ttctcgatatccactgcattccccaagtcgaaaagagaggataccaaagggtcgcataattctcctgccgttgtaataatgtgggagactgtctcatcatcgactaagggccaacaagcggctaattcagggtgcactctaagtaacaagcttttattctctatgagtgatgactgtggcgccgtcaatggtgaaacaatggtagtgctcgtaactcctgtatag

SEQ ID NO: 21056 - DNA, 417 bp, A.fumigatus
caaggcgcctcagtacggacggtattcagctccgttgcggcttcgtacgacaccatgaacgatttcatgtcccttggaatccatcgtctgtggaaagaccactttgtacgatctctgaacccgggctccgcgctaccatctcgcgacaacgacgccaccggcaaaggctggaatatcctcgatatcgctggcgggaccggcgacatcgcattccgcatgcttgaccacgcgaccaacatcaacaacgaccatcagacgcgggtgactatcgccgacatcaaccccgacatgctggcggagggcaagaagcgcagcatcagcacgccctactacaatactccccggctgtccttcatggaagccaacgcgcaacacatgccggtcgtcaacacgccgagtggaagtatgcgtcgcacg

SEQ ID NO: 21057 - DNA, 384 bp, A.fumigatus
  unsure (34): Identity of nucleotide sequences at the above locations are unknown.
ggggatttgccgggacattgggcgatgagtgggntgattatattctggcagatgagatctccatcccctttcgatacgttaggtcccggaaggggtaacgcccgtattgaggatcgattcttggagcaggatcacggggaggagcttgaagactgggtgtatggcgagaagattgtctatactcgcgatacattcttctgttgcgaccatcggcaaagcgctcccgacgcgaaagatgcgcgcatcacctgggagcaggagcaggagcggcgatggcgaatgcggaaagagctgttcccaaatctcagcgatgacacgatcatcctcggtaatttcaaccaattgtacaaggtgagtattgtccttatgatgatgtgtgattag

SEQ ID NO: 21058 - DNA, 447 bp, A.fumigatus
  unsure (418): Identity of nucleotide sequences at the above locations are unknown.
agtatgctaagccttttcattcagattgagccaacaacgttccgtacatggcttcgtatactggcgcgcattcccaacgcggttctgtggctgcttcgcttcccggacttgggtgaacagaaccttcgggagacagccatcgcgtgggctggccgagagacagcatcccggatcatttttacggatgtggctccgaagaacgctcacatctctcgggcgaaaatcctggacttgttcctagatacgccagagtgtaatgcacacacgactgcgacagacgtcttgtggagtggcacaccactgctcacatatccccgctacaagtacaaaatgtgttctcgaatggcgagcagcatccttagcagcgcgctgcctgactctgacgctggccgcaaggcccctgatgagttgacgggtnttaacagacgggcctggaaggtattgcat

SEQ ID NO: 21059 - DNA, 267 bp, A.fumigatus
aagacagacctgggtgatgtgcttgatagcattaaactcggggatgctcaggatgggggagggaagacgcagacggttgcactgcgaggcatccatctccaagagattgccctgaggaccaacgtaacactcgagagacatgacaacagcctcccgaatagggtcaatgggagggttggtgacttgagcgaagagctggcggaagtattcgtaaagaaggcgaggctgctgcgccatgcaggccaatggagcatcattacccattga

SEQ ID NO: 21060 - DNA, 726 bp, A.fumigatus
  unsure (10),(14): Identity of nucleotide sequences at the above locations are unknown.
tggggttatngtgntgcgaatttggaccgcaacggtttgcgtccttgccgtttttatgtgaccgatgatgaccgtattatctgtgcctctgaagtcggtgccgtggacatcgacccggaaagagtcgttcaaaagggccggctacagccgggaaagatgcttctggtcgatactgtggccggtcgtatcatcgatgatgctgaactgaagcacaccgtcgcccaccgtcaagactttgccgcgtggctcgacaaggaacttctgaaactgcctgacatcaatcgaaagttgctggaacagaatgtggatcttagttacacactcgacgacaccactgttcaaaacgaccctcggctcaaggctttcggttattctttcgagcaggtcagtctgcttcttggccctatggctgccgattcgaaggaagccctcggttcaatgggtaatgatgctccattggcctgcatggcgcagcagcctcgccttctttacgaatacttccgccagctcttcgctcaagtcaccaaccctcccattgaccctattcgggaggctgttgtcatgtctctcgagtgttacgttggtcctcagggcaatctcttggagatggatgcctcgcagtgcaaccgtctgcgtcttccctcccccatcctgagcatccccgagtttaatgctatcaagcacatcacccaggtctgtcttctacgacagccggccgaaggataa

SEQ ID NO: 21061 - DNA, 249 bp, A.fumigatus
cggaacaggcttctggatgtgctggcccaacgcaaggacagcggcgagatctacggctcgattctgattgacggccggccgcagggcattagtttccagcggaccacgggatactgcgagcagatggacgtgcatgagccgacggccacggtccgggaggctctggtcttttcggcgctgctgcgccagccggctcatgttccgcgcgaggagaaactggcgtatgtggatcacatcattgatctcttg

SEQ ID NO: 21062 - DNA, 321 bp, A.fumigatus
acgcggattttccagccctttggtcaagactacgtcctgacggcgttagggcttgagttgctcaatagccagggcggatcgtctgtcctgctgtacaagcgggggagccagaagacaagatcggaagacaccacgaccccagtgcaagaggccgcgcgggcgtcgcatgccaagcagtcgaccttcacctggcatgacctcgactaccacgtcccctaccaaggacagaagaaacagctcctggataaggtgtttgggttcgtgaagcccgggaacctggttgcgctgatggggtgctctggagcaggaaagacgacgtaa

SEQ ID NO: 21063 - DNA, 246 bp, A.fumigatus
gggggtaacgcattcttcggtccttcgaccgctgtcgtagaagacgcacagtcgtcgaccaaggcgctcaagagccatgagaagaaagtgaccgaggatcttaaacggagcctcaagcaagagaaacaggtccttcgtccagccaggaaacctttctggttcgagaagttcctgttctttatctcgtccgagggctacttggttctggggtatgtggtacttctgtctctgccgtgctatttgtga

SEQ ID NO: 21064 - DNA, 660 bp, A.fumigatus
tctaactttggtagtggccgtgacgctatgcagagcgagttactataccgtcgccatctcaagaaaggcgatatttttgtgcatgcagatttggaaggcgctcgaccgatgatcgtgaaaaacagaccagggacaccggatgcacctataccaccgagcacactttcacaagcagggaacctctgcgttgcgacatcgagtgcttgggaatccaaagcagtcatggcagcatggtgggtcaatgcaaaccaggtgactaaaaccaccacaggcggtcttctaccgacgggagaattcgagatcaagggtgaaaagaactttctcgccccgtcgcagttagtccttgggtttgcagtcatgttccaaatcagcaagaacagtttgaagaatcacaaaattcacatattcgaggatgcgactcccacagagccatcggcgaaggaaagcggaactgccaaagagattgtagacaatgagcaatctgtggcgcaagatttggggccagcagagacagataagtgtgctgcgaaccgtccaattgaacaagaacgcaagtctaactcggagtccgaaaataaagaggtggaaccgggactccattccgccgaaggaaccccttacagcgggggtgtttctgaacccctttacgaaaccaagaag

SEQ ID NO: 21065 - DNA, 210 bp, A.fumigatus
ggtgttgctgctgttcgggatgaagtcagtgtgtccgattccgccctatcacttgcgttcgagatgcaccagcctaagtctctccggaaatatctgagggagttgaagttactggcagaagctgtagtttgtatctgtgaattcggcggctggggaacccaagcaagaagtagtcttcacaacagccgccgaaggacacttattcccccc

SEQ ID NO: 21066 - DNA, 306 bp, A.fumigatus
  unsure (306): Identity of nucleotide sequences at the above locations are unknown.
gggtctttcggaccgtctggtttctttgatcttgaagttgctacttcgaccgtcgtcgattggcccaccggcgtttggtgggttacattggatgtgattggagacaaagagacgcaaagagggacaaggaaaagaagaaacaatgcgctgggatttgaccgtcgtctggctagactaatcgaaaagcggtttcgtagtgcgtacagtaatattgttactagggcgatgcaagactccatgacacctgtcacctataatggtcggaataagattgcgtcgcgcctcctccacttcccaggttgttcn

SEQ ID NO: 21067 - DNA, 387 bp, A.fumigatus
tcattgtctcgtaccgttgacttggagctgaccatttctctgattgcagctgcggacgacaaaggcgtcgtcaacaacatcctcactgttggttcgagttcaattgctgcggcgcctggtgctgaagctcatgctgtcgagaaggaaaccgaaactcctcttgagaatggagccagcgagaaggtcgaggagaccgcgaaagagcccggggtgcaaagcacaacgacgaccgaggcggtgaaggatgaagtgccagagaagactgatgactctgtggttgtcgagaaagatctgcacgtggagtcggaacccgcaacacaggaggtgaagccgaagcttgtctccgagccatccaagccgagcgatatccatgaggacgccgaaaca

SEQ ID NO: 21068 - DNA, 651 bp, A.fumigatus
tgcgaggaggttgcaggcatacttgaaagcagcggctcttactaccttcttgaccacctcgccttccatcccactctctttcatgtttcaatactcgtctgctattgtatccccctgactagaatgatgaagtccatccggtttcttgcgtccgcgctggctctttgcttggtcgacgcctatctggtgactcctccaggaacacctgcaccaggggcagcgtcggcttgtagcgcctgggtgcaggcttcatacggcctgacatgcgacataatccaccgtttttacggcatgactgcggccgaattcgaggaatgggtgagcaagtgtccagctgcccagctgtaccctcttaactacatatgtactgactcggcgaagaaacctagcgtcagtcagcttggtgacggctgcaccctgatctcaggcctctactactgtgtgcaagtcaattatatcccccaaaagtctaccttggaacccgcccacgactacgacacgttccaccaattagctcagccgggaaaggcgtctccacgccgacttcctacgcataccggcttgggtgagcaactggcaccaagttccaactgggttgtcaatggtgaacccctgcttccgaatttgcaagctgctccagggaatatctct

SEQ ID NO: 21069 - DNA, 333 bp, A.fumigatus
  unsure (106): Identity of nucleotide sequences at the above locations are unknown.
ctggcctgtacctttggatctacagtgattgcctatctcattgcaagcggtattcccttcttcaacaacctcgtttcgctcattggagccttcctgggtgtcatcntggcctaccaaccaaccggctgcatgtggttctacgataattggagaaaacgtgataccggtaattggaaatggatactgatggcatgctggaatgtctttgtcatattgattggatcattcatgaccgtcgctggtacatacggcgcgattgtcaacattgttaactctctggcggaggatggtggctcaaaaccatggacttgcgccgacaattccaattcttga

SEQ ID NO: 21070 - DNA, 396 bp, A.fumigatus
  unsure (308): Identity of nucleotide sequences at the above locations are unknown.
ccagacaaaacctacgacacgaccgacatcaaccatgcagcaagtctacacccacgaaggaccctacgagtcaatcccctcgaccgcatcgccaggcctccagttcctcagacacttcctcccagccctggactccctcgatccaactacaaatcccatctcccgcttcatccatcccgacgcccgtgtcgtcgtgggcagcggaccccccaacagaggcacagacgtgatcggtcttctaaacgttcgccagcgacatatccagcgctttcaacacgagatccacaaggcgtgggatattgcacggnccgattcaaggaaacggaaacggcggacccccgacacgtgatgttcgaggcgaacagcggaaccggcttccgtaatgaaccccgatga

SEQ ID NO: 21071 - DNA, 480 bp, A.fumigatus
  unsure (455),(458): Identity of nucleotide sequences at the above locations are unknown.
tgcattccggccaagaacgacgacttcccctcaacatcgaatacatccacatcggcgtcatgcttgggttcatccaggacgttttcactgaggccttcatgtcccaccccaccctctcccttcaacgcaaagtcgctctcgtccgcgccatcggcaagatcatctggatccaaaacgacctcttcgccaaatggcgtgtccgcgacggagaagagtacgccgacgagatgtccgagatcatccttgacgacaaggaaggctatatcggcgagaagaagattctcggggacagcagcccatcagcgagctccagcgatgatgaccgctccagtatcgcgagcagtgtggctccatctgccgcatctgcgtgtccattttcggatatggcgaggccgtcctccgagacaaagatctgggctggacggtgatcacgacgctgattcatgcttgttgtntancacgcccggcactggccggtaa

SEQ ID NO: 21072 - DNA, 207 bp, A.fumigatus
  unsure (190): Identity of nucleotide sequences at the above locations are unknown.
acaaaaagcttcgtggaacaagacatcaccgttgtgcctttcatcacaagaatagccgccgatgagaccacaaacgtagacgactgtaacaccgaggacagcccacagatcaagggacgaaagatgttcctgcggtggtacctgaccaagctctgttccgatccgactgagatggagttctggcggtatntgaacaaagtcgggtga

SEQ ID NO: 21073 - DNA, 444 bp, A.fumigatus
ccctcaattagagtgatgcattccggccaagaacgacgacttcccctcaacatcgaatacatccacatcggcgtcatgcttgggttcatccaggacgttttcactgaggccttcatgtcccaccccaccctctcccttcaacgcaaagtcgctctcgtccgcgccatcggcaagatcatctggatccaaaacgacctcttcgccaaatggcgtgtccgcgacggagaagagtacgccgacgagatgtccgagatcatccttgacgacaaggaaggctatatcggcgagaagaagattctcggggacagcagcccatcagcgagctccagcgatgatgaccgctccagtatcgcgagcagtgtggctccatctgccgcatctgcgtgtccattttcggatatggcgaggccgtcctccgagacaaagatctgggctggacggtga

SEQ ID NO: 21074 - DNA, 459 bp, A.fumigatus
ttactttggtcctgccaggtccgtggtgaagacaacccggcgtacaacgcctccaaggcggccatcaagaatttaaccgagcatctcgcgcatgatctgcggtccgatcccgctacggcgcatatctcggtgcacttgctgattcccggatggacatggactggtcttatgggaaacgtcgggcctacggacgagagtagcctcaagaagatggaaggggcgtggtttccgagccaggttgcggaggagttggtcaagggaatggagaaggggtcgttttacattgtctgtcccgataatgagacagacagggctttagatcaagcgaggatgcagtgggcgagtgacgatgtggttgaggatcggcctgcgttgtcgcgatgggaagacacgtggaaggggagagcggaggagtggattcagagtgaggctaagcggagaagagatgccagtaacagt

SEQ ID NO: 21075 - DNA, 345 bp, A.fumigatus
tactggtggctctgtgaaatcgcctattgctgggcctcagtcggctgcaaagtatccgtctgcatcttcctacgccgcatcaccgtcaaacgcctccacatctggatcctctactgcgtcatcgcactcacagccatcgccggtttggcgtttatgctcatcatgctgctgcagtgccggcccatcgagtacttctggacccgcactgcgctcgacccctccatcccgggctcctgcatcgacatccacatcgtcatcgccatgacctacgtctacagcgcgtttgcggcgttgtgtgatttcaccgtgggtattctgcctatcttcgtcttcacgcggggctaa

SEQ ID NO: 21076 - DNA, 564 bp, A.fumigatus
  unsure (20): Identity of nucleotide sequences at the above locations are unknown.
gcgccgattcggccagttcncgtaggtgaggacgtgcgatggcctgacccatccaagaagccagtcgcgcctggcaccaagccgggcctgaagctgctcgcctcccaccctgagacaatccgggcctggcctggtggctttggttacgcgaagcttggagctaactatggcccttccctgtcagctcacggtcaagcacaagccttgggctttgaccaggtcctttggctcttcggggaggaccgtcaagtaaccgaggccggcgccagcaatttcttcattatctgggagaacaaagatactggcagactcgagctcgtcaccgcgccccttgagaaccagttgatcctcgccggcgtcacccgccgcagcgtgctggagctggcacggtcaagattgaccaagccagtcggaagccttgcgcctgttgacgttgtggaaaaggcgcttaccatcggagatgttgagctggcctggaaggaaggacgcgttgttgaggcgttcgtctccggcactgctgtaagtcactcttggctcgagaacgctcactcatcatttcgctaa

SEQ ID NO: 21077 - DNA, 549 bp, A.fumigatus
  unsure (203),(297),(304): Identity of nucleotide sequences at the above locations are unknown.
gagcgattccaccagaacctgaagcctttgttgaatcgggagcccatctccaccgaagagggcttgatgatcgagcgcatggtcaacgagatgggcaagcgatgggcggagatcgctcgacgactgggcaaccgcagcgacaatgcagtcaagaactggtggaatggcagcatgaaccgcaagagaagaggtctttcggccantaccacgagcccatcccgcactttccaaggccgagtcgaagccccatacccgcgcgcttcgacggccctcggcagccccatcgactggccccgnttctccntatcccacaacagacctctcacatcctggacgaattcgagcattcagacacgacgagaatcctctgccgcctcggtcgactgcccccggcagttgagtcccatttacactcttccggctttgaaccgccccgtcgagacgcccttgacctcgccctccttctcagatgtctctcctccctcgatggtctccgaccacaactctgtttcttcagcctcgcccaggaccgttgcatctagtgtatag

SEQ ID NO: 21078 - DNA, 234 bp, A.fumigatus
cccgacaggcctattcgtaccttcaacactgctgttgtctattatcataaattccgccttattcaccccgacacagagtacaattacatggtagtcgcaccatgccttaatctgcagtggaagtacgctgacgtgactggtaggatgcggctgcagctgctctattcacggcatgcaagatcgaggacacccttaagaagtcccgggagattgtatgtgctgcgtacaacctga

SEQ ID NO: 21079 - DNA, 579 bp, A.fumigatus
  unsure (36),(39),(45): Identity of nucleotide sequences at the above locations are unknown.
ggggcgggtttgacgcatacggcgactccggcgtgntanacaagngagagacacatggtgcttggggagcccttgactcacgccgctctcgtccgtgaccggaatcaagatgggtctttgtccaccgtctttgtcctgacgatgcaccactctgtctgtgatcgttggtccgtcgggcttataatggacagcgttgagacggcctatacgggccagacgttaacaacgaacagcatgggtcccttcctgcagtatatccagcagcttcagggaggagacgcgttctggaggtcccagtttgtcggcgtgaaggcggaggtgtttccttctctcccatccccggaatacaccccaacgccaacagagacgattgacctatcggtcgagctacgggacgctgttcccgggggccacacaatagccaatgcaatcagactggcgtgggctctggtgattagccactatacaagctgctctgatgtggttttcggcgtcacaatatctggacgcgccgtccctgtgcccgacatagaacgcattattggcccgatcatagccacggttcctctgcgtgtgcgc

SEQ ID NO: 21080 - DNA, 264 bp, A.fumigatus
tcggctggagcggacggttcggtcctgtggagagaggagatgcggagctgcaccatgcggctggttcggtatatgctgaaggttcgtgggccacatatgaccttgaatctacaacgtattgactatgtgtcagacaatgagccatatgacgccgagaagcatctcgtccttggaacctccgaatctgctgaaacactcgcgaagctcgagtacgagtggtacacgaacgacgaagcccatacggcagctatatacgcctctcgt

SEQ ID NO: 21081 - DNA, 426 bp, A.fumigatus
ctcagcagttccattcagaaagcaatagccaatgtgcatgtgcacacaatgacagaacgatgtcatccagtcgatgactgcagtgcggagaagatgacatccgcccccgatacggtaaaagaggcggcccttctcgttgtcacagaaggacagcctaatatacagaatgtctccgaggaagaatatacagcaatggaaagacgcattcgactcaaagtagacatgcgtctttgtactatcgccgggatcctatgcagtcttaacctacttgactcgggcattctgtcatccgcatcggtcacaagcatgttcgaggatcttgacttgcgagggtcgcggtattcggtctctatcttcatctttacgattgcaagtgtcgtcgctcagctgccttgcaccgttgccgtgcgcgtggttggccctcgc

SEQ ID NO: 21082 - DNA, 228 bp, A.fumigatus
agacttggaacctgctctaccattggtaaacggaccaataccatcctgggatacagtgaggtgaccctcgaatggcagatcgaggatgactactacaataccggcaacccaaagtcgctccaggctggaacgtatcgcttccattattatggcgatgccaagaatatccaaggccagatcaaatctttcgagggcattggcaagccattcacggtgaatttgggctga

SEQ ID NO: 21083 - DNA, 264 bp, A.fumigatus
ctcaggtcgtctcagttggtactatctaaccacagtagattataccatactctgaagacgggagcacagctggctgagtgggcagagagcacgcattctctctcacacacgtggaacactagagcagagaatctcaagacggctattaatcaatactgctgggacgatgcatatggagcgttcaatgacaatgcgacagccacgagtcttcatccccaggacgcaaatagcatggcattgcttttcggcattgtcaacgagaca

SEQ ID NO: 21084 - DNA, 288 bp, A.fumigatus
ccgcttgatcttaccttcggccgccgtggtgagacgacaggtgctttcgacgaatcggggccaccactcagtcaaaagaactcggatacctaccatatgtggacgatgatcggaacctacaattacgtgctattctccaatgataccgacttccttttaaccaattgggagaaatatcaagctgccatggacttcatctatggaaaggtggatgaaaagtcggggttactgatcgtcactgggacacgagattgggctcgatggcaacagggatataacaactcataa

SEQ ID NO: 21085 - DNA, 705 bp, A.fumigatus
  unsure (69),(659),(672): Identity of nucleotide sequences at the above locations are unknown.
gttcctggtccaaccaagttggatcatggcaatggtacatccatggcagtggcaaaacaagcgagtatntgggcttgtcccccgacttcaaaaacccagccgacacgagcgacgcccagggggttcgaatcaccattgtatgtcatttactcgtgcgctggtgaaagagtgactaacagtaataaggacggaacctccttctggaatggacagaacatggagcgatctgaactcatcccccagacaactgccaatcttggctcgggccatctatactaccacttctccctgtccaccaagacaacaaatgcccctgacgcctccttcgagcatcagatcgcgttcttcgaaagccacttcactgagctcaagtatggcgcgtccggctcatccgacaacaccctgcgctggtatgcaaacggccaaacacattggtccatccaactggagccaggcaactggtacaacttcgcctacgatatcgactttgcgtcccaaaaggtgggcctctgggcgtctaacggctccgatcccttgaccgaggtggtctcgcccgtcagcgcatccacctttaccaactcggcggactggcacgttggccagctgcgcctgcccaacaggggagcctccaacgacgcaccggaagactggttctggtntggcatttggctnttacacgactggaaatggaaggtatcgcgttcg

SEQ ID NO: 21086 - DNA, 369 bp, A.fumigatus
catgtattgggacgaatgggttcaacgagtacttcccactcgctcaagtaccggggcgagggccagaagccctacagcgcccgtaacattggcagcatggtcgctgaggcctaccgcaccttgctgtatggcggtgtctttgcctaccccgctgacaagaagagtaccaagggcaagctgcgaatcctgtacgagtgcgcgcctatggccatgctcttcgagaatgccggcggtctggccatcaactcccgcgccgagcgtcttctcgaggtcgtccccgagcacatccacgaccgcagcggcgtgtttcttggctcgaaggatgaagtgcaaaagatcatcgacacctacaacaaacacaagaaatga

SEQ ID NO: 21087 - DNA, 402 bp, A.fumigatus
ctagtatgtcgtctctgttgcaaaaagcaaatggaacatgccgctgacatactcaacagcaatgtcgcattcggctgcaatctcggcggcaccacctctatctcctgtctggtttcgcagacggacagcaccacaacccatgtgactgccaccgccatgatcacagacatcggctctttctttctgcccgttgtggtcaccggcactgctaccgccggtgctcacgccaccactggagcatccgtcacaggggccacgccgtcggcgactggacagactaccctggctacgtcgggcccgtctgtgacaagcggcccccaggccactggctcttcggcttcggcctcggccacgccgtcccacagctcccagcggaaaagcctgccatcccccaatattact

SEQ ID NO: 21088 - DNA, 276 bp, A.fumigatus
acgcggaccttccagccccgtggtgaagacgtgtggtatcaatttgaatacccggccttgacacgcgattccgcggcccggtcttcccccgtcctatccattctcaaggttgatcctaccctcaccgacgccgatgggaactttctcgatgaaggaacagtcatgtggaccccggcccacggccccagcccgaatgccccgcttggcgatgggtattccttcacttatcagggtgagttggcgagagtgtgtttccggggaaatgtgcttaactga

SEQ ID NO: 21089 - DNA, 183 bp, A.fumigatus
  unsure (50),(87),(149),(159),(161): Identity of nucleotide sequences at the above locations are unknown.
ctcctgttatttgaaatacctgcgcgaaattcgataggacatggagtccnatccagtattctcgaggataggctaaacgggatccangctatggctagggttagccgaggtcagctgtgctccgtaacttgtaagtccgtcgtccgccnaggtccaccnancgtgcaggctgtgcaaccttag

SEQ ID NO: 21090 - DNA, 342 bp, A.fumigatus
tcagattgcaaatattatacatatcaattaaactcattacctctctccagcctcctcttcagatcgatcagcagactgttgcccagcaaaatggagacgtcgctacgagacaaagtagctatagtaagcggttcctcctcgggcattggagctgctattgtgcgcgagctgtcctctcgcggggccaatacggtggtcaactatcccttccccagtctccgagctgaagcagacacattggtagcctctcttccctcgcctgcaattgccgtaaaggcagacatgtctcgcgcagacgcgcctcaaaagctagttgacgcggccgtctctcaatgggggtag

SEQ ID NO: 21091 - DNA, 813 bp, A.fumigatus
  unsure (543),(549),(611): Identity of nucleotide sequences at the above locations are unknown.
cggtctacaggaggggtgctcacctttgagtcatttgcgcgcgactttcgatacagtcccgcagacaagacccgcgtcagctccatcgccgtcggcatccagcaggccggcgccctggtaggctgcttcgccgtctggcccgtgacgaaccgctggggccgccggctcgccatgatggcatgttccgccgttttctgcgtgggggtcatcctcgaggtcataaatgcgcactcgctggccctgttctacgccggtcgggtgatctgtggcctgggaatcggtggctccgccaccgtcatccccatctacatggcggagatgagccccaaggagtcgcgcgcccgcctcggcagctgctaccaattcacctacaccatcggcatcctcgtctcgtactggatcgactacgctgtcaagttcatgcccccctcccccgcccaatggcaaatcccaatcgccctgcagctcgtccctggcgccctcatgggcctcggcaccagcaccctcccggagagcgtccgctggctcctcgccaggggcggncacgtncgcgcccactccagcctgctctggatccgtgcttcaagccctaactcccccgccctctccgncgaattctcccacatgcgcctcggccttgaacaagagcgcaaccgcacagccaactttcacccccggaactccttggcgggcccccacgcccggcgccttctcctaggcttcgggctcttcctggcccaacaatcacaggcgccaccggccttgcctactttggcccaaagtttttttccttctggcgggaacggccaatag

SEQ ID NO: 21092 - DNA, 219 bp, A.fumigatus
  unsure (1),(2),(3),(4),(5),(6),(7),(8),(9),(10),(11),(12),(13),(14),(15),(16),(17),(18),(19),(20),(21),(22),(23),(24),(25),(26),(27),(28),(29),(30),(31): Identity of nucleotide sequences at the above locations are unknown.
nnnnnnnnnnnnnnnnnnnnnnnnnnnnnnntgaagacagcagattccttcacgaaattcttccatctcttcattcaaaagcaattacaccgtttcgacttcccctacatcctattccccttcctcgcccacttcttcatatcgtctttgcgaatctgctgcttcgctggacaagattctggagccggtcttcaagcgtctaccccacgaggtatatga

SEQ ID NO: 21093 - DNA, 186 bp, A.fumigatus
ggcgcgtgcagcgcatgcgcgcatccttcggcccccgtggtgaagaccggtacacccaaagtcaagggatcaagtaagtttattgccccattggatacggaacacaccccctttcataagtactccgtactccgtccgttctctgtcgaggcggatgaacaacctttgaccgttgttgtcacgtga

SEQ ID NO: 21094 - DNA, 603 bp, A.fumigatus
  unsure (572),(573),(574),(575),(576),(577),(578),(579),(580),(581),(582),(583),(584),(585),(586),(587),(588),(589),(590),(591),(592),(593),(594),(595),(596),(597),(598),(599),(600): Identity of nucleotide sequences at the above locations are unknown.
ggccaagtgacggagaatttcgggttgaatgaggtagacttggttaatatgcctatggcagatactcctgcggcgctttccaccgagcttcttccgtaccagcggcaggggctggcgtggatgatcgagaaggagtgtccgcaactgcctgggcctggttctcagaacgtggtgcagctttggaagagagctgggaaccgattcaccaacatcgccacaaactactcaacggctattccaccccctcttgctagtggcggtattctggccgacgatatgggtctgggcaagacaatccaaatcatatcgttgattttggccaaccctcagccaaataccccggagtcatccaagaccaccctgatcatagcacctgtcggagtcatgagcaactggagaaaccagatcaaagaccatacccacagtgagagcacgccaagtgtgctcatttaccatggtactgggaagaaagaggctgcaaaactcgatgagtatgatgtggtaatcacgagctacggtgctcttgctgtggagtatgatccgagtgccaaagcagcgcctagtcttcaccnnnnnnnnnnnnnnnnnnnnnnnnnnnnnaaa

SEQ ID NO: 21095 - DNA, 867 bp, A.fumigatus
  unsure (14),(18),(836),(837),(838),(839),(840),(841),(842),(843),(844),(845),(846),(847),(848),(849),(850),(851),(852),(853),(854),(855),(856),(857),(858),(859),(860): Identity of nucleotide sequences at the above locations are unknown.
gtccgtggctcccntganccatggatctttggtatggtctttctcgctacagataccaagaccggtcacgatgtggccatcaagtgtttgaccaaggcaccatctgatgatccatcggctccatctgccattgacgatcgttttgaagagctctattgtcacaagcgccttgcccaccatccgaatatcgtgaatcttattcactcattcgagactgaaactcatttgtaccttgttctggagtactgcgccaacggcgatctttacgaagcaattcggctcaaccgcggtcccttggagacggaacatgttcgcgatttcatgctacagctggttagtgccgttgagttccttcactcgaatggcatgtaccaccgtgacatcaaaccggagaacatcttcttgacccaggacggtacaatgaagctcggtgactttggcttggcaactcatgctccttggtgtcatgaggcgtgtgttggaagcgaccgctacatggcccccgaacagtacgacccaggtgctaatggctattcgccggccaaggctgatatttgggcgattggcatctgtttgctcaatgtcctcttcgctcgcaatccctttgcaactcccacagaatcggacatcctcttcgcggattacgttcgtgatcgccagtctcttttcgacatcttcaccaatatgtcccaggatacttttgagatcctgagaattgccttggccatcgatcctgagaagcgctcgcttgctggtgtccgtgatgccctgttgcgtgtggtttccttcaccacagacgatgaggtattggacgatttttgcaccgacggtcttcnnnnnnnnnnnnnnnnnnnnnnnnngggcgtc

SEQ ID NO: 21096 - DNA, 609 bp, A.fumigatus
  unsure (107),(574),(575),(576),(577),(578),(579),(580),(581),(582),(583),(584),(585),(586),(587),(588),(589),(590),(591),(592),(593),(594),(595),(596),(597),(598),(599),(600),(601),(602),(603),(604),(: Identity of nucleotide sequences at the above locations are unknown.
atgcaagagcctacctgggactacttttcatatgtacgttcacccatgcaagcgaaacaagagaccgagctgatgtctccagaaaatcccgcgggtccagcaacagnactcgtcttcgcgctctacaacatcgggtctatccccgcggtggtcctctcgggtcccgtcaatgactacctgggccgtcgggccggcatgtttaccggcgccgtcatcatcatcattggcacatgcatccaggcgccttcagtcaaccatggcatgttcatggccggtcgattcatcctcggttttggcgtcagtttctgctgtgtcagtgcgccttgctacgttagcgaaatggcgcatccggcctggagaggcactctgaccggtctgtacaactgtacctggtatatcgggtcgattgtcgcgagttgggtgtcatacggctgcgctagcatcaagagccatgttgggttccgcatccccatctggtgccagctggtttcgtcggtgattgtcgccgtcggcgtctggtttctaccagaatcaccacggtggctgatggcacaggatcgcgttgagtcttcannnnnnnnnnnnnnnnnnnnnnnnnnnnnnnnntat

SEQ ID NO: 21097 - DNA, 300 bp, A.fumigatus
ctaggcaacgagcacgaagttggccagggcatcaaggatagtggtgtccctcgcgaaaacattttcatcaccagcaaactgtggaacacccaccagcccaacgtcgctgaaggtctccagaagacccttgacgctttgggcacggactaccttgatctctatgtaaatccacaccattctcctttggtcagacgcggcacggccgctcgatcggccaggctaacattaacgtcagctcatccactggccagtccgactagttcctgtaggccggccactcccgccgtttttcatccatga

SEQ ID NO: 21098 - DNA, 597 bp, A.fumigatus
gtaactgtcctcagccgacccacaatcagctccgatttttgcctgaagacgtcatccttgaccacttatatccgtcttcacccgtttgcgcgtgtggctgagtggctattcaatgaagatgttatcaaggcaatcttcgcaacagctcagcaagacgccagcgaggttgccaacgccgcgtctgactctatacttattcagtgcttggtcaaaagcatagaagtcatggacctgatgttggatctgcaatcgacctacttccatatcgtccggccgtccatcaagtctcaggcaggtggaagcagaatcaacgtcgctaattcgtcgctttcatccttcgaggatagcatcctcaacaacttaacgattatacctgctctgagcctttattgcggcgcgggtcacgagcaacttaccgttacctcaatggcacttctggagaaaatgtcaagctctaggaagttgaacaagttgtcgtcaccagaaatatcgaattggcaatcctcaaacaaaatagttgaagtcctgagcacagaagtggacgttgacactggttcacgcccagttttcacaaaagggggcgaaggatccgcgcta

SEQ ID NO: 21099 - DNA, 183 bp, A.fumigatus
gacacttcccgagactccaggaagcaaagggaggaaggggcctgtacttccgtgacccaaacccttattattgatccaaccttgatcatctacaaagtggatcaccactgggcagcacaggatttgtttacaacttacaatgtctgcgagacctctaggctctctttgtctattcgtcgatga

SEQ ID NO: 21100 - DNA, 192 bp, A.fumigatus
  unsure (95): Identity of nucleotide sequences at the above locations are unknown.
ttagggtccaatatcttaatactccgggccatgggaaagatccaggacactcgagccagcattaagtatcgattgagggaattctccccttacanaatatatggcggtagagtagttaatttgtttaatttttctgcattgctattgcaactccgtgggaattcgataagagaattccaggccttctgttga

SEQ ID NO: 21101 - DNA, 204 bp, A.fumigatus
  unsure (171),(187),(192),(194),(195),(196): Identity of nucleotide sequences at the above locations are unknown.
aaaactaacttggagtaccaagtccatgtgagactgtttgaaagggcacataaaggcggtgagagcggcgcttactcaatcgggcccagaagcttggagcttcggccaggcaccttcaagcacgcgtacattggagactcactgtccttcatcgtattcaccgcgggcttncatggactgcagtttnaaatncnnncgggcccg

SEQ ID NO: 21102 - DNA, 276 bp, A.fumigatus
  unsure (260),(276): Identity of nucleotide sequences at the above locations are unknown.
aactacgccggtgatatctcactttacccagccgcactcacggtgcgcacaattaaggcagtcttcccgtcgtgcaggatcttccgcgaagacgcagccgcggatgccaagctcgatttcaccaacatggtaatcttctgcaagaagagcaacacaccccttcgcttcagggatccagtcaaagccgatttcctgggaagcaagtctcgtcaacactaccttgtgcccaagcacgagtcttcaccacggggctggaaganggcgctccactatatn

SEQ ID NO: 21103 - DNA, 366 bp, A.fumigatus
ctggactttcttagtggacttggggttgggaccacccccgctgcgttgattacgcacggcatcgagaccacaatcgtggagatagatccggttgtgcataaattcgccatggaatacttccacctaccttccagtcacattgcagctattgaagacgcttcagtgtttgtgaagcgtgcccaggaatccccaaaccctgctcaatacgactacattgtccatgacgtcttcaccggcggggcggagccagtcgagctcttcacaatcgaattcatcaagggtctatatgacctattgaaagaggatggtgttattgccattgtaagacccgcccctccgttactaactccgtcacctcatgactga

SEQ ID NO: 21104 - DNA, 402 bp, A.fumigatus
ttaccccggcctcataagtcagcaacaggcttggctcccggcactccaacgcatatcctcggccctcgagagcgcccagacaccagaccacgcccacgcccacccgcccgcctcctgttcacccgaggcttgtgcaaacagatcatgctatcgttctcctctcctcggttccccggcttagccttgctcttctccagatcctccttactaccctccgagcctcccccgccccaaccctccactcactctgtccaaaccatcttctcctgtctatcctccctcccacccccctcccccccccccccgccccccccccccctccacccccacctcccccccccctccaacccccccctcctcctcccccgttttactgcccttaaaattagccccccagcatga

SEQ ID NO: 21105 - DNA, 492 bp, A.fumigatus
cccccctcctctcccccacgcgccgccaccccccgctcctcccccccccccccccctctggggacccaccgagcgagcgtaccttcgatcgtccggcgacagtccacaccaggtcatttcgaccccgctgggcccagtaggctcgctggcgcccccccccccccccctcccctcgcccccccccccccccccgcccccccgcgccgccccccccatcacccgtgccgaccccttggactcgcagcggcgccctcccccgcccggccttcgccaggaacccaagtgcgcccctccctgttccctggacagcatttctcccccccgcgaccccccccccactcccccccccccccgcccccccccaccgccccgccccccctcccccgccccccccccactgcggacctttcccagaatcaacctttccgcccccccccccccccgcccccccccccgcccccctccccccccccccacccccccccccccccc

SEQ ID NO: 21106 - DNA, 522 bp, A.fumigatus
tcaacagacaccgagcctagaaaatgtaacccccctcctctcccccacgcgccgccaccccccgctcctcccccccccccccccctctggggacccaccgagcgagcgtaccttcgatcgtccggcgacagtccacaccaggtcatttcgaccccgctgggcccagtaggctcgctggcgcccccccccccccccctcccctcgcccccccccccccccccgcccccccgcgccgccccccccatcacccgtgccgaccccttggactcgcagcggcgccctcccccgcccggccttcgccaggaacccaagtgcgcccctccctgttccctggacagcatttctcccccccgcgaccccccccccactcccccccccccccgcccccccccaccgccccgccccccctcccccgccccccccccactgcggacctttcccagaatcaacctttccgcccccccccccccccgcccccccccccgcccccctccccccccccccaccccccccccccccccc

SEQ ID NO: 21107 - DNA, 552 bp, A.fumigatus
ggggggggggggggggtggggggggggggaggggggcgggggggggggcgggggggggggggggcggaaaggttgattctgggaaaggtccgcagtggggggggggcgggggagggggggcggggcggtgggggggggcgggggggggggggagtggggggggggtcgcgggggggagaaatgctgtccagggaacagggaggggcgcacttgggttcctggcgaaggccgggcgggggagggcgccgctgcgagtccaaggggtcggcacgggtgatggggggggcggcgcgggggggcgggggggggggggggggcgaggggaggggggggggggggggcgccagcgagcctactgggcccagcggggtcgaaatgacctggtgtggactgtcgccggacgatcgaaggtacgctcgctcggtgggtccccagaggggggggggggggggaggagcggggggtggcggcgcgtgggggagaggaggggggttacattttctaggctcggtgtctgttgatcagagacagtggcccctgctgcagctgtag

SEQ ID NO: 21108 - DNA, 522 bp, A.fumigatus
gggggggggggggggggtggggggggggggaggggggcgggggggggggcgggggggggggggggcggaaaggttgattctgggaaaggtccgcagtggggggggggcgggggagggggggcggggcggtgggggggggcgggggggggggggagtggggggggggtcgcgggggggagaaatgctgtccagggaacagggaggggcgcacttgggttcctggcgaaggccgggcgggggagggcgccgctgcgagtccaaggggtcggcacgggtgatggggggggcggcgcgggggggcgggggggggggggggggcgaggggaggggggggggggggggcgccagcgagcctactgggcccagcggggtcgaaatgacctggtgtggactgtcgccggacgatcgaaggtacgctcgctcggtgggtccccagaggggggggggggggggaggagcggggggtggcggcgcgtgggggagaggaggggggttacattttctaggctcggtgtctgttga

SEQ ID NO: 21109 - DNA, 345 bp, A.fumigatus
catcctgatggtggatgccaaccaggtacgactccactccttcctgctgatttaagccactggactaacgctttgagttttcaggtctggtccgtccccgaagccatcgaatggatgcaccaacttgccgagttcaagccctggttcatcgaagagcccacctcccccgatgacatcctcggccacgccgccatcaagaaggccctcgagaacaccccgcacggcaccatcggcgtcgccaccggcgagatgtgccagaaccgcgtcgtcttcaagcagctcctgcagacgggagcgctcaccgtcctccagttttcaacacgccgcagcaaggaaagatgtaac

SEQ ID NO: 21110 - DNA, 204 bp, A.fumigatus
ggttacagcgaggataagctgcgtgcgttgctgaaggagagtgtcgctcagggctacaagcacttcaagctcaaggtcggcgccaacgtggaggaggaccgtcgcagattgactatcgctcgggaggccatcggttacgaccggggtaacatcctgatggtggatgccaaccaggtacgactccactccttcctgctgatttaa

SEQ ID NO: 21111 - DNA, 204 bp, A.fumigatus
tttacacctgatgattcgaaccgttcgatatccttagtatatggtgattcgaaccattcaaagaatacttacgacaatcaaggcctccctaggttttggatggacaatagtatgtattttctgtgtgaatatacccctaccctatttttttgcagttatggaccagatattatgtatgagttctcgatatccctctctatctag

SEQ ID NO: 21112 - DNA, 387 bp, A.fumigatus
ggtgcatttgacgcccttccgcccctggtgaagactctcacctacgtgctcggcggtatctcggagatttttgcttcggtgacttcgctcgagtatgcctttaccaaggcgcccaagaacatgcgctcgcttgtgcaggcggtggcgctgttcatgaatgccttctcgtctgcgctgggccaggcgctcgtcagtctgtccgaggatccgctgctcgtctggaactatactgttgtggcgatcctggcgttcgtcggcggcattggcttctggctgaccaactacaagttggataagcaggaggatgcgctgaataacttgccggccagtcgctacggtggcgacaatcccgatcctaagctggatgaggagtccgtgcggcagtaa

SEQ ID NO: 21113 - DNA, 396 bp, A.fumigatus
actcagatgcgctccttgcagccccctgtgaagactagaatgatatactatcgtagaaatatgtccagtaatgccatgctaccaatcagaaaatcaaatcccacaccacaagccatgtacacaatcccaccgtcccccaaaacactgcctgcgccgtactccgccgctgcgttgcgcgcttcagctccttattcccctgcccgatgttcgtcgttgtcgtcgaagcgtccatcaccagctgctcgatatactcctcctgcgtcgacagatgcgacacaagcgtctgctggagggaggagatctccaggagcgatttctcggcattcctgcacgaaacacacaacagcgttagctatctcgcccacccacctccgccagagtgtaagagaagagtag

SEQ ID NO: 21114 - DNA, 261 bp, A.fumigatus
cttcgtaacgacattatcagctttgatcagaatcgaaagcgcattgtctccacattttggacatttgatcacatcacatacctcaagtcggcatttgaccttatccatcgaagcaacaatcggaacactcaagtgtacaagatgattggaagtctgttcttcatcttcaaccgcttggtggagattgtattcctgattccgatcattggcatgatggtaagcatctatacttgtctggcatatgcatttccaggatcctaa

SEQ ID NO: 21115 - DNA, 489 bp, A.fumigatus
ctcgtgggcaccgtttccggtacctactgggctacctgtacccctgtagctgccgagattctcggtctccgtgacctccccagcggccttagcatcacctggctgatgctcgtgcctccgacgacggtctcggaggcgatcgccctattgctgcgcgataacaagtccgcagattccaagtatctgaaggtgcagatcttcacaggcttcatgtatatcggcagtgcgctgtgtctttggcttgtccggggctggaaagtaggcgacctggctcgtgccaaggaagaagctgtcgctgcggtggacacccgacaagcgggtgactgtgcagctgggagtgcgccgtctgctggtgtagccgaggacgctgaaaccgagaaacagggtcaaacggtcgaccctgcgttctccatgcacacggcgtcgaatcggaacccctggacgcctgcgacactgttacgcggcatggtggctttgaagcgggtatga

SEQ ID NO: 21116 - DNA, 342 bp, A.fumigatus
agactccttgcgatacaggaaaagggtgtctcagcatgggaatttcaaccagagttggaaattgccaactgttttgtcgaaggccgaacggaaatcgaattctatgattcggaatgtagtgtgcagaccaacttgccagttcccaagcagaatgacgtctattactgggaagcgaagatctacgagaagccagaaagcactctcatcagcatcggcatgaccacaaaaccgtatccgctatttcgactaccgggtatgtcaatgtccgaatattcaacactagttctcctgcactcctgttgctgctcctgttgctgctcctgttgctgctcctgttgctaa

SEQ ID NO: 21117 - DNA, 288 bp, A.fumigatus
ttctcctgcactcctgttgctgctcctgttgctgctcctgttgctgctcctgttgctaacacaatttctcccttcacaggcttccataaaacttccgttgcctacttatcaacaggtcaccgccgatataatcagccattctccgcgtcgccctacggccctgctttagcacaaggcgatgtggttggcgtagggtaccgaccacggtccggcacaatcttcttcactcgcaacggcaagaagttagaggatgtggtccatggggctaagacacagaatttcttccct

SEQ ID NO: 21118 - DNA, 240 bp, A.fumigatus
  unsure (191): Identity of nucleotide sequences at the above locations are unknown.
catactgttccttccgattcttgggaaatgattattggtggctacccagtacggtatgtggtgcgtttcggcaaacagggttatcagatgaagatttacggccacaaagacccacgccaagatacagaatctgtattattgattcatgcgattaatagtggatggctttttcttgtgttgaatcggttttntatgtcttcctttttcacttcgggaagtgccggtccgcgcttagttaat

SEQ ID NO: 21119 - DNA, 441 bp, A.fumigatus
atgtcgcgtgatgggacatacggcattccttcacctcagttccaggccaccccctcatcacacgtgtcgtccccttcgcataccaagtctcccggttttgcattccaaggagccatgtcgccgaacgggatggacgcgcaacaagcccagcacgcgcggtctcaactgaacctccattctaggaatatgagtcagacatctcccccgataagcatcggtcagcccgagtcgactgatcccaaatcggctgtgtcaggtggcccgggtcccagagtctcccgcgtgccctctgctgcgtattatccatcgcctttccagaaacattacgatcagttgggtaagctgaccttcgttaccgtcgctttgcctttttttttcattgttttccttacagaagtgatttcgtgtactcatactttcccctgtagaacaggaatatga

SEQ ID NO: 21120 - DNA, 210 bp, A.fumigatus
tttcgtgtactcatactttcccctgtagaacaggaatatgatgcccaggcagacatgatcgacgaagaacatgagtcggttgatgcgcctccctacgtctccggattcaatgccgctactacttctgtccctcccggctctcattcgctaggtcctcaactggccaatttcaatgtcttcaccaggggctacagggccgcgctaggtctc

SEQ ID NO: 21121 - DNA, 231 bp, A.fumigatus
tcgatcaacatgtctgacaacaacaacaacgcttccaccctcaacagctacatcaaccaggctaccggcctcgcccagcgtgccatgggctccgttaccggcaacccatccactcaggtctgcacggaccccatcccccttcgatatacaacgtataatccactaacaacatctcaggccaaaggcgaatccacccacacccaaggcaaagccgagtacgccgccagccac

SEQ ID NO: 21122 - DNA, 459 bp, A.fumigatus
tacgcaatgcgtggctgcttccggctcgctgtggtgaagaccgacagccctgcacaggccatcacagactcccccgccaatccgcaagcagacttcggtccgacaattcgcggtcccctaggctggattgtgcatgcgcgctccggcgataaaggcccagacgctaactgcgggttctgggtgcgccatcacgacgagtacctctggctccgctcgttgctgtccgcgccaaaggcgaaggagctcctgggtgaggcgtataacgcgaatcccgagttgcagattgaacggttcgaactgccgaatctacgggctgtgcatttcttgtttcggaatttgctggatcggggagttgggatcacgaccaccgtggattttctggggaagaatgtggcggagtatttgcgcgcgaggtgggtggatttgcctgtgaagtttttgaatagggggaaattgtaa

SEQ ID NO: 21123 - DNA, 198 bp, A.fumigatus
acttttgacattcgcaaatgcgacaacccatctcacctcctctatgtgttccccgacgcccagcagcaatggcatgctaagatttcaaatggaaagcaaccatacaggaaagcagaaccaacccattccactcagcggacaaaaacaaagaaaacacgcaagtatacatacgctcaacacccagatgctatgcattag

SEQ ID NO: 21124 - DNA, 861 bp, A.fumigatus
  unsure (860),(861): Identity of nucleotide sequences at the above locations are unknown.
ggttgggtcctgggatacggggggaccctaaatatttgggtcttttggcttcagattgcacgaattgttccttgtcagcgacaagaaacattcggcgaagccgtttcaaagtctctcaagttattaccgctgaactgggctgtcgggtatgggacaggattggtcagcggcgtcttggggactgacagtctctcacttgctggtttggatgtaaatatgacatttggcttggccaaaaatgcttccaccgattttgaatcttatcccgtggatggtattctgggcttgggacgatcggctaatagcaattttaacactccatcgttcatggaaaccgtcgcgacgcagcgccttctcaaatccaatattatcggattcagcttctctcgcaactcggatggtgccagagatggagcggcgaattttggtgacctggataccaccaggttcacgggtgatattgtctacacgaacacaactggagatagcaataactggaggatacccttggacgatgccagtgtgaatggtacgccttgtcgtttcgtcaataagaccgccgtcatcgacactggcacatcgtacgccatgcttcccccgaaagacgctacagtgttgcacaacctcattcctggtgcagtcacgacctcacacgggcagaatttcacactgccgtgcaactcgacggcagtagtgcaagtgagcttctcgggccttagctacaacatctcccccaagcattacgtcggaccagcatacggttcagcgtgcttgtccactattgtgggacaagccttgtacggagacgacgtgtggctcttgggcgatgtcttcacccggggtggccagggcgctccatnn

SEQ ID NO: 21125 - DNA, 525 bp, A.fumigatus
  unsure (493): Identity of nucleotide sequences at the above locations are unknown.
cgtcgaagatcccctggtagtcatgccaccaggaaaagtcgattactctctgcagacgtactccaaaaacctgacaaccggaagaaccagaaccacccactaagatgcatagcttcttctccgtcttctccaaatccatctaccaactctgcaacgacctcgacagcctcgcctacgccacctcctccgtcctacaagacttcctcgccgacggcgtccgctacctcgaactccgcaccatcccccgcgcctcgcccaccctcgccttcacccgaacagaatacctcaccaccgtcctcaccaccatcgaaacgtttttgtcggctcactcctcccaaatctcagtctacctcatcctcgccatcgaccgcggcaacgacaccgccgccgacgccctctccatcgtcgacctggccattgcgcaccgcccccgcgtcgtcggcgtcgatatctgcggcaaccccacgaaaggcgacgtcgcgctgtacggtcncgccctcgccaaagccaaggcccacggcctag

SEQ ID NO: 21126 - DNA, 693 bp, A.fumigatus
  unsure (381),(519),(606),(637),(656),(671): Identity of nucleotide sequences at the above locations are unknown.
cttcttctccgtcttctccaaatccatctaccaactctgcaacgacctcgacagcctcgcctacgccacctcctccgtcctacaagacttcctcgccgacggcgtccgctacctcgaactccgcaccatcccccgcgcctcgcccaccctcgccttcacccgaacagaatacctcaccaccgtcctcaccaccatcgaaacgtttttgtcggctcactcctcccaaatctcagtctacctcatcctcgccatcgaccgcggcaacgacaccgccgccgacgccctctccatcgtcgacctggccattgcgcaccgcccccgcgtcgtcggcgtcgatatctgcggcaaccccacgaaaggcgacgtcgcgctgtacggtcncgccctcgccaaagccaaggcccacggcctaggcatcaccgtgcacttcgccgagaacgaggctccggctcggagcgggaattaagcacgctgttatcgttccgggcgggacgtctggggcatgtcatccatgtgtcngaggacttcaagcgcgagattgcgcgccgggcgctggggctcgagctgtgcatgtcgtgttatgtgcatgcggagatgatcgatggngggtgccccgcgcatcattttgggtattggnaggcatgtggattgtccantgggttggtgtgtangttccctccgcccctttttaat

SEQ ID NO: 21127 - DNA, 504 bp, A.fumigatus
  unsure (419): Identity of nucleotide sequences at the above locations are unknown.
caaccggaagaaccagaaccacccactaagatgcatagcttcttctccgtcttctccaaatccatctaccaactctgcaacgacctcgacagcctcgcctacgccacctcctccgtcctacaagacttcctcgccgacggcgtccgctacctcgaactccgcaccatcccccgcgcctcgcccaccctcgccttcacccgaacagaatacctcaccaccgtcctcaccaccatcgaaacgtttttgtcggctcactcctcccaaatctcagtctacctcatcctcgccatcgaccgcggcaacgacaccgccgccgacgccctctccatcgtcgacctggccattgcgcaccgcccccgcgtcgtcggcgtcgatatctgcggcaaccccacgaaaggcgacgtcgcgctgtacggtcncgccctcgccaaagccaaggcccacggcctaggcatcaccgtgcacttcgccgagaacgaggctccggctcggagcgggaattaa

SEQ ID NO: 21128 - DNA, 345 bp, A.fumigatus
cgcggtttcttccatccccgtggtcgaatgagcgcagacaagtcgaatctgaaggagtactaccaacccgtcacgatacgcatctacagctccaacccgaagatactagagcctctggcacgggtggtcaagccagcagatgaggtgcgcaagtacatgaatgaagtaatggaccgcgcagaacgtgcccccgagggattcctggccttacgccttccgcgcgagaacaaggatgaacacgagcccgaggacacgagaaaaagcggaactcctgctcctgccgcaaattcaggcgcgcgcagtcggttcctaaagagtaacgctgccggggggggggaaaatttc

SEQ ID NO: 21129 - DNA, 420 bp, A.fumigatus
gaactttaccgcccctcggagagcaacatgctcttcgacgcgccttcgctcgtcctctacatgtgcggcatcaccgtctacatcgccaatatcgtcaagggtctgcgtctggcctcggcgggcaagtacggtgaggagctggcgaccagccccgaggagaaagaccagattctgaaccgcgaggattcgctcaaggtgctgtcggctagtaataccattctggcgttggtgttggtgggggtgttggtgttgcaggcggggcagtggtatgcggagcggaaggatgcgcaggagtatgagtcgttgaggaaggggcataaggagggtggtggtggtggtgcttcttcttcgtcggcgtcgggggcggcggcggcggcgaagcctggcaggcaagggagtgtgaagaagaagagtaactag

SEQ ID NO: 21130 - DNA, 507 bp, A.fumigatus
aagactcgtaagtgtccagcggccatatcgcggaattttcattcactgacaatgggtaggtttggtggattcgagtatggataccaacaaggagtgctcgggcaatcgttggtgatgacgcggtttaccgaaaacttctcatcggtcgtacactcctctgcggctaccggatggcttacctccgttcttcagctgggtggtattgtgggatcgctatctgcgggcatcttcggcgagatcttttcgagaaagtacaccatgtttgcggcatgctgctgggtcatccttggaagttatctgtacgtcggtgcttcggcaggaatggcctcgctcctgtacgtctggactaatctttaccggtctgggagtcggtcttttcagcggtgttggccccttgtacaatgcctaactggctgctccggagatgcgcggtctcctggtatccttctatcaattcgcgaccatcctgaggatcatgatttccttctgggtgggctatggcagtaa

SEQ ID NO: 21131 - DNA, 228 bp, A.fumigatus
gatttcttcgtttcccccggtgaccctgctttctacctccaccacgccgccatcgaccgtgtcttctggacgtggcagaatcaggaccccaagtcgcggacgtatgtcgtggcaggacagaccatccttcccagtctggtgccagatgcgcccaatgctactctggatgatatcgtcgatatgggcagtgcgctggctccgccgcagactatccggcagctgttggat

SEQ ID NO: 21132 - DNA, 237 bp, A.fumigatus
  unsure (201),(215),(226): Identity of nucleotide sequences at the above locations are unknown.
tgcttcttgtttgcctgccttgcaatcgcaacttgggacaacctgtctattagcagtctcacgagttatgctagttggctgccattgaagtctcaggatatgtactcttcctacacccttttaaaacaaagaacaaccaatagtcctggagatatgtgtccgatgaacagttatagtcacgccacaagtcttcactttcgnactgactggaccgncacttattttntgggcccggat

SEQ ID NO: 21133 - DNA, 219 bp, A.fumigatus
  unsure (212),(213): Identity of nucleotide sequences at the above locations are unknown.
atagcttcaattataaaatggtctctagtgcagaatagccgaagtgtgtataccgtttcctctctgcttctttacacactctccatgcaactacttgacatttcgaagagagacgtctcaagttggttctttgaccgggaagcctgcaagcgctctcttcggggacttgttcagtcttcaccgggggttcaagagaggtctgtatctaaaanncccgcg

SEQ ID NO: 21134 - DNA, 561 bp, A.fumigatus
ctcgaggcgaatctaccgcggaggctggtttttgaccttctcgagttgtactttacgagcgccttttccacgcatatgcaccccgtgtgccaccatatccattgttatgtccttcgcaaggcctcattcctgagccgggagaacccgcggccgagtagcccggctctgctggcaagcatgctctgggttgctgccctggacgatcgggcgtttgcactctccatttccccgccgcagcgcaagaagatttgtcaattcttgtgcgccttgacgatacgattactccgaccgttgattcacgtgtcctttaaggagcaggccggttccaacgcgagtgacccgaccttcactggggttgctccggaatgtcctcccaccaccgtgcaccatccgtttgaatcgagcggcgacgatcgcggtctagtcgggcccgcggggtccttggatgatgtgattacctatatacatgtggcatctataatttcttctagcgaacaaaaggccgctagcatgcgatggtttgttttgtcaccttttcgcggctgtaggcgtcgagactga

SEQ ID NO: 21135 - DNA, 198 bp, A.fumigatus
atttcgtttctattttattttgttttattttatttcattttcattttcattttattttttatttttatttttatttttatttttatttttatttttatttttatttttatttttatttttatttttatttttatttttatttccgatcggttttgttttcttgtgagcaagacgtacagcatgtatttttatcaatag

SEQ ID NO: 21136 - DNA, 228 bp, A.fumigatus
  unsure (225): Identity of nucleotide sequences at the above locations are unknown.
agcatagaaggcacacccgcccgtatcaccagtgcgttacaactccacccgaccagacaccttaatgttttctacttgttattgttcgactatataatatcaagtattaccaccactatcacagcgcttttctctattatgcttaaacctggagtcgccagcatcgtcccatccatctacttcaccaaggggcggaaggtccgcgcatgcggtaacccgtctgantcc

SEQ ID NO: 21137 - DNA, 669 bp, A.fumigatus
  unsure (259),(267),(273),(274),(275),(276),(280),(283),(633),(661),(662): Identity of nucleotide sequences at the above locations are unknown.
acgagttctctaaaaatcattcttcttccacggaataaagtgcaggatcgcatcgtcggcaaaaccccaccccgcaacaccaccgagggtggcgtatggggcgctctccacgacggctccgctatccaacaaatcggtacccagtggttggtcctcatcatgctattagcggtcctccagatgctgcgcatcaaatacttcgtcgcctctatccgcgcccaatatgactaccttctctccccagcgctctccaaacagntaaacagngttttnnnngtcntcntcccccttggcggccttctctccgtccccttcatcggcactatcctcgacaccttgaaaacccaacacgtcctcctcatcctcgtctccaccgccaccgtcatcggcatcctcggctgcattccccacagcctccccgccggctacgccaacatcgccctctttgtcatctaccggcccttctactacaccgccgtctccgactacgccgccaaggttttcggcttccagaccttcggcaaggtctacgggctgatcatctgtctagcggggctcggcaatttcctccaggcgggcctcgacgccctgacgttcaagctgttcgcgcgggatcgtcttcacccggggcgnaagatcgcacgtcatcaatttaaaattnncgcgggc

SEQ ID NO: 21138 - DNA, 246 bp, A.fumigatus
  unsure (225): Identity of nucleotide sequences at the above locations are unknown.
gcttacaatcctcctaggttcatggcctcggaagccgatctagacacggagattaaaggactctcaatcttatccgaacatcctgaattatacgcggaattcgccaagttgggatgtgtggggtctctaacatcattgctgtcccatgaaaatgcagatattgccattgacgcaatccagatcatcagtgagttgacggataaagatgtagggacttcacacggngtcgtaggagactcagtttaa

SEQ ID NO: 21139 - DNA, 453 bp, A.fumigatus
  unsure (91),(318): Identity of nucleotide sequences at the above locations are unknown.
aaagtcaacaacacgcggtacaactctcctggtgtgccgcgtctcggtctacccgcgtacaattggtggagcgaagcattacacggcgtancaggatcaccgggcgtcgagttcgccgacagcggcccattcagctatgccacctcattcccccagcctattctcctgggtgcaaccttcgacgacgacctgatcaaacaagtcgccaccgtagtaagcaccgagggtcgggcattcggtaacgctggtcgctccggactggacttctggacgccgaacatcaaccccttccgcgatgcgcgctggggcaggggacangatacacccggtgaatacccgctgcacgtctcgcggtatgtctatcatctcgttgatgggctacagaatggcattggcccggcgaatcccaaggtcgtcgccacatgcaagcctttcgccgcgtatgacctgtag

SEQ ID NO: 21140 - DNA, 396 bp, A.fumigatus
gtagggagcgcttgtccttccagcccggtggtgaagacggaccgatccgtagcagttgccctcggccggcctattggaattaacaccgacgactccgacgtgggcatgttgaccgaggacgattttattgaggacgagatcgacagcgtcgccgagtaccctccagaccctgtacacgtacagttctttcttcagtacgtcaagctgtgcgaaatcatgggtctagtgctgtctcaacaatactctgtggcgtccaagtctcggaggatgaacgccatggacttgacgcattcagatatggctctagcagactggcttcagaattgcccaaaggaggtatgctggcagaagtcccggcatcacttcttggcagctcttcttcatgcgaactactag

SEQ ID NO: 21141 - DNA, 210 bp, A.fumigatus
  unsure (54),(159),(166),(180): Identity of nucleotide sequences at the above locations are unknown.
ctttccaacagcgtctacagcttgttctcggcgttgatcatgcacgtctaccanatgcggtcatcagtaccatctattgttacgacgtgccaggaaaaaatcaacatttgcatgccaggccttgaaagacttgtccaaaggtttggcttggtggcaaanaatggtncacaactggttccnagtcgaatcttggggcaacaaattcctcca

SEQ ID NO: 21142 - DNA, 666 bp, A.fumigatus
  unsure (509),(523),(525),(595): Identity of nucleotide sequences at the above locations are unknown.
ggacgagatcgacagcgtcgccgagtaccctccagaccctgtacacgtacagttctttcttcagtacgtcaagctgtgcgaaatcatgggtctagtgctgtctcaacaatactctgtggcgtccaagtctcggaggatgaacgccatggacttgacgcattcagatatggctctagcagactggcttcagaattgcccaaaggaggtatgctggcagaagtcccggcatcacttcttggcagctcttcttcatgcgaactactagtgagtgcagaaaggacgtgccatctttggaagaccatgactaatgaacccagcaccaccctgtgtctcctgcatcgagcacacatgcctcctgcttcgtcggcgccaaacagctaccgtgtggaggagatggcgtatccgtctcgtactattgccttccaggctgcagggatgattacctctatcgtcgaaaacctccagacacatcaagaaatccgatatgctcctgcgttcatgttggtctntccttttaaagatntntactacctcctgctaactttccaacagcgtctacagcttgttctcggcgttgatcatgcacgtctaccanatgcggtcatcagtaccatctattgttacgacgtgccaggaaaaaatcaacatttgcatgccaggccttga

SEQ ID NO: 21143 - DNA, 288 bp, A.fumigatus
cgggggtgtccttcttcccgcgttgtcagaacagcggactccttccgcatcgagtcgctgattcccgctgagctggcgtcgctgccttccaccgcggacggcatctcgcagttcatgacgaaactgcctagcttcgattcgcagatggcggctatcaaggagggggccgagaagcagggcaaggtcgtgcggtacgtgggtagtgtggatgtagcaaagaaaggaggttcgcgttgggctacaacagttcgacaaggacagtgctattgcgggactcaagggcagtga

SEQ ID NO: 21144 - DNA, 207 bp, A.fumigatus
caaagaaaggaggttcgcgttgggctacaacagttcgacaaggacagtgctattgcgggactcaagggcagtgacaacatcatcagcttctacaccaagcggtacggaagcaacccgcttattgtacagggcgccggtgcgggcggcgaagtcacggccatgggcgtgacggccgatctcatcaaggtcattcagcgattgggttag

SEQ ID NO: 21145 - DNA, 276 bp, A.fumigatus
  unsure (14),(17),(20),(25),(29),(30),(39),(40),(47),(51),(52),(53),(65),(79): Identity of nucleotide sequences at the above locations are unknown.
ctgcgaaggaaacngangangccangganngaggaatcnnttggttncccnnngaaggccttgcnaaaccaactaaacncatggccacattcacaaagtgatgcggtttgctctggtcccaatcgtcccccacggcaaaagccgaatcggggtactccggtgggtatgtattttatggcccccttcctcctgggttccgttaaaaaaattatgggcggaacaattgtttggcgccctccaaaaattttgcggggggaatcggggtgttttccattt

SEQ ID NO: 21146 - DNA, 261 bp, A.fumigatus
cgtctccaccggtcaagaatgtcgatcgccacgcccatcaaccttatcctcctatctctcttcgcaatcctggtctacatgcaactccgccccaaggcgcccgtcgccctcccgcaagctcccccgcctgtcgtgttccgcaccttcacaccaaccaccctccttgaatacaatggcgaatgcgataaacccgtctatcttgccgtccgtggacgagtcttcgacgtgaccccaggcaagaacttctacggccctgtatgc

SEQ ID NO: 21147 - DNA, 414 bp, A.fumigatus
  unsure (57),(317),(382): Identity of nucleotide sequences at the above locations are unknown.
aaaagaggagagagaggacggaaatggagagagagaagcagggaggagacggaaagnagacaggggagagacagagagagaccaggacagacaagcgaagacgacaggaacagagagcggaggcaacgggaagatgaacacagacggagaagaagagggggaagaggagagccagcgagaaggaaagagaagagacggcaggaggacaagagggagaggaagaggaacaagggaggaggagcgaagaaagccgggcgggggagagaaaagagagaaggagcgaaaaaggagaaacagacgaggggaggaagggcggnggggaggaggggggccgggggggccccccccccccccccccttcttgtgtcttttttaatttttnatagaaaacctctttggactattactcggtaa

SEQ ID NO: 21148 - DNA, 417 bp, A.fumigatus
gataatcggtctattttccatagtcatcccctcataacacctcaaatccaattgtcagagtcaattaattctacctatcaattcaaaatgtctgcttccgttcctgctccggacgctaatcaggattacaaggcatcactactcacactactgatctctaacaacgtcctttcttacggcacatatactctcaagtccggtcgtgaatctccctacttcttcacttcgtctctgcttcacactgcaccactcctccgggccacatctgccgcctacgccagcgttctgtccgccgagccttttgtaaagactgccaacgatggcacactcagacacaagtttgatatacatttgcgggtactttcttcgcttggagcgtctctatcccgtgatatgaaacagtactatcgggtctga

SEQ ID NO: 21149 - DNA, 339 bp, A.fumigatus
gtgtcctcttgtgggtataccttcctgtggaatctgctcgattactctgcgggtgtattacccgtttcgcacgtcgacccgaagaaggatgcgctctcggcgccgtataaaaccgttctaaagcaacttggcgccaatcatgccattgcccgcggggcgtggaagcattacgatgcggccaagatggcgggtctcccgactgcggtgcaggttgttgggagacggtggcaggaagagaaggttttggggtatatggctgttgtggagcaggcgctggaggggtattatgataaggagactggcgagggagggaagtacccgctgctcgagattgactga

SEQ ID NO: 21150 - DNA, 534 bp, A.fumigatus
gacgacgaaaacagcgacgacggccaagacgacgtacaagcgtcattaagcaacatctcttttggtgccctcgccaaagcgcaagcctccttgggccccacagccaagcgcaaatccaaagccacccaatcaaaaacagatgatggagaaaccccagctgcctctccattagacgacattcgcgcacgcatccgcgaagcccgagaacaaaaacgagagggatcctcaaagtcgaaagacttggagaagttttctcgctcctccaaacacgcaccgatggtgcagtcatccaaacaccccgttacccgcaagcgcacaatcatcgagccgccggcggccctcaaatcgcgagacccgcgattcgatcccgcggtacgcagccaaagcgggcgtagtgaagcttcccaaagcgcctacgcctttttggacgattaccgcgctgcggagctcaaggaaatgaaggagaagctcgcaaagaacaaggatccacgacaaaaggaagcactgaagcgtgatatccgatcggctacggac

SEQ ID NO: 21151 - DNA, 330 bp, A.fumigatus
  unsure (87): Identity of nucleotide sequences at the above locations are unknown.
accatactcagtactctcgtctatataatcaacccgatgcggtactataaaataaacctcttcaccccgcaggcggccgggttgtgnattagtacgaccccctttcagccccgcggtgaagactcctcctttttcttctttgatttcgaggccttggatttcttctccttttccggtttgcgctccttcttcttgctcggtgtttcttccaaggctcccgtatctgcatcggcagtgctaggagcagctgaggacaaacctgctaatgcgccagacatagtgctcgagggttcccactggccctgtggccgaggggtcatagaagagtaa

SEQ ID NO: 21152 - DNA, 417 bp, A.fumigatus
ggtttccccgccgccgagggctacttccagtccgtctcgggccaccgtgtccgcgggactgtccggttcagagtcgtcgatatcgacgtcattcccggttctgatcgcgaacgtggcttcctcagtatcgagggcacaatgctgtcgcccgaagaggaagcccgagtcctcgacgacgagcgcaatgggaattactcttctatgacccctcggccacagggccagtgggaaccctcgagcactatgtctggcgcattagcaggtttgtcctcagctgctcctagcactgccgatgcagatacgggagccttggaagaaacaccgagcaagaagaaggagcgcaaaccggaaaaggagaagaaatccaaggcctcgaaatcaaagaagaaaaaggaggagtcttcaccgcggggctga

SEQ ID NO: 21153 - DNA, 666 bp, A.fumigatus
cagctgtgggttgacctgcccaaggagctgaagatgtgcgagccgcggtaccgcgacctccgcgcgagcgagatccctgtcgtggaggtcgacgacggccgcgtcacggtcaaggtcatctcgggccagtcgcatggagtcgactctgtgcgcgacgtggcgtacactcctgtctggttgttggacatgacaatccggccgggcggtcgcatctcccagccgctgccggagggctggaatgcctttgcgtatacgctcgccgggacgaccatcttcggctcgaatgacgccacgcgggtcgtcaaggaattccataatgtcgtgtttgaccaggcgggtggttatgtcgaggcgtcggtcccggataacgccgagtcagagtcccgcttcatcctcgtggccggccagcctctggatcagaaagtcgtgcagtacgggccttttgttctcaccagccaggaggaggtgtaccaggccatgctcgactaccagaccgcatcgaatggtgttcaccacggggctggcagataccgcgctgctacgctcgtccgtcccggacttaccgccgggcgaccccgcgcccgaagggaagagaacgtaggtcgcacaactactacagagactccgatgccccgggtacacaagaaatgggacgcccaaggcacc

SEQ ID NO: 21154 - DNA, 399 bp, A.fumigatus
  unsure (380),(382): Identity of nucleotide sequences at the above locations are unknown.
gctcctctgtcgatgccacgttcatcggctacggctagaaagagtcatagcaatcggcatgagaatggcagcgcaaatacagggaaaaaagtggccaaacagagatccaatggacatctaaacggtaatctcaacggcggctccgcgtccacttctctttcctcctctcaagtcgatttgccgtcgtctcgctcttccagcgatccggtcgttcccacaaccaccgcagcatcgaccaagctcaacggaacgccggatagctccaagggggattgcaatgcgcctgatcacttgaacggatacgccaagggcaatgccgacatgtcgtatgtgcagaacgatggcgtcgcctcccagaccggtggcgatgttgcaggaancngcttcgcgttctactga

SEQ ID NO: 21155 - DNA, 537 bp, A.fumigatus
  unsure (85): Identity of nucleotide sequences at the above locations are unknown.
atcaacaagaccgtctacgaaagggcaatgaatgcgtggagtaagcccggtggctgcaaggacctgatagtcaagtgccgtgagntagcggccgagggagatccaaccatgtccggccacaacgagacggtcaacgaggcctgtcgaagggcgaacgactactgcagcaaccaggtggaaggcccctacatactgttctccaagcgtggctactacgatatcgcgcactttgatccagatccatttccaccaccttatttccaaggtttcctgaaccagaactgggtacaagccgccctgggggtgcccgtcaacttctccatctcagtggacagcacatacagcgcctttgcgtcgacgggcgactatccgcgcgccgatgttcacgggtacctcgaggatcttgcatatgtcctcgactcggggatcaaagtggcgctcgtctacggagaccgggactacgcatgtccctggaacggcggcgaagaggttagtttgcgcgtcttcgaccactggggctcggaaggatccgacgct

SEQ ID NO: 21156 - DNA, 402 bp, A.fumigatus
gttggggctatcggcaacgagattcgcaacggactgctatggccgctcggcaaacccgataactacgccaacatcgccaacatcctgcactcggcggcattcggcgtcaaggactcgaccctatcgcccaagccgaagatcatgatccacctcgacaacggctgggactggtcggcacagaagttcttctacgaccgtgtcctgtcgtcaggcgcgaacctggtcaagtccgactttgacctcatcggcgtctcgtactacccgttctacaaccccagcgccaccctgtcggcactcacgaccagcctgaagaacctccgctcgacctacggcaaggacgtgctggtcgttgagacagactggcccgtctcgtgcccgaacccagcgtatgcgttccgtctt

SEQ ID NO: 21157 - DNA, 711 bp, A.fumigatus
  unsure (664): Identity of nucleotide sequences at the above locations are unknown.
agattgatggaggaatacgctcgagtcatccatttttaccgtaatggagggaacttctaccgtacctatcaaccagatggcgttccgctggagctggtcgcatatactcagaccctgcagtcgcgtctggagctctggaagtcggcattcgggtactcctattcgtgccagaaagcccagggcagcccgcagacttctgcgcgcgcttctcttctgctcatccagtattacatcgcactcgtgactgtatccacatccgtctatgctgaggaaacgctgtatgatcggttcctcgatgcgttcaagcggattctttccctggtgagaacatccaacgcctgctgtcagagcacagtcgcaacttcgctcgtcggcgttcccataaagatgggcgtcatatacccattgtattttgtcgcaaccaaatgtcgagactcggcggtccggcaggaggccatcgacttgttgtcctcggcgccgtgtccagatgtagtctgggaagcgccgatcctgacggctgtgtcaccgagggcgaaggaaatcgaagagctaggtctcgacgaaaacgagccgattccagagttcaagaagcttcatggcctcgggtgggggattgattatgaaactcgccaagtgagtgtccaattccgtagaacaaccaacngaatggaccgcgagtgggaccaattgaaagaatgtcttacctggtaa

SEQ ID NO: 21158 - DNA, 432 bp, A.fumigatus
gtgcagtacgactttgactcttgcatcatgggcaataccaccagtatcgccgctgggcgtgactgtttactatccgccgttggagggaaccatgctcatgtcgcattccaagatcagctgttgtaccaggctaccgcggtcgagccatacaacgtgaatatcccggtcactccggcagcagtgacatatcctcaatcggcggatgaggtagctgcggtggtgaaatgtgccgctgattatggctacaaggtgcaagctcgcagtggaggacacagtttcggcaactatggtatgtatgccttaaactgttacggtggtagttctcagcctccgaaatcaagtccgctaacttgtctctgttcaaggcctcggaggagaggacggggccatcgtggtcgacatgaagcacttcgaccaattctccatggatga

SEQ ID NO: 21159 - DNA, 243 bp, A.fumigatus
cttgtctctgttcaaggcctcggaggagaggacggggccatcgtggtcgacatgaagcacttcgaccaattctccatggatgagtcgacctataccgcgaccatcggacccggaatcacgctaggcgacctcgacaccgcgctatacaatgcgggccatcgagcaatggcgcacggtatctgtccgaccatccggacaggcggccacctgtcaattatccgccacgaggtgaaagacccgggt

SEQ ID NO: 21160 - DNA, 285 bp, A.fumigatus
  unsure (68),(245): Identity of nucleotide sequences at the above locations are unknown.
actacgctcagtgtatccccgggagccacgggacgtcccaccaccctcacgacgacgacggcggcgangacgacatcccagaccaccaccaaacctaccacgagtggtccaatacatccgcaacccaccgtgaccgcatccggtaaccctttcagcggctaccagctgtatgccaacccctactactcctccgaggtccatactctggccatgccttctctgcccagctcgctgcagcccaaggntagtgctgttgctgaagtgccctcatttgtttggctgtaa

SEQ ID NO: 21161 - DNA, 375 bp, A.fumigatus
  unsure (375): Identity of nucleotide sequences at the above locations are unknown.
gaccaactctctgacagtcgtagcgacgttgccgccaaggtgcccactatgggaacctacctggccgacattcaggccaagaacaaggccggcgccaaccctcctatcgctggtatcttcgtggtttacgacttgccggaccgtgactgcgccgctctggccagtaatggcgagtactcaattgccaacaacggtgtggccaactacaaggcgtacattgacgccatccgtgctcagctggtgaagtactctgacgttcacaccatcctcgtcatcggtaggccgtacacctccgttgcgcgccgcctttctctgacatcttgcagaacccgacagcttggccaaccgttttcacacacgggcctggaaggatgn

SEQ ID NO: 21162 - DNA, 312 bp, A.fumigatus
  unsure (144),(285): Identity of nucleotide sequences at the above locations are unknown.
aaaagggggaccattcggccggtggaaaccggcaggtcaaattggtggcatcttctccccactttgatccaaacgccctgggccccatatatcggccggacgaagaggattctcgtcgctcccccctgtttggcggcctccatntacaggactctgggacgagtgatctggaagttggacgcagagcccgcatccgtcattggagtacgctggctgaccaagatcttcgtcgcgggggatgtgatatcttttctgttgcagtgcggaggtaacagacaccacctngtcttgtccgtccctgacacccactaa

SEQ ID NO: 21163 - DNA, 459 bp, A.fumigatus
tacaccacaggaggcggatacatggcagcgggcacactcgaggccatgaagaacggcgaacacattgtcattgccggtctcgcgatccagctactctggttcggcttcttcatcgtcgtcgcctcgctgttccactggcgcgtcgtccgccatccaaagtataccatctccaacgacctgagatcccagggctccgggatctcatggtcgactctcatgtgggccctctatgccgcttgtgtgctgatcctcgttcgctctatcttccgggtcgtcgagtttgtccagggcaatgccggcttcatcatgaggcatgagtatctcctctacgtgttcgacgcggtattgatggccctgactggtatcgtgcttggtcttgtcttcccgggctcgtttgtctcgcggcggtcgcgatgcgccgacgatgcggtccctctcggtagtcaattgtctaggtga

SEQ ID NO: 21164 - DNA, 333 bp, A.fumigatus
  unsure (14),(31),(38): Identity of nucleotide sequences at the above locations are unknown.
ctctcgcggtcttncccctcctgtggtaaanagcccanggtcgctcgatacatgccgcacgtccgcaaagctcgtgaggaggatctgaaggagggcaaaatcactcggcaggagtatgatgcaattgaatccttggagagaaaccacattaggtatggttccattgccgattcagagagcgatgcttatgagcggaatagcaatatatcgactgcccacagcaatattggttatttgttcactctcgcactgaacttgagtgttttgcttcccctacagaacaatacctattcaaacaatctcgccctctgtttgacaaactcatgtaagtaa

SEQ ID NO: 21165 - DNA, 222 bp, A.fumigatus
  unsure (48): Identity of nucleotide sequences at the above locations are unknown.
cggctgctagactgggtggttttaggagtatggtggttcatcttccancagaaacggccaggccctcaggtcccaaagggttcgaactatgcaacgattggcttcaagcaaatctggcttgcgctcagagaggtccggtctttgccacagacattcctctattttatcgcttactttctgcttgccgatgggctaaacactaccggtgagtgcagccagcct

SEQ ID NO: 21166 - DNA, 516 bp, A.fumigatus
  unsure (11): Identity of nucleotide sequences at the above locations are unknown.
gttacgcttgnatccttcgacccgggcctggtgaagacagctcctcctccccgtcgcacctaccaagatcccgctcatccggaattgactcaaatcatgctggaagacgagtcaggccgcctgcgtttaacagggagtcttttgacgtcaactcaactcgcgacaggagtcatcatagcggtactggggacggaaaatgcaaatggtgattttgaaacgatcgatattagagtgcctgacctgcctccgcagccgcgtcggtgggagcggaatgaaaacagaacagagacaaaagagccgcgcaaaagcaagattgcttttgtgagtggtcttgggattacgggcacatcgagtgatactcttgcgctggaacttctggcagactatcttctggggtatacagggtcggatgcgtcctcgatcacacggcttatcattgccggaaactcactgggggctaatgtgacggctgaagcagcagctacagacatggagatgggaacggccgcgaagaag

SEQ ID NO: 21167 - DNA, 384 bp, A.fumigatus
  unsure (14): Identity of nucleotide sequences at the above locations are unknown.
tactgtaccaccantacaaacaaccaccaacctccaacttcgttcaagttatatgcggcccacattctttcaatgttgtccatgcaaaagacgcccaccttcatcctgcccccaactgcgaatctcaacaaccacaaccctcatggtatccaatccaacccaaccgcggagcatcgcaactccacccgcgctctgagcttgtcggaaatccccgcctttcccgatggtccatccatgggcgatggtctctctcgccatgaaagcatcagtaccgacggcacctccaacgattctcccgagtcttgggacggggaaagccactctgatagctgtccctcggtcgactatgagatcaaaatccatgacggctcgtaccctgtctaa

SEQ ID NO: 21168 - DNA, 510 bp, A.fumigatus
  unsure (497): Identity of nucleotide sequences at the above locations are unknown.
actgccaacgccagttccctcctggccaccttaaatttgcgtccaggacccgaagctcagaagtcttaccgatattatctttgccgtttcaattggtggcgatattcagcaacctccatctttaagcctcttttcacatacctccctgttcaaaacagcgccaacgtcgtaaattcagcagccatgtctcgccatcacccggatcttgttatgtgccgcaagcagcctggtatttccatcggccgattgtgtgacaagtgcgacggcaagtgtcccgtgtgcgattcctacgtgcgacctacgacgcttgtccggatctgcgatgaatgctcctttggcaattaccagaacaagtgtattgtctgcggtggtgaaggcatcagtgatgccttctattgtttcgagtgcacgagattagagaaggaccgagaacggtgtcccaaaattataaatctgggaagttcgaggacagatttattctaccagaagaaaagctntcgaaatcattga

SEQ ID NO: 21169 - DNA, 192 bp, A.fumigatus
aaggttacaagtctcgtgaagctattgaacaacatcctcaccatatcttaccccgcccagtgtacacagaagaaccctcgctcatatttctcaatctcttcagggcccgtatcaattagcaatatcatggcacggctctacatatgctaccatatcttcaccacgacggacaaggtccgaataatgttaaag

SEQ ID NO: 21170 - DNA, 480 bp, A.fumigatus
  unsure (429),(430): Identity of nucleotide sequences at the above locations are unknown.
aaaaactctgcgcctcggcaatcttcctcctcgacccgcaggagcaagagcaagagcaagagcacggataagccagcctacgaagtggaatacgtacctcgcacgcatcaactcatcgagtcccgcccaagctcgaccctaaccccaacgtccacgtccaccacttcaacctcgacctcgacctccctgtcacggcgtctctctatacgtctgacgcctagatcaaggtgctcccgctcgtactgtgacacaaccgaacgccaacccctcgtcaagcgccgggcccagttcgcctacaaacccatccaccaggattatctcagcgaagtggccaaaaagacagctgcggcacctcgaatcacttccaacagcgtcggagagagaccaatatctccgtctccaactcccccttcgtcgctggaagccacnncgtccccgtcgtggtcgcgcttccggtatatccctgcccgaccgcagtaa

SEQ ID NO: 21171 - DNA, 816 bp, A.fumigatus
ttcccaacagcttggaggaagaccgggggcgagtctcattcggggaatggtgcacggactgcatccttcgatagggagtctggcactgaaaacatgtttgaagcatcaatggacgtccttgatgtcgaagctcagggtcatacagcatggatgacctccgccttgctcgagttttactgcgtcagcaaagcaacagacatcctcaatgccagggaaggctctcagatgcggtacactcgggactctccggaggtacagcatctggccaaaaagatgtatgcccatcaatcgcagctgctatcgacacatggaatgttacctggaggcattgagagcgacgaatgtgaagagagaagacagaggtatcgcgaaaccattgatggaattggcttgcaggccctcaaagggctaaacttggatgatatccctaagcagacgccgtctctcgatgcaacgaaagacgtcgttttggcttccaaagcctcaaatcggatgcaagtccatgtaaaaacggattttgcacgacctgcgcaaatgaggcgtcaatacagcggactgttggggttcagagaacaagatgccggaagaggcgacgcgcacgcgccagagcatcagccgttcgccctattgggtagttcgcctgtgagcttcccgttattcaggcccaatccgccaccaccgactccagctatatctcgttatgcgacggaattctcagaagtgagagtcctcggtcgcggatcatttggcgaagtctatcatgtgaagaatcatattcacgggcagaattacgctatctattggaccacgggctga

SEQ ID NO: 21172 - DNA, 303 bp, A.fumigatus
gttgcagccttcaacgccttcataggcacaaccgtgatcgtcgcgcagatctccttcgctgtccccgcagcattgctcatctatcgccgtcgttcgcatgagtatctcccaccatcaaggccgttcaaggtcatgcatgtggtagggtacgtgtgtaatgtgatgacggttgtgtgggcggtggtgattacgattttctctacatttccgacgacgttcccggttactgggggaaatatgagtatgtcttcattcctccccccccgttttcgttatggtttcatttgctgtgggtgtggttag

SEQ ID NO: 21173 - DNA, 192 bp, A.fumigatus
  unsure (2),(117),(120): Identity of nucleotide sequences at the above locations are unknown.
cnggggcatgggggctgcaagcatggcgaaaaaaacgacagaaggagacctggggaaatggcgcaaaatgattggagaagaaagcccgacgaaattaacaataccgtcaacgttcanaanaacgagactcacccaatgaacggaaagactgccccccgcacgaaaaggccatcgagggcaataaaattgtaa

SEQ ID NO: 21174 - DNA, 240 bp, A.fumigatus
tcgagcgaacacccacacaataccacagatgtcgtgtcaaactggcgtcgcttatacaaatatgtcgtgcggtgtatcatcaaatgcagcaggcgaccggcggtcgaacatcccgcagagaccgaaactcacccttcagaccaaatcactaccaacgacatttggcacttcaacaacggggctgtctctctcgttagcagcatgtgccacagcgtctcccactgtgcgcaacacttttaa

SEQ ID NO: 21175 - DNA, 516 bp, A.fumigatus
  unsure (41),(323): Identity of nucleotide sequences at the above locations are unknown.
aatggggcttacaaccaaggaggatactttatggccaaccngtatcctccccagtattttcaggcgcctaacagccagcagcagcagcaacaaccgcagcagccgcaacagcacaatttggcgtcccttcagccgacctatcagacacggatggcctacaatgccaacgatgggacaaatggacttatccagcagttttccaaccaggatctgaactcgacgcgcacggggttttttggccgtgctgcctctcctgctcagagacctcgcacggctggtttttctgcccccggacaacagcaaccgggccatctcgcccctcntatgcctcggagtccccgaactccggctgagaacgaagaacttcaacggtatcccgaacgctactctgagaacgttcataagcgtggtaaggcggcgaaagagttggtgaatgtatttttccatgagaacattgagcgggcacgcgatcgtaacatgcgtcttgcaccagcggggctggaaagaccagcgctc

SEQ ID NO: 21176 - DNA, 273 bp, A.fumigatus
cgagtacagtgggactccaactccctctgggaaagccggtacatctggcttcctatggatattgatgagaacaagaagacgctcgaccttgtctggaacgacgtctatgatctcaacgtgtatgtagtccaccaattgtttaaagaaatactaacgggaccagcaaaaccggggagtggaaagccatccgcggcaagacatacactgccaaaaaggccaagacgaacggcgatgcgtataaacaggaagctgtatgtcctccaccgtcggtga

SEQ ID NO: 21177 - DNA, 345 bp, A.fumigatus
ataggccccaagtccccatacctttttctttctttgatatcgtctttcaaattctcactccctttccaacctgcgacactcctcatcttagaaatggccgaggacaaggctccccgacccaccatggatccgaagctggagaagcacgcccatgatgcggatgaggcgatgaaggcctttgagggtatggagggcgagtctattaccctcgatgaagaaacgaacaaaagacttttaaagattattgactggcatatgatgccgatcatgtgcgttgtgtatgggatgaactatttagatagtataggccaacggattattcgcgaacattctaacaagaactga

SEQ ID NO: 21178 - DNA, 300 bp, A.fumigatus
actgcggtctggatgaattatcaatccatcacaatggcggctagtgcccccgacaatggccaccgctcccacccctctcagcaagccggctcaactataccgaggagttctgaaggccatgaggaacggagccctggctaccgtgacgaagacttcggcgcggaactagaaatggagagatcgtctcggacatccccccagagtttcactccccgttctctctttgttggactcgtcattggcgccttgatcactttctccaacacctacttcggtttgcagaccggctggatcagcaca

SEQ ID NO: 21179 - DNA, 303 bp, A.fumigatus
gaaccagaccctctccgggctgtccagattggcctcgatatggatattgtcacatcgtcacatccaggtgatgtcatggcggcggcggggattgagcatcgtacgtttaatgctctccctcaggacatgctgcgtgctgttccaggcgtgacgccaaaggtgctcgagcgactcatcctcgagacgggaaatatcagcgagattgcgaatatggatgttgagcagcttgatcctctgattggaagggaggcagcgcggaagatcgttggcttctttcgtaaaaatttgtttgatagtagttga

SEQ ID NO: 21180 - DNA, 588 bp, A.fumigatus
  unsure (9),(588): Identity of nucleotide sequences at the above locations are unknown.
tccctgccntccaaaaacatgcggacaaaacttgtcgacgccctgaacctctggttccaactgccccatcacctagtggacaccgtcaagggcaccgtggacgacctccataactcgaccctcattctagacgacatccaggactcatcttatctgcgacgagggtttgccgctacacaccatgtcttcggctccgcccaatgcatcaacagtgcgacctatcttttagtgcaagcggcttcccggttgagtgttcataacgagcaatatcccgccgtgatcaccgtctttctggacggcctgaaagagctctcactaggccagagctgggatctcaactggaggtccaccggatactgcccgtccaccgaggaatacatggcgatggttgatggcaaaaccggagtgatgttcgatatgatcgttcgaatgatgcactgcttctcatcatcccagactgtcccggtgtcagagttgagccagcttacgcaactgctcggccggtggtatcaagtgagagacgactatcaaaacctgcacgacgaacagccttcaccacagagacgaaggaccgcgcagagcccatgn

SEQ ID NO: 21181 - DNA, 465 bp, A.fumigatus
gtgggtggaggtgtgctttcggactgttttaaaccagaagagcgtggaaaaagtgttgcaatatacagtcttgctccgattctgggtccagctgtcggtcctatagtcggtggcttcatttctcaagacaccacctggcgatgggttttttatgccacctccattgctgacggagctatccaaatcggcgggctattcttcatccgtgaaacatatgcacccaagatcctgaaacggagagcagagcggatccgaaaagagacaggtgattcggcgtaccagactgaaaccgagcgacagaacaaaaccctttcacaaacaatgcagacggcgctggtgaggccgttccgcatcttgtccactcagcccatcgttcaagtcttggccatgtacatggcttttatttatggggccctgtacgtcccccttttgacaattcgcccgagagcgccaaaatacgcgtag

SEQ ID NO: 21182 - DNA, 351 bp, A.fumigatus
tactacgcgccgggcggacagctcgtacaccctcgcggagttgtatcgaacgagaccgagcgtgcaaaggcaaacagcaaagtcacggaagagctgacccatgctctagtgcacaaggggttcatggttgactttgcacctcctagcggggacgaggacgctgccggggatggaaagtttttccgctgcgttgtcaatgtccagacaactcgcgagactgttgaagctcttgttcgtgctattgaggaggcgggcccggccatcatcgaaagacttaaggccgaggctgcttcggttcccaaacgtaggccgggagaacgaggccacggacctgttgttcaccaggggtag

SEQ ID NO: 21183 - DNA, 246 bp, A.fumigatus
gcgggatccttttggattgattttctcttcatttacctgtgtacaatctgtttgactgcccagttccggctgtttgctgctgcatcaccgaactttgaagtcgcattgcgctacagcggggtctctgtattgttttgcatcgtctttggcggttatgtgctctctgtggacaagatgatgaattacgttccttgggtagggtggatagcggtaagcaccatccggaataacctttcagggcgataa

SEQ ID NO: 21184 - DNA, 225 bp, A.fumigatus
tatactacgccggcgctatatacatacgaagcaatgatggcggcagagtttcatgacaccaaattctcatgtgcgcctggcgcagttataccttcagggtacacttacaataatattgcttatcaaacttgtggtatttctggaagtcagccagggacaactatggttgatggagatcattatttggccgtgcattgtccaccgccgggatggaaggtaaagcgt

SEQ ID NO: 21185 - DNA, 426 bp, A.fumigatus
cttagggccttcgacccgccgtggaagaacactaatgcgccgcgggcgaccaatgggaccgcagagtatgattatatcgttgtcggctcaggacccggaggaggccctctcgcagccaggctagcaattgccgggttcaaggtgttgttgctcgatgccggagatgatcaaggagatgccctccaacaacaagttcccgctcttcaactgcaatcaaccgagtatgagccaatgatatgggactattttgtgaatcactactcggatcttgagcgccagaaacaagactccaagatgacctacaggactcctgccggggagttgtacgtgggtcagaatccaccagcgaactcggaacccctgggcatattgtatccccgtgcaggcacattgggtggttgctcggcacacaacgccttgatgtga

SEQ ID NO: 21186 - DNA, 516 bp, A.fumigatus
aactcatgcgcgtatccggcgtctcctgtggtagaagacgagatcccggctggcggaacgaaatcatccccttcggacactggaaccgaattggtatcgtccttcaaggcggctccgtcaccaggctctaatatcataattgatggagatctgatcatcgacatgggatcgccccctccatctcgtcccgcttacagggttaatccagcacacttctcgtccaacaataccccaggaaacgaggaagatgacgatgaggaggaggaggaggaggaagaagaagaagaaatggaagctctccggctaccatctcctgtcggtcacggtggtgcttcgtctgagagggtggaaacagcacccccaacacaggaggaaattgaagatgatgacgatgcactagcggctgaaatggaggctgcttttgaggaagaagcgaggaagcaggagtaccagccaccctctctgcagtaccacgttcccagtgaagatgagagtgaggttagcgaggaggaatga

SEQ ID NO: 21187 - DNA, 522 bp, A.fumigatus
tactcttatccttcgacgcggcggttaagacagcatggggcacccgagctgcgacagccccgaatgccattatcgccttccacgatgtccaccacctccgtcctcgatggcttctccctcctgcccatgactcctccagatctggtggatggagtgccctccatgcaccaggataccgctgcggtaacaacagccattcatgtcatatccacagagcgtgcggccctcgccaacctggagcagatctaccagaccgaccggctagcgcaggagaaccttgcgcgggccgtaagtcggatcgtccgcaccgtccgaaatggcgggaaactggtcgtctgcggcgtgggcaagagtggcaagatcggacagaaactggaggcgacgatgaacagcatgggtatctacagcgcatttttgcatccgacggaagcattgcatggcgatttggggatgattcggccggtacggatattcgcggctttcttgcaaagcttagttggggaaagtggtatagtctactaa

SEQ ID NO: 21188 - DNA, 210 bp, A.fumigatus
  unsure (73): Identity of nucleotide sequences at the above locations are unknown.
cttaatggtctgagatacttcgtgccagtaatgctccataaatgccccactttggcattcctggggcaggganaactcctggagctcaattcgcaatactctacgtccaccaccgagccacgagtccaatcatcgcatctgggtctggtccataaaccaagtatgatctcgtatgtgctcactatgaattgcaatggagctcacggataa

SEQ ID NO: 21189 - DNA, 432 bp, A.fumigatus
cacataaccttgtcgaaaatggggtcatgtttcagcacagagtcaccagaggatgcggaacaaaagaaacgaagtcaggccattgatcgccggttagaggaggattccaggcgactacggagagaatgcaagatacttctgctgggtcagttctggatttctctgagtataataatggtgattgtgccgtgggctaacgggagctttcctttgatttgcgacagggtccggagagagcgggaaatctacaattgtcaagcaaatgaaaatcattcatcaaaacggctacacagtggaggaacttgcgttatatcgtttaacgatctacaaaaatctcctagattgcgccaaagctctcattggagcttaccaccaattcaacctccaaccaacgagtcccaaagtccgcgaattcatcgagtgcctttctga

SEQ ID NO: 21190 - DNA, 330 bp, A.fumigatus
tttgcgacagggtccggagagagcgggaaatctacaattgtcaagcaaatgaaaatcattcatcaaaacggctacacagtggaggaacttgcgttatatcgtttaacgatctacaaaaatctcctagattgcgccaaagctctcattggagcttaccaccaattcaacctccaaccaacgagtcccaaagtccgcgaattcatcgagtgcctttctgaatacaatattgacccggatccaaacacgcctctagatcctccaattggaaatgcggtcacctatctctggaatgatccatgcacgtccactggcgttagaacaacagaatga

SEQ ID NO: 21191 - DNA, 492 bp, A.fumigatus
agagtgcctgcgacgatttccaagtcagcgaactcgagaaagaagagaacagggaaagtgcaaaccgaggtctccaagacgacggccaagaagccccagagctcaagatccaaaagtcaggcgaagggtaaggaggccaagcccaaaagtagcgtcagacttcccaaggtcaagacggccaaaacgaaagtcaaggcggcaattcttcccaagaagaagtcatctaaaataacagggaagtcgccatcgaagccgaaggtttctcctgcgtcttcctcgacgttgagccgtccatctgcgaaagcaaaggagaagatactcagggtagccaaaggtgcgaatgcccggaaacagacgacgaaggggaagacagctggtacgaaatcgccttgcaagaaccccacaagcaacagcatcaaaaagcgccctggggctgcgtcatcgactaaacggacaaagggcgcaagcgtggagatggtccattccacttaa

SEQ ID NO: 21192 - DNA, 195 bp, A.fumigatus
acgaccggcaatgctatcgcgcttgaagggactgacggtcatcggtgtggagggcccactgccggcagtagcggcggttacgccaccaacaccacttccaatacccgagaaaacgcggcccaattcactcttgatgccagcttcgccggccgggccaaggatctgagcctgcgctccttggacggcttggggtaa

SEQ ID NO: 21193 - DNA, 558 bp, A.fumigatus
gaagcgcttgtccttccagccccggtggctgaagaattgacaactgccgtttcgacaacagcggctggtaacggtagcttgacttctggctgtctctaccagccgggagctacctcggtgtcgcaagtcaactcgtcgtgggctcaatcgagcagcatacccatcataaacagctcagacgaaaccaaggctctaagggcaatatgcgatctggtcgtcaactccagagactgcggcttgtcaccggtgctcagtaacactttgttcaacaagactgccgattcagacgccgaaccataccaaaacatctccacttctgcctcgtggtcctgggctattggtgaaccccgagacccctcacctcctggcatcgacgaggactcgcagcacatcgagcgatgtgcagtaatggacctctcactggggggccattggcgctccactaactgcagccaagagcgccacgccgcctgtcgtgtgggaaaccatcccttcacctggtccctgtcatcgggagcgtatacgtactcagacgcgttcgaccatgcttgcccggag

SEQ ID NO: 21194 - DNA, 540 bp, A.fumigatus
gggctgacgaacctgatctcggtctgcgggctgacgggagttgagtcgcctatcccaccttttggcggctcaggcgattttgacatcagcccgtcagcaattgtgtttgttgcaaaggatcccaacctcaatcctgcgacacacacgtcctgttcgtgctactactgtccgatgttctcgtggaccggtgtaggcgcactggaagccaaggtatgcacagtcaagggtcttgagggtgctatgtcatctcctgttctctcgtccgatggcagctcgattgctctgctcgggatgcgtgaagatggctatgagtcggacaaaaacagaatcctctacgttccaaatccttggaatggtgagatgattgagattttcgcctctgctgatggcaagggacagtgggatctcagcccgtcgggattgacgtttgccaaggatgatcagtcattattcgttcaggtcgaggagcagggtcgtggcgtgttgtatcagcttcctctcgacaagtccgtcttcaccacggggctggaaataacgcgt

SEQ ID NO: 21195 - DNA, 240 bp, A.fumigatus
  unsure (83): Identity of nucleotide sequences at the above locations are unknown.
tcggcaaacaaaccatacgtagagccttgtacaacccaagtacggagtaggtccatctacgacccgtggttctggtctgtcanacctcaacaaactgttattaaagcagtgatggattatcgttcctgggcatatcatactatttcgtttttgggaactaggcttgaggccatatcagcagttccctacaagccacttcacaaattttataaaatatatagcgtgcgagccatggtcgtt

SEQ ID NO: 21196 - DNA, 258 bp, A.fumigatus
atgtttagatggcgcgctacggatggcccgagcttcttcagcaacaagtaccgacagatagagggaaagaagttcctgggagtgcgtgtgccaaagggtggaaaatcgcgtgtcgataacaggtatcagaagaacaggccgggtttctttcttccgggggcggcagctgccctttttaaccctgcgcccgccttccactctcgcgctaaaaatgtggaatgccttaggttttgctctttctctcactcttttttgtga

SEQ ID NO: 21197 - DNA, 297 bp, A.fumigatus
  unsure (33): Identity of nucleotide sequences at the above locations are unknown.
tccccccatatactgcccgttggctgcgttaanaaatctacacaagctgcccttgtccaaggagcagcactgcgtggtttggagggtctccaatcaacaacgaagcgatgccgtcgacactacggcttcagttggaatatccccttccgtgatggaatcgacagtgaacttgatgccatttatgatgaatatgatgacatgaaaagggtgtctggcatcatggagtggatgattgctaaggtgggcgctcctgaaccggacctgttggatctcagtctgtggaacatgctgatatag

SEQ ID NO: 21198 - DNA, 528 bp, A.fumigatus
gcaccaaatggcggctatgtgcaagttcaacctccattgattacatcatccgactgcgaaggagctggggagacatttacagtgctaccgcgtgaaacaattatggatcccaagtcggaggggaaccatttcttccgggcgcccaagtacctgacggtctcgtcgcagctccatctcgaggcctacgcagctgagctgggaaacgtctgggctatctcaccgacctttcgcgcggagaagagcgacacgccacgccatctcagtgagttctacatgctcgaggcggagatgaacttcatggacgatctcgactccctgacggatgcagtggaatatgtagtccgcgatcttactcgccggttgtaccagtcgccggtcggccaagagatcctgactgccaagcggtcaggcgagagcggccaggacgatgccgggaatggggcagtgccaaaccttcgacagcgatgggttgatctcatggaagggcctcgctggcgacgaatcacctatacgcaggcgatggagttg

SEQ ID NO: 21199 - DNA, 192 bp, A.fumigatus
  unsure (26),(104),(135): Identity of nucleotide sequences at the above locations are unknown.
agggaagtaggggacgtgttcagtancgtctcgagtttgctgggaggcttgaccaaagataagaaaggtaaaccaaacaccgtctcaagggagaagacgtcaanggccgccttaaacttcgctgaggcatcacantggtttttggaattccgccgcatgaaggggagcctaacaaagggtatcagcatttaa

SEQ ID NO: 21200 - DNA, 204 bp, A.fumigatus
  unsure (54),(85),(163): Identity of nucleotide sequences at the above locations are unknown.
atgctgataccctttgttaggctccccttcatgcggcggaattccaaaaaccantgtgatgcctcagcgaagtttaaggcggccnttgacgtcttctcccttgagacggtgtttggtttacctttcttatctttggtcaagcctcccagcaaactcgagacgntactgaacacgtcccctacttccctctataactccctttaa

SEQ ID NO: 21201 - DNA, 519 bp, A.fumigatus
acacccatgcgcggatccttcggcccctgtggcgtgaagaatagccttctgccacgattttggagcgcatacgatgctttgtcgctaacctcagaatcgcccaccctcctcctgaaagcactcccgcttgctcagcatcttcaccgggctattctgcgtacggggacatctctactatcgaagcaccaaattcggcacctgcgagcatttcgcattgctgttgttaaggatggcccagatgtcaagctttttacaaaccctggagctctgacgaaactggctctctggatagctgaggcgatccgagtccaatatcgggagcgaggcgacagcgtaaagatcggaaagaagcgagcggcagggactcccttggtgctggccggccttgacgaagaccgaggcctgtatgtcgttgtcggcacgggtggcggcggaggtgtgatcgattacgcggcgatgcacaagcgtcaagaagaacgccggaagaaaaatgaatctaatgataataatcaaatatag

SEQ ID NO: 21202 - DNA, 222 bp, A.fumigatus
  unsure (57),(69),(161): Identity of nucleotide sequences at the above locations are unknown.
cttgacatgcgcggcaacaagcaccttctgcggaaacgcttcggtatcgccttccangaagtggtgcangagaacaacactcgagtgcgtatcgacagttttgagcattgtgtcctaaaaattcaaaaaggagaactgggtggcttcctcgaagctctcancttccgcaccgttctccggttaaagtccgagtctccctgccgtctgccttgctcaaaataa

SEQ ID NO: 21203 - DNA, 309 bp, A.fumigatus
ctgaccgctacatgcagcgtgatcatagcgacaattatcgagatcgccttctcccgcgacgtacgccattccaccgatcctacatacgattactgccccattacgattgcgtcgcaggttgtacaatgtgcgagtatcgttactgcgtgctggggccaactgaagcctttcctcaatcagctcaagtccaatggtctgcgcattcaaggggtgcaatatcaatattcgactgggaaggggcaatcgtcgcggtcgtacggacgatccgggacaaaccagtcttcaccaagggggacgaagatccgcgga

SEQ ID NO: 21204 - DNA, 543 bp, A.fumigatus
aacaggttctatctggttgtcagtggtgactcctgctacgacattgcagctgctcagggaatatctctcgacaacttttacacctggaatcccgcagttgggagctcctgcggcggcctgtggcctgactattatgtctgcgttggtgtgatatcagatggcacgacgacgacgaccaccaccaccactcctagtactacttctacaactactaccactgcaggaaacggggttatcacccctacaccaatccagacaggcatggtgactaattgcaacaagttctaccaggttgttagtggagatggctgttatgacattgccgccgcagcggggatcgcgctgaatgacttctacacctggaaccccgcagtgggcaacacttgtgctggtctttggcctgattactacgtctgtgtgggcatcatcggcagttcaggcaccactactacgaagactactagtacaacgacctctggcaatggggttgccactcccacaccaagttttctccacgggagccaacgtccgcgcaaggaggga

SEQ ID NO: 21205 - DNA, 198 bp, A.fumigatus
tgtccttcaccattatccgctgccgccgccactcacatcattcatcaaaccgagtccgaagccggatccctgcggcagagtggctcgactccaaagcaacccaaatctactctcatacagctcctcttctctggggactcgaacgagatccaagaacagggtgtcgtgcctatcctcggataccctgcctatgtatga

SEQ ID NO: 21206 - DNA, 753 bp, A.fumigatus
tgcctgacagccggacgcgcagataacaaggtccagaagttggtggatgccgatggctcggagctgccactattcatccattttgaacatatacccagtagtttcgtccagctttcacttcttatctcggctcagtcggtgccagtccaccttcgtccctttctgtccgtgtatacagaggcgttcttcaacttacctgtccaaagggatgggaagacgatcaatttcgaacaagtcgtggttgaattggaaagggatactgttggctattcgatggagggtgcaaggagcctgggcaactcggagatgttgcgcatctctttccaggtcgaaattgagaagtatagcaatgcaatcgcctggctcaaggagctctcctggaactcggtctttgacgtggagagactgcgcgcgatcaccagtcggctgcttgctgacgtgcccgatgccaagcgtagtggtgatgacatgctggcagctgtgcatgtcatggttcactacgcgcctgaatccattgtgcgggcacggagtacattagtcaaggcgcgatatctcaagcggatcaagcgacaattggccgagcaacccaagaccgttgttgctcgcatggaagagatcagacaagctcttttcaggtttgagaacatgcgagttctggtcatcgcagacattgataagctgcccaatccagtttcatcctggaagccctatgctgagcgagtcttaaccaggcggtggccgatcagcgtcaat

SEQ ID NO: 21207 - DNA, 969 bp, A.fumigatus
  unsure (706),(709),(735),(737),(745): Identity of nucleotide sequences at the above locations are unknown.
agagtctcggtcaaaatccgtatcctggagaccccagagaagacagaaagccttgtcaagagactcgttgccacaggtatcacaggcttgactgttcattgccgcacgacgccgatgcggcctcgcgaacgcgccatccgcgaccagttggcgatgattgcgcgaatctgtcgcgaggctggtgttgcatgcgtcatgaatggcgacgtcacctctcgggacgaagcgcttgcgcttatgaaggaatttggagtggacggagctatgatagcgacagcggctgaggcaaacccgtcatgcttccgctccgaagcagagggtggtctactcccctggagggaggtggtccacgactatcttcaagccgctattgagtgcgagaaccgcttcggcaacaccaaatttcttctgaacatcctcatccccgggaagaacagggagttcaaagatgccaagacagcaaagtcttactccgactactgccacttcctcaaattcgatgacctacttccaggggccgcccaattggacaaaatcctcattctcacggacaattccgtttataaaaacaacaaaccggaggatccggctcgcaatatcgcgttcaaaaccccccccaaaattaccaaaacggtccttgcggcaaccgggccgccaaggcccaaaccagctccccaacccggaacgggagaaggtcccttcccancanctccatccccaaccccggcaagttcnancccgaganaacttcctatcgaacttcctggttccagctcccaaaggttgcttccaaaaccagaacttggccgcttgaattttacattctcttccccccctaatcccgttccgggagatttcaattttattcccctttctcctatttttccgaatctactgggcttacccgagttccaaatccgcctgttttggttgtttgtttggaagaaacctccccggggttcccttgtc

SEQ ID NO: 21208 - DNA, 741 bp, A.fumigatus
  unsure (34),(38),(40),(97),(171),(172),(173): Identity of nucleotide sequences at the above locations are unknown.
tttatcttagtcttttcttacttgttgtttcccntgtntnttctatttctgtgtatgttcttttttttatcctttttctttctttttttctctgcanttcttctttctttttcttcgtttcattgggtgcgttgtgtttccttttattcccgcactggaggagctgcctcnnnccaggctggcgctccctcaccgattgcggtcgtcggaatggggatgcgcctgcccggagcggtacgcactgcggatgatttctgggacgctctcatcagccagaaggattgctcctccgaagtcccccaaactcggtataatattgacgcattctaccacccggataagcctcagtccgtgagaacgaggcgcggatatttccttgaggacgactacttgcagaaggccgacacgaacttccttcaatggattccgggatttagtacgagcgaactagatcctcagcagaggttattgctcgaagtcatctgggagtgtatggagaatgcgggacaaaccggctggcgcggcaaggacattggatgctacgtcggtgtattcggggaggactggcaccaattgactgcgaaggaatcacagatgatccctcgtacacaccccttcgccaatggatggtttgcactatccaaccgggtgtcatttgagttcgacctgaaaggaccaaagttaatggggtcgagtcaccccccgtggaagataagcctcttgggccagtacctccgctaa

SEQ ID NO: 21209 - DNA, 561 bp, A.fumigatus
  unsure (174): Identity of nucleotide sequences at the above locations are unknown.
ctattcccataccacgacaccggcaacgtgactttggacgctttcaacgtctcccaacgggtagggacagacctgcaattccgctgtatcgatcaggcaactgtctttgctggtgttacctctggggtgttccaaccttcatacttttatcagatacagaggacaaccggtggntacgaccctaacaacctcggcggccctcccgcaacgccagagttcccgaacggtgacccagagctgccctatttccgtctccatggcgcagaccttccctgggtctttggaacgctaaccaccctgcgcgaacccctcgacctcttttccatgcagctcgtgtctgcatactttgcggagtttgttaggtctggtcagccgaatcccgcgccggagtacctccaggcgcgcgggtataagcagacgctggacgccgtcaacaatttcgatcgatgggagccggtgtctcactccgagggcccattgcagctcctcgattatcctagtgtgaaagatcctttgccaggtcttctaccacgggggccggcggacccgcgctatgcagta

SEQ ID NO: 21210 - DNA, 180 bp, A.fumigatus
tccaaacgaagatctgttcccttgttccatgaatctgccactttcccacccttcatgacctatccggtccccaatcttcaaattaacatttgggttctgttcttccaaccgggacaacccagcccagaaatgctctgggttgaattcttgaagggatttgggatgaacctgattattttg

SEQ ID NO: 21211 - DNA, 285 bp, A.fumigatus
cattcactccttattcccatcgtctacatcttctcatcatcaaatcctctccctctcctcaagttcaataacatctgcacaatgaaactcaccaccgtctcaatcctcgcggctgtcagctcagcgctcgccgtccccaccaacatcaagcgcgacagctatatccaaattagcgacttctgggccagagctggtcccacatcccccggggcatccatgcactttgtcgttactgatccaaactacccggaggacacgcccaccgattgcaacctgatctggtag

SEQ ID NO: 21212 - DNA, 291 bp, A.fumigatus
ccaacgcttctcttgttgtctaggacctatggccacgctcctaaggaaggtgcacgctgcaacaatggcgaatactacatcaaattccccaatggcgctcccgacttcaacttgttcacactggagcttcagagggtcagtgggccaatcgctgaggatggtcatgtcttgctgagttcgaacgcgaatggcggtgcacctggaaccaagtggatttgtgtcaatgacccgaagccaggggttgagattagctgttcttatgatggggttcttcagatgcaagttgcctaa

SEQ ID NO: 21213 - DNA, 546 bp, A.fumigatus
tcaccccttagcgcggcattttcgccccccgtgggtgaaaacagggggaaagaatcatttgcgagttgtctcttgaataattcacacatgagcttgtcggatctagacagacatgtcatccgcacatacagagatgcctgccgccgtcttgataccggggagagtcagacgcgggaaaaccacatgcaagctgtgagagaatacgagcaatcgctccaaaccaacggaccagtgaatctttattttgatctggccaccaggaccaagatgggtgaagaactcgataatctccatgatatgtggagctatgtccgctatgaaaagtacctccctgccacggtcaacgaggatgcagaacaccatccctcgtctaaagtctcggacccctggcacaaggccttctggaagccactctacggacgcctcgaagccgaggcaggcgcgtgggctcaagtcctgtccggcaaaaaccacctctacgactgcccgacttacctcctggcggccccgctgtgcgaacaccaaacccgggactggggagagacc

SEQ ID NO: 21214 - DNA, 456 bp, A.fumigatus
tcaagctttgggtggcagtcggacggattgaggggccacatatatgcagataaaacgaacagtactatcgtcatatccttgaaaggaactagcccggccctgttcgatggtgctggcacaaccacaaacgataagatcaacgataatctgttcttcagctgttgctgtgggcagggaggctcgtacctctggcgacaggtctgcgactgccagcaatctgcttttacagcaaatttgacttgcatcgttgaggccatgaacgacgaaaatagatattacagggctgccatcgacctttactcgaatgtgacagacatgtatccagacgcaaatgtctggttgacaggccattctctgggtggtgcgatgtccagtctccttggtcttacatttggactacctgtcgtgacattcgaggctgtccccgaggctctgcctgcggctcgcttggtctga

SEQ ID NO: 21215 - DNA, 519 bp, A.fumigatus
  unsure (453): Identity of nucleotide sequences at the above locations are unknown.
gaccaagcgatgaaggatgcgggcccgcttaaacctccggtcgtcgatgaacgcaagccgctgacgcaggacgaaatcgccctgcaggcgctcattcgcgagagtaaaggcgagacggaaggtcggacggacttggtcattgaaagtgcgaagcgggaagttgacgagggctatcctgtgcggctcgacgagacgggctcgttccgagttgatgtggcttcgcggcctgagccagcgaccctggatcaatacaacgctataccagtggaagagtttggtgctgcactattgcgtggaatgggctggaaggagggccagtcgatcgggcgagggaagtacggcacttctgctacggattacacgtctcagacaccccggatacccgagcgtcgaccggggtttttgggtattggagcgaaggacgtttcgggtggcaacggcgcaaaagctgancttggtgcgtggggtagggctgcaatgcgcaaaggggctagaaaagcaaagaacccaggaggttga

SEQ ID NO: 21216 - DNA, 216 bp, A.fumigatus
ccaactccgtgtcccactcccgccgactacggcaattatggagactacggcaagtacggcaagtatggggactacggacagtacaaagtgaagagagacgacgagccttgcacgactaccaccgagaccccgactccctctcccactcccgccgactatggtgactatggcaactatggcaactatggcaattacggcacctacgagaactactag

SEQ ID NO: 21217 - DNA, 579 bp, A.fumigatus
ttcgaagcgcgggtccgtccagccccgtgggctgaagacgatgcggctgtgattgcttgccgcggtggcatgtacactatcctcgcaactgcccacgattacgaactcggaggagcatccttggatcagattgtcatcgatcactttgccaaggagttcatcaagaagcacaagaccgaccctcgcgagaacgctcgcggcctcgctaaattgaagctggaaggcgaggctacaagacgggccttgagtctgggtaccaatgctagcttgagcattgagagtcttgcggacggtattgatttcagctcaactatcaaccggacccgttacgagctgctctctggcaaggtctttgctcagttcactcgcctgatcgagcaggttgtccagaaggcggagttggatgttctggatatcgacgaggtcatcttctctggtggtacctctcacacacccaagattgctcagctggcccgcaacatgttctccgagaagaccaagatcctcgccccctcgacctctgccagcgctattaacccgtccgagttggctcctcgtggtgctgccatccaggcatct

SEQ ID NO: 21218 - DNA, 549 bp, A.fumigatus
ctgcgttatgggaactggttcaagactgtgcacaagttcaagcccagggagattgttgctgtggactttatgaattcatccacggtcatcttctttctgctgggtctatggagcatcggcgctgtgccagcattcatcaactacaatctgaccggaaaacccttgacacattcagtccgcacgtcgactgctaggctcttgatagtcgatgacgaagtgcgcgactgtttcccgccggagcagttggagatcttcgcttccagcgacttccgcgaggacaagggtgctgtggaggtggttttcttcacgcccgatgtggaagctcaggtcatgcagaccgagcctgtgcgtgaggacgacaaagcgcgcagcggcccagtcttgcgtgatatggccatgttgatttacaccagcggtactaccggacttcccaaacccgccattgtcagctggaggaaatgctggacgggcagcacttttgtgtccaattggttgggtttaaagccagccgaccgtttttcacctggtcacgccggaatgaaggaatgg

SEQ ID NO: 21219 - DNA, 471 bp, A.fumigatus
  unsure (181),(412): Identity of nucleotide sequences at the above locations are unknown.
cacggtcgcaggctccactccgcaattcggtatggcatcacccaagcgctctttgcagccaccgcactggctcagcgccgtaccatcgccgaggtgatatgtcacgagtggagtctcggctcaatcgcagatcgtcctgtagacattctcgcctcctgccatcgcaacgacgcgctccagntggaccgaatgatcatgaagaaggccccgatgctcccccacgcttcgtttgtgcatgcctccgatataggtccccacggtatggtgctgatggactacgtggacaccgtcgctcgtcgcattcggcaacgagctcccccaggctatcacccccgtcttcatttcgacgtctacggtacgctaggagacgtcttcccggagacgacgaggctggctgattttctcggccggntacgtcagcgcgcacgaccatacgccctcctcatcgaatctccgatcattgcgccatga

SEQ ID NO: 21220 - DNA, 252 bp, A.fumigatus
  unsure (242),(245): Identity of nucleotide sequences at the above locations are unknown.
aagccggcgcagatccagcgattagcggctctccgcgcttgtctaaagcggaagagcatcgatgtcaggatcgtcgccgacgaatggtgcaatacgctgccggacattcgggatttcgcggacgcagacgcggtcgactacgtgcagatcaaaatgcccgatctgggcggggtcgatcagagtattgatgccgtgctctattggtcttcaccacggaggctggcaggatccgcgcacacgtntancccccaa

SEQ ID NO: 21221 - DNA, 450 bp, A.fumigatus
ctgattgcatctctctacaggcattgctttcggcgagcagccagtcgcctcttgtctttgccggtcaccgcgccgacatggtctgccagggcccttgcacctcgcgtcccactacccgtattatcccctctgcaatctcaattagctttacatacgagatggttcagcgacaacaccgccagccaggagccgacgagctcaccagagcatgagcatcatggccattccgagacggttttggcggagcccgatactcgcgatgcgcggccacagaaacccaagatgcggctccgggtcctggaagagaatctccggccaagacagactgtctacgttggtaatctgttctacgatgtgacggcggaagatttgaagaaccacatgcagcagtttggcgttgtggagagagttgatctcattactgataaccgaggattgagcagaaggtga

SEQ ID NO: 21222 - DNA, 252 bp, A.fumigatus
ggatgctgtgataaacttttctctaccagggccaccgtgactgattgcatctctctacaggcattgctttcggcgagcagccagtcgcctcttgtctttgccggtcaccgcgccgacatggtctgccagggcccttgcacctcgcgtcccactacccgtattatcccctctgcaatctcaattagctttacatacgagatggttcagcgacaacaccgccagccaggagccgacgagctcaccagagcatga

SEQ ID NO: 21223 - DNA, 411 bp, A.fumigatus
ggtcatctcacagacacagtcatggtggagaagaaattcgtaccaatcactctctttccaaagaaggcacgtcgattcacacatagcggcctggtagcattcttcctgttcatctacttctgtatcaccaagacatcccaccacgttggcgagcctggatcctactcgaccccggtgaaagccaaagttggtgaaacatttccccggaaaatctggcagatctggaaagtgaacccgttggaatttgacgcacgggacatcgatgttgcccgcagctggactgcgaaaaacccgggctatcgctacgaaattctgaccgaccagaatgacctcgaatatgtcgaagcgaatttcgggccccttggggagaatcgaccccatatcgttgaaacgtatcggtcgttgaatgcc

SEQ ID NO: 21224 - DNA, 318 bp, A.fumigatus
aaccttcgccaagcccatttacggagtgtacggccatgggagactatgcccaaaagcagcatgccacccctgagtggtacaatccctaactatgttctgatgggggtgggcgcctggtcggccggataccatatgaccctgaaatatcacacccaaatgtgtatgcacccctgcctgtcatcgctgccgccatggttgagcttacctagaattctgtctgttttccagcggatgaactatcaatgcatctacttgtcacgcttcttctgtaccggatcttcactatccagactagccttcagcgcaccaggctcatag

SEQ ID NO: 21225 - DNA, 378 bp, A.fumigatus
agcgaggtctcggacttctcaacatcggaagacagcttcacagacgaggatggggacgacgaggacggcggcgctcctgttcctgacatgccggcaccgacttctgaacgtggagtggccctttccttcccctacctggagctgtatggcattgagctcctggagctcgtaggtctctatattacagtcaagtgcgatcgttgcaaagagcacttggacgtgagaaatattccgcaggttaaggataaaagcgatgctttggctccgaaagtcgagacgtgcaagaagtgtaccaacacaatgagccttggtaagaatatcttattccatagcctgaagggggggaaaaatccaaaaactccaaaaaattcacactaa

SEQ ID NO: 21226 - DNA, 330 bp, A.fumigatus
cccgccatcgacgcgttatccgccagccccgcggtgaagaagtatccgattacagggcagacgacgttcctcatccactcaccgtggtttgagtctctgacgatcgatctagggggggtgaagcagctgcgtgtcacggcaaccgggggtgacggcaacggggacagcaagatttatgtgcaaagtctcaaggttaatgggaacccgtggcggaagaactggctgacatggcatgatgtctttgagaatggagggacgctggagtttgagctgggggagagcccgagtggctggttcacgggtgagctgcctcccagccctgcgtcgtaa

SEQ ID NO: 21227 - DNA, 831 bp, A.fumigatus
  unsure (88),(812): Identity of nucleotide sequences at the above locations are unknown.
cccaccttgttaagcgacaggcgccttttatcatcttcgccaatccccaatccccatacgcatttccccagttttgggaagtggcagnaaccgtcaaatcaaccaaccccaattcttatgaatgggatcaacatgagtgggatgcttcaaacaccggcccggccacggcccccaggcacgatggttccactttttaggccggtagaaaaggcgacagatgctgccgagttaacagatgttctagcatcgtctggaattgatgtcagagaagaagaggcctttctcacgagtagctactcggctcccggcgttcaagcgcaacagtctttaagagtacaacaaccaccatcatcgcaacagcaacctcaacaagccctcaatacttctttcgcctcccaagcctttactaccgggacaatttccaccacccccagtttcagcgaaccgtcccagttcaagccgcaagtcacacaagactctttctataccgaaccggcgtcgcaaccacctgcgccgttcaaagaccctaatgagccgactcgggaagacactgaagcagcaagacgcgcacaataccatctacaagagcctttcttactgacgaaggtactagaacaaaggctacagagacgcggctttgaacttggtgttcgcataccggcagaaggcttatttcaccctgtaccaggtcgtcctcagcctattgaggttactggaccggatggctcgtccattgttcgtacggggaagactatcctaaaccaggaaggggcccctttggttgatatattgaatttactgtcgatcgcagncgtcataacgccgggatga

SEQ ID NO: 21228 - DNA, 198 bp, A.fumigatus
  unsure (89): Identity of nucleotide sequences at the above locations are unknown.
tcccaccttgttaagcgacaggcgccttttatcatcttcgccaatccccaatccccatacgcatttccccagttttgggaagtggcagnaaccgtcaaatcaaccaaccccaattcttatgaatgggatcaacatgagtgggatgcttcaaacaccggcccggccacggcccccaggcacgatggttccactttttag

SEQ ID NO: 21229 - DNA, 711 bp, A.fumigatus
cataccaaggtatgtgaccgacgagtttgcccatccaggctgcgactaaatgagacagaggactacagcggtgggggagcaggggggacaggccagtctgaagcgaactacgtcgatcccctggccgacggctccaaatgcgagcgggatatcccgtaccttttgcagctgcggaccaatgtgatccggacgtatgccgtcaacccgtccttaaaccatgatgcgtgcatgcagaagctgtccgacgccggtatctatgtcatcacggatctggcgtcgccggacgaatccatcacatccaactctcccgtctggacggtcgaccaatacgcccgctacaccagcgttatcgatgcattccaaaagtacgataatgtgattggctttttcgccggcaacgaggtggtgaatcaggcgaatcagtccgccggcgctgcattcgtcaaggccgccgcgcgagacatgaatgcctacatcaagaccaatggataccggcaatcgctggcaattggatacgcgaccactgacaacccggaaatccgactctcgctgtccgactacctcaactgcggcgaacaggccgacgcggtcgacttcttcggctacaacatctaccaatggtgccgtgacaagaccttccagacctcgggctaccataaccgcaccgaggattacaatgactactccatccccatcttcttctctgaataa

SEQ ID NO: 21230 - DNA, 216 bp, A.fumigatus
aaccgccgtgaagacgcaacgcttgagcctgaggaactcgacttcaaccgttcaaatttgattttagaatttcgagagacgctgaaattcggggtgatatcctcccaaaaaagggcggaacaaaggtttattcagtgcatagtttcgaggggcaacagtagtgcatggatatacatctatcatgacgacaaatcagaatcttgcatacccctgtga

SEQ ID NO: 21231 - DNA, 339 bp, A.fumigatus
ggcacactcgcagtccgaccgccatgtgcagtccatcagcagtttggggaagccctttcgtcgataatgggcccatccgctggcgaaaacgcccatgaaacggatcaagatagtcgctactgctcattgatagatttcgatgcagatgaccccgaccttccgctgaattggtcattctctcggaagatatgggttacctcgatggtggccatcctgaacttgatcgggacaattgctagtagcatctttggcactggaatcaaagatttcatgcaggaattcaacgttagcaatgaaattgccgttcagggaacgacgttattcttagcggtacgttag

SEQ ID NO: 21232 - DNA, 411 bp, A.fumigatus
aagatggcgcatttccttgcctccgaactaggggcacttggagctgaagttgaacaaagaccgttgggtaaacaaccaggcaaagagcatcttgaccttccgcctgttgtcatcgctcggtatggtaacgataaaaacaagcggacgatcttagtctacggtcactatgacgtgcagcctgccctcaaagacgatggctgggctactgagccttttgaattgactatagacgatcaagggagaatgttcggccgtggaagtacagatgacaaaggccctgttctaggttggttaaatgtcattgaagcccaccaaaaagccggtgttgagctgcctgtcaaccttctctgttgcttcgagggcatggaggagtatggctcaaaaggtctggaggagttcattaaatccgaa

SEQ ID NO: 21233 - DNA, 198 bp, A.fumigatus
attcataactgctattcattatttgtgcccctgaaattccgaaccccggattttattactgtaaccggcatgtccgataagaaatccggctgccgggaattacgggatttattaacgccaagaaacttcgtcagtaatcccccaatctccttcgccatctgcaatccccgggccgcctacgcccggaacgttccataa

SEQ ID NO: 21234 - DNA, 213 bp, A.fumigatus
agactgcctgttgtctgcaatcaagatgagttggttgttttcgagagcccgcccaacacgacgtgcggagagtatgcgatgccctggctgtctagtacaggcagcggttatctctcaaatccagatggtagtggccactgcggatactgcaagtatagtcgaggcgatgatgtgagtcttatttggttgggaatgtcacaaagaggttgctaa

SEQ ID NO: 21235 - DNA, 549 bp, A.fumigatus
gttgacgacttcatctccggtctgtggaaagttcacctctcagtcaagaaggagggctatgttcagaacttgtcccttggattgtaccgttctgattacatggctcacgccccgacaaatgcgaacaccccgtctttgaagcaagtggagttcaacactatctcatcgtccttcggcggcctatcttctctggtgcgaaagctccattcagagcttcttacctccccgccaggctatcctatttcttatcctttccacccactgtttgaatcgaatgtacctcctgaaaataccgctgtggaaaccttgtcagccgggctggctgccgcgcattccgcttacgggccttcgaagtcgactccggctcttcccacgtgtattctgttcgtagtgcaggagaacgaacgaaacatatttgaccagctagcactctccagacagctcactaccgttcataagatacccgttttccgactacacagtaccgaggtcttggatcatacatcgattcctgcctcgagtgctcacgcagggcagaggaacggttaa

SEQ ID NO: 21236 - DNA, 576 bp, A.fumigatus
aattgcatagcttcggtcgttcggcccgcctgtggtgagaccgtgatcatcggggaaggattacagcaatacaagagccttcgtgacctagagaagcgattggatgcctccattgtgcgtaagaggctggatattcaggattcgatcagcaagactgtcaagaaatatcggacaatgcgcatttggatctccaatactgtggaaaatcagccatggcagaccggtgcaggccagaatggagcagccccaggaagcaaccctggctccggtcgctataaagtgagaattgagggtcggcttctggatgatgacaccgaccctacagcgcctgatcacagcgaagacgagggcgagaacgccgaggagaacggagatactatggagcacgatggacaagatgccgagaaggcgaagaaacctgctgctaaacgaccaaagcagcggttttcgcatttcttcaagtcgatcactatcgattttgacaagtctccatcttcgaatccggaggagaccaagactattagctggacgaagccgcagctaccggcaaatgctgtcactcttcctccaattgcg

SEQ ID NO: 21237 - DNA, 264 bp, A.fumigatus
ctcactctccgctcggttcggactcagtcggctaccaatgacctctatctgattgccccccggcgtagtattattcgccatagccgacggccgcaacactgcgttgacaaaaatctccagcaaatccgcataccgctgcgacatgtgaatatcgtctggagcattttgcctgatgacattgatggtccgaagaagaaggtcaatacaagggttggtggtgcggtcgagtggttcttttcgtctcagtacggcctaagaacataa

SEQ ID NO: 21238 - DNA, 540 bp, A.fumigatus
  unsure (313),(397),(490),(515): Identity of nucleotide sequences at the above locations are unknown.
gcagcgcgtttccttccagcccccgtgggtgaagacggcaaggaacacggtcttgatctggccagagcgcagaccgacagcaatgtcggcaatggtgacgtcctcagtctcaccagagcggtgggagaccatgacaccccagttgtcggcgtaggagtccttggcggcctggatggactcggtgagggtaccgatctggttgaccttgagcaggagggcgttgcaggacttgagctcgatggccttcttgatacgcccagggttggtaacagtcaggtcatcaccaacaatctggaagtccgaggtcttgtgnaagtatctccaggcctcccaatcatcctcaacgaaggggtcctcaatgctgacaatggggtacttggcagcaagggacttgtanaggtcggcaagctgctcgtaggtgagccacttggaggggtcgctctcggggttcttgaagtcaaggtcgtacttcttgacgtcggccttgtanaactcgctggaggcaacgtccatanccatcttgatcttgccggtgttacc

SEQ ID NO: 21239 - DNA, 540 bp, A.fumigatus
  unsure (26),(51),(144),(228): Identity of nucleotide sequences at the above locations are unknown.
ggtaacaccggcaagatcaagatggntatggacgttgcctccagcgagttntacaaggccgacgtcaagaagtacgaccttgacttcaagaaccccgagagcgacccctccaagtggctcacctacgagcagcttgccgacctntacaagtcccttgctgccaagtaccccattgtcagcattgaggaccccttcgttgaggatgattgggaggcctggagatacttncacaagacctcggacttccagattgttggtgatgacctgactgttaccaaccctgggcgtatcaagaaggccatcgagctcaagtcctgcaacgccctcctgctcaaggtcaaccagatcggtaccctcaccgagtccatccaggccgccaaggactcctacgccgacaactggggtgtcatggtctcccaccgctctggtgagactgaggacgtcaccattgccgacattgctgtcggtctgcgctctggccagatcaagaccgtgttccttgccgtcttcacccacgggggctggaaggaaacgcgctgc

SEQ ID NO: 21240 - DNA, 459 bp, A.fumigatus
tcagacttaggatgcggctccgcccatccccgatggatgaagacacataacgtcatcatcaatcaactgtttggtcaagagaccgggctggggatgtctcttttgacctttgactgggcacaagtcgtctttgcgaaccagagtccgctcctcgttccattttgggccggactcaatgtgatggggtcgtgtgccttgttttactggatcatctgccccatcatctattacactaacacatggtattcagcatatatgcctatgatgaactccaatacgtttgagggcaccgggagaccataccacacaaagaacgtcatggatagagatgggactatcgacactgaggcataccgccgttattcgcccatgtttcttccaacacgctatgctctgacgtatgggatcgcattcgccaatcttacaggcatctttgtccacgttgcgctttacaatgga

SEQ ID NO: 21241 - DNA, 738 bp, A.fumigatus
  unsure (147),(160),(340),(723): Identity of nucleotide sequences at the above locations are unknown.
gccttcggaaattttgggaggaccgaatcgttgagtttaccggaatttaccaggaaggaatttgaaacgggggatgtcaatttgggcagcgcggttatccagagcacaagcgagatctttgccgttggacgtatcgcttcgaacagnttggaagggaagntgaatccggcgtcacttgtttttgagacttccagacggacaggcgctggtctacgtgtaccactgaacttggattccatacagtcggcgaattttttcgctggacaaatagttgcgctgagggggatcaatgcctcagggaactatttctccgtcaaggaggtgttgcctcctcccctgntaccacgtgcggcgtcttctccagtttctgtggacactatcaatcagaggctagagcaagccggctctccctcaccattgaatgtgttgatcgcgtctggaccatacacggcggatgacaatctcgctttcgagccgctacacgagatctgtcagaaagccgctgagacctacgcggacagccttgtactgatgggccctttcctggatattgagcatccactgctggcgtcaggggactttgacctccccgaaatggagggatttgaccccgacactgccacattggcaaccgtgttcaggcacttcataacagtgccgctacagaaactcgtcgctgctgtgcccagcattacgattgtgatgataccgtccgttcgggtnggcacgccgccgtga

SEQ ID NO: 21242 - DNA, 324 bp, A.fumigatus
caattggtcctcatttttggtccgccgagtacttacccatcacccgtcaatacaggcaagcgaatcgccctgccaacccgggtcgaacccaaggtcttcttcgccaatgaacgtacctttctctcgtggctcaacttcacggtgatcctgggcggactggccgttggcctgctcaactttggcgaccgcgtcggtcgcatctccgccggattgttcacgatcatcgcaatggcagccatgttatacgctcttttcacatttcactggcgggcgcagagtattcggcaacgtgggcagagtggaattgacgaccggtacggtccc

SEQ ID NO: 21243 - DNA, 387 bp, A.fumigatus
  unsure (111),(122),(156): Identity of nucleotide sequences at the above locations are unknown.
gcaaagattgagacttgcaccacacaggaagacgcacaagtcacctctgagaaggaccagaagctggagccgtcgacatctgtcgccgtaagccagggcgctggtgaagtngacattccccntcggacctatcgccagaaaatcgccctgatccantacctcgaggatgaccagacgacttggtatcagtacttccgtcgcccatttttcctctttgcctttccaaacatcgtgctggccggcattcaattcgcatttggctgtacagccggcatcatctcttttaacaccatctcggagattatgacggagccaccatacaactggagtgcaggctcagtaggcctactattcctagcagcgctcgttggtaacttcatcgggtaa

SEQ ID NO: 21244 - DNA, 204 bp, A.fumigatus
cccaccagcccattggtccctcttggtacatcgcaacccgcggacctcaatgtcagacagaagaaggaagaagatctgaccaagccatcagagaaggacgcagtatcgtatctgccgtctggtatcatggacgatgcaagcttcgaagtgacgtggtcaaacgaagaactcgttggttctcgaagatttatttatatcaactga

SEQ ID NO: 21245 - DNA, 396 bp, A.fumigatus
tggatcttcagccgcgtgcatactctgctgccggtcagcatgcgcaagtttctgcccgccgctgatgccatgttggagatgatctgtatccacctgccctctcccgtcactgcccagaagtaccgtgccgagactctgtatgagggtcccatggacgacgagtgcgctattggtatccgtgactgtgaccccaaggctcctctcatgctttacgtctccaagatggttcccacctctgacaagggtcgtttctatgccttcggtcgtgtcttctccggtattgtcaagtccggtcttaaggtccgcatccagggtcctaattacatccctggcaagaaggacgatctcttcgttaaggctatccagcgtaccattttgatgatgggtcgtttcgtt

SEQ ID NO: 21246 - DNA, 210 bp, A.fumigatus
gttacttcacatatagattccgaggcgaatgagcgtgagattgttgaggaggagagatctctaacggatcataatgataagggagaggggcccgaaactgagtcggcctgggccaatgaggccattactggtctgtgtatttctcggaccggtcacatatttgcgacgatgaccgactcctcgatagctgtttggcagactagagtatga

SEQ ID NO: 21247 - DNA, 309 bp, A.fumigatus
  unsure (299): Identity of nucleotide sequences at the above locations are unknown.
cctactacagttgttgctgcgattgcccgctccgcctcgtccatgaagacatatgggtcgaatgtcgctgttctgatgcatcctgactcgacgatccttgctgtgcagacacttggtggatatctgcttacttacacgattgccaccgaccccacaagtcgcgtatatcaacaacatttcgatcaatcgagtcagagccgtcgtcagcagctcgctcgactgtctgccgaggacgatgcgaatgcaatgcctgatgtcagtcttctaccacagggggcgaagggccgcggcgaagcgtntaatccgcac

SEQ ID NO: 21248 - DNA, 375 bp, A.fumigatus
  unsure (374): Identity of nucleotide sequences at the above locations are unknown.
ccctttgatgcatatattcctggatacctcttgctatcgctcggaggtcccttcatctttatctcgtcattccagctgtccaacacattccccactcgctctgggttgatcctgtccatgctcacaggcgcatttgatgcgtccagcgctttattcttaatcttccgactcaccaacgagcgcaccaatggctcattcaccagccacagattcttcatggtttatctgatcgttcccgccttcatcctcgccgcgcaacttctcgtcatgccggccacatcctacaaaacggccggcgagttagtccaacaagcagaagcgtacatcgttgatgaagctaatgaccgcgtcgacgagcgcatccacgctcgttng

SEQ ID NO: 21249 - DNA, 243 bp, A.fumigatus
tttggaacccttggctcacatctagtcatcagtgtggagtgtttgggtaagacacctggtgaggagggtggacagatgtacaccgtcgggcccaactactggtttaaacacttttcccccttgatcgggcgcctgacagggacgaaagacgaagtgcagagctcagatggcaagaaggcagtcagccgttacaagtatgttatctcggacctggctaccctgaacgcagattgcttattttga

SEQ ID NO: 21250 - DNA, 564 bp, A.fumigatus
cccccccacgcttctcctccccggtgtgaagaccccatgttggcgcaacatactgtcgccaacaaccacggccgggaaccgcccttgcagcttttgagtccagctcacatttcaaacggtcttccccggacctcatatcaagactcgcagctacagacctctcctgcctccagcaaatctggcccagcaggaagcgtgcaacggtccaacaacggtagcctgtcaaagcctctgcctacacctgcccagacgcccgtgcagaactctttcctcgccacaccgtttcagaactacgatccatccgcacatgatgctagtcaggccgaggcagaagcggctatgagacgggctgtgatggagcagcaacagcaacagcaatcacaaaaccaatcaagtgactattcactggctccctccgtttcgaccgtgagtcacaactcgccggtgaccccgcagacaaaccttgacgagatcgacgatgcatcgaaggcgatggctaatggtgagaaccgatatcccgatgtagaccggtggatggatgaatacttacatgccgatgcgctt

SEQ ID NO: 21251 - DNA, 570 bp, A.fumigatus
acccatttctccactgaattagacgagccaggggcgaaccgggcaatggaacggataccaaaagagactttgcagcagctctactttcacactcttctcgacttggacaaagatattctcagtggtgcattggacttctggtaccagtatacactttcgtccgagaacattgagactttgattgaggtcttcaacttgcctacagtcttcgtcccccggatggtcgcactgttaacgcatgaaggccgaccgtacaagaaggaaactgtgttgcaagaagaaaaggtggcccccccaccgtcggatatccctcgtgtaccgcccgagctcatgaaagagctgatggagctttcggagcctgaacggagctcgcgttggctccggtgttgctttgtggaggacctcgagtgcgagatcacccaaattgccttgtggcaggcgtatcagagcagatttgcagaccctcgccttcggtgggggggggggtgtgggggggggggggggggtcaaaaatgtcagtacgactttcgtcttcacgccgcgcctggaaggtaccgagtgggggggggg

SEQ ID NO: 21252 - DNA, 255 bp, A.fumigatus
cgccctttacgctttaccttcgacccccgggcgtgtaagactggcaagcagtttgaattgcgcagcaaggtcatcggtgtctatgacaagggcaaggctggttcagtgatggaaaccgaacaaaccatcgtggacaaagcaacgggggagatctacaccaagattgtgagcagtgggttctttgttggccagggtaactggggtggtcccaaaggtcagttactcacgtccttcttctcaaattgcggtcattaa

SEQ ID NO: 21253 - DNA, 345 bp, A.fumigatus
  unsure (277),(341): Identity of nucleotide sequences at the above locations are unknown.
agtctaaacggcgactataaccctcttcatgctacacccgagccagggcaacagatgggcttcggaggcaccatcatccacggcctcttcagctggaacagtactgctcatgccgttctcaaggcgtttggcggcagcgaccccaacaactttcgcgaattccaggcacgctttgcatcgccagtgagaccgggtgaccgtctcaccacggaaatgtggagggtcggcaatgccacggatgggttcgaaaagatccgatttgtgaccaaaaatgacnaggggaaagtcctcctgagcaacggtccggctctgattaaagtacccaattcaggctcgaaatngtaa

SEQ ID NO: 21254 - DNA, 627 bp, A.fumigatus
cattacttttccacggcggctgttaaaaccttgatgacgcatgtgcccatgaagcgcaaggtgatactttcagtgctcttcgccttgtctttgatcttggttgggatcacctgctatcgtgttccgtcggtaatttggcaccacggatcacagcaataccgatcgcttctggcgtcgctagagattctagccgcgaccgctgtctccaacgcggtcgtcattggctcattcgtcagagataaaggcgttaagaacgcgaagttcaagaaggatgttggttcggcctcggtgagcgaaagtatggatcacagctcgacgagacgtgccaccatcacctaccatcaatggggcagcgactcggatcttgcaggagacctggggatccgactggcgcctgaacttcaagcctcggaccacaagattcctcgtccagcgccaatcgccgtaccttaccatcccctcacagcccaaacagggacgctgaccgcgaattggtcctttggcaaccagcgtcactcgataggaaccgatgacgacaaaacgtctacaaccggtagcttggagctgaaaatcagccctcacgagtacatcgagaccatcaaaacccctcacaaaaaagtccaatga

SEQ ID NO: 21255 - DNA, 654 bp, A.fumigatus
tcatatttccacgcggcgctaataattaataaatgcttgagctccacgaacttgaacccctacttcattttctgcctgaagccgaacgaccggcgcattgcaaatcagtttgatagcaaatgcgtacgagcacaggtacagatgttcggcattgctgaaattagtcaacggctacggaacgcggactttagcgttttccttccattcgctgagtttcttggtctggcggaaattggcaacatcgtcgttggcagtgacaaagagaaagcggaagtcgtccttgatgagaagcgttggccaggcaatgaggctacagtcggcagcactggtgtgttcttgagcgagagatgctgggccgatctagcaaaagtcggagagcgcgttgttcctgtgtatgctgctgatatgtccgatgatagaggtgatggtttgctccacccccgtagcactggctacggggactccaaagtccgactgctcaacccagcagatcagtcccctggagcgttcatctatggtgaccaagctaaacacggttacttcggcagccgtgatctcgatggacgctctgatgccggtaactctgcgttcaactccggggatatgtttccaaaccatgaaacgcgggaacagatgctcgagaaagggaaatga

SEQ ID NO: 21256 - DNA, 189 bp, A.fumigatus
atcggcccagcatctctcgctcaagaacacaccagtgctgccgactgtagcctcattgcctggccaacgcttctcatcaaggacgacttccgctttctctttgtcactgccaacgacgatgttgccaatttccgccagaccaagaaactcagcgaatggaaggaaaacgctaaagtccgcgttccgtag

SEQ ID NO: 21257 - DNA, 522 bp, A.fumigatus
  unsure (13): Identity of nucleotide sequences at the above locations are unknown.
tccttccagccgnctggtgaagacagcttcctgcatgttctcgatacaccacacagcagaaaacacctgcgaggaggatgtgaactagaggccgtgctcgcgccatttactgactccctttcggactcgattcataatggacgattgaaatcgtctgccaaagccatttccgcaatgcttaaaacatggccagggttgataatccttgcaagacatgaagccaaaccccttcaatccctcctagaatcgcttcactacccagatccacaggcaagagatctcattatggaactactctttgatgccctcagaattaaaccaccttcttggtcatcctcctttctcgctggccgccgactcaccacatatggcagagttgctaacctcagatccgagtccgacgcaaaaccagttcgcgcattttacgacagcaatgatgatagatttgatttgacggcgcatttttcgacattgattctcgcgacgctgattgatgccggactttcccaggtatgcttctcg

SEQ ID NO: 21258 - DNA, 513 bp, A.fumigatus
ggacgaaagcaaggcttcaggtgctactggagagggaagaatcactgtcatgggcagcattgtgtgggcgactgtggagtcgatgtattactgagcaggctcgtggacgtctttgacgaagttctcgcgcatactgcggcatcgtcgaacacgagcaatgagggggaagatgggcttcggataacctggaaggactttaagggccaggagccaacgcataactgtgcaaacattggtcccgatgtattgaggggagtgtacaacttggtgaagcagggacgattcgactgcgatgcgacggagatcatatacgagagagctctcgaagactgctctggagatgttgaccaatcaagtgcactatttgagcgattgaaagattccatccggaatgagttggactgtcaagtctgttactcgctaatcacagacccattgaccacaccctgtggccacacgttctgccgcggctgcgtcttcacccacggaggctggcaggatccgcgcttacga

SEQ ID NO: 21259 - DNA, 573 bp, A.fumigatus
ctctcagcaagtttagatgataggagaccgagtgcgaaagacggagataccaacaatagtcatcgtgataagaaaccatcgacaaaagccaagcctatgaaacttgatctgcacttcacaccagctcatccccaagaaactacgacttcgaaagcagaatctcccgcccagactgctcctacgcgctatgttgcagctcccgtttctgccgtcgggtcaaggccaaatactcctatgacgggtgtctcccgggcttcggactcctcggctcctcgacagccgcgggttcttcgcgtggttgacaccccaaagaccgagacaccacctcccgcttccacctctcagtctagcgcttctctcccgacaactctgaagacacgttcaagacggccaagtatttcttcgctcagtcgacccgatactcccggtgatttgggctctgaagcggatctgtacacgtctgcgtctgcttctcgtgccaattcgcctcccgcttcctctaggattggctctgcacctgtgcgctctatcagtaagagtcaaggtcttcgcgccggggcgagatcagcgtac

SEQ ID NO: 21260 - DNA, 429 bp, A.fumigatus
ggggtatatgctgaccactgcctcaattggaccaacagtttgttaatcgttctggcggtggtttcgaccatcagctggtttattcggtatcgctttctgaacatgtacagtcgattacctcccgagccccaacggaaggaaccgcaggttgatctcttccccgatgtacaagaaggagattcgaagccagggctggccaattacctggacgaattcctcagcgctatcaaagtttttgggtacttggaacggcccgtcttccacgaattgacccggacaatgcaaaccaggaagctgatcgcaggcgaaacgcttatgttggaggaagaaaagggattctgtctagtagtcgacgggttggtccagatctttgtcaagtccatgcgagcacggaaagtcttcaccccagcggccaaggaccgagctagc

SEQ ID NO: 21261 - DNA, 498 bp, A.fumigatus
agatacgatgattctgtgcattcacatggccgaccacaccctcaggagtcggccagacacaaggcacataccccgaagcgcacatcgaaaactaaccaagctaacgtgacaagtctgatgtcgtacgacgttgatgctatatacaactcccgcgacatcttttacgtagccactgcggtgccgatatccactaccattgccatggtcttcctctacaggatgctcgggtggccatccttattcggcgtcttgacgctgtgctgtttgactccgcttccggctctggcatcgcgcagggtctcacgcatccaacagtcagtgatgagggcaactgatatccgtcttgcccggatttcagagtacttaaattctatccgaaccctcaagttcttcggatgggagccagctgctgtggcctcgatcaatgagatcagacacgtggagcaacgacgtctctggaggcgcagtgtctttgcggccgccatttctatggcaggt

SEQ ID NO: 21262 - DNA, 555 bp, A.fumigatus
gtcctgggtgtctcggcagaaccaacaatatgggcccctgcgtcggagctgatcgggcgacggtggccgatcacggtaggaatgatcggatatagtatcttcacgatggggactgcgacagcaaaagacacgcagaccctgttcatcacccggttctttggtgggctgttcgccgccggtccctttaccatagaaccggatgcctttgccgacatgtacaacgacagccagagaggaatagcgattgccatgtttgcaatggccgtctttgtcggccccttcgcatcccccttcaccggcggcttcataacaatgagttacctgggttggcgatggaccatgtacatttccgccatcatggggttctttggtgtcgtcctcctgatcttcttctacaaggagacatacgctccggtggtgctgatggagaaagcagcaatgctgaggccccagacacacgactggcggatccatgcaaagcaggacgaggtggagcttgacaagctctgcatggactcttcaccacaggggccgaaagatccgcgcaagcgccct

SEQ ID NO: 21263 - DNA, 792 bp, A.fumigatus
tggaatttcagggggcccccacattttataacgttgatggggaaaccattaacagaggtggttatcttccgtttcagaacctattacaccaacagttatttgaacagcgttatcccccaagaatttgccatgatctctggcaacgcgtcggcccattcgcaagctgaggctgatcatccttacaatggtctcgagtgtttctgcgagggttctagcgaacgcgaatcggatatcgccaaatttcccaccagcacctgcgaccagcacctgcagctcaaccttctctttccccagtgcttcaaccctgacgaccattccgagtacgactttgcagacgagtccaatacctgtcccgaggggatgttgcagatgccgcagcttcgctaccgcgtgcagtatgataccaagtctgtggccccagatggatggagcgggcctgcgccatttcagctctcatgcagtgatactcccggtgatgggtactgcttccacgcggactttatcaatggctggtttgaggacgccgcggagaatatgctcatcaatggtggtggaggctacgaagatggtcagtttatctcgggagagcatggcacttcggcggttaaggcgacttgcacgcctactgatcaggacccggataacggcaccagcgactattataccagtctggagatgatggacgatggcgccgctgcgggggatgcggtggcttcggatgctactgttgccactggggatgctacgtctacctctgtgggtcttcaccacgacgcggcaggatccagatag

SEQ ID NO: 21264 - DNA, 546 bp, A.fumigatus
taccccctgaccgcgtctccttgcagcccggccggtgtaaaacaggccatggtaaaggttgcagttttgctaacagaacggtatgggagagttctacgacgagggcgcaaggaccgcatcaagctcttgttcggaagtctcgctgacgttgggagacgtaatgtcagcacgtctccagacacggaggatgtatgtagggagacagatgatactgtcaaaccgcatgtgacaggctttgaggtcgatgcgcctgccaacgatgactacggggatgaggatgaggatgaggatgatgatgatctcgccctggcggccttggaatcgttggatgctattgacgtgttcaagcacgactctcgtgtcgataagaaggtctatgaagctcgtatatccgtcgctacattacgtcgtcttctgatgctctttcttgtcattgcacctctgaagactttggagcccgtgactttgtatacctcggacctcaacgaggctcgaatggagagtattcgaaaagaggccgataccattctggctgccttcagtact

SEQ ID NO: 21265 - DNA, 309 bp, A.fumigatus
tgtagcgacggatatacgagcttcatagaccttcttatcgacacgagagtcgtgcttgaacacgtcaatagcatccaacgattccaaggccgccagggcgagatcatcatcatcctcatcctcatcctcatccccgtagtcatcgttggcaggcgcatcgacctcaaagcctgtcacatgcggtttgacagtatcatctgtctccctacatacatcctccgtgtctggagacgtgctgacattacgtctcccaacgtcagcgagacttccgaacaagagcttgatgcggtccttgcgccctcgtcgtag

SEQ ID NO: 21266 - DNA, 228 bp, A.fumigatus
ttccactctaatattgtgctgcagtggtacaccaagcaagaacagaacaaccgagtcaatatatggttcagcttcaacggctggggccagatttttggcggcttactaccatacggcatcgcagttggtactgcgaataatggttcggccatcgaaccatggaagattgtgttcctatttacggggctgctcacaatggccttgggtgtgatcttcttgtgggtcgta

SEQ ID NO: 21267 - DNA, 588 bp, A.fumigatus
  unsure (36),(42),(55),(72),(73),(79),(90),(118),(365): Identity of nucleotide sequences at the above locations are unknown.
gcgatccttcgcgcttgtcccgtcactattgaagancgaagnacagggccaccanactttaagattggaaannttagcncggaggacacnccttggtgtccggtctgcctctcttcanccatctcaaaacgctggaatatccggccgttgccactcaaacaagtaattcgccatcatagccttcaaaatctgtctcttgccatcgacgaacttgtaagcgacccgcgtacagtttcaacaatgcccttcctggagatgaccccggtggcgcggaacggccagctcccactgtcgtacctcgagaaagaaatgctgctcaaccacctcatatctggcggctcgccggccggaaacatgaaccccgnctgcaattatttttttttattcaacgccgaaaccccggcacacgcgtctcacagggtcacagcatatgtagaagtgtctcgcaccacatactccgttattgagggcacgctctaccggcaacaggccccacgatctgtcaatgtcccccccgtggtccaaaccggtaacccctgctcatacgtccacggcagaattaccctctcatttgattctaccacacaa

SEQ ID NO: 21268 - DNA, 288 bp, A.fumigatus
  unsure (148): Identity of nucleotide sequences at the above locations are unknown.
aggcttttctcaaccagaccactttcggactccagacaccactcgtctcttttacgatacaaagcagtcgagatgtcgggccctgtggatacagcaaaatcgatcacgaaaaagcgcaagagaaagcacgggggaggtgctcgtgcancaactgaaacagatgatgcgatcactcggcctgccattgaaaatggagctgtgaacgattcccctgagaaagaggaggatactaagaagagtgagaagaatggaaaggataaatccgctaagaagcgcaaggtcagccac

SEQ ID NO: 21269 - DNA, 225 bp, A.fumigatus
gctcggttggcacaacatggagagagattattgcaagcatctggaagatttgttgtaagttatccagtctctttgacatggatccgtatcagcgctgacttttatagtccccatcatccactgtcctcgtcaacgggcacacacacctttctctcattttcgtataagaagcagaagggggtctatatgaccatgtattataatccccgggtgtacagcacctaa

SEQ ID NO: 21270 - DNA, 471 bp, A.fumigatus
  unsure (366),(462): Identity of nucleotide sequences at the above locations are unknown.
aagccgcggcccagtgatgtgatcctcgcaatggcattgcgcacatcggccgacaacgcagaggatgtggcagctggcttccggatgctgcgcgatcctctgcccgaacatgccacggagatcaccagtctcattgccgacctctactccatcagcacatccttgactagcctggatgacctcaccaagaatcgtcactatcggcgtaatgtggctatcgccaaagaagacctggatctggtacagaccagcttgaagtatacactcgaggacattgtggatttcttcggcgacattgaagtgcaaaaagggtcgaaccgcgaggtctacaaacggacctggcttggcctgactgcgttcttccanaaggagtctcatgagccgcttcccactcgtctggccaagtacaaggcgtttctccgggaattggaagatttgatcaaggggtacgttcagcttgtnttcgtctag

SEQ ID NO: 21271 - DNA, 876 bp, A.fumigatus
  unsure (47),(213),(247): Identity of nucleotide sequences at the above locations are unknown.
gccagacccgcaatggggtttcaagcgaaccctttactgcaaaaatncagaactgggatgaataagggaggttttccaagacccaagggtgcggaaggagactttttcaccctggcatggaaagaattctttcgaggttccccatcaagtctggaaattggggccaaattccgcgtggacgtgtacgaatgggattttggtgacaaggccgantacctaggcggtgccaacatcaacctcgaaatgntggagcctttccacagccaggaggttacgttgacactcgacggcaagtcgggagccatccggctgaacctgcttttcaagtcaaactatgtcatgcggtcccgtcaaggatcctccacattctctggtactttcgcaacacccggcaagatcgttggcgcccccgtcaaaggagtcggctttgtcggcggtaacgtcatcaagggtgcatctttcctgaagcatggtatcatgtcgcggttcaagggggatgattcgtcgagtgatgagatcccggaggagccagaagaagtctcgaagacggagacaacccagacaccatcggccatcctggtcgacggtgcgacaccaccaagctcgactcccaactcattacagcacgcacgaacccgaagcgtggtgtcgcactttggtgaccgattgggcattggtggcagtgctggcaagggagagaccggcacggcgacgatcaccgtggtgtctgccagcaactaccctccatcatccaacgtccgagtcataatcaaggcgctcggtcctaagggtgccaaggaggtactcaagaccaaggccatcaaggccagtggcggtcttcaccaccgggggcgaaggctacgcgctaagcgtaac

SEQ ID NO: 21272 - DNA, 504 bp, A.fumigatus
cgacttcagtttgaacgaggtactatctcgtatatgcttacatccacactcaccaaacccacgacgatgaacccgaccgtttcctgccgaagacgcgttaatttcctagagaacatcgatatcgcaccctttccggcccccaaggctcgcatcgtgacccttgaacctgttaccagacgctcaaaacccaagggcaaggccaagtcagtagaatctgatgcggctgctgatgtccagtctcgggagccgtctctcaatggtagtggagcggttggagataatcgcccgccccttagtccggcccccagtaatgtcagctcgtcgagtcggctcagcaacagcagccaaagctttcaactggccagtgaccctagttcgtctgctggcactggggtacgcaatggcagcattaccccttcgatcgcggataagactatcacggcgaaaaccgaacttttcacgggctggtgtcttcaccacgaggcggcgaaggatccgcactag

SEQ ID NO: 21273 - DNA, 702 bp, A.fumigatus
  unsure (22),(38),(656): Identity of nucleotide sequences at the above locations are unknown.
ttggccagtttggtaatctccnttgagaacctgattgntgggcaaccagacacggacttgagcaatgtcaccggacaaatgttcaacaatcgagtgtatgagatgtcgattgcgaagccagggcagccggtcagcgcctgtaaagtgccagaaagtttaacggaggctattgaaaactctatccaagcgcatcctgacatttatgctgtcgaagggttgacggggcgcctcacgtatagggagtttggaaggatgacggagcatatctcccagcgtcttttgcagcacatccagcccgggagcgtggcctgtatgattagcgatggctctcttctttggcttctggccatggttgcgataatcagagccggtgctatctactgtccagtagatgagaaactgcctcgcgatagaaaagactacatggttcgaaatagcagagcagcattgatcctctacgccaattccagtcaggaaccgttgtgcaatggggttccgtctctaaacatggagtctattatgcaggaaatatcttcatcttccggctcaccgattgcaaccagtcgcaatcgtcccagcggtgatactgttgcatgcttggtctatacttcaggaagtacgggcttgcctaaaggtatgcttaactttaaacatgntacgctgttttcacacacgggcgcaggaagcatcagcgcggtgcat

SEQ ID NO: 21274 - DNA, 204 bp, A.fumigatus
tatttccacccagcgattacctctcagcctccacttttgtggattcctcgtgataaactcggggtgagcaaacaggaggtcaagcatacagcacgagttattcccatcacggacgaggatgcttggctggacgataagaacaagatccactgggacgttgacaagggcgttcctcccatttttgaggagaaaatttactactaa

SEQ ID NO: 21275 - DNA, 387 bp, A.fumigatus
gatatctcgcaaatccgggttaagaacctcgaatccaaaacctacatcgataagacccaaaacgctactacgcacactgagaactcgcctgcattggagatcgacaaggagacagatcgtgtgtacagagcattggaccctaaggttcccatcatcgtggcatctgccgctgacgacaagcctattttctctgttacacgcgagggattgaatgatgtcgttgtctggaacccgtggatcgaaaaggcaaagggcatggccgatttttccccggatgatgcatacaagaaaatgatttgcatcgaggctggttccgttgctagctggcagactttggaggctggcgagtcctgggagggaagccagtcaatccgcccgagactgtag

SEQ ID NO: 21276 - DNA, 600 bp, A.fumigatus
ggagtttccgggttcctagatcagtacgcacgttacgacgactttgaaaattttatgagattgtatgcaaccagtaggacagacgtcaacttcactgtggtctcgataaatgacggtctcaatctgcaggactcgtccctgagcagtaccgaagccagcctagacgtccagtatgcctattctttggcgtataaagcgcttggaacctactatacaacgggtggccgaggaccggttgtgcctgaggaaggtcaggatacgaacgtgtcgaccaatgagccttacttagatcaacttcattatcttcttgatcttccagatgaagagcttcccgccgttctttcaacctcgtatggtgaagatgagcaaagcgtccctgaatcatactcaaatgcaacatgcaatctgttcgcgcagcttggcgcacgcggcgtgtcgatcatcttcagcagcggtgactcaggcgttggttcaacatgcataactaacgatggaaccaagacaactcgattcttgcctgtcttcccagcgtcctgcccatttgttactgctgtcggcggtactcacgtagtcttcgccaagggtggaagatccgcgtcc

SEQ ID NO: 21277 - DNA, 474 bp, A.fumigatus
  unsure (44),(59): Identity of nucleotide sequences at the above locations are unknown.
gcgcggtggaagtataaccaaattttttcaagacgttcgatttnttggggtttgtcttntttgcccctgttgcaatccaaactcctgtgggcactggaatacggaggtattgaatatgcatggaacagcgccaccgtcatcggcttgttctgcggtgcgggtgcaacgttccttgtttttacggcatgggagcaccgcatggggaaggatgccatgattccattccatgtgattcgcaaccgaatcgtctcctgcagctgtgtggtgattatgtttttgttcgggatgacaatcactgcgtcgtactatttaccgatatacttccaggcagtaagagacaagtcggcgctggttagtggtgttgatttgttgccgggtgtgctgtgccagattgtcatggctctggtctcaggggctctcagtatgtcatctgttccttctgtggttattcatgctaatgttgtcttgccatag

SEQ ID NO: 21278 - DNA, 204 bp, A.fumigatus
gcagagagtgttgttcaccacatggttaagcgtgctgtggaaatggaggggactgtaactggggagcatggagtgggaatggtgaagagggactatctggagcatgaagtcgggaagacaacagtcgatactatgcgcagagtatgttacaaccttcacaatgtcttcgcgtcatccttcgccttctactattctatctactaa

SEQ ID NO: 21279 - DNA, 183 bp, A.fumigatus
tacatgctggtactagtcacatatgagcgtgctgggtcctatgaggggcttgtcatgtctagcggacagtcagtgaatgcctgctgcctgcctgattgttgcctcgtcgaccttgccattttcgccgcgtttaacgtcacctactttctttcttcaccacgcgggcgaggatccacgcatggt

SEQ ID NO: 21280 - DNA, 195 bp, A.fumigatus
tcaaaaatggccgagaaaaggtccgatgtagatatagacgcccatcccgtccatgaacgacgcgatgatgccttggattatttggatgaacatgccaatgtccaggatgaggcgacggtcgatcttgcagccctccgacgcaagatcgactatcgcatgtcttcaccacggggctggaaggaaacgcagtgcgtg

SEQ ID NO: 21281 - DNA, 228 bp, A.fumigatus
  unsure (70),(91),(177): Identity of nucleotide sequences at the above locations are unknown.
ggtgacaagctcaactcggacgaaccggccttgctcaggacaaagcatgggatgagaaaatggttgaganaccagaaacagagcatcgcanaaagtgatcactcccgcgatgcaaactcgcaggccatggatgcggatgctgctggtgagaccttggccgagggcattgaaggtgancaagaaagagtcattccccgattactacgacctcatgtctggtgttcctga

SEQ ID NO: 21282 - DNA, 276 bp, A.fumigatus
  unsure (3),(24),(110),(220),(244): Identity of nucleotide sequences at the above locations are unknown.
ganaccagaaacagagcatcgcanaaagtgatcactcccgcgatgcaaactcgcaggccatggatgcggatgctgctggtgagaccttggccgagggcattgaaggtgancaagaaagagtcattccccgattactacgacctcatgtctggtgttcctgatctccccgaacaattgctgtggaaggaagatgccgattggcatgttcttgatgcctccnaagaagttccgaggtatttgcccnagggggctttttgtttcatcccggattacaac

SEQ ID NO: 21283 - DNA, 564 bp, A.fumigatus
caaagtactgtgcggcgtcgagaaagccctatctcccaagaggagacacaaatagctgtggagctcatctttgcggttatcaatgaactatattcattgtcatctgcatggaacatcaggagaacacttctgaacgcggccaagtcgtatattttacgccctggaagcccaagtctagagacgatccgctctctcttacaggagtctatgattgatgctaatatctcggatgcatcaatcgcatcctatctcaccaagctccgcgagaatgtcctgccgacgaaagaggagctggagtcctggcctcagccgcccagtagcgtggaaaaggagcgtatgagggaaattgcgagaaaaacacttgtccttaaggggctaccacaggcacttacaagtgtcatgggggctgctgctagtcgcgaatcactcgagagggtgtttgattgcctacaggttgagatgattgcgcgcggttttgtttattccattcttttgcacgctctgagagctctgtcttacaccgaccgggctggaaggacacgagctcgtcgtaattcgtggggc

SEQ ID NO: 21284 - DNA, 504 bp, A.fumigatus
  unsure (291),(306): Identity of nucleotide sequences at the above locations are unknown.
tttcgggcggatggttgggaggaatcgttaatggacagcccgaacagattcctacaaaatggaccccggggtcctggtccccgttccgtttattctggatactcggtcaatcgcagcgaccacacgctgttggtcggcgagttcttccgcgaatctccaaagaaccccatcgttctggtgaagtacccgtggaacaccaacagtggcaagctcaagaccaacgacaagagcatcgtcaccgccacatttgcacactgtgcggatttcttgcgcatgcagggcggcttctcntacgacaacactttntacatctcacgcagcaatggacggtcacccaaagccggagatatgttcaagtggaagcctggcaaaccagcggaattgcggaatcgatggttcatggcgggaaatgaggatctgagctacaacaaggtgcgcaaggagtattatactgtgagcgagtatgatggggagcgattcattctggcctataacaagatgtag

SEQ ID NO: 21285 - DNA, 444 bp, A.fumigatus
aagacgaccgtcgaccacatgaagggtctcggtgcggatgtgatcttcgccgttgacgtcggttctattgacgacaacacacctcaggtctacggagactccctctccggattttggtccgtctttaaccgctggaacccgttctcctcgtgcccctatccacccacgctatccgaaatccaggcacgcctggcctacgtctcgtctattgacaacctggaacgcgccaagaatatcccgggctgtctgtacatgcgtccccctatagatggatacagcacgctggagtttggcaagtttgatgagatctaccaggtcggatatgcctttggcaagcaattcctggagaagctgaagtccgaagggtccctccccttgtcagaggagaccgaggagaataagaagctgctacgtacactcgctccccgccgagccagtatatga

SEQ ID NO: 21286 - DNA, 189 bp, A.fumigatus
tttctgttgagatattcacatgaaatgaagaaggtacagagcaagcttgacagcgtcgtatgggtacgaggactcctatcgtttgaagaccatgaaagcttgccgatcacgatggccttcctctcagagttcatccgagtcgccggcatgctaccctttgctgcccttcgcccgtactgccctcaatga

SEQ ID NO: 21287 - DNA, 219 bp, A.fumigatus
gtttacagccatttcaacggcctctccaacacactcagccccccaaagagggctgtcacgcctgtaaatacaatcagccctccatatccgctgccgtacccgtaccccgcgctccacttctcccccgccatcaaggcctcacttaacggcccactaagtacattcccgatcccccgtcccgaacacaagaacccaaacacaatgcccggatccgcatag

SEQ ID NO: 21288 - DNA, 324 bp, A.fumigatus
gcgtcgagtctgaatatcgctgtgcaggacgggccggaggcggggcagagtgtggcgcatgtgcatgcgcacatcatcccgcggaaacgggcggacctggaccatcggggtgggatggatgcggtgtatgatttgttggatggggaggagggggatctgaggcgggcgtttgaggaggggaaggagggggaaaggcggccgagggcgaagttccctgctgttgataatgaggggcggtcgccgaggagtatggaggagatggaggctgaggcagagatgttggcgagggagatggagaggatggagagggaggttgtggggtga

SEQ ID NO: 21289 - DNA, 399 bp, A.fumigatus
  unsure (5),(6),(8),(17),(135),(153),(356),(362): Identity of nucleotide sequences at the above locations are unknown.
ttcgnntntgaccttcnaactgggaggccggtgagaccaagtaggtggcattcgacgagaactccccagggtgcttgggcgcccgcaaagggcgacgagctgcccaaggaccagtttggtgggtactcttgcacntggggtgagttcgacttngacagcaaaatcaaccacggctggtctggctgggacgtgtccgccattcaggccgagaatgcccaccatgaggtccagggtatgaagatctgcaatcacgccggcgagctttgctccatcatctcccacggtctttccaaggtcattgacgcctacactgctgatctggccggtgtcgatggcattggtggcaaggtcgtccntggccntacccgtttggtcgtcaacctcgactacaaggagtag

SEQ ID NO: 21290 - DNA, 816 bp, A.fumigatus
  unsure (409): Identity of nucleotide sequences at the above locations are unknown.
ctgtgtctgttaaccgcacttgaacgggaaagaaaccaatcctccaagatgggcttgcgactgcgacctccaaagcagagccaaagggtactccccgtgaagcctcccaagggacatttcttctttgcgggccgagagttcgctcgcctgccctggtggaagcgacgaaacatgcgcaccctctacattttcatcgtcatcctgattctcaccaatacggcaaatggcttcgatggctcgatgatgaacggactccagacgctgtcctattggcagaattacttcaatcatccccgcggctccatcctcggtctcttcaatgcctctatgagtctcgggtccttgataggtctctttatcgtcccatacctgatcgactgggcaggtcgaaagatcgggttggccatanggtgcgtgatcatgctgctcgcggtcgctctgcagtccggtgccacaaatttcggcatgtttgtcgcggctcggattattctccgttttggagattgtatcgttctgggaaatgcgcctctcttgattggtgagattggtcctccccaggatcgggctatcctcctcaccctccgcggaaccccgtatcactcccggggcattcatacccaactgggttaccccttggttaccctcccaatcaaagttaattttccggaattgtttgcctccctgggatcccattggctatgccaaattggtcttaaaaacaaatggttcttgggaattgcccactttcttgcaacccctcttcccccgtattctttattgccggcctctggtggaatccccaaaaatccccttggc

SEQ ID NO: 21291 - DNA, 210 bp, A.fumigatus
tttgtccatttgtgtagtggtggcgttcacatctaccaaaacttcctaggatacttgcaggctctcggctataagcattggattaagatctttactagtaaacaaacaaagattcacgcaaacataggactctctggccatttcatatcacgccattcagaagctagcgctgggaactcaattctaaggttcatggctaggtacatatag

SEQ ID NO: 21292 - DNA, 210 bp, A.fumigatus
tcatccgctgtcatagaacgtttattttgttgcttttctgcatatttccttcacttaccctctttcttcccctctttattcatctttttttcctccctttttattttcttacatcctctttttattcccttcatttatgtttctctgtatttcctccaacctgcttcttactccattccccttccatttcttacctatctttttttcttc

SEQ ID NO: 21293 - DNA, 408 bp, A.fumigatus
  unsure (339): Identity of nucleotide sequences at the above locations are unknown.
aagatgtggaggtcattacggctactgttgatatcgaagaagtccgtcacccagtatgttcttacacttgtttctggtactgatgaccggcaggttcggacctatcgcgctagctctagccgtaacatgcaggctaccaaacaacctccgtttgttcggcttgatctcgacgtacggctttcccgtctggacgatgatgccgagcccggccttgtcccgtcggaaccgatctcagcaaagtaccacgctccagaagaagagatttccctcggcccagcttgttggctttgggattatctgcgaaaaaacggcgctgctggctttttccttcccccttancgggaggtattgacagctgcgctacagcttattatcgtacactctatgttgcgagaaattgtcaaggca

SEQ ID NO: 21294 - DNA, 204 bp, A.fumigatus
ctggtaaatcccattacatggtatggcgacacaatcactttctcacataacgatccaggcgtcgagattatctcaaattcgtcaggaagccatcatgagctgaagaagcttgacactcgcgtgaatctgattacccaggcgactaagctggtaagcatattgctcgtttgccttctggtttcgcgaactgatacactggtatag

SEQ ID NO: 21295 - DNA, 207 bp, A.fumigatus
agcggaggcatctacctctatgccaaccagcagggttgcgatggtgataggctctactatgatggctgtgcaatgattgtcatcaacgggaatattgtcgcccagggttcccaattctccttgaaagatgtggaggtcattacggctactgttgatatcgaagaagtccgtcacccagtatgttcttacacttgtttctggtactga

SEQ ID NO: 21296 - DNA, 279 bp, A.fumigatus
cgtcctattcttttctcccataggcttcagaatctcagccccgacgaaagtttagtctacaatgtcatccactcgacaggacgcaacggcatctgggtccgtgcgatccagagtcggaccaacttacacaaatctattctagaccgttgcctcaaatctctggaagggaagagttacatcaagagtgtccacaatgtcaagtttccgagtcggaagatgtatatgctggccggcctcgctccgagtgaggccggtcttcaccacggggctggaagatat

SEQ ID NO: 21297 - DNA, 558 bp, A.fumigatus
  unsure (44): Identity of nucleotide sequences at the above locations are unknown.
gcgcgtgtccttccagccccgtgggtgaagacgatcttcataangaagaaagagtcgcacgactcgggtttctcagatcgtggtcccgctcagttttcctctcccgatcatactcccacccagcttcagcactccccatcgactcccaggatgtcgacgttaggaaaggcctcgagcgccatggtctatggtatcgtccagtatgacttccaagcagagcgaccggatgaactcgacgcgaaagcaggggaagcgatcattgtcatcgcccagtccaacccggagtggttcgtcgcaaagcccatcggtcgtctaggtggccccgggttgatccccgtctcattcatcgaacttcgggacatgcaaaccggtcaagcggtatccgatcctttggaggcagtcaagcgcgctggtgtaccaagggttgaagaatggaagaaaatgaccgccgaatacaagaacagcagcatcaccctcggcaagattgactcggccgcgtcagcagtgcagtccgtgacctctggagttgagaagatgtccatggggcgcaacagcgcc

SEQ ID NO: 21298 - DNA, 195 bp, A.fumigatus
gcaggaaagtcttattcgtggacttctgcagtcaacatcctccttttgatcttctggcagtccctgttcgatcataaggaactagcttgtgccccctatttcttcacctctttgcgagttttgttccttacggctctgtgtctgacaatcgtggttggaagattattgggtgagtcttcttgttcctatatctag

SEQ ID NO: 21299 - DNA, 480 bp, A.fumigatus
aatcaaaaatggcaagcattgcattcccagagatcgccaagctcaacttcccatacatacaactatgtctaccacgcagcaactgcgtcacaagcaaccatccttctcctgcacgggttcccgtcttcctgctatgactggcgtcaccagatccatcacttcatcaatctaagatatggagtcctggcaccagatctactggggtacggcggcacctccaaacccaccgcggtagaggagtacaagctcaagagtatggcgagggagatcatagaattactggagcatgaaggtttaagacagattcatgccgtggcgcacgacactggatgtaatcttctttcaaggctcgcagattattacccggaccgtctgctgtcatgcacgttcatcgctgtaccctactctaagccgggggagcattttgacttggacatggtaaacaagttcacaaaacagttgttgggatttgagaaatgt

SEQ ID NO: 21300 - DNA, 294 bp, A.fumigatus
  unsure (182): Identity of nucleotide sequences at the above locations are unknown.
agagacgaatcaaacacacaaacacgcgatgaaattgtcaaccgagtcggtcgaaaagcttggattcacgtggcagagttgtcgaaacgagaggaggtcaagagtatcattccagcagtcacaagccaaggactgaagcccgagattctcttcaactgtgctggcattcaaaggagacaccntagtgagaagtttcctgacgaggattgggacgaggtgtgtcaggccatcccctggttcttaattcttcagaagctgattgcggctacgaatttccttaggttattgaagtaa

SEQ ID NO: 21301 - DNA, 495 bp, A.fumigatus
  unsure (450),(487),(488): Identity of nucleotide sequences at the above locations are unknown.
gttattgaagtaaacttgacctcggtgtttaccctgtgccgcgaatttggagcctacctactggctcgggatgcgtccgactttccttccggccgccgtggttccatcatcaacgttgcatcgcttctttcgttccagggtggcatcaccgttccggcatatgcagcttcgaaaggcggcattgcacaattaaccaaggccctgtccaacgagtgggccagcaagggtatcaatgtgaacgccattgcccctgggtacattgacacggacatgaacgttgccctgatcaatgatgccaatcggaacgctggcatcatggctagaatcccagccggccgatgggggaagccggatgattttaagggtgttattgtgttcttggcgagtgaagcaagcaactatgtttcaggggaagtggtctctgtcgatggaggttggatggaccaggtnttacacgacagggattggctggaaatgcgcttcggcnncgcctag

SEQ ID NO: 21302 - DNA, 582 bp, A.fumigatus
ttagtcgactgctgtaccttcgtggtgaagacagaacttcaggcactatgtgagagctgtggcttgacgctttctacggcgtttagtacggcttggggacttacgctccgctcgttttgcggttccaacgaagtctgcttcagctacatggcttctttgcgggatgtctcggttgatgaaattggttcggttgtcggaccggtcattaatcttctggcttgtcgaatgaaggtcacagaggatgtctgtcttgaagacgtcctgcatcaagtgcaaaacgattacatggaaagtctgccttacagacacacttccctcatcgatatacagcatgccctgaaactctcagacaccattttgctcaactcaggcatctcctaccggaaacttcccccgaagaccctcagcaacagggatgagatgcgacttgtggaggtgggaaaaatccatgatcccgcggaattcccggtgtatgtcaacatcgaggccacggatgatgttgcatacatcgacctcaactactggacgacctctctgtctgaaggccaggcacagaatgttgccagcacctttttacagtcc

SEQ ID NO: 21303 - DNA, 204 bp, A.fumigatus
catggactcggaccaccggaagaaaaaaccgccctgaatcgcaccgtcggccagggccgtgtgagcaagacccagctggcgacagccgtccgcaagcatttcaacagcgctgcgctggcggagcaggaagctatcgctcgctttctatacaaggtccgagaagagggcagggggcgacagttccggttaaggttccagccttag

SEQ ID NO: 21304 - DNA, 582 bp, A.fumigatus
attcccctcggtgaaaacatccatgtcaaggccaacattaccgtctccgacggtacgtacattggcttcatcatcttgatgttcatcggtgccctgcttgctctctgcctctgcaacgctagcgacattatccgacccgacggcagccgcgtcatcttgatgaagcatcctagctggcaatcggagctgctgggcctttgggaaacccttcgatttgagccattcgtggttctgcttttccccatgttcttctcctcgaactggttctacgtctaccagcagaactccgttaatggtgctcacttcggtacccgcaccaaggctcttaacagtcttctgtacttcctcgctcagatccttgcggctgtcatctggggatacctgctcgatatcaagagggttcgccgttccgtccgagcgaagattacctgggtcgttctcttcgtcctcacctttgccatctggggcggtggatacgcctatgagaagacctacacccgcgaaagcgtcaatcccaagctcaacccagattttgtcccaactgactgggtcttcgccggaaggtacgaggagcgatcatgc

SEQ ID NO: 21305 - DNA, 192 bp, A.fumigatus
  unsure (181): Identity of nucleotide sequences at the above locations are unknown.
gacaggacatcagagctagctccatggtgcagagatggccacgaggactcacttgttagcagtatgaccgtaaatgcgtataatatggccggagacgtcatgaaggagtacgccaacgcaaagtgctggacgaaggaaaccatgccgagcactaatgctgcaagtaccaggcgcgcccctntttactactag

SEQ ID NO: 21306 - DNA, 558 bp, A.fumigatus
acgcgtttcttcatcccggcgtgcagacttatcggcacatgtccggaattcgacgccctcgacacagaaaaggccattgaggccgcctctgctgcttttcccaagttccgcacaacccttgcgcgcgagcgtgcccgcatgttgcgacgatggtaccaattgatgatggacaacgctgaagacctagcaacattgattacatgggagaacgggaagcccctagctgatgccaagggcgaggtgaattacgcagccagcttcttcgaatggttcagtgaggaagcacctcggatttacggcgacacaatccccgcctcagttcccggcaaccgagtcatgacgttgaagcaacccgttggcgtctgcggcttgataacgccgtggaatttccccgctgctatgatcacaagaaaggttggaccggctctggcggcgggttgcacggttgtctgcaagactcctggcgaaacacctttcacagcgaacgccattgcggagctggctcatcgtgctggtattcccaaaggagttgtcaacatggtgacttcactcaaaaac

SEQ ID NO: 21307 - DNA, 231 bp, A.fumigatus
agtcaccatgttgacaactcctttgggaataccagcacgatgagccagctccgcaatggcgttcgctgtgaaaggtgtttcgccaggagtcttgcagacaaccgtgcaacccgccgccagagccggtccaacctttcttgtgatcatagcagcggggaaattccacggcgttatcaagccgcagacgccaacgggttgcttcaacgtcatgactcggttgccgggaactga

SEQ ID NO: 21308 - DNA, 516 bp, A.fumigatus
  unsure (73),(180),(516): Identity of nucleotide sequences at the above locations are unknown.
gacagcaacctggggcaccgtcacggtgtaagacgagtaggtgatggtggtgcagggggcggagggggcgganggagcgggagtgacggccgcaccaccggtcagcgtggcagtggcagtggcagcaccggtaggagcggtgactgcatcgacgccggtgggggtgacggtggggaccanggtgatggtggtcgggatgccggtcacgatgccggggttctggggtacgtaggcagcgcagataccagtgaagtaggacagagcggcctggacctccgcctgcgaggctccccaggactgcacacaagcgatgaccttgtcagtgaactcggaggatgggcagaagcagctggcgtcactgttggagtcgcacttggggagcaggctgagccaggtgttgatacacttgggcacaacgttggggcacggggccgaagggacagacgaaggagtggtggtcacggatggcacgtcgctggtctcgctggcggtgacaggggactggcctgtgggaan

SEQ ID NO: 21309 - DNA, 558 bp, A.fumigatus
  unsure (1),(337),(444): Identity of nucleotide sequences at the above locations are unknown.
nttcccacaggccagtcccctgtcaccgccagcgagaccagcgacgtgccatccgtgaccaccactccttcgtctgtcccttcggccccgtgccccaacgttgtgcccaagtgtatcaacacctggctcagcctgctccccaagtgcgactccaacagtgacgccagctgcttctgcccatcctccgagttcactgacaaggtcatcgcttgtgtgcagtcctggggagcctcgcaggcggaggtccaggccgctctgtcctacttcactggtatctgcgctgcctacgtaccccagaaccccggcatcgtgaccggcatcccgaccaccatcaccntggtccccaccgtcacccccaccggcgtcgatgcagtcaccgctcctaccggtgctgccactgccactgccacgctgaccggtggtgcggccgtcactcccgctccntccgccccctccgccccctgcaccaccatcacctactcgtcttacaccgtgacggtgccccaggttgctgtcttacaccgacggggctgccaggacacgcgcttaatggggaag

SEQ ID NO: 21310 - DNA, 360 bp, A.fumigatus
  unsure (140),(247): Identity of nucleotide sequences at the above locations are unknown.
caaggtcatcgcttgtgtgcagtcctggggagcctcgcaggcggaggtccaggccgctctgtcctacttcactggtatctgcgctgcctacgtaccccagaaccccggcatcgtgaccggcatcccgaccaccatcaccntggtccccaccgtcacccccaccggcgtcgatgcagtcaccgctcctaccggtgctgccactgccactgccacgctgaccggtggtgcggccgtcactcccgctccntccgccccctccgccccctgcaccaccatcacctactcgtcttacaccgtgacggtgccccaggttgctgtcttacaccgacggggctgccaggacacgcgcttaatggggaa

SEQ ID NO: 21311 - DNA, 522 bp, A.fumigatus
tatggcgagattgtcgatatacgcttcccatctctcaagtacaacacccatcgacgattctgttacgtgcagttcaaatcctctggggatgcccataacgcgaccaggctcaatggcacccgggttggaagcgacctcagcctggtagtcaagatctccgatccgacgcgtagagaggaccgtcatggacctgtttacgaagggcgggagattcacatctccaacattgactggaaagccaatgaggatgatctcaaggaagtgtttcaaaagtacggcactatcgagacggtgcggattccaagaaaggtcgatggtggcagtaaagggtttggctatattgtcttctccactaaggtatgtcttgtggccatccggctactgagttttatgactgatctctcgcataggaggaggcagaaaccgcccttgctatgcatgaacaggaattccgctcgcggccgctacaggtacgaatctcgaccccccaaggtgccaaacgaactgcaaccactatcgtga

SEQ ID NO: 21312 - DNA, 837 bp, A.fumigatus
  unsure (54),(745): Identity of nucleotide sequences at the above locations are unknown.
gcgattagaagcgagatattgtccagtcccggtcgtgtaagactactcgccacncggaggaaaagcgaacctcctactcatcacaaactcaacgaagaggctctaaacacatgggtctaccccactaatttggggaagacaagagattaccaattcaacatcgcacagcgaggtcttttccataatctgctggttgcgcttcctactggtcttggaaaaacgttcatcgctgcgaccattatgctcaattggtatcgatggacaaagagtgctcaaatcatcttcgtagcaccgacaaagcccctggtagctcagcagatttctgcttgctttcaggtggccggcatcccgcgatcagagacgaccatgctgacaggtgaagctgcaccaggcattcgcgcggaggaatggaaaagcaaacgtgttttcttcatgacccctcaaaccctcgtcaatgatctcaagtcaggaatagccgacccgaaacgtatcgtcctgctcgttgttgacgaagctcatcgtgctactggcggctatgcatacgtggaagtggtcaagttcctcaagcggtattacaagagcttccgggtcctcgcccttactgcaactccaggttccactgtggaatcggtgcaagccatcattgatgacctgggtattgccaaggtggagattcgtcacgagcagtctcttgacatacgggagtatgtacatgctcccgaacaccgaagtgcaaacgttccanaaattccgacgaaaatggtgctgtgcatgggaacttttcaacaaggaccctgccccccgcttgttcgaacaacttcccgtaaccttaaacgc

SEQ ID NO: 21313 - DNA, 552 bp, A.fumigatus
atatatgcgctacttgctctttgctgcggtgtttcgtcgtccttggaattttcccccctgtgccttctcccagtgccactgacccagtatcaggggttggcagtatttttcttaatctctcgcagttcgattcccatccccgaaaatatcggatcgaagttgagtcccgcgaattacaaagataccatctcacaatctgataaagcgcacaatgacgcgccaccaaaaccgccggtgaaggagacaccgggaagcgcgaatactgcgccagttggccgagtgaatgcgacattcgtcacgctggctcgcaattccgatgtctgggatattgcgaaatcgatccggcaggtcgaggatcgcttcaaccgtaattaccattatgattgggtctttctcaacgacaagccatttgacgacacttttaagaaggtcaccacatccctggtgtctggaaaaacattctatggtgaaattccaaaggaacactggtcgtaccccgattggattgatcaagaaaaaggtcttcaccacggggctggaaggaaccgcgct

SEQ ID NO: 21314 - DNA, 531 bp, A.fumigatus
tatggcctgtttggcgtgacgtgggccattgcgggtgctcttggccccattatcggaggtgcctttacgactgctgtgacctggcggtggtgtttctacctgaactgtacgtataatctcgttgacctgtggcggaatcaagctgatttgctcagtacctgtcggtggcgtctcgttcgcaatcctcgtcttcttcctcaagctcgaatccggtggcacgccgctgttcgaaggcctccgagctatcgattggtccggcactgttctcatcatcggaggcacactcatgttcctcttcgggctggagttcggcggtatcaactacccctgggcctcggccacagtcatctgcctgatcatcttcggcgtagtggtctgggtcctagcgatgctgaacgagtggaaactcgccaagtatcctctgattcccgtgcgacttttcaaaaactggcacaatcgtctcgtccttatcgtctgcttccgccaggccttgttttcaccatcggcggatggaccgatcaacgattaaag

SEQ ID NO: 21315 - DNA, 426 bp, A.fumigatus
actgtacgtataatctcgttgacctgtggcggaatcaagctgatttgctcagtacctgtcggtggcgtctcgttcgcaatcctcgtcttcttcctcaagctcgaatccggtggcacgccgctgttcgaaggcctccgagctatcgattggtccggcactgttctcatcatcggaggcacactcatgttcctcttcgggctggagttcggcggtatcaactacccctgggcctcggccacagtcatctgcctgatcatcttcggcgtagtggtctgggtcctagcgatgctgaacgagtggaaactcgccaagtatcctctgattcccgtgcgacttttcaaaaactggcacaatcgtctcgtccttatcgtctgcttccgccaggccttgttttcaccatcggcggatggaccgatcaacgattaa

SEQ ID NO: 21316 - DNA, 744 bp, A.fumigatus
  unsure (96),(154),(204): Identity of nucleotide sequences at the above locations are unknown.
ggcggagtacttctccaagtttcagtaagaattgggcccaaccatggcttaccttttttaagcagccaacagaatttcagtatgtcatccccggangacctgaccgagaaagcgcgcagtgtctttgaggcagccaaattccgcccttgccaantaggccagacatgtcccgccatccagccaaaccgccccgcgccacgcccntacggccaattcaacatcaagcagaaaggagacccacgaaagtggttccgagtcgaactccaccggaagtccgaattgttttggaccgcccccaacatcccagcctgtactcctgacgcagaagatccgcattacatgcttgccaaggacgccagactgccggagaactcgccgcgagagctccttgaccggatgaaccccaccgattaccctgtcaagatcccaaccccgaacctgtacgctgaggcgctggccatgctgtactaccgcgatggggtgccggggccgaccatccggggagactactggttggatctgcagagtgagcttgtccagacggggctagtgacgctggatgagctccctgcgcgcatcaagcggcactatgagctggtgcgtgatgcggacatgaaggaggtgcacaggtacagcgaggaggttgcggggcagatgagggagagattcgaggttcctgtgcgtatgctgccgcttgatagggatgtgtttgagccgggggcagcggcggaggagtttctttga

SEQ ID NO: 21317 - DNA, 276 bp, A.fumigatus
gcctgctttttttgtcaatacagttcgcttactctcgcaatgtcggataccaaacaacctgttggagtgcagacttcttctgcggttcctgacgccgtcacgtctccatacttcgagcctcctaagtacaacgacccagttactgtcaacaagaatactggggaggatgactctggttctgaagccgttgcagatcgtatcgatacgcagaagaagggattttgggcgtacttgtcttctaccacaggggggcgcaggcaccgcgctaagagtatc

SEQ ID NO: 21318 - DNA, 291 bp, A.fumigatus
  unsure (13): Identity of nucleotide sequences at the above locations are unknown.
cccctccacgtcntacatctgccctcgacatgtctatccccaacgaagctctccagaaggtacgagttggctgcaggcgtatttctccacaattttgcctccctaacactggttttacagttgcttcaagagattgaagctcgagcgatcagctcgcagcagcagatcggcgtcaccaaggcgcaaatcaccgcaaagcagaagaatgtccgcctgctcgaattgacatcaaaagaaattggatcgttatctaaagacacaaaggtctacgagggagttgggaaaatgtga

SEQ ID NO: 21319 - DNA, 969 bp, A.fumigatus
  unsure (100),(938),(939),(940),(941),(942),(943),(944),(945),(946),(947),(948),(949),(950),(951),(952),(953),(954),(955),(956),(957),(958),(959),(960),(961),(962): Identity of nucleotide sequences at the above locations are unknown.
tctgaattacccccgtatttttggaagccgtcgtggcctttttcaggttacttcacgtacaaagaccgggcgtttcgcaagccgaagaggtccggctccntacaagacccatctcccgatgccagcgagatagaggccgaaatcgttcatgctgctgggtcgctggagcaacctttgggtgtttacaaactgaactctatgcttgactcaatgttcaatagtattgggagtacttgcgctcgattccaagctatcactattgtaactagcatactgctcgttggccttctaagtctgggttggctccggttcgctgtcgagacagatcctgtacgcctctgggtgagccctacatcgccggcagcacaagaaaaggagtattttgatgccaattttggacccttttaccgagcggagcaagtatttgttgtcaacgaacatggtccggtgctgacctatgacaccctcagctggtggtttgatgttgaatctcaaattcgtcgaatgatctctccgggtcgcggcttactacttgacgacgtctgctttaaacccactggcgacgcgtgtgtggttcagtcgttaacgggctatttcgggggctcaggatggaacctccacccggacacatgggaagagcggattaagcactgtgccaactctcctggtgaccccagctgtctccctgactttcaacagcctcttaaacctgaaatgatactgggtggttacgaaaagtccggcaacgtcctccacgcgcaagcgttgattaccacgtgggttctgaacaatcacgcccaaggtacggagggtgaggccgatgctattgactgggagaacaatctcaaacagttgttatacaacgttcaagaagatgcgaaagaacgtggtcttcgtgtgtcattcatcactgaagtcagcctggagcagggtcttcnnnnnnnnnnnnnnnnnnnnnnnnngggcaca

SEQ ID NO: 21320 - DNA, 837 bp, A.fumigatus
  unsure (61),(166),(302),(443),(829),(837): Identity of nucleotide sequences at the above locations are unknown.
gggaagggaaccttggttggtagacctggaacgctcaaacttaagtcaattcccatcctgnttgaccttcgatgcggggggggatcaatttcacgacccaaatttgttctggagcgtggactgatttctggtcgcgcagataccaaagagagaccctttaaatgtntgaaatgccggaggacattcgttcgtcgagatcttctcttccgccatgatcgtactgttcacgccaaagatggggggatacctcttgttgctgagggacggcgtcgtggaggcgcaggtgttcagaagtcctcccntgcacctgctccatccaaaccctcgatcacaattgatcctactacattagaacagcttgaggcaagcagtgacggtatggtcgaccttgaagccgcagccatgttgatgacagatttccaacataaggccgcagccgccgntactggtcaggtccacgatcgtgccgaatccgaccgctctttttcgcccggtcggggatcgttaatggaaccttcctccgcatatctgtcgggcaacgcgactcttcctcaaatgccctgggatacattggtttctcctgccgacatgaagcaccatatgatgaaccctacattcgtcagccaaggcaatgcatcggacttgcgtcagctgccaaacgtactggatcgaggcgacactctggcgccttcgctccactcccttgtcagctcgcttccgatgtccggaaattccacacctaacgcgctctcaccgttcccctcaatgacaggccctgtcagtcccgtaaacgtcttcaccacggggctcgaaggaaacgcgctacccnccgggaan

SEQ ID NO: 21321 - DNA, 423 bp, A.fumigatus
  unsure (158),(292): Identity of nucleotide sequences at the above locations are unknown.
ttgacaacgactttcacggcccccgccagttgcgttactgctacggggaactatctgattggacttaacacgacagttcctgtctgggaatatgcggtgcagtgctccacgctgggatacaccggctgcatccccacggggaccgcatccctcccgantactctcaatgacaacccgaatacaattgcgactcaggtatatttctcccctggtctgtactgccctgctggatgggctacgaggggtgtcgcggtccgcgatgccaacaatggcctcagcgcatcgggcatcntaagtgcccgtcccactcccactcccacagtttcgatcccaactgcggccccccagtgggaaaacccggcgacgctgttgatgggtctcttggacccgagtgagactcttgtgatgtgttgcccagagtaa

SEQ ID NO: 21322 - DNA, 213 bp, A.fumigatus
cagcctaaccattttacagacgatgacgatgatgaccacgacaacctcgaacccatctccgaagcaaacatcatttcgggaggtcgtcggacacgaggcaagaccatcgacttccaggaggctgccgagaagctgaaggccgaggatgagatggacgatgaggacgacgacgatgaggaattccaacctaacgacgaggacatgcgcgattga

SEQ ID NO: 21323 - DNA, 486 bp, A.fumigatus
  unsure (407),(415): Identity of nucleotide sequences at the above locations are unknown.
attcatagcgcggattcgtcgaccccctgtggtcgaatacacaaaggcattcggaccactgcggcggactacatcaccaaggaataccatcgcaacaatgtgacgatccagacagacaccaccgttgaccgcgtcgtgctggaacagggtcctgatgggcttcgagccaccagcgtcatcacccagctggcagatgggacaccgcgcacatttcacgcgcgaaaggaaatcatcgtctcgggcggcgcatactgcagtccggccatcctcatgcgctcgggaatcggcgctcgcgcggaattggatcagcacggcatcccctgccaagtcgatctccccggcgtgggtaagaacctcctggaccacctcgtaagtcccagcccatttccccccccccccccccattntttttgtntttttttatccctctatatccctttcctccttatcctttctctttctttttcgactcctcacaccttctag

SEQ ID NO: 21324 - DNA, 240 bp, A.fumigatus
  unsure (57),(65): Identity of nucleotide sequences at the above locations are unknown.
gaacctcctggaccacctcgtaagtcccagcccatttccccccccccccccccattntttttgtntttttttatccctctatatccctttcctccttatcctttctctttctttttcgactcctcacaccttctagggtccacttaccctatctctctgctctctcccgctaccttgtctttctctcccctttcccttcttttctctctgttcccatctctaccttcccgtcgttctccc

SEQ ID NO: 21325 - DNA, 183 bp, A.fumigatus
cgacggtcaaagagacgcgctgccacgcgggaaatgcttgagtcagatctgtatgcccaacaggctacatacaatgccaatggtgaatcgaggatccgttggacgcccactacacttagatcggatccccttgcttgctctttgaggttcgccgcagcaatcaagttgtcagcaagacgctca

SEQ ID NO: 21326 - DNA, 366 bp, A.fumigatus
ctttgttgctgtccatatcaaccagacatgggttatccacggcaccgtatgtttccattgaccagagagaatgctgtgtctaatgtcgacgtccagggcaactttctgacatggcaccgttacttcacctgggcctatgagcaagccctccgcaacgaatgcggttacacgggctaccagccatactgggcctggaacaagtatgccgatgacccgcgcaactctcccatatttgatggctcggattacagtatgtccggcgacggatcatacattccgcacgacggttccgaggctgctcccggtattgtcctaactcctggaaacggaggtggctgtgtcttctccggcccgttcaaaaagtaa

SEQ ID NO: 21327 - DNA, 192 bp, A.fumigatus
cgctggatgtgcaggggctctctctcgaaacgcgaacgcaaagagtacaccgacgcagtgctgtgtctcgcttctaagccttcgaaactggatccggcatttgctcctggcgcgcgctctcgctacgatgactttgttgctgtccatatcaaccagacatgggttatccacggcaccgtatgtttccattga

SEQ ID NO: 21328 - DNA, 900 bp, A.fumigatus
  unsure (278),(868),(890),(892): Identity of nucleotide sequences at the above locations are unknown.
agggacagaaacaacccccaaagggagctgtttcagacagtttctttgagaacctggataagaatctcgggattaatggttaaccacggctttcggactggggcagaagcattaaacatccattacaacctatggggattctttggtgatcggtttctcaccagtaacgtcgacgtagaagaagataaaaaacttaaatcaattggcaatcgatatcgcgcttttcagaccagaaacgggttacggattgtggcctttggagtcactgtcaatgaccntatcctcagggatctaaaccataccgaggttcacaatgcgagctggatatttgaacaggaatggtttgcggaagccatgaagaaagaggctgacatctacgtgattgttggtcatatccctacctacgcttcctgcctggatcctacaaaggataatcctatggtgtgtctgcgcgataggatcaggaattccacagataagcccatccagctcttcgggggccacgcccatcatcgaaacttcacgtgttatgacgacagatcctcgggtattgattctggcaagtattgcgataccgtgggatgggtggccttgaacaacgtgttgtcgcctacgtggtctggtacgaaggagctgctgggtgacgatctccatccgaacaaatcctgcgccgtaggaagacaaggagatacacacgacgccccttatcttctagatcgccgatacctggactggaaccgtgtaacatttgcgtaccatacggtaaacctggaaggaaacaccgacaacccgtccgtgccagcatcctttgatatgcccctgggccgcaaggtcaccgatgctatcagcaaagcccgatctacacgcnggggctggaaggtaccgcgctncncaaaaatt

SEQ ID NO: 21329 - DNA, 621 bp, A.fumigatus
atggccgtcagacccggggtgctgagcattccgctggagacctggggtcccgcggattatttttcaggcaacagcaaagaaccacaaagagacgccgagaagcttcccccattgccgcgggacacaatcggctgcgctgcaccggacgatactggcatctggagcatgacagtccactttggctgggtctggagcaaagtgcgcacttatgtgtccgactgcgcaaacaatcgagtacgcgagccctggcgtcacgagtcaatgtattcgatggtcctttccgacctgaccgaaatcgagaaccaaacgccactctgccatcgatacgaccatgtacgattctacgatcgacagccggacgaactgatcgtcaaccgcgcgtactggatcccctggctcaaactgcagttcatgtaccatgccatcctcaccgtcctcaaccatcccttcctgtatatcatggcctcgcggcataaccccaacctggccattccgaatagtttctggcgccgctcgtcggaactggtccttctacatgcgacgtggatcgtgcgtatgattgatatgctatcagacaaggacggttttcaccacggggggcggccatccgcgctaagtaag

SEQ ID NO: 21330 - DNA, 288 bp, A.fumigatus
  unsure (255),(256),(257),(258),(259),(260),(261),(262),(263),(264),(265),(266),(267),(268),(269),(270),(271),(272),(273),(274),(275),(276),(277),(278),(279): Identity of nucleotide sequences at the above locations are unknown.
tcgccaacaggggcaagcactcgatcaccgttcccgatgtccctgccggcgagtacctgctccgtcctgagatcatcgccctgcacgagggtaaccgccagggtggcgcccaattctacatggagtgtgtccaggtcaaggtcacctctgccggcaccaagaccctccctgccggtgtttccattcccggtgcctacaaggccaccgacccaggtgttctcttcgacatgtacaactccttcaccagcgtcttcnnnnnnnnnnnnnnnnnnnnnnnnngggcgttat

SEQ ID NO: 21331 - DNA, 900 bp, A.fumigatus
  unsure (157),(182),(868),(869),(870),(871),(872),(873),(874),(875),(876),(877),(878),(879),(880),(881),(882),(883),(884),(885),(886),(887),(888),(889),(890),(891),(892): Identity of nucleotide sequences at the above locations are unknown.
atgctatggtcaccactccgtacttcggcctcttacccaccgttgttatttagccttcttcccccgtttcttcatgttctcttcaacgcctggattgttcagcatccatttctccatcggttttcattccttctcctctctcagtttgtcatgcatntcagtcattccttacaattcaagcngtctttcaaaatgaagtcgaccttcggattgctcgctctggcagcagcagctaagctcgtcagcgcccacgcgactgtccacgccgtctggatcaacgacgtggaccagggtgcgggaaactccgctgacggatacattcgttctccccccaacaacagccccatcaccgatgtcacctcgaccgacatgacttgcaacgtcaacggcaagaaccccgttgctaagaccctctccgtcaaggccggcgacaaggttaccttcgagtggcaccacgacactcgctctgactccgacgacatcatcgcttcctcccacatgggtcccgtgatggtctacatggctcccaccgagaagggaacagctggcaacggctgggtcaagatcgctgaggagggctactcgaacggcaaatgggcggttgcaaacctgatcgccaacaggggcaagcactcgatcaccgttcccgatgtccctgccggcgagtacctgctccgtcctgagatcatcgccctgcacgagggtaaccgccagggtggcgcccaattctacatggagtgtgtccaggtcaaggtcacctctgccggcaccaagaccctccctgccggtgtttccattcccggtgcctacaaggccaccgacccaggtgttctcttcgacatgtacaactccttcaccagcgtcttcnnnnnnnnnnnnnnnnnnnnnnnnngggcgtta

SEQ ID NO: 21332 - DNA, 183 bp, A.fumigatus
  unsure (165): Identity of nucleotide sequences at the above locations are unknown.
ttctccgagtttaacagtatattctgctttgaagaagttctgacgacccagccagtgcattgcctaggatgtagacatgtcttacactgttggtgcatcgaaaagtggttcatgcgctttcacaatacctgtcctgtatgtcatagaactatttgttcagatganacagtcgacattgtttga

SEQ ID NO: 21333 - DNA, 210 bp, A.fumigatus
gattcgcggattgacctcttcccttatccctgtatacgtcgggtacatttgatccacgtcgactccgcagtccgcactatttacaacggaccttcccctcccttccatttcacctttggtttgcagcacgccattgcatctgtcgatgggttgagaatttcaggaatgatatcattgtcggacgggtcaaaacactatatcctcgagtag

SEQ ID NO: 21334 - DNA, 465 bp, A.fumigatus
cggtatgtgctcacacaatttcgacaacaaggcagtgaaggactagaggaatatgctaacgcaagcttagactatgcctctcacgatggaaccgctatccgtgactacatccacattctcgatctcgccgacggccacctcaaggccctcaactacctgcgtgccaacaaccccggcgtccgcgcctggaacttgggtaccggcaagggcagcaccgtctatgagatgattcgcgccttctccgctgccgttggccgcgaccttccttatgaggttgccccccgtcgtgctggtgacgttttcaacctcacctccaaccctactcgcgccaacaaagagcttggctggaaggcccagcgtaccctcgagcaggcctgcgaggacctctggcgctggaccaagaacaacccccaggggtaccgtcaacagcgtctcacagcgggggcgaggctcaacgcatggtat

SEQ ID NO: 21335 - DNA, 291 bp, A.fumigatus
tcataccaacactcatttccagacaagcaactcttccgactcgatcaatcaatcatcacaatgtatcaacctcttcttctcctccctctcctcctcacctcggcctttgccaccccccatgatcccaccacgcaccatgctctcgagaagcgcgcctccttccccatcccctcctccaagggcatcgtgacctactcctcccccaagaacatcagcggcaccttcgactgcggtctgaaaaactaccgccgtggcgtcaaatgcaccggccacaaaagaaagctgttataa

SEQ ID NO: 21336 - DNA, 189 bp, A.fumigatus
tgctggatggcaaattacaaactcgccttccccaacatcacatccctcacaagcttcaatgcctcctccgcaaagacaaccatgttccgctcccgatcagtgccgcaccccgtttccacctcgcgagtgaacgtcccctgcggagttgacaccgctaacgcaacgtaccctctgccagtcgaccattag

SEQ ID NO: 21337 - DNA, 201 bp, A.fumigatus
aaccagctttacacactggaatcgcgcatcgccttcgccggctggacccagtcgcatatcgacagctaccaaggtcccacgccagatatcgtcgccgggctcgcgcagcacgtccgcaataccctgcagccgacgtataccgttgccgagagcgggacagcggggccgacgggtggtgcgacgcggaatcggactccgtga

SEQ ID NO: 21338 - DNA, 204 bp, A.fumigatus
  unsure (13),(14),(15): Identity of nucleotide sequences at the above locations are unknown.
gccggacatgttnnngacatgctctttcaaggcgttgtgaagatctttctgcaggtccgttctgtccatccccctgacaatatcacactccacactcctactgttgcaaccgatgcgacggatgctagctctcaagcggttgctcacttactcactctgactttcctgtccatcatatcatgcgacatcactgtcctcaaatga

SEQ ID NO: 21339 - DNA, 558 bp, A.fumigatus
acctgtccagcagagtgcgattacacttgtcgacatgtagtaacagatcgccgacttgcccgcgaccctcccatgttgaatccggtggtacaatttcatggaaagtggccttttcgcaggatcctcggcatgcaggagccattctctgtcctgttatccctcatcaatattatcgctcactggaatggcatcggtcggatcaaagaaacagtcccagcatggcattccctacggccatactatctgacttttggttactgcgggctggcgtgctggacattcagcatgttattccacacaagggatttccctctcacagaaaagttagactatttcggagctggtgctaacgtgatgtacgggctataccttgctataatcaggatactgcgccttgaccaaggaaaacctcggtacaagccgactctacgccgtctaacgaccacaatctgcgttcttctgtacaccatgcacgtttgctatatcagtttttggtcatgggagtacacctatagtcttctaccacgaggagacaggcatccgcgcaaaggaggggag

SEQ ID NO: 21340 - DNA, 210 bp, A.fumigatus
accccgtcaatgcagataccaggaccttcccgcagacgccgcctacacctggatctgggtgcagcccagaacaatgagtccgttctaatatcgagtaagtatcccactcgacgaaagtctgcggtgtctacttacgtagttattgcccgtgcagcacgcagcattcgcattgcagctaccgctgacaagactggtgcctgggcgcgttag

SEQ ID NO: 21341 - DNA, 222 bp, A.fumigatus
  unsure (54),(186),(202): Identity of nucleotide sequences at the above locations are unknown.
gaccctggccaggtcctgcgccctcacgtcgagcaccgacacaatgtcaagtcncaagcgaagaaagggcatgatctcggaatgatgggcgtgctgatccatgtcttgggcgatgcagcgaacaatctcgggggttatattgctgcgttggtggtctggaaggcaaatatgaggggagatactacnccgaatctgctgtcancatggcgaatgcgatcgtga

SEQ ID NO: 21342 - DNA, 288 bp, A.fumigatus
tcttgtgggcttcattgtcgcgctggtggcgctcaaggtagcagagctccttcatgtcttaccgtggagagtaagctaaagagccagatctcccaacgcagcaaacatcctaaagagctttctttcggctggcagcgcgcacaactcttgggcgcctttttcaacggcgtcttcctcctgtctctgggaatcagcatctttcttcaatccatcgatcgctttgtgtccctagagcgtacggtataccgtcctggtggcggcaatgttactgacacatgcaggaattga

SEQ ID NO: 21343 - DNA, 261 bp, A.fumigatus
ccttcattactagtctcgtgtgtacaaatctatatcacaggcaagtcaaccgcctcccccgtctccaaggccctcctcactccctcacaaaccatcaacgctcgtaacccatcttcgccagaacacctcggcggctccctcccggcaatcacctccacaaagtgcgccagctgcaaatcaaacggcgcagccttctggtcaacctcaaatctctccacggccaactgctccgtccaactcttctccgcccgcccatcgtaa

SEQ ID NO: 21344 - DNA, 636 bp, A.fumigatus
  unsure (1),(43),(103),(306): Identity of nucleotide sequences at the above locations are unknown.
ntattaagccggaggcttatttcgggcggccggacggaatggngtttgtcaattccttccgggggcgtgatccccattaacttggtccatgacatggatacgntgcagtacttgtttggcccgatcacccgcgtccatgcggagaggacgccacggcagcgagccaacccgccgcacgaagtcgaagaaggcgcagccctgatcctgcgcttcgcgtcgggtgttgtcggcacattcatcgtttgtgatgccaccccttcgccgcataactttgagatgggcacgggggagaacccgcttatcctnggtccacccggggcaagcgagggcggtggtggagcggacttctaccggatctttggctccgaagcgtgtctaagtgtgccggatatgacgcggtggagttacgatgggcgggcggagaagagttggacggagcagttggccgtggagagatttgaggttgaccagaaggctgcgccgtttgatttgcagctggcgcactttgtggaggtgattgccgggagggagccgccgaggtgttctggcgaagatgggttacgagcgttgatggtttgtgagggagtgaggagggccttggagacgggggaggcggttgacttgcctgtgatatag

SEQ ID NO: 21345 - DNA, 441 bp, A.fumigatus
attccttctaggatcatgcatctcttacaatgtctactttcgaccatttctctcgcctccacagttacagcttttgttctttattcatttaacctcgaggtctcgaccgaagggccccccagcaatgatgtcgcccgccgtttcgtgccatggaaattactgctggacgactcatacaacaatcacgggtcctcttcaaatggtgtctctttaacgttggacctcaaaaaattccctgtccgccgtgataacaaatacaaagttgtcctggccgatgaacctacaacacccaacactgccgctcttaaccaggagggcctcgattactcttactttgctacggtcagggtcggctctcaaggccagcagatgtggttggttctggatacggggggacctaatacttggttctttggctcagactgcacgcctgtttcctga

SEQ ID NO: 21346 - DNA, 231 bp, A.fumigatus
aaggagtcagccaggaggcgagggttcaactcgggtcatcgcttaccctccgggcatgtgaacattttccaggtcgcgattgtgttgtccggcttcgatgacaaggattttgatatcaggattctccgcaagacgggccgcgactacacagccagagggtcctccactgcgaatggtgagttagagcccgcgaggggtatactggctgatgatatacgcacccacagatga

SEQ ID NO: 21347 - DNA, 261 bp, A.fumigatus
accctcgcctcctggctgactccttctagatggtctaataatttcgactcagagactgactggaacttaatcacaaagcccatgcctggggtgcacaatcgccaggtgaagctcagccgtggtcggtttctcggcggttctagtggatgcaatgggccactgtgcatacgaggtgcccaacaggattacgatgactgggaactggaaggctggagtggcgaggagttctttgctgctatgcgaaaggcatcctctggttga

SEQ ID NO: 21348 - DNA, 534 bp, A.fumigatus
actttgtacatttcggcgttgggcacatctcgcgagctggaagccggccagttggccgcggagactgcgaacgagagcaagacgttgttcatcgccaatatctcacacgagctcaagactccgctgaatggcatcttgggcatgtgtacagtgtgtatgagcgaagacgatcttccaaggatcaagaagtcgttgcaggtcgtttacaagtcgggggatcttttactgcatcttttgaacgacttgttgacctttagtaagaaccaaatcgatcaagcaattcggctagaagagcgggaattcagattgtcagacatccggtctcagctggcggtcattttccagaatcacgtgcaggagaaacacatcgacttcaatgtcaactttgtcagcgatgataccctcccgccacaggccgatggcttccacgaaaagacgtccctaccggctgcccccgcgcttgggccaccaggcactggccgattgagggacatggtattatggggtgatcaacatcgcatccttcaggtgttg

SEQ ID NO: 21349 - DNA, 246 bp, A.fumigatus
tggcgcggcttcttgcagccccgtggtgaagactccaggccgatctattcacagctctcatttattctcttcacgctcgctcttgaagcccatacaggcaagaactactcgcagatcctagacgaaaccattgatgagcccttggatctcgtcaactccggtgtatctccgggagctacgcagcgagcggctgtcccacctggtttatcaggctggggtgctgcagtcagcacgtttggcaactag

SEQ ID NO: 21350 - DNA, 192 bp, A.fumigatus
aaaccagttgttcgggagggtccgcctcggccagaacctggatcccccgctaagtccccagtcaaggccggaggtggtagccctaagaagggtttccttgacgaaaaacctcccaggttggagcttgcactggacctaccctccaacaatccagtctcccagaagggggataacctaagcaactggctgtga

SEQ ID NO: 21351 - DNA, 270 bp, A.fumigatus
tcctgccatcgcgtggtgaagacagaggatgacttggttctggccgagttctatgcgccctggtgcggccactgcaaggctctagctcctaaatatgaagaggctgctactgagctcaaggggaaaaatatccccttggtcaaggtcgattgcactgaggaagaggacttgtgcaaagaaaacggcgtcgagggctatcctactctcaagatcttccgcggccctgattccagtaagccctaccagggagctcgccaggctgactcgtaa

SEQ ID NO: 21352 - DNA, 546 bp, A.fumigatus
accacgacccgttctgacatgttgattcaggtgcaaggtcgagtggacatcacacgcacgtttgacggccgcgagctcaacaacgaatatatctttggacttttctccgatccagaccaccttagtctcgtgggcgtccccatcgcatacagcatcacccagttcacagccaatgacgacatcgcttcggccacgacagtcgtcaccttcaactcgacctccttcaacatcatcatccccgtaaccatcgacacctggatcgaatgggacgcgcagaagaagatcttgcagtacgatgccacattccggtggttcgggcctctcctcgacgcgctgctcaaagcgcaagccgcgaggatgaataccaccgaccctgtcgtggtgcaggcagcgcttacgcagctgctggcagacacaatctgccagacacacgaggaccactgcaaaggggagtatcagcagtacgagagtcgggacgcctgcatggatttcgtgccgaacaagagtcttcaccagggagccggaaggatccgcgcattgcgttag

SEQ ID NO: 21353 - DNA, 192 bp, A.fumigatus
cctagttctgcagcagttttgcggggcatgttacaccagttagtactcaggcaaataagcgagaatagtgagattggcggaggagatgttcctacttcaagtaaacagggcactggggatttgtatctcccgcaaatctatgaattcttactatcatctaaactcttgaacgctcattccctgtctcctatc

SEQ ID NO: 21354 - DNA, 231 bp, A.fumigatus
acgctgatctttcagcccggtggtgaagatgcctctgcacctcacctccgcgtgtccgccgcaaagaaccagggcgataggtcctcaacggatactcaaccatcagcgagaattccacccccggagcagtcggcggtcgaagataaattcttctggacctatacggaagagcctcatcggtcgaggcggcaggcgatcatcaaagctcatccagaggtaggtatcctctga

SEQ ID NO: 21355 - DNA, 183 bp, A.fumigatus
gggcaaggtctatcgattcttctgaccaaagaaatgatcaatccgtttctgccgctgatcaaaagtagcactcccgaccccccccttcgtacgccgaagatctgccagatgtgctcgactgtttactccaagtacctgcagcgaatacccacccagaaccggcatttccggaactcctactaa

SEQ ID NO: 21356 - DNA, 693 bp, A.fumigatus
  unsure (580),(627),(629): Identity of nucleotide sequences at the above locations are unknown.
aacgcaatcgcgttccttccagcccggggtgaagacctggacatggcagactatggagacatcgacgcctttgccaggcggtgctgcgacctagaccgcatcgactacgttattctcaatgctgcgatgcagagcagcatatttaaacgtcgtcataaggctggtcacgaattggtatttcaggtcgattacctctccactgccctcctgtgtatgctgcttgcgtccgtgctgaaggaccagtctcgtgtcggagcagtgaccaaaccgcctgttcttaccgttgtgggctcggacaccatgtacctcagcaagttccaagccgcaggacctatttccccccgtatggacgacccaacgggatacgacaggatgagacagtacatggattcgaagctgctgctgatggtatttgttcgccaactggctcggcaagtgaacccggacgatgtcgttataaacgtctgcaacccaggcatggtggccggaactggcctaggaaaaaacgggaagcccaaccccagtttcgccgaaaaggatgtggtccctgtatttgtcaaggcgctcggacggaaggtcnaatctggcgcaagcgtctatgttcatgccctcttggccgaggggcananaagtcatgggagcttcatcagcgactggactatcaaaccctacgcgggggttgatgtatactaa

SEQ ID NO: 21357 - DNA, 321 bp, A.fumigatus
ccggctggacaagattttcctaataatgacaatgacaatcgacgaatgtggagggactacctacctcatacacagtatctgacggacagcgcagaatttcaggcttaccaggctgaccatgatgacttccttgcaagaataggaagctgcctgcaaagtgatggaagatatggtaaggcagagatcatatttcgaaatgccttagaaatacgagaaagagcctgcggactagaccaccctgatactcttgccagtatcagccagcttggttcagtacttgataaccagggcaagtatgaggaggcagaggccatgcactaa

SEQ ID NO: 21358 - DNA, 441 bp, A.fumigatus
  unsure (433): Identity of nucleotide sequences at the above locations are unknown.
tctagtctttttctcacaggtactggtctcttcgtcggttctggaaaggttttgtccaccggtggtccggcatctgtactgattgcctatgccttgatcggctgcatgcttttctgcactgtgcatgcgctgggtgagatggctgtgctgtttcccgtcgctggttctttcgcgcactattcaacccgttttatcgatcctgcttggggtttcgctatgggttggaactatgctctccaatggttgatcgtcttgcccctggaaattgtcgctgcgtctatcacagttgattactgggagtcgaacatctcgaatgctgcttgggtcgccatattctgggctgtcatcgtgtcaattaacctgttcggcgtcaaaggttatggtgaagccgagtttgtgttctcgctcatcaaggtcatcgcggttattggtntcatgtga

SEQ ID NO: 21359 - DNA, 312 bp, A.fumigatus
  unsure (15),(31): Identity of nucleotide sequences at the above locations are unknown.
ccgcatagccggtcntcgtctcttggtaaanattactccttggggtatccagccgcctccgtcgattggttcctccaacaacacactgccttttatatccatctttggaactatttcaatgcattccccgaggaagtcgcacggtatactgaggttgagaaggtcggtggcctagcacgggtgacaagattgcagactcttcttactgacgctctgcacagcacctccgaggtcggagccccttcgcccatcgtgccttggttcactgtctgctctctatgcaaagtcagaccgggttggatgtgccgttag

SEQ ID NO: 21360 - DNA, 312 bp, A.fumigatus
gttgcccgacgcggtcgcggtccttccagccccgtggtgaagacgacccctgaaaaattcgatatgcgggagaaaattgagctgatccaacggtcattccaccctgttgtggaattcgggagagatttcagtgttattctccaaaatatgggtaagtccctataccagcgaggaccaaatacacacgatctaatcggactttatgtcgctgatacacagatgaccgcggctctcctgacaacgaaatggaagagctatcaaagtctcttcttcgggttaaggcatgccttgtacctttccgcggagttctag

SEQ ID NO: 21361 - DNA, 549 bp, A.fumigatus
aataccccatcgagtgacctcaattatcttccgtcttctcggtcccatgctcactgctgtcaggccttgcataaccaggtaacccctgaaaaggctctcaaatcgcagaccaggcggcgtaagaaccgatcgcccctccgtcggttcaaggacttatgtttaaaacacacctgggttctgcctctcctgctgatgagcgtaatcctcctcgcatacgccgttaatcctacgccggccaatcctttccacagcgctatcttcttgtcttacccgcaacctcccaagactcccggcggtccggttatgtacggcaaaggtcccttggactttgcttttgtcggcttctacaccattgtcctgtctttcacacgagagtttctgatgcaatgcgtgattcgcccatgggctggatactgtggcattcggggcagaggcaagactgctagattcatggagcaggtctacacagccatgtactttgcgatctttggacctttcggtctgtatgtgatgaaacagacggatatatggtacttcaacaccacgggg

SEQ ID NO: 21362 - DNA, 540 bp, A.fumigatus
ttcgtaaacacctttccccagcgccatgctctcgtcatcttcggcgaagctcacggccgcgaaacgtgggattcctccgtcgacgtcacccgcacgattggctggttcaccaccctctggcctgtggtcgcacaggtaaacccgtccgacagtctcgagacggttgcacggaccgtgcggcaagctcgacgggcgatggacatgcacgggtggacgcatttcacatcagtataccacaacactcggcagacgaaacgcagcgccggagcgcacttgatggagattaccttcaactacgcgggaaagttccagcaggtcgagcaggacggttctcttttccgcatggagccgatggccaagcaaaatctgttagatggcgcggccgagttgggccgatgggccatgctcgagatcaattcggttatccttaacggcctgttggagtttcatgtcccctataaccgcgggacggatgaggcgaggcctgtgactccgtggttggtaaacgcctcggcacgacagaattggaaggaaacgcgc

SEQ ID NO: 21363 - DNA, 309 bp, A.fumigatus
  unsure (117): Identity of nucleotide sequences at the above locations are unknown.
ataaaggtaccccgggtctgtcatggaacctgtatttccaagtcgaataagaagcagcaccagaattatgctcggaggccatcgccaaagagacacaagccagtcagaatgtctccnccaaggatttctccgtgttcaccaccaccgagaagagagccatcatctgaagggatccctggcggcttcttttcgccgctctcgtccagcatctatttcccggcgctggacactatcgcttcctcgctgcaagtatctatcaccaagatcaatcttaccgtcacaacctatctggtatgcattgtcaaatga

SEQ ID NO: 21364 - DNA, 555 bp, A.fumigatus
cttcttcaaggagcttcacctatgttgattgctggtttctccgacaaagtaggtagacggccggcatacatcatctgcttcaccatctacatcgccgcaaacatcggtctttcgctccaaaacagctacgcagctttgatggtgcttcgctgcatccagagtgccggaagcagtggtactgttgctctatccaatggtctcgtcggcgacatgatcacctccgccgaacggggttcatacattgccgttgcatcaattgggctcatgttgggtccgtctctttcccccatcatcggtggtctgatcagccagtatctggactggcattggatcttctggtttctattaatcctcagctctgtcttctttgccattttgctcctattcctccctgagacatgccgcaaagttgttggtgacggatccgttcccccgccgcctttgaacaacaacgtcagcgatataatccgacatcgtcgtcgcaagcgagctggactcgcagcagaccaagcgtcaattgccggtcttcacgaggggtggaaggtcatccatcga

SEQ ID NO: 21365 - DNA, 222 bp, A.fumigatus
tccatgcgtccctctagctgcatccccttctccgtgggccttgccgttgtggcccatgcagcgtctccgtcaaccctggaggagctctgcaccgtttcatatcttcaaactgtgctgccttcatctaagttcattcagggcatcaccattgactcagactctctcacaaccagtgtggcgaccaacagcactgtcagcagcgttgactaccctacggcgacg

SEQ ID NO: 21366 - DNA, 606 bp, A.fumigatus
ccggtcgcggtccttccagtccctggtgaagacgcctttatatatgtatggaaccgctgccttggtgactacgtgggcccactcgaggaacttattgcgctcatcccgtcgcaggcagaatctctggtcaacggggattcgatagatgagcccaatctacatgcaaatgctgcaaaaatgttcccatatctctcgtttgtgctcaccggccgcatctatccgactggtgaagagatggacgatgctgaggccacgagagccaagacagcattgtacgactacctcttctctgggaaccaatctggcacttcccaagcgataggaaggtttccgagtctgcatgccatgttgaagtttgacgcatctagctttatgagcatgctgaacgaggcgtttgaggatagtttcctcaacgaccaggagcccgatgagatccccgcgcaaggagtctccatcaaccgccaatacctgatcagcattctgttccaggttatgacgcctacttctttcgattcttcagataccatctacctcgacatgttcgttgcgcgcaacctgcccaaataccctcaatatatcctattgtctggcactacacttcatcaa

SEQ ID NO: 21367 - DNA, 492 bp, A.fumigatus
tgtgccgatattcactgcggtcggccatcccgaggtgaagaccttttctcgagtttgccgcctggcgcggaacctcccgttgttgacgaccactcatactacgcagaataccatccccaacctccacagaacgatgatcgtatccattggaccaaacatacccaaagacatcctgtctccagttttattcctctccctacgcctgcgccatcggcgattcctcgtgtccagtacgagttcgcgaaggaatcatggcttggccgaaggaagagagtgaacagacagaaagccgtcaaggaggccttcacgcatgcttggaaagggtacaagcagcatgcctggatgcgcgatgaactttcgcccctcagtgctcggtacagaaccacatttgctggctgggctgccactctggtggacgcacttgacactcttgtcattatgggtatggaaaacgagttcaaggatgcgttgcatgctattgagagcattgat

SEQ ID NO: 21368 - DNA, 228 bp, A.fumigatus
tattctggggctttgttccccgcccctatgaaacatcccttcccggggggtgcgtttttcctatccttccgggcgagcttcctcaatagcctgattagaattttctctacgggcgccgttctcccccgcgaaacacgtggttccactggggccgttttcccccctccaaaaggggttttttataagcggctttcctcccccatgggcattatggggggcgcggtttaa

SEQ ID NO: 21369 - DNA, 279 bp, A.fumigatus
  unsure (144),(193),(231),(238): Identity of nucleotide sequences at the above locations are unknown.
ggatcagtcacatctaatttcttcatcattaatagggagggctggcccatactattctatggagacgtgctaacactgcagtttcacatgtctgaagtctataaattagctccactcttaaaatctctagggctaaaaaactantgtatttctgtttgtgcaaagaagaaaactagcatctcagaaatgcctntagagccctcactagaacttatgactgacttccgtcanaaggcantcggtctgtcaaagtacttttctctgagtcaccgactttga

SEQ ID NO: 21370 - DNA, 567 bp, A.fumigatus
  unsure (468): Identity of nucleotide sequences at the above locations are unknown.
atttggacttcggaaggaagttggcgtcattctaagattttcccggcatttgatgtacttggatttgattcacccaaccaattcgggaggaatcaccgggacgatattcgccctaggttatatagacctgatggaggctcgcatccggaaatctggttggcaagggggaagggagtctttgttacaggagacttcaacattgcgaaaggggaacttgatgcagctgatgcaaccgagcccatcaggaagggagcaatgacagaggacgagtttatctttgccccggcacggcgtgtgttcaaccaaattctttctgacggcagagtaattggtcagcgcgatgaagagagagaaagtcctgtaatatacgatatctgtcgatctattcatcccggcggaaggggaatgtacacttgttgggagcaaagaatcattgctcgacccggcaattatggcgcgagaatagantacgtcctgtgtagcctggatatgcaagattggttcagcgactcgaatattcaagagggcctaatggtaagccccgaggttgcacagactttgttgtag

SEQ ID NO: 21371 - DNA, 486 bp, A.fumigatus
  unsure (74),(77),(80),(131),(143),(176): Identity of nucleotide sequences at the above locations are unknown.
cggtataagcagaccacgacgctgcccatcatggatggccaaaggcagcaaacgtacatacctgccctaccacntcnttntgcgacacaaccatctcagtcccatatgctgtcgctaccaccgccaccacntcgacatctgcntacgcaacctcagggtgtgatgccacctccgcntccgggaccacccccgggcccccctccaggtcctggatatggcgcatcgaagctcgcaaactcccagttgcagcagcagaacaatctcggatggcagcataattgggctaggcaagcgctatctcaagggtttctcccacctcccccgccgcctccaatggtaccgacaaaccaagcatacggccgtcaaacgagtttctcagtccccaatgccgacggtccaattacatctgcgacttatgtcccaggaagtaacactttcggtgccggcgtcgggatgtcttcacaacagcctggaaggatcaggatc

SEQ ID NO: 21372 - DNA, 525 bp, A.fumigatus
acccctgccaggacaatctcaattaaccaaatgggtatgcaggcgaccggcattagcccggaagtccttatctccatcgaggacggggatgtctataccgaagcactcgctgggacccagctctcggaatcacccgaggcgagccttgacccattggacaacaaattacataacgacgccaaggaggttatggagcatgtcattgctatcaaggggtccagccgtcggctgagtccggattgtcttcccgagtcaatcgcttttaaagatttcatgaaagtcatgccccggggaagcgtgcaacatctcttttcccacgtgcgtggacgcctgagagcagactgcgacggctgggatgctcttccgggtctcatcgccaatattaccgtccctgggatgccgggaccgaggaacctcgaggcaattcggtgctttgagcctgagccgcgggatatctattgtggtgcgtgcatcatgctggtcttcactcgggaactgccggaaccggccataaccgtcggcata

SEQ ID NO: 21373 - DNA, 687 bp, A.fumigatus
ccgaaagcgggaggcaatgcagtagctgccaatggcgccgttccctcgttgaacgacgctttgacgcaggcccatggtatgggtgttttgacaggagatccagttgtttcagtccctcattcacttgacgatgtcagttggcgcatcggaggttgtgtggcggtccacttgagtctggtgcatgctgcaaaaaccccggaatgcttaagtcttgcggttgaagcgttgtacgaagctgtacaggacaattggcgaaacagtgaagcaatggaaagggaaaatgggtacgggattcttgcagcgatacttcgtgataaatttgggctggggaatagttcagcgacaagtagggcttctagcatctgctccaatctcgaggaacggtgtgccttgggtcttgaccttcttcgattgactctcaaattcgttggatatgatttcgagcaccctaaccgatcgataattacaaatcccctggcctacagggtcttgcttgtggatctcgacatctggagactaggggattccgctcaactgagtttatactactctcaattctccacattcgctggcgaaagtaactatcgccgatttaatgcaaaacgtctttcttcgcatgcgtatgttcataccctttcctttgccccttctacatcttcaccaccagccggcggatccacgaagaat

SEQ ID NO: 21374 - DNA, 264 bp, A.fumigatus
acggcccctactgagaagtcatacacctccgtcctgcaaatgatccgctcttccgcatacagaccgatccagctattggcatttgaacccatgtgcatgaatctgtgcgtattctcgggcatcttgctcggcatcctatatctcttctttggtgcctttgaactagtcttctcccatgtctatggcttcaatctctggcaaatcggcagttcgtttttggggatccttgtcggaatgatgtcagcaatcctgacggatcccctg

SEQ ID NO: 21375 - DNA, 666 bp, A.fumigatus
  unsure (3),(9),(63),(209),(662): Identity of nucleotide sequences at the above locations are unknown.
atnacgcanaccccatcccccaagagtacagatacaatgatctccatcggcacccatcgcctntatctttccatcagcggcccaccccgccacaatcccccagatcctatcgtagtgttcatcgccggcgcaggcgacgtcgcatcgtcttactgcgccgttcagcggcttgtggcgccattctccccgcttgttctttacgaccgctntggcctcggtcgcagcgaaagtaatcccaacgctcccagcccaactgcgatgtccgcagctgccgagttacacaccctactcaaaactgcaaacatccctccaccgcttatcctggcagctcattcctatggagccatcattgctagggaatacctccattcctactcgagcgatgttgcgggcatggtcctcatggatgcctcaacggaacgaaacatcgagttatttcagaacccggatttggatcttagtgctatgattggaaacctgaaattttctgaggtcacaggtctgcgtgctgccgctcagctctcacgcgaagaatggcgggtgagagcgatagacactgcgcggggagtggctacttctcaggcagaagcgatggtgcgggaggaggtttgtcgtgcgcttgctgaaaaagagcagttcaagaagcaggcgctgggggagtnttaa

SEQ ID NO: 21376 - DNA, 186 bp, A.fumigatus
cgactgcgtcgagttctgattgcaactgtcttctataccttccctcatccgtttttctacgacctacgccctagtttcatggaaatggaagatctggagaagcaccgatcgtccagcttttctccaaacgaggatgcaaacaaatccacaccattactttccgattatgggaataagggcaagccc

SEQ ID NO: 21377 - DNA, 396 bp, A.fumigatus
  unsure (229),(260): Identity of nucleotide sequences at the above locations are unknown.
ctaattgtagatttttcggccgtcgactggtccgcattcgttgatacgattccagcgatgttcgcattgacgttcttcggagttcttcacgtgccaatcaatgttccggcactgggtatatcgactggggaagaaaatctcagtgtcgatcgtgagctcatcgctcatggcgtcactaatgcactgtcaagtttcgcgggaagcatacaggtacggctgaacaatttanagggcatcattcgtttcatatactcatgcanctctaaaactaccttgtattcactaattaaccttccttttcatccccacacggtggggattcccctactgggcaggtatcatgctccccctttggtaacaaaaggttttcctgtttttgggcccggggaaaatttg

SEQ ID NO: 21378 - DNA, 528 bp, A.fumigatus
acgcggtacttccagttccgtggtcgaagtagcgaggacaatccgaaatctgtcctcgccacaactattctcgcattctccgccagttctgtccttacgggacttgtctttttcctgatgggaacgtgcaagcttggttctctcatcgggttcttcccgcgtcatattttgatcggatgcattggcggtgtaggattctttctgatgcagaccggtgttgaggtatctgctcgactatccgggtccctggagcttaacggaccaaccttgcagaagctttttcatatggatacattcctgctttggatgatacccttgtttcttgctattgcttttcttgttctgaagcgctttgtgcggtccaatttccttgtcggtggttatttcgttacggtaggtgtggttttttatatcgtcaaattcggcgcaagagtatctatggataccttgcgtagcagaggatgggtctttgacgctccgtcgtcttccaacccttggtatcacttttatacgctctacggtgggtaa

SEQ ID NO: 21379 - DNA, 540 bp, A.fumigatus
tactcttacctcgaggccgtggtgaagatcaaggctcttaacggatccccgggctacatcaacctactcgatgcccttaacgcctgggctctggtcaaggagctcaagcaggctctcggctaccccgccgcagccagcttcaagcacgtctctcctgcaggtgctgccgtcggtgtccctctgagcgagaaggagcgcaaggtctacatggtcgatgacattgccggtatcgagacttctggacttgcccaggcttatgctcgtgcccgtggagcggaccgcatgtccagtttcggggatctacttgctctcagcgacgtctgtgatgtccccactgccaagattatttcccgcgaggtttccgacggtgtgatcgccgctggttacacccctgaggcgctggagatcctctctaaaaagaagggtggcaaataccttgtcctgcagatggacaagaactacgtccccgcttccgaggagactcgcactatatatggtgttcagctcagccaacaacgcaacgatgttgtcatctcccct

SEQ ID NO: 21380 - DNA, 603 bp, A.fumigatus
  unsure (361): Identity of nucleotide sequences at the above locations are unknown.
attacattaaacgcgttaccttgcagccctgtggtgaagaaaatgtacattctcccggatctttcctcgatggggaatgaaaaaaatacaccacggatgattcatcagttgaatacaatccccccatttctagaccagtcgggtgcccaaagaactgaactggaaaaaaaaaaaaaaaaaaaaaaaaaaaaaaaaaaaaaaaggactaaaatcactgcaataggacaatttgttcaaaagggtatgaaaaaaacaaatcacaaaaggacaaggccagcgccgaaaacggtggacaggagtgtaaccgcaccaacaacaacgggagccatggtcaggctagggacagtcaggccagctgcancgcccttggaaaaggtggaggtgccgctgctgctgcttccattggcaaaaccatatccgggctcagcagtggcagtggacggggtaccacggtcctggctgcaagttccggaaaaacaagggccctgccaaccacccccagtccatttacttcttgggcgggctcgggaatggcagaaaaacctccttggtcaagtcccattgggaaccttcctaccggggcaagggtgggcacaccattct

SEQ ID NO: 21381 - DNA, 294 bp, A.fumigatus
  unsure (191): Identity of nucleotide sequences at the above locations are unknown.
ccaaggaggtttttctgccattcccgagcccgcccaagaagtaaatggactgggggtggttggcagggcccttgtttttccggaacttgcagccaggaccgtggtaccccgtccactgccactgctgagcccggatatggttttgccaatggaagcagcagcagcggcacctccaccttttccaagggcgntgcagctggcctgactgtccctagcctgaccatggctcccgttgttgttggtgcggttacactcctgtccaccgttttcggcgctggccttgtccttttgtga

SEQ ID NO: 21382 - DNA, 537 bp, A.fumigatus
  unsure (82),(144),(147),(181),(184),(508): Identity of nucleotide sequences at the above locations are unknown.
ttccaacgggagacaagacaaacaaccaaaccgacaaacgaatcttcaatccgcacggagtataaaatgacacaatcaatcntcaccaccacccaagacggcatcacaaccatcaccatcaaccgcccccaccgccgcaacgcngtngaccccccaaccgccaaagccttttacaacgccntcntagccttcgacgccgaccccgcccagaaaatctgcatcctcaccggcgccggcgggaccttttgcgccggcgctgacctccacgcggtcgccgcagccgggaccggatcctcaccatccacactaagcacccaggagaacctccagcctgtccctgtcgcgtccggcaaaaatgagcaggtcccatccctaggaccaatgggtcctacccggctacacttatccaaaccccttatcgcagcgatagccggccacgccgtcgcaggcgggctggagctcgcgcagctggctgacctgcgcgtcggcgcggaggatgccgtctgtnttaaacagacggcatggaaggagataatc

SEQ ID NO: 21383 - DNA, 465 bp, A.fumigatus
gtacctccacacaaaacatatatatgcggggagagtgccatagtaacgagatcgattgcgcctgactgtcgactaactacgtctactactatcctatcctatcctatccccgacccggctgacttcatggatttcatttccgagatttcagccccttcgctggcggtcgcctccgccctgaccgtcgcagcaggggcgtatctgaacgcaaaactcgccatttccacggatttgaccacgatatgcaatgatcgagactggacaaaacggctgggtcagcgaattgctgagcttggtgatacagctaccctgtacaagatgctggagagagtcgtggaggtgcaaggacgcggcgacagtgaggcgctctggtttgagaacaagacatggacatatcgtcaattgaaagatcgtgcgtctggcccttactgctacaaacatgtgctttctcctgttcgaaattga

SEQ ID NO: 21384 - DNA, 420 bp, A.fumigatus
gtcttaaggattcaatcaactgctaacttgtcccttctacagacttccgtggacctggtggccgcggcggccgtggtgaccgttatgatgacagacgtggacctcacggtggcggctggcgtcgcggcggcggtggtggtgacgactaccgttatggtcgttatgactcctacagtgatcgtcgtgactatggcggtggtcgcgatggcggccgcgaataccgcgactatcctcgtcgtgagtaccgtgacgactacagctaccgtggtggcattgatcgctacgcctccggtagtggtggtggccgtgaagagcggtacagtcgcgagcctcgccgtgacgatcgtcgtggctattatgatcgtgatgctaaccctcccagctacggcgacgcccctcctgcccgcgaaccgtacgctg

SEQ ID NO: 21385 - DNA, 411 bp, A.fumigatus
gccagcgtacggttcgcgggcaggaggggcgtcgccgtagctgggagggttagcatcacgatcataatagccacgacgatcgtcacggcgaggctcgcgactgtaccgctcttcacggccaccaccactaccggaggcgtagcgatcaatgccaccacggtagctgtagtcgtcacggtactcacgacgaggatagtcgcggtattcgcggccgccatcgcgaccaccgccatagtcacgacgatcactgtaggagtcataacgaccataacggtagtcgtcaccaccaccgccgccgcgacgccagccgccaccgtgaggtccacgtctgtcatcataacggtcaccacggccgccgcggccaccaggtccacggaagtctgtagaagggacaagttagcagttgattga

SEQ ID NO: 21386 - DNA, 333 bp, A.fumigatus
catcacgatcataatagccacgacgatcgtcacggcgaggctcgcgactgtaccgctcttcacggccaccaccactaccggaggcgtagcgatcaatgccaccacggtagctgtagtcgtcacggtactcacgacgaggatagtcgcggtattcgcggccgccatcgcgaccaccgccatagtcacgacgatcactgtaggagtcataacgaccataacggtagtcgtcaccaccaccgccgccgcgacgccagccgccaccgtgaggtccacgtctgtcatcataacggtcaccacggccgccgcggccaccaggtccacggaagtctgtag

SEQ ID NO: 21387 - DNA, 465 bp, A.fumigatus
  unsure (13),(454): Identity of nucleotide sequences at the above locations are unknown.
agcggtatgcttntagagcgccttcaacagctgacctaccaggtcggctcctcttcacctttacctcatccctttgatcccctgtcaacaaaagaaattgacgcggcagtcgccatcatccgcaaggaacatggcaatgtcaatttcaacgcggtcactctgtacgagccgcggaaggcggagatgatggcctggctcgcagatcctgagaatgcgcctcgtcctgcgcgtgctgccgacgttgttgtaatcgcacctggcggtaaggtctacgatggcattgtcgatctggatcagaagaagatcgtctcgtggaagcatacgcctggtgtgcagccgcttattacgatggaggatttgcaggaggtggagcatattgttcggaaggatcccaaggttattgagcagtgtgcgattttggggattccagaagtggcccaccacggggctgaanggtcccgcgat

SEQ ID NO: 21388 - DNA, 243 bp, A.fumigatus
ccatatctgtcaggtgtctttgcgggatccttgttttgggttggtgtcacatatatcttcagcgtgttgccaggtaggtatactttacctcgttactgctccgtactaaccgtttacgcccttagcaacctattccacgtcgccaattttgaatatattgttcgcggtgttctattgcctcacaacatatttctacatctactcgatgacagaagaccccggctttgttccgaagacgggtag

SEQ ID NO: 21389 - DNA, 234 bp, A.fumigatus
tgctcttctacatcctatcccttccctttcacgatggccgagttttcgactagtgaggatcttttcgctcacgctcggggcaatgaatccaatgaaagattctacaacctctgtttctggggacgcaataatcctccatctgcgatgccttgctcacagtataccacacagtttatctcctcccgcggaaacgagtatttctgcgagatcgacgaggaatacttgaccgatcgc

SEQ ID NO: 21390 - DNA, 195 bp, A.fumigatus
tactatgctagaatgtcggcaagctcaattttagacaaaccgcttctcaaagttagtcggccggttgccgcttgctcaagatgccgaaccgcgaaaattaaatgcgatgggaaacttcctgcctgctccgcgtgtgaacgagtatggaaagcgagcacctgctctggcgccagtgacgagtttgccagaggaaaa

SEQ ID NO: 21391 - DNA, 471 bp, A.fumigatus
  unsure (417),(444),(459),(463),(465),(467): Identity of nucleotide sequences at the above locations are unknown.
aagagcgtctcgatgtcgaagcataatcttacagatactacggtcatacatagaggacagtacaagtataggaaatattcgcactcaaacattcccatcagccacctctctcctctcccccgccaacaacctctccctctccctctccatcccctcaaccacctcgcccggcgccccattactcagccaaagcatcggcacagccgtcaccgcagccaacaacccaagagtccacgccatcgtattccacccaaactgatactcaataaacccaccccaaagcggacccaggaacatccccataaacgaggacatagtctggatgccgaacgcctgcgccacggcccctcgtttgccgaagatccccggccgcgcgcgctccatttcctcgaggacctgctgcgtttcgacgtatancgcgggcacgcaagcgtggataaacangccgataaaggtgangganananatga

SEQ ID NO: 21392 - DNA, 744 bp, A.fumigatus
  unsure (34),(604),(672): Identity of nucleotide sequences at the above locations are unknown.
gatacgctgtcgtccgagccggctggtgaagacncacgcgtgtccctccaaagccacgatgacattacatacgaatcgatagccaaggccttcaacctgccactgaaacttcacacccgcgccttcgagcgcatgaagagactctccaagcctcaccccatgcagcctcacttcgattgggacaccccgtcgcccggcctcactgcgaagctccggatggtctacctcccgtacgacgagaacctccccgcggaatcacaagccctcttcgttgcagacgacatgtgggtgcccatcgccgtcgtcaacggtaacgtgcatatcctccccggtgtgccccgcttgttcgagcgcctcctcgagcacctcaagcccgttttgctcccccggttagccaacccggagggcaaaggtatctaccgctacctcttcagcaccccgctccctgagagtgctgtcgcgccgtacctgacggaccttgcggcccgggccagtgtgcacggcgtcaaagtcggcagctaccctcgttggggcaacaagcgcaacaccgtcactcttgtcggaaaagacaaggctttcatggattcggtgattgcggatgtcnatgagaacgttcagggcaagaaggtatctcgggatgatgagctggaccctccctctgagtcggagtanagttctaacgactccctttgcagcttcacagggaagatattttgcgtgttcaatcttttgactgatagataa

SEQ ID NO: 21393 - DNA, 537 bp, A.fumigatus
  unsure (508): Identity of nucleotide sequences at the above locations are unknown.
gagatgtcttctaacgaccctcaccttccgccatcggacattgcatcaccggggatcaaggacgaagctgcttctgtaacgctcggatcccttcaagaaccgcagcaacaatcgcaaactcccgcaggttctttttcggaacctgtcgaaaatgccgctgttcctgctacccagagcggggccgtgaacacccagaaatatgataatgcggacagcacccaagccgctggtgtccacgatagcagtacaccgattgtggccgccgagcagagcatccgtgacacttttgcaacaaatgacaagccccaagataccacagggttagagtcaactgatacgccagtgcccgagccattaccagacgcttcagacgccgccgcgaaggaagtggagggttccgccccgtcgttgaccatcacactccttttaacaacaggttctcgtcatcctttcgagatcgatgggaaatatctacaaaagcgggggtcgacctcgagagtattgatanttggcggctgggatcgacacagtatggat

SEQ ID NO: 21394 - DNA, 486 bp, A.fumigatus
tacctatgcgcggatcctgccagccccgtggtgaagacaatcgatatgaaagtcactagggattcggagagcggcattgacattgatctgcacgatcgctcggaattatccgaagtggacctagctattgtccgcattgatcccgtgacctacctgccacctgagatcatgtcgctgactctatcgtatcttgaccccgagtctctgatgcaggctgaactggtttctcgtgcttggcgagagcaggcttcttctcggcacacctggaggcaggtatttcgtcgtgcgtacggacaccgccaccccagcggtgtcgcctccaagaagaggcagtcggctggcttgggaaagtcaatcccgaatcaggagtggaagaagatgttcctcgtccgtcgtgctctcgatcaccgatggaaggaggggaaagcggccgcaatctatctgcacggccatacggacagcgtctattgtgttcagttcgacgag

SEQ ID NO: 21395 - DNA, 555 bp, A.fumigatus
cgcgtttccttccagccccgtggtgaagaccttcagcagttctaccgggaatctcgcttgcatcacctatcaacgtggaaagcagagctcaaggctcagcttcaagctgctgcaaaggaaaaatcccactctcaagcaggtcgcaaaaagcctgctccaggagcaagacgctatgttttacatgtggacttcgattccttcttcgcggctgtatcgatgctgaagcacccagagctcaaaggccaaccagtcgccattgcacacggtactggttctggctctgaaattgccagctgcaactatcctgcgcgcgcccggggcatcaggaacgggatgtggatgaaaggtgctctacaagcctgtccggagctgaaggtcttaccgtacgattttcctgcgtacgaagaagcgagcaagaaattttacagtgctgtcctcgcggtcgatggtgttgtccagagcgtaagcattgacgaagcccttgttgatatcacactgcaatgtctcgaggccggaggttcggacgggcgagggatatcagaaaggtctatctac

SEQ ID NO: 21396 - DNA, 363 bp, A.fumigatus
ctccaccttccctctgagcaggtgtcaagttccaatccattagtcaagccgaagcctactccaggttacatctacctctactccgaggatgaattggtgcacttttgctggcgcccaagaaccgctcctcctgaccaacccgaactggatctcgtaatggtcccatcagacggaactttcaccccgtatcaaccagctggcaaagatgcaccgacaaacggccgaatcttcgtattgaagttctcctccagctcgcagcgctatctattctggctccagtcaaaatctcagcatgagaggggcgatccgagctggttcagccccatcttcaccacggggctggaaggaaacgcgtacggcgag

SEQ ID NO: 21397 - DNA, 201 bp, A.fumigatus
  unsure (75): Identity of nucleotide sequences at the above locations are unknown.
actttcgccatgtctatagctccactcattacattcaaagctggtatctgtgacctggatgtgagtgactgccantacagccctgacaaattgaccttaacctctgtgtatcaaacggccacgattcggcctgacaacagatttatggcccttactaactccaccttccctctgagcaggtgtcaagttccaatccattag

SEQ ID NO: 21398 - DNA, 615 bp, A.fumigatus
  unsure (582),(583),(584),(585),(586),(587),(588),(589),(590),(591),(592),(593),(594),(595),(596),(597),(598),(599),(600),(601),(602),(603),(604),(605),(606),(607),(608),(609),(610),(611),(612): Identity of nucleotide sequences at the above locations are unknown.
gggaagtacgatgctaatgccaaccagtggattatgggcctaaatgccgccctgaaagactggaagcgccaaaccaagtacttcggccacctcaacggctcgaaatactcgtgtcttgtcttcgataatcgcggcgtaggccgctccgacaaacccacctgcttctactcaacaagcgagatggctcgcgatgtcgtggacctcgtcagctcgctgggctggatcgacatgaaagctcccgcgacacgcgccatccacgtcatcggcgccagtatgggcggtatgatcgctcaggaagtcgcgatgctcattcccgaccggctcgccagcctgacgctctgctgtacggctccgcgactcgtccgcacaacacccttcttcgagaacctgcagcagcgtgcaagcatgttcatcccgcgacatgtggacgtggagattgaccgcatcgcggcgacgctgtttgcgagtgagtttctggcgcagcccgatacggagaatgaggatcctgcgttgaactttccgacgaagagggatcgatttgcggcggggcatttgaggaagaaggcggatacagagtcttcnnnnnnnnnnnnnnnnnnnnnnnnnnnnnnncaa

SEQ ID NO: 21399 - DNA, 549 bp, A.fumigatus
  unsure (329),(498),(535): Identity of nucleotide sequences at the above locations are unknown.
ccttccagccccggtggtgtaagacgaaatacatggcatctcccactctggcgcaaatgcatcatcctcgtcgtcgtcagctggatggctttcgtggtcaccttctccagcacgtctctcctccccgcaacccccgaaatcgcagccgagttcgacacaacccccgaaatactgaatatcatcaacgccggggtgttgttggccatgggcttctcgtcgcttatttggggccccttcactgcgcttcttgggcggagggttgcgtataatattgcgattgcggcgctttgcgggtgttcggtgggcacggcgcttgcgggggggagtantgtgtttgcggtgtttagggtgcttggggggctgacggggacgtcgtttatggtgcaggggcagactatcctggcggatatttttgaggcggtatgtatgatcgtttatctctctggctgtgtgtgcgtgtgtgagtgtgataaagctgattgtggtgtaaaaggttanggggacggcggttgggttcttcatggctgggacggtnacggggccggcgat

SEQ ID NO: 21400 - DNA, 564 bp, A.fumigatus
  unsure (15),(52),(221): Identity of nucleotide sequences at the above locations are unknown.
atcgccggccccgtnaccgtcccagccatgaagaacccaaccgccgtccccntaaccttttacaccacaatcagctttatcacactcacacacgcacacacagccagagagataaacgatcatacataccgcctcaaaaatatccgccaggatagtctgcccctgcaccataaacgacgtccccgtcagccccccaagcaccctaaacaccgcaaacacantactcccccccgcaagcgccgtgcccaccgaacacccgcaaagcgccgcaatcgcaatattatacgcaaccctccgcccaagaagcgcagtgaaggggccccaaataagcgacgagaagcccatggccaacaacaccccggcgttgatgatattcagtatttcgggggttgtgtcgaactcggctgcgatttcgggggttgcggggaggagagacgtgctggagaaggtgaccacgaaagccatccagctgacgacgacgaggatgatgcatttgcgccagagtgggagatgccatgtatttcgtcttacaccaccggggctggaaggtcacgcgtacggcaa

SEQ ID NO: 21401 - DNA, 339 bp, A.fumigatus
ccaatcgggggtcacggctctaacaaagctctgcttgagatcttcggtaaaaatggccctttcacagcctgcaagggatgtagaaacatttacaccaagctcgccattgctatctatatagatcatggcaaagtgggggaaagggcagttggatgcccgtggcattgggctgtggctctcctgtgggaaatcaagttagtggattgtcctattgttgcgacaaagcgttatgcataccgctggcccttgctggcccgccatgctatcatagggcaacagctgatgatgctcctgggctcctggctgggctgttggatccattgcgcaaatcgaccttga

SEQ ID NO: 21402 - DNA, 540 bp, A.fumigatus
  unsure (368): Identity of nucleotide sequences at the above locations are unknown.
agaagccagttgagcggagataacgctgaagctttcaattctgctacgagaccgctttcacagtcaatcgccgttcagactgacgcgactgacccctttgttgcctctactgaacctgcgcctgcccctgaacctaaacgagaagtcgttacatacagcaaaggagtgcaaacggacgattcaaagcaacgccaaacagactcgctggactcggagtcagaaactggagagtttgacgatggtactggaccaagcaaacgcctaagcaagagcgaccgggaacacgatgaggaaattcgaaggaagcttcgcagggaaattgaagaagaattacaggccacccaacagcaggctgctggtgggcctantgcccaagctacaaacctacgttatcctttacgtactctcgacgaggacgaactgaaggccgtcacttcttcggaggacttcctcgacttcgttgagcgttctgcgaaagtgattgagcgtgctctaaatgaagagtacgacgtgctcgcggactacgagcttggcggggtt

SEQ ID NO: 21403 - DNA, 408 bp, A.fumigatus
  unsure (16): Identity of nucleotide sequences at the above locations are unknown.
tattccctagcgcggntcgttcgacccctgtggctgaagatgctcatcacctgtgtccttggcattatcacctactggtggatggtagattttccggagcagtcgcacagaagcttctgcttcctgtcgaagatcgaggccaaggtggcagcgcagcgtatccagatcgatcgtgacgatgtcgtgcccgaaccattttcctggcgcaaaatcctcgtcaatttccttgaccccaaactatacggattcgcttgcttgttcttcctgctcaacctcgtctcaacttctctcaattactttctccccatcattctccagtcagggatggggttttcaagcagccagtcgattctgctctcgacgccggtaagttcggcctgtcacgaagtccacgactatcccacctaa

SEQ ID NO: 21404 - DNA, 438 bp, A.fumigatus
  unsure (414): Identity of nucleotide sequences at the above locations are unknown.
aagctacgagaactcaagcgaatcaagagagagcgtgaagccattgaggcagcggagaaggagcgcgaagagatcgagcgtcgtcggaacctcactgcagaagaacgcgaacgcgaagaccgcgagtttattgagaagcaaaaacaagagaaagaagccagtcgtggccagactgggtttatgcagcgctatttccacaagggtgccttcttccgtgatgatctggaacgcgaaggactggacaagagaaatatcatgggacagaggtttgccgacgatgtcgctcgtgagaccttgcctgaatatatgcaaattcgggatatgaccaagctgggaaagaaaggaaggacacggtacaaggatttgaggacggaggatacgggacgctttggagagggcttcgtcttcaccacntggccatggacggaccaaagctcg

SEQ ID NO: 21405 - DNA, 627 bp, A.fumigatus
ggagcgcggtttcttccagcttcgggcgtgattatgatttcccctttggtgcgagcgctggaacccattagcaatttcactgtcgacacgcaagtacagctatacgcgaccttctctccaaccgcgcccaaacccgaatatgacgaggcgctagcagcttggaccttgaagaaggaagatctgagtgccttcatcaatgccgccgaatggcccttgagccctagtatcggaaacggcccaacaattaacttcattctctatgtgcctgcgccttcacagtcgccaatggtcgtcaaggagagcggtgcgaccagctggatcatccctcaatggggcggcgtcttcctcgtcaacccccctctatccaccacccaagagaaccactccagcccgacccatttgtccaaggatgcactacgcgccggcttcttaacattctcccaccagctcctcaccttacttggcgtccctactacgcctacctccctgccattccgtttacaaacgctgatccgcgtccgcgcggccacgctcctcctctccgcatcctccaccatgggctcgctcgcccgtctcaccgagtccatcccctcaatccccatcccagctaatgtcgccgcatctgta

SEQ ID NO: 21406 - DNA, 282 bp, A.fumigatus
  unsure (244): Identity of nucleotide sequences at the above locations are unknown.
actaatacttacgatagcgtctccgaactggatgcttcctgcctagaactgaccccagaatgcatcaaacaagcccaagacacaaagacaccggaggatgttaagcaattcttccgcgactacggtgagatttcagatcattttcaaccgacgccgatgaagcattcagaaaccgtcttcgcagcaaccagggaactgcgtagcacccgaagtctgaccaccacagagaaacaggatctaatanccacaaaatatgaagacagccgcggggattcaacctga

SEQ ID NO: 21407 - DNA, 351 bp, A.fumigatus
  unsure (322): Identity of nucleotide sequences at the above locations are unknown.
gggagcctcctcgacttgcttatccaagctggcctccgcagcaagtggcctgtcgaacgtgagaccatgtggctagcctatcgaatcttcatgctcaacttccccggtgtacatacaagcggcatctccgccaccagcgcccttctcgacattctgagctatcccaccgaagagggcctcatggatatgctccaagcggaaatcgaacagatcgccgccaactcggacgggtcatggtctgccgctgacctggaacgggccagtctgctcgaaagtgccatcaaagagtctcttcgctttgacggcatcaacgccctctgtntacgagaccgggcctggaaatatagcatc

SEQ ID NO: 21408 - DNA, 546 bp, A.fumigatus
  unsure (60): Identity of nucleotide sequences at the above locations are unknown.
attggaacgatcaagcccacgatgccctatttggtggggataagaaggacactgacgggntacgtggaactcctaacgtggactaacgtggagcgcattcctgatccggaactcgccaaacgccgtgatcttcgtcggagccggaagaagaggggcgttacactctacgaatgtcttgacgagttcaacaaagaggaaattctttccgagaatgatgcatggtactgcccccgctgcaaggagcatcgcagagccagcaagaagttcgaattgtggaaaactcccgacatccttgtcatgcacctgaagagattcagcgccagcaggggtttcagggacaagctggatgtcctggtcgacttccccgttgaagggctagacatgagcggccgtgtggaatcgccggaagaaggaaagagcctaatctatgatcttttcgcggttgataaccactacggtggattaggaggcggtcactatacggcctacgcaaagaactttatgagtggccaatggaacgagtacaatggtaagagctttctgtga

SEQ ID NO: 21409 - DNA, 231 bp, A.fumigatus
gacgaggtgcaccccgctatcgtgggtatctcgcgcatttggacatcgggctcatctcgacggagagggatcgccatggatcttcttgattgcgttgtgaccaactttatctatgggatggagattcccaaagagcaggttgcttttagccagccgacagaaagtgggaaacgtttggcacaggcctttttcggaccaggagtgcagtggcatgtctacaacgaaagctag

SEQ ID NO: 21410 - DNA, 339 bp, A.fumigatus
ctattatcttcagaagtcgattttgcagatacaaaccccttgctcaagcgaccagcggaaactgaacacgcttttgacaccgacaagaaccagaagcctgcacccgccaggccaagcatcaacggaaagagtcataactggttcgcgcgggtcttccagatcaaaccagcaacaagagtagttgctctcaacacatcaaagctcaaaggtcgaaaggacgttttgaagctcctgcgggaatggaaacagtttggaatggaggaggcgtacttggacaaagccaacggtgtcattcgtgccaaagtgggcgaagtgaactgtaagtcagaacctggatga

SEQ ID NO: 21411 - DNA, 207 bp, A.fumigatus
cacgagtgcctaagtccggccgtccggagatccaatggtatattagctatctttagggcgacctcgtcgaggggtacaagcacaaaacaccaggtaagtgtcgaaatgaagtacgtccaacttggatcaagcgggctgcgcgtctcgcccatctgcgtgggctgcatgagttaccgcagccccgagaaacgcttcgactgggcacta

SEQ ID NO: 21412 - DNA, 261 bp, A.fumigatus
  unsure (3),(5): Identity of nucleotide sequences at the above locations are unknown.
acngnttcttccctcaaatcggttattctggcatggttcttattctggcccggtgtgctcatcaacatcatcgtcggtgccgaggtgcctcatgtcacgggccaggcatatctcgatgataagacggtgtggcgcacttggaataaccagaccggctggtcaagcaacggcttgttcttcgttgcaggaatgctcaatggtgcttacagtgttggcactcctgactgctttagccaccttgcggaggaaatcccacggtag

SEQ ID NO: 21413 - DNA, 510 bp, A.fumigatus
  unsure (23): Identity of nucleotide sequences at the above locations are unknown.
tataggcccagccgcaacatccntaaggccgtccttgctcagatgtctgtcggcttcgtcaccggtcttctctatatgatcgcggtcttctattccatcaatgacctcgacttggtcatgagcaatccctacggtttccctctcgccgagatctaccgccaagccacgggtactcggagtggctcccttggattgctgatcgttgccttcctgcccactgtcatcacatgtgccggttgctacatcaccgctggtcgtaccttgtggaccatttctcgtgataaagcgacccccttctccggctggctgggacgtatcaatacccggatgcacaaccctttcaacgcaaccctggtctgtggtgtgattattaccatcctggcttgtatttacgtcggatccaccaccgctttcaatgccttcgtcggctgtttcgtgcagctgtcctctctttcctacctcgccgccagttttcacaacggcgtggagatccggcatggttatcgccat

SEQ ID NO: 21414 - DNA, 243 bp, A.fumigatus
tgttcagctagaacatggattaggtccagtaaaacctcagagattacccctctggtcaagagcaaaagggcgaatgctaccttactatccctcggaaatatatttagtaagctacctaatattcaacaggaccatcaaggagcatttagcgactctccactatcatctcaaaccgcagaactcgctgatgagatcttatcgatcaagtctatgacacagagatatatgtcgatctgggaataa

SEQ ID NO: 21415 - DNA, 213 bp, A.fumigatus
agaccttttgtactccttatctactcatcagttaccaccgccttcccgggtactcatctgaggcaccacatcatctccgacggtcgccacattggtcgtacaccctacctcctcgtttcctctcttccattgacctcacgagtgatcccggctgctgcaatcctcgatctttcatatctctacgacattcaaaagaccgttgacacgacttga

SEQ ID NO: 21416 - DNA, 324 bp, A.fumigatus
aatataccagatgagtggttgagtgccgctatggatgcccatgaactgtcgtttcgcgatggtcacggatcctccacctcgactatgaaagacgggtgtgcctcggcggagaaaccgcattacctcccaggagattcttcctttacatctgtatttggcccatctgagaccgtcgaagacgttgaaacggagcccggatcgacacaggacaagccccacagtttcaacacccaaaaaccaatacgtgaaaatctggctggcaagaacgtcgcacctttcctagccaggcatatccccgaacagtacgctcctcttggttcgcaa

SEQ ID NO: 21417 - DNA, 489 bp, A.fumigatus
  unsure (76),(105),(111),(115),(235),(240),(247),(252),(419): Identity of nucleotide sequences at the above locations are unknown.
gagaggggggaacagaaccaagggagacgggggaagcaggaagaggaaggaagagcggaaaccggggaacggcagngcgagagagggaaaaagcacaccgacaanggaggngaanagacgaaaagagggggggaggagaacaaagagcaaagaagagcggagaaagaaacgaaagaaggcagagaaccaaaagggagaagaaggaaaccacccacacagaacggggaaagagggngcggngaagaanggggnggacaccttcccattcaaactccccattcccgtgtttgtcaaccagccccttttcatccatcctaccttcattggcattccattcgccatcctgaggcctatattgatacttccgatacccttcttcacacccgcaataaaccttcaaatacctaccctcaacacantacaccgctgcaacgcaatgccttcgccatcgcaactccgacactgcatcgtattagctggttagtttag

SEQ ID NO: 21418 - DNA, 486 bp, A.fumigatus
  unsure (78),(107),(113),(117),(237),(242),(249),(254),(421): Identity of nucleotide sequences at the above locations are unknown.
gagagaggggggaacagaaccaagggagacgggggaagcaggaagaggaaggaagagcggaaaccggggaacggcagngcgagagagggaaaaagcacaccgacaanggaggngaanagacgaaaagagggggggaggagaacaaagagcaaagaagagcggagaaagaaacgaaagaaggcagagaaccaaaagggagaagaaggaaaccacccacacagaacggggaaagagggngcggngaagaanggggnggacaccttcccattcaaactccccattcccgtgtttgtcaaccagccccttttcatccatcctaccttcattggcattccattcgccatcctgaggcctatattgatacttccgatacccttcttcacacccgcaataaaccttcaaatacctaccctcaacacantacaccgctgcaacgcaatgccttcgccatcgcaactccgacactgcatcgtattagctggttag

SEQ ID NO: 21419 - DNA, 468 bp, A.fumigatus
ttatggttcggtgtgttgaaatgtataagtagaatgtatatcccatggtcgcctactgaggcggcatggctttttccctattttctatttcctactactcgtactttcccgccccctcctcctctttcttctcttaccacgtctatcttctctcctttcctctcatcgtcttctgcctactccctttgtgctctcttctcttctttttcccggttcacctccttttctctctctccttccttttccccctctgtttccttctccctcctcttcctcccctcgtcttcctctcttctcctgttcttgctgtttttcttcccccttctcactttgcgccttcctttcttcccctctctctctctctcttttcttcctcctctggcctcttattctcttgtcacccttctccattctccactcatcctcgttcatcccacttctatctccctttctcgctctcccatttag

SEQ ID NO: 21420 - DNA, 441 bp, A.fumigatus
  unsure (60),(75),(80): Identity of nucleotide sequences at the above locations are unknown.
gcgaccatgggatatacattctacttatacatttcaacacaccgaaccataatcagaganaacgatctgaccgangaaanctttcctactaccaccgtatccaactattccaccaataatttcaccatgaatgccgtagcatcggcccaaccgtgtctcaacgatggccagtgccactacgccatcaactggctgagcatccttgcaatgaggaataccatcagtcccctggtgtcggggttcggaatgttgcccgtctcgaaccggccatacttcacctcggataccctgcgcgcactctacggcgggtccggcaacttgacccagatcaatgggacattcgcttccatcgccgcggcccttaccgcaaatgcccggaatcgcgtttgccagggagccgtgcttggcgacgcgtggacgcatgtatcatacatccgttag

SEQ ID NO: 21421 - DNA, 453 bp, A.fumigatus
ggcggcgggatctgcgatgggatcgcgcgcaacgccacagcgggttcgtatggcgcgtacagcgtctgcacgagcaaggaccagctgtcgtatgtgttcgatcggtactacaagagccagaagaaggctgcctcggcgtgtgactttgccggcgcggcgtcggtgcagtcacccaagggtgagtcggccgattgtaagtcgctggtcagccaggctggttctgccgggacggggacggtcacgtcgcagccgacggggggaagtgaatcgaccggaggaggaggaggaggaggaggaggtggtggtggtggtggtgctgcggcgagtacgtctacgtccaagggtgcggctgcgggtgctgcgagtcctgctgctgtccgggtgggcggctggcctttggttacgtatggtcttgttgctgccatggctggtattttgatgatttctctttag

SEQ ID NO: 21422 - DNA, 324 bp, A.fumigatus
ccaaaaaaggttctggttctatggcttgttgctacaacagacccctcagtcatttcaacattcacaattaagattatgaagcgcaaatctgctgcaaacttttccgatacaggggcaaaacgggcccccagacaagatccggtgtcctgcgaatcttgccggcgaaagaagctcaaatgcaatcgtcagcgaccatgcagtagctgtgttactcgaaggctgtcctgcagctatggtatatcgctggagaggattgaaccagcgatagttgaggtggaaaatgcaagtcttcaccacaaggcgcgcaggatccgcgaaagaggt

SEQ ID NO: 21423 - DNA, 261 bp, A.fumigatus
  unsure (5): Identity of nucleotide sequences at the above locations are unknown.
gggcnacgggagcgcgtgtccttccagccccgtggtgaagatatagatgatgcggatgtgcgtgcattggatgagtacgtgtctgaggagcaggctatggaatctgcactgttggagatggcgcatgtgccattcgagaatacgggcagaacgcatgaggcgaattcctcgttcagtgatgaggaggagtatgatgatattttcatgagtttggctgatcaaggaccgcagagccaggacatggacatgtcgagtggatga

SEQ ID NO: 21424 - DNA, 441 bp, A.fumigatus
cacatacagattctttttaattttccatacacggcattgcctggaccttgtggttataggattacaacctcagagcagaatagctgcgagcgtcagattgtctacactgtggtttcacatggtatttcttacaagaatgttcatggctatggatccaacgatgtactagtcccctattgtattgatcgcactacgggatgttcaggccgcataaataattatgagttgaggatgaggccatcgtgttggatgcaaccatggaacgtccagccgagcttcccgcctactgcacaccgcaacattctagggggcaacaagtgctccatgagcccgtaccagtccactgacattcgtacacaaagtcaactgcctgacaggtatttgttgtctgtaagccttcaatccacccgtcttcaccacgggcgtggaagtaccgcgtac

SEQ ID NO: 21425 - DNA, 447 bp, A.fumigatus
gaccagcaagacatttggactgctgcatcatctcgatcatcagcctgcaaatatctccacactacaaccacaatcacaatggccaccaggatcaagctcctccccaatccccactaccgcaagtcggggaccaagtcgtatgtccacctcatgcggaagtaccgcttcaccccaacaaagggtggacgatacttcctcagtagttctcttcaccagacaggccggcagtatacacacctgcctgttggtggcagggctcgcattcagcacgtcctgcgcaagcggatcgcggataccgacgagacaagcgacgtcggcgccgacgatgtccagaatgatactatgtacctggcgccagtgagtatcggcactccggcgcagactattcatctggaagtggacacgggttcggcggacttatgggtgagacactacgcatctcgttaa

SEQ ID NO: 21426 - DNA, 210 bp, A.fumigatus
acaccgatgatcagatgcattggttatgtctcagactcgtcatcaatctcatggacagcattctttgaactagccttgcgcctgatccgatttcttttctatttttacttccctctcaacgccactcagaccttcgattcatatctattacatccactgagcaggacacagaccaaccacccggcaagcttcgctagtgagtcccattag

SEQ ID NO: 21427 - DNA, 513 bp, A.fumigatus
ctgatgagtacagatgctttggaccccgaaaacccggacaaaaagcactataccaagatctgcggaatcctcatcaactcgctcttctcctcgaacgaatacattgccgtcgtgggaatcggcatcaacgccacgaacgcctctccaactacctcgctcaatgcactagcctctcgctttgtctccaacaaatccgctccaatcacactcgagaaacttcttgcccggtgcctcaccacgttcgaggagctgtacacccgcttcctgcggaccggctttgaccgggagtttgagaccatatactacgacgactggctgcacatgcaccaggtcgtcacattagaggaagaaggcggagcgcgagctcggatcaagggtatcactcgggattatgggttgctgctggcggaagagttggggtgggacgatcgacctacgggacgagtgtggcagttgcagagtgacagcaacagctttgatttcttccgaggattggtcaagaagaaagtatag

SEQ ID NO: 21428 - DNA, 570 bp, A.fumigatus
  unsure (1): Identity of nucleotide sequences at the above locations are unknown.
naggcaattctgcactcgctagagacgaacatgtcctattatcattgctgcctgagcgttgccgcaatccatctcaaagccagtaatggccggagttcggacaagattgaccatgacatcatgcgtcaccggtatgaggcggtgtctcaactgtgcagagcgctcaacagcgacaatggacatgagcaaatcttagatgcgacacttgcgatgatcgttttccacggctctgtgggctccctggaagactatctccctgacattccttggaacgggcatttccaagccggtgcaaatctcgtcaacaagctcgatctcgcggacactggcccttacactcaacctccattcagcatgtcgctcgcctcgtggattgacatcttgggcgccacgatgctgcggacaaccccgtatttctcacacacctatcgcacaaaacacctgagtgggacatcctccgggctccgagagctgatgggatgtgatgaccgcatcatgtatctcatctcagagattgcttgcctagactcgttgaaagcagatggccctatcgacgatttggctctgtga

SEQ ID NO: 21429 - DNA, 687 bp, A.fumigatus
  unsure (14),(63),(115),(120),(345): Identity of nucleotide sequences at the above locations are unknown.
gccaggttcagcgntacggcgatttgtacgacggtgccatcaccgggtgccccggctttccgntatgcccagcagcaggtccaccacgtcttatcgtcggttgtggagaagactntggantactaccttcccccgtgcgaactggccaagatcgtcaacgccaccattgaggcctgcgatcctctcgacggccgcactgacggggtggtctcccgcaccgacctttgcaagctgcactttgacctttcgaagatcatcggggagccgtactactgcgccgcaaagaccagcacctccctcggcttcggcttcagcaaacgccaggcagccggcagcacgaccagntaccagcctgcacaaaacggcaccgtcaccaaggagggggtggctgtcgccaaggccatttacgacggtctgcacaacacccagggccagcgcgcctacctctcctggcagatcgcctcggaattctccgatgccaccaccgagtggaacaatgacaccggctcctgggagctgagcatcccgtccaccggcggcgaattcgtgaccaagttcgtccaactcctggatctcgataacctgtccactctcgacaacgtcacctacgacaccctcgtcgaatggatgaacaccgccatggtgcgctacatgtcttcaccacgggggcggaaggagccgcgctaa

SEQ ID NO: 21430 - DNA, 579 bp, A.fumigatus
  unsure (73),(122),(174),(179),(404): Identity of nucleotide sequences at the above locations are unknown.
ggatgccaagatctacacctattacgaaggatgctccgacggtggacgggaaggcatgagccaggttcagcgntacggcgatttgtacgacggtgccatcaccgggtgccccggctttccgntatgcccagcagcaggtccaccacgtcttatcgtcggttgtggagaagactntggantactaccttcccccgtgcgaactggccaagatcgtcaacgccaccattgaggcctgcgatcctctcgacggccgcactgacggggtggtctcccgcaccgacctttgcaagctgcactttgacctttcgaagatcatcggggagccgtactactgcgccgcaaagaccagcacctccctcggcttcggcttcagcaaacgccaggcagccggcagcacgaccagntaccagcctgcacaaaacggcaccgtcaccaaggagggggtggctgtcgccaaggccatttacgacggtctgcacaacacccagggccagcgcgcctacctctcctggcagatcgcctcggaattctccgatgccaccaccgagtggaacaatgacaccggctcctgggagctga

SEQ ID NO: 21431 - DNA, 327 bp, A.fumigatus
  unsure (171),(220),(272),(277): Identity of nucleotide sequences at the above locations are unknown.
tcaaatgggacgcaaagtacattttggcttaccaggccctgggggagagaccaactctcgggcaagacattgacccgaaatttctacgttcgttctagggatgccaagatctacacctattacgaaggatgctccgacggtggacgggaaggcatgagccaggttcagcgntacggcgatttgtacgacggtgccatcaccgggtgccccggctttccgntatgcccagcagcaggtccaccacgtcttatcgtcggttgtggagaagactntggantactaccttcccccgtgcgaactggccaagatcgtcaacgccaccattga

SEQ ID NO: 21432 - DNA, 939 bp, A.fumigatus
  unsure (640),(845),(846),(893): Identity of nucleotide sequences at the above locations are unknown.
gcacttggtactccaccggtggtcgataccacagtggctatatcgtcgtcccaatggccaacggatctgaaagtcaaacagctcgccaattttggacctagtccctggatcgaaaatcttgccgtccgacactcaggcgaggtcttggccacccaaatgctcgacccgcggatattgcaagtcgatcccgatggaaaattgccgcctatagtgatccatagctgggccgaaggtgccagtgctggcaagtatgacggtgttttgggaatcacagagaccagacacgacgagttctatgtggccgtggctgggcagtacgacgagaatatgaagttattacccaactcgaccaattacatattccgggtcgattttgatactttggaggtgtcctcggcaggagaggtgctctcaaatgccacagtggtggaactcaccagccttgatggctctcagctggtgaatggagccacgacgctcaacgaagacgctatcttggtttcagattcctctaatggatgggtctataaggtcgatgtccgaactggtgcatatgatgtgattgttgatgaccctttgatgaagaagaactcaggtgcagaatggaaagccggtgtcaatgggatcaaggtcttcggangatatctttactggaccaacactgatgctggtctcctggccagaattaagattaatgatgacgggaagccatgtggtgtatccgagatcgttgcttcaaatctgactgaggcggacgactttactctggacgatcaccggacaccttattttgctctggggcccttagaaaaagaaatccgccgtggttcgttcctggaaggcanncaacaggctggccacctgttgtattgggccacccaccaccaaagttntggaccggcaactttggtgaaccatcatccaaccggtccttccctt

SEQ ID NO: 21433 - DNA, 471 bp, A.fumigatus
cggacgaagaggggtactccttcagcgccaacggaacttggaggaaggagaggaatacgggggcgaaaatgggtggtgctcatggtgcccggcggcatttacgagtcacccggcagttggcagggacgaattagatcgccgatcggagagtcaaggcgagcagactcacgcaggcctgatgtgcacagattccgaatcaaagttcatgctttcgaagatacccggtacatcatgatagggcccacgttggagtacagcgagtttgaagccaagatccgggagaaattcggctttcgctcgcttctacgaatccgaatgcaggatgaaggcgacatgattacgatggtggatcaggaagatttggacctcctactgagttcggccactgaggcagctcggaaggaaggcagcgagatgggcaagatggaggtgagtccgatcccacacgtttgtgaaacgacccgtaactaa

SEQ ID NO: 21434 - DNA, 234 bp, A.fumigatus
ttaagtcgcagattggagccagatttcaacaagaatattcaattagatgttcctgttacctgttctggatcctttgtgttctataccacattcacacccctacctcaattctctgtcgaccctgttccgacccctgaaccagcaagaacacctgattactacgtcgatgtcgcacctaggttgacccttcgtggtaaaaaattgcctctcaatgcgctctctatattctccgtg

SEQ ID NO: 21435 - DNA, 198 bp, A.fumigatus
gcccccggcgccggcttcgcaacccgcaacccatcacaactcaacaccctttcaaccggcatctcaacccccgccctggtaaaatacccccggacacgctccacatccccagtcgtaagacaccacacctcaaaccctgcgctgcgcaacttctccaacgcagggaccagctccggacgcagctgcagcgacgcatag

SEQ ID NO: 21436 - DNA, 291 bp, A.fumigatus
cgccctccaccatctccaccaacccctctgcaacaacctccaagctctccctctcaaacacctcccagcatccctccccctcaagcacaccgcagtatgccccccgaaaccccgccctcaccgcagcagacacatcccacagatgcgccgccgcaaaccacttctcatcctcccccccagacccaatcgtctcaatcgcagcccgataagcccccggcgccggcttcgcaacccgcaacccatcacaactcaacaccctttcaaccggcatctcaacccccgccctggtaa

SEQ ID NO: 21437 - DNA, 483 bp, A.fumigatus
gtggcgcagcctcgcaggttctttacagaggaggagcgggatgcttttctcgccggctatgcgtcgctgcagctgcgtccggagctggtccctgcgttggagaagttgcgcagcgcagggtttgaggtgtggtgtcttacgactggggatgtggagcgtgtccgggggtattttaccagggcgggggttgagatgccggttgaaagggtgttgagttgtgatgggttgcgggttgcgaagccggcgccgggggcttatcgggctgcgattgagacgattgggtctgggggggaggatgagaagtggtttgcggcggcgcatctgtgggatgtgtctgctgcggtgagggcggggtttcggggggcatactgcggtgtgcttgagggggagggatgctgggaggtgtttgagagggagagcttggaggttgttgcagaggggttggtggagatggtggagggcgttattcaactgtctggttag

SEQ ID NO: 21438 - DNA, 372 bp, A.fumigatus
  unsure (364): Identity of nucleotide sequences at the above locations are unknown.
caatcatcatcaacaacaaatcaatcactcgaactcgaatcccgttccaaacccaaaaaccttgttttaaaccacccctacagatcacacaaaatgcagatcaagagcttcgtcctcgccgcttcagccgctgccactgcctccgcagccgcctgccaggcccctactaacaagtactttggcattgtcgccatccactctggcagtgccgtccagtaccagccctttagcgctgcgaagagcagcatcttcgctggcctcaactcccagaacgccagctgcgaccgccccgacgagaagagcgccacggtccacatcccaggatggctccttattcaggcccggccctggaagatatcgattncccccccc

SEQ ID NO: 21439 - DNA, 246 bp, A.fumigatus
  unsure (94),(201),(202),(203): Identity of nucleotide sequences at the above locations are unknown.
tgcggccagaatctccttcttcagccatccgactgctcggtccttgaccgccagcagatgctcgtcctctatgaccctgcggatgactttgaancgggtgctctgacaaggatggctgtggacaatgacttcggggagctgccggatgatactgtatgtctgccgagtcgtgcaagcagtcactgcgagaagaagaatctnnnattcctggtcgtctgtgggttctcccatcgcgttgttacgtaa

SEQ ID NO: 21440 - DNA, 654 bp, A.fumigatus
  unsure (1),(108): Identity of nucleotide sequences at the above locations are unknown.
nagattcttcttctcgcagtgactgcttgcacgactcggcagacatacagtatcatccggcagctccccgaagtcattgtccacagccatccttgtcagagcacccgnttcaaagtcatccgcagggtcatagaggacgagcatctgctggcggtcaaggaccgagcagtcggatggctgaagaaggagattctggccgcatcagctcaatcctccaataacgccacatacatcttcctcaaccctcactatttctctgttctattcccgctgcttttcaactcagccgatttacttctcaacgtatccaccgacatcgcagcatcgtggatccaattctctcagacactagctccatccatccacgcagcattgagcctgtactacatcttacttcaatcttcgacgctccggacgcagttgcagctcgagaagacctacccttacttccgcagccgattcttggaacccctcaagaccctctgtcatgcctttgagacggagatgacgcagaacggcggtgatggccgcatcgaggccgctgtcggagaggagatgtctcagatcggcatggcccgctccgtagggctcatctcgcatgtcgtcgaacgggtcgaagaagagcgtcttcaccacggggtagagatcgcgtgc

SEQ ID NO: 21441 - DNA, 552 bp, A.fumigatus
gacgatatcgatgacgaacaagtcatagttagaggttttgctggtaatgcagtacgtactgagcgcggaatacagtatctcggcaagcgacttgcgaaatacgtattgttcatgacatacccagatcaaccctacaggccactcaaacaatctagaactaaaacattcactgagtcactcggtgcatggaagactgcgaaggtaagcgttattaacgacccttctgggtctcgaactcgtgcagatgaggcagaagacgagcatcgttattaccagattacgagtattagctttatcgggcattctcttgggggtttagttcagacgtatgccattgcatacattcagaaacattcgcctgaatttttcaatctgatccgccctgtcaacttcatcgctctagcgacacctttccttgggctcagcaatgagaaccctatgtatgtccgctttgctctcgatctcggccttgtcggccggacaggccaggatctagggttaagctggactgctccccgaggtcttcacgacgcggctggaaaatacacgtcc

SEQ ID NO: 21442 - DNA, 816 bp, A.fumigatus
  unsure (7),(8),(9),(10),(11),(12),(13),(14),(15),(16),(17),(18),(19),(20),(21),(22),(23),(24),(25),(26),(27),(28),(29),(30),(31),(32),(33),(34),(35),(36),(745): Identity of nucleotide sequences at the above locations are unknown.
aacatannnnnnnnnnnnnnnnnnnnnnnnnnnnnngaagactactctgatcagttggcgaaggacgcctatcaatccggggcgtatgactatatggacattgtcgcactttctgccagacaggtcatgggagcaacgacattctctgggacccccgatgacccaatcctgttcctgaaggagatctcctcgaacggcaatttccagaccattgatgtcatcttcccttcgttccccttcttcatgtatacgaaccctcgctggctagcctacctcctagagccgttaatcgagcacatgctcagtggacagtaccccaacacatacgctatgcatgaccttggggcccatttccccaatgcgactggccatccggacggccgcgatgagtacatgccagtagaagagtgcggcaacatgctcatcatgggcttggcaatggtgaactcactccggtataccaacgattcggcggcttcttcgatctggtccacactaggggttccccccaaggtctcggaaccacacaccggatacttccctctgggtgagctgcaggccttgtccggaattgatcaacaagacggcaaatggggcggtggcgcggaaggcgagcgtctcgctgagaaatgggttcagcgcagctacaggctctggactcaatggacgggctacttggtggaatactcactggaacctgccaaccaacgtaagagaaatgcctgtatctttcctcaagcactanagctgatctgcgttagtctccacggacgatttcgccggatggctcgcactgcagaccaacctggcaattga

SEQ ID NO: 21443 - DNA, 510 bp, A.fumigatus
gactgggtgacatctaaccacgagtctcttcacatggttctgctgcagttcagtgacttcggcaccatgttcaactggcgctccttgagtgggtatatgggtcatgcctacaagtgggttatgccgaatggctccttcaaatatgtgcacatattcctgtcctcggaccgcggacccaacttcagccagggcgaacaagccaaagacaactccgatctcgaccctgaccatgctacacgggacctgtacgaggccattgaacgaagagactaccccacctggacggccaatgtgcaggtggtggatccggccgaagctcccgatctcggcttcaacattcttgatgtaaccaagcactggaacctgggcacctaccccaaggatcttccaaagatcccttcacgtccattcggaaagttgacgctgaatcgcatcccggataacttcttcgccgaagtcgaacaactggcccttcctccccttccaatatggtgcccggcgtcctgccct

SEQ ID NO: 21444 - DNA, 669 bp, A.fumigatus
  unsure (655): Identity of nucleotide sequences at the above locations are unknown.
tcttttgtaactctctgtaggctctgcacgggtgccatcctcgccttcacgagtatctgctcgaccttcgactcggccgtcttctccagctccaccgggaacgtcgcgcgcgtgttcggcgtcggcgtcgaggtcgccacgctgtcgagttcgctgtatatcctcggctacgcctgcgggccgctgatctgggcgcccttttccgaactgcagggccgccggctgcccatcctcatcggcatgctggggttcgggatcttcaatatcgcggtggccgtcgcaaaggacctccagactttactgatctgccgcttcttctgcggcgtcttcggcagctgcccgctcgccgtcgtggccgccatcttctccgatatcttcgacaaccgctcccgcggcatcgccatcgccatgttctccagcatggtcttcctcggcccgctcctcgccccgtttatcggcgggttcatcaacatgtcctatctgggctggcgctggaccgcctacctccccgccatcatgggcttcgccgccctcatcctcaacttcttcttcctcaaggagtcctacccgcccgtgatcctcatctacaaagccgccgagctccgccgccgcaccaagaactggggcatccacccccatcatgatggaaatctanttccacctgcatga

SEQ ID NO: 21445 - DNA, 435 bp, A.fumigatus
aactctggaggaacttggagctcgaactcgtccctgacgagggtctcgaccgaagccggcgacagcaggttgacccccccatcgccagcgagcacccggaagatccccccccccaacttatccccctgcacactatgtccccccccgtacccctgcggctccccctcccccccacccgcccccccgccccccccactctcccccccgcgcgcccaccgcctcccccacctcccccccccgcccccccccctgatgaccccctcaggaccgcccccctccccccccccctccccccccccccccccccccccccccccccccccccccccccccccccccccccccccccgcgcgcgccccccccccccccccccccccccccccccccccccccccccccccccccccccccccccccccccccccccccccccc

SEQ ID NO: 21446 - DNA, 525 bp, A.fumigatus
aatatcgcgacggaagcgcatatgatatcgtcccgtattcggttcgatggagagcaacttatgtcttggtggcgccccccccttgtagaactctggaggaacttggagctcgaactcgtccctgacgagggtctcgaccgaagccggcgacagcaggttgacccccccatcgccagcgagcacccggaagatccccccccccaacttatccccctgcacactatgtccccccccgtacccctgcggctccccctcccccccacccgcccccccgccccccccactctcccccccgcgcgcccaccgcctcccccacctcccccccccgcccccccccctgatgaccccctcaggaccgcccccctccccccccccctccccccccccccccccccccccccccccccccccccccccccccccccccccccccccccgcgcgcgccccccccccccccccccccccccccccccccccccccccccccccccccccccccccccccccccccccccccccccccc

SEQ ID NO: 21447 - DNA, 759 bp, A.fumigatus
gggggggggggggggggggggggggggggggggggggggggggggggggggggggggggggggggggggggggggggggggcgcgcgcggggggggggggggggggggggggggggggggggggggggggggggggggggggggggggagggggggggggaggggggcggtcctgagggggtcatcaggggggggggcgggggggggaggtgggggaggcggtgggcgcgcgggggggagagtggggggggcgggggggcgggtgggggggagggggagccgcaggggtacggggggggacatagtgtgcagggggataagttggggggggggatcttccgggtgctcgctggcgatgggggggtcaacctgctgtcgccggcttcggtcgagaccctcgtcagggacgagttcgagctccaagttcctccagagttctacaaggggggggcgccaccaagacataagttgctctccatcgaaccgaatacgggacgatatcatatgcgcttccgtcgcgatattctagccgatccgcctagcgacgatccggcggccaatgcagccgttgcggagttgaacgccattctggacaagcaggataccgtgggacagtctttctccgaggatgtcttcaaggagaatgttatccttctgatggacaatgcgcggtttttgcactgccggacgcagattaaggatcccagacggtttctgaggcgcattcggtttaatgggacccctggagcccgcaactag

SEQ ID NO: 21448 - DNA, 528 bp, A.fumigatus
ggggggggggggggggggggggggggggggggggggggggggggggggggggggggggggggggggggggggggggggggcgcgcgcggggggggggggggggggggggggggggggggggggggggggggggggggggggggggggagggggggggggaggggggcggtcctgagggggtcatcaggggggggggcgggggggggaggtgggggaggcggtgggcgcgcgggggggagagtggggggggcgggggggcgggtgggggggagggggagccgcaggggtacggggggggacatagtgtgcagggggataagttggggggggggatcttccgggtgctcgctggcgatgggggggtcaacctgctgtcgccggcttcggtcgagaccctcgtcagggacgagttcgagctccaagttcctccagagttctacaaggggggggcgccaccaagacataagttgctctccatcgaaccgaatacgggacgatatcatatgcgcttccgtcgcgatattctag

SEQ ID NO: 21449 - DNA, 786 bp, A.fumigatus
  unsure (569): Identity of nucleotide sequences at the above locations are unknown.
aaggtacggacctgcctttcccgtcagctactaccccaagataaggatggggatgaagacgaggatgttgatgctaattttatgttcatagaatggaacaaccaagctcaatcgaacagcacccggaaacccatgccggagggcggcttcggtgggttatcaagacgcagcggaaagaaacccgtcatctgcgctgtcaacgggctgtgccttggaggcgggtgcgagatggtcgtcaacgcggatatagtcgtggcgtgtctgcaggcgtactttgggctgccggaggtgcaccgcggagtggttgccatcgcaggggcgttgccgcggttggttcgtacggtgggacggcagcgagcgatggagatggctttgacagggcggaaagtctcggcagaggaagcgaaagactgggggtttgtcaatgacgtggtggatgcggcacaccacgtggtgaaacgggccgtcgagatctccgagctgatcgcggctaataatcccgatgccgtggtggtaaatccggaacgcatcaattttggctgggaagggatctgtgcacaaaatagcantcggttggtcgtccatacctgggccaatatgctatatgagggggaaaatatcaaggaaggtctgcccccctttgttcaaaaaaggaaacccacattgggtggacaccaattttgtaatatgaattctattgcgcccggtttcttccattttatgcctacgaacaacgaacttcctccctacaaactaacaggggaagaaaaaaatttccatccaaaa

SEQ ID NO: 21450 - DNA, 537 bp, A.fumigatus
  unsure (76): Identity of nucleotide sequences at the above locations are unknown.
acaaaggggggcagaccttccttgatattttccccctcatatagcatattggcccaggtatggacgaccaaccgantgctattttgtgcacagatcccttcccagccaaaattgatgcgttccggatttaccaccacggcatcgggattattagccgcgatcagctcggagatctcgacggcccgtttcaccacgtggtgtgccgcatccaccacgtcattgacaaacccccagtctttcgcttcctctgccgagactttccgccctgtcaaagccatctccatcgctcgctgccgtcccaccgtacgaaccaaccgcggcaacgcccctgcgatggcaaccactccgcggtgcacctccggcagcccaaagtacgcctgcagacacgccacgactatatccgcgttgacgaccatctcgcacccgcctccaaggcacagcccgttgacagcgcagatgacgggtttctttccgctgcgtcttgataacccaccgaagccgccctccggcatgggtttccgggtgctgttcgattga

SEQ ID NO: 21451 - DNA, 279 bp, A.fumigatus
actctcctgcccccggtggcaaatcctcttcgcaaattccctccactcggtgtccttcatccacgtctatcgtcccaaattttccaagtgaccattatgcttatgtacccttctgtacgtaagggtctcatcactgaaccaacttctgcaccttttatccaccagcaggaccctgtttgcatacaagacgatctgttcatcccagacttctctcagcaagaccctacactgcagtgtttctacgtcttcaccacggggtgtaaggagggcgttcgataa

SEQ ID NO: 21452 - DNA, 561 bp, A.fumigatus
  unsure (219): Identity of nucleotide sequences at the above locations are unknown.
acattctctgtttcggatccgtcgacgcctgtggagaagacttctagagatctaggtgagaacctcgaggcgaagttctctgacatctttgccctgttcagcaagagcatccgcgaccccgagagcgaggaagtccgggtcaacacccttctggccctgagcaagcttgccatgcaccttgactccgaggaggatgttggccccgttagggcattccangatatcgttccctccatggtcgcagtcctgaaagactcgatcgaccagaagcaggaggaccgtgttatgcaggcctttgaggtcttccagactctccttggctgtgaccctgccctcctgactgtccaccttaaggaccttgttatcttcatgaacgagcttgctgccaacaccgaggtcgacgaggatactcgtactcaagccatcagcttcctgatgcagtgcgttcagtaccgtaagctcaagatccagggcatgcgtattggcgagcagctcacccgcaccgccctgcacatcgtcaccgagctcggtgacacttcctcggacgatgacgatatcact

SEQ ID NO: 21453 - DNA, 192 bp, A.fumigatus
ttggagtgctggagcatttgggatcagaatggatatagcgtctccagtctcggagttttagatctgatggcttatctgcgtgctacggagcgccaggatctgcccgacattaacaatttgggacgccctgcaagtcattttctgattgttggacaaatggggttggatccacgatggacgaagtctggatga

SEQ ID NO: 21454 - DNA, 183 bp, A.fumigatus
caaaacatgttcatcactcgcggaatcccccttgtcaacttcgcagtggcctcctcggcgctcgcgttccaggtcttcgttctctacccatggcataatcaattagatgccgagttcaagtcgctgaaagaggaacatattcgagtgctgaaccgcatgagtcagaggacgatttctcagtga

SEQ ID NO: 21455 - DNA, 534 bp, A.fumigatus
cgcacgtgtatcttccaccgcgtggtgaagaccaccgagcaatgctttcgtttcagcgtgcatcaggtcaaatccgcacaagagatgcgccagataatcggcgaaagtcagacctcgctgaacccggaacatggcccagtctttactgtggatctattccaccatggcggagagcagtcccttctcatgattgggcatcacttggtccttgatcttgtctcgtggcggattatcctggctgatatggaggcgatgattcttgaccctcaacaccagccccatctcacaatgtctttccaaacatgggctcatctgcaggccgagtacggcacacgtcatctggaaccgccacccggtcagcagccctgcagtatcgacgagccctccatgcgacagttctggggggcggagaacaacgcaaacacagggggagactccaagaccaggttgatccgtatgaacgacgacctcacgaggaagctctttggcccatccagccaggctctggacgtcgaaccggttgagctcctccat

SEQ ID NO: 21456 - DNA, 234 bp, A.fumigatus
ataactggcgacgcattcacaggtgtggccttcctccggaacgccatcagcattgggatcccgtttgcgattagtccgtggctagagcgctcaggcgcgcagaatatgttcctcacctacaggtttgtcagcttggcagttacgttgactattattccgatggttctgtatggaaggaagatgcgtatgttgactgcggctcggtaccgggttatggctggtttacgagattag

SEQ ID NO: 21457 - DNA, 837 bp, A.fumigatus
  unsure (489),(595): Identity of nucleotide sequences at the above locations are unknown.
atcgctttgtttcttgacgtggatgcgggtgggtctctctgcctgaggaacaaggcatactctgtagcagagcacatttgctcctcccatccccactattttcatcattgttctccctgcgattcccatctcatccaaacatccacagccgtgtcaactacttccagaatgtcgaatcatcgatccagcgatgctcttacattccccgattcaagtagggcattcctggagccccatctcccgccaaacagtaaaaatttccaatcgccagattctggtctccccttcaccacactcacctttgctacttcactcgactctgctctggccctgtcaccaggcgcaaaaactgtactttcagggccccaatcaaaagcgatgacccactatctccggtcgcgtcatgatgctatcctcatcggggttggcactgcggtggcagatgaccctggcttgaactgccgcatcgccggggttggtggctacggnggtcaaggtctacaaggacaaccccgaccgatcgtcatagaccccagcgcccgttgggacttcaccgagaactccaggattctaacgctggcccgggaaggtcggngtcgagcaccgtttatcctcaccgggacgcagtccattccggcaggagaagaaagctctgctggagagacccggcggcaggttcatctctctcgacgtggtgaacctttgaaacagaggaccgtcccaggaactggaacaaccttgttaaaggccctcaccaaggaaaggatggaaaagggtcatgaatggaggaagggccgaccttatttaacttttttttttgaagcctttcttaccaga

SEQ ID NO: 21458 - DNA, 537 bp, A.fumigatus
cacctcgatgacgtacatcaaaacctcgaagacgatcggcaagatgaagtcaaggattggtttaaggtgcagatggaaaaggcgaagcgcttccagcctctagctgtattgaaccagaaactaaaagggctggacgtttttgaatcgaacgagaaccatcacccgtccgttggtgcaagtcggcccgccggggcccagacgggcaacaacgagccgccgagagtactggaccccgaagacatcattacgaaggatcactggcaagttcgcggattgtatgatacctgtctggagccgtcgtgcggaaaacgcctgaatgccacgaatggctgcgttaactgtcgcaagtgcgggaagctcttctgcgaggagcataccatgtaccagatgaaattgtctagatcggcgcagcatgagcctgtgaggggcttgtggtatcgggtttgtgagacctgctataaatcgagggaagggtataacgaccataatggtaggtgtctagtcttccaccaccgcggctggaaggaaacacgctgc

SEQ ID NO: 21459 - DNA, 480 bp, A.fumigatus
  unsure (459): Identity of nucleotide sequences at the above locations are unknown.
agcagctggtggagatcgatcgtccggcctctgcgaatcgccataattctcgataatgcggccaacatccggcatgctctgcaggtcctggcgctgtctggggcaccccgaacggcgttccaccaaggcgagggaccctttcctccagagaaaatgtccgagtatctccgagaccatccctatggcgactgcaccttgttatattttggtacctgctacggcgcgagcgaagtccgcaaatggaagctcgagaccatccaccgcgagttcatgaaggtccctgtcgcccggcggatcgacccggcgaccctcgcacccagcgactacttctggtctcgcaaccggacctccagcggcgagccggacctcgaagagcttgcgtgggtcaactggtggctgaatgggggccatatcgcgttcagtccggtgcccccgatccgcggattttacccagccganaggcggcaagtacgctgccca

SEQ ID NO: 21460 - DNA, 447 bp, A.fumigatus
  unsure (427): Identity of nucleotide sequences at the above locations are unknown.
tcgtggctggtaagtcacccttgtagcatggccattgaagcttatattgacctgatatgcttcggttacaggaacaccaatggaacgctcaatttccagtcgcgtatccacaagctggccatctctttcaagctggcaccaggtgcatctgctgagaatccctcgaagccgaatctacagctgaagtacctcgacaccattcttctgaccggtcctgatggcgagcccaccacaggcctcgacgcatacgccacggactctgtctcgtaccgcggcttccctcctctccccgcagccacatacactggcgatggcttcggtggcgcacgcaatggagggaagaggatcacgatcgacgctgagggtctcgtcctcgacaaggacggcttcttctgggtctccgacgagtacggtccctacgtctatnaatccaacaagcacggcaag

SEQ ID NO: 21461 - DNA, 243 bp, A.fumigatus
  unsure (152): Identity of nucleotide sequences at the above locations are unknown.
atcaatgatggtttaactcctgatcctcagaacgatatcaacagcaagtatggacagctccctaaagtgaagtcccaaaagagatatcttcatggctttgctcagacgcgggatgtcattcaggcacaaccttatcccgtcggggaagatcnaactaccccaaatttcggtcggctctcgtccgaaaacaagttatttattccttggcttcacaaccaccaaagtgatgttttcaaaatttga

SEQ ID NO: 21462 - DNA, 198 bp, A.fumigatus
atgaacgagcaaacagcgggtcgagagacgcgggttgagatgtgtttaatgtccgtttctgctgacaccgacgcagggattgatgacgcgatctgccgtctgcgtgtggcttatgagatcctttccttgattaatcaaaatatggatcacggcctgatgcttgaattgtacagcttcactgtcgctcggccgatgtga

SEQ ID NO: 21463 - DNA, 864 bp, A.fumigatus
  unsure (850),(851): Identity of nucleotide sequences at the above locations are unknown.
cattttcacattcgggggaggcagcatttcaacggcccgcccttggggcagattctggaatccatatggtgggcgggaccggggaaacttgaatcatggaacgccagcaaaattcgccagaaggcatacattggactgggcgagacaacaggagcgttggaagaaggggccaaggaccagggcatcaatggtacgtcttcagatacatgggaaaatcggattcccgtgagtcgtgtcacaacagatgcggagggaaacacatatccagaaggcggtttagaggcatggttgggggtaattggaagtttcatgggacttttagcgtcccttggtgtggtcaacacaatcggcacattccaggcgtatcttcaggatcatcagctgaaagaatacagccctggcaatgtgggctggatatttggcgtctattcgttcctgaccttcttttgtggagttcaaatcggcccagtattcgatgcgaaagggcctcgttttctcgttcttgccggctctatcttagtcatggtaatgatgattgccctagggttctgcactaaatactggcacttcatgcttgtgattggcattgctggaggaacgggaacctctctcatttttacgccggcgatatccgcagtcggtcatttcttcaacgagaaacgcggcgttgcaactggtcttgctgctactggaggctctgttggtggcatagtcttcccactggtcctggagactctctttcccaagatcggctggacatgggcaacccgtgttattgccttgatttgtttaatcttgttaatcggatcctgcctgctggtcaagtcgcggtcttctccgacggggccgnnaatcagcaagtag

SEQ ID NO: 21464 - DNA, 576 bp, A.fumigatus
ggctggctgcttgcctttgtgctgttcttaacagggggacgagcgaactaccagactgcttcggacgcgttacaagcgcacggggccgactcggcgttgggtagcacgagcacgagctccggcaagcctgtcacgttgcagcaggtgctcggagggcaatggaatcctcggtaccatgcgatcgggtgggttgcagggccgaacaatgaagacgggctgcttgtcgagaagggtggggatgagaagcaggggtacctccgggtggacgatatcaggagtcgaaagggcaataacacggggcgggagagcagggtgctgatgaggaagcccatcgtgcacgtggacgggcaggcgattgttcccagcaacgtctggccgagcccggacttgaagaaagtgctgttgatatccgagcagcagaagaactggcggcactcattcaccgggaagtactgggtgttggacgtggattctcagactgcgcaaccgctggatcctagtgctccggatggtcgagtgcatctacacgccgggctggaaggaaacgcgctcgccaaattcctccccgaaggggag

SEQ ID NO: 21465 - DNA, 258 bp, A.fumigatus
gaggtacttctattagagaaccccaccatgcatgttcagcctccctccgagaccgccgcggtcgacaccacactcctaaaagacgagaccatcaccacgacggtcgtagtacctgatacgcctcctcccccaacccccctaccgctctacttcgcgtacggctccaacctatccttcacacgaatgcgcatccgctgtggagacaaccctgacctctcctcgaagccagttgccatctctcggctggaccactggcgg

SEQ ID NO: 21466 - DNA, 210 bp, A.fumigatus
aaaggaatagactcgaggaatgcctatgctcgtgtcctcatcaacacatatcatattctttccctcaagcaggtctacaccctctccaaagttcaccacaaatggggctcaattgcaacaaccccccgtcgcccttattgttcggcaatatcgagtgctccatcgatttcaacttttgaaggaagtaggcaaggcggatcaactgcctag

SEQ ID NO: 21467 - DNA, 255 bp, A.fumigatus
  unsure (17): Identity of nucleotide sequences at the above locations are unknown.
gtaaacatgactctcancaggctgaaggcctgtcagggtatcactgtctccgacctttcgcctctggattgtgggagatatccatcccaacacgtaacaaatcgtcaacgtcgctcttcactggaatcacagaatgcattcttgatttccaacccagcatccgacactgacctggatctcggaaatctattttttaaaagtttcagccccgctggctggcttggcaattatacttcctacctgttttgccattaa

SEQ ID NO: 21468 - DNA, 597 bp, A.fumigatus
  unsure (62),(571),(572),(573),(574),(575),(576),(577),(578),(579),(580),(581),(582),(583),(584),(585),(586),(587),(588),(589),(590),(591),(592),(593),(594),(595): Identity of nucleotide sequences at the above locations are unknown.
gaatcaaatctcgtgtcgcaagcagacacacccacgcaaaatctcggccgtcccgcgattcnccgaaaacgccgtcctgggcgtccacctaagaatcgtcctcccgactgggatttggcagacggcagtgcgccgccgccagcgcattcgggcacaccggcgaaacgacgacgtggtcgtcctgcggcgagtggtggaagatgggcgcgcaaccggggcccatcgcatgttacacaggtgccgattgacaaggaagggaacatgatggatgtcatcgacgacgaggtagcgcttccgcccgacccagagggcgagaccaaggtcgacaagaacggggttctcaaggatggtcgagaataccgggttcgcacgtttaccattctcaaccgcggagatcggttgtacatgttgtcgacggaaccggcacgctgcattggcttcagggattcgtatctgttcttccagaaacacaagcttctgtacaagatcatcatcgacgatgaggccaaacgagatctcatcgatcgagagattatcccccactcctacaaagggcgtgccatcgtcttcnnnnnnnnnnnnnnnnnnnnnnnnnca

SEQ ID NO: 21469 - DNA, 771 bp, A.fumigatus
  unsure (691): Identity of nucleotide sequences at the above locations are unknown.
gtgaagacggtgtgtcgcatgcattctattgcccttcagctagagaacggtatgcgcatcgttgggctgagcgtgcctcttgctaacgcccgtgacatcggcgagtggattggtgcgaacaagcatacaatttataatttcagccctcacgcccgccctgtgcctctcgagctccatattcagtccttcagcattccccacttcccctcactcatgctggccatggctaaaccggcatatcactcgattttacagttggctccggacaaacctgcgcttgtgtttgttcccaatcgcaagcagacaaggtcaacagctattgatctcttggctgcttgcgctgctgatgataacgaagaccgattccttcacgctgatgtgaatgaacttgcgccactactgaatcggattcaggaacggacgctggcagaatcgctctcccacggcattggatattatcacgaagctcttagcgctactgacaagcgcattgtctcgcatctcttcaccattggtgcgatccaggtcctactagcttcacgcgatgtctgctgggacctgaatctcacggcacatcttgtaatcatcatgggcacacagttctttgaaggccgcgaagcacgttacattgattatcctatcagcgaagtcctgcagatgttcggcaaagctactcgtcctaaggatgacnagaatggccgaggtgttctgatggtaccttcagtcaagcgcgagttattaccaaaaagaagttccttaacgaagctttgg

SEQ ID NO: 21470 - DNA, 192 bp, A.fumigatus
gtcatggtgggaattgcagaggctatcctagactatcagagctattcggggttgcgggccgagaccatggtcatggggaaggcgcagaactcattgcccaatgagaagcctcataagtttgtagctttaataattctgtttttgcttgtggtcgaaaagatcaacaagactctaaagtgctgtgctctgtag

SEQ ID NO: 21471 - DNA, 618 bp, A.fumigatus
  unsure (108),(129): Identity of nucleotide sequences at the above locations are unknown.
acagcaaccttgaaaggccaagatgtagtcgttaacaccgtcggcaccatcccgcgagacatccatctccgattgatcgacgcagccatcgcagcacaggtccggcgnttcatcccgtcagagtttggntcagacacaaccaaccccacggcagccaagctcccagtttaccaggacaaggtcgccatccagaaatatctgcagcagaaagcagccgagtcagcaggctcgttctcgtacacgctcatgatcaatggccccttcctcgactggggtctgacagtcgggttcctgctgaactggcgaggtccagaagtagagctatatgatgagggcgaacgaaagttcagcgcgacgacgctggcaggaatagccaagggggtggtaggcataatcaacaatctggaggccacgacaaatcgcacagtgtacatccgtgaaattgaggtctctcagagcgagctgctgaagctctcgggcaagcagctgcccacaaagtccatcagcacggaagagctggagaaagagggttatgccgagctcgccaaaccgaacccgaaccccagggccgttgcgttgaatttccgtcttcacacacgccgtgaaggtacaacgtca

SEQ ID NO: 21472 - DNA, 594 bp, A.fumigatus
  unsure (218): Identity of nucleotide sequences at the above locations are unknown.
aatgataatcagaaactctggatcaatatggtccccaaggaagtttctgacagtatcgacgatcgcgaaaagaagcgccaggaaatcatcttcgagatcatgtacacagaacgtgattttgtcaaggatctggagtacctgagagatttctggatgagaccattgcgtgcggccggcaacgcaaaccaatcccccatcccggagcatcggcgtgaganattcattcgaacagtgttcggaaattgcttggaagttctgaaagttaatggtgctttgtgtgaagccctcaactccagacaaaaggaaagtcctgtggtgaaaactgttggtgacatattccttcagcatgtacccaactttgaccctttcatcaagtatggtgccaaccagctctacggtaaatatgagtttgagaaggagaaggcatcaaatcctgcttttgcaagattcgtcgaagagactgaacggctcaaggagtcacggaaactggaattaaacggctacttgaccaagcccaccactcgtctggcaagatatccgttgcttctcgcacaggttgtgaagatcgtgcaacagccgcaaaaaagtaatagt

SEQ ID NO: 21473 - DNA, 720 bp, A.fumigatus
  unsure (3),(5),(10),(11),(14),(29): Identity of nucleotide sequences at the above locations are unknown.
aanancgtgnnggngcgtcacccgccaantacacccttaaaggggcccccgcaccaacccatgctcagtggaactccctcacctccgggcagcgcttcgagcgttgatgtcatttcatcccctccttcgccagaggataatccgttcagccccgcccagtcaaccgccaccgatatcacggatgactatggctggcagactccaaccaagggccaagcattgtcgacggcaacagataaggactgcctcgagtcctcccaaagcgaagaagaggacgactccgcgggtgacgatgggggtgacgatgagggtgacgatgagggtgacgatgagggtgacgatgagggtgacgatgggggtgacgatgatcgagcagggcatatcgcatcagccttcaatgctccttcgccgacgaaaccattggaacggtcgaagaaagcaaagagcttgagaccccggatcagcatctcttctctacgctcagaggatgccaccaagtcggtgttaatcaagcgaaaggagagttcaacgtctcctgtcgatacttgtgcatgggttctcgagcaggggaagttctccgagggattaacatggccgtccatactgattggacagaagatacggaaacgatctcgccatatccggctcgagtactggacttccgaacaggcgagcaacatccattccggatttttctgcctaaagggaattggctcctga

SEQ ID NO: 21474 - DNA, 228 bp, A.fumigatus
tgcgatatgccctgctcgatcatcgtcacccccatcgtcaccctcatcgtcaccctcatcgtcaccctcatcgtcaccctcatcgtcacccccatcgtcacccgcggagtcgtcctcttcttcgctttgggaggactcgaggcagtccttatctgttgccgtcgacaatgcttggcccttggttggagtctgccagccatagtcatccgtgatatcggtggcggttga

SEQ ID NO: 21475 - DNA, 618 bp, A.fumigatus
attttggcggtcccggaaaataactggaatccaaaatgggaatttcctcgttccaataaaccttcgaaaggtgctccccgttttcaggagccaattccctttaggcagaaaaatccggaatggatgttgctcgcctgttcggaagtccagtactcgagccggatatggcgagatcgtttccgtatcttctgtccaatcagtatggacggccatgttaatccctcggagaacttcccctgctcgagaacccatgcacaagtatcgacaggagacgttgaactctcctttcgcttgattaacaccgacttggtggcatcctctgagcgtagagaagagatgctgatccggggtctcaagctctttgctttcttcgaccgttccaatggtttcgtcggcgaaggagcattgaaggctgatgcgatatgccctgctcgatcatcgtcacccccatcgtcaccctcatcgtcaccctcatcgtcaccctcatcgtcaccctcatcgtcacccccatcgtcacccgcggagtcgtcctcttcttcgctttgggaggactcgaggcagtccttatctgttgccgtcgacaatgcttggcccttggttggagtctgccagccatag

SEQ ID NO: 21476 - DNA, 783 bp, A.fumigatus
  unsure (106): Identity of nucleotide sequences at the above locations are unknown.
ccaatacctgaacgttggaaattcggaatagttcttcgcatactagcgtccctggcaatagttcatattccagggccgcgtcgggatgtatggtaccatgccgaanatctcttcgtcgtattcttcttctacgggttgtgcacaaccatactatcatatgtggtttccttcgtctcgaagtctcagcttgcagctttcgcaattgcagctggcggacagtgcgtcttgttcttgatttacttcatctcctacatgtcggtattgacatacgcacctacccagaaagtggatgagtaccttgagattacgcactttaccatcggactcattgcgccatccggaaatcttcttcgagcaatgttcacttccctgaatacgttctccatcctatgtcgaggacgagagatcgcctcatacccgggtgagatcactctctacggaggcccaatcctctatctgatctgtcaatcctttttcctgtttggattgctgctttggattgatggagggcctgtgctttccatgatgaggaggaaagtcaagcaggaccacgtggaagagaagaacactgtcgatggagatgttgccgctgaattagcacgagtggaagggtcaaccgacggactacgggttctgcacctgacgaagaaattcaagaagtctgtcgcggttgatgacgtgacattcggggtaccgaaatctcaagtttttgctctcttagggccaaatggagcaggcgaaaacgtcttcaccacaagagggtcgccaggatccgcgctagtt

SEQ ID NO: 21477 - DNA, 255 bp, A.fumigatus
aatgaaacagtctcctccagcctcgccctcttcgccatccacaacctcatccgccgcaacctcaaggcctgcgcagaacacgcaatcacagtgcaaccagcgaacatcgacgccttcgtcacctacgcaaagtacaccctccacgtcctccgcgaccaactcacctccgtcgacgagatctggttccccgtcttcgcggagcacgatccccgcttcctagcacaaaaggacgcacacgatgccctgtaccacaga

SEQ ID NO: 21478 - DNA, 225 bp, A.fumigatus
agcacagacaccagaatgtccggctccaccatgtcgccgtccatcagcacgcaacaagatgaagagaaggccatccaaccccccgttgtctctgacagcccggctctggagtcagctctcccaccagagggcggacttcgaggttggctatgttgcgctggcggctccctaggtctgttcgctacgttgggcttcttgaatgcgttgagtccttccttccgctga

SEQ ID NO: 21479 - DNA, 342 bp, A.fumigatus
aaatcttccggtagaacctgccgtacaaccagcgccttccaacccatcgcgccccgtccttcgctcgactcggccacaccgaccaacccggccgccagccacgctgcgatctcaccaccgcttgggagccgccccagcgcagcgggcgccgtccccgcacgaccggggctttccccgcgcccccgcagctcgacagaaacagatccccagttgggtatgagccagagtcccgggtacacatctggcgactcatacgcacagcggcctcctcaagcccatcctggcgcacgatcaactaccccagcactcccagtcccactcccagtattcaccaccgcagcc

SEQ ID NO: 21480 - DNA, 297 bp, A.fumigatus
ttttggaacggatccagcaagccgggtttgtgcctcgatgcggatatcttcatcgccattgcgtatacctacagcgtgggcgcggttattaccgatttcaccattggaatattgccggtattcatcatctggtcgctgcgcatgaacacccggacgaagatggccattgcaggaattttagggatcggatgcattgccagcgcggcagtcattgttcgaattccgtttgttcacaattacaaggatcccgacttcttttatgcgacctaccaagtgaggcgatcactccgaggctga

SEQ ID NO: 21481 - DNA, 183 bp, A.fumigatus
ggctttcccactctcttccatttaggatcctcgctccattcacccagtgagacctatagctccgcacagctcttacttggggtgaaggacaaggaatcgtcagcctaccttgtatatttttgctctttcatttccacaaactcaacacgctccatctcaccctcagctttccagcaacattaa

SEQ ID NO: 21482 - DNA, 201 bp, A.fumigatus
ataatgttcaggattctatccagggagtttaacgactttctctatctttcttatatgtgttcccagggagaggaggcgggagacggaatatatatcacatgggggttcctttttattaagagcagacaaaagagctacttagccaggatagacccttatcaattatggatgtcttcaacacgcgtcgagatcaacatctca

SEQ ID NO: 21483 - DNA, 465 bp, A.fumigatus
tgcctggacttggatgaccagggtcattgggattaccatggacatacctccggtatcatcttcctgcgacggttgcgcaagcaacttggggcttcagacatgccggtcccgtcgttgcgaacacgggtcctctctcagatgttggagagtcccaagtcgacgtccgagtctccgtcagattccacgctaccccccactcacgatctgccctcccgggatgttgcacagcgtctgtgccaccacgctttgtacgacggctgttctcttatgcggttcgtgcatgagcccagcttctttgccatgctagatcgaatctatgatacccctccggagcagtttggaaacgaagagaattcgttcctgccgcttctgtacattgtcatgtctgttggttgcttgttctcagatgaacgggctggtaccctggatactgcaggttatgaatgcgccattggtcaatggtaa

SEQ ID NO: 21484 - DNA, 477 bp, A.fumigatus
  unsure (3): Identity of nucleotide sequences at the above locations are unknown.
cangccgatctagaggaagaatatggcatggttctttacatcgctgacactaacgtgagctctccatggacgcaaacatgcatcacgcaggccgattgcattcttctggtcggtctggccgaatcatcccccagtattggagagtacgagaggttcctgcttggcatgaagaccacggctcggaaagagctcgtattgttgcatgcggagcggtattgtccgcctggactgactcgacgttggttgaagaaccgagtctggatcaatggcggccaccatcacattcagatggccttccgactgacggccgagcctacgcatccggaaaccaagcgcttcgggacagtcctcaaacaacgggtccaggtgttgcaggctgaaatccaaaagtacacgtcgcggaggattcgccagacacctctgtactctgcccaatccccattcaaaggtgatttccatcgtcttgcgcgtcggctg

SEQ ID NO: 21485 - DNA, 654 bp, A.fumigatus
  unsure (479): Identity of nucleotide sequences at the above locations are unknown.
agacctacgctcttccggcccttacaaatccgcaatgtgacgctcaagaaccgcatcatggtgtcgcccatgtgcatgtactcctgcgagtcggacccgtcgtctccccacgtcggcgccctaacaaactaccacctggcgcatctgggccacctcgccctcaaaggcgcaggcctcgtcttcatcgaagccaccgccgtgcagcccaacgggcgcatctcccccaacgactcgggcctctggcaggacggcaccacctcggaacaattcctggggctgaagcgggtcgtcgagttcatgcacgcgcagggcgccaaggtcgggatccagcttgcgcatgcgggccggaaagcgagtgccgttgcgccgtggctggcggcgcaggcgggcaagtcgagtctgaaggcggatgaaagcgttggcgggtggcccgcggatgtggtgggtccgtcgggcggggaagagcatatctttagtcncgaagaagatgcgtattgggtgccgcgggcgctgagcacggccgaagtccgtgaggtggtggcggcgtttgcgaaaagcgcgcggctagcggtgcaggctggggtggatgttatcgaaatccatggggcgcatggctatctcatcaacgagttcctgagcccggtcacgaaatag

SEQ ID NO: 21486 - DNA, 240 bp, A.fumigatus
  unsure (50),(59),(64),(78),(119),(132),(158),(160),(168),(226): Identity of nucleotide sequences at the above locations are unknown.
gcccggtcacgaaatagcggacggatgagtacggtgggagctttgaaaancggaacccngatcntgcgcaaagttgcngcggctattcgtgccgtgaatcccgaggggaatgccctgtntctgcgtttcaancgcaccgaattggttggagggtcaancnggtggccnccgaatcgggcaactgggatattcaaacctccttggaacctggtcaaaaagctgcccnaaatggggcattga

SEQ ID NO: 21487 - DNA, 450 bp, A.fumigatus
  unsure (7): Identity of nucleotide sequences at the above locations are unknown.
gttttcngggacgcgtgtccttctagcccggcggtgaagacctacgctcttccggcccttacaaatccgcaatgtgacgctcaagaaccgcatcatggtgtcgcccatgtgcatgtactcctgcgagtcggacccgtcgtctccccacgtcggcgccctaacaaactaccacctggcgcatctgggccacctcgccctcaaaggcgcaggcctcgtcttcatcgaagccaccgccgtgcagcccaacgggcgcatctcccccaacgactcgggcctctggcaggacggcaccacctcggaacaattcctggggctgaagcgggtcgtcgagttcatgcacgcgcagggcgccaaggtcgggatccagcttgcgcatgcgggccggaaagcgagtgccgttgcgccgtggctggcggcgcaggcgggcaagtcgagtctgaaggcggatga

SEQ ID NO: 21488 - DNA, 444 bp, A.fumigatus
  unsure (86): Identity of nucleotide sequences at the above locations are unknown.
ccgcgcgcttttcgcaaacgccgccaccacctcacggacttcggccgtgctcagcgcccgcggcacccaatacgcatcttcttcgngactaaagatatgctcttccccgcccgacggacccaccacatccgcgggccacccgccaacgctttcatccgccttcagactcgacttgcccgcctgcgccgccagccacggcgcaacggcactcgctttccggcccgcatgcgcaagctggatcccgaccttggcgccctgcgcgtgcatgaactcgacgacccgcttcagccccaggaattgttccgaggtggtgccgtcctgccagaggcccgagtcgttgggggagatgcgcccgttgggctgcacggcggtggcttcgatgaagacgaggcctgcgcctttgagggcgaggtggcccagatgcgccaggtggtagtttgttag

SEQ ID NO: 21489 - DNA, 486 bp, A.fumigatus
  unsure (136): Identity of nucleotide sequences at the above locations are unknown.
ccatgcgccccatggatttcgataacatccaccccagcctgcaccgctagccgcgcgcttttcgcaaacgccgccaccacctcacggacttcggccgtgctcagcgcccgcggcacccaatacgcatcttcttcgngactaaagatatgctcttccccgcccgacggacccaccacatccgcgggccacccgccaacgctttcatccgccttcagactcgacttgcccgcctgcgccgccagccacggcgcaacggcactcgctttccggcccgcatgcgcaagctggatcccgaccttggcgccctgcgcgtgcatgaactcgacgacccgcttcagccccaggaattgttccgaggtggtgccgtcctgccagaggcccgagtcgttgggggagatgcgcccgttgggctgcacggcggtggcttcgatgaagacgaggcctgcgcctttgagggcgaggtggcccagatgcgccaggtggtag

SEQ ID NO: 21490 - DNA, 783 bp, A.fumigatus
  unsure (92),(98),(104),(157),(769): Identity of nucleotide sequences at the above locations are unknown.
cgggaaggggtcttcgtcgggcccatttgtctcctccctgataggaccaaagcccaaaggaggttggaccgtcggccctttgccaaccccanaggcgngtccgngttcccacttcaacatgttttgaagacatctcttcaatctgctcacgttcgcncagggagctttacgagcttgtcgtccagtgtgcacagcctcagtcatccaccgttacccgtggaccaccgcgaagctatcatggcagccgaaaagaagtccttggagcaacagccctcgtctcctggtttgatgggcccccccttggcgccagcttccgcgtaccgatcaaattccacccagcgcccgctgactccaaacgagtcagggactcaggtttattcctccaagacaagcatttcgcgggcccagatcagacgggaaagtcaagtgtcccgcagatcatccgtttcttcatttgcatcagagcttgaagagcggttcaacattcaagcctattccaatcacatgtccaacggttacgcagcgggaaccgaccctcgcatgatacaggccatcactcagaccatgattggcgagttcctctggaagtatacccgaaggactgtgactggagagacctccaagacaaggcaccgtcgttacttctgggttcatccgtacacccggacgttgtactggagtgaacaggacccgcaaactgctgggaagaatcaattgcggacgaagagtgtgccgatcgatcttaaccgcgggatagaagcaggcgtcnaaaagtcctcgcaa

SEQ ID NO: 21491 - DNA, 549 bp, A.fumigatus
  unsure (1),(5),(30),(101),(143),(171),(194),(200),(201),(206),(234): Identity of nucleotide sequences at the above locations are unknown.
ntttncacgccaaaggggaagaaccccctnttggcgcaccccgcccctcccaagggcgccatcgggactaaaaaccttttgggccccccaaaaccgggaanaaaaacccccttaccccccccgggcccggggggaatttgggngggaaaaccaaaattttccaaaattttncccaaaaacccccccttttcccncggggnntgganaaccccgtccacccgcaaacccatcgcntacaagatcttcaacaacaactgcccccggctgcttgcaaaacctggcagcacagtctacaagcgcgcagggttcgcgcgccatgcgctttgggtcctgccctaccgcgaccacgagatcttccctgcgggacagtacgtgtgccagtcaacgggggaagaaaaccacccgcacaacccgaccatcgtcgactgggcggcgaggaacgagagcatcgagaatacggatatcgtgtgttatatccagtttggactgacgcatttccctcgcacggaggatcttcaccacggggctggaaggacacgcgtacgcgtt

SEQ ID NO: 21492 - DNA, 336 bp, A.fumigatus
  unsure (118),(137): Identity of nucleotide sequences at the above locations are unknown.
agtgtgtattcccaatcaattatacccttattattgatgctcatctctcccagattccctccagttttgcacgaatggtttgtagaaatgtttccagagacgggggcatggtttgcancacggctccgttataccangtcctgtgcagttatgtcaatggtcggatacgtcctggggtatgctgtcctcgattgcagacttcgtatcgtgaattatgtactgacgtcagagtcgcgcagactgggagaccggcatggcgaaaatatcctgtttgaggaaggcacaggtggtgttatacatgttgatttcaattgcctttttgataaggtaaggtga

SEQ ID NO: 21493 - DNA, 192 bp, A.fumigatus
gacggaatgggacccaattcaggtttttggaatgttaagccctgttttaatcagtctcgagcgtttggacaacgcaaagtgtcaccttaccttatcaaaaaggcaattgaaatcaacatgtataacaccacctgtgccttcctcaaacaggatattttcgccatgccggtctcccagtctgcgcgactctga

SEQ ID NO: 21494 - DNA, 285 bp, A.fumigatus
  unsure (258): Identity of nucleotide sequences at the above locations are unknown.
ctagtacaagtaaggaactgcagctggatccaaggtttctcacgaagctctcttagctccgcggttctagagacaaacaatgtaacttgggcggggtgcacatcatgggcagccatgcatgattcaccgccgcttctcaaggcccatacttctcaattccatgcatcacttttcacctttgaacccactcaggttggcattctcttaggtttacccaactactttcctggtgtgggtgtggagggtaagcgtcttcanccacgggagtcgaaggatccgcgctaa

SEQ ID NO: 21495 - DNA, 519 bp, A.fumigatus
  unsure (18): Identity of nucleotide sequences at the above locations are unknown.
cagggacggcacggcatncaggaagacattaagccctttcttacattggcattggatatttgcgagcagacccctggtccagagtcggcccaattgctcgctgatattcactacgggttggcagcagcagcgaatgagaccaatgatggagcggcttgccttagtcataccgagcaattactcaaattgcgtcttgagacaagttcatccaccggcaaaaatgacatccgccttgcaattgcacacaacgagtatggcatagctttggtaatgaacaacgaatatgagaagtctattgcggcgttcaagacttccattgacgtgtatcgtggactacttgactactggccgtcgatggacacaaacccacgcacaaatatgagcttcacattctgggttatgggagacctggaccaagcttggcagactctgcgtgatcttctcagtgaccgggaaacgaaatttggtgtcaatgacagggagtcgtacaagtatgttgactcacatcagcgtttgtag

SEQ ID NO: 21496 - DNA, 375 bp, A.fumigatus
ggagtttctagtacaggtgggtataggcaaacccatttgttctattctaaaattggattcgggaaacccaacctaggcaaggttcccattttcgacgggggtcgtaagaccaaaggtggaggcaagggcgataaacaggagatctggcaattcttgtggatggctaattacccaaggcgggctttgatactggtgagagtgttatctggggccaaatcttggatatccttcaaaatgggccacggtagtaagcaaatgatggcaaagcccggtggaacactctaccagttctgtgcacacgataaatttcatgagtttcgtgtccctacaaacgctgatgtgagtcaacatacttgtacgactccctgtcattga

SEQ ID NO: 21497 - DNA, 195 bp, A.fumigatus
tgtgccgttcccctgccatccaatacaacgccgaaaatcaagaatgaagggcgaaagagaccatacaacgacccaaagtccatacaagtaacctttcatatatgcaataacgttgccttacaaggcgaagctttcgtgtcgtctgacagcatgctatcgtcttacaccgacggggatggaacgtatgcgtcgaac

SEQ ID NO: 21498 - DNA, 534 bp, A.fumigatus
  unsure (9),(10): Identity of nucleotide sequences at the above locations are unknown.
gtgtttcgnnaatggcgcggctccttccagccccgtgtgaagacgaatagcagacggaggggatcctcacctgacacctcaagaactgacaagaatgaaccaaccgctgattctgcaaaggcccgcaagtcccgtgatgatcgccgtttgagtcgcagcagagatcgcgatgatgagcgcagacgacgacgctcaaccaggagtgtcagccgcagtcgcagtcgcagtcgaggccgttctcgcactggcagcgtcagtccgaggcgtgcttctcgcagccgcagccgcagttatgggagagaaaggaagagacgtcgctctattgagagatatgcccctgctgcccgaagacggcgcaacacctcttctgtatctacacatactgagaaacgacagaggatggctgaatccagccaagaaatcccaaagcggtcgtcttcaccggctgagcaggcgagcttcaccgattacgaccccaaaggttctggagaagggggtaactggtttcagatggattttttacccgatgagtaa

SEQ ID NO: 21499 - DNA, 282 bp, A.fumigatus
tgcatcagctcgacgttgaagagagtgtccaccgttgatgcaatctccgcgtccattcccggggaggtcaagttggccgtggcgcatttcaagcgagagttgatcaagttacccttcttgtggtgccggagcatgggctcagtggtgcgggaaagtgagtttgaatgtggtggccattttgccgcgtgggaagtaccagagctactcgctgctgatgtgagaagctttttggggaagggtggccaggcgtatgccgccgtgactggaaagaatggctactaa

SEQ ID NO: 21500 - DNA, 186 bp, A.fumigatus
  unsure (15),(45): Identity of nucleotide sequences at the above locations are unknown.
agcgcatatcttcgnagcgcggtcccttccagtccggtcgtgtanagcgactacccctggacggacgatgagattctcacgtgggtgagcgtctaccagttctcggtcgcgggtcccgcggcttcggttcggatctactacgaggctgcgcagacgccacctgctgatgcatcagctcgacgttga

SEQ ID NO: 21501 - DNA, 753 bp, A.fumigatus
gggcaaggctcaagaatttccgaccattcgggaagatggtatcatggacatcgcccgggtgaaggaaagaatttgatcaaatggaccgatcgtgaatatcggctacatcggaatacatcgtataacgctctagcgaagaatggaggcatgagaatcattcgtcaggaggatggaagtgacaagcaattcttccgtgcaacccgcgaccgcgtgttcaatgtcactgtctgcacgtcagccacaacgagcggcgtatccgaggagcaggcgatcttgggcattggtgtcagcggcacggtctactgggcattgatttcgcgcggcgaaaaggatctgttcgagctggatgctttggagagcgagagcctgatattcccgccgttcccggcttctgatgagaacacttctggtggccagctgaaaacgcgggccaagagaagctctcgtcatcctggcttcttcgccatcgggcgtggcaagaatatctacgttgtctgtccccaggcggctgccaacgcaaactatggtgtctcgggatctcaacgcaccgtcaacacggagaagtttttcaaggaacgggccctcaagatatcaaccggcaaagctggcaaggactttgtgttcagtgacgacgatactgtcgtcgcttctctagacaagaccggcagactacgcttctgggatattcgggaagtggtcaacaatcccgatttcgtcacgaacgtgcctagtctacagaccgggttgaagata

SEQ ID NO: 21502 - DNA, 261 bp, A.fumigatus
  unsure (243): Identity of nucleotide sequences at the above locations are unknown.
ttcaagatgaactcaatacgaacaacctcatttcgctcgcttgtccccctcttccgccgcctcgacactccccgtgctcattccacctcctccgtctccacgaatgaactctcgcatttctctgctctcgccagcagctggtgggatcccgtgggccgctcgcgcatccgccatctcatgaaccccctccgccacgaattcatctcctcttgcctggccgagtccctgacaccgcctcgtctnaacccatccaaccccccc

SEQ ID NO: 21503 - DNA, 213 bp, A.fumigatus
attatctgggctcctcttgattacctttgcagcttcccaggcaaagacatcagaggcaagttgatctcagccttcaaccaatggctccaaatccccgaggacaaactcgacgtcatcaagcgggtggtcggactgctgcattcggcatcgttgctgtatgcacttccctacatgtttgccagcggaataggaagtttacaatcacagaattga

SEQ ID NO: 21504 - DNA, 243 bp, A.fumigatus
gaagtttacaatcacagaattgacgatatccaagactcgtcgaaactcaggcgaggattccccgtcgcgcatagcattttcggtatcgcgcagaccatcaactcggccaattttgcctacttctgggctcaacaggagctcaagatattgggcaagcctgaggctatggtcatctttacggaagagatgttaaagcttcacccgcggccaggggcttggatctctactggcgagaatccttga

SEQ ID NO: 21505 - DNA, 765 bp, A.fumigatus
  unsure (252),(610): Identity of nucleotide sequences at the above locations are unknown.
tacgatcttccgggttgttctggggctattcgtcctgttccaaattggatgtgcgctagctccaaatttccctcgatgatcgtttttcgcttcttttcggggttctttggatctcccacggtcactaactctggcgggtccatcaccgatatctggccgcaggacaaccggtctgtgccactggccctcttctccgcggccagcttcctgggccccgttattgcacccacggtggggggtttcatctgtcantacacatcgtggagatggaatttctgggtggtgctgatcctcagtggtgtctgctacggcgccatgatggtgtttcttcccgagacatattcccacaagctgctgatggacaaaaaacgatgcatgccgggctattccccagccaatcaacccccagtcaaggagatgctgtacacgacgctgacgcggccctggctaatgctcttcacagagcccatcctgtttttgctttccctgtatatggctcttgtctacggtgtcctgtacctggacttcacagcctatccggttgtctaccgggaaacaccaagctggtccgccattattgcagggctttcctttttggggatatgcgtcngcatggccatcgccacccttatctcgccatacgccaatccaatccatggcatctacctgccttccctggggaagtcctccaccccaagggtcgcctccccgcatttgaatgtcatctccctggctaatccccggttaacttggttctgggtttgg

SEQ ID NO: 21506 - DNA, 195 bp, A.fumigatus
acccctgctcctccgggtttagacaaaccccccgcccaattcactgggatttttatcccacccccctttccacaatttaatcaatctacccctatggcccgctttttcccatatgcactttctcataactttaacgacactagtcttcttcctcgtgtccgctttatgcccgttgtcttacccttcccacggtag

SEQ ID NO: 21507 - DNA, 255 bp, A.fumigatus
agcccctcaggctggctggtccaattcctcgtctccgtccgacacggagatcccaagaaagtaggctatgtggcctctgggttctggtcggggttcacactcgggcgggtcctcctcgcagacatcacgcacaagctcggtgagcgtcggatggtgtttttctatattgctctctccatagcgctgcaggtcatgttctggctgataccgaacattatcgcgaacgcagtcaccgtttgtcttatgggtgggtag

SEQ ID NO: 21508 - DNA, 189 bp, A.fumigatus
ccagcacaagctaaagtcctagctagtgcagatagtcccagctccatgcgccaagcctgtttcccaagtcccaaccttccattcatggtggtgtattataaccctgagtctctgttattcatatctattgaagttattaatgcatgctctgcagctcttccagcttatgattatttttgcctgcagtga

SEQ ID NO: 21509 - DNA, 183 bp, A.fumigatus
  unsure (8),(78): Identity of nucleotide sequences at the above locations are unknown.
ctcggttntaggacgattgccacctcacattccgtcccccgtgctagatctctctcatcacccacgtggtctagcctngatgtcttggtcgacgccgtcagcatcactgcattcactggcattttgcgaagcatgaacggccgatcgatgatcatccggcatgtgtgtctatcctggagatag

SEQ ID NO: 21510 - DNA, 819 bp, A.fumigatus
  unsure (18),(201),(219): Identity of nucleotide sequences at the above locations are unknown.
tcaccaggacaagcattntcgactccccgtcaaaagttcattggcgcatcaatcgcattgcgcgctgtgaaactattatacggcgcttggcaagatgctcactcccccatcacatacactgacatcgaatacttcgtcatcaccgacgcagcgcggtacgtctcgcgcggcgcatcgcctaacgctcgtgacatgtaccgntacacgccgttgctcgcntggcttctcctcccgacgacatgggatagcatcccgggttttttagccttcgggaaggcgcagtttgcactcgcggatgttgttgcgggctggctgatcgccaaggtgctggtctcggcgtatgggatgagcccgtcccgtgcgcagaagtacgcgagtgtctggttgctgaaccccatggtcgcgaatatcagtacccgcggcagctcggaggggttactgggggtgctggtagtggggatgttgtgggcggtgctgagccgcagggtgagtcttgcgggggcgattttgggcctgggcgtgcattttaagatctacccgtttatttatgggccggcggtggtttggtggttcgatgcggagagggatggatcgggttccccgcggggtacagctacagcccgagctgcgcgggagaaagacgacgggcaggacgggcagggcatcctgtccaaagcagtcgacttcctcaccccggcccgcatccacctcaccctcgtcgcgctggccaccttctccgccctcaacgtctcgatgtacatcctctacgacctccccttcgcccagaacacctacctccagtcatcacgaccgggctag

SEQ ID NO: 21511 - DNA, 336 bp, A.fumigatus
  unsure (287),(302),(309): Identity of nucleotide sequences at the above locations are unknown.
cctgctcatttcctcttgtgctcgaatccagggcaatccaacgacaaaaagagactaccgaaaccaggaccataccgatttcccaacacagctgtcaccatggccggtggtgctgctaagtaccgtcatctcagccgcaagtcgtcgcatcgacaggccctgctccgaaacttagtcacatcgcttttcaagcacgagtctatcacaacaacctgtgccaaagcgaaagaggctcaacggctggccgagaaactaataaccctgtgcaagaagaatacggatgctantctaataagagcgtngtctgtnttctatgtatgtgctcctactgactct

SEQ ID NO: 21512 - DNA, 192 bp, A.fumigatus
  unsure (192): Identity of nucleotide sequences at the above locations are unknown.
acgcctttgattttgagaagactcatccaacattgcggtagattctataaccagaccagcttctccgggttggaaacacacatcgccaactccttcacgaacgcgctcctccaactgctcaagttcattcttcttgtgcgcaacctgtcttcacacacggcgactgccggatacaagcttacgttacgagan

SEQ ID NO: 21513 - DNA, 642 bp, A.fumigatus
  unsure (320): Identity of nucleotide sequences at the above locations are unknown.
ggaatcctaaagggaattaaccttggttcaagccaaagtatcctttcatggtgggggatggacatttccccatcccggagaagctctgggttattaaggatgcggagtgttccatcccatttatggggctcgcgttttaagattcattttaatgagatgagcaaggagttcgaattggcagatgtcgttcttcgaccgcttccccttgaatgttctccggatacacctttaaatatgattgggatgccatactatcgggaacggttgttgtctgcgtcgcttagtcatctcgtgttcgaagtcggcagtcctcccgcgcntatcgaccagagtctcatcccctatcttcgccctgcggaaatggggcattacgcgccgaatccgaagaagacacggcgttatcaagtcgaaaatacgcgtgcgctgacgaccgccgaaccagctcttatcgctcctaaattcttaagtgaaaaagcaagggagcagagcaaatttaagtcggaagcctccgtgagcgacacggcggaggccctcgcaggcgcgaagctcaatggagaagccgaagacgatcctctactcaagtacagtaatgtcgaaatcaagtacagccggtttggggtggacgactttgattttaggtaa

SEQ ID NO: 21514 - DNA, 231 bp, A.fumigatus
aagaaaaggacagtcagcatcaacatggcaacaaaaacccccgtcctcaccgaaaaagcccccaagcctctcccaggcatctactcgcaggccatcattgccaatggagtggtctattgctctggggcggtcgcgatggatcccgaaacagggaaattgatcgacggcgatgtcaaggcccacacggtactcccatccatttatacctttgtcgtctctctcgtcgagtga

SEQ ID NO: 21515 - DNA, 195 bp, A.fumigatus
  unsure (189): Identity of nucleotide sequences at the above locations are unknown.
ttgaaaaaaatgaaagaatcgttgactcatgtatgttctctagctacaagcaggtcatgcgatgccacattcatcaatcaacccaaatcaaccaacgccattgttgcaatttgtccatatgctcttaagttgtccgtttctcgaaatttagtcttcaccacggggctgagaagggaccgcaccactaangacgcg

SEQ ID NO: 21516 - DNA, 558 bp, A.fumigatus
  unsure (172): Identity of nucleotide sequences at the above locations are unknown.
gcccggatccttccagccccccgtggtgaagacgctcgagcacttggcggcctcctcaacggaaacatcggagttcttcaaacgaccgttgcggagatcgtgactgtcaaggaacatcaaccacgggcttactcgatcatgccatttgtttggtgcttggggtcgatcatangaccagcgatgggtggtgcgttggcacagccctgccagaattatcccggattgttccagcgccatacaatcttcgacagctttccatttctgctgcccaaccttgtctgtgttgtcgtcctggtctttggggttatcgtcggcttcttgtttcttgaggagactcatccggaaaaacgataccgccgtgaccctggtctcgagctgggcaattggctcatcgcccgttgctcgggctcccgtgtgcaactgacagaggatgacacagacatccaagtggatgccaacgaaactgactatttcaactacggcgatgtccctccaccagagtacagaagcaccgaaacctcgcctcaactagccgcgatcaagaatgtgggcgctcta

SEQ ID NO: 21517 - DNA, 591 bp, A.fumigatus
cgcggaattttcgagccccgtggtgaagaagtcccctcagtccccttgacgaccgatctctccaccccggtctcacccgtggtctcgcttttctccgccaaaggtcatacgcgtgtctccagctccgtctcctccctggtctcgtccactggtcagggtaattccatggagagctcaaggaatgccctgacaggactgaaggaggaacctcgccaagccagggatctggaggaggagtatttccgtacgtccttccctcccaccaaaccttttgctctgcctttgcatactaattacttctctgcagaacattttgaccaaggcatgtctgttgtgaacgacacgtactttcgaccttcggccgattaccccgaatcttacgacctgaacgacgccggcatggacaacccccattccaccaagaaaagacgcgccgacagtctctccggtaatggcctgtcgcgcattagttcgcgcatttccaccatttccactcgctggaggtctaaccgcgtgtcgggcggccccgatgccgtggacgccatcggatccagtctaaggtcgcgaacaaattccgtctcgtccgtccgt

SEQ ID NO: 21518 - DNA, 231 bp, A.fumigatus
  unsure (95),(104),(108): Identity of nucleotide sequences at the above locations are unknown.
accaagtggaattggaaaatgattcttcccaaggttgcggaacccaccaacttccttgtttattttcagggtaacggggcgttgccgttccatgntatattttntttnttctcgccttatttttttttcccaactgtattagaacggctttctgttccctcacaatctcttcactccggcgctcagagtatctatctttttgcattattccgtgagttgggaccggcatga

SEQ ID NO: 21519 - DNA, 456 bp, A.fumigatus
acgcctcgtcgacggtatgttcctttcttctccaacagtccatatctgacatgctccctaggcgggcaatcagtccaagatggttcgcccagtggacactttctctcccgcggtagacaggctagcagatacggcaaaggggaggatgtcaatgccgtgtttctgaaaagattggatcatgcactgcgagacggtgatccaattcgtgccatcatccggggctgggcttcgaataacgatggaacaaggtctccaccaatgtgcccaggtccggattctcaggctgcctgtatccgttccgcatatgcgatggcaaatcttcaagattttgagacaaccgcttatatccagtgtcatggaatggaatcaaccgttcgtatcccgtttgaccctgccgttgtgttttaccattttcaccaactaaacgtatatcaggtgggacaacccctggattaa

SEQ ID NO: 21520 - DNA, 300 bp, A.fumigatus
  unsure (8): Identity of nucleotide sequences at the above locations are unknown.
caacatgntaatggcccacagggcaaaaccattgaggggaagctctcatctgtccccaagttctcctgcggccaagacaaaaaggggttctccattagcaagctgcacctctccacctccaaggagaccgaggtgcacatcgtctatggcatgcccgatggttccacctgccgtaacattgcttcttgctcgcccgacggtacccaggtcaccaatgaccagtgtggtggtgccacctccgtgagcttcgagccccccgagggctcggaggtcttaaccaggcggtggaaggacaacgct

SEQ ID NO: 21521 - DNA, 441 bp, A.fumigatus
  unsure (205): Identity of nucleotide sequences at the above locations are unknown.
tactccaaccctgagaacacagacaacgagtgcactgatcatcagaaaggtggttgggactggtctgatctttcttccggatctttctcctcgtatggaggcttcgatttctcgggtttcaagtgcagtgacagcaccggttgggggaaacgtaccttcgtaagtcggctcaatcttctccttcctcatcacaatagcaacatgntaatggcccacagggcaaaaccattgaggggaagctctcatctgtccccaagttctcctgcggccaagacaaaaaggggttctccattagcaagctgcacctctccacctccaaggagaccgaggtgcacatcgtctatggcatgcccgatggttccacctgccgtaacattgcttcttgctcgcccgacggtacccaggtcaccaatgaccagtgtggtggtgccacctccgtga

SEQ ID NO: 21522 - DNA, 243 bp, A.fumigatus
acgatgcggggatctgaggcatcggggcctggtgctatcttcggcgctccctcgactctcaccacttccgtgataaggaacccgacatcgttcctatcaagctcgactcctctcccgtctacagacgcagatgtcatcgcccaaaatgtcgaacatgtcctgttgtctttaacgtcgcacaacgatggcggcctggttggcgtccagtggcaactcagtctcaccacgggtggagatccgcgt

SEQ ID NO: 21523 - DNA, 285 bp, A.fumigatus
ctaccagagtcagccatcatggcgagcaactcatacaaggcgcttcgatcacaatatcaagccgcgttgaagcgcttcatcaattcttccaagaacctcgatatacttaattccgtcccgttgaaccaccaacaataccaaaaacaggcttcgcaggccccatacatactctatgtcctggactcgtcatgcaaccctccaactcttgctcatttgaggatcgcaatctcaaccctttctggaaaaacccagtgttccctcccggctgctgctactcctccctaa

SEQ ID NO: 21524 - DNA, 405 bp, A.fumigatus
  unsure (51): Identity of nucleotide sequences at the above locations are unknown.
ttcatgtcgatggtcgacatcttcgactacctgccccgatctcaccccggntatgagaagaacctgcggcgtttccagtccctggcaaaagccttcaagaagacgcaggacaagtccggtggatggtggctcatcatggatggggagtacccgcgcgatccccgcaaatacatcgagagcagcggcaccgccatgtttgcttatggactcctcaagggcgttcgcaagggctatatccgctccaaggactatttggctcccgcgacgaaggcgtacaacctcatggtggacaagttcgtggagacgaatgcggacggcacgctgaattggcttggcacagtgcaggttggcagtctgagcagcaatggcaccttcgaggtgagtatgaacctatacctaacctga

SEQ ID NO: 21525 - DNA, 639 bp, A.fumigatus
  unsure (412),(479): Identity of nucleotide sequences at the above locations are unknown.
catctcctaggtggtggtgcctggctcggaggccagcttttctctgccatggtcctccgtcgccctgccgaggttttcctcaacgagatcggcgtgcccttcgaagaggaccctgcaaaccccaacttcgtcgtcgtcaagcacgcctccctcttcacctctaccttgatgtccaaggtcctctccttccccaacgtcaagctcttcaacgccactgccgtcgaggacctggtcacccgtccctccgctagcggtgatgccaaggacacccagattgccggtgtggttgtcaactggaccctcgttactcttcaccacgacgaccactcttgcatggaccccaacaccatcaatgcgcccgtggtcatcagcacgaccggccacgatggcccctttggtgctttctgcgcanagagactcgtgtcgatgaacaccgttgacaagctcggtggcatgcgcggtcttgacatgaactccgncgaggacgctattgtcaagaatacccgtgaggtcgccaagggtctgatcatcggtggaatggagctgtctgagatcgacggcttaaacgtatggggcccaactttggcgccatggggcctaacggtggtcaagcttccgaagagccctttaaggtcttga

SEQ ID NO: 21526 - DNA, 522 bp, A.fumigatus
  unsure (2),(3),(4),(5),(6),(7),(8),(9),(10),(11),(12),(13),(14),(15),(16),(17),(18),(19),(20),(21),(22),(23),(24),(25),(26),(27),(28),(29),(30),(31),(32),(33),(34),(35): Identity of nucleotide sequences at the above locations are unknown.
annnnnnnnnnnnnnnnnnnnnnnnnnnnnnnnnngaagacgtttgctccgatcagggagagccaggtctctcgtgctatgaccagacgttactttcaggatctggacaagtatgccgagagcgacattgtcatcgtcggtgctggctcctgtggtctgagcactgcgtacgtgcttgccaaggctcgtccggacttgaagattgccatcatcgaggcctcggtctctcccggtcagttttcactccataaaccatccgcttcgaagctaacatctcctaggtggtggtgcctggctcggaggccagcttttctctgccatggtcctccgtcgccctgccgaggttttcctcaacgagatcggcgtgcccttcgaagaggaccctgcaaaccccaacttcgtcgtcgtcaagcacgcctccctcttcacctctaccttgatgtccaaggtcctctccttccccaacgtcaagctcttcaacgccactgccgtcgaggacctggtcacccgtccctccgctag

SEQ ID NO: 21527 - DNA, 297 bp, A.fumigatus
  unsure (4),(17),(22),(24),(27),(28),(58),(81): Identity of nucleotide sequences at the above locations are unknown.
ggcnccaaattccaagngaggnanttnnacaagaaccgcgcgatcgtggaggagatcnagaagctcgctgctcgggagaantgcacaaccagccagattgcgctggcctggttcccggcgcagggtttcattgctatccccggtacgaccaaggctaagcggctagaggagaactgggcgtccagggagattgaattgaccgaggaggagaagcaggagatgcggagaattattgatgtggcaaagccccacgggaataggtacgggcctgagaatcaggctttggtgggacattga

SEQ ID NO: 21528 - DNA, 210 bp, A.fumigatus
ctcgtctctgctgcttatttggccttgttttttttcaacggatacaattactatgttcttcctgcggagtacagtgatcgcgactctgtgttgctttggaacttccgtgctggcctcttcctggccttcatctatccaggggcaaccgctgccagacaaatggtttcaaataaacctcgatcaactggagaccaccctaagcgaaactga

SEQ ID NO: 21529 - DNA, 330 bp, A.fumigatus
cacacgatcgggcggtcgatggactccatcctggtcgtctctagcccccaggaggcgtccgcaccatctcttgctccatcgtgtgtcttgtgtctccccctctttgaacgcttccccatccccttaccccccagcccgaagagaagaggggttgatttcgctcacacaaaactcccgcaccccttaacgtaccgtgccactcaccaatcctatggtccatgtttcaccttatctctgacctcttatacttttaactctcgtttcctcgatgccgactttaggaggtctcttgaagaaacggcggacaaaggattcgcataccctctctaa

SEQ ID NO: 21530 - DNA, 372 bp, A.fumigatus
caatgtacaggtgacctggtaggcttgggtacgaatggcatggatgtgctgtgccggtgggacaagtcgatgagaccagctattgactctatacgcgccgccatcagctccttcgactactacgatagtaacggtgagctcagagactgccttccatatgctccaggtgaccttctcaacgttgaagtggtgcagatgtcgggacttattgacctgctgtatgggaaggctaaagattgcggcattgatcttcgattcggagccatcgtctgtgattactgggagtccgagggaaacgcgggaatcgtgttggagaatggacacaaggtagctgctgactgcgtgattgctgctgatggatggggtacatag

SEQ ID NO: 21531 - DNA, 336 bp, A.fumigatus
  unsure (324): Identity of nucleotide sequences at the above locations are unknown.
ttgctgctgatggatggggtacatagcaaagctacaggtaccatcaccggaaaagatgtggccccctactcgactggtgctgccatatatcgatcacattttgatgcacgcgagattagggatgacccagaggcaaattggatccttgacagcacaggtcgggcagaccacgctaacatgtacctcggaaaggatactattcttttggtgggtaccgtcggaaagggtaaaaatgtgtcttgggatatgccacacaaagtgagcagttcccttgcttttcccttcttggaaggttcttacaccacggcccgctggaaggtccgncacttggcgtat

SEQ ID NO: 21532 - DNA, 501 bp, A.fumigatus
tacgtcttgttctttccatctttattcgggggtccgtctttcgaatatgtggactataggcggtggcttgatacgacgcttttcgaggtgccgcccggaactgatccgtccaaggtgcctccaacccggaagaagcgcaaaattccccgtagcggcacgcctgcgaccaagaaagctttgatgggtttggtatggatctttgtgttcttgcaattgggctctctctacaataaggagtcggtgcttggagagtccttcctgagctattcatttcttcgacgagtctggattctttatatgctcggattcaccacacgaacgaaatattacggtgtatggtctcttaccgaaggtgcctgtattctatctggactcggatacaatggctttgatcctaagacaggcaaggtcttctggaaccgcttggagaacattgacccctggagccttgagacggcccaaaagtcttcaccacgagtagccaatccgcgtatatcccat

SEQ ID NO: 21533 - DNA, 477 bp, A.fumigatus
cgacgtaggatcttccagccccgtggtgaagaatcctctccctcaccagatcaatcaccaccacctcgtcctacaaagccatcaccaccaacaacagcaacaacccagcaacccggacagctcccaagcctcctattgtctccacgcccaccctaccagcaaaaccatccaccgcctccacctccactgcgcccgcacccacaaccgacgaccgcgccgcccgtatcctcgctccaacacccacccaccaaactacaagcaacatctccaaaaccggcctcgccgacgcccctctctcgccggactcgccccctgaagaaaaaatcgactggacgcgctccttccacgggctctccgccgcgccattccccaaggaagtatccgatatcctcctcgcggaagtcgaccccgaataagtcgagatcaagcccgatggcatcctgtacctccccgagatcaagtaccggcggatcttga

SEQ ID NO: 21534 - DNA, 327 bp, A.fumigatus
  unsure (16),(160),(179),(227): Identity of nucleotide sequences at the above locations are unknown.
tgggtgtacaggttantgtctgtcgcgcggggcgagcaggattacttcacgccggatgggatcccgacagcaacggaagggtgtcggtctaatgcgctggtgcgctgctgcaaggatctgggggattgcaaacgaactgtggggaatcgcggttggaatnctgcagttccaaggcgcantaataccccggcacggtgtttgttcaacaatgttgttgaacaaaaacncggaacaagaatctgggttacccagggaagaatacggtttctaatccgttggaaggaaattgggaacaaattattggaaccgatgtttcccgggggttaa

SEQ ID NO: 21535 - DNA, 387 bp, A.fumigatus
agaatcctctccctcaccagatcaatcaccaccacctcgtcctacaaagccatcaccaccaacaacagcaacaacccagcaacccggacagctcccaagcctcctattgtctccacgcccaccctaccagcaaaaccatccaccgcctccacctccactgcgcccgcacccacaaccgacgaccgcgccgcccgtatcctcgctccaacacccacccaccaaactacaagcaacatctccaaaaccggcctcgccgacgcccctctctcgccggactcgccccctgaagaaaaaatcgactggacgcgctccttccacgggctctccgccgcgccattccccaaggaagtatccgatatcctcctcgcggaagtcgaccccgaataa

SEQ ID NO: 21536 - DNA, 324 bp, A.fumigatus
  unsure (224),(248): Identity of nucleotide sequences at the above locations are unknown.
gtcgagatcaagcccgatggcatcctgtacctccccgagatcaagtaccggcggatcttgaaccgggcgtttgggccaaggggttggggcctcgtgccgcggagcgagagtattgttacgccgcgtacggtgaacaaggagtatgctttggtttgtaatgggcggtatgtattttttgcttcgcttttgctttgggacgggagagtatggggagatacaaatanggggctaatgggtgtacaggttantgtctgtcgcgcggggcgagcaggattacttcacgccggatgggatcccgacagcaacggaagggtgtcggtctaa

SEQ ID NO: 21537 - DNA, 492 bp, A.fumigatus
  unsure (5): Identity of nucleotide sequences at the above locations are unknown.
ccccntatttgtatctccccatactctcccgtcccaaagcaaaagcgaagcaaaaaatacataccgcccattacaaaccaaagcatactccttgttcaccgtacgcggcgtaacaatactctcgctccgcggcacgaggccccaaccccttggcccaaacgcccggttcaagatccgccggtacttgatctcggggaggtacaggatgccatcgggcttgatctcgacttattcggggtcgacttccgcgaggaggatatcggatacttccttggggaatggcgcggcggagagcccgtggaaggagcgcgtccagtcgattttttcttcagggggcgagtccggcgagagaggggcgtcggcgaggccggttttggagatgttgcttgtagtttggtgggtgggtgttggagcgaggatacgggcggcgcggtcgtcggttgtgggtgcgggcgcagtggaggtggaggcggtggatggttttgctggtag

SEQ ID NO: 21538 - DNA, 522 bp, A.fumigatus
  unsure (512): Identity of nucleotide sequences at the above locations are unknown.
ccaatggcatggcaggagatccgccgctggcgctccatgaaggagcgttcgcaactcgtcaggaaggaagcgcatgaccccatggatgtagtctacattgtgtcccggccgtacactgccgcagccggcatcaaagccgcgagtagattcagccacagccgcaggcagatccttgtacgctgggcgattgcttatgcaacaacacccgcagcgttgttggtcctctgtctcggagtagccggattactgtcttgtctgtgtcaatacctgattctgcaagctgtcgagaagaccgtgcccgagctgtcgacgcaagttggcgcgtttgccgacaaggtcgtcgacagcgtacagaatgcctcagcggagtgggccaacgacgccaacggagtgattggacacatgaaccaagacttgaatgagaacgtctttggctgggtcaacaccagcacgaccgctttaaacgatacggtccacaccttcgtcgttttggaacaggccgctggcaagancactgtcagg

SEQ ID NO: 21539 - DNA, 792 bp, A.fumigatus
  unsure (688),(718),(749),(766),(781): Identity of nucleotide sequences at the above locations are unknown.
attttcgggggcggacatatatcttccagccgtcggctgatgacagctcaatgggtctgggattgcatcaatgagggcaggcttgtccgtcctgatttgtatgcaccgggtgccacccttccgcctcacttgagcccttgggtcaagccctctagaggcggctacgatcctaaagccagcctggccgagcaggaagaggaaggcgaggccgagttagacgaggacagtgacgaggagatggaagaagcgaccagcgataagaaggccgaaggtaaggcagatgttggatcggaaagtgaagatgaggatgagtctgttgacggcggcatggatgttgccggtaccgatgatgatgagagcgagagtgaagatgaagaggaagactttgatggatttgaagaagaggctgcttccgaatcagaagacgaagaggaagcggctcgcacccagcaccagaaggagctcgaggctgaaactgctggtcttccattctcttccaacggggctactatcgacggatccaagaaaaaagcttcccaggctaagaagatcgctgccaagaagcgcaaggaggaggaagagctggagagacagaagatgatgatgagtcgcaagaaacgcaagttgcttgagaagatgatttactcgaacaagaagcagtctgaggaagcggcgaaactgcgatctnagagaagaaagcttgagaatgggggcggcnaaatgagctcatatagaataaaagttagcancatgcttttgggcgacnagaatgatatccttnttctgggaatt

SEQ ID NO: 21540 - DNA, 204 bp, A.fumigatus
ttcggaagcagcctcttcttcaaatccatcaaagtcttcctcttcatcttcactctcgctctcatcatcatcggtaccggcaacatccatgccgccgtcaacagactcatcctcatcttcactttccgatccaacatctgccttaccttcggccttcttatcgctggtcgcttcttccatctcctcgtcactgtcctcgtctaa

SEQ ID NO: 21541 - DNA, 480 bp, A.fumigatus
atcatcttctcaagcaacttgcgtttcttgcgactcatcatcatcttctgtctctccagctcttcctcctccttgcgcttcttggcagcgatcttcttagcctgggaagcttttttcttggatccgtcgatagtagccccgttggaagagaatggaagaccagcagtttcagcctcgagctccttctggtgctgggtgcgagccgcttcctcttcgtcttctgattcggaagcagcctcttcttcaaatccatcaaagtcttcctcttcatcttcactctcgctctcatcatcatcggtaccggcaacatccatgccgccgtcaacagactcatcctcatcttcactttccgatccaacatctgccttaccttcggccttcttatcgctggtcgcttcttccatctcctcgtcactgtcctcgtctaactcggcctcgccttcctcttcctgctcggccaggctggctttaggatcgtag

SEQ ID NO: 21542 - DNA, 291 bp, A.fumigatus
  unsure (92): Identity of nucleotide sequences at the above locations are unknown.
tggctgttctgggatacagagagattggcacggttgccattgaggtctcctattaactgggcgtccaccaaggggtactgtgttcggctcancagctgggtgccgttccccccacaatcattgtcgctatcgccttgcccaagagatatcgtatacgcattcaccgtgccattcccactcgtaacattggccccccaaggcgttgtagcatccttggacagtccgaccaacgggagcacccaacgatcggggcttgtgaccgggacgggcgcagactcggatggcggataa

SEQ ID NO: 21543 - DNA, 687 bp, A.fumigatus
  unsure (286),(601): Identity of nucleotide sequences at the above locations are unknown.
caaatcctcgcaagtccggctcgcagtactgcgcatgatgaaccaagagcaaccacaacagtgatcgttccagccactaaaatttattatccgccatccgagtctgcgcccgtcccggtcacaagccccgatcgttgggtgctcccgttggtcggactgtccaaggatgctacaacgccttggggggccaatgttacgagtgggaatggcacggtgaatgcgtatacgatatctcttgggcaaggcgatagcgacaatgattgtggggggaacggcacccagctgntgagccgaacacagtaccccttggtggacgcccagttaataggagacctcaatggcaaccgtgccaatctctctgtatcccagaacagccatcacatactcaacctggggaacgactctcacctgaccgtaaccaccagcagtgatgacgaggattttcccatcagcacagttccctttggcttgaacctcggccataaaggcgaatggaatggttcacttgcactaggcgggctctacgacgccaatcggctcaccgatgatgcgacatcctggatctccatcgcagagaccatgaacaacaatggcacctttntgcagaccggcaagcagaccctctcccgccgtcgtcttccaccacggcggctggaaggaaccgcacttggcgttaaacgagcgcgc

SEQ ID NO: 21544 - DNA, 390 bp, A.fumigatus
  unsure (140),(303),(330): Identity of nucleotide sequences at the above locations are unknown.
tacaggatacacagcatactactatacagggtaccgagtactaaatatccatgtgatgatgtgactgagacaatttctcctgctcatgttgcaagaagccctcggggaatctatgtaggtttactattggccgtcctatntcccacagtccagcttttggttgtcaaccacctcatgatcgaccactaccccgattttgtggatgtttgtgcaacgtggcttgtcgagcacgagctctcaatatcttcagcgatcgcagtgcagatgcaggattccattggatcttctctgtcggtcaatatntcagctaaactggcaagaatgatgtancagcataagcggtcatattccaaggatatgaattcagggctttgggctctcaaaacactg

SEQ ID NO: 21545 - DNA, 195 bp, A.fumigatus
  unsure (128): Identity of nucleotide sequences at the above locations are unknown.
ctagtgtggagcatggcgagaagctctggaggggagctattgacacctgaaatcaatgctgtgcctcaggcattcagcaaagctctctccgccgaatggcaaatcgaaggccactgctgtcaaattgntagcctgaccatcgactctcattctcgccatctgcacctttcaggtacagtcgctttccttgtatga

SEQ ID NO: 21546 - DNA, 216 bp, A.fumigatus
agactaccgccgaaacgaccgtaccgtcgaacgcggagcttcagcggctcagaatctccggatgaactggccgtcgatgccgacgtctactggcggtcgcgcaaccgcggacgcagcccgtcgcactccgaaaccagcgcccaggagcagctgtcggagcgctatcaggatgacgagcatgaggcacatgacgaggagagtacgcaggacgtatag

SEQ ID NO: 21547 - DNA, 534 bp, A.fumigatus
cgtatgtatacctacgctgtgactgtgccaatatcatccttgtttgagcgcgaattggacattgaggatctggaatccaccgccgatgcctttgagctcaaggtggatatagcggaaggtgcttccgacggccagggcattgactcggctctggcagacagaattagtcaagctgtggcgactatccggcgaaacatcgtcattcccctgatataccatgtcgaaagtagcttaacccctgtaggttctcctgtgcaacacaacgggcccttacgccgctcggatgatgcatacctgagtctgatcaaacacgggttacggctagctcctgagtacttgactgtcgatctctcctacagcgatgatattttatcacaggtcattgcttccaaggggacgagcaaagtgatcgggcatttcgcgtggtcccatccgtgcccaaagggttgggaggatgcggaaccactggcaatgtatgaacgagccagacgactaggtcatcagccgccggatggaagatcagcctcgagagaa

SEQ ID NO: 21548 - DNA, 252 bp, A.fumigatus
  unsure (239): Identity of nucleotide sequences at the above locations are unknown.
agagtcaatactacttcgtactccgcgcctttgttttgcatgagaaacgcaatctcgctcatagaggcccccatcaatcactccaccgaactgagggcgaggcgaaccgatgttttcttcttctgtatacttgcatatatagatattctgaccaatgggattaggggtatgctcactgtcctagacaacccacaatatgtgaacgtgacagtcttctaccacaaagggccgaaggaccngcgctatgcgtat

SEQ ID NO: 21549 - DNA, 207 bp, A.fumigatus
agcaccgacaacatgtcatcgactgatgagaagcacggcatctcggtagagcatggctcacctggctccgataccgacaacaagcctgccgggcttgttggtcaaggcgaggcggccaaggtcggaggtgcgaagacaaggaaggttttcaacgttagttacctccgcagtcggccatcaacacgcatcttgaacgacatgtgttga

SEQ ID NO: 21550 - DNA, 189 bp, A.fumigatus
catgacaacccctggagcttcgtctctttctgcctcattccccgcctgccagctactaagcttttaattctatataagtccgcccacttccagctgtcatacagttatcaacgaacattatgcctctggaaaggggtgttgtgtgaagtggatatttactatatctcgcaacatccacaagtattatag

SEQ ID NO: 21551 - DNA, 393 bp, A.fumigatus
gacgaccggggcgtgcgggcgggttatatctttaccgcttgtataccgactaccatcgcttcaaatgtcgtgatgacccgatcagccggtggagatgatgcagctgctttagttgaggttgtcattgccaatttcctaggtccgttcatcacggccggttggactgtcactttgctacccactaccgctgaattcgatccgtggaggcaagcgaacggagatttaagtgagatgtacaaggatgtattcaaacagttaggcctcagcgcacttttgcccctagtaataggacagctggtgcgttgggcctggccagagcagacggaacgagtgatgcagacgtatcggatcgcgaagcttggatccgcttgtttactgctgattgtttggtaa

SEQ ID NO: 21552 - DNA, 339 bp, A.fumigatus
tttccgtcatattataatcaggttgttgcgatcgtgcagtccacattgatcttcgtggctgtctctgaaggattcggaacctcgatcgacctgctggtgcaagagcaaatcaatagaatccaaacagtaagacagcctgcaagctacacggctcgagactcaaccctcacaagcatacagttggtcacaatcagcgacatcctctacctaatcaccatctacgtctccaaatgctgcgtcgtgggcatctacctccggctgacgcctcaaaaaactcacaaccgaatctcctgggcaactctcatcctatgcacattatggatcatcccaagcgcactc

SEQ ID NO: 21553 - DNA, 519 bp, A.fumigatus
gggcttcgagcgcgtatcttctatgcccgtcggtgtaacacgaatccatttctcgaaaccaaggaggattcgacgctgaatcctctcagccccaatttcaaagctaagaactggatgaagaatctgctcgccctttcatcccgggatcctgaacggtatcccaagcgtgtggcgggtgttgctttcaaaaatctcagtgtccatggatatggtagcccgaccgattatcagaaggatgtgttcaactcggtcttggaagttggtactcttgtccgccggatcatgggtactggcaagcagaagatccaaatcctgcgggatttcgatggccttgtcaagagcggcgaaatgctggtcgttctgggccgtcctggaagcgggtgctcgactctcctcaagaccatctccggcgaaatgaacggtatctacatggatgagaattcgtacttgaactatcatggtatctcgtccaagtatattgtcaagcaattccgcgggggaggctatcttcactgctga

SEQ ID NO: 21554 - DNA, 213 bp, A.fumigatus
aggttcaaggacaatcaaaatggcgaacaacagattgcaatacgtgagtttcttatgctggtatataacttctacttggatgaaatactgattctctttttattacacagcggagacggaacccgtacgtttgaaattccctcccagaagtgcacaatcctatgcccctgcgtcgctttaatcatcggtttttttttcgctttagttcagtga

SEQ ID NO: 21555 - DNA, 189 bp, A.fumigatus
atcgcggttgtctcctttatacacatatatttgatctactatgtcgttctacagggtttctgtccatccttcggtgacatcatccgccacgatgttgagatgcacgagcagaccattcaatacacaatgcgcccaagctctcaggagtttctcctcatttggaaatacataccggtcatcaaagcgtga

SEQ ID NO: 21556 - DNA, 465 bp, A.fumigatus
ctaactgtttcagttacagttatgaccctcactgggctcacaattaaaggaaggtgcgtagaacttgaggtaagtatatcctcacagcgagggtggggaactgaagaagaaacagaagcagcagaagaagttgagacagtagcagaagcagtagtagaagtagaagcagtagtagaagcagtagaagcagtagaagtagtagaagtagtagaagtagtagaagtagtagaagtagtagaagtagtagaagtagtagaagtagtagaagtagtagaagtagtagaagtagtagaagtagtagaagtagtagaagtagtagaagtagtagaagtagtagaagtagtagaagtagtacaagtagtagaagtagtagaagtagtagaagtagtaaaaatagtagaagcagtagaagcagtacaagtagtagaagccgtagtaaaagcagtagtagaagcagttatacaa

SEQ ID NO: 21557 - DNA, 414 bp, A.fumigatus
ctgcttctactactgcttttactacggcttctactacttgtactgcttctactgcttctactatttttactacttctactacttctactacttctactacttgtactacttctactacttctactacttctactacttctactacttctactacttctactacttctactacttctactacttctactacttctactacttctactacttctactacttctactacttctactacttctactacttctactacttctactacttctactgcttctactgcttctactactgcttctacttctactactgcttctgctactgtctcaacttcttctgctgcttctgtttcttcttcagttccccaccctcgctgtgaggatatacttacctcaagttctacgcaccttcctttaa

SEQ ID NO: 21558 - DNA, 384 bp, A.fumigatus
ttgtataactgcttctactactgcttttactacggcttctactacttgtactgcttctactgcttctactatttttactacttctactacttctactacttctactacttgtactacttctactacttctactacttctactacttctactacttctactacttctactacttctactacttctactacttctactacttctactacttctactacttctactacttctactacttctactacttctactacttctactacttctactacttctactgcttctactgcttctactactgcttctacttctactactgcttctgctactgtctcaacttcttctgctgcttctgtttcttcttcagttccccaccctcgctgtga

SEQ ID NO: 21559 - DNA, 540 bp, A.fumigatus
tgtataactgcttctactactgcttttactacggcttctactacttgtactgcttctactgcttctactatttttactacttctactacttctactacttctactacttgtactacttctactacttctactacttctactacttctactacttctactacttctactacttctactacttctactacttctactacttctactacttctactacttctactacttctactacttctactacttctactacttctactacttctactacttctactgcttctactgcttctactactgcttctacttctactactgcttctgctactgtctcaacttcttctgctgcttctgtttcttcttcagttccccaccctcgctgtgaggatatacttacctcaagttctacgcaccttcctttaattgtgagcccagtgagggtcataactgtaactgaaacagttagttacactagaacagccaacccatcatctattagacattcgatctcaacgtctgattccacttcagagggaaattag

SEQ ID NO: 21560 - DNA, 582 bp, A.fumigatus
  unsure (15),(22),(168): Identity of nucleotide sequences at the above locations are unknown.
aaccctacattttcntgggtantgccacaaccatccggccccagtttttccttcagacgctcgcgcagcaaagaagtccgcgaagccatgcggaaccagggtcgttcgcggatgcttcttcccgccgagtttcagccaaagactggcagtggcaagaccatcgaagantacacccgagaaattaacacccttccacacttcggcttgagcgagaacctggtcctcgacgtggtcgaagaattagaggcagaacaacggcacaagtgcctcagtgaagaatgggccgggttttcatccaacggcaccgagcccacgcctgctacaactaccgataacgattcgacaacatccggcaactcctccgctgttggctcggatgcagacgaatcaacctcgggctcgcgctcacgctcaaaaggctcatccaacacagcgtccacctctagcaccgccgacttcgagtctcttatcgagtcgacatccacctccaccacgactttcacttcctacttggaagttgtcccagagtgcataaaagtctccgtcttcaccacggggctcgaaggaccgacgctacgcgta

SEQ ID NO: 21561 - DNA, 648 bp, A.fumigatus
  unsure (29),(81): Identity of nucleotide sequences at the above locations are unknown.
agtggcacaggcatgtttggtcctggggnccgttcaggcccacggactggagctttcgtgggtgggaagaggccaggaacnccgaacagtctcaagtcaaatggtccccaatacgatttgggatctcagtccttgtactacattgcaccagctcctaaatctcaaggcggcggcgctcaacgttccctccaaagagcacccggccaatctgctgccagtctcatcgacgccgacgacgaagatccgttcatcgcagcaggcatgataggccgtggggcggaaagcaaggaagaacgcttccggagacgtcttgtgcagcagcagcgcgaacgagacatcactcagaagctagtcacctctcgagcgggcaacgtgggcgccgagtacctccgctcaagagcaaacaagcccacaacatcctctcagccagaaagcgccgcctcgtcttcacaagagaaatccagcttcgaggcctccaccccggtttctgcgaccagcctcggcctaacgggcttcaggagagcggacaccgtcaagctcagtccactgaagcgcgcctacgacggcgacaaacagcacaatggcagcgtcaagaagacgcgattcataacgtcgtcttcaccgcggttgcaagagccgtctaggcaa

SEQ ID NO: 21562 - DNA, 480 bp, A.fumigatus
cgcggatgcggcgctcccgtggtgaagacgattgattccctaacggccctatgtaggagctcgggaccgagcggtggcacactgaatacggtgctcacaatcttcgattctctttccttctccgacatcctcaaatccacggaccccttcgctttggccgcctccgcgccccccaagaatgtccccagcgagccacttgtagacaagatcctaggtgtcaggtctgttcgggacttgggtactctcaccacgtcgccatcggctatggcagacatcacaattgtgcaccgcagcagtaccctgatgccggaattctacgggccactattctacttccggcaatttgtcaaagttagaaatgcacttgtcggcataatctttcattatgccttcatcatcggcttgtgtcttctgacactccctcccgtgcgcgcactggtgcgacagttcgtctacgccgcaggtcaggggccgcggaag

SEQ ID NO: 21563 - DNA, 633 bp, A.fumigatus
  unsure (24): Identity of nucleotide sequences at the above locations are unknown.
acctttcttcggctcggcgttaanaagagacgagaacgcgggaggagactgggtctgcctgacctgccgcccgccagcgagaaggacgagtcgactctcggagaggatgaggtggatataccggatgaggagctgaaccaaaaacttcgcgacctcaaggagcctatctgtctgtttggagagaatcatgttgcccgtctgcggcgttaccgccgtcttgtccgtcggtcgatgacgcctcagccaaaagtgacggacgggcctatcccgactaccctggaacctgtatcggaggtggacatgaagattccaaccacccttcctaaggacgcagatggtcgcaagttcttgttccggcagttggcctcgtacttcaacatggtgctgctggagtgggagcgtgctctcgccagacgggatgcatcggtcaagcagagtctgaccggtcgtcaggcttacaatgcgatggttcagtcgagggaaaatttgaagccactcttccggaaatttgagaagaacgacatcgatgataacctgttggagcctattatggagatcgtgcacaatgctcagttgcggagatatgtcgatgcccatgacgcgtatctacgcgtcagtatcggaaaagcgtaa

SEQ ID NO: 21564 - DNA, 522 bp, A.fumigatus
  unsure (281),(521),(522): Identity of nucleotide sequences at the above locations are unknown.
aagtctgacactaccaagtctgaccctgtgaacgaagaccctgtcccgccggaaggtctatatgtcaagaaggtctccccagttagcgaggtcagctcacaacttgcacactgggaacacgtcaagccttcgtccctcttgtccagcaaacctcaccatgattcatctgtgtacaaagaactcgtcgacaagttctgtttctatggatccacgaagggctccaatggcacaaacgactcacttagtaacgggaaatcgcatcccgatcctccgagcacatntagcacctcccccgcacaatccttgtccccccctctctcaccgcgttcgacagaggtcttgggcatcgactatgggaatagctgctcgtcgtctgctagcccagtcagctcaagccctcgtgcagcttcatcatcaccacctcatttcgactatgctcatcactctcacgtgcagagcaacttcttaaaagagagctcgaccccggcagtcatcagagggtgcgtttggctcttccagtnn

SEQ ID NO: 21565 - DNA, 225 bp, A.fumigatus
ttgacggggaagatgtcagttggggctcgcgacttgagtatgaatgagttcagggagaagcaagaagtgaaagtcatgattgcaagcctcatggccggcggtacagggattgacatgtccatggcaaataaatgtatccttgtggatctctggtggaacgaagccgtgcagcagcaggtacgcatttgtttacggacaaccgagaatacgcgttctaactggtaa

SEQ ID NO: 21566 - DNA, 228 bp, A.fumigatus
ttatctcaggcgttctgtcgactgtacagaataggacaagagaaagtggtggaggttgtcaaaattattgtccataacacgattgatgactacatccttcaactacaaacgaagaagtcggtcaatatcaacaaagccattggtgaagaagcactgcataaacgagacaagattattgaccttcttaaaatgttcgcggaagtcgaggtgccagacaacggtggcatc

SEQ ID NO: 21567 - DNA, 189 bp, A.fumigatus
aagtctaaatacgtcgcttatgtttcccccaactatgacgggacggcgcaggagtcgatggttccaaaggtcggcgaatttctggccgtcgaccccggagagcgtgccctactccgtgcctatcaatatgcggataacagagatggcgacgatgagacgcgtaaactctgtttgcgctgggatatatag

SEQ ID NO: 21568 - DNA, 525 bp, A.fumigatus
ttgtccgtcgcgacactctccatcgtctcgtatcataaagatccaaaaccggtggattttggaaggcagctggccgcttccgcatggttgctgtacatgtgcgctgctgctctggggggtgtcaatgatgccaaggtctggggcaatcgtgccctagttcgccgaaacacttacggggagagcgcgtgctggtacgctagcctagtcgccaggcttaccgttccaattgcatacaacttcctgacgttcctgccgctgagtgtacgacaaaacaccatcttctatcatttcctcggtcggctcattgatctcacgccactaggtcaaggatacgattatttctttccggtctttatcctactacccgtctttgccactctcttcaacctttacgggaggatcaagaatgtatgcggtttaggtctgattgaagaggatgacaatgagttggagagtaaccccagcggctacgggctagccggttgtcttcacgccacggagctggccgaatccgcgcttatgtta

SEQ ID NO: 21569 - DNA, 711 bp, A.fumigatus
  unsure (142): Identity of nucleotide sequences at the above locations are unknown.
aagcgcctatttccaacaacatgccctttgacatcaaacgatgaattcatgttctccttcatggagccgttgttgcatttcaccatgggtggtatcgagatcaacgagcacgttcaggtcttcaactccgagaagaagcctntcaatgttctctacgcttgtggtgaacttgcgggtggtgtccacggtgccaatcgtcttggtggttcttctctcctgggctgcgttgtttacggtcgtgttgctggtgatagtgccagccagtacctgttcaagaagctgacgtccggctccaccaccgcccaacagcgtttaggccaaatctccctgcacatcgatccttccactcccggcaagatctccgtcgagtggaacggtgccgctgccagcggcgctggcagtgctcaggtgactgctgcccctgaggctgtccagactggcggtcagggcgcccctgcccccgctgccgcggcctcgaagcccaatgacatttcgaacttcaagattcccgagaaggagtacaccatggaggaggttgccaagcacaacaagaaggatgacctctggatcgttgtcaagggtgttgtcctggacgttaccaactggcttgacgagcaccccggtggtgccaacgccctgttcaacttcatgggtcgtgatgctacggaaggtatgtcatctcatcctcgaaccaccagacgcccctgctaa

SEQ ID NO: 21570 - DNA, 312 bp, A.fumigatus
attcgttctgttccctcggtctccgaatccgattctcaatctcacaccatggcggacgacaagaaaacgaatgagtataccatcgagatggataagttagatcacggcaataaggatttcgaggcgccggcccctgctgttcggcccagaggtcctccagttgcgcagcttgccaataatcccatcctgcctgtactggcttattgcggttcatctattttgatgactgtcatgaacaaatatgtcctttccggcagggatttcaatctcaatttcttcctcctttgcgtgcaggtaagttggtcagattag

SEQ ID NO: 21571 - DNA, 981 bp, A.fumigatus
  unsure (748): Identity of nucleotide sequences at the above locations are unknown.
gaatggcgcgcaccttccagccccgtggtgaagacgcggatgcaagaggggactgggctccaggaggggacgcacatgcaggaggggaccgggctgcaggaggggacgcagatgcaggaggggactgggctgcaggaggggactgggctgcaggaggggacgcagatgaaggagggggcggggctgcgggagggcatgcagataaaggagggggcggggctgcgggaggagacgtggatgtgggagggcacgcggatgcaggaggggatgcggacgcaggaggggacggagctgcaggaggggtcgcggatgcaggaggggactgggctgcaggagggagcggtgctgcaggagagagcggagctgcaggaggggacggcgctgcagaaggagatgcagatgcaggaggggacgcagatgcaggaggggacgcaggtgcaggaggggacgcagatgcaggaggggacggggctgcacgaggagatgcatgagggggtgcaggtacaggaggggttggagctgcaggacgggacacagatgcaggagggggcgcagatgcaggaggcgacggggctgcagaaggagatgcagatgcaggaggggatgcaaatgcatgaggagatgcaaatgcaggaggggatgcaggtgcaagatgggacggggctgcatgagggagcggcgctggaggggacggggctacaggaggagatgcagatgcaggagggggtgcacgtacaggactggtcgnggcttgaagatgggacacaaatgcaggaaagctttgggctgcacgaagggaagcaaatccaagaggggactcgggtgcaggagggaacccgggtgcaggaaggtgcgcaaggccaggaaagggacccggttgcaggaagggacacacgtccaggaggggaccgggctggcagaagaataagcaatagcccgggggggggaggtcccagaggggtcggggcctttatgaaggga

SEQ ID NO: 21572 - DNA, 723 bp, A.fumigatus
  unsure (543): Identity of nucleotide sequences at the above locations are unknown.
aggagggggcggggctgcgggaggagacgtggatgtgggagggcacgcggatgcaggaggggatgcggacgcaggaggggacggagctgcaggaggggtcgcggatgcaggaggggactgggctgcaggagggagcggtgctgcaggagagagcggagctgcaggaggggacggcgctgcagaaggagatgcagatgcaggaggggacgcagatgcaggaggggacgcaggtgcaggaggggacgcagatgcaggaggggacggggctgcacgaggagatgcatgagggggtgcaggtacaggaggggttggagctgcaggacgggacacagatgcaggagggggcgcagatgcaggaggcgacggggctgcagaaggagatgcagatgcaggaggggatgcaaatgcatgaggagatgcaaatgcaggaggggatgcaggtgcaagatgggacggggctgcatgagggagcggcgctggaggggacggggctacaggaggagatgcagatgcaggagggggtgcacgtacaggactggtcgnggcttgaagatgggacacaaatgcaggaaagctttgggctgcacgaagggaagcaaatccaagaggggactcgggtgcaggagggaacccgggtgcaggaaggtgcgcaaggccaggaaagggacccggttgcaggaagggacacacgtccaggaggggaccgggctggcagaagaataa

SEQ ID NO: 21573 - DNA, 489 bp, A.fumigatus
atggcgcgcaccttccagccccgtggtgaagacgcggatgcaagaggggactgggctccaggaggggacgcacatgcaggaggggaccgggctgcaggaggggacgcagatgcaggaggggactgggctgcaggaggggactgggctgcaggaggggacgcagatgaaggagggggcggggctgcgggagggcatgcagataaaggagggggcggggctgcgggaggagacgtggatgtgggagggcacgcggatgcaggaggggatgcggacgcaggaggggacggagctgcaggaggggtcgcggatgcaggaggggactgggctgcaggagggagcggtgctgcaggagagagcggagctgcaggaggggacggcgctgcagaaggagatgcagatgcaggaggggacgcagatgcaggaggggacgcaggtgcaggaggggacgcagatgcaggaggggacggggctgcacgaggagatgcatga

SEQ ID NO: 21574 - DNA, 696 bp, A.fumigatus
ccccgtcccctccagcgccgctccctcatgcagccccgtcccatcttgcacctgcatcccctcctgcatttgcatctcctcatgcatttgcatcccctcctgcatctgcatctccttctgcagccccgtcgcctcctgcatctgcgccccctcctgcatctgtgtcccgtcctgcagctccaacccctcctgtacctgcaccccctcatgcatctcctcgtgcagccccgtcccctcctgcatctgcgtcccctcctgcacctgcgtcccctcctgcatctgcgtcccctcctgcatctgcatctccttctgcagcgccgtcccctcctgcagctccgctctctcctgcagcaccgctccctcctgcagcccagtcccctcctgcatccgcgacccctcctgcagctccgtcccctcctgcgtccgcatcccctcctgcatccgcgtgccctcccacatccacgtctcctcccgcagccccgccccctcctttatctgcatgccctcccgcagccccgccccctccttcatctgcgtcccctcctgcagcccagtcccctcctgcagcccagtcccctcctgcatctgcgtcccctcctgcagcccggtcccctcctgcatgtgcgtcccctcctggagcccagtcccctcttgcatccgcgtcttcaccacggggctggaaggtgcgcgccattc

SEQ ID NO: 21575 - DNA, 978 bp, A.fumigatus
  unsure (233): Identity of nucleotide sequences at the above locations are unknown.
cccttcataaaggccccgacccctctgggacctcccccccccgggctattgcttattcttctgccagcccggtcccctcctggacgtgtgtcccttcctgcaaccgggtccctttcctggccttgcgcaccttcctgcacccgggttccctcctgcacccgagtcccctcttggatttgcttcccttcgtgcagcccaaagctttcctgcatttgtgtcccatcttcaagccncgaccagtcctgtacgtgcaccccctcctgcatctgcatctcctcctgtagccccgtcccctccagcgccgctccctcatgcagccccgtcccatcttgcacctgcatcccctcctgcatttgcatctcctcatgcatttgcatcccctcctgcatctgcatctccttctgcagccccgtcgcctcctgcatctgcgccccctcctgcatctgtgtcccgtcctgcagctccaacccctcctgtacctgcaccccctcatgcatctcctcgtgcagccccgtcccctcctgcatctgcgtcccctcctgcacctgcgtcccctcctgcatctgcgtcccctcctgcatctgcatctccttctgcagcgccgtcccctcctgcagctccgctctctcctgcagcaccgctccctcctgcagcccagtcccctcctgcatccgcgacccctcctgcagctccgtcccctcctgcgtccgcatcccctcctgcatccgcgtgccctcccacatccacgtctcctcccgcagccccgccccctcctttatctgcatgccctcccgcagccccgccccctccttcatctgcgtcccctcctgcagcccagtcccctcctgcagcccagtcccctcctgcatctgcgtcccctcctgcagcccggtcccctcctgcatgtgcgtcccctcctggagcccagtcccctcttgcatccgcgtcttcaccacggggctggaaggtgcgcgccat

SEQ ID NO: 21576 - DNA, 969 bp, A.fumigatus
  unsure (223): Identity of nucleotide sequences at the above locations are unknown.
aggccccgacccctctgggacctcccccccccgggctattgcttattcttctgccagcccggtcccctcctggacgtgtgtcccttcctgcaaccgggtccctttcctggccttgcgcaccttcctgcacccgggttccctcctgcacccgagtcccctcttggatttgcttcccttcgtgcagcccaaagctttcctgcatttgtgtcccatcttcaagccncgaccagtcctgtacgtgcaccccctcctgcatctgcatctcctcctgtagccccgtcccctccagcgccgctccctcatgcagccccgtcccatcttgcacctgcatcccctcctgcatttgcatctcctcatgcatttgcatcccctcctgcatctgcatctccttctgcagccccgtcgcctcctgcatctgcgccccctcctgcatctgtgtcccgtcctgcagctccaacccctcctgtacctgcaccccctcatgcatctcctcgtgcagccccgtcccctcctgcatctgcgtcccctcctgcacctgcgtcccctcctgcatctgcgtcccctcctgcatctgcatctccttctgcagcgccgtcccctcctgcagctccgctctctcctgcagcaccgctccctcctgcagcccagtcccctcctgcatccgcgacccctcctgcagctccgtcccctcctgcgtccgcatcccctcctgcatccgcgtgccctcccacatccacgtctcctcccgcagccccgccccctcctttatctgcatgccctcccgcagccccgccccctccttcatctgcgtcccctcctgcagcccagtcccctcctgcagcccagtcccctcctgcatctgcgtcccctcctgcagcccggtcccctcctgcatgtgcgtcccctcctggagcccagtcccctcttgcatccgcgtcttcaccacggggctggaaggtgcgcgccatt

SEQ ID NO: 21577 - DNA, 261 bp, A.fumigatus
acagatctctactccatgattggctccatcaagagcatcttctggctgttcaatcacaaagagctagtgaaggtcgtcgatgatccagcttgtattctggaggacgagatcatcgcaatcccgcgcaacataaacccgatgggatttttaatgagctattattccgagctggaaaagatgccgttgttcattctacagttatacgagagcgtccgtccccattcttcaccacaggcaaggaccgaccagcgctatctgtta

SEQ ID NO: 21578 - DNA, 195 bp, A.fumigatus
cacacgtatgctgaccttcgggctacttatccgcacagtcgaatattttccgtatttttccacgagcaggcagcttcctacgaaggtaagaaacaaaacaccatgaatacatttgaatcgaccattgtgaaaggctacctggataaaagcaggctacattttaccacgcaaggaacctatttgagattgtattga

SEQ ID NO: 21579 - DNA, 219 bp, A.fumigatus
tacaggttagttgccgattggtgtcatgcattgctcagcactgataccctttccctacagctggaacaagcactcgaggtctccgagaaagatgtcaagcacgcaagtgccggggtattacaagacctgaagcggtttcagaaggataaggaggccgatttacggcgatatatggtaggttgtccattcgcgccgacagacgaccatgctaattgctga

SEQ ID NO: 21580 - DNA, 921 bp, A.fumigatus
  unsure (34),(53),(57),(62),(64): Identity of nucleotide sequences at the above locations are unknown.
gggggtcgcggtggtagagcaatagatagatccntccatggttgcgttgcgtnaganagganangaggttgggtctccgtcaatgtggagaatctatccatcatcccattccgggactcaagccagggtgctggcctacctctactgtctcgtgtctctaatgtgtttgcgcctacgcccattgaccctttcaaggtcgcagaaaatgggcttgactcaatctatgtctctgcaaagagccagatgatggagacggttgtgacagtcatccctccaatcaagtacaagcttgaatatccttctgtacactacgccgctttgggtgaaagccgcactttcgatatcgagtacaccgatcaattcctcgacgccgttggcgggcgtgtcatcgagagtcttctcaagagtatcgaagatcctatcatcagcaagtggatcattgctgctctgaccctgagcattatcttgaacggctacttgttcaatgccgctcgctggagcattaaggagcccgaagttgcccctgtccctgccgcccccacggtggctgtggtggaagcgaaaaaggaataccctaagatcgacttgaaccccgacactcccaagaagagtttagaaaaatgtgaggccttcttgaaagagaaacgagccgcttacttgagcgatgaagaattgattgaactttccctgcgaggcaagattcctggctatgcgttggaaaagaacatggagaaagaagacctccttgacccgggttggatgcggttccaactaaaaaacgggcccaaaaattccggtcccaaccctggttggtttggctcccaaaattccccggccccacttttcccgcccaaattccaaaagggggcttctcttttggggaaaatgttttcccaaaaaacccttccccccattttaaac

SEQ ID NO: 21581 - DNA, 288 bp, A.fumigatus
attgaattcactaattgttgtagctgggtcttctcctccgagctttcggcttcccagtccagcggccatgctatttacaagccgtccgctaatgcccaaaagctgaatggctacacctggaagatccaatatggtgatggtagcagtgccagcggtgacgtctacaaggataccgtcactgtgggtggtgtcactgctcagagccaggctgtggaggctgccagccatatcagctctcaattcgtgcaggataaggacaacgatggtccgttttcaccactgggatag

SEQ ID NO: 21582 - DNA, 396 bp, A.fumigatus
tgttggtcggttcagggacagagttaccaaaatcaaggatcgtcccaaagctacccatacggaaaccagaaccagaacccgtaccagaatcccgagcaccagggaaaacccgcgaagcaggataagctttcagggctcctaggaaaacttcaagacaccgtcaccggacttggttcggaagtcgcccagcgagtcggcaatgttcttgatccacaacaggcatatgcagagcatggtccgaataagcctcagtcggagcacagatttggtagctttgcccctccgcggcaggccaacgatgcgaagtggtatgtcgacggatgctcttacttctatgctgtctcaaaagctctcgagagcgcccgggaatcaatctggattctggactgtaagtga

SEQ ID NO: 21583 - DNA, 552 bp, A.fumigatus
acaggatcggtgaaggtaacgacttcctttctctcttgtgattggaattgtccctacccactcggtgaatgtatgctgagcgttggacttttgatcaccatagggacattctcaacagtctacaaagctgaggaccttctgtacgaccattacaagaatgattgggacactttccaggaaacccaaagcagtaactggtcaagtcccccagcaaagagacggcgagtggaggagtcggtcaccaaacggagaaaaccgcgatatgttgcactgaaaaagatctacgttaccagcagtccgttgaggattcaaaacgagctggaactgctccatgacctccggggctgccggtccgtgtgccctttgatcacagctttcaggcaccaggaccaggttgtggctgtcttgcctttctttccccataccgactttcgcattcaatatcgcacattcatggtcgccgatatgcgacattatttcagatcccttttcacggcgctaaactccgttcataagcacaatatccttcatcgagacatcaaaccaacgtaa

SEQ ID NO: 21584 - DNA, 354 bp, A.fumigatus
  unsure (15): Identity of nucleotide sequences at the above locations are unknown.
gcggagctaacagantacccagcccctttctccccctcgataggccgcaacgcaacgcaacccaaaatcatcgccccagcatcaactttcaagttcatccccaaggacgaccgcatcccaccaagtgccgaacctgtggactcccatggcttcccagcaggaacgcactgggtcgacttcgccaagccaggcaccatcgccgtgctcgagcagcctgcaaaccagcactgcgccgtccttggtgggatcatggccgttcggatgaaggttttgggtgtgcgcggagtgctggtgaacgggcgtgtgagggatgtacaggagtcttcacctcgcaagtggcaggatcagcgctag

SEQ ID NO: 21585 - DNA, 543 bp, A.fumigatus
acgcaatgcggatctcgacgcctttgtgaaaattggacatgtagcacatacatctatgaagatggcaatcggttgtcgaaggccgatcacaaccttgctagacccctgtccactaaagtgaaacccccatttgagtcgtcgtggtgggcgaaactgttcacagaactcacacaggacaagcaaatggccgaaaaatccggacggcatcagaacgcagatgaccatatccggcagttcttccgctctttatcagcagtccaagaaattcgagcgatctctcaaaactcgcggcgagtctctcagggctctggtcatccgggcgactgcagcaagaggatggcaatcttactgtggaagttccggcagactctacctgacgaggtcgggctgacaacatggaggaagctgattcctccacccgaccgaaccatgatgaatagtccgaagccggctacaggaattgatctgcccccattgtctctcgactcgattttactgaaaccgcatcccccgaacgtgtatcaaaatcctcaagggcacgac

SEQ ID NO: 21586 - DNA, 468 bp, A.fumigatus
  unsure (382): Identity of nucleotide sequences at the above locations are unknown.
tccttctcacggacactgagcacttctgctccctcgaggaggtcacgatctgcgtcgcggacgctgcggcgctcagggtcggcgccgtatgccccggcgccccaactggctattcctccgaccatggtggccgaagcggcggcgccggtgcggggatcgaaatcgtcctcctcgtcttcgtcgtcttcgtctcggttgagtgcattgcgctccagttcccgttgggcctcgtccattcgcttcttgacctcggcggccattcggatcccgtcggagacgatgttgtccaggacgccacggagacctttccccgggggaacgatgccgccagatgcgccaccaacaggtgcacctgatacggtgctacctggggctttatcantgccgatgtttgagaaggtggtcagattacactacaaggacatggttgtcgatgcacggtggaggatgatcggacagaccgaatga

SEQ ID NO: 21587 - DNA, 264 bp, A.fumigatus
gtccgtgccgtaagttccaatacattgtgtcgtccattgcagcggactcggagactgactaatgcagtgatgagtttcacttccatgttctacaagagatctgaacagcctctgcgtatgagtctctggatgtctggcaacggcatggccacgatgatcggagcgcttctcagtttcggagtgggccattctcataataccaatattcacagctcgcagctcatattcgtcctcacaacggccaaaaaggaccgcaagtgcgta

SEQ ID NO: 21588 - DNA, 351 bp, A.fumigatus
tcccagatctcggtctcgaaggccagagatattcttgggttgctgctattttctactttgggtactccagaccctttctcatacaacggagccgacttcgctaacccgacaaggtacgtgttctgggcaatcccggcgaatctcctgattcaacgattgcccctagcgaagtatatgggtggagtcatcatcatttgggccgggctcgttattgcgcatatcggcgctaagaattatgcgggtatcctggttttgagattcctgttgggcatggcagaggcatgcgtaagtccgtgccgtaagttccaatacattgtgtcgtccattgcagcggactcggagactgactaa

SEQ ID NO: 21589 - DNA, 420 bp, A.fumigatus
gctgggattctacggtatccatcattcaccccgttagtcatggtcttcatacatgccatcacgacggcgagcacattcgatctggcattgttgcaggatactgttcagtcgttgcaactattcaagggcctctcccgtggctcggaccgtctctacacaatctgtgcggctttttccaggacggctcagatcctcgtagactcggaagaaacgctggaaggcctcacacaacaccgggacggatcgcttgtcatgccggctctagatagcaacatcgctttgcccaacgtggactggccggaaaatgtgtttgactcgcatatgaacagcactgacatctccatgttcctcaatgattttatcgggacacatcgttcagtgatggatattttgaactctgactacgtgaatgagacttga

SEQ ID NO: 21590 - DNA, 468 bp, A.fumigatus
ctaattagaccgactccgctctccgttatacatggtgccactcataccaccccaccaccagcagtcccagccatgaaaatcatgcgccggaatgacggggatcggccttccaccgaaggaagtactgcagcaagttcttcggtgccttcaaagaccacatccgaggtaggcgacagcggcaacgacggcgagcgtggttcttcagctggggccactcctgccaaagataggatggccttaacacgagaagagcgagaagctaaataccaggaagcaagagagcggatttttcgcgacttccctgagacgaaatcctccgatatcagtgaccaggggacgagtatgtcacgctcgagctcgacaagtggacgcaagaaaacacaccgacagaagactccacatgacgacagtttggacgcccgctctcaattctatgccattatgcgaccagggctggattactcgggt

SEQ ID NO: 21591 - DNA, 645 bp, A.fumigatus
  unsure (10),(11),(12),(13),(14),(15),(16),(17),(18),(37): Identity of nucleotide sequences at the above locations are unknown.
aaattccccnnnnnnnnnggttgcggggaaggaattnattcccgtatgagccccgatgagggaatggcggtttcttttttgtcttggaacatgctaacctctcagcccctactgcgtaatcttcctcctgattccaactttgccaaggccctcgtgctgggtattgcgctggctgctaatgttggaggcgccgcgtcgccgatagcgtcgccccagaatatcattgcgctgcagaacatgtacccgagtatcagctggggaacctggttctttatttctctgccagtctgcatcatttcgattcttttgatttggctgctcttactggcaacgttcaaacccggccgggacacgaccattgtgccgattagaccggtcaaggaccaattctcgggagtgcagtactttgtcacgattgtgacgctgtccaccatcgggctgtggtgtgtcagccatcagctcgagcacgtctttggggatatgggggtgatcgccatcatcccgatggtgctgttctttggcacggggatcctgaacaaggaagacttcaacaacttcttgtggacgatcatcatcctcgcggctgggggtctgtgtcttggcaaagctgtaataagccgcccggggctggatgatcatgggttg

SEQ ID NO: 21592 - DNA, 270 bp, A.fumigatus
  unsure (16),(35): Identity of nucleotide sequences at the above locations are unknown.
acagtggaatatccancccggcgggtctctcaganaccgcgcgacagcccggaccccactggccatggcctcgagcaccaccaacccaaaagtctcggtaatcgagcagtgcaggaagaggtctcccgaagcatatgcacgagccagtggttctccggtcaagaaacctgtgaaaattacatgatccctgacagtatcaaagagacggtggatgtttctttcaacctccggattgcggtttcctccgacaatcaaaagcttgaacggtag

SEQ ID NO: 21593 - DNA, 864 bp, A.fumigatus
  unsure (29),(88),(144),(169),(202),(223),(328),(357),(830),(849): Identity of nucleotide sequences at the above locations are unknown.
attcgcaggtgccccaacaggccggagcnaccagaggcgaatctgcgactgccaggttatcttctccggtacaacccagatctgacgntggtgtacccgttccgcctgaaagatatttacaaggagcccgcccagccggatatngtttatgtggcgagtccaggttccntgggtttccagttattactgtacttgcggcagntacgaaagccccccgttgtgntgctgaacttccaaaccgacctgtcagcatacagtgagatcatcctcccatctccattgagtcggtggtctgtttggttgttggcagtggtgcaaggtttccttntcagcattcccgctgtgcataccattttntacccatcatcatccatcttacgttatctgaaggacgccggcgcgcctgccacacgagctgtcaaattgggacgaggcgttgataccatcttgttccatccctcccgtcgcgacgaggcctttcgaaaggagattgcgcctgacggggaaatcatccttgtctgcgtgtgccggttagccctagagaaaggattcgagtttctggccgtggcagcagccaaactcgcggaagagaagctaccgttcaagcttttgattgtcggaggaaaccgcaatccggaggttgaaagaaacatccaccgtctctttgatactgtcagggatcatgtaattttcacaggtttcttgaccggagaaccactggctcgtgcatatgcttcgggagacctcttcctgcactgctcgattaccgagacttttgggttggtggtgctcgaggccatggccagtggggtccgggctgtcgcgcggtntctgagagacccgccgggntggatattccactgt

SEQ ID NO: 21594 - DNA, 189 bp, A.fumigatus
agacgtctgggggggtcggcgaatgagacggatgtgtctgctcgcatcacagcgcaggtggcgctggcgacgaggccggatttcttgctgtcgaaaccggggatcggagctgatgaggggctgatgatccttaccaatgagatgctgcgggggattgcattggcaaagagagcacattgtaagttgtaa

SEQ ID NO: 21595 - DNA, 573 bp, A.fumigatus
  unsure (135): Identity of nucleotide sequences at the above locations are unknown.
agaatctatatggttccatcgccaggtagcatatgcgctgctcatcttcactatcatacacgttgcttcccattatgtcaagtaagtcagacgtggttgaacgctatgtggagattggtaatccgccgaagtttntacaacatcgagaaagacaaattccgcgccgtaactggtatccagcttcattatacccaggcaggtggaatcaccggccatgtcatgctcgtatgcatgatgctaatgtatacaatatcccaccatcgcatccgacagcagtctttcgagacgttttggtacacgcaccacctgttcattcccttcctgctggccctcaacacgcatgcaactggttgctttgtgcgagacactccagaaccaacttcgccatttgcgggaaagaggttttggaaccattgcattggttaccaaggttggaggtgggaactggtagggggcagtctctacctcatggagaggctctaccgcgagattcgatccagacgggccaccgtcatcacaaaggtgatccgtcatccatatggtaagcgacacctccgcgattgcagcgcttga

SEQ ID NO: 21596 - DNA, 423 bp, A.fumigatus
gagaccgcaatacacgaccactttctattactgttgacgactgccttcccatcacattttatttcatccatcatggcggctaacggtctgtacaacatttaccggcttgccatccccgtggcgacgggtgcgatgatcttcaacgcttccatttacgacgtccgcggtggaacacgggcggtcatcttcgaccgattgagcggcgtccaggagaaggtcgtcaacgagggcacacatttcctgatcccctggctgcagaaggcgattatctatgatgttcgaaccaagcctcgcaacatctccactacaacgggaagtaaggacttgcagatggtgagcttgaccctgcgagtcttgcatcgccctgatgtcccgaagctcccggtcatctaccaggtgagtccacattgctccaaggcttga

SEQ ID NO: 21597 - DNA, 300 bp, A.fumigatus
cttgagtccagagccgttcttcagaatgtaccaatagcatatagaggctggggccaagttttgcggaagggcaacagtggcattcttgtttgccatccagactttctcgacacggatgtgtcgtcatggtggtcgactctgttgggagaagagggtcgtgcatttgatgttcgacggttctttgtcaattgtataaacccaatggggtgtccctatgggagcgtaagtccgctcaatgcgttcaaaggagcccatggaccagcgtttccattgactacaatccgcgatcatgttaggtaa

SEQ ID NO: 21598 - DNA, 309 bp, A.fumigatus
ctcctcccctcctacgattcccccaccccggactccacgtctctaccacagaccgctgtctccccgcaccagaacctaaccttcgacagctggatcccatccacgaacctggcaactgtcgatccgatggatcagcctagggaatttctggactggcgccagctgttctcctttaccgatccggatcagcctgtgctgccgatgagcatggatgggcttccggagctggaggatgaatggcggcagatctactggcaggagacaccgatgtcagatcttctccaggacggaggatggatgcacggctag

SEQ ID NO: 21599 - DNA, 597 bp, A.fumigatus
atcttctgcatggcggtgtttatcggtccgtttgcggcgccgtttgtaggcggtttcatcacgatgagtgcgctcggttggcgctggacgatgtacatctctgcgataatggtgttgctgggatttgtgcttgttgtgctgttcctggatgagacctatgcgcctgttattctggtgcgcaaggcggcgacgctgcggcggcagacgcataattggggtatccatgcgaagcaggatgaggtcgaggttgatttccatgaactggtgcggaataatttcacgagaccgctgaagatgctgttcaccgagccgattctgctgctgatctcgctgtatatctcgtttatctacgggctcatctatgccctgctcggtgcataccctgtcgtcttccagagggtgtacgggatgaacatgggcgaggggggactggcgtttgtcggcctgatcattggagaattgctcggtggcgtcttcatcctgtttctccaaggctcatacatcaagaaactggctgcgaatggagacgttcccgtgccggagtggcgtcttccccgcgcgatgtcttcgcaacggggctggaaggacccgcgcttc

SEQ ID NO: 21600 - DNA, 348 bp, A.fumigatus
  unsure (15),(69): Identity of nucleotide sequences at the above locations are unknown.
atttatgcgtccaantacctcacacagagttacgggttgtatgccgcgtcggccatggcgggtaactcngtcattcggagtatcctgggaggtgtgttgcccttggtgggctcgtatatgtacgcggggatcgggcccaactggtcggggacgctgcttggattgctcgaagtggccatcatcccgattccgtttgttttctacaaatacgggtataagatccgccggaagagcgcgctgattatgcgcatgcagatggatcagatgcgactggaggggaagcgaaaacggctggtgcagcgcacagagggcaacgcggcaactgagcaggtgaaggtggaggtttag

SEQ ID NO: 21601 - DNA, 345 bp, A.fumigatus
aagaccaattctctgaccttttttatttttgcaaaatatatagattggagggttcgctggcgaaagctggtatattttaccaaggaattggactctcctgacaacggtggtcgcctgaatttcatcaactttgagactcaccggatcgatttgtgcattgacttcatccggcaattaaaagatgaacatgagaggctcaatggcccctctagggatgagttgtgtgtcgtcgctacaggaggaggtgcctacaagtactacgataagctgaaagagacgctgaaagtgaacatcatacgggaagacgaaatggaatgcctcataacaggtcagtctactggataa

SEQ ID NO: 21602 - DNA, 426 bp, A.fumigatus
caggtcagtctactggataatctcattctttgcatatcaggagcgaaaactcaaccacctcctgccccaggacttgacttctttattaccgagattccgaatgaagtgtttacatacagcgaagccgagccgatgcagtttgccgaggcccgaccggatgtttacccgtacctattagtcaacattggttcaggagtatcaatgatcaaagtatctggcccaaagcaatttgagcgtgtcggtggtactcaccttggcggtggcacattctggggcctgatgtcgttgctgaccggtactcggaactttgacgacatgctggctatggcggaccggggcgacaacagtggggtggacatgttagttggcgatatctatggcatggactatcgtcttcacctcgggactggacggtcccgcgcttag

SEQ ID NO: 21603 - DNA, 498 bp, A.fumigatus
acaggttcgcctcggacgccccaggatcacctcttccctcctgatcccagcggcctgtccatttccgcacacaatgaccagcaccctctccagccggacttcaactcctcaaacttgccagcaacacccaccggcccgcgtgattctttcatgcaatcaggaaagcgacctatcctatcattgagcggataccacgccccggatgtagacccaagcttgacctctcgcttggaacaagtggagcttgtggggaccggcgaattttctcaggtctatcacgtggctcatgcccatgaaatgtcactcacgtccagattttctctaccgaatggagccgagtctcctcactctctgcctgcacgggtgtgggccgtcaagaaatcagaacagccatatgccggcctgatagaccgtgaacgccgcatccgtgaggtggatgtattgaaagccctcaccaactcggaccacgtaatttcgtttgtcgacagttgggaagac

SEQ ID NO: 21604 - DNA, 540 bp, A.fumigatus
  unsure (20),(47): Identity of nucleotide sequences at the above locations are unknown.
cctaacgcatactctgatcnatcccgcccgtttgcgctatcgggcanggtctggtcctgcgtcggtcaaatcgtggttaaactgtttcctaaccaggtgaggaaagtccttctggaatggaaactgagcaagctgggctcctgtgccttgctggtgcttatctggagcacctacgacggcgcatttgcttcgaatgcctttgccgagatcccgtcgaacaacatggtcttcaccgtgttcattctcgtcgccctattttgtctctggattactatcgcctttgtaatatcccgagtgtggctttctcgcgaggatacaatcgcagtgtcttacttggtttctacaaaaaccccggccatgggtgtgccgctgactactatcatgtacaagggtctgtctgccgcccagcaatcccggactcgactgccgatggtcatattccatgctattcagatcgctggcagtagtctgttgaccataccgctaaggaaatggcatgcacagagaaatgctgaagagacaggggacggcaccgtatga

SEQ ID NO: 21605 - DNA, 369 bp, A.fumigatus
cggccgcccgcgccgccgcatcgtccgccagatcccgccgtcgcgcaacttcactcgttctcgtccggtcctcgacaatcttcttactcttgccgtcatccttcttatccagacgcttggccaactcgtctcgctcctccagattccgcttgcgctccaactccttcttcgtttctggatctaattcctcggaaggcgtttaccgaggggatggcgtaccctcctccattcccgttcgcttccggggggaattctcaaaattcccgttcttctccacccctatctccattattcgttctcagggtattcttcttctccccacggattccccaatatctcccaaagttcgtctccgcaagctccttctaa

SEQ ID NO: 21606 - DNA, 390 bp, A.fumigatus
acgccttccgaggaattagatccagaaacgaagaaggagttggagcgcaagcggaatctggaggagcgagacgagttggccaagcgtctggataagaaggatgacggcaagagtaagaagattgtcgaggaccggacgagaacgagtgaagttgcgcgacggcgggatctggcggacgatgcggcggcgcgggcggccgtcatgcatgatctgcggctgcggtcacggcaggagtatctcaagaagcgagaggcggagcgtctggcgctgctgcgacaacaggtcgcagaggagacggccgagatacgcgagaatcccaatctgacccgtcgggagaaggaagaatatgcgcgcaaccgggaggtgctgcggatcgcggaggagcgctaa

SEQ ID NO: 21607 - DNA, 372 bp, A.fumigatus
  unsure (339): Identity of nucleotide sequences at the above locations are unknown.
cggatcgacgaccaccgggacgggtatatgatgccggaggactatatcacggagaaaggcaagatcgatcggaagaagaaagaggaggcgctgtacaagcgatatgtggatcgtgatgagcgcggtcaggagcggttcatcaccgagcacgaggaatgggagatggagcagacggccaaggcaaaggcgcagatcaaacgggcagaattcgtggatgagggcgactacgagtatgtctttgacgactcccagaagatcaatttcatcatggacaccaagctcgagggaaatcgcaaaccgttaacgcaggagcggcgccctccttcaggagaatttatnctacgcgggcgggatggaaggtccacgtttggt

SEQ ID NO: 21608 - DNA, 399 bp, A.fumigatus
aagctctccccaccgactgcgcaggttatcatcaccagttcgattgcaggtttcattcggcaagtgcccttcagtttcgcatacagtctttccaagtctgcaacgaatcatcttgtcaagatgctttcgacgacgctcagctcgtacgacattcgagtcaatggcattgcgccaggcctgtatcactcggagatgtctgcgtcagcattcaagggcggagataggggcatttctgacgggtcgttcccgcgcgaaaggattcccctcacgaggggtggaagtgaggaagacattgcgggtctgattctttggctggcgagtgcttctggtggctacatgaatggtagtatcatcgtcactgatggaggacgaaccgcagttcatccggcatcctattag

SEQ ID NO: 21609 - DNA, 429 bp, A.fumigatus
  unsure (422): Identity of nucleotide sequences at the above locations are unknown.
acagatcaagtgaatgcacttcaggatctgggagtagcagtatccaccatcaactcgacgactcctctagctgagagacggcttattatagacgatctcctttctgggcatccgagaacacgtctcttgtatgtgacgccggaattatgtcagacagtggcgttcaggcggactcttcagactatgcattcacagggagagttgatccgcatagcaattgatgaagcacattgtattagcgaatggggccacgactttcgtcccgcatacaaacagctttcttggttcaggtgtcatctgaaccagccaccagtcccaataagtgctttctacggccacagcgaccccacgtgtgcgcgcagatatcatcgacctccttggattagatcttgcttattagccgacgaggccggaagattccnggataat

SEQ ID NO: 21610 - DNA, 339 bp, A.fumigatus
gaatttggtgccaaaatcattgtcggtgggcggaagatcatcgacgactacaacgtccaggcggcgagagagcgtggagatgttgagggcgagcttgccgttccagaagacaagctacctcccccaggtgagccgtacaacaaaaaccagtacgtcgcgtggcacggtgccagcagcgtctaccacaccaacgccccgtctctgccgctacccaccggcaaggctatagactcgaaaaagcgcaaggtgactgtgacgggcgataactggatgcttgagcatgcccgggaggccaggtatgtcctcgcacctcttcgtctctctctgttagacggatga

SEQ ID NO: 21611 - DNA, 339 bp, A.fumigatus
gcatgcccgggaggccaggtatgtcctcgcacctcttcgtctctctctgttagacggatgactaacgcttttactagttccttcaactcgcttatcctgaatgcgcgccgcgcgaatctggaaggtgtctacgacatccacaccaatgctatccactaccccaagatcatgcagccatcgcacgcccgctgggagcgtgttccacccccggacccgcgggccaccgccaaactcgccaaggggctgtccacgctgagcctgacaaatggaacggacgagggcgaggccgaaccacccgccgaccacgtcttcaccacggggctggaagggccgcgccaa

SEQ ID NO: 21612 - DNA, 504 bp, A.fumigatus
  unsure (504): Identity of nucleotide sequences at the above locations are unknown.
aaccaccgcagacacacacatagaccaagcaatgatcaagaaacaatacgcttgacaacaccatcacgctggttaatcaaagctaaaacaccgcaagttctcgctatgctggctgtcttcctagtcggccctggcctgatcggtggagaggtgctcgacctcctactcaaggaaaagaactatgagatcaccactcttgtgcgcagagacgcagcccgtccggcatttcacgagctcggcgtccagactatcctcggctcactgagtgacaaagatgtgattgtgcagcaaacagccgccagcgacatcgtaatccactccgccaccgccgacgacctgccctcggtccaggccattctggaaggggtccgacaacgcacccagcgcgggcagcgaaccatctacatccacaccagtggtgccagtctcatcggtgataacgctgaggggtcttacaggagcgattgtgtttttgacgacgagacgccgagctctatcgacgcn

SEQ ID NO: 21613 - DNA, 195 bp, A.fumigatus
ctgcgtctaagcgtcattaattccagcaagactgcatatgctgcatttgtcttcgacggagcaagtttcttcacaacttactcattcagtcatgatggccagagcgaaaacgtctggtcagacagattctgctgccaagtttatctcaaagtgcgagtagcccagagccgagcattgtgcgatgagactgactaa

SEQ ID NO: 21614 - DNA, 588 bp, A.fumigatus
  unsure (516): Identity of nucleotide sequences at the above locations are unknown.
tttacgcggtaccttcgaccccctgtgcgtgaatacgccaatgttctggtaactgctaacatgtcgcaggttcaatcgccactcaaatcgccgatcaagtctccatcgacccccgccgtccctgcttcctcaactcgttcgtccatcagtggcccttcacggccgtccgcagtgaaagcccgccctccgtccggaccaaagacgtcgatgggccctcctccgcctccctctgtcgctgctcgccaatctcgatcgtcgatatcagggcccgccagcaaggcggccagaccaagtctgcaaagtgaaccaacaacgtcttcaggacagttgaagcggcctgcattgcgcccaaccgctcccaacaagtcatcggaggagacagaaagccacacgagtgcctattcgggggatcctgagatagatcctagagatgctgagcctgacatggacgggaatgaggctcctacccgcaaggtatccgaaaaggcactgagctcggggcgtccggccggcggncgccctagcctcacgtcttccttgcaacggcaagcacaaaacaattctgcggctgtcgcgagggaacttgat

SEQ ID NO: 21615 - DNA, 354 bp, A.fumigatus
tctttatacaccaaaaaaagcccagattcataccccacgcatctaatggcaaccactaacaagcagccagtgaacatcatcacccatactttccacccaacaaccttgatagccccccgcaccttcatcagcctagtaatctctgccgacttaccaaatttcgtccgtcagggattcatgacggttcagatccccctcgcggcgaaacctacagatgcagttcccgacgagatacgagaaaaggttgcatccgccgcgcccagaaacgcggtttttgcatcctacgccagcgtggaacaggttgtgtcactggtcttcacacgccggccctggaaggatccacgaattgcgtat

SEQ ID NO: 21616 - DNA, 474 bp, A.fumigatus
aaatctggaaagctcatgacacccaatcttggggatgcacgtgcgtacatgtacagcctgttaaaccaaccaagctcacaaaataacggaactcacgcgggcaagtttgatgtcatcgacctagatccttacggtaccgcggctccgtttatggatgctgctgttcaaggtgtcaaagacggtggccttctctgtgtcacttgtaccgatgcaggcgtatgggcatccaacggttacccagaaaaggcatatgccttgtacggaggtgttcccattaagggatcgcattctcacgaaggcggattgcgccttatcctacatggactggcgacgtcggccgcgaaatatggacttgcaatcgaaccgcttctctccttatctatcgacttctatgcacgtgtcttcgttcgtgttcatcgatcgccggcagaggtcaagtttacctcaggtaacacaatgttagtttttaactgc

SEQ ID NO: 21617 - DNA, 717 bp, A.fumigatus
caagttagcagggaagaatactgctgcggggtgattctgcttgacgatgacgactggcctggcgttatccgtgcggctggcgacttcgctgttgacttcggacgagtgaccggtacaaattatacgacaggcctaatcaatggcacaactctgcatgatcaatcttccgttcgtggtaacaggggagtgattattgcgggaacaattggcaggtcccgcctcatcgactctcttgccgcacggggcaagattgatgtcagtcagacgaaaggaaaatgggaggcatttcagactgaggtcgtcagtaatcctctcgagggaatcccgaacgcggtggtcatctctggcagtgacaaacgaggagccatctacggcctttacgatatttccgagcagatcggggtttctccctggtattggttcgccgacgtcgcgcctgcccaacacaaagaggtatatgcgttgaaaaagaagaagatccagggacctccgtctgtcaaatatcgaggcatctttatcaatgacgaacaaccggctctgacgaactggattaatgaaaactaccctcctgcgagatatggtcccggtttcaatgccaacttttactcccgtgtgtttgaatatcttctcagactgcgtgcgaactatctatggccggctatgtggcacaatgcattctatcccgacgacacaggtccctcaccacgggggcaatga

SEQ ID NO: 21618 - DNA, 546 bp, A.fumigatus
gcccgcggcggggcctacatgatccacatcacggctgagcttgggggaaaggcgccggtgtgtttgtttccgagcctcgacgtggaattggcggtcaaggcggcgatgtttgcgagttttattgccagtgggcagacatgtgtgactgggagtaggctcttagtgcacgctgatctttatgatcggtttaaagacctgttggagaaaagggtcagagccttgcgggtgggagacccgatggaagagcgcacgcagattggttctgtcatctctcgcgcagccgttgagagatgctctgctttcgtgctgcgggcagtacaggagggaggccgcgtgctctgtggtggtaacccgacaaactcaaatggaaaaggcttcttctttgagccgaccatcatcgagacacatgccgattcggatctcgcgactaacgaggtcttcgggccggttattgcgctcgtgagatgcgaatcggaggaggaaatcatccgcattgccaacagcacgtcctatgccctcggcgcatcggtctggaccaacgacttt

SEQ ID NO: 21619 - DNA, 759 bp, A.fumigatus
  unsure (23),(40),(75),(191),(723),(727),(730),(740): Identity of nucleotide sequences at the above locations are unknown.
tcccggtggcgcccgtggaaaanaattcccaacccccagntgcgagctggtccggcctccttggacactgttgcntcggatctctctggaattttgcctacaggttccagttcccttgcgtccggagttgccactaccgattcgtccaacgctgatggcactgttacgcactcaacagtcgttattccttnttcgacaggcaacaactcttcgcctgaggccagcccttccccaactccaagcccgagcggcgtactcgatccgttgacctctgctgttactgacctattacctggctccgcatcatcctcagccgtgaccaacggtagcagtggagctgagacctcggcatccacagaccttggtcagtctactgtgcctgtcagcgtccctgctgtgacaccctctgccaccagttcgagtggcctgggtggaattctgggtcctatcctcagtagcgctggtagcactggagtcattccaaccgcaagcactcacaccagcagctttgttggcgtccctaccggcttgactagtatcctcatcccaggaggcagcagcggaagtgagtcgccaacttcgtacactcagattagtcctagcgttcctacaactgctccctctgtgaccagcaccgccgtcattcctggtagctccgataccgctattggttcctcgattgctgtcacgggatccaccggagtgagctcgagtccgctcatnttcnttncgagagacgngacccgagcattgaaccgc

SEQ ID NO: 21620 - DNA, 222 bp, A.fumigatus
agtggtcggatctgtgagattgcacggcggcgcgggatgacgatccacggtgcaatcgtcgtcagtcgtcaggttgagttctacaagatgaagcgtgatggatcgtttgaatgtatgacgtggttggctcaggagaagaagcgtctgcatatcctccgggatatgcggactattacctcccaccttatgcagataaactacgaggtgagactgcgagattga

SEQ ID NO: 21621 - DNA, 318 bp, A.fumigatus
  unsure (290),(295),(307): Identity of nucleotide sequences at the above locations are unknown.
tcccccaccaagcgaatacgggtcctcttggcacactgtttcgctagagcctcttccttcaaaagtcccaaactccccaagcttaaaaccacaaatagatattcccccctaattcacacaatgtcccctactcttccccccgaggtcgtctcgaatatcctcagtcatgtcacccccctctggcactggcgccgccgtgccatgtggaaaaataactgtgaacggatcacggcggagaacgacgtccgctggtttctgaggattaggggcgcctgccgtgcgtcgttttncaccnacgccgccggcnggaacagtaaa

SEQ ID NO: 21622 - DNA, 432 bp, A.fumigatus
caaactccgctggatgccttcgtctcaccgtcatctaactacgtatcggatggttttacagatctctttccagttagcagttcacttgattcgtcgttgaagaagaatacggcctttatcaagcgtctccgaacaggaatcaatgcttcagtcttgcaaaccttcttgaccgatatccgcactttgtcgctccacaagtacctttccgagattatctccgcatgctatgagggtctctgcaaacttaagtctcccggggagattgccgcgggcgtagaagtcacaagcgcattgcatcagcgattcggaccggacgagtttacgaggcagattggttggctgctaggtcgcggcctcagcacacctgacaagtcgcagctcagaaccctcagccaggagttttcaacacgccgcaggcaggacaggtgtaaa

SEQ ID NO: 21623 - DNA, 540 bp, A.fumigatus
  unsure (271): Identity of nucleotide sequences at the above locations are unknown.
agacttgacgaaagaatgcaatccgaagggctctacgattgtccatatagttcatacgctgtcgaatctattcgatacttggttctcttcgttctctttgtgacatgtcttcactattcctattacgctctttcgggccttttccttggactactctggcacctgcttgcattcaacgtccacgacaccggtcacctaagcataacgcatggattccacaccgacagctgcatcgggattttcattgccgatttcctcggcggtctatcantcggttggtggaagcggaaccacaatgtgcatcacatagtaaccaactcgcccgagcacgatccggatatccagcacatgccctttttcgccatctcctctcggttctttggttccttgcgctcgacctactacgatcgcgatatgaagttcgacactgcagcgcgtttcttcatcaagtaccagcattacctctactaccccatactattattcggtcgtttcaacctgtaccgcctagcatgggcatatctcctcgacacggcatag

SEQ ID NO: 21624 - DNA, 267 bp, A.fumigatus
gctatatcagtatttgctactacggtaccacctggttgtccccattcacaactggctttagatacaaacaataccagccaacctgttcaaacatggcgcagactatacgaaagtagcaactctaacggacacccaggccaaaacatcttcttctatctcaaccaccccatccgcttcgtgtccctggtgggcgtcatcgtcgccagaacagacgtcttcaaacgcacgattctcacgctagactacattatcggggagaccatctaa

SEQ ID NO: 21625 - DNA, 759 bp, A.fumigatus
tcttctttgtgcgaaacctcgcaatttcacaacgcagcgagcaccggtatatacgagacttttttcctgtgcgagatgggatacctgttcgatatgcttgagaaggccaatggacagaattgtcaggccacaaacttcctgaagactttcagcagctatcgagaagcttcgaatctcggcctgctcgaggaaaacctaaccacaaaatctctctcttccgccattcagtctgtgaatagatttttccttaaccagatcgcgcacgatttccgcatgattgtcccgagctccgatgatttagaccatagactttcgaccattgcgtcggagtcaatccgatgcatgttttgccagaatgagatcgtcagacctggcaactccttagccaatgagctaatttaccctaccattgatatcaaacaagctcgcagaaatccagctttccgattttcgagtatcctgagagcaagtattgagcgagagacacagaacaggggatggtgcaactattgccggcgatatcagcaagtgaccataaggaaatctattcatcgcatgcctctggtcctgattctcaatgcggctctcagtaacgccatttgcagaagattatggtccattcctggctggttacccgaggaggtaggcattgccgttgacaacggccaagttatgtgtttcgaaggagacgagctcaagactcagttgcagaacaagctgcctcatctgtcttcaccacgagtggccgaccgcataggt

SEQ ID NO: 21626 - DNA, 699 bp, A.fumigatus
  unsure (34),(38),(60),(173),(176),(222),(231),(262),(432): Identity of nucleotide sequences at the above locations are unknown.
tccggcgtcatccccagccatcaaatcaaaattnttcncaccaaatttccgcttcccttngcagacggaaccattattgtcggccagaacagcatctcccacccaagcgaggcaaccgctttccagcttagtacaggttccagacggcccagcttcttcttcgccgacggcgnttntgacctcgaggacacagaaccctcagacgcttcggacgccgcttcntacgaagangaccacttccccggatccgtgcccaccttcngcaacaaaaacatccagttcagcaaatcagccaacgaggacctccctgcccgcatcacccgcatttggtacataaacccctacggccaggagatccggcccccggccaacccacgcgtcctcgaatccctccgcaacgcccaggctatcatttacagcattggctccctntacacttccctcgttccctccctcatcctccgcggcgtggggcaagccatagctaccagccccgcccgccacaaaatacttattctcaatggctcgttagacagggaaaccggcccgccctcgcagcccttcacggcggtcgatttcgtcgaggcaatcacccgtgctggcgaagaaagccgtggccggcctgttcacttgccttcgccgccgtattcttcctacgtcacgcatcttttgcatctagaggcggtcttcaccacgtag

SEQ ID NO: 21627 - DNA, 576 bp, A.fumigatus
gccatggaaaccagcagggagactttgcaagcgttgagtcttgtgaaccatacctggtatcaggctgccgtgccttttctgtacgaaaaactgcagctatgtcttacgacgaccccgcaactccaagaagacgtggaacagctgatgaagcattccctgcgcaagcaatacctgcgatacctgcgtcgtctggaccttgtcgggcgaagcgggaagcgaagtctccatctagctgctttgcaggaagatgcggagggacccatcatgctggataacttcctcgatcgcgagctctggcagaggcatactttccgactttgtcgtggagaaacgactacccccgattatgcctcgctcgccaggttcatcgcggccgtgtcgaacctgagagagctgaactgggttcgtgctctgcgcttcccgcaagaggtcctggatgctctacacaaatatcacccttcttgcaagctgaacctgctttacttctatctccaagcttggaaataccaaggtcttagcgataatgatatgactgtggtcacctcgccttgcctccacacgatccgctgctattag

SEQ ID NO: 21628 - DNA, 330 bp, A.fumigatus
gcattgatcaatcttcctattgcagcgttcgtgactgttgacccttcaacaggttcccacatttcgaagctttgccgacgactgagaatcccggtgaatgtatctgacgcaccggatctctgttcctttaacttgctctctacgtactcagatggccctctgcacatcggaattacgacttcggggcgtggctgcaagcttgcctctcgcctgaggagggaaatttctgcttcgcttcctccgaatctagggactgccatcgacagactcggtgcggtaagaaggcgcctttgggcagaagactacgctgcaggactctgtgatggcatt

SEQ ID NO: 21629 - DNA, 225 bp, A.fumigatus
  unsure (170): Identity of nucleotide sequences at the above locations are unknown.
gcgatgatgtcaagttgtatatcgctgactagactagccgatggacgagtcgacgttgatctgaactcgaggattgcccgcactctcgctcagatcatcgagctgcaacaggaagacattcataatccacctcccgactatcagcaagagctccaacagcagcgggatcnagatcaagatcatcaactagaacccatcgaatgcagcatccacctcaacattgtg

SEQ ID NO: 21630 - DNA, 363 bp, A.fumigatus
  unsure (341): Identity of nucleotide sequences at the above locations are unknown.
tggaggaaagacatacaacaaatgtcactttgtgagtttccctcattagaagtccggctgctgctgctgactgatcatcttacccagtggtccaactttgagattggaagcttagagtggttgagatcgaagcagtatcttgactatttcgatgctcttgaccacgacggcggcttcttctatgagcgatggggagacgccccagttcattccattgcggccggcatcatgctcaagaaggaagagattcattttttcaacgagattgcttactaccacattccattcacacattgcccgaccagtgagcagatgaggctggacgtacttcaccacggggntgaagagtgccgatcaagctct

SEQ ID NO: 21631 - DNA, 378 bp, A.fumigatus
acccggaaaaaggtttccccccggggggtttttttttccttttttcccctttttccccccgggcccccaatttccccccaccttggaaatgggcttggaaactaccgaaggtactactggcgcgtggaacccagcattgagctttattgcgacatcagcttcgacccattcaagcttatgaaggaacagaacaagaagtacagtttcgtccttagtttgtatgaatattacgacaccatccccagtctatgggatagcgtcaagaagttcatgggcaatcacccagagcatattgcagaaggaaatgcgatgggtttcttgagtgatgatggaggaaagacatacaacaaatgtcactttgtgagtttccctcattag

SEQ ID NO: 21632 - DNA, 417 bp, A.fumigatus
ctctggtccttccagccgcgtggtgaagacgacgaaatctgcggcatcttcgcccgcgcgtcggatccggagctccgcgccatcagccaggctttcggcgctcggtacaactcgtcgctggagagccacatcgagaaggagttctccgggcatatgaaagacgccctgctgcatatgctccgcaccgcgctggacccggccatgcgggacgcggacctgctcgaggactgcatgaaggggatgggcaccaaggacgagaaactggttactcgggtcgtgcgcttacactggaacagacagcatctcgaccaagtcaagcgcgcgtaccaccatcggtacaagagggatctcatcgccagagtccgcggagaaactagcggggattaccagaagttaatggttgcgctgctcgagtga

SEQ ID NO: 21633 - DNA, 525 bp, A.fumigatus
ggtctgtacaccgaaactcccatggccaactcggagctctttgaccaaatccgccagggtaaagcacgctggttacgcggagacattgtctctctcacagaggacggtgtcatgttcaatcatcgctcacatggagtccccaagggtggccccggacatgaatcggttgttcctggagatgtgatcatcatggcaacgggcttcaagcgtccatcgctgaacttcctgccaaacgattgtttcgaagacccatacggtccacccagctggtatctccaggtcttcccgcccaagtacacgagcatctgcgccaacaacagcacctacatcaatgccatcggcactgtgggaaacatgcacattggtatatacacacgcttcttattgatgttcctggttgatcctctatcgcggccgacggaaggtaggatgaagacatggatcgactttacgcgctttatgaaacggctggctccgacaggcgcgtttgacttcttcacttacgccgaattgatctactggtag

SEQ ID NO: 21634 - DNA, 321 bp, A.fumigatus
ttttctttcgtctgcggccactccgactcccctgcttccgacccccctttcgattctctattccttttctcccctagatccctcctcgcttccctctccctctcccttttcccttcccgtgacttctccttcgagaaactctcttcctctctccccgttctcccttgtttatcatgctctttttccgcccctgcttccctcctgccttccctaaggaggactgaacttctccgtgcgcttattattctgcctcttgctcccccttttcctccccttttgctcctttttgcctccctcgcttcgatcttcgggctagtctga

SEQ ID NO: 21635 - DNA, 681 bp, A.fumigatus
  unsure (640),(675): Identity of nucleotide sequences at the above locations are unknown.
ggccggcaacggagcaaaaataaacggggtaagaaaaaccatgcgtctcagactagcccgaagatcgaagcgagggaggcaaaaaggagcaaaaggggaggaaaagggggagcaagaggcagaataataagcgcacggagaagttcagtcctccttagggaaggcaggagggaagcaggggcggaaaaagagcatgataaacaagggagaacggggagagaggaagagagtttctcgaaggagaagtcacgggaagggaaaagggagagggagagggaagcgaggagggatctaggggagaaaaggaatagagaatcgaaaggggggtcggaagcaggggagtcggagtggccgcagacgaaagaaaatcaggaggaagagaggagtagttcagcgaaggcgaaaaaaaatccagaagaggggagggagaatcagagggtagagaaggggaccgtcagaaggattctaagggcagacacccggggaggagagcaagaggcggcgggagtcgagtatctggatgagaacggacagatgcgaactgcaacggcccgcaaagaagtgatcctgtcagctggggcactgcggacaccccccatcctggaagcatcaggcgttggcgacgcagacaggctgactnttcacctcgggcagacagcccgcactaatatcctnaaagag

SEQ ID NO: 21636 - DNA, 222 bp, A.fumigatus
tggtggcataacccccttcccacccccccccagttccccacggcccgtcaagccggcattcatatccgtaacacccgcccgtcccggcatcctaaggccggcaacggagcaaaaataaacggggtaagaaaaaccatgcgtctcagactagcccgaagatcgaagcgagggaggcaaaaaggagcaaaaggggaggaaaagggggagcaagaggcagaataa

SEQ ID NO: 21637 - DNA, 483 bp, A.fumigatus
agacaatcgtcactttcaacaacatcatcaacaagccagggcgttaaaggatatcgccggatgcctcgtacacgcaggtccaaccgcctatccggggcgaggaccagatacacaagcgatccctttgaggttgcgggagtcagtgatgagtcggactcgagagaagggatcggtccttctcgactaaatgcaaagcagcccgtccgagcagatgattcctcagatgaggagtacaaagaagtccaaaatgaacaggacgaagctgaagaaggcgaagatgaagacgtagagatggtggacgtcccaggcgatgatgatgaattcgtctccgatgaggaggacgaaatcgattcaaagaaacccaaatcggccggggtttcgcgagtcaagaatcccaagcgacgacatgacgacggctctgtcgctattgctgaagatgagactcacttccgggggacgtggagccctggagagcatgtggga

SEQ ID NO: 21638 - DNA, 471 bp, A.fumigatus
gtctcatcttcagcaatagcgacagagccgtcgtcatgtcgtcgcttgggattcttgactcgcgaaaccccggccgatttgggtttctttgaatcgatttcgtcctcctcatcggagacgaattcatcatcatcgcctgggacgtccaccatctctacgtcttcatcttcgccttcttcagcttcgtcctgttcattttggacttctttgtactcctcatctgaggaatcatctgctcggacgggctgctttgcatttagtcgagaaggaccgatcccttctctcgagtccgactcatcactgactcccgcaacctcaaagggatcgcttgtgtatctggtcctcgccccggataggcggttggacctgcgtgtacgaggcatccggcgatatcctttaacgccctggcttgttgatgatgttgttgaaagtgacgattgtcttcaccacggcgggctggaaggacaacaa

SEQ ID NO: 21639 - DNA, 414 bp, A.fumigatus
  unsure (411),(413): Identity of nucleotide sequences at the above locations are unknown.
gaggcagtagatgcaccgaagacttggtcaggtggtaattgtcacgtgcaacccttgcctccgtcggtctctgtaatgagtggtaacataacataccccatctctccctctcgaccacctctcctctttcagtctatcgtcgctcgtcatcttgtggatttcaatttcagaataacatatcttctattttgttcttggactctccagatatacgatcgtgttaccgcggtgatgaccaactctgatcccaagaacaagtgctgcgggactgattgcgacaatgaagcggggaccttgcaatgcccgacgtgtctgaagctcggtgtcaaaggcagttacttctgctctcaagagtgcttcaagaagaattgggtaggcaacatccaggatgacattccaaggccgcccaantna

SEQ ID NO: 21640 - DNA, 456 bp, A.fumigatus
agaccgcccctccgcctcaatcccaagcgcagcgcccagatcaccaaactccgcgacaccgccaaccaggcctaccgcaaatccaactacgccgaggccgtcaagctctacacttacgccatcgatatggccctgagccgccccggctgggaacccgttaatctggcccgcgatgagttatccggcctgtacgccaaccgctcacaggcgcacatggcgcagcaggcctggcccgaggggatgatcgatgccaaggctagctgtgattgcaaacccattgggaatgtgaaggcttggtggcgtgcgggcaaatgtctcgctgagatgggtcgctgggaggaagctaagactattctggagcgcggactggacattgaggggaagactggtgagggcgggaaggaactgggggcgttgttggaggaggttcagcagagactacagaagtcggcatag

SEQ ID NO: 21641 - DNA, 198 bp, A.fumigatus
aacaccaaaatggacacatccaccaagccctcctcatcactaccctcctcgaacccccccagcgtcgaaggcgcctacaaacgcaagtgcatcgctttaaaaaaacgcttgaacgagatcgaggctgagaacgagatgatgcgcatgcgcaacaagcgcggatggcaatacatccagaaaatgcgactggagtcctgt

SEQ ID NO: 21642 - DNA, 282 bp, A.fumigatus
atcgatggtatcgacgaggatagcatagcaaagccacatcgacccttgccctctggccggatcacacctggacaagctaccctcctctatcgcgtcctcttcttcctgatgtgggttgccgccgtgtacaccaacacgatctcctgcacgttggtctattcgattgccatcgtagtgtacaatgagggtgggctggcagctattccggtagtcaagaatttgatcggagctatcggtctcggctgttactgctggggaaccacgatcatctttggtatttag

SEQ ID NO: 21643 - DNA, 300 bp, A.fumigatus
  unsure (166),(192): Identity of nucleotide sequences at the above locations are unknown.
gggcccaacaacctccatcacaatcgcctcgaccgaaccgccgtccagacccttctgcaccagtactcctcccgcgccaaatccgacggccacctcatcaacgcctcaaagcaggactcccagtgcgtcgaacacggtgtcttcctctcctacgtccacgtcgagntactttcctggctaaccaaacacaantacaccgtccctgcgtcctcagtaaaatggtacagctggcgcaagctgagttcgcgcaagtaccttcttccgtcttcaccacggggctgggccatcacgcgatcggaa

SEQ ID NO: 21644 - DNA, 465 bp, A.fumigatus
ctccgctccggtccccggccctgcggccatgcggccgtgatctgtctctgctcgcagcgcacccgggacgcgcggtgcggacgttctgccccgttactgcggcgcgagttcgagcgacatctgcgggcgctggagctgtaccgcgacctggacgatgagcggcccggcggcgtgggcatctacttcatcagccacgttgggggccacaagtatgcggcgaatgtgattatttaccggcggcgggactttgagtggtatcgcaaggagaacccggggcaggacacgctagggaagacgacggtcgaggcagacgagggcgcggcgcagggcatctggctggcccgcgtgcggccggaagactgcgagaatatcgtcaagtatacggtcttgcaggggaaggtggtcaaacctgggctgcagcttcggggtgggtttgatcgcgagcgagggaagattagttggtag

SEQ ID NO: 21645 - DNA, 588 bp, A.fumigatus
aactgcattatcgatgttctggacgaaagcaaatctgactcacaggaaaccttgatgcgacaaatggaccactcgttcaataacccgaggcgtacttgttcagccccttctagcatacatctgttaattctcagccgtccatatcccgaacttgaacaatacctatccgcattcaaaagcatggacttggggtcgtgtcgagagatcacaaacgacctcagagcgatgattaaggacagagtggagggccttgctaggcgcagaaaataccctaaatcagtgtttgagaaagtgtcccaaatcttggaggaaaaggctgctgggacattcctctgggtaggaattgcctgtgccaaattggctcgggtgcaatccagaagggcagtagagaccctgcaagctctcccgcaggaactacattcgctttatcggaaactcctccttgcagccgtctcagactgtgacgaggacgatcatcgagtagtaatggagatactgggctttgttgcattcgcccagcgacccctgacgatcatagaagtcgccgaagcatgtcgattatatacaagccgccaggcctggaagtaa

SEQ ID NO: 21646 - DNA, 579 bp, A.fumigatus
  unsure (579): Identity of nucleotide sequences at the above locations are unknown.
ctactgcatagcgcgcgtcgttcgaccccctgtggtgaagacgtccgcctcgtcgagaagatgggcagcctgtacacgcagcactacgcctcgaccgtgggcgggtccatgacgcggaacacctttgatctcatctaccacggcgaggtggcgggcatcagcaacacgcgcccgttgttcgccgcactgatcaagggcctcctggccccgatcagcggctccgagggcatcaacatcaacatcgtcaatgcggagctggtcgcgcgcgaacgcggcatcttcgtcaacgagcagcactcgcgcgatccggcggatcattcgtattcgtattcctctcttgtgacgctggtcgcgcggccgccttcgcgtgcctcctcccgtgcgccggccccggacgcgacgtctcagactggacccaacccgcatgaccaacgcatcatctccgggacgtgcagcggcgaccagccgctgattaatcgcctgggccggttcgagacctcgttcgtcccggaggggacgctgctcatctgcgagaactacgactcccccgggaagatcggggcggtggggagtctcttn

SEQ ID NO: 21647 - DNA, 210 bp, A.fumigatus
aaagagtcacagtgtgtttctctggttagcagttggcctgttgcaaacagcgctaatctacttggtcaggaaattttcgagaaaccacagttcttcgtcaatggaccaactgcgtccgatgtgcgccaagggcgcgatggcgaatgttggtttatcgctgctctctgcacgatgggcaacaaaaacggcctgataaaaaagatctgtgtc

SEQ ID NO: 21648 - DNA, 390 bp, A.fumigatus
  unsure (20): Identity of nucleotide sequences at the above locations are unknown.
gatggtagcattgcgggtcnggcgcattggagaagaccgggtcgggacccggagctggtccggaaatggatggccggaaaggaggagtgggataaaaaatttgccaaggaaaagctacgtgtgcagaagcagcggatgaaagaattggcccatgggttccaggactttgatggagatactgctcccccgagctccgtggcggcccgaagactggctcctggtattttgcctcaaaagggcggaaagcatcggaagagctaccagatgaccctgtggagtcggatggctagcaagcatgacaagaagaccctcgcaagagaacaggcgatgcagaaggaagaaggtcgttcgaggctgacgagcgtcgacggtggacgagcatgggcgtcc

SEQ ID NO: 21649 - DNA, 270 bp, A.fumigatus
catatacactacatctatacaccctcaacgctggtcgcccagtctatctctaccgacacaaagcgcaaacatcgcccaatgaacgccggcatctatcacccacaacatccccatcctaaagtacaccaacacctccttctctaccaccgtctattccgaccgttagttcaaactcaccccctcctccaccctgttcccttcaccccccttatccgcactggactcccgccctctcaccttaccactgttccccttcttcgtcgtcctcaa

SEQ ID NO: 21650 - DNA, 192 bp, A.fumigatus
cttctacatagcctggccaacggcttcgcctactggcagggccaggagctgagcaatgctactaacacctactttgatgacatggctcaggctctgggccacattgagcaagttgccggctctaatgcagacaagattcgctttggcaacggtgagaccggatggcccacaagtaagttttgcaccttttga

SEQ ID NO: 21651 - DNA, 243 bp, A.fumigatus
acagctggtggaaccaactacggaccggccgtcgccagcactgcgaatgctgctgattactacaagtctgccgtttgcggcatgctcgcatggggtgtcgatgtcttctactttgaggccttcgacgagtcctggaagcccaagaccaagggcgacaacggtgagatgcaagacgaaacgcactggggtgctttcactgcggaccgtaaggccaagttcgatttgacctgccctaagcactag

SEQ ID NO: 21652 - DNA, 228 bp, A.fumigatus
agacgccggatcgtgggccacccaaccaaaattgacctgctatacgcccttaccgacatcggtagcacctatcgctgggaacaggagctgaacaaatggatcccagtcaccgacctcgttggccccgaggacgagaatctgctggggacggagagcgtggctacggatatctttatttggcgcaaggccggttcccgagttccaataactctgcgttcttcgtgttga

SEQ ID NO: 21653 - DNA, 258 bp, A.fumigatus
  unsure (219),(230): Identity of nucleotide sequences at the above locations are unknown.
cacccccgtctttccaactggccgcatcctctaatcatggacaatagtgatcctttcatcatgatggccgaggctaataagacttacggtttcactatcgccgtcaaagaactccgggaaactgtacccaacatcttccgctacgcatccgcatatatgcgaaagaataatctcaagtcgaaaggactttgggagatgtttcttgagaagcctgaacangaggagccccngcccgatgaagatctgatcagtgactag

SEQ ID NO: 21654 - DNA, 201 bp, A.fumigatus
atgccaccgcagtccccagatgtgaattttgacatatcggtccaagtactcctgatgcaattgcgtaggagaaccgatgaggttatgcagccggtgttccgggaggagtttgcgagtaagacgatgatcactgttgcgcatcgcctgagaactattctggtggtgatttggtggtattcctcgacaaggggcgtattctaa

SEQ ID NO: 21655 - DNA, 375 bp, A.fumigatus
cctacccctagtgtccccccctcggggcggagggagaagggaggggtggctaccacggcctcctatgtccgaccatccaatcctccatcgccaaccactcgctccaccgcgcatccgcaacccgtagctctgcctcctccggctcacgcagcggctgcagaaacggcacctgctgatccggcagaacatcatacgcgctcttcgtcaccgcccagccgccgctcttcgccgcgaacatataattcaaccgctcctgctgccggatcgcgcccacgccggctccccagtcctccccgaagaaaacgcgcaagttcgcgggcgtatcctggcccgtggcgaccaggcgccggatgtagactctggcggagacggtag

SEQ ID NO: 21656 - DNA, 186 bp, A.fumigatus
  unsure (145): Identity of nucleotide sequences at the above locations are unknown.
gtgaaaacaaactttggtcatggcgagggcgcctctggcctgaccgccgttatcaaggctgttctggctctggagaatcggacgattccaccaaatatgcattttcgacaaccgaacccttttagtaagaaccagcccctttgtnttcatcctcgcaggcagcgataccacgctatgcctagagga

SEQ ID NO: 21657 - DNA, 540 bp, A.fumigatus
  unsure (273): Identity of nucleotide sequences at the above locations are unknown.
gcgctctcccatgaagctgccaaggttcttcaaacgggcagttgctcatccgccatggttgccggaaccaacatgtttctcaccctttccatgagcgtgacaatgtctgagaacatggttctctcgcctgatgggctgtgcaagacatttgacgctgacgcaaacggttatgcgcgcggcgaagctgtaaatgctgtttatatcaagaccctggacaaggcaatagcagacggcgatcctatccgcgccgttatccgcgccacatcggccaantatgacggccgaacggcaaagattttcgcaccggatattgacggtcaaaagcggcttatcagaaaggcctacgagcgagcgcagattgaaaacatcgcagaaacggcttttgtggagtgccacggcaccggcactagacggggagacatcgtcgaggccacggcgattgctcagacttttcatccgcacggggttcatattggatcggttagcacaaagccatgtttcgacaccgtcttgtggattcttttaacccggtctaggtga

SEQ ID NO: 21658 - DNA, 585 bp, A.fumigatus
  unsure (531): Identity of nucleotide sequences at the above locations are unknown.
tttgatttgcgcgtcactcgcgacgggaatacgttggtgacgaagcatggtatcatcactttccagccctttgagactgtcctctatcaaatcaagaattttgccgactcgcataaatccgaattcattttcctcgatctcgatctcgctcatgaagatggtgtcggaggcgacgttttggccatgttgatcaaagttctaggagacggcaaagaagatgcatttgcaaccgcccacgtcggccccgatgggaaaatgtacaacactgatcttacctgggcgaagctgcgggaggacgggaagcaatacgtcgtcatctatggcgaagaggagaaggtcaacggggaaaccaaacattatgacagtggcaagtactgggctccgcaggccggcaatatccgggacaattgggcggatgactacgaggacaaatccccccaggagattgtgaattggttagaccaagtcctagcgcagtggaagaaggagaagctgtggatcacccagttcattgacacacccaggccctcntactttgtctacagaccaggcgggaaggtactcatatgccctaggaaaggaaag

SEQ ID NO: 21659 - DNA, 492 bp, A.fumigatus
  unsure (482): Identity of nucleotide sequences at the above locations are unknown.
tgggccaactcggatgcgaaacatctggttacgatcgtgctgtttacgagggttgagtacgattcttcggctcttggaggtccgttgccgctgagctccgaatcgctgaggtgcatctccagccccaaccatgctccgaccagggacttttatcgcgtcgtggtcaacgatatggcgagtggccattggacgacgattctcgacgagctgaagaaggatttccggactttcttgagagatgtctcgattctaaagatggaccgtccggatacacctaccgtggatggggtcaaggttgctcccaagaacaagccggcaatcatcgcagggcgaccaagtactgcgctgcgtgggaatatccttgaggcaatacatcttgcttcggcccaccttgcatacgatcatattgaccgtgatttggtccatacgggtacctcgatcatcggcacaactccaggaattttcaacagaccagacgcatncaccgaagaa

SEQ ID NO: 21660 - DNA, 741 bp, A.fumigatus
  unsure (148): Identity of nucleotide sequences at the above locations are unknown.
ccgattgggaagcacaatgtcacgggaagtaatgcgtgcttgggcctttttcccttccagcaccgcatggcaacaaaactctcaggaggtaataaacgcaagctttctctcggtattgctctaatgggcaaccctctcgtcttgctgntggatgaacttagctccggcatggacgcagcctcgaagcgtgtgatgtggaagacgttggcttctgtagtccctggacgctccattgtgctgacgacccactccatggaggaggcagatgcactggcaactcgggcaggaatcatggccaagcgtatgctggcgctggggacaactgatgacctgcggaagagatatggtaacaaatatcatgtccatctagtccattcacaggcaccgcacactacggacgaaactatggaacgcatccgggattgggtgcaaaagaactttcctggtgccgtgatagagcagaagacctatcatgggcagataaggttcagtattcctgcaacagcggcatcttcatctccaaaggcggaaatcactgaatatgctgcgggtcctattgccgaggaagaagagctcggacccggacccagatatcaatccgtcaacaagagcatcgtcagctccatattctcgaagttggagcagagcaagactgatctaggcgtccagtattactctgtcagccaaactacattggaccaaggtcttcaccacggaggcgccggatccgcgaataagtat

SEQ ID NO: 21661 - DNA, 531 bp, A.fumigatus
  unsure (2): Identity of nucleotide sequences at the above locations are unknown.
angaagggccggtcctcggcgggccttcactcccaaccacctggagatggtgttctggatcatctgcccatcgggggcgtttccgccggactgatcccatcttcttcaagcgccccccaggcccgcgccaaggacgtcccgtacaaggagatcctgctgcagatggacccctccgggatcgtcctcctgctcggcgccattctctgcttcctgctggccttgcaatggggcggctccgccaaagcctggggcaacgccgatgtcgtgggcacgctggtcgggttcggcctgcttctgatcgcgtttgcgatcaacgaactctggctgcaggagaaggccatgatcccgccgcgcctgttcaagggccagaccattctcttctcctcgctcttcacctttttcttctccggatcgttctacctgctgctgtactacctgccgacctacttccagtccgtcaagggcgcatccgcctcggactccggggtgcgcaccctgcccctcgtcctcggcgacggtctgtttgccacg

SEQ ID NO: 21662 - DNA, 546 bp, A.fumigatus
gcgactatgaccgccgtggtgaagacttcgatccgcattccggaggatgtctttcctacgattacgcgcactccaggcagtatgatcaattttcgatattatgtggaggtggttgtcgacttgcggggcaagctcacatctcccgagcgctttttaccacgcttcaacatggtatcgtctgggagcaatttctcgccgagtggccaggttctgaaccccagtgacgccaatggcaactcaattaccacgaactgggctggcaacatcctagacacggctcagatacgccgggaaaagggagttgtagctgtcgcttttgaggttgtgatcgggactcgtgactcgcaacgacacaaggagaaaaccgagcgcacgcactccgtggctgcggtgtctgacatatctccaccacaggcacatcccgctgcggaaagtgaccactggcagaacggctatagcccgatgccgacgacgaactcggagtatctgcctcaaaccgactacggctttcccgtacatcgccccgggggcgaagatccgcgctag

SEQ ID NO: 21663 - DNA, 321 bp, A.fumigatus
  unsure (273): Identity of nucleotide sequences at the above locations are unknown.
gctgggacatgggccagattgcccagtttctacagggaaaatacatcagacacgatagtggattatactacattccttgttgcggatgagaagacggccttagatgaggataccctgctccttgtttatgatgttgagggtttgcaggagagtatacggctctcggcctgctttgccaacagtgaggcggtgtctgtctcagtcgcgaccaaggatgtgggtgagctgtggaccctcgcggatgaggatggggtgtacagagggggtccgcancacccgccgccaaaaaagggcgggaaggcgcccaggaagcggctgtaa

SEQ ID NO: 21664 - DNA, 420 bp, A.fumigatus
  unsure (25),(30): Identity of nucleotide sequences at the above locations are unknown.
catgtatccttcagccggcgtgtcnacaanttcttcaccacggactgctacggcggtcccaaacagtataaccagttccccgtcgataagaaacatgccttttccatgattgccgagctcttcgcgcccaagtcccgcggcacggtgacgctcaagtccaaggatccaaaggagaatccggtcatcgactgcaactacctctctgacccgctggatctgctcgtgttgaccgaggcctgtcgcttcggtaacgagatcgtgatgaacggtgcgggaacgaaggacatcgtcaaggggtcgtggccgccgaacctcaagcatcacacctataagacgagggaggagtggattccgtatgtcaaggagcatgcgacgacttgtaagtcatccgtactcgcaacaagacggtcctatatctaa

SEQ ID NO: 21665 - DNA, 189 bp, A.fumigatus
gtcatccgtactcgcaacaagacggtcctatatctaactgacgggataggctatcacgcggctggcacatgcgccatgggcaaagatggcgattcgatggctgtgctggataacaagctgcgggtgaggggagtggctggtcttcgagtagccgattgcagcgttatgccgacgctccatggaggccat

SEQ ID NO: 21666 - DNA, 498 bp, A.fumigatus
  unsure (453),(461),(471): Identity of nucleotide sequences at the above locations are unknown.
gtacaattaacgccccgtcgcgtgtataactgccgaacgaggacttcccttccacccgtcctcaccctctccaccccggaaatggacgacgacgtgctcaagttcgtcttgcgcggccacctcctcgactgctacgagtggatctacttcccctacctgctcgaagcgattgcacacgcagccccgcgcaacccggccaccgatgagtttgtcgtccgcggcctcgccatggccgccgagcgcatccacaagaaccgcaagggcttccgccaccgtcaccacggcgtctggctcatgctgcgctcgtgtacgcggagtgcgctcctgctggttgcggcgagtcgggcggcggggggtgtgcgcgatatgctgcctgtgggttggaaggcggcggttcggggcgcggtggaaatgttggcgtactggagggatgacgccggggatgcgaggganaggctganggttctcgangacgtggtcgcgggatggggggagtaa

SEQ ID NO: 21667 - DNA, 450 bp, A.fumigatus
  unsure (443): Identity of nucleotide sequences at the above locations are unknown.
cgccccgtcgcgtgtataactgccgaacgaggacttcccttccacccgtcctcaccctctccaccccggaaatggacgacgacgtgctcaagttcgtcttgcgcggccacctcctcgactgctacgagtggatctacttcccctacctgctcgaagcgattgcacacgcagccccgcgcaacccggccaccgatgagtttgtcgtccgcggcctcgccatggccgccgagcgcatccacaagaaccgcaagggcttccgccaccgtcaccacggcgtctggctcatgctgcgctcgtgtacgcggagtgcgctcctgctggttgcggcgagtcgggcggcggggggtgtgcgcgatatgctgcctgtgggttggaaggcggcggttcggggcgcggtggaaatgttggcgtactggagggatgacgccggggatgcgaggganaggctga

SEQ ID NO: 21668 - DNA, 513 bp, A.fumigatus
cccctggtaacatgcccgcactgcctatccgaggtgaagacggagcgcgaagtcgtggcagctcaagctcatcaccgcggctcggatagtacgtcgggtcacaaaacccctccaccttcccttcgacgtcgaaagtctcgctgcagcgttcagaaaggctcgccaccgaaccgcgtcactaagaggaagactcaggtcaagccaaacattagagcgtcagcttcgaaacagcatcctgccaagtcgaagaccaagggccacgtcttcgtctgcagcttctcacgctacggctgcgcaagtacctttgcctccaagaacgaatggaagcgacacattgcctctcagcacgtccaactcggcttcttccgctgcgacgtcggcaactgcaacggcggccacaaacccaacaacaaaatgacctcaacttccaccctcaaccaccacgaccagcccggtcaccaaaccaacgactttaaccgcaaggatcttttcacccagcaccagcgccgcatg

SEQ ID NO: 21669 - DNA, 231 bp, A.fumigatus
catcgggatatttccatactaattcgatcacagcgattaccccatcttctgctatatggccctccgggtactggtaaaacatccacaatcctcgcgctcgcaagacggatctatggcagcaacaatatgcgacaaatggtgctcgaactcaatgctagtgacgatagaggcatcgatgtagtgcgcgagcagattaagacttttgccagtacgttacatcacaccttgata

SEQ ID NO: 21670 - DNA, 363 bp, A.fumigatus
aagaagtcggtcgtgatgagcctgtacaatgcggcgagtgcggctggtaacatcgtcggaccaattctgttcagctcggaggatgcgccgacataccatcctggactgcaagcctgtttggggatttttgtggcgctggtggcagtggtgttgatccagtgggccgatctgttcgtgttgaacaagctgcaggagaagaagcgggtgcggaacgggaagccggccaagatggtggatcgctcgatggacgatcactatcacggcacgggaggcgacgaggaagctatgcaggaggaattgggcaacaatggactgctggatgtcactgaccgggacaatgacgagtttgtatatatttattag

SEQ ID NO: 21671 - DNA, 225 bp, A.fumigatus
agtgatctcaaatcctttcaaattctttggattctcttcttgttgcatgcggccacaatgtgcaattattttaagaactactatatctacagctcttgccgcgaaccatcacagcatttcatccgcacatcggtcgacggagctaaggagagcaagtgtccggacagccctcatgacagattcattgtagtcgtggggaaatgccgcctctgtcctcctcgttga

SEQ ID NO: 21672 - DNA, 324 bp, A.fumigatus
  unsure (14): Identity of nucleotide sequences at the above locations are unknown.
ctcccctcagttanaaatagccgggcatctggcgaatcccgaggtgaagacctggcgcacgatctgcgtccgcgcgccctacaatgggatggagtcatgcatggcaattctgcctgcgccctgcccccgagtataaacagcgccgtgccatttcccgcagctcatatggccgccccgcaggagctgttgttgctctcgccgcaagccccggccgaccccggctcgagccagggttcgccgagcgagctgggcgctggcggttatcctgatgtgaatactacttctggtgtgcgtctaattctactctacccctctacagggtag

SEQ ID NO: 21673 - DNA, 210 bp, A.fumigatus
tgtgtagtttcaaacgtgacccccgaggaccaggcagttgttactgcctgctcgtaccttttccgctccctaggttcggttattggtgtgtcgttatcctccaccgtggttcaacaactcctacgcagtcagctcagattcgctttgcgcgatagcaaggacattgatcgtattgtcgaaggggtgagacagagtctggactacatcaaa

SEQ ID NO: 21674 - DNA, 513 bp, A.fumigatus
gaccctgaggacagagagcgcattgctgatgtggtcttccgcagaatgcgtgatgaccaccaaagacttttgaccgacgtccgcagggacggtattgatgagcgctggagacggagggccttctacacggatgtagaagatggcgccactgctcccgaaggctatgtgagcgatcctgatgttgaccatctgtctgaggatgaggatgcccccggtcacccttcagctctcgattcccaccctccatcgcctcgttctcggtcatcgtccaaggtgcgcttccaggacgatctcaccgatgactatgacgtcagatcgaatccctctacttcgtctcgcagtatccctgtaggcgagcggtggggtgggtttgagatccccgaggtcgagaaagacgtcggcaaggagatcttgtatcaagtaacgcagcaaggattcaacgaacttcttgacatcctattcaagccgaacgaggtcatcgccacggacctgacaaatccgcactcacgatcc

SEQ ID NO: 21675 - DNA, 534 bp, A.fumigatus
  unsure (3): Identity of nucleotide sequences at the above locations are unknown.
aanaagggtgtctcgctgagtacgcggactatttacagcatggcagagctctccattggtttgtttcaagaagacgacttgatggagaggtcgctcgcaagtctaccggacactgccatccccataataaccgactatatcgacaagttgtgccatgcaaccgacctttgcaaagatcattctctgcaccaatgcctggatggagataatactcctggtatggatgaggaggctctcaccatggtcaaagtaatgcagcaaaatatagaacgctggttccgttttgtcttgggtgaggacttcactacgaatgcgagctcttcggataggctcgatctggaacaagaagtgaagctggcgactttggctgctacccagcgagccagggagaacagagcactaagcaacagcagtggaaattcgcacaccgagcatgtcactctacgctcaggccagaatttctatacatggctgcatacatctgctgttcatgacgtcaagagcgcggtcgtgtctaaagcccttatctgtacg

SEQ ID NO: 21676 - DNA, 204 bp, A.fumigatus
accgggcaatgtaggcttacctcccagctattcttatgggtctttttctggactaacaggtggcaggtcacacccgttgcagagttcaacgcatacgccgacgcattcgccgcggcgcgcgttttcgccctcacctcccctaaccccaaaaccaccatgccatccggcaccaccctcccgtcctaccccgctaaactaagcaaa

SEQ ID NO: 21677 - DNA, 486 bp, A.fumigatus
  unsure (12): Identity of nucleotide sequences at the above locations are unknown.
ttccacagctancttgctgcgggctgtgtaagacatatgttcgagccctcggcggatcccactgtcatcgagcccatacgcaccggagactcggcgcatcggtcctttattgcctctaagcggcccgcgcaccaggaaatcctccgcgtactacgcgagaacgatcccgacactgtcaccctcgtggccgtcggcccgctaaccaatctggccctcgcttccgcggaggatgccgagactttcttgcgtgtcaaagaagtagtagtcatgggaggagcagtcaatgaaccgggcaatgtaggcttacctcccagctattcttatgggtctttttctggactaacaggtggcaggtcacacccgttgcagagttcaacgcatacgccgacgcattcgccgcggcgcgcgttttcgccctcacctcccctaaccccaaaaccaccatgccatccggcaccaccctcccgtcctaccccgctaaactaa

SEQ ID NO: 21678 - DNA, 201 bp, A.fumigatus
gcccccccatttttaaataaggccggatcgctcactcccgaggtgaagacgactgtggaaaatattatgattattaactctattattattctacattacatattatatagtaatataagccgtaatagccctaccttggggagaatagtacctcctcagattaggttgaaaagggctataaaagccaggtccccatcttga

SEQ ID NO: 21679 - DNA, 519 bp, A.fumigatus
  unsure (301): Identity of nucleotide sequences at the above locations are unknown.
aatgccgcactcgaggcgcagaagaaagcggcggaagccaacgacgtccccaagctcgtctccgtgcagcaagcgatcaaattcaacggcggggggcacatcaaccattccttcttttggaagaatctggccccggagaaatccgggggtggcaagatcgatcaggcaccggtcttcaaagcagccatcgagcagcgttggggatccttcgataagttcaaggatgctttcaacacgaccctgctgggcattcagggcagcggatggggttggttagtgaccgacggacccaagggaaagntagacattaccacaacccacgaccaggatccggtgaccggggcggccccgttctttggggtggatatgtgggagcatgcttactaccttcaggtacatctccattctctccggcttcttttcttttgttctccatgctcgtttgctaatgagtcaatagtacttgaacgacaaagcctcgtatgccaagggcatctggaacgtgatcaactgggctga

SEQ ID NO: 21680 - DNA, 363 bp, A.fumigatus
gtcgcagagcccatcgctctgacctccatattcccatactcatgggttatggttaaggattttcgagtagcagatcgcacagatgcgtctttgtatgccggaatcctcgtgtccgctttttctcttgttgaagccctcaccggtatgttctggggaggtctttcagaccgcatcggtcgtaagccggtccttctgtccggttgcttcggtaccgtcctgtcccttctccttgtgggattcgcgccaaacttctgggtagcactcttaggtcgcgcactaggtggtctgctgaacgggaatatcggagtcattcagacaatggttggagaattagtcaagcgaccagaacatgaacgtaagtga

SEQ ID NO: 21681 - DNA, 189 bp, A.fumigatus
  unsure (35): Identity of nucleotide sequences at the above locations are unknown.
caatctggaaaattccagcatctcactcctcattntatgtaccctgtcgacgaccccggggctctccaatatctttgtatgggcgttgctgctcagatgacctcgtctagatacgtaagtaccaaggtacctgtggaagtgataccacgttatctgtattgtaattacaaatactatcccaagatataa

SEQ ID NO: 21682 - DNA, 522 bp, A.fumigatus
  unsure (409),(448): Identity of nucleotide sequences at the above locations are unknown.
acagtcgcttcagccatggacacttaccgcatcaatcggtataacatcacggaacagaagacctacacgaaccgtctgatccaaggcgccctgcggtaccagaagttgaacctgtcaagtgctggggagcttgagctatcttttgtggggttcaagccaactgtgcatgaggttcccatgtcgggacttccagggtcctttaattgctcggacccggtgctgaatcgaatttgggagataggggcgcgtactgtgcagctgaacgaatttcctgcaagatctcttccggatttctggattttgactgaagaaggagctctggtggatagccttgctccccaaccatttgcagcggactttgcagctaccatgtcggcttacaaggtcaccttctccgtgaagccggtancgcatggttttggcttcactgtgttgagtgacacgctanggaatgggatttacatctttgtagatgtagttaactcatcgatctctgctcatgctggatccacagagattgga

SEQ ID NO: 21683 - DNA, 342 bp, A.fumigatus
accttccataggagagatgagactctacagccactaaccagacagacagtccccacgggcctcttcatccacaacgaattcaccccctcatcctccaacgagaccctcaccgtcgagaacccaaccacaggaagcaccctcggcaccgtctccgccgccaccgccgccgatgtcgaacgcgccgttacctcggccaccaccggcttccagacctggcggacaacccccggccccgagcgcggccgactcctcctcaagctcgccgacctgatcgagcgggacgccgaggagtttgccagtcttgaggcggtcgacgccggaatcctctacaccgacagcatg

SEQ ID NO: 21684 - DNA, 234 bp, A.fumigatus
  unsure (203): Identity of nucleotide sequences at the above locations are unknown.
gcgttgtcgattgttggggcctcgtgggggctcgtgtttgcttctttctcgacttctgcttctgccggtaaggcgcagcggcatgcgaagaagggcaagagtagcaaggagaggcaggctgagggctccggacccctcatgaagcggattgtggttgatggatgcgatttgttgattcctggggtatttctggtcttaaccgnggggatagaagccagtgcgctgcccccatac

SEQ ID NO: 21685 - DNA, 462 bp, A.fumigatus
ttttgtttccaacctatcgatgactcccgccccgtccgtatagaccaacagatgcccagcgccctcacgcacatcttctggtccaacaccgacgtctccaccggcatcacccacaaaccctacggcgtggactggatcaacttcgaaagaaacatgtaccgcctctgcgtcctccaaggcaaggtccgcgacggcgacaaggtccccgaggatccatgggagatgttcctgcgcgagcttgcaccgctcacgaaacgccccgctggtcagccgcagccctcgactgcatactttcctacctcaattttgcggtcgtcggtggggaatgcaaatgcaaacgccagtggcggtcccagtgcgggtcaggatggccagcatcatgtgcttttcgaggtgcctttattgcgccgctcggatgagaatcggcggaacgtgggccggatcccgcgttatttgaattga

SEQ ID NO: 21686 - DNA, 534 bp, A.fumigatus
  unsure (504): Identity of nucleotide sequences at the above locations are unknown.
ccttccagcctcgtcgttaagaccgcagatgaccaacagaacatgccgcacagcactcaatatggatatggcaatcagtattgcccatatggcaaggctggcatatacggccagccgcacggtttctcctacgaacactcctcctcgcctgctaccgagggtagcttcaaccaatctgctcccggccgtgactccgtctatggccgcaccggatccacccaaccttctgagacccagcagaccgccgccggcaccaacgcctttggcgcgggcatgtcggacgtatttggccgcacacaagctggtttcggacaaaaccagcccatgtcccagcagcctccggtgacctctgacgataccaagagcttcaagacacctaaagcggccggccccagtccctcccttgcacaggccaaccgtccgggctctgacactaacaacgtgcccggacagcctcaggcacagactggccttccccctcttcaaagccaacatggacaacanggattcagtggaatacctcacctgaacccc

SEQ ID NO: 21687 - DNA, 279 bp, A.fumigatus
caaagtcagctcgtcatgcagtttgctctaccccctcggaggagtcctcatacttcttcccacacccgctcctccaggctttctttacaacgcaagaaacagctcaagaccgctgcaattttaggctttgctatcctcaccctcttcttccttctatcacacttctcccattcgagtacagcaccaacgtctgccccttcgggagcttcaagcattgtcattgtgacggatctagatcgagcccgtttcgccgttatacatcgctttcttacgagctag

SEQ ID NO: 21688 - DNA, 408 bp, A.fumigatus
gttcggtccaaattaccctaccaggggaagccgattcggggtcggccggaaatttctcttgggggcagcttaactcggtattcatggcggcatgcacgaattttccccagtctgctagggttacgattcactctaggcgcgtttgaagcgatgatcggtatgtcctcccccgcccgatctgatgccatgctaacgggtctagcccctccctgcgtggctgtaacgcaaatgtggtggagacgaggggagcagacgcttcgaacagccttttggaacgggatgaatggggtgacctttattgtcggcagcttgttcacctacggactcggccatatccatagcgacagcctattctcataccaggtaccgcccttcctccctggtcgagcgacagaagctaatgagtag

SEQ ID NO: 21689 - DNA, 363 bp, A.fumigatus
attatctttatgttctgcggtctgctgactgtcgcctactccttattaatatttattttcatgcctgactctcccatggaagcgaaatgtcttagcgaccgtgagaaggtgattgccgtcgagcggctccgcgccaaccagatggggatcatttcgcgggaatggcgatgggaccacgttcgggagacgttctacgatctgaaaacgtggtgctggtttttcctcatcgtctcgatctcgtacgtcgtccctgccagggtggatttgcgactcgcgctaacctatgcagaatcccaagcggaggcatcagtacgtcgggccacctgtcttcactacgagcctgccggaccgaactacggtagg

SEQ ID NO: 21690 - DNA, 231 bp, A.fumigatus
  unsure (221): Identity of nucleotide sequences at the above locations are unknown.
ccgtgtaggtacctcatcgggcaaggaatcggcagcatcgtcttccctccctactcggaagcatttggacgcaagaaactgtacattgtcagtacggcgatgtacagcttgtcgtgcatcatcatcgcgattgttccgtcggttgctggcgtagtcgttggacgtctactcagcgggttcctgtcggcgattcctactaacgtagtggcaggccgtatcgnagacttttga

SEQ ID NO: 21691 - DNA, 186 bp, A.fumigatus
  unsure (172): Identity of nucleotide sequences at the above locations are unknown.
gctactgcggcggctacgatccttcctatcctcagtgtctccgccatgattatcgcagcatatcagatgggctttttctacaacatcaaaaaatcttgcaattcgaacatgcgaatcgggctgccgaaccatgtgcggccacgaaacacaatcctgttgcctcctaccacantgccgcgtccctga

SEQ ID NO: 21692 - DNA, 282 bp, A.fumigatus
atagggccatatcgggttcagtccggtggccccgatccgcggcgccgatgcgttgcggctggggcaactggccaagaaacactgggccgcctcggggctggattttttttcctcgactttgtggttgggcttcgcgaactgcatctgattgtggagtgtgtgtatgatcgcgatgatgcacggcagcgctcctcggccctgcaggtgatgagggccctgattcaggacgccgccgcgcagggatatggcgagtaccggacgcaaatggactgcagaggataa

SEQ ID NO: 21693 - DNA, 408 bp, A.fumigatus
  unsure (343): Identity of nucleotide sequences at the above locations are unknown.
aatctttcttctcatacgatggatccaattaacccggacttagtgaactgtccatttatggcttcgtcctactcttcactcaacttcgatggtccattgagggtggatgcaaaccacgcgatgaatccgcaatacgcgcccaacagttttgtgcataagtttagaccagatactgccgaggcaccgtaccagctggcagataacactgtgagccgcaagtctcacttctaccacgaagggaagttgtcggagtatgaccagccgcgtgctctataccaaaaggtcatggatgctcgggggagagagcatcttcattgcaatactgcacgcatgctcaaggtanttgaatatcccgaaattcaactcagatacctaacacagctgtactgcattgctccggagtatgca

SEQ ID NO: 21694 - DNA, 273 bp, A.fumigatus
cgctcaggcagccctgcgcacttgattctgcaagtcgagctgaatttccgttgccacaccaagctatctctagcatgtaagaattccttgcaactctacacagcagcggtggggaacaattggaagcgctcgatttcaatggattactggagagatttctgtcttcaggcctgtgggtattcagagaagttgagctacgactgcaggccaagagagatttcagtcagtaagtaccgtctcctaagtggtcatttttgttctacaccggcgtaa

SEQ ID NO: 21695 - DNA, 651 bp, A.fumigatus
  unsure (57),(81),(232): Identity of nucleotide sequences at the above locations are unknown.
tactgtccccggagcctttctgtcccatccgcgggtgatgttcaattgcccttcgcngagtcgtcgggttccccgaaaccngattcagcaccatcccaatctgcaacaaccatccccattcccgtttcgaagcgtaaggcatctttctcggctcccacacggcgcgtgactgttgaagaagctcgtgcgccatctcaacctagagcacatcatgaaaccaataccgagcgcntacccgcaaacttcgaggcgaatggacccgagagacatgggggaatagttcaaagtatcgaagacccccaaaaccttgtgagccgtaatgacacttcgacacctgcggctggttctcagcaccttccacctgttgagagtgctacagagatccgcccatccaagcgcgtgaaactgactcaagaatcgtcgaaaacatctacccgtcctactccttcaccatcccatgtcattactcccccaccaatccaacccccaacggttgatgaaactatggaagttaccgacggagctgaatcgcaaccaaacgccgaccagactcgaagggcgtcgaagtcgcgaggcagaagggcaagccgcacctccaatgttgaagacgctgcgggcaaggcgaagaggaagcaacaacggtctcgcaaa

SEQ ID NO: 21696 - DNA, 240 bp, A.fumigatus
cggaggcgctgctctccccgtttcctgtcaataaatgcatcttggacccattctacaatggtctcaccgaaatccagctcccatccttcttcaaaaatagatgtcatcaaccattccctaatcgtcattaaattggtgttctaccttcgcccccatcccggtaaccttcaacccaagttgacttttattcacctggttccgttgttttcccataaacaatgctccacggtcccccaacat

SEQ ID NO: 21697 - DNA, 360 bp, A.fumigatus
gatggaacgaaagtcgtcggagcaggtgccgacaaagctgcacggatgctggatctcgcagccaacgctactacacccgctcaagtcgctgcccacgatgctcctatccgatgctgccatatgatacctaatccagctggaaactctcctcttcttgtgactggttcatgggacaagaccatcaaatactgggacctgcggcaatccacccctattgcgacggtggagtgccaggagcgcgtctacaccatggatgttaagaacaaactactagtggtgggaacggcagatcgatacattgatatcatcaatcttgacaatcccacaaagttttataagaccattcagtcaccactcaag

SEQ ID NO: 21698 - DNA, 657 bp, A.fumigatus
  unsure (608): Identity of nucleotide sequences at the above locations are unknown.
tcgagtcaaagatcagaggactttgccatccaggctgctgccatactggacacgttcgccgcttacatgcaccgcaactttgatgtcacctggaagattcgcggcgtcacgcgcagctgcactgtcgctaagatggacagcatcaacctcacctgcgttccgggccgcaaatactggttcaagtattggttaaagcgggccgtgctgctgagcgatatcgacctcgaagatcgactgatggtgctctctccccggccaacgcacaaccaacgcggtccgctactgacaccgtcgtcatcttcgccgtcgttcgattcgacgacaccgggggcgtcggacgatgacgattactattttcctcctggtcctgcgtttacgccttccgtccggaatgcgcgtcgggtccgtgagtcggcgctgcgcatggttgatgtcaacgagtacctcaacgacactcccgtggccttgcgcgagaaccaccgcgtcagccgcccgcccgagtgccgcgactggtccgggtatctggggtttgtgggctattcgcaggatcataagcatttggcgagcattatgctgggaatgtgcggggtgtggaacccaaaggctcnggggatgtgggatgagaaacatgcccgaagatcagtttactggttgtaa

SEQ ID NO: 21699 - DNA, 498 bp, A.fumigatus
gagcgcttgtccttccagcggcgggtgaaaactgctaccataggtaccactagtggtacctatggtagcagcaacacctacgaatccactagcaacacctacggatctagcaacacttatgaaaacagaagcaacactgctggtcctcacggatccaacattgccaacaagctcgacccacgggttggctccgacgcggacaaccgtggcctgggtactggcactggcactaccagtggcactggcgccttcggctccggaactggaactggaactggaacgacaggctacggcaccacttcctcaaacgttggaccccacgactccaatatcggcaacaagctcgaccctcgtgtggacagcgaccaggacaaccgcgctcgtcgccaggctatggctggcagcagctacactggcgctggtactggcaccggcactggagctacggctggtcctcatagctccaacatcgcgaacaagctcgaccctcgtgtcgat

SEQ ID NO: 21700 - DNA, 456 bp, A.fumigatus
gtaccactagtggtacctatggtagcagcaacacctacgaatccactagcaacacctacggatctagcaacacttatgaaaacagaagcaacactgctggtcctcacggatccaacattgccaacaagctcgacccacgggttggctccgacgcggacaaccgtggcctgggtactggcactggcactaccagtggcactggcgccttcggctccggaactggaactggaactggaacgacaggctacggcaccacttcctcaaacgttggaccccacgactccaatatcggcaacaagctcgaccctcgtgtggacagcgaccaggacaaccgcgctcgtcgccaggctatggctggcagcagctacactggcgctggtactggcaccggcactggagctacggctggtcctcatagctccaacatcgcgaacaagctcgaccctcgtgtcgatt

SEQ ID NO: 21701 - DNA, 297 bp, A.fumigatus
tggccagaggctttttccctgttttatgccaacaccctttccttatcccttccctttcaggtctctaggctggcaacgactctcctaattagggttctattgactgagttgcatgctgcagttgagaatgtgaccatggagcactgcttgaaattccacgtattatgcaaggatgccttaatcatacgacggaagcctccgctggcaggcttgcatactgcaattctagatctgttgacaaacaggcgacgtccgtgctccgattcgacgacgccggggctggaagatatcgcgctc

SEQ ID NO: 21702 - DNA, 324 bp, A.fumigatus
  unsure (310): Identity of nucleotide sequences at the above locations are unknown.
atgactggtacagggtgtttcaggtcatggagcgaaatgacccctatactgcttcttcagatcttcggctggaggataggctggacttctatgtataaatatatcgaagatgtagtgatggcttgctccatggccaggacagacactcctttcattctctcctctcaaggctggccctgtcgcaatggcgaggttcgcgtggcttctgacctcaagtctttcgttctcgattctttctacagcttttcccggctggcgctcattttcaagctcctaccaactttgtcttcacacacgcagctggcaggancaacgcggagcggg

SEQ ID NO: 21703 - DNA, 501 bp, A.fumigatus
cgctgttccttccagccgcggggtgaagatcaagatcaggacttgactgctttggaggatatccttaagtggaaaggattcttcagacccaacgtccttggccttcttttggtggcagaattcttccctaaatggcataagatcctatacatctggcttaccaatgatccaaacttcgaagaggtcggcgaatggttcacctggtggcgcacccagatcccggcagagatcaacgagctcgccgtcgtcgacgacgaatggaacaaaggtctccaacaaatggaccttgcgtcccgcctggacgaccccgccaccgagctgccagtccccaacgccgcagcgcaaccggcgcccccagaagacgtgccccacgccgcttcagaagcgcctgccccgtctcgcaaacccaatgtcgtcgaggaaatcgccttcaaggatattcttgaatcttggtgcatggaacagggtcttatcatacttcccctgcgggaagcgcacccg

SEQ ID NO: 21704 - DNA, 786 bp, A.fumigatus
aaagccaagtgggtggccgagcagctggtcctggaggccggtcgccgcggattgcccgtcaagattcaccgtgcgggcaccatcagcggccacagcgtcacgggagcggccaatgcctgggatctgttgtcggcactgatagtcgaatctatcaagctgggctacgcgcccgacgtcgacggctggagggcggaaatgaccccggtggactttgtcagcaaggcgattgtccacctggccacccagacgcaggccggccagacgattttccacctgggtgatccggatccggtagacacgagacgggtgtttgatgccctgtcggagctgggataccccaccaagcgactcggatgggacgagtgggtggcgctttggacggagaaacaacgatcggtcaagggaggcgatggcgcatttaccgttgatattctgcgaagtggtatgcccacggtggaattcctgcggggaatcgttgtgctcgacaacgcggcgaccaatccattccgcgccgtggtcgaatggtccagggtcgatcgcgcattgttagagacctatactcgtcattggtttgctcgtggatggcttcccaaggctcctgcccggttggccaatcctgttgtcgccatccggggtcctttgaaccgccgggtggccgtcatccaccgggggtcctctgggtattggcgcccgctgtgggcaaccgcccctccgtccgcgaaagggatgccatgtttcccctggccggttcgcccgtctgggtattccctcgaattccctttcatc

SEQ ID NO: 21705 - DNA, 189 bp, A.fumigatus
tcgctgatccttccggccgctggtgaaaacatctgggggctaccagcagctaccatggaaatcctgaagcttaataatggacatctccgcgtgatgagtctctgccacaatgccctacaaatcatggctggccgtatcgtcctttacgtgacattcctagtcagactccttgcctctcttgcgccttaa

SEQ ID NO: 21706 - DNA, 327 bp, A.fumigatus
gcggcgcaccaggatgcattggcatcgcctatgggcgtatacttccgtgtcggcctcgatgccggaacaaagctgggccacagcctgggcggcctgctgaccatgcaggatctggatgccgggtacggggaacggacgctgacctggggaggtgggatgactctgttctggtttatcgaccgcaagaacggattgtgcagtgtttgcgccatccaagcctcgctgccgttcaataccgacgctgtgatggcgctgcggcagacattccgccacgacatttaccgcaagtatgctgcgtttaaggcgcaagagaggcaaggagtctga

SEQ ID NO: 21707 - DNA, 279 bp, A.fumigatus
agacgcggcactctggctcgaaagattactgtagacccgaacatgacgctggaggaattcatagagagtctcggtgagcgagccgaggcccagctcaagaagccgagtatgagaacggaagaaaagacactctaccaacgtttcccgccccagctggaggagcagaccaggagcaacctgaagctgaagctgaaggaactggttgaaaatggtcaggaaattgcggtcagcgaccccgcgtactctattgactttcgcttccaattgatcttcaaatga

SEQ ID NO: 21708 - DNA, 198 bp, A.fumigatus
tcttttgcccgccgtatacgtactaaaacaatgctcgcttcgactcttgggccatcacgcacgccaacgtatacacttgtgacgaggcctcagcgatttgctccctgcatactcttcatgtccaagatcacctcgctgcttcccggcaacgtctcctccgcctatatccacgcagtggccggagcctttgccagatga

SEQ ID NO: 21709 - DNA, 309 bp, A.fumigatus
tcaaaaatgaataggttcatgggcgctctctccaactctggccgtcgctctgccaactacgtcggcttttacaagggcatccagtcctgcggcgccgctattgtgaacaaccttgatgctcgcaagctgtcttacgagaaggaattcatcagtaactgggtgctcctctctgtctccctcgttgtggctgcccccgtcatcttcttcaagatccgtgatcacatcgatgttcaggatgatctggcgggcaccgacgagactatagcggatgttctgcccgctaaccaccccgagaaggccgtggcctag

SEQ ID NO: 21710 - DNA, 432 bp, A.fumigatus
tcaatggtatggtttaaactacgatttcacaacgccgctaacatggcacatatggtctcttttgacaatggcagaacactcaagcagaaggccgatttcgcgaatagcaaatgccttggcggccttttcagttgggcgcttgatcttggaggccctggctctttggccaatcctaacgatctaagctacgacgatacaagcatggagggtgccaatgcaggcggaggcaccgatggaaccggccttttctatgtcgggccaggagatcttcgacgaaagtcaaaacaccgtgactgctgtggcccccggtcaacgtcttctttccgaaattcgttctcggatccccgacaaccattgatttcggcgctggggtttccaacttcattggaggttccaacttccaccaccacttaccgttcttacgcgggaacg

SEQ ID NO: 21711 - DNA, 504 bp, A.fumigatus
  unsure (8): Identity of nucleotide sequences at the above locations are unknown.
aacataancgcgtgtcgcgcctctaggatgaatatgtgcgctgggcttgatcttctgtggcgtaacaatattgaccctgccaaagttctgctcgggctgggcttttatggcagatcgttcacattggaggactcttcctgcaacacccccggatgcgcatttagcaccaccagcggttcgggaggtgccagggctggtgaatgtacaggaacgagcggtattctctctgactacgagattagccgcattatagatgactactcagtcaatgtgcactatgatgaagctgccggcgtcaattggatgacctggagtggtgatcaatggtatggtttaaactacgatttcacaacgccgctaacatggcacatatggtctcttttgacaatggcagaacactcaagcagaaggccgatttcgcgaatagcaaatgccttggcggccttttcagttgggcgcttgatcttggaggccctggctctttggccaatcctaacgatctaa

SEQ ID NO: 21712 - DNA, 198 bp, A.fumigatus
  unsure (65): Identity of nucleotide sequences at the above locations are unknown.
aaaataaaaataaaatggaaaattactgtcaggacctttagaccacgaaacctcactctgttcantacaagatacatcctcattctcccactcattctcctactctggacgcactatcttgcctttttttttattattatcctttcgtcttgtcttctatcccttttctcttcaacattctacctgtctactatttga

SEQ ID NO: 21713 - DNA, 450 bp, A.fumigatus
aaacaaatttgcattctatcaacgccccccccccctactccatcctatgcaatgaacttatcccatgtttacgagatgctatcctcccagataaccttcaacccaatcacccccatccatgacgccacccggtccacccaagttgacaggcaaagccctcgctcgaacctctccgacaccccaccgctgaaaagtccgataccacgcgggagccctcctcctcctccttccctcgtcctcgtccgtcgtcgaccaccaccccccccgaagccctacccaagcagggtcccccaccccttcgacccatatccttcccgccccctttgccaccccccatcccagggaccgggtctcctcctcggcccgtgcccacttagccccccgataaaccaccaaggcaggccccttcctacccaacgtaaatccattcgggtttccgcattcacctcg

SEQ ID NO: 21714 - DNA, 417 bp, A.fumigatus
  unsure (1): Identity of nucleotide sequences at the above locations are unknown.
nacatctccagccagaagccgggctacaagcatgccggatatgacgtcgaccacccgattatccctcatggggtctcggtcgcggtcaccgcgccggcggtcttccgcttcacggcggcctcgaatcccgaccggcatctggcggccgcggaggcgtttggcgtggatatctcgaacgtcaagcgcgagagcgcgggcgaggtcctcggcgaggcgctggccaagtttctggccgacctgggtgaccagccccggggactgaacgatctgggcttcaagcattcggatatcgagtcgttggttgaggggacgatcccgcagaagcgggtgttgatgctggcgccgaatttgagtggcgagctggagagagagagggatgagttgagggggttactggagcagtcgatggaatattag

SEQ ID NO: 21715 - DNA, 504 bp, A.fumigatus
ttacgtctctcgggtcccggcttgaagccggaacccgagagacgggatactccagttccgctgaattccaagacgtccacgcccacgccgaatgaccctaccccagaagagccgtcgaactccaatgtcgccagttggtcacctcaagatgtggtcatgtggatgctccaactcgggttcgaggagagcatcgtggagaagttcttcattaatgacatctcgggtgcgatccttcttgagctcgaggccaacgacctcaaagaactcgatattcagtcttttgggaagcgccaccatttaatgaactgcatacgacagctgaaaagtagtgcgtcgatgcctggaggcgatatacaggttacttgggatccttcatctcgcgaagataactcgactccaaaaaccacagctgctgatgttggaaccaattgctgtacaagcccagtcaccgacgaagaaaggccggactccggaaacaaacagcacaagcaccgccgccgccgt

SEQ ID NO: 21716 - DNA, 345 bp, A.fumigatus
attttgactgcgaaatatctgccgcttgacgtcaacatcgggatagggttcttcgcatccccattgactaatctgactgtcaatcagagtcagctcaagacaggagactacccccagcaaatctcgcaacctcccatgtcccccgcctctcaaggggaaagcagcctatccagacgcagctgcatccgatgcaaccagaggaaggtcggatgtgatcgaaaacaaccttgtagccgatgcctcaaagccggggccgaatgcatccactcggggaacaagcgagccccgcggaagctgaaacggcccccgatctccaagattctggtccaccttcaggagctagaa

SEQ ID NO: 21717 - DNA, 183 bp, A.fumigatus
  unsure (114): Identity of nucleotide sequences at the above locations are unknown.
ctctgcagcgaaaccctcgtgtctccaattgccctggcgaggttgtccatgtcggagatggccgccgctatgttggtggctgccagcgcacaggaggcgccaacagcaaggtancaggcaagattcttcagcaacatttcggaagccgattgtgtccgacctaaagatagctctaagggttat

SEQ ID NO: 21718 - DNA, 315 bp, A.fumigatus
taccttgctgttggcgcctcctgtgcgctggcagccaccaacatagcggcggccatctccgacatggacaacctcgccagggcaattggagacacgagggtttcgctgcagagctaccaaggaggcgcctttggtgccatcaacactgccagcgccgtcaacaacgcaaagcttgcggctagagctgctcgagagaaccttgctgcgagcggtgcttttacccccgacgaagcggcccagtactacgaggcttacatgaaaatgaccccagttctactggatgcattgacagttgccaaggacaaggtacgctag

SEQ ID NO: 21719 - DNA, 765 bp, A.fumigatus
cgtgcgctgagcgcgggatcggccggccccgtggtggaggataagggtcaacgtgcggaggaggtccgacagagcgggggctcgcagataagtgtgagagagtgtgccacagcagggtggcaccagatcaaggtcgtttgcaagcgaacgaacatcgtcttctggcgatcgaggaactacggcttcacacgactattcaaccacgtcgtcatcgccctagtcaccggcctcgcatttctgaacctagacgactcccgcgcctccctccaataccgaatttttgtcatcttcaacgtaaccgtcctaccggccatcatcctccagcaggtggaaccccgcttcgagttctcgcggctcgtcttcttccgcgaatccgcctgcaaatcatacagccagttcgcattcgccctgtccatggtcattgccgagctcccctatagcatcctctgcgccgtctgtttcttcctccccctctactacatccccggcttccaagccgcgcccagccgagccggctaccaattcctcatggtcctcatcaccgaactcttctcggtaaccctgggccagatgatctccgccctgacgccaaacagcttcatcgcctcgcagatcaacccgcccatcgtcatcatcttctcgctcttctgcggcgtcgcgattctcaggccccagatgcccggcttctggcgcgcctggctgtaccagctcgaccccttcacccgcctcatcagcgggatggtcaccacaaaactgcccggccgc

SEQ ID NO: 21720 - DNA, 408 bp, A.fumigatus
tcgcggccctggcactccgtggtgaaaagccttagcaataaccagctcatcatggtcctcatggaaaactgctccattaacaagatccctgacattttcttcgtagcctttggtgaagtagagcatagccttggcatatctctcaggggtctcccgcaggccctctctctctgggtcctctccaatgcattcaaatatagttcttacagcacctgcaagtttctgaatgcgctcttcagtttgctcaggagtagattccagtcgtgctctcgtgccgggacctatccacagagccaattagcacaaattcaattagacagtaatccaaaagcgaagaccacgacagtgacttacaaggccaactcagcccgtcaaagtcaattggaggattcgcagtgtacgggctaa

SEQ ID NO: 21721 - DNA, 306 bp, A.fumigatus
ttggctctgtggataggtcccggcacgagagcacgactggaatctactcctgagcaaactgaagagcgcattcagaaacttgcaggtgctgtaagaactatatttgaatgcattggagaggacccagagagagagggcctgcgggagacccctgagagatatgccaaggctatgctctacttcaccaaaggctacgaagaaaatgtcagggatcttgttaatggagcagttttccatgaggaccatgatgagctggttattgctaaggcttttcaccacggagtgccagggccgcgattatgttga

SEQ ID NO: 21722 - DNA, 543 bp, A.fumigatus
  unsure (13),(307): Identity of nucleotide sequences at the above locations are unknown.
tccgcacttttgntccgtccatcgcggcggttaagatatcctggtcatgagtatggtcggggcgccgaggcacgcggagaaggcgctgcagcgcggggtggacattgtctgtgcgcagggtggggagggtggcgggcatacgggcgacatcccttctccgtcctcgtgccggccgtcgtggacgtcgcgaagcggtataagagcccgatgacgggtcagccggcgttggtggtcgcggcgggcggaattaacgacggtcgcagcctggcggcatcgctgatgctgggtgcgtccggggtttgggtangtacacggttcgtggcgtccgaggagagtggtgctagccggatgcacaaggaggctgtggtcagggccctgtacggcgagacgcaccggacccttgttgtcagcggacggccactgcggatgctgccgaatgattacatcaaggactgggaaaagcggccccaggagatcgccgacttgacggccaagggcatcgtcccgatgatgcacgacttggagaacgagaaggaggtcgat

SEQ ID NO: 21723 - DNA, 540 bp, A.fumigatus
  unsure (228): Identity of nucleotide sequences at the above locations are unknown.
cctccaggaggaccaccactgctgtctgctgtaggcgacgttggaggattttaccatgcagatcttgacaaggcaccggctcaatcgttccataacccaacatacggcactaccaatggcattgataacgcgggtaacaaaccatccaaccttgttcgctcgggagccagcgacacgcttcctaccattgcaatgtttacggactttggcaagacctggtcggcaaantacgcagcctcgtccaccacacataccgggcaggttgcgctctctgcggatgccgataccgtcctgctcatgaactctaatggtgccatggtatcaaagtacagcagcacattcagtgccgtctcgtctctaccttccggtgcggccatcgcgtctgacaagtccaacaataccgtcttctacggcggatcggctggttcgttctacgagtccaccgatggtgccacctcgttcaccaagactgcatcccttggctccagcaccgccgtaaaggccatcagtgtcaacagccgggataaaaggaaacgcgct

SEQ ID NO: 21724 - DNA, 342 bp, A.fumigatus
aggtcggccgtaaggcacagctttcaaatattaccgctgcgaagacgtacgtgtgatattcgacccgatatacctactccgagaataatagggaccctatgtagcgttgcggacattatccggtcatgtcttggacccaaggccatgttaaagatgctcctggatcccatgggaggtatcgttctgacgaacgatgggcatgctattctgagagagatcgaggtgtcgcaccccgcagccaagagcatgattgagctcagtcgcactcaggacgaggaagtcggagacggaacaacaaccgtcatcatcctaggtattctctattgtcggtcattcacttga

SEQ ID NO: 21725 - DNA, 447 bp, A.fumigatus
cactcttcagctggagaaattcttgcccaggcccttcctcagctcgaacgcaacatccaccccgtcgttatcattcaggctttcaagcgtgctcttgccgacgctcttgctatcgtggaggaagtctcgctacccgtggatattgacgatgacaaggcgatgtacacgttgatccaatcgtccatcgggaccaagtttgtctcccggtggtcggagctgatgtgcagccttgcgttgaaagcggttcggactgtttctttcgatgctggtggtggaaagcgggaagtcgacatcaaacgttatgctcgtattgaaaagattcctggtggtcagattgaagacagcgaggttattgacggtgtgatgatcaacaaggacattactcaccctaagatgcggagacggatactcttcaccacgaggcgccaggagccgcgcttaggttca

SEQ ID NO: 21726 - DNA, 195 bp, A.fumigatus
agcaacaatttatcccgccatgtcaaagcgagtacgtctaacgctttgcaacgcactttttttccaagtaatcaatattcactgtatactatcgagccgtttatgctcctattcaattttgctgaacttcaatcctactccagtgaatggctcttgtccctgcgctctcgtggaacccctcccaacgatctctaa

SEQ ID NO: 21727 - DNA, 444 bp, A.fumigatus
  unsure (430): Identity of nucleotide sequences at the above locations are unknown.
cagcgcaggttgcatcgctgggggccttcatggcgcttgccctcgattatctgtggagactgcgcagacaccgacagtcacagtcctgcgtgttctccgtcggtggctgttggcaatggagggggtttctctggggttagttccacacccataaacaatcacctgcaagggacagtccgaactgagagtacatcaggcattggaattgcaactttcctcatcttcattcgatcgatctttcgtacggccgaattgaacggcgggttcagcagtgaccttgccaatgacgaggttgcgttcatgatcctcgagggtgcgagcatggtcatcgcctgtggcggtatgagtatattccacccgggaatgagtctgaaagggcattggaaggacccgactccttctactcactggggtttggacaggctgccgngcattagcgaataa

SEQ ID NO: 21728 - DNA, 516 bp, A.fumigatus
agtcgtcgggtaccggcgaacgcctcatgtttcaatcaaatccgttcaatttttcggcattcttccattaagtaccgttgctcaagtccaatcaacctggcccgcgttgatgttaatggagcaaggtacttcatctgtcttaccatcggacccgcttttatcaccgcagcgatctacctctgttttggacgggtcatcattttatacggcgaaggcttctccagaattaaatctcgaacatatgccattatttttgtgacatgcgaccttatatgcctcattctgcaggccgcaggtggagctgtgattgccactgcaggccgggaccaagacggcctccgccataccgggatcaatatcatgatcacagggctagcagcgcaggttgcatcgctgggggccttcatggcgcttgccctcgattatctgtggagactgcgcagacaccgacagtcacagtcctgcgtgttctccgtcggtggctgttggcaatggagggggtttctctggggttag

SEQ ID NO: 21729 - DNA, 216 bp, A.fumigatus
  unsure (209): Identity of nucleotide sequences at the above locations are unknown.
tccggccagaccggtcttgcctcgccgccccacctgtttttcaaagccgagaaacacgagatcaccaaggcaatggacagcacggattcttcctgggaaatgccgttcgtgattaacatttggtcggtgcagctgtcctggggtgattgccgagctgcaccgccattttcggtctggtcgtggcgcggtaaaaatagaggcctcatccnacggtag

SEQ ID NO: 21730 - DNA, 459 bp, A.fumigatus
  unsure (8): Identity of nucleotide sequences at the above locations are unknown.
agcgatgntccttcctgccgactggtgaaaattgctcctcggtgtcccattgtaattcaattgctaatgacagccgcaggcgccctgaatatgtcccgcgcgctcggagacctccagtacaaagcacccctaatcaacgcggatgagcccttctctctcgagcaggagattgccgggttcaaccctgacaaggaacagggggatctcctgtctaaccgaccggcgatctcgcggattgagctcaaggaggacaggaagtacatcgttattcttacgacggatggggtgacggacgaaatggaggatcggagaatccttgatcaggtcgtggcgcattggaattatgggactcgggcggaaggtgtcgcgggtaaaatcacgacggaggcgacggggggcccgatgagtgataatgcaacttgtatatgtgcttttatttatgggagacaggcagcatga

SEQ ID NO: 21731 - DNA, 237 bp, A.fumigatus
tgcaacttgtatatgtgcttttatttatgggagacaggcagcatgattgggcttatcatggcgtggcgtatcataccatatgatgtgttcagcagctcccagactatggacatgggatccgaatataccccggctagttattgtacttcctctggttatccatatatcaaattgtttttgcccatgaaaagcatgcaacaatcatatgtttgctatcagctccgctctggcgaataa

SEQ ID NO: 21732 - DNA, 198 bp, A.fumigatus
  unsure (32),(36),(37): Identity of nucleotide sequences at the above locations are unknown.
atacattttttggcgcctggcttcttattganagannactggatcgtcctcccaaaagtggacgattcttcggacctgagcttggaggatgacagagcctactcggccccggtcaaaacgggttccggtcccgcaggatcggcccgggtggtggagcatacaagcctgggcggcgctatcatgaaagccagtgactga

SEQ ID NO: 21733 - DNA, 624 bp, A.fumigatus
gtttcaccccaattaattatttcacccaatggcacaagtggaataaatttccgcggcaagatggcccatcatcaacaggggaatttgggaggggggttctctctattcactggtaactgttctggggccgaagcttgtattgggattggagcagcatgtgctcgtcaatggccccagaagggattccatctcgccttgacttactccactaacctcgaggcaaggaatatgctcgtaaaagagcttagatccagtcaaccggcagcagatggcgccgatgcacttcgcatttcgatccaccaggttgacgttgcatctgccgaccagatccaaaccatgttcgcacagattgacaaggagcacggacagcgaccggacattcttgtctccaacgcaggctacggcaagcgcatcccacaggtctgggatatctcactggaggcattcgactataccatcaacgtgaatctgcgggcctctttcatcctggtgaagggggttgtcgaccatatgagggagcagcgctggggtcggatcgtctttatgtcgtcaatcgctgggtatggcggtggaatcaacggatgccgtaagtgcatgaacctttatcctcggccagaggcatga

SEQ ID NO: 21734 - DNA, 186 bp, A.fumigatus
ttagctgacgcttatcaaatagattacgccgcttcaaaaggcgggatgactggcatgatgaagaatctcgcgactcgcctggctgaatataatatcagcgtcaatgacgtggcgccggccatgatcggcgacactggcatgattcccagcgcgccagtcttcaccacgagcagccgcaccgcataa

SEQ ID NO: 21735 - DNA, 219 bp, A.fumigatus
catccaacgaacatgcagcgtatagttgcacatccccaatgctacctaagctttggcgatctcttccattttctcagccactcggctcctaaccctgatttcttcctgactcacctcgtgggctatcaaatcaagtatctagagcactgcccactgcatcccggtccaggcatcctggaggggcagatgacctacaaaattatcgacagtagactttga

SEQ ID NO: 21736 - DNA, 504 bp, A.fumigatus
ctcttccacagcactcccctgcaccacaactacaccgtctccctcgtcaatcacgtaatacagtacgagcaatacggccacccggtgctcaagaacatcatccacccatcccgcaccctcgtcgccatctggattggcatcaacgacatcaacgactccgccaaatacgccgtacacttccctacactctacaaccgcatgatgaccacgctgttcacctctgtccacactctctacaacctaggctaccgctcctacctcttcatgaaccttccccctctggaccgaacccctgccaaccaagcacggagcaatccctccccgaacgcaacccagataacctggttcaacaatgcactatcccaacatgcaatgagctttgcaagaacccaccccaacgccaccggccaagtcttcgacgcccatacagcgctgagtaaccggaatggacatccggcgcagtatggaatccctcaacacgaacgaatttctgcgcaggtgtaa

SEQ ID NO: 21737 - DNA, 750 bp, A.fumigatus
  unsure (3): Identity of nucleotide sequences at the above locations are unknown.
gtnttcttcgcgggcgaatataaagtcccgctgtatttgcaatccgtcaaggaagcatcgcccatgcggtatggtgtcttcgtcctacccgtggttctctccgaagctttcgcgggcatcatcaccggagccctcatccaccgcacgggccgctatcgcgagctgatctggctgggaatgacattactgaccatcggcaatggcctatacatccatttggatgcatactcatccttagggcgtataatcggataccaattcctcagcggcatcggcgcaggattcctcttcgaaccccccatcatcgcgatccaggcgatggtctctcaggacgaaaccgccactgcaaccgctaccgtcggcttcatccggaacctggcgacatcggcgtccatcgtcatcggcggcgtggtcttccagaactccatgcgccggatgaaacccaccctgctcgccgcggggatgtccgaaacattgacggaacagatgtccggagactcggcagctgcgaatattgaaatgatcaagaccatcgaggatgcaacccagctgctcgcggtcaaggaggcgtttgcgagcagtttgaggaacatgtggatcctgtatacatgcatgtctgcgcttggaattgttgcgggcgtgtttattctcaagacccggctgaacaaggagcatgtggcaacgaggaccgggctgatattcgtcccacgaggcgacaaaatccgcgctatgtatagggacccccaaaaa

SEQ ID NO: 21738 - DNA, 648 bp, A.fumigatus
  unsure (16),(19),(25),(38),(106): Identity of nucleotide sequences at the above locations are unknown.
tcctgccacagccagnttntagagnttctccttgaatntaatgaaagtttgcacatcccagcggatcagcgattgaatctcagtgcgccgggagactcatcctacntgcccacgcctgaaagatcgccgatgtacgtcgacaccgcgacggcaaaatccatcttgaaagatgcgaaagcacagatggctgctggcagcatgacactcgaagcatatcgcactctgggagacgatattaaacgaggcaacgcatttgcgccgcgcatgcattacactgccctccaaaaggtgcctcatacggcggtgccgcccctaagagaggattcttctacaaatatcagcctggaggagaagcttggatatcttactccggagcacgaaaccgagtattacttgagcatggatgcaaagctcggcgatgaagcagctgctctcgagcttagtcgcattcccgaaaagccatcctttgctgagcgggagagggagttggcgctacgaaacccagtctctgtctacaactggctccggcgcaatcaaccgcatattttcctgcaggatcatgagaacgcgtccgagaagtcaggctctcgaccaactaatgcgcgggcgtccaaaagatcttcaccacggggctggaagttccgcgtc

SEQ ID NO: 21739 - DNA, 426 bp, A.fumigatus
  unsure (408): Identity of nucleotide sequences at the above locations are unknown.
cgcatcgtctttgccaacagcttcgaatcggtgaagcagctgtggatcaaagaccagtccgccctcatctcgcggcccaccttccacaccttccatagcgtcgtgtccagctcccagggttttaccattggcacctcgccctgggatgagtcctgcaagcgacgccgaaaggccgcggccacggcgctgaatcgccccgccgtgcagtcgtacatgcccatcatcgacctcgagtccaccgccagtatcaaggagctgctcaaggactgccgcaacggcgccgtggacatcaatcccacggcctacttccagcggttcgcgctcaatacgagcctcaccctcaactatgggttccgcattgaaggcaacgtcgatgacgccctcctgcgcgagactgtcgatgtcggnctcttagccagcgggtag

SEQ ID NO: 21740 - DNA, 372 bp, A.fumigatus
  unsure (21),(38),(42),(59): Identity of nucleotide sequences at the above locations are unknown.
aggcggtcgcatcgggtgctntattcccaactcatacngatnatcattgcctcattcgntcggacggacctgatcgacagaagaaattatttcatggcccagaccattgtccttgccgtcttcgcggcggtgtacttgctcatccgctacttgaatcgcacggatatccccaagatcaaaggcctgcctgagattcccggagtgcctatctttggcaatctgctacagctggggaccgaacatgccaccgtcgccgccagatgggccaaaaagtacggtccggtgttccaggtgcgcatggggaacaaggtgaggaacttcgtccctggactgggcctctcgtgccaccatttgcggggtgggggtttctga

SEQ ID NO: 21741 - DNA, 249 bp, A.fumigatus
  unsure (59),(67),(70): Identity of nucleotide sequences at the above locations are unknown.
tttgctgatatgtttggactcaacgttttgagagcagaagaaaacttttcctttggccntgcatccnaanctcaaaagttgaaatccactttgaatgaaactaacctgttctcggcagaagggaaccctgttaatgtcccaagttcaggttactgttccaccaaccgaataaatccttactggaagaagttccgtttttcccgaaaacaggaacctgaaagctttgaacctttgccgaaactggtttga

SEQ ID NO: 21742 - DNA, 519 bp, A.fumigatus
catgaggatgtggtcgagaggttaaagcgtgaggccagcaaccttgcgcgtctaagacatccatcaatcctccaggtattagaacctgtggaagagacgcgtggcggtggcctcatgtttgtgaccgaaccaattaccacatccctggccagtttgttacgggaaaaagatgagcaagagagaacgtcaaggatcggctcaagctcaagccattttatggtagaagaggcggacggaactcgacggcggagagacctcgagattgatgaactagaaatacaaaaaggactcttacaggtagctaagggtctggagtttctgcatgagtctgcaggccttgtccatggaaacttgaatcctgaagctatctacataaactccaagtccgactggaaaatctccgggctcgggtttgcaggacctccaaactctacggagtcacggtcatctcttccgccgttggctctgtcagaagttctctaccatgatccacgacttccccagtggagccccagttga

SEQ ID NO: 21743 - DNA, 447 bp, A.fumigatus
  unsure (21): Identity of nucleotide sequences at the above locations are unknown.
tgtccggcccggctggttaanaatgcgccgatttcgcgctggcgcgtgtacaagaacccgaacaaactaaacgaatcgatggatcatgttcgcaagacgctcaagtggaaggcgttcttgatcggtaggtttctctttcccggtatctcaccccgctacatatatctaacggctaaagggctcaccgtcgcgacattagcgatatttgtccggtccgtcttccgggtggccgaactgcaagagggtttcgacggtcccttggcaaatgacgaagtgaccttcatgatcctcgagggggccatgatggccatggctaccctttgtttgactgtcttgcacccaggatactgctttggtggctactgggatcagaccagctggaggtccatcaagcaatccagtcaattgagcttgatggaactcaaggcacagaactcacgggcctga

SEQ ID NO: 21744 - DNA, 483 bp, A.fumigatus
cgctgtcctggtcgctcggctggtgaagacggtgccggaaatgccactcactctgatctattcactacggctagcgcatcacatataagagttgtcttgaaggatgacacattaggcctgggagctcggccaaagagggatcttttggatggacccactggcctggacgcattcaaaggattactcggccggctcaatggtaaatctgatacacaacttgaagcggagcaacaaaagcgggatgatgctaaattggctcgatatgctgcaacgaagtggcagactgtcagatttataagtggcggacttcttgtgcaggagaaggataatgctacggcttccccggcttctcaggatcttcgcgttgacttcccgcgggaaacatcttccaacgaacatgaaaatggcatgtttaagactgaacccatggatagctactcacatcaggaaggctgtgccacagccagggaggaggagggctag

SEQ ID NO: 21745 - DNA, 213 bp, A.fumigatus
ggttggcgttccttcgatgttgatggaccgttcgaggctagcagagatgtacctttatcgtttgcgaccgctacaaggacttttgtagaggttctgtccgctgtttccgtgtcgagtctgtcacagtcaccaattttccttttcttcggtatcttctcttgttttttttcgcgggatttcctgggactcatgtccatctcctttcccttctag

SEQ ID NO: 21746 - DNA, 324 bp, A.fumigatus
  unsure (35),(84),(324): Identity of nucleotide sequences at the above locations are unknown.
aaaatggttccgagaagtttccagtttgccggtantaaggacggacgtggtgtgaccgtgcagcgagcatgtgtaagccggttntttgccgaccggttcgcaaagctcaactctgcccttcgcaactcggccgtgggagactacgagtattgccgccatggcctcgagctgggtgatttgaagggtaatgagttcgtcatcactctgcgggaatgcattattcctggtgtggacctccaaaatcccgaagatgccgtcgccacggccaaggagtttgtgggctctgcattgcgaaacctccgtgagcgcggttacttcaattan

SEQ ID NO: 21747 - DNA, 444 bp, A.fumigatus
tatggcctgcaacgcttcggaaccttcgcaacccgcacggatatggtcggtgtgaagatgctccagggtgacttcaagggtgcctgtgatgcaatcctgcattacagtcctcatatccttgccgcagcccaggaaggcaactcgagctccatgattagctcagatgacaaggctcgtgcggaagcaatccacatcttccaaactaccggcaaagtcagcgaggccgtggagaaactaccccggaaattctcagcagaaaacaacctgatccgccatctgggccgctcccagaacgattatctcggagctttgcaaaccattccccgaaatctacgtctgatgtacgtgcacgcttaccagtcacttgtctggaacttcgctgtcggcgagcgctggcggctctatgtctcaccgccaggcggcaaggataggcgcttaggtata

SEQ ID NO: 21748 - DNA, 240 bp, A.fumigatus
gaacgggatgggccaggttatttctattccaggtcaatcccctctatcagttatttctcgagtgttgtcatcatcggagtcggggcggccggaccgaggcaagtctcaagtccgcaaaaggaaaacgcagaggttatgacgttgatcgctgcattcaacactcctccaaagaaacaactgggtttccgaacggatactgccgatcccgcctggagagacgatgatgataatgatgattaa

SEQ ID NO: 21749 - DNA, 447 bp, A.fumigatus
cacactgctctcatcatgaccttatctggctgtgtggtcgtcgttgccggtgcatccaagggcattggcagagccatcgtcctgcgtgcggccgccgacggagccagcgtggtcatcaactacatgtccgacgtcaagggcgccaacgccctggtcgctcagattggaagtgatcgtgccattgccgtgcgggcggacatctccaagaccgcggaggttgacgaacttattgaagccacagtagctcggttcgggcggatcgacgtcctggtccccaacgcggcctatgtgcccgagagcaacctgcggagtgtcactgaggaggactttgaccgcgcctttgctgtcaacgtcaaagggccttgtttccttgcgaaggctggtgcaccccgcataagtctagagtttggaacccatgctgaaattctaccctcctcgcagatagcc

SEQ ID NO: 21750 - DNA, 837 bp, A.fumigatus
  unsure (3),(4),(6),(7),(8),(9),(35),(36),(37),(38),(39),(40),(41),(48),(50),(51),(52),(54),(55),(56),(59),(60),(61),(62),(63),(64),(66),(68),(70),(72),(80),(191),(239),(611): Identity of nucleotide sequences at the above locations are unknown.
ttnnannnnaaaaaaaaaaaaaaaaaaaaaaaaannnnnnnaaaaaanannnannntannnnnnananantntttctctntctctctctctctctccctctctccaccgtaagggtacgccagttcactattggatgcgtcttttccagtgacgactacggccatcgatgtttggggcgtatcccttctangcagcgccagctccagtttgacaggtgcccccgttcccatcattttgnacaagttttgtgcagccacccccctttaccgttaccgttaccccgtaagtcgaaagccttgcatacttttgagaggacccaagttcctatttaccaacacaactcatttctcttcagcgtcataagcggcaccacctcgatcatcggcgccaccgagaccacgacactttccttggaccccatcatctggggctcctcgacctactcgcctccggttgagacgaggagtctgggtggaagtaccaccgtcattggcgggacgaccttgcccccgacacccatcactgtcacacccaacccgcaccccacgaccacgccggatcctgggtccacggaccctgcgctcaattccaagaaaccctcctggacacntggcaagccaccgacccctactgccgaaccgggctgtcctgggtgcggcactcgttgtgagtcgttgtgttttctttgttgtcttggacacgtgaaacgaccttggcgactaacacaactttcaccccatctaggtctcctgttttgcaatcccgactgccccttctgtcccccggggcatttgtcctctcttagccgccggcatggaaatctaactccccccccc

SEQ ID NO: 21751 - DNA, 252 bp, A.fumigatus
  unsure (79),(127): Identity of nucleotide sequences at the above locations are unknown.
gggtacgccagttcactattggatgcgtcttttccagtgacgactacggccatcgatgtttggggcgtatcccttctangcagcgccagctccagtttgacaggtgcccccgttcccatcattttgnacaagttttgtgcagccacccccctttaccgttaccgttaccccgtaagtcgaaagccttgcatacttttgagaggacccaagttcctatttaccaacacaactcatttctcttcagcgtcataa

SEQ ID NO: 21752 - DNA, 426 bp, A.fumigatus
catctcgttgaatacatacagcttgatcaaatgcgcatggagaagcagaacatcccctcagcagcacgttcaaaagtcaacattcgttttcggaactatgccaccgacgttgacgaagccaagcggaagctcaaatcgctctccgacgatcgcaaggcgctctttggcgaccgctacacggacgaaccacaagatgagcacctggagcagaggcagcaacttctttccggcaccgagcgtttggaacggagttctgcccgtctacaggagagccagcggattgcactcgaaacggaggacatcggacgcaatacattagccgatctctaccagcaacggcagactatagagcatgcacgagcgggtctgcagcagagtgaaggatatgttgatcttcaccacacggccgaaggaccatgcaagcgt

SEQ ID NO: 21753 - DNA, 183 bp, A.fumigatus
  unsure (37),(42),(79): Identity of nucleotide sequences at the above locations are unknown.
gctgttaggtgtcaaacagtaatttttcaggagatancctanctgtgtttctccgaattgtatctatccaagctcgacnaaaaacaaaaggcctttcacttccttggtaaacacattctattctccagtgagcctcgcaaaacccccaaaaggatgaagggatttttcagtgaacaagaattc

SEQ ID NO: 21754 - DNA, 510 bp, A.fumigatus
gggggagcggatccttccaccccgtcgtgtaagaactcgcctcatgttcacatgcttgacatcgaatgcttcacttatctcaatcgagctctcgagtctagcatctcccctatcgtcattctcgcatccaaccggggtcacactgttattcgtggcacagatgatatcactgctgcgcatggaatccccccagatctgcttgctcgtctcctcattatcccaactcatccttacacccccgacgagatcaagaccatcatccgcttgcgcgctaagacggaaggcctcaatatcaccgatcctgctctcgacaaggtcgccgaccatggcagcaaggtcagcttgcggtatgctctacaactgctcacccctgctagcatcctcgcgcgcgtgaatggacgaccaggaggcattgaggaggcggatattgcagagtgcgaggatctcttccttgatgcgaagagaagcgccgccatcgttagccaggacagtgagaagttcctttcatga

SEQ ID NO: 21755 - DNA, 414 bp, A.fumigatus
  unsure (399),(407),(408): Identity of nucleotide sequences at the above locations are unknown.
ggcaagactcggcgctggatcgagcacaacgcaaatgctgcccttcttacgaggaataatgacggcaagtttggcacgtggtggggcagacgatatcgcgtcctggatgatgctattatcgatcaaagtcctttgcctcctggcgcggtggattataagaattacgacaacagaggcgatggatggtctaaggagcaaactggtgcgctgcgtggccgtgcgtcctggactgctagcagcgcagggacgccagagtcgtcggatcaacgaacgggatcgagagagacctggatttggacgaacagaccgacgttggccgaggtcaggttgatggactataacgaccgaggacgaggacgtactgttgaaacacagtcaggcggcatcgctgtgttgcgncccggggnncccccc

SEQ ID NO: 21756 - DNA, 429 bp, A.fumigatus
  unsure (417),(418),(420): Identity of nucleotide sequences at the above locations are unknown.
ccgcgggatcctggcagcctcgtggtgaagactgtggacgatgatgtgaagtctgctcttgaaggactacaggatggtgggctggtgcaactggtacgttccctggagtgtggagctgagttcggaagcttgaaagattttattatctcattgattgttaactacgagttctgcgaaatacaggccatcgacatcccgtcggaaacgttcaagctcgctgctgcggagtccggcattgacgcgaactccgtccagacgcacatctcttcatcctcgcctcggtacactttctaccactatcctgaaaccgataccgttttcttcatttatacctgcccgtcgggctcgtcgatcaaggagcgcatgctttatgcaagctctcggatgtatgcccttcgtgtagccgatgaacaaaanngngggggggga

SEQ ID NO: 21757 - DNA, 426 bp, A.fumigatus
  unsure (1): Identity of nucleotide sequences at the above locations are unknown.
nttttaaaagcgaacaatacaagcttcaccatgtcagtttggaacccagataacattcgtgacgttgccgagtccgtcggcatcgtcaatctcagcaacgacgtgaccgagaacctcgcgcgtgacgtcgaataccgcatcgcgcaggtcctcgaagaggctctcaagttcatgcgacacagtcgccggacgctgcttactacgcaggatgttgcgcaggcgctgcgggttctggacgtggagccactgtatggatatgagaccacacggccgttgcgattcggagaggcgtcgctggggcccgggcagccgttgttttacgtcgaggacgaggaggtagattttgagaaattgattaatgcgccattgcccaaggtgccgagggagatttcttttactggttggtgctacagctgtcgtttttag

SEQ ID NO: 21758 - DNA, 309 bp, A.fumigatus
ttaatgcgccattgcccaaggtgccgagggagatttcttttactggttggtgctacagctgtcgtttttaggtctgtgttttgtgctgactggttttattgtacagctcattggttggccgttgaaggtgtgcagccgtccattccgcagaatcctaccgctgccgactcgaggaacctcgaattgaccgccaaggggcccaatgccaactcgacgttggcggcgatgagcggcactggggacgtggctgttaacccgctggttagtcttcaccacagaggccgcaaggtccgcagcaatgcgtttagg

SEQ ID NO: 21759 - DNA, 258 bp, A.fumigatus
ataaacagatcttttctaatacagcgtcttaaggtcggcaccgagctcatcatccgtctcaagtggggccagacagagtacaagggcaagctggaaagcatcgattcgtacatgaacgtccttctgagggacacggaggagttcatcgatggaaagaacacgggtacacttggtcttgtgctaattcggtatgtttcggattgcggcgtcccaatcactttcgctgaacatgtcctaactgatacgaaccaggtgtaa

SEQ ID NO: 21760 - DNA, 501 bp, A.fumigatus
aaacagcatctgtctgagccggttgcaccacaactccgcgaacgaccagtttctcgagtacctgagctctcatattcgtcaatacggtctgtagagacgcttcctgtgggagccacttcacccgtagcagtcgtttccggtctgcagattgccgatgagaatatgcacccggcgcacttgagggatgctgtgcaagacaagcggcctactgactccatgtcgatcgctaaggatatcccaagcgacgatgctgctgctgacgcagaagacctaaagtcaggtgccgccctacctttgggtactatctccggcaacgccgtcacacgcggcaggagacggcagtccaaccaggctgattccggtgctcagacaatattgtcgtcgaagcaaattgatcagattctgatggaacgtgtctcgtcgcgcccattgtctcctcctgatagtgacaaagccaaggaagctggaccgtcgccctttgcaacgccaaaggcgcgtccg

SEQ ID NO: 21761 - DNA, 543 bp, A.fumigatus
  unsure (23),(511): Identity of nucleotide sequences at the above locations are unknown.
ccttcggtctcgtgtgccatccntagcccatccccagtcaatacaccacctcatcatggctcggatatcgtcagtcctaatactgccactcgtggtgaaatgtacccccagcaacctcaagctcaaaaccccgaccgtgctgcccacctgctgaacctactcaagtttaatcagggcgctgcagctgccccgtctcaacagcagcctactgctgttggaatggagcagccaaggtctcctcttactcaggaaactggcttcgagggtgtgtttaggtctcacacgaggaacatctcggcgtctgatctggttgcttccctgttcggtcgacaggctcaagctccaccttcggctgcaaccccacctatgatgcctaatccttcgcagttcgctcagcctggtcattctggggtcggcgagagttcactctcggcagcccctactgctgaacatacgcaggagatgctgcttcgtctgctgaaccgaccatccccgagccaggacgttcctnttgcccacgaggcggccagatccgcgctaggt

SEQ ID NO: 21762 - DNA, 327 bp, A.fumigatus
gaaaaactagcggcagtagaccgctgcaagcgagaactgctgcaggtgtacgacgtacttgaaatccgtctttcagggagatatggtggcggcacacgggagtatctggctgggcagggtcagggcaaatacagcattgctgatatcaatgcctgggcctgggtgcgaaatattcgacgcattggactctcggagaatgagttggctccgttacctcatttacaacagtgggtggatcgcattgcggcgcgaccagctgtggagcgaggtttgggggagtggtatgatgaggatgtgcatccagatttattgcttgagactgcgtga

SEQ ID NO: 21763 - DNA, 402 bp, A.fumigatus
  unsure (385),(391),(392),(393),(395),(396),(397): Identity of nucleotide sequences at the above locations are unknown.
agacaggaggacaaacaagagaaggtcgaggctccgaagcaggatctaggagcgagtctattcgggactacctccctcactagcagtgtctccgcgaacccgaatcctttctcatcgaatacatcttcagggtttcccagtaacccatttgcggctcctactgcagcaccgacgccagctaaagagacctcaactacaacacaatcaactaccactctttccgagaccttcgccgacaaggtcagagtctcctctccacccccagaaaccatgccaccggaagccgctggacccgctgccccttggcctgagaagtccgccttcccagctccgtatccgcagttttacttggacgccgaatatgagactctttctcgaccccccnactatnnncnnnccccc

SEQ ID NO: 21764 - DNA, 228 bp, A.fumigatus
  unsure (192),(195),(199): Identity of nucleotide sequences at the above locations are unknown.
tttatgggaataatatggcttaagctgtcgcaggatagctccggcaccatcgatcgtgacgagttcctttctctcccgcaagtgtcctcaaacccgctcgcaacgaggtacgtgagacaagcgatagatggtggcaccgtggaggaacaccaggacgtcggagataagcttaccgttgcagagcaggacagngtntttncctcagacgacggaccatatagacgtaag

SEQ ID NO: 21765 - DNA, 627 bp, A.fumigatus
accgactccagctggagctggcgcatccccagcgtcctgcaatgcgtcttctcgctcatccaggccgtgctcagcctgctcgccccggagtccccccgctggctcatctaccacggccgccgcgaggaagcgctcgccatgctggccaaataccacgccgacggggacacctcgtcccgcctcgtccgcttcgaaatggccgaaatcaccgccacgctcgaaatggagaagatccagcgcgcctcccgctggacggagtgggtcgcgacccggggcaaccggcaccgcctgtttttggcgctctacatccccgccatgctgcagtgggccggcaacgggctgacctcgtactacctctccaaggtcctcaacaccatcaacgtgacggacccgcacgtccagctcatcatcaacgcctgcctctccgtctggtcgttcctgaccgccgccttcttcgcgacgctggtcgaccgcgccggtcgccgccggctcttcctcggcggcatgggcggcatgggcgtctcctacgtcatctggacggtctgctcggcgctgaacgaggaacaccacttccaggataagggctatggtcttcaccgcggggctggaaggaccgcgccaacgggg

SEQ ID NO: 21766 - DNA, 456 bp, A.fumigatus
tcccgaggtgaagagacagtccataaccaggagcccggtgaactgccaagccacgacgcacccgctccagacatggaccccgaggatcagggatggatacgcgagttcgcgaagttcaagaaggacaccaaagtgaaggccgcaccaacggcgccgccgagtatcgtcccttcggagcaccgcagcactctcgcttccactatgttcaccgtcggaggcaccccgattcgcagaaagaagcgcaagggcgcgctcaccaacccctccgcgtactctatgacctcgtctgctctggcccgtaccgaaggccaccgactgcttgacgaccgattcgacacgatagaggccctctatgccctcgacgaggacggcgaggagtatgacgataacatgtccatggtcagtggtatgaccggcatgactggcatctctaccgcttcatcgcaagcacccagc

SEQ ID NO: 21767 - DNA, 390 bp, A.fumigatus
actgccagagtacagaagagggacctattcaacgcatttcgtgctcactcttccgcattcgatggcacacctcttggccagcacctgcgccgatcctctccgcctccggattttctagctcaaattatgcctgcgctcgccgaggtcgttaatcgtgcctcagacgctgtcggcgctctgaattcagccgcggaagaactttcaagcatggggttttccggaactaccgtgaacgacatcatttccgagatgcgccatcgcttccgttcggcgcgtctcggtctaaagcgcgcactgcctggagaaacagccaatgtgggcctcgaagatggaagtgccacattggccgcgctggtcaatcgggtaaagctgttggtaaaagacctataa

SEQ ID NO: 21768 - DNA, 387 bp, A.fumigatus
attcgagaattacaagagatctgtgacagatcttccgacgaggagagtgtgacagatgccaccagtaccaatattgggcccatatctaaactctcagtaggaattctgggaacgcatcaatctgcgggttccgacacaagcggtagccagtacctacaacgactacaggttcaagcactgtggcatgtctaccgggaaaatgtggcgcccatgatcgccatcctgcacacaccctcgatcgaggctatgttacgtgagggctatgcaaacaaggactccatattacaacctgaacaggaagctctcattctggccatatgctttgccgccgtggtgagcatgacgccgcagcagtgtctgtccatcctcggcggtggtcacgatgcc

SEQ ID NO: 21769 - DNA, 222 bp, A.fumigatus
tgcgttcccagaattcctactgagagtttagatatgggcccaatattggtactggtggcatctgtcacactctcctcgtcggaagatctgtcacagatctcttgtaattctcgaatctaccctttatcagctacacagaatctgtatggaaacaacacacataccttatccccgagactgaccgtcttcacctacggaggccggacggctccgcatgtacga

SEQ ID NO: 21770 - DNA, 369 bp, A.fumigatus
ctaaacagaaaggaacaagatagattgattggctatgcagtgggacatattacctctggactaccgcgatggatgtatgtctttattattttcggtgcggtgtccgtcgcgacagggattatctcgctacttctacttcctgatcttccgtccactgcacgattcctcaaccccagggagcgagccatcgccgtcgatcgcgtctccaggaaccagcaaggcgtcaaaaatcatcacttcaagtgggagcaggtctggcaggccgcgcgggatcccaaaacatggcttctctttgtgatggcggttggggcgcaggtgcccaactctgcgttaacaagtgtatgctttacttccatgttacattgctga

SEQ ID NO: 21771 - DNA, 219 bp, A.fumigatus
aggtggatcttccaggcgccgtgggtgaagacggctggcgagctgggctgctctgccggcgacgataaatgtctctgctcccaagccaactacggatatggtatccgtgattgcactaccgaggcctgccctgacgacgatgccatcgctgtcctctccagtgccctttcctcttgccctagtaagcactcccattccgcgctgccccaatgtgattga

SEQ ID NO: 21772 - DNA, 285 bp, A.fumigatus
ttgcaatcgttaggtgattctgcagctgtcactgccacaggagctggtggctctagctccggctccggctccggctccgactccggctctggctctggctctggttctggctcgggctctggttctggctctggctctggctctagctccggctctggttctggctcgggctccggttctggctctggttctggctccaactccggctctggctctgcctcttccaccgctactggcaccgctactggcagcgagaacagcacgactggtggtgctggtgctggt

SEQ ID NO: 21773 - DNA, 426 bp, A.fumigatus
ccagcaccagcaccaccagtcgtgctgttctcgctgccagtagcggtgccagtagcggtggaagaggcagagccagagccggagttggagccagaaccagagccagaaccggagcccgagccagaaccagagccggagctagagccagagccagagccagaaccagagcccgagccagaaccagagccagagccagagccggagtcggagccggagccggagccggagctagagccaccagctcctgtggcagtgacagctgcagaatcacctaacgattgcaatcagcacccagctcaatcacattggggcagcgcggaatgggagtgcttactagggcaagaggaaagggcactggagaggacagcgatggcatcgtcgtcagggcaggcctcggtagtgcaatcacggataccatatccgtag

SEQ ID NO: 21774 - DNA, 306 bp, A.fumigatus
tttgaagaaagaggatgcagacaaggtatgtcccgaatacatattcaagtatatgcaccagaccatgtttggcaaagagctaaccattatcagcgccaacttcgcgatcttggaatcatggttgtgcaagatgctcgaatatgcagacatctcgccgccccatctatactgcggacccccaaattcgtcaacgcactggcatacggtcctgcgatagtgaacattgagttcatcacggagtgcctcaagaagaatgagcttctgaaccctgacgacttccccttggtggacaagtccgccgaaaag

SEQ ID NO: 21775 - DNA, 657 bp, A.fumigatus
  unsure (2),(3),(4),(5),(6),(7),(8),(9),(10),(11),(12),(13),(14),(15),(16),(17),(18),(19),(20),(21),(22),(23),(24),(25),(26): Identity of nucleotide sequences at the above locations are unknown.
tnnnnnnnnnnnnnnnnnnnnnnnnngaagacgtccgcgcctgaacctccgtcgaaaaaggctctgcgcaaagccaaaaagaaggttgctgagcctactactgatcctacaacgaagcaagaggctgctgtgcccagcaaaaagcaagaagacgaggctcccaaaaaacgttcagaccacggcatctggattggaaacctggccttttcggtgaccaaagatgatctgcgcaagtttctcacaagcaattgcacatttgcggataccacaatcacccgtatacatctgcccaagggccaggaaaagtttggaaaggctcagaacaagggtttcgcttacatcgatcttgccaacgagaaggctgtgaaggaggcagtaggattgagcgagcagctgctatctgggcgccgtgtgttgatcaaggatgcgaagaactttgacggcagaccaaaaaagtcagagtcggattccgcggcaacagttacgaaacctccttcgaaacggatattcgttggcaatctcggctttgatgttacaaaagaggttcttgaggaacattttggacaatgcggtaccgtcgcacatgtacatgtggcaacgtttcaagatagtggaaaatgcaagggctatgcttgggtggagttcgaggatcttgct

SEQ ID NO: 21776 - DNA, 201 bp, A.fumigatus
agcaagatcctcgaactccacccaagcatagcccttgcattttccactatcttgaaacgttgccacatgtacatgtgcgacggtaccgcattgtccaaaatgttcctcaagaacctcttttgtaacatcaaagccgagattgccaacgaatatccgtttcgaaggaggtttcgtaactgttgccgcggaatccgactctga

SEQ ID NO: 21777 - DNA, 612 bp, A.fumigatus
cgtcaattagtgatccccgttgcgtctcccactcccagcaccgtcacttccgaggctgtcaccactttgcactcgaccagcaccaccaccgtgactgttattgccagtgcctccactcccgcggccagcccgagcccggctaccgataaggtccctctgcccactcctgccatcaccaacttcccctcgactggtgtctacaccattcccgccaccactgtgaccgtcttcgaaacaaccaccgtgtgcggaaccaccactaccgagctgcctgctggtactcacacctacggtggtgtcaccactgtggttgagaccgcgaccactgttgtctgcccctacgccaccgtcgagccctctggcaccaccgtgaccagcgtgatcaagaccaccacctatgtctgcccctctgctggcacctacaccatcgctcccaacaacaccaccgtccctaccagcaacgtcattgtctaccccactcccgccgtcatcactcctggttactacactcaacctgaagcagactgtgaccgtcacccgcaccgactaaccctatgtctgcccccttcacggcccaggacgagccccacctctggtccgggttgcccctag

SEQ ID NO: 21778 - DNA, 540 bp, A.fumigatus
tcggtgcgggtgacggtcacagtctgcttcaggttgagtgtagtaaccaggagtgatgacggcgggagtggggtagacaatgacgttgctggtagggacggtggtgttgttgggagcgatggtgtaggtgccagcagaggggcagacataggtggtggtcttgatcacgctggtcacggtggtgccagagggctcgacggtggcgtaggggcagacaacagtggtcgcggtctcaaccacagtggtgacaccaccgtaggtgtgagtaccagcaggcagctcggtagtggtggttccgcacacggtggttgtttcgaagacggtcacagtggtggcgggaatggtgtagacaccagtcgaggggaagttggtgatggcaggagtgggcagagggaccttatcggtagccgggctcgggctggccgcgggagtggaggcactggcaataacagtcacggtggtggtgctggtcgagtgcaaagtggtgacagcctcggaagtgacggtgctgggagtgggagacgcaacggggatcactaa

SEQ ID NO: 21779 - DNA, 327 bp, A.fumigatus
  unsure (293): Identity of nucleotide sequences at the above locations are unknown.
ccgaggtgcgtatgcgtgcgaccctcacttcgcgttgcactacgtactgatgagaaccagcttcaataccaccccgtccgtaacaacatcttactgtccggaagcacagacggactggtgaatatctacgacactaccatcacggacgaggacgatgccctggtgcaggtcatcaaccacggctctgtccaccatgccggattcctgggcgagcgtaccatctacgctctcagccatgacgaggacttctccgtccacccggccacagatcccgacgaggagcccgaggagtnttctccacaggcgcccaaatccgacgagaggtat

SEQ ID NO: 21780 - DNA, 711 bp, A.fumigatus
ctccagggagcccaaaggatatcctcccagtcaattaagagaacaatgggcgagctcgacttgcccggcatcatgagcaatatcaaccttcggatggacgccaatttcgaccgcgacttacatttcaagccggatttagatggggagaaagggagaaggaaaaggaaagaagcgggagattactgggaggcgatggctgccgaaatagcaatttacgctttttgcgcaaaccagactgaggatacaacaaacgacgaccagcaggatgaccccccgcaaacgttcgagccccgattgcccgccatgttcgagaccctacaagacgtccttaagaccttggtcccggagcgcgatcacccggccgttacgcaaaacttggaggtggctctactgatgcagcaggtcaggaagggagttctcgacatggttgggatcgccaactggttagccaggctcctcaaaacacattgcgctccgatgcgggacgaatgggcagaccgcatggttgagcagatccgtgctggctcggaatcgcaggactccatggagattgtccgcgggctgcagaccctctttgccattttggaggctatgaaattggtaggcttggccgtcgttggttctacacacacacaggtatatgtgctgactttgttgcttctaggacgtggcgacgtcctcaccacgtggaagaagcggccgctagatata

SEQ ID NO: 21781 - DNA, 426 bp, A.fumigatus
aagtctctctcaagaggttgtaactcatcccctccatctttcacaatggcttccaaccctgtcaacgagagaggtgtttttgtccacgaaaacacatccgcccccgaacatccaagcttgatgcagatgttctccctcaagggcaaaaccgccattgtcacgggtgctgctgctggcattggtctcgccgtggctcagggcctggctgaagcaggtgccaacgtcgcattgtggtggggcgccaattctagctgtcctgagcgggcggctgagattgctgccaagtatggggtacagtgtgagtactcctctgaactggcattggttccgtttcgactggatgtgaaaaaatggaaatctaactttcacagccaaggcttaccaggtcgatgttacaaaccccaaggctgtccaggaggctgttga

SEQ ID NO: 21782 - DNA, 354 bp, A.fumigatus
agatgcaccttgactgttcgggccaataatgcacttgaagaggagtcatggcttaatccttgccatatcaagtcccgagttggtatcagcctatgggctgactgtgggtataaagtcttgaatacgcccgtctgttcgagacctctcattcagtgcctctggcgacaccagaaagcaaccaagagcacgacacggacttatttctctttgacaatgcgtatatctgtcggtgctctgcttggcttgacagccctgagtcatgccacaacagagaaacgagccgcctctgcttcggcttactgttccaactcggccggcaactacaagctgtcctccatcgcagctccggttcaa

SEQ ID NO: 21783 - DNA, 504 bp, A.fumigatus
tgcctcctgcccgactggttgaaaaaaatcgtcactgccgctggaatgaaaaccgaagtgggcagaatagctaaacttctccaggagacttcggacgacgccgactccagtaggctcgttcaggccgtccgccgtgtcaaatcaacagcggaaaatgtcctcggtctcgctggtacgccattacaggtaaagttgagtaaatttgcgctccttctttttgctcttgcagttcttctagctattatcgtcttttcggtcaacaagtgggacattgaaggagaagtcctgatatacggaatagccattggcgtcgctgtcattccagaatccttaattgctgtgctcacgataaccatggcggtgggcaccaaagcaatggccaaggggaacgtcatcgtccggaagctgcaatgtttggaagctgtggggggtgttacaaacatttgctctgacaagacaggaacattgacgcaaggaagaatgattgcacgtacggcgtggata

SEQ ID NO: 21784 - DNA, 186 bp, A.fumigatus
atggcggatgaaattgcattggctgtggtgaggtcagtggcagataacctgacacagcagacgaacgtcaacgctgccgccatcagacatcaaaagtccgaggccttggtcttcttgctattggttttccattgtctctgctaccatagtaccgagtacggagcaggcttttcaactgtcaagtaa

SEQ ID NO: 21785 - DNA, 237 bp, A.fumigatus
tcatttttgtcagcgtacaaagattctcctggtgtggcatggagtcgaagtggttgtcgattaatgtatggatatcaaaacaccactacgacgccgtgcgcttacacgctgaacaaatattatctgccgttttccccatcaggtattgacttcctggctccccatatcgctgtgtacattgtcgtgtttcattgctctccaggcaaattctccatatggcgcatggcggggttatga

SEQ ID NO: 21786 - DNA, 183 bp, A.fumigatus
cctttcagtgcatacaactttggaatccccgccctcccatggatcaacggccgtgacttagctggagaggtcattcaggtgtccgacggctgctcccgtctgcgagtcggtgacatcgtcctcgttccgtccacggattaccgcgatatgttttcagcccggggctgcaggaccgcgcttgag

SEQ ID NO: 21787 - DNA, 516 bp, A.fumigatus
  unsure (52): Identity of nucleotide sequences at the above locations are unknown.
cactttcctacggccgcagcttcgactgcctcgccgccggccacgagcaccncgggaatcaccctcctgaacgccgcgctgcgcaacatcggcctcttcctcccgccgtggctgcacctcatcctgctcaaaatcccctggctgacgcgcgactggtgggccttccagtcgttctgcagcgagcggctccacgcacgcatgcgcatggacctgccgatccccgacatcagcgcctcgctgctcgccccgctgcacggaagagcgcccactccggaggagagactgatgctcgacggcgacgcgcggctgatcgtcgtcgggggcagcgatacgactgccgtgtcgctgtgcggggctctgtacgagctcgcgcggcatccggagcagctgcgcaagctgcgcgaggaagtcgagccgtttgttgatgcggcgggcgatgtgcgtggggccgatattgcgcttctggagcatctgaacggcgtgatcaatgaggccctgaagatgtatccggctgtg

SEQ ID NO: 21788 - DNA, 546 bp, A.fumigatus
  unsure (467),(535): Identity of nucleotide sequences at the above locations are unknown.
gacacagccggatacatcttcagggcctcattgatcacgccgttcagatgctccagaagcgcaatatcggccccacgcacatcgcccgccgcatcaacaaacggctcgacttcctcgcgcagcttgcgcagctgctccggatgccgcgcgagctcgtacagagccccgcacagcgacacggcagtcgtatcgctgcccccgacgacgatcagccgcgcgtcgccgtcgagcatcagtctctcctccggagtgggcgctcttccgtgcagcggggcgagcagcgaggcgctgatgtcggggatcggcaggtccatgcgcatgcgtgcgtggagccgctcgctgcagaacgactggaaggcccaccagtcgcgcgtcagccaggggattttgagcaggatgaggtgcagccacggcgggaggaagaggccgatgttgcgcagcgcggcgttcaggagggtgattcccgnggtgctcgtggccggcggcgaggcagtcgaagctgcggccgtaggaaagtgtcaccagccggctaatngacatcctcac

SEQ ID NO: 21789 - DNA, 396 bp, A.fumigatus
tacagatctccgcaacccattgtcctcttctctccgcagctttgtccatgggccccggcacgcgatgcttctgttaagatgacttcgatcctttcctggttccggagactctactctcttgataccctcgacactcgttttacttcgtctgcgaccacctcgttaaaggccgctgctgacacgcgacccccgtctgcgaaagatgctcgcgcaaatgccatcgccaatggcgcttcgcctcccaactggcgaacgcctgaattctttgtttactatcttgtcttcttaaccgtggtgcctatgatgttcaagactgttattgatgcttcgaaaggtacggcgtgtggttgcgagtctggggggagcttggagacccctgctgatcacttgctctag

SEQ ID NO: 21790 - DNA, 495 bp, A.fumigatus
ttatggagtgtctgccgttctggcggtgaagatctcggcgctcttgctggctcttcttcgccccggacaatgcgagctttacggaagatccaatcgcatcagattctttcgtcgaaaacttctgcgtttagcggtccaacatcgcatctttccacagcgcgctcgtccgtcaacgccgaggcgcaacaggcacatttggattcccctgttcggctgcggcaccggcgagctaggtcaaatagtgacgctggctctggagaacgacccatcttgcaggctcagaaacgatcgggaaggaagacaggttctgggtttgggatcaagagatccgtcttggagaccctgttacgggatgggccgcagaatggggacgtcgaggatgcactgaaggagctgagataccttgttctgtcgacacgggtggaagcagacggtgatggcatggtatgtggacgttgcaatagcgccgtgacctctaggcggataatgggcctg

SEQ ID NO: 21791 - DNA, 315 bp, A.fumigatus
  unsure (260),(286): Identity of nucleotide sequences at the above locations are unknown.
caggacataaaggtctttgatgaagaaatcactgccaaatggcgcaaggaaattataggcagcggagaggatatcactcccaatatgatggactggatcatcaaggaggcgcagtggaaagccaaggtcttccaggacaccaagcatgtcgtcgcattcgatgctggcgtggtcaaatctgatattgccatcggtgaagaattacgacaggtgctgaaagatgctgttcggcccctggaggatgtgcctgaagggctcanagactaccatcctggatcggacgacnaggtggttgacctgggtccatccgtccct

SEQ ID NO: 21792 - DNA, 195 bp, A.fumigatus
tcaataatgcctggtggccagtatcaaaaactccttattgctacttctgctcaggccagtggaagaactcctatctacaacttcacgagcacagtgaagggatcaaagagattcacctggatcaccagagaacttttagctgatatgctaggcaaagaagaacgagaatttggaaaggcgcgaaattccatctag

SEQ ID NO: 21793 - DNA, 186 bp, A.fumigatus
  unsure (97),(164),(173): Identity of nucleotide sequences at the above locations are unknown.
aggaggggtttgatgtttaagtacctgcaccttatattcagcagggaattttttctaaggccttgccaaagtaagcccaaccttttttgttcatccnaacaacataattttttggattttcagctgccaagtaagtaccacagacactttttagatagtgcccnacagccggntaatggaataggt

SEQ ID NO: 21794 - DNA, 588 bp, A.fumigatus
  unsure (452),(463): Identity of nucleotide sequences at the above locations are unknown.
aaacggggagctcaacagtcacaatctaccggaggtggtctctttgggtcgaacgctcaacaaaaaccaatgtttggaacgactccgtcggcgcccagtggcggtggtttgttcggcaatgcagccaaggacaagcctgcggaatcaacaaccccaacaaccactgctgacggtgctgcgaaacccctctttggagctgccccgtcagcacccgctgggcaagctcaagggtcctcactcttcaagatgccatcctctagcgccgattcagggtcgaaacctgctttcccgtctctcggtacaactaccacaaccacgaccagccaaccttctacagccttgaccacatcatccgacactccgcaaaagtcactattccccagtcttggaggtactacgtccgcgaccccgtcaactacaccagcggccgctccagctggaggtggtctgtntggtggactangtgcgtccaagcctgcggaaaccggtgcggcaacaaccaccaccgctcccgcttctcaacccgcagcggcgaccggcggactgttcggtaaacctgctgagaccacatcctccacacaggccccg

SEQ ID NO: 21795 - DNA, 294 bp, A.fumigatus
  unsure (192),(203): Identity of nucleotide sequences at the above locations are unknown.
cgccgattcagggtcgaaacctgctttcccgtctctcggtacaactaccacaaccacgaccagccaaccttctacagccttgaccacatcatccgacactccgcaaaagtcactattccccagtcttggaggtactacgtccgcgaccccgtcaactacaccagcggccgctccagctggaggtggtctgtntggtggactangtgcgtccaagcctgcggaaaccggtgcggcaacaaccaccaccgctcccgcttctcaacccgcagcggcgaccggcggactgttcggtaa

SEQ ID NO: 21796 - DNA, 612 bp, A.fumigatus
  unsure (25): Identity of nucleotide sequences at the above locations are unknown.
gtcgtgtcgggacgcggttctttcnacccgtggtcggcatcttgctctgatgccaccaggcaagctccaccagcccccacagggagcagctacccctcgggctttgacatgacccggagttgggcgaatctgagcccctatcaggaggcggatagctttggcgtgccgaaaggaatgccgcacggctgtgagctgtcccaagttcatgtgctgcatcgccatgccgaacgctatccgaccccgtatcccttggatgggcaggggatggaggattttgccgcgaaatggagcaattacaccaggagccttcatctcaaagcccccgccaccggtcctttgagctttctgaacgactgggaatacattctaggggaggacactctcctggcaaccggcgctgcgaccgaggctaccgcaggggccagcttctgggccaactacggacggctcctgtaccgtgccggccgggagaatggagcggcctggaatgcctcgttgaacgtgtatccaaacggcacggcgcgtcctaagccggtctttcgcacgacctcacagccgcggattctccaaagtgctcgatggtggttgagtatggactccctggtccagtag

SEQ ID NO: 21797 - DNA, 450 bp, A.fumigatus
tcgcgtcagcttttcgtcgagaattcgcaagacacggacgttttaccagtggattacagaaaaatggccgatcccatcgccgacgcgcctgtcatagacgagttcgcgcaaactcgaggcggggacgatctgttcgatgacgaaatcatcccagtatccgcagacgaacaagtacaagctgaggttcagacaccggaggaaaatgttgcagacaccaagagccaggagccaccacggatagataccccgccgcgctcacgtggagcggatagacgaggagggagagggagaggaagaggacgcggaggacgcgggtcgcaccattcatgtcgcgggcgtgcatatggagggccgaggggcatgtctactgacaatgctgccgaacgagaggacaacaaagtggagaatgcagcccgcgacacaccggcagaaggatctgaacaatctgca

SEQ ID NO: 21798 - DNA, 219 bp, A.fumigatus
acatgcccctcggccctccatatgcacgcccgcgacatgaatggtgcgacccgcgtcctccgcgtcctcttcctctccctctccctcctcgtctatccgctccacgtgagcgcggcggggtatctatccgtggtggctcctggctcttggtgtctgcaacattttcctccggtgtctgaacctcagcttgtacttgttcgtctgcggatactgggatga

SEQ ID NO: 21799 - DNA, 213 bp, A.fumigatus
gcgcggcggggtatctatccgtggtggctcctggctcttggtgtctgcaacattttcctccggtgtctgaacctcagcttgtacttgttcgtctgcggatactgggatgatttcgtcatcgaacagatcgtccccgcctcgagtttgcgcgaactcgtctatgacaggcgcgtcggcgatgggatcggccatttttctgtaatccactggtaa

SEQ ID NO: 21800 - DNA, 207 bp, A.fumigatus
aggcgtacaggtcgaggacagacttggccattcttgactgatccgccaatctacagtatcattgccaacacattcattttctcgttcctgatcgcaatcgtaaagtgggaggtcaacctcaggcaattgacttcgaggtatgtctttagtttttgtagcactggcaccctaacccccctgatactaaacccttcggacaaaatctga

SEQ ID NO: 21801 - DNA, 633 bp, A.fumigatus
  unsure (8),(20): Identity of nucleotide sequences at the above locations are unknown.
cgtcctancgcaattgctgntccttccatgcccgtggtgaagattggaatgctccgtattaccccggccagggtcaaatcaacatcatttacttttgcccttatcaccaggaggtctaggcatcgtggtggaaccagatacttctcccgcggcatagacgagcacggccatgtttcaaactataatgagacggaacagatcgtgatactcaatgatgcggcgggagggctttctggttttgcgccgggacagtctatggccaaggataaatccggtggctcaggccaggatctccagatcatgtccttcgtccagacccgaggaagtgtacccgtctactgggccgaagtgaacaacctcaagtacataccgaaactccaggttcgcggagtggagacagctgttgatgctgcacgcaagcatttctcggagcaaatcagaatttacggcgagaattacatggtcaatcttgtcaaccaaaaaggcagagaagagcgtgtgaagacggcctacgagcagctggtacgcatattggtgtcttcctcgatcgaggaccccgaggccgatgaaaacacctccgagaaagtccatgtggtagaatccggtcagaagcaaaaagaactggaccgcctg

SEQ ID NO: 21802 - DNA, 453 bp, A.fumigatus
acacgtgcgctccgtgtagtggccattgcagccggtcgccaactcggcagccgtctgttcggtccccccgctctcaaatccgccaaattgtcctacgagaatattcccaccgtggtctttgcacaccccgaagtcggcaccatcggtctcactgagccacaagctcgccaacgctacggtgacgacaaggtcaaggtttactataccaagttcaccgccatgtactacgacgtgctcccgacagaagagaagaagaagaacccgaccgagttcaagattgtgtgtgtcggtcccgaggagaaggtggtcggtctgcacattctgggtctcggcgtcggcgaaatgctgcagggtttcggtgtcgcgatcaagatgggtgctaccaagaaggactttgatagttgtgttgctatccacccaaccagtgcagaggagttggtgaccatgcggtag

SEQ ID NO: 21803 - DNA, 198 bp, A.fumigatus
agaccaagctctcaggtgccccaggctatttctgaaggccgccgtctatacgttggtaacatgccatatacggccaagtcggaggatgtgcaagcgttgttcaccgccgcaaacttcccaatgtacggagacaagaattcttgtatggagatggccaaaactgagtgctttgcagcgagcggatcgatatcgcgatag

SEQ ID NO: 21804 - DNA, 366 bp, A.fumigatus
  unsure (355): Identity of nucleotide sequences at the above locations are unknown.
gtgctttgcagcgagcggatcgatatcgcgatagaccccttcactggccgcaatccctcatactgctttgtcgatttggagaccagggaattggcaaataaagcaatgaccgaattggatggtcgtgatatgcttggccggcctgtcaagatcaaacctggagttgcaaaaacggcaagtgagcgttcgcagcaacagcaacatcaacagcaacgaactgaaagctcgcctcgcagtgataagggcaggccgtttgctcttgaccgctggagacgcaacgacacgcccgccttcgctaaggtcgacagcgtctctagccgtcgcctttatgtaggtgcccaccgaccgactagtnggaaaagtgtc

SEQ ID NO: 21805 - DNA, 219 bp, A.fumigatus
  unsure (160),(161),(181),(211): Identity of nucleotide sequences at the above locations are unknown.
agaggctttccttatgatctgagtcaacggcatgtgatggaagcgccgaactcgctggcggtcgatgcgtgggatggcagtttcacatatgcagagctaaatgatctctcccaccgattagctacccactttgatcgcgatggcgtcgatcctaatgtgnntcgtcctgtctacttcgaanaactcgctggacgaccgttgctatgctggnagtcatga

SEQ ID NO: 21806 - DNA, 363 bp, A.fumigatus
  unsure (333): Identity of nucleotide sequences at the above locations are unknown.
ccagggcttatcccagctcctgcaaaccatcctccaagccgacaagagcaagaagcgacgctccattctcggacccgaagccggtgcccccagccccgcaggtcaaacacatacatcgaatgccccaaccagcgcgcgcgacagccgagcagatacccccagccacgcatccgccggtccatccagcaagaagggatcaactgccgccgccgccaaggagcccccgcaaaccgtcaagacactcaccccagccgaagaagcccggtacggcgtacaacaccacgaccgtctcgttccgggcgtgcaattccgaagcgacggcgcacagaggtnttctcgccgagcgccaagaatacgcgctag

SEQ ID NO: 21807 - DNA, 435 bp, A.fumigatus
  unsure (398): Identity of nucleotide sequences at the above locations are unknown.
aaccctcccccaaggaacctcgaagtgcccatcagtgtgggcaatactaccatgtaccagtctagccagggcttatcccagctcctgcaaaccatcctccaagccgacaagagcaagaagcgacgctccattctcggacccgaagccggtgcccccagccccgcaggtcaaacacatacatcgaatgccccaaccagcgcgcgcgacagccgagcagatacccccagccacgcatccgccggtccatccagcaagaagggatcaactgccgccgccgccaaggagcccccgcaaaccgtcaagacactcaccccagccgaagaagcccggtacggcgtacaacaccacgaccgtctcgttccgggcgtgcaattccgaagcgacggcgcacagaggtnttctcgccgagcgccaagaatacgcgctagcgctagg

SEQ ID NO: 21808 - DNA, 441 bp, A.fumigatus
  unsure (403): Identity of nucleotide sequences at the above locations are unknown.
tttaaaaccctcccccaaggaacctcgaagtgcccatcagtgtgggcaatactaccatgtaccagtctagccagggcttatcccagctcctgcaaaccatcctccaagccgacaagagcaagaagcgacgctccattctcggacccgaagccggtgcccccagccccgcaggtcaaacacatacatcgaatgccccaaccagcgcgcgcgacagccgagcagatacccccagccacgcatccgccggtccatccagcaagaagggatcaactgccgccgccgccaaggagcccccgcaaaccgtcaagacactcaccccagccgaagaagcccggtacggcgtacaacaccacgaccgtctcgttccgggcgtgcaattccgaagcgacggcgcacagaggtnttctcgccgagcgccaagaatacgcgctagcgctaggg

SEQ ID NO: 21809 - DNA, 327 bp, A.fumigatus
  unsure (284),(286),(287),(289),(290),(291),(292),(293),(295),(296),(297),(298): Identity of nucleotide sequences at the above locations are unknown.
gaattcaatattggggtctggagcaggatgaagtggcccagagcgggcctgatcccgagcccgaaccactttttcccggggaattggcaggccaactatccatgggcattatttagtcttaaaaagcccacatgtttaaacccgggttctccaagcttctggtgtcatgcccggggtagccacgtttacctttcacgtcgttttctggggattgtcctaaccctcattttctttaactttttattcgacccttttatgccctttccttctctcttttctcttcncnngnnnnngnnnnaacaaaagtacatctctgatctcgcctga

SEQ ID NO: 21810 - DNA, 348 bp, A.fumigatus
  unsure (136): Identity of nucleotide sequences at the above locations are unknown.
cgtgaatacagtggttggtacttcaaggattacttcaatcaaccgtcgcgagctgcgatcggcacagtcgtcgccatccttgaagttggtgcattcatttcttccttaatcgttggtcggattggcgacttgatangaacgcggaagaacatcctctacggctctgtcgtgttctctatcggtggcgctttccagaccttcgcaactggtctacccatgatgatgctcggccgtatcgttgcaggcctaggcgtcggagcattgtcaacgatagtaccagtctatcaatcagagatatccgtatgcaaaaatccctcgatttctcctgcccccattttgtgccggtcc

SEQ ID NO: 21811 - DNA, 399 bp, A.fumigatus
ttccactcctgcctccttttcgtcttctttttttcccctttttatcttttcattttatcatctttgttactgttttcccaaacgaatccattattatttctttcccttggaggttccctactgtggtcttgtgtctgcactcttgccaagcccattggtccttgctctgagcctatcacttgcgattcgcccgcccataagtccgcctctctcaacctttccatctcacgcgcacctccactcaacatccaccattcggatattccgcccatccaaagcgaacacccctccttctgctccaccatcgattgcagtctgcccaaaacggacttcagaactcccttctacgctattttccgccattcactgttgaagtgcagccctccatactctcgatag

SEQ ID NO: 21812 - DNA, 522 bp, A.fumigatus
tcggccggtgtcactgatccgtatgaattctacaaatatgtgcacctgtctgaagttgggaactgcattggttcaggcattggcggcacccatgctttgcgaggaatgtacaaggatcgatacctggataagcccctccagaaggatattctgcaggagtctttcatcaacacaatgagcgcctgggttgacatgttgctcctctcctctacgggaccaatcaagacccccgtcggtgcatgcgccactggtgtggagtctgttgacatcgggtacgaaacgatggtggaaggcaaggcccgagtttgctttgttggcggttttgatgacttccaggaggaaggttcatacgaatttgccaacatgaaagccaccagcaatgcggaggatgagtttgctcatggccgtactccacaagagatgtctcgacccacaactaccacacgtgctggtttcatggagtcgcagggctgcggtatgcagctgattcttcagccacggcggctgaagatcatgcgtccg

SEQ ID NO: 21813 - DNA, 285 bp, A.fumigatus
ccaatcttttctcaaacttcatactgtcctcgattctttgtttcttctttttatctctttcttctttcacctccccatcgattggtctacacccgtcgatttacactcgttcctcaccttgatacttctattgtcttcgatttttcttcctttcctcccactaacgtttcaatcaccaccttcgttccctacagccaggtgctgttattgttcctccgcgtctctgcaaggggttctcgcttgctttcagtttcataccaccagccttatgctagattcgattga

SEQ ID NO: 21814 - DNA, 636 bp, A.fumigatus
gatcgtgggaaaacttcgctgacagatggtctcatcgccacaaatggcattatttccccgaaattggcaggcaagatccgctatctggactcacgtccagatgagcagcttcgcggaatcactatggagtcgtctgctatttccctgtatttctccatgatgcgtcgctcgtctcctgatactcctcctcagcctagagagtacctgatcaacctgatcgactcgcctggacatatcgacttcagcagcgaagtatcgacagcttcaaggctctgcgacggtgctctagttcttgttgacgccgttgagggtgtctgcagtcaaactgtcacagtgctacgtcagacttgggtcgagcagctcaaaccgattttggtcatcaacaagatcgacagactggtgggagagttgaaaatgagccccagtgaagcttactctcatttgagcagactcttagagcaagttaacgctgtcatcggaagtttctatcagggcgaacggatggaggaagacctccagtggcgagagcgtatggaggaacgtatcaatgcctccgctgctcgaaccgctcagaagcagggacaatgcgatgagacaaacatgagcagcgtcgatgaggcggaatttgaggattag

SEQ ID NO: 21815 - DNA, 189 bp, A.fumigatus
  unsure (33),(37),(106): Identity of nucleotide sequences at the above locations are unknown.
aacgatgaggatatctacttcgccccggagaanaaanatgtcattttctgtattgccatcaatgggtggggttccattgttccccccccccgggcgggtttaaganaaggaaactatgttttcaaacgattgattcttgagaaaagtgctatgggggagaattccaacctgaaccttaaaacaaaagtt

SEQ ID NO: 21816 - DNA, 258 bp, A.fumigatus
aggaagatacgcttactgtgggcagtacccccctggtgggagtcgccggaggtggtgatagaggcaactaaggagcggtcactgcttcaccataacattcactgtatcgcctacccagaggccatccggatctatactaacgggtccggcatctgcgggcgggtggacaccgccgcggtatgcctgggccccccatctgccgtcaacgttacctggggacggtccacggatgtggaacacacggtgccagttgcatag

SEQ ID NO: 21817 - DNA, 225 bp, A.fumigatus
  unsure (24): Identity of nucleotide sequences at the above locations are unknown.
accttgctgtccggctgccctttntatgtcctgaaacaccctgaaaagtacaacaagctcgtccaggaaatcagaggggcttttcagaaacaagacgatatcactttcctttcagtggcaagactcccgtactcgcacgctgtgctcgaagaaagcttacgattatatcctcctgtgccaggatatcttccaagaaaggtcccgatggggggccgcttccattga

SEQ ID NO: 21818 - DNA, 489 bp, A.fumigatus
tatctgcaagctaatgtacctcacaaggtcattgccgggtttgctgagactggtcaatttgacaagatcctcacctattcgaagcaagttggataccagccggattacactcaacttctgcagcacattgtccgcgtcaaccccgagaagggtgccgaattcgctgctcagctggctaatgaggaaagtggcgcactcattgatcttgaccgcgtcgtggacgtgttcctgtcacagaacatgattcagcaggcaacctcgttcttgctcgatgctctcaaggacaataggcccgagcacggccacctgcagacacggttgcttgagatgaacctcgtcaacgctccccaggttgcagacgcaatccttggtaacgagatattcacccactatgatcgtcctagaatctcccagctttgcgagaatgccggcctcatccaacgtgctctggagtcttcaccacgggaggacgcgcatccgcgcatataa

SEQ ID NO: 21819 - DNA, 672 bp, A.fumigatus
aaacaaagagttagatatgctccatatctcaagaaattaagaactggtgaacaatgtattgatttattcaaacacggtcgatatttaggttggtcaggtttcactggtgttggggcaccaaaagtcattcgtaatacattagtggatcacgttgaaaaaaataatttacaaggtaaattgagattccatttatttgtagggaccagtgctggacccgaagaaagtagatgggccgaaaataatatgattttaactagagctcctcatcaagttggtaaaccaattgctgctgctatcaatgatggtagaactcaattttttgataagcatttgtcaatgttccctcaagatttaacttatggattctacaccaaagataaaccaaatggatctaatttggattatactattattgaagccactgctatcactgaagatggatccattgttcctggtccagctgttggtgcctctccagaaatgatctctgtttctgataaaatcattattgaagtcaacaccaaaactccatcttttgaaggtattcacgatattgatatgccagtgaatcccccattcagacaaccttatcctcacacatcggctgatttcaagattggtaaaactgctattcctgttgacccagtcttcaccacggcgctggaaggagcc

SEQ ID NO: 21820 - DNA, 183 bp, A.fumigatus
ttgattgctatgcgaccatcgaacaactgggaccacggcgttgacagtccgcagtacagttttaccaacgtgaagaagatggagcctttggtggacattcgcattcaacactggatcgacaagctcaacgagaaattcgctcagacaggggagattttcgatttctcatggtgggccgtgtaa

SEQ ID NO: 21821 - DNA, 279 bp, A.fumigatus
tggcatgtctgcagctacatggcgtacgacatcatcagcgagatcggcttaggcgccccctttggcttcgtcgagcacggccaggatgtctgcgggctcattcatggtttccacgatggtctgccggcgtacggtctccttgctcgtctgcaccccttcaccaactggatgaacaccaccttcatgaataagtacctcgtcgccactccccaggacgattcgggaatcggcgtcctcatgcgtttccgcgaccgcctgatccaccaacggttccgctag

SEQ ID NO: 21822 - DNA, 414 bp, A.fumigatus
ttatataagcgcgggcgcgtcgagctctcgtgggtgaaaacaaggtgtgtaggaacttcccatacgaatgggtaccatatgagtacccatccatatcttattcaatcattccatcctaatcctatattcattggttcagaaattgttgcacagttactcttgcacaatgttaggaaagtctacattgtagcgcgaagcaagagcaagtacctcagagcacaagagaactggcgacagcgccatggtatagttctcagcgagaatgacgacaggttggaattcattcagtgcgatctgggagacatcaaatccgtaaaggatgcagcggatgagattacggccaagacagacagactggacatcttgatatgcaatgcaggtaagctttctcgctcgactgcgcagccgctttga

SEQ ID NO: 21823 - DNA, 282 bp, A.fumigatus
tccttttgcagacttcagcaatcaaagcggctgcgcagtcgagcgagaaagcttacctgcattgcatatcaagatgtccagtctgtctgtcttggccgtaatctcatccgctgcatcctttacggatttgatgtctcccagatcgcactgaatgaattccaacctgtcgtcattctcgctgagaactataccatggcgctgtcgccagttctcttgtgctctgaggtacttgctcttgcttcgcgctacaatgtagactttcctaacattgtgcaagagtaa

SEQ ID NO: 21824 - DNA, 291 bp, A.fumigatus
  unsure (2),(22),(245): Identity of nucleotide sequences at the above locations are unknown.
anatatggtcccgcatgtgaanatacctacggaccgcgcccggtcatgctcccatgtatcttcctttgcctcttctcgctgtgcatgacgagtctggccaccgagtactatcaaatcatcttggcgcagggaattggttatggactcggagcgggaggtatttttaccacctgcttggtctgcgtgagccagtggttcgtcaagcaacgaggccttgcgttgggaataactgttgcgggcagtantattggtgagtggcagactattctctccgtgtctatggcgtgctga

SEQ ID NO: 21825 - DNA, 345 bp, A.fumigatus
tctgatgtgggactagggggcgtgatattcccattctttctgcgcctggttatggaagacgtgggattcaatggcatgatacgctacacggcgctgttcctagggatcattctggttggcgccttctttcttctcagtgcgcgccttccccctaagaaatgggactcagaaatggcatggattgacttcagagtgttccaaaaccgaggctttgctttctattgcctcggctcatatttggtgatgtggggattatgggcgcctttcgattatcttcctagcatggctcaattgtccggaatgtcggattcgctggccctctacctgctcgctatcgtgaagtaa

SEQ ID NO: 21826 - DNA, 558 bp, A.fumigatus
tatttaaatccactatctcaattactacaatttgtcaatccgacatatgagatcattgatggtgatagcaactctgagtattctcgacttgaacaggatttttttgcacaatctcaactggagaggcacagtgttttttataacaatcctggacaaccactttatttgtggtttgatttcaaaaccgaagataattcaacttatgatgccttaaaaccattgttgaaaccatttatagataatgggtatttagcctattataatatgactgatgacaagtattattctggtccattaatcttaacaataacggttcacttaccagttgacaaagtaactaatgatacaattagatatttgtttttagatggcccattagataagtttacaattgataataacaatacaaatatagatgaattgcaaatatgttcaatattatttcgtgtggcaagtggttccttagagacaattttggtatcagagtcatacgcaactagcactaagaatgatttcatatgttcttcacccacgggcgctggaaggaaccgcaattgg

SEQ ID NO: 21827 - DNA, 630 bp, A.fumigatus
acaattgtgtttttgtcatcttgtaatagtgtcaaattttacagtgaattattgaactatattgacttaccagtgttggatttacatggtaaacaaaagcaacaaaagcgtacaaacacttttttcgaattttgtaatgccaaacagggaatattagtatgtacagatgttgctgctacaggattggatattccagccgtcgattggattgtccaatttgatccaccagatgatccgagagattatatccatcgtgttgggagaacagccaaaggaactcaaggtaaaggtaaatcattgatgtttttgaccccatctgaattgggattcttaagatacttgaaagctgctaaagtacctttgaatgaatatgagttcccagctaacaagattgctaacatccaatctcaattaactaaattgatcaaaaccaattatttgttgaatcaatcagccaaagatggatacagagcatatttgcaagcatatgcttcacatggattgaaaactgtgtatcaaattgacaaattggatttaaagaaagttagtgctagtctcggtttagatcaagtacctagagtcaatttgagtattggtggcacaaaaaccaaaaagcaaaaaaggtcataa

SEQ ID NO: 21828 - DNA, 876 bp, A.fumigatus
  unsure (775): Identity of nucleotide sequences at the above locations are unknown.
cgcaattgcggtccttccacgcccggggtgaaactttcttattctggaactaaaatattaacgtatgcgtctaatctattggattggatgtccaaaagcttcactaaagaatgggaagaattatccagtgtccctttcaacccttcaaaagttgatttattgctagatccaagtgaattgttaaaactaagtggtcccaaaattgtgttttgctctggtatagatttgcgaagtggtgatatatctgccgaggccttccaatatttatgtaacgatgatcgcacgacaattattttgacagaaaagacgacgatgaactttgctagtagtttgagctcagtactctacactgaatgggactcgttagctaaaaaaagaggaggcggagagtctgaagacggtattgctgtgcccatagataaaaatatttcgttgaaaaattggacaaaggaagtagagttaacaggtacagagttgacagagtttcaagaaaaggtggctcagaaaagaaaagaaaaattattagccaaagtgagagatcaaaagaatcagaatattttaagtgccgataccgtagattcagaagaatcttctgatgacgatgacgaaggagacaatgaagcagaaaagcaaaaaggcaatacttctagtaacttgctaatcaagcaataccagaatatcaatgtcgcagattctaatgttgctcctaacgaaatcaaccctcttgctactcatgaagcattcatcacagatcatattaaacaaagcttggaanagaacttacccatcgatttgaagataactcacaaattgagacctagaacagcgacgttcccatactttgccactgcgcacaagcaaaaatttgatgaataa

SEQ ID NO: 21829 - DNA, 306 bp, A.fumigatus
agtactgagctcaaactactagcaaagttcatcgtcgtcttttctgtcaaaataattgtcgtgcgatcatcgttacataaatattggaaggcctcggcagatatatcaccacttcgcaaatctataccagagcaaaacacaattttgggaccacttagttttaacaattcacttggatctagcaataaatcaacttttgaagggttgaaagggacactggataattcttcccattctttagtgaagcttttggacatccaatccaatagattagacgcatacgttaatattttagttccagaataa

SEQ ID NO: 21830 - DNA, 759 bp, A.fumigatus
  unsure (590): Identity of nucleotide sequences at the above locations are unknown.
caactcatatcaattgatcttttatcccctactaccatgttacatattgaacaaaataatttattaattgagaaaactttaacggaaagattatttcctaatccatctgaaagttcattgaaatccttagatagaattgtgtctgattttgatttcactacatttcatttactgacattacccggggagaaacatttattattaatatctctttcattaagatgttggccagatttagttaaacatgatgttgtcaaatatcttaatgataaatatcaaccattcaatgaagtattgacaatattatctactaatgatgttgaacaaggttatgattattcattagttttagatacttcaactgctacaacttcttcgaattatgacgaagattttaaattacaattgattaaagaattatcaaatttgaaaagaaatgccatggcagctccatttgaacaagcatttaatagatatgatgaattactgaaaaaatatgctaatgctaatacttattcagaagaaattcaacaagaattatttaatgaaccagtatcagtaattaaatatcgtggaattgatgaatgcantttattaaaaccttcatttgataaagtaacggtgattttctcaaccgtgttccaagatgaaactgataaaatctttggtaaagttttttacaagaatttgttgatgctaggaaaagatcagttcaaactgctcctccagttatatattctcatatcgaaacaccattag

SEQ ID NO: 21831 - DNA, 543 bp, A.fumigatus
caattaacttatattaatcaaccatctcccatagctaatggatattttgctgttgctacagaaatttttgatagttctgttgcaccacatactttggaacatttaatattcatgggatcaaaaaagtttccttataaaggattattggataatttaggtaatagattatattcatcaacaaatgcttggacagcagtagatcaaaccgtgtatactttgagaactgctggttgggaaggtttcaaaacattattaccgatatatcttgatcatttaattaatccaacattaacggatgaagcatgtttaactgaagtttatcatattgatggtaaaggagaagaaaaaggagttgtatttagtgaaatgcaagggatggaaaatcaatcatggtttattctatacaaaaagatgcaagaaactttatatgataagaattcagggtattcttcagaaactggtgggttaatgtcagaattacgtcatttaactagtgacaaaatccgtgatgttttcaccacggcggtcgaaggaaccgcactt

SEQ ID NO: 21832 - DNA, 534 bp, A.fumigatus
agaaacgatactccaggggtgtttttaccgactacaaaaaatgcagaaacaatgcttagtcttgcattggttgggtgcattaacgaatcattcattgatcctgttattttagcagattatttgttgtacgtcttgaatctacaagatccaacaggaaagttgtacacagattatatcgatcacccaactaacaatgtgtatgagctcttggaaagcatcgaccaaaaaagaaatgttttgcaaatagataaacgttttgatgaatgtggattggcaaaccattggattagcaaatggaagcaaggtaaatcactgaagtatcgtgggttatttgatgttgcagccattcacgaaatcaacgcaaaggactttggtaacttaactaatgcagaaagagagagaattggtttatcaaacgtgcagcaaagacttcaagaaagattcggcgatgatggtacatctacttctaaacacagaaaaagaactgccaaagacagagagtgtgacatgaaaaatagactatttaaactttag

SEQ ID NO: 21833 - DNA, 183 bp, A.fumigatus
acagcggatcctaaaaaagcagatacgatcaccattgagttgcagaagaagctagacgtcaaatacaaaactcagcacaagctggaaaaaaagtcgaagccatttattgcaacttctaaaccacaaccaaacgatgggaaatttggcgagtactttgatatagaagatatcttggaagactaa

SEQ ID NO: 21834 - DNA, 510 bp, A.fumigatus
agtatttcaattaacaatcaaagaaattatcattcttcgggaaagtgggacctaacgttagatgaattgtgggctttcattcaaaccaaatttaaccaacaagatcaattggatgaatttcaaaaacaattaatatggcaatggttatttgttgcggaggatgaggaaggaaattcagagagtgctaaaatatatgtcacctataatgatagcccagtcacggcgaatagcgataacaagatatttgttgccagttatgacgatttaaataacattcgagtacttccagaacaggaaacccaagtgctgtatttgacaggaattaccaacaacaaaaagttcttatcatcctttggtgacaaaccatatgagttactacaagagattgccatacacggaagcaaaggtatatgggccccaactttaattgatataactggtcaggacaacagatcattgacgggaagactcaataagttggaagagtggagactcatttacagggagtaa

SEQ ID NO: 21835 - DNA, 426 bp, A.fumigatus
tgtaatgaaggaaataaatatatgatattccattttaaccaaaaagagaaagcagattctagtaaatgtaacacaatacatgttagaaagagtattgaaaattgggcaattatacttttatacatactatttgtctggtatcgcaagtctgaacttcattatgaccatataattcataccaatttatggggtgtcgaaaaaaataaaccgccatttttgttccaaacaaaaaactcaatacctcgattacttcaattctctataccaacccaacctactgccataacacaaacaatgttatatcatctaaatatactatctgtattatcacgatctccatcaccactgccacaaacacaaccgcaaccactggaacaggaactactgctgtcatcttctcatccaaaatcagcaactcgaagatga

SEQ ID NO: 21836 - DNA, 366 bp, A.fumigatus
agattctcaaataccatgtcaacatgtgctgaaaaagtgattgattttgaaattaaatttgaaaatgaagataatgctgaaaaatttagagcaaatctaccaaatcaacccgatgttaaaccattaactcatgttgaaaatatgcaaaccaccattgatagaattgatgctcaattggatggattatataaagctatgcagtattataaaacaagaaataatagaaatcaagctacagttgtgtcaactgaatcaagaatttattatttctccatttttgaagtcttattgatggtaggaatgggattcttacaaattactattgttcaattattctttagaggatcaagaaaacaattggtgtaa

SEQ ID NO: 21837 - DNA, 285 bp, A.fumigatus
accgccatttttgttccaaacaaaaaactcaatacctcgattacttcaattctctataccaacccaacctactgccataacacaaacaatgttatatcatctaaatatactatctgtattatcacgatctccatcaccactgccacaaacacaaccgcaaccactggaacaggaactactgctgtcatcttctcatccaaaatcagcaactcgaagatgataaacttgccagaagaatccgatgttcctgtatcaaatattactctgctgcttggaaacagatta

SEQ ID NO: 21838 - DNA, 330 bp, A.fumigatus
ctttatatttttgggtataacgcccttcttaaaagagatgcgatgcattatgagaagagtttcgaatctaagggccaacaccacttttacatcgttttgcgtcagacgtacttcgtcgtgctcaatagcaccattcataacatcgtaactcgtatcccccaagacatactatcctatacgatatataccaacaatacaatatataaaaccgtatcttcaaatccaaacaaatctcaatcattttataatgataagtgggtactgatatctttgatgttgggtggtcataagacagatcaactgagtgctttattattcacatcacggtaa

SEQ ID NO: 21839 - DNA, 450 bp, A.fumigatus
aaactttgcatcccagaaacgcatcaaaaaaaaatcaaaaaataccaagcaatgaaaatttcatccaatctcatctcactgattaataaacccattaggatagttccgttgatgtcagttaacaagaaaatcaagttagacaatatggttaaaatttgtactcattcaggttcatttcatgccgatgaatcccttgctgtttatttattaaaattattacctaaatattctcaagccgaattagttcgttcaagaaacccagaagattgggaatctagtgatattgttgttgatgtcagtggtaaatacgatggtgtcaaatattttgatcatcaccaacgtgaatttgataccactttcaacgaaaactacaaaaccaaattatcctctgctgggttggtgtataaacattttggtaaagtcttcaccacgggcgtggaaggaccgcac

SEQ ID NO: 21840 - DNA, 270 bp, A.fumigatus
tgtaaaactgggctgagcctgcctatgtgcaggatcgttgtggctggagatcctcgcatgcagttgagcgcctatcccatcgaaacgccctgggttgcttcttcaatagagattttgcatataaacacccgagtcgtttggctgctctcccatatcaccgatttggagcaacttgagaaggttctgctcaatgttactcaacaatgggggcatggtaccaacctgtccaagttaaatgtctcagcttcgcagagtaatttgactttctga

SEQ ID NO: 21841 - DNA, 192 bp, A.fumigatus
ttgcggctccttcgaccgcccgtgtgtgaacacagatgggttaaacgtgagttaagcaccaatccccaattaattttggatgctggtggtgttggtgttttgagctaccaacatcacaatgtcgacgaaccagcaatttatttagctggtgcatttactgtccctgttgaagaagaaggtgcagatatttaa

SEQ ID NO: 21842 - DNA, 603 bp, A.fumigatus
aacattaaccaatgttgcccagagttaaaaacaaaaaccccaggtgtcactcaacagattaaatgggtttcaataatgggcggaagctttgggtttggcaataaaactccgtatgcggaattccatgtgcatactgatcaacatgcagccaaattagtaattcaggaattaagtaacaaggttgtgtattccccatggaattttacccataaagtcattgccacttcggaaattagaaaacatatgtatgacgacaataacgagaaacgaagttctccaataagaaatgttttatttcgtatttggacattctatgacagagtgtatgctgcaaatggatttttggaaggcccaccaatacacgatccattggctgtatatagcttgtgtccatttttcaattcatttgaacgatatggatatacctgtgcgcagaagaatattgatattattactgaaggtgttagaatgggtgaatcggtgattgttgaaggagggaatactgacaaaggagtttatattggtgaagcgatagataacaaaaagttttgggatagtattttattggctcttcaaaatgcggatttacaaacaaagaattga

SEQ ID NO: 21843 - DNA, 726 bp, A.fumigatus
aacagttttagtttcttcgttaaccattggttctataccatgtcaattttcacaacattgttcaatgttcgtatttattataattctttcattggtttaacacttactgaaaatgggttgagattggtgcctaattttttcggtttctcatttggatcggttggagctgggatttatatgaaaaaaaccggtcgttattacaagttggcagttttagctggtattttcgccatttatggtattggcaaaatagcgttacttactcctaacattccaacttggcaacagtttttattgttgattccttcaggattgggttactcgtgtatattgactgttactttacttgccttgattgctgcagcacctttaaaatatcaagcttgtaccacatcaattcaatacacttttagatcaacaggttgtacactaggagtgtccgctgcaacggcagttttccaaaatgttttactccttcagttgactaagaaaattaatgaattggtttctgatcctcgtgaagcggcaaagatcattgccaaagctttggatagtacagagtacgtgaatgaagctcctaaatatgttagagaagctataagagcttcatacgatgccgggtgtaaaggagcttttggatttgcttttgcaacaattgttcttggtgtcatttcatctttattcatgagagaacacgttttacacacaagtattaatagagactaa

SEQ ID NO: 21844 - DNA, 513 bp, A.fumigatus
actaatcacacaacagcttcaactttaatcttaccaatcaactgtacaaatatgaatacgttttcatccccaccaaacgtgatacgagagtataatgactccacatatcagctgccattgaattcacaattccaccaatcaccattcttgcagactcaatcaccagactatgtcagcttacgagaagaagaggatgataataatgataagaatctagacatcatgtcatcatgtatagtagattcagtaatatataaatcacaaaaaattgctggcccactattgagtcaaatatccaatttgaacattcagcaagcattgattatacgagaactactattcacattgttaggacatgaaggtcattacattcaatatagtaaacgttatgatccaacctcacaaatcagccgaattgaaggaccggactataagattgcaaagaacttggatataagtcttaaagttatcaccaagaaattggtcaaatttggaaagtcttacagtgggtga

SEQ ID NO: 21845 - DNA, 189 bp, A.fumigatus
  unsure (141): Identity of nucleotide sequences at the above locations are unknown.
aaatcgtttattcaagtatttgataataacaaatttgggaaaattgtgcaaaagttttgctctgaaatgaaaaagtttttatcgagtcatcaacaagtgctaataaatgttgagcatgagttcaagtttaataagaatttnaatttgaatatgttgggatctgctcttacatccagaaatttccaatga

SEQ ID NO: 21846 - DNA, 840 bp, A.fumigatus
  unsure (755): Identity of nucleotide sequences at the above locations are unknown.
aagtgcggttccttccagcgccggtggtggaagaaaaatatagcaatgattgagtttccaaacctgttgattgcaaaaaccgctactgcacctggagcacatattagactaactaactacagttcaagtttcatagtcagagcattcaaacagttgattccaaattatcatccatacaccttagtttcctttcccactgacaaatatcaacgattaattattcgtaaaagtaacttcaagttatataatatgagaagatatatgatagcaggtagttatgacccacacttgttgtttattggttcaaaatcaagccaaaatttttccttgagcaaattactggtcaatgctaaacgtttattgattgttattggtggatctgctatttcatttgcattgccaatcttgagggttatgaattaccatgggattcccactaagattgtttgggttatcaaagactttagagacgtactagtgcttagatattttgatggattcattcatggtgacgattttgagatatttatcactggtgatagcacaatcaaagaacaagcaaaaactcttcgaaacgcaataagctgtgcttccaatttcagcaaaaaatctagaatctccagtcattttgatatagaacatgatgaaacctccccgttgttgagtgacaacaatgagtcacaaattcctttgaatcttgaaaatcaaatagaaaatgtcgacatcagtatgaatagtgatgacgaagaagaacnagaacgtgattcagactgttcacacaatgggatcaatcattctcgatacgaagactttaatgacgttgacgatatattagtttga

SEQ ID NO: 21847 - DNA, 387 bp, A.fumigatus
tggatgtcctacaacccgagtcatgaatggtggagaatcccacgcatatggacttgtcgtactatgacacagtccggcgagaggggatcagaggactacgatttagggactgacagagatcaacgaagtcaccaaaggagaactataaattggctttgttgctcttccgagcaaggtcaaaaacagaatcacgcagtccacactgaacttacaatcatatacttccaaatcactaccaccatgccttccgtcagccagctcgtctctgctgctctcgcagcaggagctttcaccaccgtgaatgcggctatgggtcctgcctttagcactggtcctgttgcctccaactccttcatccgcgaagcaacatccactcttatcctgccc

SEQ ID NO: 21848 - DNA, 771 bp, A.fumigatus
gttaacgaaatatttccagaagtgacttttttcctactagctcaggaattacctcgaggtagaacaattaacaattccattaccgattttgaatcatcagcgaatggaagcacaattccgttgacccgaccaattttatcagtatatgtatttgagtcctcagtatgtgatgttactaattcaaatagcaatagcgatcatacatttaccgcggaaggtggtcattcatctgatgaaatgctcagcacgactgacatatataactccttaactagtaaatcggtttctactcctactgagactagttggctcaatagtgttgctggtacctcgaacatggtagatatgagaacatccacaggaaccatcatctcatttagtgaagtagctactactgaaatgatatcttccccaagtgatactggtaacccaaagaaatccagtgcaattgattatggaacgaatagtgatattacaacactgacaggtagatataccagcttaagggatgaaactgtttctactcttcaagaagatgcaggcattgaatcaaccacagttggaggtattacaaaaactgtacacacaactgtttatgttaccacttcccctgataactcgattacgactgaaactgctgtggttgtagttgtaaccaacgactctactgctacaacctatactgaaatcattcaaactactgtcgttgaaggcaaaacgttgacaactgctattccaattcttcaccacgggcgtcgaaggtccgcactt

SEQ ID NO: 21849 - DNA, 228 bp, A.fumigatus
attagtctaggtgatattgttataccttgtggtctgtcattagactcattagctatgactgttatcgtacctgtaggtattatcactctttgtgttctagcttatgctattgaatatatgagtcatgaccctaatcgtaatagattctatattatattaagtatatttgctgtatttatgactatattagttgttagtgataattatctaatgatgttcattggttga

SEQ ID NO: 21850 - DNA, 234 bp, A.fumigatus
tcgacacgtatcacagcaatgaaatcagctttatcagctatattacttaatcgtatgggtgatactttctttgttatagctttaggtcttatgattaattattatcatgcagtagattatgatacaatagcattagttacaccatatatgaatacatttttattatatacattaggtttattgctactcttagctgctacagctaagagtgcacaattaggtctacatgcatga

SEQ ID NO: 21851 - DNA, 264 bp, A.fumigatus
ttaatgataagctgttatttaaacctttattcacttagtatgatgagtagttatgatctaattacccttattaattgcttattgaaatattatttattagctgtgacattagaacttatacatataaggggttattatgatgatatatatggtaatatatttagcttaattattattatattagccggtggtgaatcagctatcggtctaagtatattagttgcttattatcgtttaagaggtactatcggacatagtatctaa

SEQ ID NO: 21852 - DNA, 708 bp, A.fumigatus
ttattgcggatccttcccgcccctgtggtgaaagacgaggcattaacccaagctttccgtaaatcaattggaatcaaaataaaagaagaaacagaaattattgaaggggaagtggttgaaattcagatcgatagaacaatcactggcggccacaagcaagggaagttgaccattaaaaccaccgatatggaaacaatttatgaattgggtaataagatgattgaagggttaaccaaagaaaaggttttggctggtgatgtcatctctattgataaggcatccggtataattactaaattaggaagatcattcactacagccagagatcatgatgccatgggaccagaaaccaaatttgtccaatgtcctgaaggtgaattacaaaagagaaaagaagttgtccacactatctctttgcatgaaattgatgttataaattctagacaacaaggattcttggctttgttttctggggatactggggaaattagaccagaggttcgtgaccaaatcaatactaaagttgccgaatggaacgaacaaggtaaggcacatattgttcctggggtgttgtctatcgatgaagttcacatgtcagatattgaatgtctttcattcatcaaccgagcattagaagatgaattctcccctatcgtcattatggctaccaatagaggtgtttctcgtctcagaggcactgattattaa

SEQ ID NO: 21853 - DNA, 216 bp, A.fumigatus
catgtgaacttcatcgatagacaacaccccaggaacaatatgtgccttaccttgttcgttccattcggcaactttagtattgatttggtcacgaacctctggtctaatttccccagtatccccagaaaacaaagccaagaatccttgttgtctagaatttataacatcaatttcatgcaaagagatagtgtggacaacttcttttctcttttgtaa

SEQ ID NO: 21854 - DNA, 261 bp, A.fumigatus
acttcatcgatagacaacaccccaggaacaatatgtgccttaccttgttcgttccattcggcaactttagtattgatttggtcacgaacctctggtctaatttccccagtatccccagaaaacaaagccaagaatccttgttgtctagaatttataacatcaatttcatgcaaagagatagtgtggacaacttcttttctcttttgtaattcaccttcaggacattggacaaatttggtttctggtcccatggcatcatga

SEQ ID NO: 21855 - DNA, 903 bp, A.fumigatus
  unsure (12),(37): Identity of nucleotide sequences at the above locations are unknown.
ttgttattcatnggattcattcaagtagaacatttantgggaaacctcaagaattcagatgtgggcctgtttgaaatcactttaattggtacagattttactgatcaatctcaattatcaaataattataccatgatggtttctaatgatactgggttatatttaacttctcaagcattattatattctgaattatctaaatcgggtcaaactaatggtaatggaggattagtagttaaacctggtgataaaataaagattcaatttgaaaaaaatttatttaaaagttattcatctagtgatcgacctattattgcttattatggtcgatcagccgatagaagttcattaccaaattggatatatttcgatggtgatactttaacattctctggaacggttccttatgtaacttcagaaaatgctccatcaattgattatagttttagttttattgcttcggattattatggatttgctggagcagaagggaaatttaaaattgtggttggtggtcatcaattgagtacttcaatgaatgaaactaatattgttaatggtaccattggttcgaaaattgatgaatcaataccaattttatctgatgttttccttgatggtcaacccattagtaaagaaaatatttccgatatttatgatcaagatttaccaaattatgccacatttgataaaaataattttactattactggtactttccctaatacttcaaccactgacaattttactattgttgttaaagatatctatggtaatagtgtcgaattaccttattcatttgatgttgtgaattcaatttttacaattgattcccttaaagatgttaatgctacaagaggtccatattttcaatatttttcaccacgccctgagatcccattg

SEQ ID NO: 21856 - DNA, 909 bp, A.fumigatus
  unsure (787),(852),(868): Identity of nucleotide sequences at the above locations are unknown.
aaatatttgcggatccttggcggcttcgtggagaagaatggtttcttgtgcggacaatcttatgggtatcttgtggaagatgatttgatatggacagcagataaattgacggcttcagatcggaaaattactacagccaacttgcaaagaaagtcattgatatgctatttaatggcaattaacaaatcacttgatgaatccattaaagacgtgatcaaaccggtagtgggtaatttaatgtccttgtttgccaaggagatgtttagtgctgtttgtgaaccgatgagtatgcacgcttttaaagtgcagtcacacccgagatttattaatcgtgttaacggtgctttatttgagccagtttcacagtttcctgctgttgataaaactgtttgtttgaaaataatacaacaatcgttacaattatcaatcaaatccagttgtcgtgagtggtctgattattattatttggccaaagttcaaagaaagttggacaaacctgcaggtttggttatggaaacaatggcttcagcgtgtcggagtgcatttaaaaacaaacatgcggacaatatcattgagcctcattataatttggtttcctttgcattgaaatatgtgaaaagtaataggcttgattcgaaggatgccttgaaatacttgatcgaagatccgttgattaagcttgaagtacgggaagaaactgatttcataaaactaatcataaaggcactcaacaaaattgatctgtcagataagaaaaactggcaacacaaagcaaagtataaactancccgtttgatgcaagaagagtatcatgatgtgaaacgagcaatagattcaatgttaagccttatntcgttgaaaactccanataaagcacttgttctgatatggaaaccggaaccagaaaga

SEQ ID NO: 21857 - DNA, 291 bp, A.fumigatus
tcagaccactcacgacaactggatttgattgataattgtaacgattgttgtattattttcaaacaaacagttttatcaacagcaggaaactgtgaaactggctcaaataaagcaccgttaacacgattaataaatctcgggtgtgactgcactttaaaagcgtgcatactcatcggttcacaaacagcactaaacatctccttggcaaacaaggacattaaattacccactaccggtttgatcacgtctttaatggattcatcaagtgatttgttaattgccattaaatag

SEQ ID NO: 21858 - DNA, 489 bp, A.fumigatus
tgtttgttaattagtttaagtagtgaatctgtttgcgacataattcactgtaagacattaaagctttttgatctgcgacaatttttcatcaattttcaacaatggcaaagaaaaattgaaagtaaagcaactggaaaaaaatgtgaagaaaaaaaaaatgatggaaaatattcattactccataccaatttttatattacaactactacaataatgtttggcttaggtggtactactcctcaaatttcatctcaacaaaaacttcaagctgctgaagctgaattagatatggttactggcatgttcaatgctttagtttcccaatgtcacaccaaatgtatcaacaaatcatataatgaagctgatatttcaaagcaagaatctttatgtcttgatagatgtgttgccaaatattttgaaaccaatgttcaagttggtgaaaatatgcaaaaattaggtcaatctggtcaatttatgggtagaagataa

SEQ ID NO: 21859 - DNA, 186 bp, A.fumigatus
agaatatttggatatgataaaccatttgatcttcatgattggttaattaatcgttgtggagttgaagtagaatatgtgatggatttttatattggtcaaaatattcaagtttacttggatgttagacccacattaaacactttaggaggtattaaaatgagatttggtagaccatttggattctaa

SEQ ID NO: 21860 - DNA, 195 bp, A.fumigatus
attggtctatttggacatctttacttaaaatcttgcaacacttctctgatatcgtttgttgatccaccattgaacaactccccattattcaatttggttctaacggcacccacaagaatttataaacccaaccccccaaacaactggtcttatttttcaataatttctggaaaaatctccaaattcaaggattcc

SEQ ID NO: 21861 - DNA, 624 bp, A.fumigatus
agatgtccaaatagaccaatttatcttgttggattctattttggtggggcattaacagccaatttcttaggtgaagagggtgaaaaggagaattcggaaagcttggtgaaagctgcttatacttttggttgtccttgggattttgttgatggtgcttatcaattgcaaaattcatggactggtaaatatttattgagtcctgctttggccaaatttttagctaaaattgttaccaataattataaagagttggagacttatgcccatgacattgtcaacaaggaaacattgaaggttatcaaaaactgtaaaacattgtgggagttcgatgacaatgtaacttgcaaaaccaccccatacaaagatgccttcgagtattatcaagagttgtctccagttaagaaactttcacaaataaacacaccattgttagctctcaattcaaccgatgatcctgcagttggagtcaaattgcctatactgcaaatgaaagccaatccttatttttgtttagttgaaacagatttaggtggtcatttgggatatgtccaactgaatggtgaattttggtgtgttgaactagttgaacaatttttccaaaaatttgaagaattggtcaaatag

SEQ ID NO: 21862 - DNA, 801 bp, A.fumigatus
aaaacgggcgtatttggaagaggaacagtcagtaggatatccatccgatcaattcatttgagaaacacgaccaattttgttgtgcctgaaaattataagccaaataggtcattgctcaagcagttaccatggaaagcaggacttgatatctggtggaagtccttgtctccaaatagactctctgatttgcagaaagatttagtggaatttatgctaccctctcatttgcaagaaaaccagagaataatcaaagagttcaaaaaaacaactatcgacgacaagggcaattatatcaatgaggtagggttcaagattataaacaacaaagataaaccaacaaagcatcttgttttcattcatggttatggtgcttctttaggctgttttgcaaggaattttcaaataatcaacaagttcaaagatactgactacaactatcatgtccatttcttagacaatttgacgtttggcttgtcatcaaatcccagagtgaataacgataccattaattactggcgtatccctgctacagccattgtgaagttatttgataaaactccaactgactccaaaaagttgtaccggaagtattacaaactaattgagggataccaattagatccagaaaatttcgaaaagtatagatcctattttactccaattttaaaagatcttgaaaacttttactgctccgcgatcgagaagtggagattgaacaatgacattgacagtatggattatttggttggtcattcatttggtgggtactggtgtggcaattatgcattgaaatacccctga

SEQ ID NO: 21863 - DNA, 732 bp, A.fumigatus
gataccgatgccgatgttgatatggataaaccatctaaatcagaattatcacgttctgctaaagatcgtcaatctgaagttatagcatcccataatatggtgacacaattcaattttgatgatgagttgggtgaatggtgtgaattcaaattagaattaaatggtaatgaaactcaaaaattgttgatggttaatattgttgaagatttatcacgtaaagttgttgttcgagaaattcctcatattggtagatgtattcgtcctgaaccagatgctaaaactggtaaaagaatattaactactgaaggggttaatttccgtgccatgtgggatcaagatgattttattaatgtcaatggtatcacttcaaatgatgtttatgccgttttgaaaacttatggtgttgaagctgccaaaaataccattgttaatgaaatctatagagtgttcgatacctatggtattagtgtttcttcccgtcctctggatttaattgctgatatgatgactagagaaggtacttatttggcattcaatagacaacgtattgatagtagtacatccgcatttatgaagatgtcttatgaaacaacttgtcaatttttgactaaagcagtgttggatggtgatcgtgaagaaatggaatctccttccgctaaaattgttatgggtaaattatcaaatgtgggtactggttcatttgatgtatttgctccaatgcccagattttga

SEQ ID NO: 21864 - DNA, 234 bp, A.fumigatus
ttgcctgatcaatatctttatcaaacttcaccaaatacaatgctgtcaacaccgcctgtaactcaaaacttgctttcttcacatcctcaaaatatgtcgaatcgtcaacgccaaaatcttttaggtcgttccatgcactcaacaactgaaataatggctcgttctcagggaacctggttttcccatcctcaatcatcttggaggcatcctgttccaacgcaattgtcgatctga

SEQ ID NO: 21865 - DNA, 222 bp, A.fumigatus
attatgttttattatgccaagacgccgcaggatccaatgtttaagttggaagatcccagagagtatacggaggagaaccggctcaaagtgagatttgatccagaaaaatataaagaaggtcatcctcacgacgagttatcgacgtgggacaggatccgtctttccaatgggtatgacataactgaagaaaagtcggcctgggacgagattaggagtaaatag

SEQ ID NO: 21866 - DNA, 612 bp, A.fumigatus
  unsure (77),(78),(80): Identity of nucleotide sequences at the above locations are unknown.
ctgaagaaaagtcggcctgggacgagattaggagtaaataggtttataaaatgcgaaaaaaaaaaattctcgacacnnanactacacgtagacacccaccaccaagcagttatggacgcatttagtgattcaggagagttgtataccattaggaaccagttttatactaatcagcacaataaggtcaaggcgtactcgcttgatgagttttcacccgaaaatcaattgaaggtgttggagtttcaaatcagatcgacaattgcgttggaacaggatgcctccaagatgattgaggatgggaaaaccaggttccctgagaacgagccattatttcagttgttgagtgcatggaacgacctaaaagattttggcgttgacgattcgacatattttgaggatgtgaagaaagcaagttttgagttacaggcggtgttgacagcattgtatttggtgaagtttgataaagatattgatcaggcaatcacgtttttgagtgattatattgataatgtgaattcgttggccaagtataacgagttggagccgtttttggtgttggtgcagtttcacttgatcaagggttttcacaacggcgtggaagatccgcaattg

SEQ ID NO: 21867 - DNA, 819 bp, A.fumigatus
  unsure (107): Identity of nucleotide sequences at the above locations are unknown.
aaacataggagtactgcagacagttttttgtcgcaacaggtagacgaaaagccatgggtggatgcactggacaattcatcagttcaagaatatcaaggttttgatgntactgcaagtcacaacatccaagatttagccagaaaattgacccatggttctacaaatggtgatcaccattctgcaaatgatttagctagatatttgagccacatgtccgacatacctggtgttagtccattcaacggcaacattagtcatgaacaattagacccagattccgaaaatttcaatgccaaatactgggtgaaaaacttgaaaaaattatttgaatctgattctgattattataagccatcgaaattaggggttgcctatagaaatttaagagcttacggtattgctaatgattctgattatcaaccaactgtgactaacgcactttggaaatttactactgaagcaatcaataaattgaagaaaccagacgactcaaagtattttgatattttgaaatcaatggatgccattatgagaccaggtgaacttactgtggttttggggagacccggtgctggttgttccacattgttaaagaccattgctgttaacacttatggtttccacattggtaaagaatcccaaattacttatgatgggttatccccacatgatattgaacgtcattaccgtggtgatgttatttattctgctgaaaccgatgttcatttccctcatttgagtgttggtgatactttggaatttgccgctagattaagaactccgtcttctaccacgggcgctggaaggtccgcgacttga

SEQ ID NO: 21868 - DNA, 186 bp, A.fumigatus
ccctcccatatatacacacgaaacatgaagattaatactcccccccctaactcctttatctacttttattttccaaaaaataaaaaagaatataaatatcctataattatcaataatttcaataatttaaaactaatcatttcttccttacttcaaagtcaagtattaagaactctccatgtctaa

SEQ ID NO: 21869 - DNA, 228 bp, A.fumigatus
ggcaaattattctcctcaatttatacatccacatcatggtttaggatctattacttctacttatacacattttttatttctttttatctttccttccttccttcctttcttgcttcttcttttgtaactgaagttaatttgggtgatccccaagataatcaaaaactaaacaatagaattattcaagataagctattagtcttcagccggccgtggaagatacgcact

SEQ ID NO: 21870 - DNA, 729 bp, A.fumigatus
tatggatgtcgaggcgtgttgaaaattcaagaacaacagcaacaacaacaacaactgcagcaactactgcattatcaacaacaagattttggatataatggttcacaacaatcatataataataataataataacaatagcaacatcaatactcaacaacagcataataattcctccaaaccaccacaaattgaagaattggtgaaacaatataaattaccaatgaaacgtgcagcacaaggtgaaaccagtgatgctagtgataaaccaactactgatacatcaccaacatcatcaattaaatcatttcctgaaatatcgatggttaccgataatttaactaataaacaagattttattgataattttgaaccaacacaattatttcctaattttagtatacctccaacaagagcccaatcgccaactccaaattatgaagatcataatgataatgggattggtagtaatatttatggattcatgaatcaagaaatgaccatgagagatattgtggcaccatcacaacaggaacaacaccaacaattccataatgatgttattggtaatggtcaacatcaacatattaatggtgataataataatcgtgatccacatacaccaggtttccaaactaattttatcgatagtgcatttaattatttgaatttacaatcaggtattgatatgaatgaagatattcattcattatttcatatgatgaattga

SEQ ID NO: 21871 - DNA, 495 bp, A.fumigatus
  unsure (86): Identity of nucleotide sequences at the above locations are unknown.
caaaaatctcgtacggatacatatgttaaacgatttgtaacatttttatgtcttttatccaccatatcattacaaggtaccaccantactaccaccaccaccaatactattaatgttaataaagatattttgaatggtgaatttgtgattcaatttttggaatcagttcaatcaggtcttttccaacaaattttaacatcatttatattaccaacttcatcaattttaactaatttacaagataaaaaattagttaatattggattatcacaaattttagtgacaatttcaacaacttctgaacaatatgcccatttgactccattaattttagaaactttaatatctaatttgaattcttatgaaggtatttcaaagagctcaaccaataacaataacaatggaatcagtagtagtagtagtactattgctactactatctctggtggtcaacaaccattgatatcttcaccacggcgctggaaggatccgcac

SEQ ID NO: 21872 - DNA, 195 bp, A.fumigatus
  unsure (47): Identity of nucleotide sequences at the above locations are unknown.
atggaggatgttccaagaattttttctttaaaccttttcaaaaatgncatttttaattggaaaaaattcttaaacaacagggatacccggaaattattaaaatttgatttcaccctttatattcacttctggtatggcatattctgggaatatctcagggataacaagattattaattgttattttggaacatga

SEQ ID NO: 21873 - DNA, 249 bp, A.fumigatus
acgtggttttccacccgtggtgagacctctggctcttccagcaagaccccagctcttgatatcaccctgagccaggtcaacaacacccggattaaggccgtggtcaagaacagtggcactgagaaaatcacttttgttcacctcaacttcttcaacgatcctagccctgttaagaaggtttccctctaccgcaatggtatccttctccctttcccgtcaatgtccctgttgcccaggaaacatcgctaa

SEQ ID NO: 21874 - DNA, 558 bp, A.fumigatus
gttcaagccaccgaggttgagttcactgggatcaagcagcgcctccgcagtgatggcctctccaacgacgccctgaccaccctcgcacccggcgccacctacgaagacgaatttgacatcgccagcaccgccaatctcacccaaggcggtcccgtcactgtccgcacacagggcttcgtccccatcgctatgaataacaagatcgctggctacatcccttattcctcgaacgagctcgaactcgaggtcgatgccgagaaggctgtcgctgtgcccgcgagcatcaagcccctcgatcgccgcacaaagatcacctcgtcctgcactggcaaccgtgctacagtccttaacacagccctccgtaacgccgcctcaatcgccagtaaagccgccgatgccgcgtcgtcaggctcctccgcgctcttcaccgaatactttaagtcaacctccggcaacatccgcagcgccgtcgccgcgcgcctcaaagctgtccccagcgaagcctcaatgaaccggggtggctcaactaactataacggctccgacccctatgggtaa

SEQ ID NO: 21875 - DNA, 243 bp, A.fumigatus
atgttatggtcgttgttggctaaaatggatatgcgacatcactgtcatcactacttacatttctctccttcttttagcattaccacccacatcttcttcatccagactagattcgcttccatcataaagatcatccgtttcagtttttttaaaacgaggatcaaagaacccacctttacagaccaaacgcgaagaacgtttagatatttccgtcaatgttttatcaaaatcgttaagatctaa

SEQ ID NO: 21876 - DNA, 789 bp, A.fumigatus
  unsure (32): Identity of nucleotide sequences at the above locations are unknown.
gtgcatgtttttttattatggatacctgtttnttcgagccagaaaattgaattccacaatatgccaaatggatcaccaaagcatcacattctagatgaggatgtattattgggaataaggtatcttagagatggagaattagattatcatcccactaaaccattaccacatcaaaaccatttcaaagatttttgcattaaatataacaaagaccccaaattaggagatttgaatcaaattgataaaatcccctgtgaaattctacatcagtttaccactaagagttgttggacacatgttttaatattattttgggttcaattcacatttgcgttcaaattatatgctacattaaatacttttttatttgtctttattaaaaagttcagaggtagtccattgaagtatttatataaaacaattagatcagcttcatttttaggtgcgtttactggtatacattgggcagctttctgtttcattagaaattatcatccaaattggttcggacaaaaattctgggatattctagcccctaaagcagggtatgcattatgtgggaccagtattttattggaatacccaagtcgtcgtaatgaattatccttgtttgtattgcccaaggcattagggacttttattgatccaaccccaactgaatcgaatatagcaaccgaggtgatagcttttagtttaagtttcgcagtattaatagcttatgctagactgcaaccaagtaaattaagagggttagtgggtaaaggattgagttatatggtcaaacattaa

SEQ ID NO: 21877 - DNA, 297 bp, A.fumigatus
cgaattatagtctatatagaatctaataaatgcgtgtccccatttctcacgctttcccgaaattatccatcatgtccaacaacgaatcgatatcgtcttctggcgcttcagacttcagctgagatccattttgatgggcttcaatccagttcgctacattgtcgacatacattttggagttcggaaaaaagtgaactcctggatgcttccaaatatcggaagaatgattcgtttgtgcatacaacgaatagccccgattttctgctaacacagtgtccaattctcccaacacgttaa

SEQ ID NO: 21878 - DNA, 573 bp, A.fumigatus
  unsure (1),(2),(3),(4),(5),(6),(7),(8),(9),(10),(11),(12),(13),(14),(15),(16),(17),(18),(19),(20),(21),(22),(23),(24): Identity of nucleotide sequences at the above locations are unknown.
nnnnnnnnnnnnnnnnnnnnnnnngaagacgaaaaggggaaacaagtaaagttgcagaaacatgccagtgaagtttatcaaggtgagagaactgtcaagtcaatcaccaagtttttaacttcaagattgaaaaattatgtgaaaaagtttcacaacatcagaagtgatggtattgctgaatggttggcagaagatataccttctgttttacttatttccaatgcaaatctggttagtccattgttgaaatccatagccattgattttcttgaccgtgtcaacgtcggaatgatatccaaatttaatgatgagtcgcataaatttgttattggcgataaagaaattgaagttccagctacctccaaatcgagcttgttctattttaataaggaaaagggagagttggtggcttatactaaatctgacaaattaaatgacaagatcaaaataactgaatggataatagaacaaacccagcaacaaccaatagaaggcccattatccaagatagataagaagtattactacaaatatagaacaggaaaaaagaaaatagaacatgacgaattatag

SEQ ID NO: 21879 - DNA, 318 bp, A.fumigatus
cgaccagtaacggggaatattaccttcacacggaagggggaagttaaaagtgtggttttcaatattcttaacgtgttgggagaattggacactgtgttagcagaaaatcggggctattcgttgtatgcacaaacgaatcattcttccgatatttggaagcatccaggagttcacttttttccgaactccaaaatgtatgtcgacaatgtagcgaactggattgaagcccatcaaaatggatctcagctgaagtctgaagcgccagaagacgatatcgattcgttgttggacatgatggataatttcgggaaagcgtga

SEQ ID NO: 21880 - DNA, 222 bp, A.fumigatus
tttgtcagatttagtataagccaccaactctcccttttccttattaaaatagaacaagctcgatttggaggtagctggaacttcaatttctttatcgccaataacaaatttatgcgactcatcattaaatttggatatcattccgacgttgacacggtcaagaaaatcaatggctatggatttcaacaatggactaaccagatttgcattggaaataagtaa

SEQ ID NO: 21881 - DNA, 381 bp, A.fumigatus
caggttatgtttctcgagagggagacggatgatatcatccagctcgttcagatgtcattttgccctggcgagggcagtccggtagggctaacaccttcacacgagggttcggccgagttgaccaatgggaccaacaagacggatagtactacggggcaacaggagctcgagaataacctcacggatgtagtttgtgaatgtttgggacttgagattcaggatgtggacgcggacaagtctttctgggaccttggggcccagagcatggatgcactgaaactacaacacctatgcgagaaacggggggtcagggttagactgcgggatatatttgtttctaggagtcttttggagttggcaacctgcgctgtcattatttga

SEQ ID NO: 21882 - DNA, 363 bp, A.fumigatus
aagtttttggaacaccagatagtgagctgggatttcagcaattatttctccaatggaatcaagggatcttggaggaccaatgactttgttcgtttgatggaaagacgaatggaactggaagtggtctatgggcactcgttagagacaatcaccacagactgtaagccactctataagagacaattgaacgaagactttgtgtccaccatcaaaaatgcatacaccaagatgaatgagactttttacaagcaaggggaataccatttgaacattgctgacaacattgaaaccattgttctccaaccatttagcaagtggtgtaccgagcacgagcagagagtcaagttatatgaatccacttag

SEQ ID NO: 21883 - DNA, 492 bp, A.fumigatus
caagacaaattaaaggcattgaaaaatgctcagtatctggtggaaaaattgcaaaagaagtatttcaacaaatgtcgaatgttggaggagttcaagtcccactatactgaaaaagaattgcaagaggagttaaacgatttgtcatttcaaaaagatcgagctgccaaaaccaatactgatgggagcaaagaggaagacgacaatgatactgcagacgaagaaatctatgagttcacacatgctaaatacgacaccaaacagatgaaggcattgctcaaggcaatgcttacagaagtccccatgggtccacacaaggtggcaattttaggtacctatcaaaatgtttctactgggagcaacatcaccaaatggttgctagaaaacatgccggagttcaacaagaatttggacaaggctgaagtttttgggcaagatttagttcgaaatgactttgtcttctaccacgggcgctggaaggaaccgcacttgcga

SEQ ID NO: 21884 - DNA, 756 bp, A.fumigatus
  unsure (211): Identity of nucleotide sequences at the above locations are unknown.
accggcaagtctaccactaaaaataagaatccatttgatctaattatgtctagtgaacattcaaaatcatttgatggggatcttacttcacatagaagtgtcgaatattatgatgattccatgaatagttctgggctgccattcaatttcttggctccatcacaagtcagaggatctacatttataatggattctaatatctccactatcnacaacatcaaagttatttgtcgatttcgacttgaaattgaaaaggaactacaaaagggtaaactgattgttgaatttccaaacactcaaactgtgacattatatggaaaggattacacaacccattattcttttgacagagtattttcccctgaagcaagtcaattagatatctaccaattctccattgccgaaacagtcgatgatttaataaatggttacaatggtactgtcttggcctatggtcagactggttcaggtaaatcgtataccatgttgggtggaccacaattactggatcctaattccaaaggtattatacctagaatatcccatgaaatatttgagagaatttcggcaaatgaagccgtgtcgtcagaggtggaatattctgtgtgtgtttcgtttatggaaattcatatggaacaaattcgagatttaatcgatgttgtcaacaatgaatttgatcataaattcactatacatgaagacaaactgaatggtatatatatcttcacccacgggcgctggaaggaaccgcgatat

SEQ ID NO: 21885 - DNA, 489 bp, A.fumigatus
gcaagtgcggaccttccacgccgtggtgaagatgtctcttacttgaaattgagaccagacagggttgcttgtcaagatgctaccgcccaaatggccattttgcaatttatgtccgctggtattccacaagttgccactccatctactgtccactgtgaccatttgatccaagctcaagttggtggtccaaaagatttggccagagccattgacttgaacaaggaagtttacgatttcttgtccactgcttgtgccaaatataacttgggtttctggaaaccaggttccggtattatccatcaaattgttttggaaaactatgccttcccaggtgctttattgattggtaccgattcccacactccaaatgctggtggtttgggtcaattggctattggtgttggtggtgctgatgccgtcgatgtcatgtctggtttgccatgggaattgaaagctccaaagatcattggtgttaaattgaacggttaa

SEQ ID NO: 21886 - DNA, 255 bp, A.fumigatus
atgtctggatggacttctccaaaagatatcatcttgaaattggctggtattactactgtcaaaggtggtactggttctattgtcaaatatttcggttctggtgtcgacaccttctcctgtaccggtatgggttacatctgtaatatgggtgctgaaattggtgccaccacttctgttttcccattcaacgactccatggttgactacttgaacgccactggtagatctgacattgctcaatttgccccagtttaa

SEQ ID NO: 21887 - DNA, 462 bp, A.fumigatus
  unsure (439): Identity of nucleotide sequences at the above locations are unknown.
gggaaaaaagtggatgagttgaatggagatattgagttcaagggaattgatttcacatatccatctcgtccggagtctggtatttttaaagacttgaatcttcatattaagcaaggagaaaatgtttgtttggtaggaccatcgggaagtgggaaatctactgtgagtcaattgctcttgagattttatgaccctgaaaagggtactattcaaattggcgatgatgttattacagatcttaacttgaaccattatagatcaaaattgggatacgttcaacaaaaacctttgttgtttagtggtactatcaaggaaaatatcttgtttgggaaagaagatgctactgatgaagaaatcaataatgctttaaacttaagttatgcttctaactttgtcagacatttaccagatggtctagataccaagattggtgcttcanattctacgcaattgagtggatga

SEQ ID NO: 21888 - DNA, 288 bp, A.fumigatus
ctaaaacagagagtgtctttagcaagaacattgatacgtgaccccaatattttaattttagacgatgcaacctcagcattggattctgtcagtgaagaaatagttatgctgaatttgattcaattgaataagaatagacgtgtgacattgatttcaattgcccatcgtttatcgacaattaacaatagtgatagaaatattgtgttcaaccaagatggccagatagtagacgattgtaatttcatgaattgcataatgatcccaacgtcgtttcataaattgttgtaa

SEQ ID NO: 21889 - DNA, 441 bp, A.fumigatus
cgttcctcttttagcactgccaatttttcgttgttcaaaagctacacctcttttttttttcttttctttttcttgaaaaacaccctaccatcaaacatgacagatactccaactgaaggggcttcatattcagagcaaatattggaatctgcaagaagaaataatacagaattgttactttccatcaaagttgagttaaacaatgatcaagaaaagtgggcagagttgatcaataccaccaaagaagtgataactgacaatactcctttgcacctagcatgtcaattgggaaactgggagtttatagatatagtattggacatgaaagcgtttgagattgatccgcaaaacagagaaggagaaacccattacatgtggctgttaaatataccaacaacgaagagcctgaacacggatactttattgttgaccatatgctag

SEQ ID NO: 21890 - DNA, 207 bp, A.fumigatus
  unsure (95): Identity of nucleotide sequences at the above locations are unknown.
ttgagttgttggagagtgcatagtatgcgatttctatggagcccaactgatgctgaaactttggctgaatttgaaaaattaaaggtctggatcantaccctgattaggttgttttttacattatttacccttatattacaaattgtcagcaattataagaaaacccattcttttaattttttccgggctggcatccttaatgcctga

SEQ ID NO: 21891 - DNA, 192 bp, A.fumigatus
tctttgggctataagtggtgtttgtctttgattcttggatcggagcatgcgtctagcatatggtcaacaataaagtatccgtgttcaggctcttcgttgttggtatatttaacagccacatgtaatgggtttctccttctctgttttgcggatcaatctcaaacgctttcatgtccaatactatatctataa

SEQ ID NO: 21892 - DNA, 558 bp, A.fumigatus
gatacccgttccggtgccgcggctgggggcggggaagacctcgggggtgtaggcgtagaggacgccgtacatgatgttctggaagaaggcctcgaggcagctgcagacgagctggacgttggagttagtggaggcggtgaagcagaagaggaggacgccggtgatgagggtcgagatgaccattgtgcctttgcggccgatgtacttgatgtcgacggtgtagcacgccaggatggagcctggcacgccgacaatggaagtgatggcgtagttgcggtaggtgacgtaggtggaggcctcggtggagccgccggcgtttttgatgtactggggcaggaacgcgttgaagagggggtagcccattccgattgtggtccagcagaaccagaggataaccgctgttggagacatgttagccatggcctatctagactcggcaggaggaaggggggtggggaaagggttggcgctcatactcgctactttgcgttttttttcttttccatttacgtgtatgtatcgcgctacgatcaattgttagcgggcgcattgttataa

SEQ ID NO: 21893 - DNA, 483 bp, A.fumigatus
gcgccaaccctttccccaccccccttcctcctgccgagtctagataggccatggctaacatgtctccaacagcggttatcctctggttctgctggaccacaatcggaatgggctaccccctcttcaacgcgttcctgccccagtacatcaaaaacgccggcggctccaccgaggcctccacctacgtcacctaccgcaactacgccatcacttccattgtcggcgtgccaggctccatcctggcgtgctacaccgtcgacatcaagtacatcggccgcaaaggcacaatggtcatctcgaccctcatcaccggcgtcctcctcttctgcttcaccgcctccactaactccaacgtccagctcgtctgcagctgcctcgaggccttcttccagaacatcatgtacggcgtcctctacgcctacacccccgaggtcttccccgcccccagccgcggcaccggaacgggtatctcaagctgtctga

SEQ ID NO: 21894 - DNA, 603 bp, A.fumigatus
gccatggctaacatgtctccaacagcggttatcctctggttctgctggaccacaatcggaatgggctaccccctcttcaacgcgttcctgccccagtacatcaaaaacgccggcggctccaccgaggcctccacctacgtcacctaccgcaactacgccatcacttccattgtcggcgtgccaggctccatcctggcgtgctacaccgtcgacatcaagtacatcggccgcaaaggcacaatggtcatctcgaccctcatcaccggcgtcctcctcttctgcttcaccgcctccactaactccaacgtccagctcgtctgcagctgcctcgaggccttcttccagaacatcatgtacggcgtcctctacgcctacacccccgaggtcttccccgcccccagccgcggcaccggaacgggtatctcaagctgtctgaaccgcattgctgggctgtgtgcgcccctcgtcgccatctacggcgggagctcaaaccccaactcccccatctacgcctctggtggactcatccttgcgtcctttgtcgcaatgtgctgtcgtcctatcgagacggtcttcaccgcggggctggaaggagccgctcca

SEQ ID NO: 21895 - DNA, 693 bp, A.fumigatus
agattcaacggtgggtccactggtaactcttccatgcgttcatggtacgcctgtgtcaataccaatcttgctgccgcaactggtgggttgacttggatgcttgtcgattggttcagaacaggtggtaagtggtcgactgttggtttatgtatgggtgctattgctggtcttgttggtatcactcctgctgctggttacgttcccgtttacacgtcagtaatcttcgggattgttccagccattatttgtaactttgcagtagacttgaaggacttgttgcagattgatgatggtatggacgtgtgggcactccatggtgttggtggatttgttggtaactttatgactgggttatttgctgcagactacgttgccatgattgatggaactgagattgatggtgggtggatgaaccaccactggaaacaattggggtatcagttagcaagaaactgttgcatcgctgcctggtccttcactgtgacgtccattattttgcttgccatggacagaatcccatttctcagaatccgtctccacgataacgaagatatgttgggatacgacttggcccaaattggtgaatatgcctattatgctgatgacgatcctgataccaacccatacgtcttggaacctatccgttctactactataagccaaccattacctcatattgatgctgttgcttga

SEQ ID NO: 21896 - DNA, 732 bp, A.fumigatus
cccggtattgctccttccagggccggtctgataattaaaaaacctcatgatccggcccaacaacaacaagagctacagccccaggatcaatcacaatccattgaatcaattgttacttcatgttttgaaagtttacaaaaaaatggatttataaattattttggaatgcaaagatttggttcatttagtatatcaactcatgaatttgggaaatttattttaaatgaaaattggcaagaatttgttgaattgttattatctgatcaagaatcagttgcacctggttcaattgaagctagaaaaatttggaaacaaactagagatcctaaattaactttgaataaattacctcattattttgttgctgaaactgccgttttaagagttttacaaaatgaatcaccgcaacaaaaagatgacaacaataccgtttattcttcaaattcttatcttaaagccattcaagcaattccgaaaaatcttcgtatgatgtatggacatgcatatcaagcatatatgtggaatttagtagcatcaaaaagaatcgaattatatggattaaatttaatcgaaggtgacttagtgtgtgaagaccctatcactaatcctgacattgttgatgaggatgtagtttatcttaatgaagctaaagttagatcattaacaaaacaagatattgaatcaggtaaatatactatatttgatgtgatattaccatcaccaggttgttaa

SEQ ID NO: 21897 - DNA, 816 bp, A.fumigatus
  unsure (546): Identity of nucleotide sequences at the above locations are unknown.
ccgtcctttgaaaatttaaatatcccttgcatatatatatcgattcaagcagtgttgtcattccctgcttcaggtaaaactactggtgtggttatagacagtggtgatggggtgactcacgtagttccagtatacgaaggatttgcattgccgccgtcaataaagagaatggatattgctgggagagatataaccgaatctttggcattcaatattcgaagaatgacaggggttgcgttacagagcagttctgaattggaaattgtcaggttgattaaagaacaaaattgtttcatatcaaaggacccggtaagagatgaaaagaaatatggaagtcattatagtagaaataaccctaataacgaattgatgtctacttataaattgcctgatggacatgaaattcaattgggagttgaaagattcagagccacggaaatgttgtttaatcctcaactcattggacatgagtcacctgggattcatgaattgacttcattggcaattgccaagactgatttggatttaagatcaactttgtatcanaatataatattatctggtggcaacactttgttaaagaatgttggtgatagaatgttgaaagaattaaaagatctacaacaaccactacgagaagatcgaaaaatgagtatgtggaataagaatgttcaaaatgatgtgtataatacgaaaatgaaagtgaaaatctactgcacaccggaaagaaagtattctacttggattggtggttctatattggcaggggtgtcgacttttaaaaaaattgtgggttacatcggaaaaatttcatga

SEQ ID NO: 21898 - DNA, 219 bp, A.fumigatus
cttccatatttcttttcatctcttaccgggtcctttgatatgaaacaattttgttctttaatcaacctgacaatttccaattcagaactgctctgtaacgcaacccctgtcattcttcgaatattgaatgccaaagattcggttatatctctcccagcaatatccattctctttattgacggcggcaatgcaaatccttcgtatactggaactacgtga

SEQ ID NO: 21899 - DNA, 219 bp, A.fumigatus
tttaccatatgcttttcctttttttttaaaatgggttccacaatttgttctaataaagaaagtaaaattaaccgacagatacatatgttaaggcgatctgcttgcacttcaaaaattgttctagatcgctttttttgggcttctggggtttataatttcgttgtttttacaaccaaaaaggtaacgttttattggatttactacattaaccaaataatc

SEQ ID NO: 21900 - DNA, 795 bp, A.fumigatus
tcgcggtccttccagccccgtggtgaagacatgttaagatcaactactcgtaatacattacgtttggctactagatatactaaagtttcatcaagtatcattcgtcacactttaccaacaatgtttggtagtagtactggtggtagtggtataagatttgcatctcaattggctcatgttaaaaccccaccaaacttacaaaatgaaccagttaaaaattttagtttcaaagatactaaagattgggatttattaagagcttcaattactaaattcactgatgaaggtgctttaaaagtcccattggttgttggtggtaagaagatttatcgtgacgaaatcaaaactcaagtaaacccagctaaacactctcaagttttagctgacgtttctcaagctactccagaagatatcattgctgctattgatgctgctaaagctgctaaagccaaatgggcaacaacttcttggactgacagagctgctatttttttgaaagctgctgatttaatttctaccaaatatagatatgatatgttggctgctactatgttgggacaaggtaaaaatgtttatcaagcaaaaattgattgtgttgctgaattgattgatttctttaaatttaatgttaaatatgctgaagaaatgtatcaacaacaaccaatacaaacttctcctggtgtttggaaccgtgctgaatataaacctttggaaaggttttgtttatgctgttactccattcaatttcactgccattgctgccaatttggttggagctcctgctttaatgggtaa

SEQ ID NO: 21901 - DNA, 234 bp, A.fumigatus
ttgatttctttaaatttaatgttaaatatgctgaagaaatgtatcaacaacaaccaatacaaacttctcctggtgtttggaaccgtgctgaatataaacctttggaaaggttttgtttatgctgttactccattcaatttcactgccattgctgccaatttggttggagctcctgctttaatgggtaacactgttgtttggaaaacatctgctacacccgcattatccaactaa

SEQ ID NO: 21902 - DNA, 216 bp, A.fumigatus
acaaaacctttccaaaggtttatattcagcacggttccaaacaccaggagaagtttgtattggttgttgttgatacatttcttcagcatatttaacattaaatttaaagaaatcaatcaattcagcaacacaatcaatttttgcttgataaacatttttaccttgtcccaacatagtagcagccaacatatcatatctatatttggtagaaattaa

SEQ ID NO: 21903 - DNA, 207 bp, A.fumigatus
aatgcaatcaaatttaatgaagctagattcaatgcccagttatcgtactttaccaaaagcaataaagctaagtacacattaacagacaacactatcacgggagttgacgaagccaccacattaaaaacaaactcccttgttttgtttgaaaacgaagttttccttttctttttactagtcttatcttcatttggagacttaacataa

SEQ ID NO: 21904 - DNA, 858 bp, A.fumigatus
  unsure (354): Identity of nucleotide sequences at the above locations are unknown.
caaatatcaaagatcacggttttgaacccacagattttatggagatttataatttctttgttgatagtaactgatgataaccacgaacaattatgttttattagctcatcaatattgattaaactgttgaagttagtgccgttattattaggatcaacttgcagagtaaccaatgattcacttgagacgttattgactgcgttattgaatcgtttatcgaagaaatgtgatacaattatacacacccacataactgtcttattcccgtcctcaagtgatcaaatactacaccaaatggcattcgaagattcttgtttgcccaatatcgatttaaataaatccattcttgagaanacagttgactcacaactattgttagagtttataacttgtacagctcaaattttgagttttatgaaatccaatgactatgatattttaacggcattccaaagcaattatgttaagtctccaaatgaagataagactagtaaaaagaaaaggaaaacttcgttttcaaacaaaacaagggagtttgtttttaatgtggtggcttcgtcaactcccgtgatagtgttgtctgttaatgtgtacttagctttattgcttttggtaaagtacgataactgggcattgaatctagcttcattaaatttgattgcattttatttaaagaacttgaaaccttcacaagatggagacaaagccttgatttttagaagttataagaaattattcccccgaattatttcaatgctagaattgaaaaatgattatactggatgcatgaacaaaaaaacgaaaaatccaacttcatctgcttctgtatcttcaccacggggctggaaggaaccgcac

SEQ ID NO: 21905 - DNA, 213 bp, A.fumigatus
agaatcacgtttttgtcttttattaggactaattgtcattgtcgagagagaatagtggatgtcaatgatggaaaaacaacaatgctgaataaattttttagatttgaaggagaaggatttatgacatgtttatatagttggatttccaaaataacgaaatttcaatcaacaatttgtaataatgaaaaaataccacacaatcaaaaatgctag

SEQ ID NO: 21906 - DNA, 423 bp, A.fumigatus
acatgtcataaatccttctccttcaaatctaaaaaatttattcagcattgttgtttttccatcattgacatccactattctctctcgacaatgacaattagtcctaataaaagacaaaaacgtgattcttcatcacctaaaaaacacctcatcctcaatgcatttgatatgatgtgtccatcacttcaaactgcgggattatggagtcatcctgaagataaatctcgagattataataccattgaatattggactaatttagctaaattattggaaaaggggaaattcaatgctcttttcattgctgatgttttaggtggttatgatgtttataatggacctcgtaatttaactgctgctgctaaatctggagctcaatggccaattaatcttctaccacgggcgctggaaggaaccgcactt

SEQ ID NO: 21907 - DNA, 330 bp, A.fumigatus
aataatatacgttcattattatatttcgaattaatacttaacctgggagttatactattaattaactttatgtgtcaagatatgttatccttctatgtatacttcgaaatatcattagcacctttatttatccttattggtttatatggtgctaataatagagataaagctgctgattatatactaatctatactttatttagtagtctatttatgttattagctataggtacatatgaagtattaataggtaatactgattatcaagctgttagtctagttgtactgtcaactgatctacttcttcaccacggggctggaaggaaccgc

SEQ ID NO: 21908 - DNA, 783 bp, A.fumigatus
gtgtggtccttccacgccgtggtgaagaatgaatcaataaatccgcaacataggaatttatttgcaaaatttgattttaaattattagcttcacttttcaattcatttaatgagtttatgttgattgatgccgatacaatcttgatgaaatcaccagaatttttcttcaatcatcaatcatatcaacaaactggagcattttttttcaaagatcggtcaccattacttaaacgtccaataaccgatggagaatttcttatcaaaatgggaccatcatcaatcgattcaattatgtttgatatcccaatgatgacacaatatacaacccatagagagttgtttaaagggttacgtctatatatggaatcaggattagttatgatagataaacaacgacgacgtcatttcaattcaattttaatgatgaatcaacttaaattcattcatccaatttccaattcaatgtggggggataaagaattgtgttggttaggatttgccatccatggtgatgaacattataaatttaataatcattttgctgcagcaattggtcaattaacttcaaatcaatataataaagacagaagaaccccattaaaatctaaagaaatatgtgcttcacatccgggtcatataagtgatgaagatgatcgaagtgtattatggtttaattcaggatttaggttttgtcatgaagcaaacaatattgattatcccgaagagactagaaataatgtaatattgaaatttcttaatggtcgtcatccattggaaatttaa

SEQ ID NO: 21909 - DNA, 234 bp, A.fumigatus
caccgactgtacattaaacatcatttcagatatccattagtggtgcagtctgtagcgattctttatataaccgacggtcttatcacattaaccgttttcactaatgtcgccgtatccacccgacctaccctaagtatgtcgggtgactatactaatcgtctttcgattatacctctatataatatgccctataaaagttattattatattataaatgattatttatcaaggtaa

SEQ ID NO: 21910 - DNA, 435 bp, A.fumigatus
  unsure (291),(295): Identity of nucleotide sequences at the above locations are unknown.
aaaatttcacccattatagatgaattaagtgaattatttattgattatcctgagattcaaataattaaaattaatggtgataaagatgggaaaaaaatgagtaaaaaatatgttgatattggatatccgacattattatttttttatgatgatgggaggaaaattgaatttgatggaattagagatttgactagtgtaagtaattttattcaacaattaagtgggattagattaaatgaaagtaaatcaactgataaccatgacgaagaagaagagaacactgcgaagacngaangtccttttagtggtagtaatagtaatgtcaacgatggcgatgaagaaacgacccattggatgaatttgaatccggaaaatttgaataaaaaattttccaatccacaatttctttggtttcatttggaacatcctggtgtc

SEQ ID NO: 21911 - DNA, 531 bp, A.fumigatus
  unsure (285): Identity of nucleotide sequences at the above locations are unknown.
gtcatggttacctcttcaacagccaatgataataataatgaagatcccataatttctaaaaattgggtatgggtacctaatcaacaagatttattcactaaaggttatatcactgactatttacctgatggtaaatgtaaagttaatgttgtcaaaggtcaagaatcatcccatgattcaacaataatcgtggatcaagataaattggaaaactgtaatcctgtgaaattcaataaatgtgaagatatggctgaactaactcatttaaatgaaccatctgtcgtntacaacttgtatcttcgatatttagacgatttgatctatacttattctgggttgtttcttgttgccatcaatccctataaactgttaaccatttataatcaatcaattttaatgaaatatcaccaatataataacgtgactacaaacaaaaatgactaccaatctaaaaacggctccaactgcaactactacaaacaaaggaattcaccgccacatttttgtgctgttgccgaaatcgacttttaa

SEQ ID NO: 21912 - DNA, 219 bp, A.fumigatus
tcaccatgtcaactgttgaaaattctaataccaaatttcatcaccctacttttcaacatcaaccacaaccacaatcttgttcttataacccgtcttcaacaattccaaaattatctattcctcaacacttacaaatccaaaaacctaaccactagttttatcaaccatatccccagctacttcaacacaactacagccctggtgtcccatttaataatc

SEQ ID NO: 21913 - DNA, 198 bp, A.fumigatus
ttatatgagtttctattattatctctgactatgtataatcttttttattcgcaaccacacgacaatatacaacaacaaactactcaaactgttaacaagcgtgacaagcgtgacaagcgtgacaagacaagcgtgacaaaaagaaataattattcatcatggcctcctctctcattccaagttggtgttaacgactaa

SEQ ID NO: 21914 - DNA, 210 bp, A.fumigatus
caccgaggcagttggacctcagccgccagcagaagtacaaccagtcgcatcagtaccaccaatggcacccgttgcaccaaatctgtcgttgacttcggtagctccggctcccgaatcagcaccagcacaggtggctgcacccccactagtaatggccccagcagccccaccaatatcatcatcaggaaacgctccttatatttccaatga

SEQ ID NO: 21915 - DNA, 510 bp, A.fumigatus
aaaaatagttgttcagaaacttcaattccttgtagtatatgctgggacttgttgaaaatcatgaataatggaaccaaacaaagggagtcttctaaacttcacgatacacccaaagcacaagagtctccgacaatagctaatttgctaaatgaccaagctgacaccgaggcagttggacctcagccgccagcagaagtacaaccagtcgcatcagtaccaccaatggcacccgttgcaccaaatctgtcgttgacttcggtagctccggctcccgaatcagcaccagcacaggtggctgcacccccactagtaatggccccagcagccccaccaatatcatcatcaggaaacgctccttatatttccaatgataaaaactgggtaaaccagtttggcccaccaacaacgatgctacaagatttacaccaagtacaatctcaaccaatatatctgaactcaaattttcatcagcagcataaatattatccacatcaaatactgctagaataa

SEQ ID NO: 21916 - DNA, 414 bp, A.fumigatus
tgcggttccttccagccccgtggtgagatcctcttagattctggtactactatcagttatttcactccaaatattgctcgtagcattatctatgccttaggtggtcaagtgcattatgattcttctggtaatgaagcttatgttgctgattgtaaaacttcaggtaccgttgatttccaattcgatagaaacctcaagatttccgttcctgcttcggaattcctttaccaattatattacactaatggtgaaccttatccaaaatgtgaaattcgtgttcgtgaaagtgaagataatattcttggtgacaacttcatgagatcagcttacattgtctacgatttggatgatagaaagatctccatggctcaagttaaatacacttcccagtctaacattgttgctattaattag

SEQ ID NO: 21917 - DNA, 807 bp, A.fumigatus
attgggatctccacgcccgtggtgaatacattgattgttgattcgattcctattacagttgttacatctgatcaacatggacatggacatggacaagagcatgaacatgaacatgaacatgctgatgtagatatttctcatatccctgatgattatgatttatcacaaggtgggataattagaattgtcaaaattggtgaattagatgctaatccatgtcgtggaactcatttaacatcaacagcacaaattcaatcaattgcattattacatcaatctccaattagaggaggtcattctcgattatatttcatttgtggtggtcgagtagctaatcatttacgtaaagaacatgaaattttgaaaaatgtatctacaaatcaattatcttgttcaatcgatgctgttgaagaaaaaattgaattattaagtttaaatgataaaaaaaccaattctacattaaataatttattaaaagaattagcatcaattgaagctaataaaattttccaaaattttaatacccatgataataacaacagtaaattagcttatgtatatcgtgctgatctgccagaatatttaacttgggttcataaagaattaacaactttgattaatcaagataaaactggtgatgttgatgtatcaaataaacaaacccttgttttattaagtggcgctgctcctaatggtggtaacataataatatcgggtccaaatgcagaagaattacgtgtagaatgtacatcaaaattatctaattttaacacgtggtgtgtaaaggatcttcattttcaacgttaa

SEQ ID NO: 21918 - DNA, 825 bp, A.fumigatus
gcggttccttccagcgcccgtggtgaagtatgtacagcaaattaccttggctccattccgggcccactaagagatcgtatggaaataattgaagttaacgggtacacaaagaatgacaagattgaaatcacaaagagacatttaattcctgcagccgcaaagaaggttggattggatgaaggtcgcgtagtgatccctgatgaaactatttccagattaattgacaagtactgtcgtgaaagtggtttgagacatatcaagtctttgatcaatagaattttcagtaaagcttccagaaaaattgtagaagaattggaagaaactgatgttgatagtcacaacaaagatacagtcgaaggaactcttgttgctaaagaaagtgagaaagtaatatccgacaaagccaagattgatactgaaaactcaccaatagaatatatccaaagcaatactgaagttaaagcagagacaacaacagaaagccaacaagaacgagatgctgaacgtgatggggacgaggattttctgaaattggatctgccagcagatttgaaaatagaagttaagccagagacattgaaggattttgttggaccacaaatttacataaaggacagactttacgaaactttgaatccaggtgtagcaactgggttggcctataatacatctggagatggtgatgcattgtattttgaatccattttaacagattccattagttccgatcttggaaatgccggattacatgtcactgggtcattaaaggatgtgatgaaagatctgcatctattgcatattcttttgccaagcagtttatggtaa

SEQ ID NO: 21919 - DNA, 207 bp, A.fumigatus
gttttcagtatcaatcttggctttgtcggatattactttctcactttctttagcaacaagagttccttcgactgtatctttgttgtgactatcaacatcagtttcttccaattcttctacaatttttctggaagctttactgaaaattctattgatcaaagacttgatatgtctcaaaccactttcacgacagtacttgtcaattaa

SEQ ID NO: 21920 - DNA, 294 bp, A.fumigatus
ctatcaacatcagtttcttccaattcttctacaatttttctggaagctttactgaaaattctattgatcaaagacttgatatgtctcaaaccactttcacgacagtacttgtcaattaatctggaaatagtttcatcagggatcactacgcgaccttcatccaatccaaccttctttgcggctgcaggaattaaatgtctctttgtgatttcaatcttgtcattctttgtgtacccgttaacttcaattatttccatacgatctcttagtgggcccggaatggagccaaggtaa

SEQ ID NO: 21921 - DNA, 342 bp, A.fumigatus
acagtctctgaattgtcaatcgcaggcccatcactctgtgtgggtgctgctcctcctaatccggcaccttggcctaataatctttgtaatctgaccatagttgtgtggcaaaagaaaaaaataacctgtcgagaaaaaaaaaattcaccaacaaaaaaaaaatacttatactatgcaaactcttcaccaatgactacaccactgacatcacctgccagaacccatgccagaaaagtgtactcccacataaaggcaccctttttcatcagtggcgatgacttggtgctctacaagtactgcgaccaaaccaaaccattcagacgaaaccgatactttttctaa

SEQ ID NO: 21922 - DNA, 465 bp, A.fumigatus
tataagtattttttttttgttggtgaattttttttttctcgacaggttatttttttcttttgccacacaactatggtcagattacaaagattattaggccaaggtgccggattaggaggagcagcacccacacagagtgatgggcctgcgattgacaattcagagactgtttacatatcgtcgttggcgttgctcaaaatgttgaagcacgggcgtgctggtgtgccaatggaagttatggggttaatgttgggagagtttgttgatgatttcactatacatgttcacgatgtgtttgcgatgccgcagtcgggtactggagtttctgttgaggcggttgatgatgtattccagacaaagatgatggatatgcttagacaaacgggcagagaccagatggttgttggatggtaccactcgcaccctgggtttggtcttcaccacggccctggaaggacccgcgct

SEQ ID NO: 21923 - DNA, 228 bp, A.fumigatus
aaaaaaattttccccattttgaaaattggaattggaaatctcttgattttcattttcctcatcactaataattggagaactgctcattgccattgcttcttgcaatcgactttcaaaaccatctggatcattaacataatcatcaaattgagggtcataactactaccgatttcgtctatgtgattgctggtaagaatagttggggcttcatcattgctgctctctga

SEQ ID NO: 21924 - DNA, 249 bp, A.fumigatus
ttcttccaacaattcttctgcaacatatgcacctattttttgaccaaccaacgggataatgtctattctaagacaaagaagtatggcattttgggggctacctctgattttttcccgatagaaatttttgtggatgtttatataacgatatacagccaaggtatgaatacagctgcattcttcaattgtaaacatttcacaagatcattggccggttttgttttgatagttcaattcaacgttgtttga

SEQ ID NO: 21925 - DNA, 690 bp, A.fumigatus
tcttgtgaaatgtttacaattgaagaatgcagctgtattcataccttggctgtatatcgttatataaacatccacaaaaatttctatcgggaaaaaatcagaggtagcccccaaaatgccatacttctttgtcttagaatagacattatcccgttggttggtcaaaaaataggtgcatatgttgcagaagaattgttggaagaactagacgaagaaggagaattggaaacaagtgtttccgagataatgaatcaactagctgcatcaaatgaatcgcttgagggatgtcttccaattagttccctattaagtctggctattgccataattgatgaagcttcagagagcagcaatgatgaagccccaactattcttaccagcaatcacatagacgaaatcggtagtagttatgaccctcaatttgatgattatgttaatgatccagatggttttgaaagtcgattgcaagaagcaatggcaatgagcagttctccaattattagtgatgaggaaaatgaaaatcaagagatttccaattccaattttcaaaatggggaaaattttttttcacgagaagaaggaagatcaattgagctgctcccttcgctgccacctccatcgcacaatacatcagtttcaacaagtcgtgatacatcttcaaccacgggcgctggaaggaaccgcacttgc

SEQ ID NO: 21926 - DNA, 570 bp, A.fumigatus
aattcccttaaacgtgcaactttgaatttcattagtacaattgttatgaatcatctttcaagtgtgttgatcactgaatccaataaacaagagttgcctgaaattattggcaaagtatttgaatattcttatgatttgagtgatacgaccacgtcaaaattagccattgtccagttgactaattttgtcaatgtttttggtggaagtgggggtaaattggatgacaaagaggataagtacagtgaaaatttaccaccaatcgaaggtatagatgaattcttgatcaacaaagtcattaacctctcgtttgaattaccatttcaaaaacaagaatctaatttaaatgacgcacagtatcgattaattgctcaagaaattgccatattgttaaagagttttgaattgaaaaaacacgacgaatttatagttgttttgagtaattatttgttaaatatgggattatctcaagatgtgtgtaatgacttttgtttgaacttgcacaatttggatttaaaagattttaaaaagtattttatcagtgttatcaacaaaatgaaaagtgggaaatag

SEQ ID NO: 21927 - DNA, 252 bp, A.fumigatus
attgcgcaaattcgacgtccttccagtctgtcagtgaaagctcccatgagattgcccaagagtatactaactctgattcggctggacaagcgatcggatatccaggccccagttctcaatatcaacctgaaaaacgataggcttcttaccccgggctacctatttctcaccccctatggcgtagatctgccggggccctatatctttgacatttctgggtcttccccacggggctggaaatacaagcgtgcg

SEQ ID NO: 21928 - DNA, 843 bp, A.fumigatus
gtaccaaatggagaaaaaaccattaccaaaagaaaagtgagattagttgggggcaaagcagttaacttgttcttggaggatccagttccaacagagttgagaaaagtgttgaccagaacggagtctccatttggtgagtttaccaacatgacatacacagcgtgcacttggcagccagatactttttctgctgaagggttcaccttaagagctgccaaatacggcagagaaactgagattgtcatttgtataaccatgtataatgaggacgaagttgcatttgccagaactatgcatggtgtgatgaaacatatcgctcatttgtgctcacgccataaatccaaaatatggggcaaagatagctggaaaaaagttcaagtgataattgttgcagatggtagaaataaagttcaacaatccgttcttgaattgcttacggcaacaggctgctatcaagaaaatttggccaggccctatgtcaacaatagcaaagtaaatgcccatttgtttgaatataccactcaaatatctatcgatgagaacttgaaattcaaaggagatgaaaaaaaccttgcaccagttcaagtcttgttctgtttgaaagaactgaaccaaaagaaaatcaattcccatagatggctttttaatgccttttgtcctgtcttggaccccaatgttattgttcttttagatgtgggtaccaaacccgataaccatgccatttataatctatggaaagcattcgatagagattccaatgtagcaggggctgctggtgaaattaaagcgatgaaaggtaaaggttggatgtttcaccacggggctggaaggatccgcgattag

SEQ ID NO: 21929 - DNA, 810 bp, A.fumigatus
  unsure (799): Identity of nucleotide sequences at the above locations are unknown.
agatcaaagaccgttaaattgtcgccattggataatgcagttagaacgatagctgccaagaatgatgatttgattcaattagaagcgtttatcaatgcagctcttaaagaaaaaactgattattcacattatttcaatgatttatcgagacaattggcaggtacggtggattcgccagtaaatggaggggttggccaatatcgtgcatttttctccgatagcaaatatcaaattaatgaagaaagtattgctaaaacagagttgttacgtaatgcattcaatgatcttgctattatcttgtatcgttgtttgaatttacatggtagtttgattggactatcgatgaaactgtcacatcaagcattagtcgaattgtttagaaagaatttccaagaagaaattgttgctttacgtttaggtgaagaggcgacaattacagctccatcctcaagtcgtgtttccattttccacaataaacgtgctaatggtttaatgactgaacgtgccaattccatttcaaacatgtctggtgctggttctacatattcgggttcaagactagcaaggtctcctactaatgcctcatcagtgtcttcaaataattcatcaatcactagatcaggtagagcatcaaacacttcgggatatcctgcaagtgttattcaaccaggatatactgggttaaagggatcatctcttaaaaatggtaatggatctgtcacttctaaatcaataaacggatccggtaaaacaaatgcaattaatacaaaatggttatacgaagtgttctcgttgtcanacatcatttaa

SEQ ID NO: 21930 - DNA, 828 bp, A.fumigatus
  unsure (119): Identity of nucleotide sequences at the above locations are unknown.
atactgatcctaaaatcccaaaaatttttgaatagtgattatactattgatgttttattaaatcggttaaaagaaagtttgaataccggcgaagaatttagtaaatttattaaaaaganagctcaaattgaagacgatcattataatcaattaaaaaaatttgctggtcatgtacgtaccaatatgaaaaataattctcgaaatttgaaaaatgattcattacaatttcaaatggatcaaattattcaatttgatgaatcattatatggagtaggcaattcttatgttgttgccttaaatacaatgtatgatgaattaacatctttaattgggacaattggtagaacaagaaaattgattaaagatgaacataaacgtaaagaaaaagattgtattgatgccataataactgctgaaaaagccaaaaccaaatataatcatttatgtgaagatttagatcgattgaaaacttctgatcccaataaaaaatcatttagtttgaaaaataaatcagtggaacaacaagaagatgaattgagtagaaaagttgatactgctgatcaagaatataaactgaaagttgctacatgtaaaaaattaaaagatgaaattttggtgattcatcgtcctaataatactaaaaaattgaaaaatttaatattggaaatggatattgctttaaatttacaattacaaaagtatgcaacttggaatgaaaatttgattatgaattctggagtattaataaatcctttacaatccagtaaagcatcaatgaaatcaatggctagtgatcttcaccacggcgctggaaggatccgcacttga

SEQ ID NO: 21931 - DNA, 372 bp, A.fumigatus
caccatgcctggcgcaagaactcaggaaatggactagagctcgccaaccatgcggcagtcccaacgctaactacccccagcaacaaccacaatttgtccaatgggtctgacgagcagatgcaggattggggcagtggcacacgtacccgaatctgcccgatagctggacaagaggtcctgcagccgaatgcgaaattgtcactgggtaaacaggacagcgggaataccatgcgggctgcattagcacttctcgcaagggcagctgaacaatgtgagagcctatttaatggtatggagcacgagagagctatgctactccaatctgatgacaaaaaggcgaggctttcctgggaagtatgctctatcgtttag

SEQ ID NO: 21932 - DNA, 441 bp, A.fumigatus
aggcagaaatctgacaagttgaaaggctcggtgacgtggcatcggctaggcgaactcgcgacatgcattttcgagcttggtttgcaccaggactcggatgaacgcattgatcttccggactttctcctggagtccagacgcaggctattcgccgctgtctatcaattggacaagagcattgtgaccttcttgggtcgaccgccccggatctcgcggaggcattccaattgccgtctacctcttgatatcagtgatgaggctctcactgggagtagagagcttgcgcaaagatcggtgacggcggaagggtggagttgtcatgctgtctaccagcgttcagcctggatccgcgtgcgcttcctcatcagcacgttccgggaggaaatcctggagttgtccctgacaaagcccagcgagaaccgagaagagcaattgaggtga

SEQ ID NO: 21933 - DNA, 531 bp, A.fumigatus
  unsure (407): Identity of nucleotide sequences at the above locations are unknown.
ccgccgtacccatgtcatcctcccacagctatattgtcgtccgtgctggatgcaacaccgtgcaggtgggagggggagatagctgctctgctctggtcacaaagtgtgggatctccgctgcagattttagcaagtataaacccggcccaaacctgtattcaacactcgtgccaggacaacctgtctgctgctcggccggcacactccttggctttgccccaaaacctaagccagatagatcgtgtgctacatacaccattcgacaagacgacaactgtgcgaaccttgctgctcaatacagcctcacaaaggaagatcgaggacttcaacaagaagacatggggctggaatggttgctcaaatgtctgggtcgggacagtaatctatttaagtagcggaagcccacntatgcccaaccccgtggctaatgcagtatgcgggccccaggtgccgggcacagaagcaccggatgacactacggatattgctgggcttaatccctgcctattgaatgcttgttgtaatatttag

SEQ ID NO: 21934 - DNA, 531 bp, A.fumigatus
ttttcgaacgggaggatgtctttcttttggaaaagggaaaaccccctaacaggtccggctgtccttaccactcatgtcttaaaaatttggtcgaacgccatttatttgaagatattccgttggaggtcaacagtagccgccgtacccatgtcatcctcccacagctatattgtcgtccgtgctggatgcaacaccgtgcaggtgggagggggagatagctgctctgctctggtcacaaagtgtgggatctccgctgcagattttagcaagtataaacccggcccaaacctgtattcaacactcgtgccaggacaacctgtctgctgctcggccggcacactccttggctttgccccaaaacctaagccagatagatcgtgtgctacatacaccattcgacaagacgacaactgtgcgaaccttgctgctcaatacagcctcacaaaggaagatcgaggacttcaacaagaagacatggggctggaatggttgctcaaatgtctgggtcgggacagtaatctatttaagtag

SEQ ID NO: 21935 - DNA, 198 bp, A.fumigatus
  unsure (116): Identity of nucleotide sequences at the above locations are unknown.
catcctggacgtgccaggaaaatcaatagcctatggcccattaatcccctgtctcacagcccacaatccacagccctgtctcactatcagaaagtaaaacccatgggtgcacgatntagaacccccacaccgaagaataggattgagggaagaatcttctttgacgtgctgtgtgctctgttccctacgtgtaaatag

SEQ ID NO: 21936 - DNA, 555 bp, A.fumigatus
ggagggagctatttccagtcccggcgtgtagacaactactacatgtcagctcctgactcggaacattcattctctcgtcattctagaccgtgtggtcccattgtacaattctcttacaactccctgctaccccactcggttcggctgaaggtcgtcagttgtattcgcatgatggcttccgaaaaggcgcaggatgccattgggccagcggcggagtacgatcctcgccgtgattctacagcatctgcggccaaggtcgttcacaatgccagagcggcgacggagaaggaacaacgcatgtcgctctgggaaggcatcaagacctaccccaaagctgtcgggtggagcttgctgatctccacctgtattgccatggagggctacgatatctgcctcgtcaacaatttctatgccttcccgcaattcaatcgcaaatacggtgagctcacctcaaagggtgactatcaagtgccggctcgggtaagttctccgcccacctatcctcccttctgcgatatgtgtgctgagatggcgttgtatagtggcaagcaggcc

SEQ ID NO: 21937 - DNA, 222 bp, A.fumigatus
  unsure (6),(93),(97),(108),(113),(130),(140),(172): Identity of nucleotide sequences at the above locations are unknown.
ggctancaaggatcttatcggatggcctcggacccgggtcctgctcggttggtatcggcatatggtgagtctgatatcacgtatcggggatanggtnggggggtgtanccgcntgactattcggctcatntggcatatantatctgctggctgtggggtcgaatctacccgntatggtcatatacacagtatttcaacgttaggccctatgggctggtatag

SEQ ID NO: 21938 - DNA, 198 bp, A.fumigatus
attgtagacatatgcggggctctttgccgcttcgtggtgaagatgaaagaatccccgactctttgctgccttaaggcacaatggtggctagaatttacctcccctgctaccgatcatatcaataccggggccttggtcggcgtgagaagtcttcaggcttcgcgcatcattggtggatgcggtggacccttgggctga

SEQ ID NO: 21939 - DNA, 210 bp, A.fumigatus
cccactcctcccatcacaccggaaaatgaagcgtttgccaatgccggcaaccccaacttcgtcaaggaggggccagagactaacacatgctcgccatcaccgtcgccacccccgatgcaatacgtggactctcacgcgtacaacccagaggccgcatatgcgcatcaaccgtatgagcaacctcagatgagcttcacttcaagtttctga

SEQ ID NO: 21940 - DNA, 762 bp, A.fumigatus
agacgcacatgcgatgattccttcatggatccacatgctaatgctgtcacgtcggactttattcgtcagaaaatccgctcgatcgttcgcgacggtgacaccgccgaggttctatgcccaacttatccgtttggtgcaaggcgtcccccctgcgcagatgggtactacgagacattcaatcgatcgaatgtgaagcttgtggatatccgcgaagacgagatcgaagtctacgaccagggtatcaagactgcttccggcgcggaatatgagcttgacatgatcatcttggcactgggcttcgacacaggcacaggagccatgaacaagatcgacatccgagggagccagaacaggtcgctccgggagtcttggactcggcggctagaaacattcgcgggcgtcttggtccatggttatccaaacatgtttgtcgtctgcggtcctcacttgcccgccgggaaccagccggtcagtctcgaagctttcgccagctggatcggcaagaccatcgagcatatggagaccaacgggcttgccagcatcgacgtgtcgaacgaagctatggatgcctggacgacgcatgtcgagcaagtatggggcgggtcattcctggccaaacacgctcacgaacaaggctcttggttcgtcggcaccaacatttccccgggggacaccgcaaatcatgttctatttggcggaatggcaacctggaaccctgggttccatccaggaaccttggaaaccgggcgggtcaagttatga

SEQ ID NO: 21941 - DNA, 183 bp, A.fumigatus
ctcaactcagtcggactctccaagaacctccttcgcgctctgagcgcttcatccgccgatcttcctgagctggaagctttccccaagtcccacatagtcaccttcaagtactatgttggtgtcattcactttctagatgagaactaccgggaggtaagaagatcacgagcaaatctccgttag

SEQ ID NO: 21942 - DNA, 336 bp, A.fumigatus
ggattgactgaccatgcatgtagatgctttaacggcgcgcgtgactttggtgcgagattggttgccctcatggccggatggggaggcgaggtcttccgcgagaaacatgtctggtggatctgggggccctgggctgctgatatcaccggtggactgtttggtacgttcatttatgatctggcgatcttcaccgaggccgaaggtccgatcaattatccgcgtcgccgacgcaagagagcgctgttgatcaaggagaagaatcaaatggttaaactgcgctgtaagcggaggaaaattcgggatgtagagagagctgttcgtgaggttgagcagtag

SEQ ID NO: 21943 - DNA, 528 bp, A.fumigatus
gggcgggggaggagaaataatctagcccggtcggctataatcatacttccttccgtcgccattggtgccttgtacggccgtgcgtttggaacgatgtttaagatgtggcaaaatgcctatccaaattttttcttcttcaacagctgcgagccagatgttccttgtgtgacaccgggaatatatgcaattgtcggagcagcttcagctctcggtggcgcaacacgaatgacagtgtcaattgttgtgatcatgttcgagctcacaggtgccttgacatatgtcattcctatcatgattgcggttatgttgtccaaatggtgcggcgatatcttcggcaaacgtggcatctacgagtcttggatccatctcaaggaatatcccttccttgaccatcgtgacgacactacttcccccgatttacctgctcatagagtcatgacaagggtcgaggacctcacagtcatcgttgccaatggacatacgatcgatagcctccgcaaccttctcctggccacctcatatcgcgga

SEQ ID NO: 21944 - DNA, 228 bp, A.fumigatus
agcgagcaaagagcatggtcagcattaagtttgatccaccggcgtatgtatcccgaaatcctgttgaatcccatcactcaaagttcgctgaccatcctcaatagttctggcagatacatcttgatcaagctctggaacccccgcaacgatggtaatatcgatattcggagtatcattacatatggctttgctggtcctcgattctttcccgctggagaatttaggtaa

SEQ ID NO: 21945 - DNA, 591 bp, A.fumigatus
  unsure (9): Identity of nucleotide sequences at the above locations are unknown.
gcatccggntatgccaggcgcggggccttccagccccgtggtgaagactccatcctgcgaaagacctactacactgcaatccccaccaatccctcctcaaaacatggacgacacaggatacaccattcttcgcaccagccagagtcgttggactggttcaatgtcctcatagctcagaccatcgctcaatacaggcaaacggcatatctgttgaaggactcaccgacatcatcaatcctcaactcgctaacggcggccctgaataaccccgagaagaagccatcatttatagataaaattactgtgacggatatatctctgggggaggagtttcccatcttcagcaactgtcggatcattgctgtggatgatccaaattctgatggtggacgccttcaggcactgatggacgtcgacctgagcgatgacaacctttccatcgctgtcgagacgcagctgctcctcaattatccaaagccatgctctgccattcttcctgtggcactctccatttccgttgtccgcttttccgggaccctttgcatatcactcgtccccgcttccacacctccactccgacactccatccca

SEQ ID NO: 21946 - DNA, 411 bp, A.fumigatus
atgagcgatccgaatattgtacgactcctgaacattgtccacgccgatggccacaaactctatcttgtttttgaatttcttgacctcgatcttaagaagtacatggaagctcttcctgtcagcgagggtgggcgtggaaaggcgttgcctgaaggttctgcgttgagcaagaacatgggacttggagatgctatggtcaagaaattcatggcccagttggtggagggaattcgttattgtcacagccatcgtattctgcatcgtgatctcaagcctcaaaatctgctcattgaccgtgatggcaatctgaaattggccgactttggtctggcaagagcattcggtgtccctctgagaacctacacacacgaggtgagaccattgggccatattgactgtcattcaacgtag

SEQ ID NO: 21947 - DNA, 183 bp, A.fumigatus
aatacttatatggtgctccaggtcgtgaccctctggtaccgatccccggaaatcctgcttggtggtcgtcagtactctactggcgtcgatatgtggtcctgtggcgctattttcgccgaaatgtgcacacgcaagccattgttcgtcttcacgccacggggctggaccgaaccgcgctgcgga

SEQ ID NO: 21948 - DNA, 771 bp, A.fumigatus
  unsure (220),(742): Identity of nucleotide sequences at the above locations are unknown.
aaatattacccattggataaaaacccccccaagccccttagtggggggttatcagcccgggagaccggaacccggagagtttctgttggggaaaataacttgcggccagaggagtgcctttggttggcggaccttcgggtcggatccagatctgttatccctgagactggatatatatcgatggcactggaggcagcgaggatgatggtggagacccagngactccgcttgctgagcgtcaaggacttcaccgtccacaccccggtccctatccagaacgatgccatcggcacggaaatactggtcactgtgaatgatattttctcgcacgacggagtcatttccgctctgtttcgctgcgaggctgctgtatcagacgagttcgtcaagtgtgcaacagccaagatgatcatgcatccaggggatccagaccgtgctctcctccccacacagggccagcgggctctggcggcaggacccgtggacatcaacggcttttataacagcctgcggtgcgtggactatcactgtaccgggccatttgctggcttgacaggactccaccgagggtgcgatctcgccacggggacggttcacgtcccctcgagagatcctgacggacctattatcctccatcccgcaaccttagagctcgctattcaagcaatgattgccgcgctgggtgcgcccgacgaggggctcctgacgggagcgttactgtccaaaactgtggacaacagtnttcacctccggagatgccggaccggatag

SEQ ID NO: 21949 - DNA, 405 bp, A.fumigatus
gacacaaccatcgccggaaggtggcttaaatatgggcgcgcagctcacgattcccacgagtcccaagacaatgatgaaacaagggcagattcctcccctggagatggttcgacccgcagcgagcaacaaggggagcgtcagcagagagacggggcaaatagacctaacgaattcgcggcaaaagcagcagcatgggctgaacaattctcagatacctgggaggacatcaaaccctgggcccgtctcttgtacaaggccgccagattatatgggtcgtggtcgtcccggtcctcgccgtctggattcgattactttgccgacgatgcctcagagaacatttctttgacgacttcgattttcgtccagaattttcacttcaggggagcgggcgatccgcgcatgcat

SEQ ID NO: 21950 - DNA, 573 bp, A.fumigatus
ttacaccactgcagcggcaaaacctcactgatcatgagtctcttccgaatggtcgagctcagctcgggaagtattcatatcgatggcgtcgacatcaccaagattccccgtcaagagatccgctcacgcatcaacggcgtttctcaaagcccgctcctgatcaaaggcagcatcagacgcaacatggaccccaatggttcctacgccgagaaagccataatcgaagccataaagtctgtagggctctataccaagatccaagagaaaggcggactagacaccgacatcagcgaggtcttcctctcgcaaggccaacaacagctcttttgtctcgcgcgagctatcctccggccggggaaggtcctcgtcctagacgaagctacaagcaagtacgtcacgacctcatctcctccaccttgctcatgggatatcatattgaccatatccacaacagcgtcgacgcaaagacagacgaaatcatgcaaagagttatcagagagaaattctgcacgcacaccattctcgccgtcgcccacacactcgagacaattctacacagccgccctgaggtag

SEQ ID NO: 21951 - DNA, 606 bp, A.fumigatus
tcctcagtcagaccaagccaatgtctaattacaccactgcagcggcaaaacctcactgatcatgagtctcttccgaatggtcgagctcagctcgggaagtattcatatcgatggcgtcgacatcaccaagattccccgtcaagagatccgctcacgcatcaacggcgtttctcaaagcccgctcctgatcaaaggcagcatcagacgcaacatggaccccaatggttcctacgccgagaaagccataatcgaagccataaagtctgtagggctctataccaagatccaagagaaaggcggactagacaccgacatcagcgaggtcttcctctcgcaaggccaacaacagctcttttgtctcgcgcgagctatcctccggccggggaaggtcctcgtcctagacgaagctacaagcaagtacgtcacgacctcatctcctccaccttgctcatgggatatcatattgaccatatccacaacagcgtcgacgcaaagacagacgaaatcatgcaaagagttatcagagagaaattctgcacgcacaccattctcgccgtcgcccacacactcgagacaattctacacagccgccctgaggtagttaat

SEQ ID NO: 21952 - DNA, 666 bp, A.fumigatus
  unsure (155),(161): Identity of nucleotide sequences at the above locations are unknown.
ccggattccacgatcgccgcggcagatttcaggacagatgcccccattgggcacccaatatccatgtcccaaaatgcccagatgcaacagcgtcgtatgagtcatgtcggtagcccacatgtccagactgttcaacccgtgctcaatcatgttgntcgttnttcgttccccccgccgatggcgccgcatcttcagcctgttcagcaaagccaaccgtcgccggagctcgtcgccggtgctgccgaggagtctcccttgtatgtcaacgcgaagcaattccatcgcatcttaaaacgtcgggttgcccgacagaaattggaggaacagttgcggctcacgtcaaaaggccgtaaaccttatttacacgagtcgcgtcacaatcacgccatgcgacggccgcgcggtcccggtggaaggtttttgacggccgatgaagtggccgctatggaaaagaaacaggcggctaccgccgctggctcgggtcaagaaaatgtggactccggaaagcctgccgaagaaaacccttcgtcggcgccaaaacggaagtcaagtgaagttaacgacgacaacgcgaattcagtcaagaaatccaagactggtggagctactcgaccagccgaggagagcgaacgtgaatctgcagaaccaaccgatgaagatggttaa

SEQ ID NO: 21953 - DNA, 564 bp, A.fumigatus
gaaagagcacttgactttgagaagcgcaagagagaagtgatcacaaggctccgcgagcagagaaaggatgcgtccgctgcaaatttacctcatgtgagcagatatcttgctgccaaagccgctttgcagcccgatgtcaataacaacaatgcggggccagcgccaccgatctctgaaactgacaacccaagtcctcgtctaaacccgcatgatccgaggtcttatctcatgcgcaataaaccctcccatgacaaaaggaggcttgcctcagacccagccaaaatccgacgaattcaaacaaacaagttgcctttcgagaagatacccgacgggtgcgaattgcatgatttatgcctggtgcagtctgcagacatctccctgatttccgagaccttttgcaatctctatgaacatgatctatatatacgagagggcgataattttgcagggtttactgacgcggatctgcagtccctgagcttgtgggagagccaattgtcctcgttaatcaagcaacaattcgtctttaccacaggaggccgcaaggacccgcgctataagtat

SEQ ID NO: 21954 - DNA, 186 bp, A.fumigatus
aataactgttctctgccacgcgaagtgtataagtcagagacactccacccggacacttacgaccagaaatactacaacgccataccggctatcaagcccgatgcggtgggtgtcaggagtgaaagcgtacatacacaagaggtaagtgcttgccaccgtgagcttctcgaacttgacgtcttctaa

SEQ ID NO: 21955 - DNA, 210 bp, A.fumigatus
aggtctcctcgtattggtcaattcctgttcggaatatctgcagcacctaacttgctattagaagacgtcaagttcgagaagctcacggtggcaagcacttacctcttgtgtatgtacgctttcactcctgacacccaccgcatcgggcttgatagccggtatggcgttgtagtatttctggtcgtaagtgtccgggtggagtgtctctga

SEQ ID NO: 21956 - DNA, 270 bp, A.fumigatus
gggggcggcacacatcttgttcggaccggcggctgcgtggtgaagaccagggatgggctgtggccgcacaccaccacattcgagacggctctgggtcccttaggcaaggagagcggcgtcaaaatcctggcccttcgcacgaacaagtccgacgtttgcgttggcatcccgacccagagcaaggttgacgcattaaacgaggaggcgcctgatggtgcctggatccggaatggcaagtatgccatagtatcgtttagtgagggtcaatga

SEQ ID NO: 21957 - DNA, 450 bp, A.fumigatus
ctggatagcctggccgctcttattctggagcgtcttcagtctgtggccctcgtcggcgattataatgtcgactcccgcacccctcgcgaggccttcttggacggttctaagcttctcgtaacccactatcatgacgctataggctctgcccatagtgaagtccgtcaaacgcttcctcttatcatcaaagacgaatacaccgatgcgctcgttgcccagccattttcgaaactccttcctccagttgttgatcaatgtcactgggcaaacaatgagtgctttcttgatcactggagggctttcatggatcggattctgtttcagcagagtccagagcagcgtgatcgtttgcaaagtcttccccaaacccatgtcatcggcaagtatagcgccttctccgttgaacgatcgcattcccatgacgcactcgtaaaggaattggacgccctc

SEQ ID NO: 21958 - DNA, 567 bp, A.fumigatus
  unsure (535),(536),(537),(538),(539),(540),(541),(542),(543),(544),(545),(546),(547),(548),(549),(550),(551),(552),(553),(554),(555),(556),(557),(558),(559),(560),(561),(562),(563),(564),(565),(566),(: Identity of nucleotide sequences at the above locations are unknown.
gagggcgtccaattcctttacgagtgcgtcatgggaatgcgatcgttcaacggagaaggcgctatacttgccgatgacatgggtttggggaagactttgcaaacgatcacgctgctctggactctgctgaaacagaatccgatccatgaaagccctccagtgatcaagaaagcactcattgtttgcccagtgacattgatcaacaactggaggaaggagtttcgaaaatggctgggcaacgagcgcatcggtgtattcgtctttgatgataagaggaagcgtttgacggacttcactatgggcagagcctatagcgtcatgatagtgggttacgagaagcttagaaccgtccaagaaggcctcgcgaggggtgcgggagtcgacattataatcgccgacgagggccacagactgaagacgctccagaataagagcggccaggctatccagtcactgaacgccacaaagagaatcattctttctggcacaccaatccagaatgacctgaaggaatcttcgcggcggtggatcttcnnnnnnnnnnnnnnnnnnnnnnnnnnnnnnnnn

SEQ ID NO: 21959 - DNA, 369 bp, A.fumigatus
  unsure (366): Identity of nucleotide sequences at the above locations are unknown.
tcatacttcagcatctgtagacggaagagaccgttcccgaccacttctactcgtacatgtgtattcactgtcactatcctgcagtgtctatataagcccttctcatcgatctcatctctctccttcatctctctccatccttccatctccaacttccacctacgttcaaccttacagacagacaaacgcactacaaccactccatcaacaacaagtcccccaatgaagctcaacgctatcctcctcttctccctcattggcctcggcctcgcgactccggtcactgtcgatggaaacctcactactcctggcgacagtacgtccctccacccactcgccacgacatctcaccctgctgacccactntag

SEQ ID NO: 21960 - DNA, 498 bp, A.fumigatus
acgtgtcttcatcggctggtgaagattaatcataaagagatccgccatctctatcgggctctcgtacgttatggagacatcaatgagcggacagaagatttcttgcgggaagcccgtcttatggatagggacagggaaactattgttgccgttctgcgggagatgtctgatatggctgcccagctcatccgagaagacgatgctaagatggaggcactggaaaaggctggcaagatggtaacgaagaaggagaggaaggccgtcttgttcgatttcaaaggcgctaaccgtttgaatgcccaccacatcgtggaccgtcccagagacttgcgcattctgaggcaggtcacctcatccgttgctgatgtcaagagctttcgcattccggaagcaaccaaggccgcggattattcatgctcgtggggggcgcgggaagacggcatgttgtgtgtcggtgtcgcccgccatggatggggtgcctggacccagatccgagat

SEQ ID NO: 21961 - DNA, 387 bp, A.fumigatus
  unsure (196): Identity of nucleotide sequences at the above locations are unknown.
aaccaattcatgttcgtccccggagtggaaaggatgggggaaaaaccaagtcccatcccgggaattcccagcgctattttagggagccggcttcagatccaacgaatttgctctccacagagacccactgagcttcagagcgaaacagtcaacaaaatgcctgccattgctgaagggaattcaacaacagtcaaanaggtcccctttaacaagtatggggtacccgctcttcaacgcaaagaccaccttgagtatctttacgactcactggaggactatccagcctcctttgtcgcgctcgatgctagtcgcccttggatggtttactgggccttggcagggctatgccttctaggagaagatgtgactcgatttcgcgaacggtaa

SEQ ID NO: 21962 - DNA, 375 bp, A.fumigatus
gatgcgacagcgacttcgaaggtgccacaggttgacgaagttgcagaggatttgagcaagaccacacttgaaaacgacaacacggctgctgaagaaccagcccaatctacagaagacgtagaaattcctgagaccgcgcaagccgacgacgctgaaaccggaggcgaggacgatgatggttctgattctgatggtggctggattacgccctccaatttgaagaagcgacaggccctcgatgagtcgatctctgcgtctgcagcacccgagccaaaggttatgcaggtcgctaccatgaccaccgactttgcggtaagttcggacaaggtgttaccaaggtggttttacattctacaccgccggcatggaaaataa

SEQ ID NO: 21963 - DNA, 198 bp, A.fumigatus
ctcttttgtctactctttttctctctctcatacgacacacttcacaatgtcatcaccaccacctcacccaacgccgacaaatcctctcaaacgaccctccctctcctcctcggcctcacaacctctcggctccaacccgaaacgtccacgcatgcaccccctccggcagacgtccttcccagccagtatagacaatga

SEQ ID NO: 21964 - DNA, 282 bp, A.fumigatus
cagcgggccctccgcgttgcagacgcctgcatggacaccgccgtctccgttgagctattcgtcgagatcctcaaccgctacgtctactacttcgaccagcagaacgaaaccgtcacaaccaagtacctcaacggcctcatcgagctcatccactccaacctgcaaaccaacgaggacgagccgaatcccagcctcgagggtccaaagcgtcacttccagcgtacgctggagtatatccgctccagagaatacgagggcgttgtcaccgatccgagacagtga

SEQ ID NO: 21965 - DNA, 408 bp, A.fumigatus
agcgggccctccgcgttgcagacgcctgcatggacaccgccgtctccgttgagctattcgtcgagatcctcaaccgctacgtctactacttcgaccagcagaacgaaaccgtcacaaccaagtacctcaacggcctcatcgagctcatccactccaacctgcaaaccaacgaggacgagccgaatcccagcctcgagggtccaaagcgtcacttccagcgtacgctggagtatatccgctccagagaatacgagggcgttgtcaccgatccgagacagtgaattgtccaggcgcttttgtgatctatcgggactggaaatgattatatcatgtaagaaacgtgaaagcgtggctaccttgtttttctttcctcctgtatctgtttcgccgtttcctggcagcttttga

SEQ ID NO: 21966 - DNA, 378 bp, A.fumigatus
ccatggtgcccggactttgctccgctattgacaacgataggtgtggccggccatatcacgctgcgcgaccccgtcgagccggacactttctgggtcaatccattcggcgtggcattctcgcaaatcaaggcgtctgatttgattcgcgtcaatcacgaaggaaaagtcatcgacggaggcgaggttcgcttgctcaacgccgcggcgtacatgattcattcggcgatccacgctgctaggcctgacgtcgtgtgtgcggcgcacagccatagcctccacggccgagccttctgcacgctgggacgaccgctggatattattactcaggattcgtgcgcgttctacaatgtacgctcgtcttcaagggcttatgtataa

SEQ ID NO: 21967 - DNA, 447 bp, A.fumigatus
actaattcttcccatacaaaaagaaatgcaaggcagcaacaatccctcccttcccggtatcgtgatagacccgtcgtcacctcaatcccccactgtctcctgtgcattctcaccatcaacacccacgagctccatgtcgagcagatcaacaccacagtcatcacagccagcatcacaagcggaatcaaaaccagcaaaacgaccccggaaggtccacccatccttccagcccgtcctccgccatctacgcagtcctctctgccccctcgtctccagcaccacggggcagcaacatcccgacttccccaagaccctcctcgcctaccacctactcacctctcggcaactggacgatctagcccgtcacttccaccaagtgtggccgccagtggaggccacaagggcatatcccgtctcgatccccccgtggatcggcacacagggtga

SEQ ID NO: 21968 - DNA, 492 bp, A.fumigatus
ttttccagccgcctggtcaataagggtttcggtcaattcgcggcggccatcgtcgctctgattgttactgccggcttcaaggaatctctggagactgctagctccgtgggcaagtgctccggtgtctgccagctcgctgtcgacaagatgtggcgtgtggttatcggtttcggtgccgttcctgcctgcattgccctctactaccgtctcaccatccctgaaactccccgctacactttcgacgttgcccatgacattgtcaaggccgacgaggatgttcgtgcctatatgaccggcaagcacgagggtcaccccgacgagatacgccgccagtccgtcctccagaagcacgctggtgacgtgaccccgaaggccagctgggctgatttctggcgccactacttgcagtggaagaatggaagtatcctccttggcactgctggttcttggttcttcctcgacgttggtaagtctcgttgcctgcccacctaa

SEQ ID NO: 21969 - DNA, 588 bp, A.fumigatus
  unsure (587): Identity of nucleotide sequences at the above locations are unknown.
tggtttcgttgtgtaggcgactacgtggatcgcggtctgttcagcgtcgagacgatatcccttctcgtttgcctgaagctacgatacccccaacgcgttcatctcattcgtggtaaccacgaatcgcgcggtgtcacccagtcctacggtttctacacggagtgcgcgcggaaatacggcaacgccaacgtgtggcactacttcaccgacatgtttgactttctcaccctgagtgtagtcatcaacgatcagatcttctgcgtgcacggtggcctttccccctcaatccactcgatagaccagatcaagattatcgatcgatttcgggagattcctcacgagggtcccatggccgatctggtctggtccgaccccgataccgaacgcgacgagttctcgctatcacccagaggagccggttacacattcggtgcgcaggtcgttcgaaaattcctcgaggtgaatagcatgtcgcatattttgcgagcgcatcagctgtgccaggaagggtatcaggttctctatgacgaccgtctgagtacggtgtggagtgctcgtaactactgctcccgattcgggaactgctng

SEQ ID NO: 21970 - DNA, 822 bp, A.fumigatus
  unsure (776),(786): Identity of nucleotide sequences at the above locations are unknown.
aaaaggaactttcgcagtttggtgtggggaacagtccccgggtggatattccacccgctcacgggggggcccatcggatatggggggtatgactgtgttcgatactttgagcccaagacggctcggccactcagggacgtgctggggatccccgagtcgctttttatgatgttcaagaccattgtcgccttcgaccatttttttcaggtcatcaaggttgtaacatacattcctatttcgggccccgattcggaacttgaagcggaataccgtaatggccaagaggcgctccagcagaccattgacttgttgctgaggccagaatgtcccttcccctttcagggcccgatcattccgaaccaagaatacacatccaacattggtagggaaggatatgagcggcatgtgaccaggctgaaggaacatatctccaagggagacatcttccagaccgtgccgtcgcagcgcctgtcacgtcccacttccttgcatcctttcaaccttttccgtcatttgcgcaccgtcaatccgtccccttaccttttctatatcgactgcgaagagttccagcttgtcggagcgagtccggaactcctcgtgaaggaggagaaaggcaggatcatcacccaccccattgcgggaacggtaaagcgcggcaagtctcccgaggaggacgacgctttggccgccgagttgaggggcagtctgaaggaccgcgcggagcacgtcatgctggttgatttggcgcgcaacgacgtcaaccgggtctgtgatcntaatccgacncgaccggggaaggaaggtaacgcgtccccccccccc

SEQ ID NO: 21971 - DNA, 249 bp, A.fumigatus
  unsure (180),(249): Identity of nucleotide sequences at the above locations are unknown.
cgaataacccactggccggacaaacttccggaagtggcaaccttgccagcattttcgcagctggccggaagcccccgggatggcacgaacaaggtttatttccagatagttcgctatctgcgtgagatggggtacttttcacaggatcttaagaccgccttcgtgtccaacaaccgggtntccaacctcctccgcaaagaccactgggcgacctggatcaactgggttgactttttcccgcgcgaatan

SEQ ID NO: 21972 - DNA, 615 bp, A.fumigatus
  unsure (69): Identity of nucleotide sequences at the above locations are unknown.
tatgacctcctctcgcgtctgccagaccagttgcgaagcgatcagccaaagactgccacagagcttttntacaacaccgacaagcccatttaccagtatctggccgaaactggcagagctgccggcttccacaaagtcaccggtacgggtagtgtcgtcgaggcccctgggctgctggccgactacccatgggaggaagtcaagtcggagactgtggtcgacgtcggcgccggagtaggagactttatccggtcttacctggagaagttccccgatgccacggccgctgccttcgagctgccgtcgaccgcggagatcctcaagcagcggttccccgacgatgaccctctgaccagccgaatcgtctcgatcaccggaggggacttcttccaggacccaattccagaatcatctgtctacctcctccgatggatcttgcataactggggcgacgaggattgtatcaagctgcttcgtcgaatccgggagaccatggtcatcaagccgggagtaagccgtgttttgattattgagtcggtcttgtttgacgggcgtctgggacccgggccccggtattttcaccacgccgtgccaggatccacgctaagggacgcc

SEQ ID NO: 21973 - DNA, 522 bp, A.fumigatus
  unsure (11),(108): Identity of nucleotide sequences at the above locations are unknown.
tggagatcaantagtctaaccagttctcctccctctccaggtaatggtagcaccgtcgaatccgtccgacactgcctgtacaccatccgccgcttcctcgccccgcantatgccgtgatccccgtgaccgccgacatgctcatcaaggagccatggacgctaacttgcgccttgctggtgatacccggaggagctgatctggggtactgtcgatctctcaatggcacgggcaaccgccgcatcgagcagtttgtcaagcgcggtggcgcatacctcggtttctgcgcggggggctactacggctccaagcgatgcgagttcgaggtcggcgataagacgatggaggtggtcggggatcgggaactggcgttttttcccgggatatgtcgcggcggtgcgtttccggggtttgtgtaccacagcgaggtgggcgcgcgcgcggccgacctcaaggtctccaaggacgtactgcaagacggtggtcttcaccagacggctggaagatcatacgtccgggaggga

SEQ ID NO: 21974 - DNA, 324 bp, A.fumigatus
ccttcgcgaaaggagttcacacgggccgtcgagcagaagcagatcgcacagcaggacgccgagcgtgcccggttcatcgttgagagagccgagcaggaacgtcaggcgaacgttatccgtgcggaaggtgaagcagagagtgccgagatcatcagcaaggccgtcgcgaaggccggtagtggtcttattgagattcgtcggatcgatgccacaaaggagattgctcagacgctggccaataatcctaatgtcacgtacttgcctggcaatgaaggcaaggacggtggaaagagcacaagtctgctgctgggtctgagaaattaa

SEQ ID NO: 21975 - DNA, 261 bp, A.fumigatus
tgtacacttgattttagccctggcgactttgtcttacatttgactattcgatttaaaaggctggagaggcgttctgtccttattgataccatacttgccatgatgccgcaaattaagttttgcgctagccctgtcatttctctactgtggctctccaaattcaagtccaccgtccaatcctactaccatctaatacatagcaccctactcctaaatacctattaccaggtccaaggttaccggagccaagtcagtaaatga

SEQ ID NO: 21976 - DNA, 372 bp, A.fumigatus
  unsure (342): Identity of nucleotide sequences at the above locations are unknown.
ccgtcaacagctggggcctccaacggccccaaccgggctagccactccatgggcaccacgggtcaacctgcaatcatctacctcccggccgggacgtatctgatagaaggaagtcttcaactctacgttggtactgtgattgtgggcaacgcgctcaatccgcctactctcaaagccagcgcaaactttcccaacgatcatatcgtctacgggaaagaaccccagctgggcgggacgatcaacttctacattggcttcaaaaacgtgattatcgattctacgagcgttgctgcgttcaaatcaatcacattgctaaaatggactgtctcgcaggccacgcanctgacgaacgttctttttcacatgcccgac

SEQ ID NO: 21977 - DNA, 453 bp, A.fumigatus
caagggtatagaactattacttttccaattcaaaacaaaactgcccgtccctgggacccggtcactcaaggctctacgggaaacctgacaagccatgatcgccagaaacgagcaagctgtgggggcccgactccggacaatcccaacaagttctggctggagacgattactcacagtggagagtcgtcgttcctggactcgacctacaagcacaactacaaggtctttcggaatgtggtgaccgactttggagcggacaacaccggggcgaaggatgcttctgctgccattcagaatgccatcaacggtatgcccttcggcccgggctgcctatataggcgaagtgctaaccgtcaacagctggggcctccaacggccccaaccgggctagccactccatgggcaccacgggtcaacctgcaatcatctacctcccggccgggacgtatctga

SEQ ID NO: 21978 - DNA, 339 bp, A.fumigatus
cgaaacagcaaaatgcgtctcagttctcatcttcttattggagtagccctgcaggatacctctgggcgtgccaccgttctggtaccactgacctataaggaccaccacggcactcctcacgcgatacataacggaactacatatactctttcagcaaacgatacttctccatccatcatcattctggactatggacggaacgttgaaggatatgggacatttcatgtctcccggagatcgggtaatacttccgtgttcgagatgagctacagcgagacagaagccttgttggacatgcacatcgtaaggttttcacacacgccggtcgaggaccatcct

SEQ ID NO: 21979 - DNA, 429 bp, A.fumigatus
tctaccgccgctcaatgtcgtggtcttgcagagaagactctgaacaaggaggctgcatgcacccttgcgccttgttccttcaacggcgtccaccagccttcacttgagaagacatttgccagggaagacgtatatattttttcttacttctacgaccgcaccaagcctctgggcatgcctgactctttcactttggatgaattgcatcagcttacgtcgaccgtttgtggtggcgaagatagctggggcatctttgcaggcatcgaaggtgccctgaaagagcttcgtgatcggcccgagtggtgcctggatttgaacttcatgatgagtctgctgcacactggctatgaaatgcccctcagtcgcgaggtgaaaattgccaagaagatcaagaacagagaacttggatggtgtctcggtgcaaggtaa

SEQ ID NO: 21980 - DNA, 279 bp, A.fumigatus
attttcacgacagtccgccaattgaacccgccagcgcacctacgtcttcaccaccgtcgtcaacctaataactcctacccaaccgtaaaaatggagaacgagaagggagagatcgttgatctgtacgtgaatactcattccttcgctgttttgcgcttgaagtggttttatggtggtcctggagccgagaatgacttcgcgatttgggacaatgcacaagaggacaagagacaagctggggcgagcttcagccttcatcatgggagtgttgcagaatag

SEQ ID NO: 21981 - DNA, 231 bp, A.fumigatus
gcacgtcttctccttactcttattcgtctgtttcgaccaagagcggtagcggtgcgcttgcacgattggcgcaaagacataggcccgatcgaaatagagctgatccctatgcgacgcagtattaacatggctggtctcgaaatccgctcccggtgcgaaacctacaagtcattgtgcatcatgggggtgatctggagttccgagccgatggaaaccggggtcagattctga

SEQ ID NO: 21982 - DNA, 186 bp, A.fumigatus
  unsure (159): Identity of nucleotide sequences at the above locations are unknown.
aggttgcgaatacgaaaactgactcgtttcccagttctcgatgacaacacgtatacaaacaagacgtgggctgaggtttctggtatcccagtcccagaattccacgtgatgggaagtcaaatttctcagcaaatgtgcggtacaatctctatgcatcanaaggaagattgggctctatgggcatac

SEQ ID NO: 21983 - DNA, 564 bp, A.fumigatus
  unsure (24),(33),(38),(41): Identity of nucleotide sequences at the above locations are unknown.
cgcgccccccccaggatggagctncttttcacncccgnggngaagacgaatactatccaccgacggcctgaccagctcaggcttctgtccattcaggaagatcgcctccgcgtgttgagccgcaaacgccttgcccgccgacgaggtccccgcctgcaagaggaacggcgtgcgctgcggactcggctcgcagagatgcggaccaggcacattgaaatacttgccccggtgatggacctgcctcacggccttggggtcggcgtatcccgccacgccatccttgcggttgacggcgccgtcccgccacgagccctcccacagcttgtacgtgacgtgcagatactcgtccgcaatacgataccgctcatcatgttccacctgcgtgttgagaccaaagttccgcgccgcggaatccaggtacgaagtgacgatgttccatcccacgcgtccgttgctgagatggtcgaccgtcgagaaccgccgcgccagggcatagggcgcgtcataggttgtcgacgccgtgatgccgaagccgatgctctccctcggggccgccatcgccga

SEQ ID NO: 21984 - DNA, 564 bp, A.fumigatus
  unsure (524),(527),(532),(541): Identity of nucleotide sequences at the above locations are unknown.
tcggcgatggcggccccgagggagagcatcggcttcggcatcacggcgtcgacaacctatgacgcgccctatgccctggcgcggcggttctcgacggtcgaccatctcagcaacggacgcgtgggatggaacatcgtcacttcgtacctggattccgcggcgcggaactttggtctcaacacgcaggtggaacatgatgagcggtatcgtattgcggacgagtatctgcacgtcacgtacaagctgtgggagggctcgtggcgggacggcgccgtcaaccgcaaggatggcgtggcgggatacgccgaccccaaggccgtgaggcaggtccatcaccggggcaagtatttcaatgtgcctggtccgcatctctgcgagccgagtccgcagcgcacgccgttcctcttgcaggcggggacctcgtcggcgggcaaggcgtttgcggctcaacacgcggaggcgatcttcctgaatggacagaagcctgagctggtcaggccgtcggtggatagtattcgtcttcnccncgggngtgaaaagnagctccatcctggggggggcgcg

SEQ ID NO: 21985 - DNA, 354 bp, A.fumigatus
agctgtgcagaagttcaacgaagatattcaggcggccttgaggcgggctcttttggtgaccccaactgcagcagttggtacaagaccgaggatggacgcatcaccgataactggcatagtacggttgttgactaccagaacgagctgtccagcatccggtgggatgactatatcgccgaaggaaccggcgagtctctgattgcaaagaagaaggaaatgcacattggacgggtgagagaggagacgtggatcagcaacacctcgcttctctggggtgtggccagtgtggctgtggcattgggaggatactatctcaaggggagtgctttgatcagaggaaatcgagtgagatga

SEQ ID NO: 21986 - DNA, 516 bp, A.fumigatus
  unsure (8): Identity of nucleotide sequences at the above locations are unknown.
tcacttcngggtttgataacattttgcgcggcattttgggctcttgtggtgaagacccacaggagccctgaggctcagcacctcggtctgtccgtcaagatgttgactggtgatgcccttgccatcgccaaggaaacctgcaagatgcttgccctgagcaccaaggtgtacgactccgagcgtctgatccacggtggtcttgccggctctgcccagcacgacctcgttgagaaggctgatggtttcgctgaggtcttccccgagcacaagtatcaggtcgtcgagatgttgcagcagcgtggccacttgactgccgtgactggtgacggtgtcgacgacgctccctctctgaagaaagctgactgtggtatggccgtcgatggttccactgaggctgcccaggccgctgctgatatcgtcttccttgcccctggtctcagcaccatcggcgatgccatccagcttgcccgtcagatcttccagcgtatgaaggcctacattcagtaccgtattgcc

SEQ ID NO: 21987 - DNA, 342 bp, A.fumigatus
gaccaggggcaaggaagacgatatcagcagcggcctgggcagcctcagtggaaccatcgacggccataccacagtcagctttcttcagagagggagcgtcgtcgacaccgtcaccagtcacggcagtcaagtggccacgctgctgcaacatctcgacgacctgatacttgtgctcggggaagacctcagcgaaaccatcagccttctcaacgaggtcgtgctgggcagagccggcaagaccaccgtggatcagacgctcggagtcgtacaccttggtgctcagggcaagcatcttgcaggtttccttggcgatggcaagggcatcaccagtcaacatcttga

SEQ ID NO: 21988 - DNA, 507 bp, A.fumigatus
  unsure (5),(10): Identity of nucleotide sequences at the above locations are unknown.
ttacnggggntaacctttgcgcggattttcgctcctgtggtgaaaaggtataggggtcttcccgaaaatttcgtggagaggtatgaacctcctgcccccccgcggccgacgcgccctagcagaccaaagaaagaagccaatgctgccactccatccgaacctgctgctgcggaaactcatgtagaacgccttccctctccgggaccagcaccggagagcgccccttcgctcgaacaggaacctgtcctcgaaccgcccagatcacctccgattgctgtgcaagcgccggcatttgaggcgtcttccccgccacagccagtcgaagctcaagctccaattccggcggccccgcccaccgctccctcggagtcaagtgagccgaaagagctagccaccaaatcggcatctaaaccagcacctcccccggtcgcacagaaacctagtgggtcatcatttaaggaccggatcgcggctttcaacaaacctgctgcgccgcctatcgcgcct

SEQ ID NO: 21989 - DNA, 189 bp, A.fumigatus
ttcccccaattcgcgctcgcggtggctcctgcccatggtgaaaacttgtgccacgtgaccattctgtttgatttggtctttgttgtgcagcactatatcctctacagagactccatggaaggcaagatcgatcgccatccagacctcgtcacccccctattgtcggacccaagaggtgctagcgcttga

SEQ ID NO: 21990 - DNA, 390 bp, A.fumigatus
tttaaaagcattccggccgaccagctggcccctggtatcgataacgcgcagaaattcacctcagtctgtatcaacaccgccgtctacctcccttggcttgttgggcaatgccgaaagaacggggtggtattcaaaagagccgtcttcaagcacgttacggaagctgcaagcgcccaccactccggcaagaaggccgacgtggtggtgaattgcactggtctctcgtctaaaaagctgggcggagtatgtgatgagaagctatatccggctcgcggccagatcgtcgtggtccgcaacgatcccggagccatgttttccatctctggatgcgatgatggtgcccacgagctgtcttcaccaagggccgagatccgcgatggttaccacgga

SEQ ID NO: 21991 - DNA, 324 bp, A.fumigatus
gtaaacgaaatcctcatttattttcttcatctaggatcaaccgcatctgacaaacagttgaacagtatcatcctaattcccggtattggcatgctccctgtccgagaatggtcgattctgttgcggcagtggacggcttttttcgactcgacggaatcccgcgtcaatttcttcacctacgactatcagattacgctcgacaacactttctcgtttcgagccctattagacaaagggcatgacttgctggctgctctcaatcaacaccagcagaatgtgcgtgtcttctccaacgcagaatgcctccgatggcaacgaggctaa

SEQ ID NO: 21992 - DNA, 642 bp, A.fumigatus
gccgcaaacctcaaacaggaaactgatcacggcaaggctggttttctggatactcgcatggtcgacttctctcgtccctcagtaacttctcagagaaaccgactggtcgcaagcgagattcatcaagttgcacccgccgtacctccagaagacagccaaccaggaaggacagataacgccgtaccaggttccagtcaaaatcccctcctgtttctcaaaaacccccgatatggactgccacctgctctggtggccaatcttgctgcgcttggggttaccagcatctacccgtggcaggcgtcatgtttgcttgctcgggggctcctcgaaggagagaggcatcttgtctatacagcacccacaggaggtggcaagtccctcgtggccgatgtcttgatgctgaagcgcatcattgaacatccgtctcgcaaggccatccttgtccttccgtatgtggcacttgttcaggaaaagctgaagtggctgagacgcattgtggaaaacgttgaaaagaatgtcgctgacgatgatgacgaagcggctcggttgaagccatattaccagcgttggaaaaagctacagaaatctattaggggtcacggatactttggtgggaataagaccgctgcctctgggggctga

SEQ ID NO: 21993 - DNA, 429 bp, A.fumigatus
gccgaaacttgcgcgggagaggaaatggtacaagttccagataacgagaccagagccttgagaatgaaacttttggctgcttctttctttgctctctgggctgtgggagatgctgcaccgagcagtgtttccaatcccagagtccgagtccgaaatggtacctacgttggcatgagaaatgtgaattaccaacaagatttctttttaggcatgccgtatgcccagcagcccgtgggaaatctgcgattcagagtccctcaatctttgaatgatagctgggatggggagcgcgatgcaaagaaatactcggatatctgtgttgggtatggcgtaagtcaacacctccctctttggcagacctcaggcgagctgactgagagtagtcggactctatttggtatccgatgtctgaagcttgtctcaccataa

SEQ ID NO: 21994 - DNA, 246 bp, A.fumigatus
tcggactctatttggtatccgatgtctgaagcttgtctcaccataaacgtcatccgcggttcgtcggttgatgagaactcgaaactgcctgttggcgtgtggatacatgggggtggattctacatgggctcaggctctgaccagcgctataatatgtctgctatcgttgccaactcgtacgaaattggtaggccatacttccaggccacaaaaaggcctcctatcacatgcccactatttcatgca

SEQ ID NO: 21995 - DNA, 258 bp, A.fumigatus
gtctgtggtgctagcggaaccggtatgtttcaaagttcgtctacctggccactgttccccatactgacctggtatttcctttgcacaggacgtacaacctttgtcaacaccctttgcggaaagaaagtccttgagagcaaggatgccgacgatgctgccagcgctcacattgaggagggtgttcgtatcaagcctgtcacagtcggtaagttaccatcagtgcttaggtacccagaagaaacagcactgatttcataa

SEQ ID NO: 21996 - DNA, 183 bp, A.fumigatus
ctgttcttcagctttggtgaaatcgtcggatacctcgaacgccaatatgacgatattcttgctgaagaatcgcgaatcaagcgtaaccctcgcttcagggacaaccgtgtccatgtcctcctctactttatcacacccacagttttcaccacggggcccgaaggaccgcgcaagcgtatataa

SEQ ID NO: 21997 - DNA, 192 bp, A.fumigatus
cgtcgtcatcttcaaatccagctgacacggctgccaggcaccaaccccaaggactggaaactgcctagctggcttccagcgagcaacaacaccaatacaggcgatgatatcgccggcacagttgaagccgttggcgacaatgtcttcggcttctccaagggtgaccgggtcgctgcattccacgtcatgatg

SEQ ID NO: 21998 - DNA, 699 bp, A.fumigatus
acgattacttcctcccgtcgtttagaatctgtctcgcccaggaggatcctcatgggtattgcttccagatatgccgctatctcatttccattggtgattcttgccgtatactcaatccagaaggtataccttcgaacttcacggcagctgcgattcttagaccttgaagccaaggcacctttatactctcatttcagcgactgcctcaacggcctggtgactttgagagctttcggttggcagccagcgctggaggacaagaattttcagctgcttgactattcgcaaagaccattctatctcttgtacgctatacagcgttggctgaccctgacgctggacatggtcgtggcggcaattgctgtcatactgattgttctcgtggtaacattgagggggacgatcagcgcacgtgacgttggcgtggcattgttgaacgtgatattgttcagccaaagcatcaaactgcttgtgaccttctggacaaaccttgagaaccatattggctccatcgtgcgaatccgctctttcacagagaccgtcagctcagagaacctgccaactgagaaagacgacgtgcctcccaactggccttggggaagggacatccaattccaatcagtatttgcagagttacgggtagcagattgccttcgagcctttaatacccacttaacccttattaaagaccttccgtag

SEQ ID NO: 21999 - DNA, 333 bp, A.fumigatus
gcaatggccaccataacccaagttcagacacaggagacacacacggtcttgccgaagagccttacggtagtgccaggccagatcaccgtcaaggagatctcgaatctcgacctgccagatatcccccttccaccaccatccacgaacccatctgagatcctcgctcaagacaagggcacaccagacaatcatgttcctcgagaccctcggctcatcagattaacgggcgtccacccattcaatgtcgagcctccactgacagctttgttcaacgaaggtatcgtcttcaccacaaaggggaaggaacgagccgcgcaagcgaatccacgcccc

SEQ ID NO: 22000 - DNA, 651 bp, A.fumigatus
gtcgtgctttaccctgattgcactcaccgccgcaagtcgtccttggtttcagtagatgactcaagatcaagaccacaccttgacaatacagacgagaggacggcatgttttgtacactccttgatcatgggtgaatggatatcaccgccatccaaagacatccgaccagacgcgaagccgagcaaagcgcacggaacaaccccgcagaccaccgtcgtcgacgacgacgcgattaaaccgtccgaggcgaaggaccgaaaggctctcaagacaacccctacagtggtgcaatcgcggcacctgaccaagaagcagctgtcggatatggcatggaatgtgcgcaagctgtcaaagaagctagggagcatcaagctcaagcttacggtgaagagcgtattgttggtgacaaaggtacgcgacgaatctcttgtcgtacttacacggaaagttacccagtggctgctctccaaggatcgctcgacaaaatatgtcgtctacgtggagaagcggctggagacgcaccggaatttggagcgactcagctccttcaagaagaacctacagccgaaggcggctcaagtactgggatgcaaacatggcatcaaaagaagccaatctaatcgacttcgttcttacctaagaaggggatga

SEQ ID NO: 22001 - DNA, 234 bp, A.fumigatus
tggggcgtatgcgggctctttcgacaacctgggcgtgaagagggcataacgaggaatatctatctaatctctgtatgtagctgctccacaactagcttggcgggtacgtggataaaacatagtcacggattaaaagaccaaaaacaaaagccaactaactccattaacaatttcttcggagcaatgagtgtccaatgggtcctagtaccgtccttgaaccttcaaggtatctag

SEQ ID NO: 22002 - DNA, 216 bp, A.fumigatus
ccatatcgcactctagccaagagagtctttaagatcaagaacttctccgatgtcgacgccactctcttcgagcctgcttcctgcgccgcccacggtctggacaagattgctcccaagatgggctcttccgttctgctgttcggtgctggccccactggtctggtatgtggtttcaggtctggtagttgtgacatcacgggaactgactatgtgtag

SEQ ID NO: 22003 - DNA, 354 bp, A.fumigatus
atccttgctcagatgctccgtctgaacggtggatgcaaggttactgttgttgctcctgagggtctcaagatggacctggccaagaacctcggtgccggtgacgaatacgtcgacttgtcccgcaaggacccctccgctcagttcgagaagctcaagtcggacaacccgtatggctttgacatcgtcgtcgaagccactggtaacctcaacatcctcaacgactccatcaactatgtccgtcgcggcggtaagctcgtcgtgtacggtgtgtacgccaacaaggaccgtgtctcatggccccctgccaagatctgtgagttcttcttccccttgcttctgctgagtgcttgctaa

SEQ ID NO: 22004 - DNA, 267 bp, A.fumigatus
  unsure (4),(10),(11),(22): Identity of nucleotide sequences at the above locations are unknown.
gggngttttnnattgatggccnttcgaacccccggtgaagacattatgcagcgagacaagaagttgtatggagaggacgcggaggagttcaagcccgagcgttggctcgatgccgaacgggccaagcggtacaacaagtatagcttcacatttgggtacggagcgcgagtgtgtctggggagggatattgccatgatggagctgtacaaagggccattgcaggtgggtacttgtattccccgtttcactgttggacaccaatgctga

SEQ ID NO: 22005 - DNA, 249 bp, A.fumigatus
atttcatcctcaccagtcctcatcaccatcatgaagttcacttctgtcctcgcctccggcttgcttgccacggctgccatcgctgctcccctcccagaacaacgtctagcccggcatgcccgtcctctggcccgcaccgcctacagatcgagccaccctccctacaagcccggcacttccgatgttttcaaactcatcaacaccacccaaggtcgagttaagctccaactgggctgggtgccgtcctca

SEQ ID NO: 22006 - DNA, 636 bp, A.fumigatus
  unsure (1),(5): Identity of nucleotide sequences at the above locations are unknown.
nactntgagctgaaattcagagtgcagaaggatggagaggaagaatacatcgtccgcagccatagcaactaccttatcaaccgatcagtgagcgccgaagtcaatctcgaccctggtcgatatcatgtactcgtgaaagtcactgcctacagaagagacaacgtggagtccacagaagaggtcgtgagccgcctggcaccaattaagcgggagaagctcgttcagattggcctctcgtatgatctcgcgcacgccaagggtctggtcgtagagaccgagcaggagaagcaagcacgggaggaacgtgagctgcgtcgcagaaaacttgagagacgaaagctgcgcgaagaaaccaagaggaggcttcaaaaggagtggattcgcgaacgcaagatggctgcacggaaagagcgggccgcagcgagacgtgtcgcaatgagcaacggcagcctcaaccacaagcagcctgacaagcaggccgctgagcagatctttcccgatggtcctgtgcaatctcccgcagatttggcaggcgcctctaccaatggtttcgatacgatgcctgtgcccaacagcagcgtccccacggtcttcacccggggtggaagggcatgctattcgatgcaacccggcagc

SEQ ID NO: 22007 - DNA, 432 bp, A.fumigatus
cagacacccgaagcactgcctggattctggatcttcatgtaccgcgtctcgccgttcacttactgggtgggcggaatggccgccacgcagctgcacggccgtgcagtgaagtgcagcgcagccgaaacagccatcttcaaccctccatcggggctgacatgccaggaatacatggcagactacatggccgtggcaccggggcacctcagcaatcccaacgcaacgtcttcatgcgaattctgctccctctctgtcgcagaccagtacctggcgagcgtcaacatctactggagcgagcggtggcgcaacttcgggatcttctgggcgtacgtcgtattcgacatcgccgtggccgtgatgctctactactgtttccgggtgaagaagtggaacttttcattcggcaagcgcaagaagagcaaggctgcttaa

SEQ ID NO: 22008 - DNA, 384 bp, A.fumigatus
agatttgtctgctcgctctgctctcgtcgtttctgccgtcaggagcacctgaagcgtcattaccgctcgcttcacactcaggacaagccgtttgagtgccatgagtgcggtaagaagttctctcgcagcgacaaccttgctcagcatgccaggactcacggtggtggttccattgtgatgggtgttatcgacacaaacagctcgaacactcaacccgcgttcgatgagcctgagccgcgggctttgggcctcgctctgtacgaagccgccaacgccgcaacgagcaagtcgacgacgagcgagtcatccgatggaactatttcagacacgtcgtccgtcggtgggcggcctgccaagaagcgccgacgggacgaccacgtctga

SEQ ID NO: 22009 - DNA, 471 bp, A.fumigatus
  unsure (13): Identity of nucleotide sequences at the above locations are unknown.
cggcctaacctancgcggtcctcgcccctcgtggggcgtactcacgattgtcacatgcaaagatttggcgccctcaacaatgccatcatcgacctggtggaagaattcgggctcgtggcatttgagacactggccgtggaagacaagaagagcatgatgaatttgttgcgagttattgatagggcaagtgggtatgcattcgggcccgctgagggtgcaaatgataccatctggcaggttgctgtccgggaaggactagggaccatggatatccgagacgtccaggaacgatggctcgacgcgaaggacgaatacgacgcgcaagaacgcagtgagctcgaggccgaggcgaaagccagggaacaggctgcacagccgccgccgagagaggacgatgaactcgatgccgacttggcgaacttcaggggctcgctccccgacagcggcgtaaaagtgatacggaagtcatga

SEQ ID NO: 22010 - DNA, 249 bp, A.fumigatus
tcctcctcatcatcacttcccatatccagatcatcctcatccatcacctctcgcacagaggcagcggcaaatctgcccacagccgcggcctccctgtcctccaaccccccaaccaacccttccaaaacccccatctcatccgcccccttcagccgcgatatttccctgcgcgccccccgaatcgcctcctcctcaacctccttcatcgtcccagacaccttcctttacccgaaccacccccaatcgctt

SEQ ID NO: 22011 - DNA, 438 bp, A.fumigatus
accatgaaggactcaaatcatgacttccgtatcacttttacgccgctgtcggggagcgagcccctgaagttcgccaagtcggcatcgagttcatcgtcctctctcggcggcggctgtgcagcctgttccctggctttcgcctcggcctcgagctcactgcgttcttgcgcgtcgtattcgtccttcgcgtcgagccatcgttcctggacgtctcggatatccatggtccctagtccttcccggacagcaacctgccagatggtatcatttgcaccctcagcgggcccgaatgcatacccacttgccctatcaataactcgcaacaaattcatcatgctcttcttgtcttccacggccagtgtctcaaatgccacgagcccgaattcttccaccaggtcgatgatggcattgttgagggcgccaaatctttgcatgtga

SEQ ID NO: 22012 - DNA, 285 bp, A.fumigatus
  unsure (11): Identity of nucleotide sequences at the above locations are unknown.
tcgacttgcantatagaacggccccttcagcccgcggtgaagacccacaacaatcactccctctccaacttcaagaacccttcgcaacgagatcccctcgtcgaagctcgttcgacaatcaggaaaaactcggcctcggcacctgttcgacggagaatcagccgcgcttgtgaccaatgcaatcagctacgcaccaaatgcgacgggcagaacccgtgcgctcattgtattggtagagttcccaacagctacccgaactttgtactgcggaacgtgccatactga

SEQ ID NO: 22013 - DNA, 444 bp, A.fumigatus
cacggaaactattacccttacaagtacgaccttggtcgtttcaacaccatcggctccatttcctttgatcacccggacccctcaatcttcaccgtccttaccggaccatcagaccatgcgggtaccgctattgcggacttcgtgatcttcccgcctcgctggctggttgcagagaacaccttccgtcctccatggtatcaccggaacaccatgtccgagttcatggggctgatctgcggcaattacgatgcgaagacgggcggcggtttccagcctgcaggcgccagcttacacaacgtcatgagtgctcatggtcccgacgcggacgctttcgagggcgccagcaatgctgagctaaaaccccagaaggttggcgatggaagcatggcgttcatgtttgagaggtatgtagtgttacgctacattgaaagattcaaatactga

SEQ ID NO: 22014 - DNA, 630 bp, A.fumigatus
  unsure (132): Identity of nucleotide sequences at the above locations are unknown.
acttcgtctaaatttgaggaagtaccttgggtttggtcccattcggggaacgacttgggtaacctgatgaagatcatgttgtgcaaacctctgccagaaaacgaggaggatttccacacacttctgaagatnttcttccggtcgctatacgacatcaaatacttgatgaaacatgcaggacgcaatcaagctgtcaacgattcgccgctgactccagccgccgcgcagatcttgacgaacctgggccaaaagtccggtcttcaggatattgcagacgagctcggtgtgaaacgggtcggcattgcgcatcaggcagggtctgactcactcgtcacgggcgagatctactggaagatgcgtcagctgatcttcaatggcaaaatcgatgagggtaagtattcggggcagatctggggtctcaacggccaaatgccagcaatgacatatcatatgcaacctcaccaaacaccgaatctcaatggagccaccatttattcagcagccgggacaccgagcacacccaatactggtcgtcaaactcctcaacatcacggtggcaatataggtggtgcactaactcctggtggtccaggtggagtcatgggggcgtttcaaacagggaaggcatga

SEQ ID NO: 22015 - DNA, 198 bp, A.fumigatus
  unsure (165): Identity of nucleotide sequences at the above locations are unknown.
aatcgtgcggcaggcgccaacaagcattgggtgatcgccactgttctagccggagcacccgctgaagattatccaccctcgaggacagtctacgcatggaagggcacctccacagtcatactggcagtcctagggaacgagagggcctttccaacccaggtagtnatcggcagacgggccgaagatccacgcaatcgg

SEQ ID NO: 22016 - DNA, 429 bp, A.fumigatus
  unsure (34): Identity of nucleotide sequences at the above locations are unknown.
tggtacttccacaccacggcaatgtttgagggtntccctcaccgggagcacgtccccattttcaaggcctattacctgctccaggctagttactgggctcagcaagcgattgtattgctgttacaactcgaaaagccccgaaaggatttcaaggaacttgtcggtcatcacatcatcactttggcgctgatcgggttgagttaccggttccacttcacctatatgggcattgcggtctatatcacccacgacatctcagatttcttcctagcggtatgcctgcaaggattcttcttacttgaacgagagctaactgatgcttcttgtagacctcaaaaaccctcaactacctggactccatcatcactgtaccatactttggcaccttcgtccttatgtggatctacctccgccatttcctcaacctga

SEQ ID NO: 22017 - DNA, 396 bp, A.fumigatus
  unsure (368),(372): Identity of nucleotide sequences at the above locations are unknown.
acctcaaaaaccctcaactacctggactccatcatcactgtaccatactttggcaccttcgtccttatgtggatctacctccgccatttcctcaacctgaagatcctctgggccgtgctgaccgaattccgcaccgttggcccctacgagctcaactgggagacccagcaatacaaatgctggatcagtcagatcatcacctttgtcctgctggccagtctgcaagcagtcaatctcttctggctcttcttgatcctccgcattctcaagaactacatcttcaacagcgtgaagaaggacgaaagaagcgacgacgagaccgaagaggaacttgaacatgaggcagagagccgtggcacccttgcttntttngtccagcgcagcagaatccgagaa

SEQ ID NO: 22018 - DNA, 567 bp, A.fumigatus
  unsure (28): Identity of nucleotide sequences at the above locations are unknown.
ccttgctggtgctggccgtgtggagaanacttcccagagccggaggatcttaaggaaatcccccagaaggtcgatggtgctgagttcttggtcaacctgatcgattcccccggtcacgttgacttctcctctgaggtcactgccgctctccgtgtcactgacggtgccctggtcgtcgtcgactgcgttgagggtgtctgtgtccagaccgagaccgtcttgcgtcaggccctgaccgagcgtatcaagcctgtcctgatcatcaacaaggtcgaccgtgctctgctcgaacttcaggtttccaaggaggatctctaccagtccttctctcgtaccgttgagtccgttaacgtcatcatcgccacctaccacgacaaggctcttggtgatgttcaggtctaccccgaccgcggtaccgttgctttcggttccggtctccacggatgggctttcaccgtccgccagttcgctgtcaagtacgccaagaagttcggtgttgaccgtaagaagatgcttgagcgtctctgggtgagtggaacatatctttttcccggaaggaaaatataa

SEQ ID NO: 22019 - DNA, 576 bp, A.fumigatus
  unsure (549): Identity of nucleotide sequences at the above locations are unknown.
gctagctggttatattttccttccgggaaaaagatatgttccactcacccagagacgctcaagcatcttcttacggtcaacaccgaacttcttggcgtacttgacagcgaactggcggacggtgaaagcccatccgtggagaccggaaccgaaagcaacggtaccgcggtcggggtagacctgaacatcaccaagagccttgtcgtggtaggtggcgatgatgacgttaacggactcaacggtacgagagaaggactggtagagatcctccttggaaacctgaagttcgagcagagcacggtcgaccttgttgatgatcaggacaggcttgatacgctcggtcagggcctgacgcaagacggtctcggtctggacacagacaccctcaacgcagtcgacgacgaccagggcaccgtcagtgacacggagagcggcagtgacctcagaggagaagtcaacgtgaccgggggaatcgatcaggttgaccaagaactcagcaccatcgaccttctgggggatttccttaagatcctccggctctgggaagtnttctccacacggccagcaccagcaagg

SEQ ID NO: 22020 - DNA, 222 bp, A.fumigatus
ttcttgtctgtcgcttcaatcgtggtcttttgtggcgactatgcgagtgtgagctacctctttctgtcctctggcgcttcttgcccgaatttcgagttcgtggacctgttggtccccgaggcatcggcgggaacatgttatctacataatcagactcgggaatgtcctctccggcaatgtcttcgtcaaaaagcaattccaattccaattaactcagcccgc

SEQ ID NO: 22021 - DNA, 357 bp, A.fumigatus
ttgagccagtcgttacccatacgggtatttttgctgagtaattttgtcaaagatagcgactcgccgtacctgaaatgccgcgttccattggatatactcaagacagcattgactcccttgggcgatttcccgcacaagaacgaggcggtccaatttcacaatcctatccttttcattcgggcactgcgaagtcattacatcccggaggcttcgattccactcatttcttccttctttcctcagtcgcggatcgtcaatatagactgtggacactgggtggttcaggagcggcctgaggagctgagatcaggtgatgtgtccattgcttatttcttgatcctcaagtatgtctgctaa

SEQ ID NO: 22022 - DNA, 375 bp, A.fumigatus
  unsure (236): Identity of nucleotide sequences at the above locations are unknown.
cccaaccaatctatagaaacatcacctaccacgccagcgccctcacccgctccgagcgcagcgccctccgaaaccaacgcggcctcacaatctggctcaccggcctctccgcctcgggtaaatccaccatcgccggtcaactcgagcaacagctgctccgcgaccggggcgtctccgccctaccgactcgacggcgacaacatccgcttcgggctccacaaggacctaggtttccnccgaaaaggaacgcaacgagaactttccggggcattggcggaagtaccccagcttcttccccgaaaagcgccaaacatcgccaatcacgtccttttatcctcgcccgtaaacaaggctgaaccggcaaaaaatgctcgc

SEQ ID NO: 22023 - DNA, 594 bp, A.fumigatus
  unsure (474): Identity of nucleotide sequences at the above locations are unknown.
aaatggcatcatctcttcttcctccgatgctccatagtaatgatttctcaccggattcaccccgcgatcagcgccccgctcttataccaattattcaggccatttttgcatacttcaattcttcatccttctgcctctcatacgatcaccttttctgagactaatattcaaaaagcacagtcacaatggccacgtactgacccctcaccccctcactcttcttcagagcccgcgctaacccaaccaatctatagaaacatcacctaccacgccagcgccctcacccgctccgagcgcagcgccctccgaaaccaacgcggcctcacaatctggctcaccggcctctccgcctcgggtaaatccaccatcgccggtcaactcgagcaacagctgctccgcgaccggggcgtctccgccctaccgactcgacggcgacaacatccgcttcgggctccacaaggacctaggtttccnccgaaaaggaacgcaacgagaactttccggggcattggcggaagtaccccagcttcttccccgaaaagcgccaaacatcgccaatcacgtccttttatcctcgcccgtaaacaaggctga

SEQ ID NO: 22024 - DNA, 474 bp, A.fumigatus
  unsure (165): Identity of nucleotide sequences at the above locations are unknown.
agcatcccattgtctggcatctccgacattcctttcatgcggaattcgaggcggggattccgatcaggtacattcctgcaggtgcactacggacaaggccatccagtcattcgtttagggccgaacgctctgtcttttgcgggaggacaagctatcccggctatntacggacatgacacaccagctaccaaggatcggcaatatttgaatgcggcgggatcccacttccacttggccgacgtcgtcgataaaaaggaacacgcgcgaaagcgaaaagtgctcgcatctgcgtttgccgctacgcacctagaagactgggagtacaaagtggcagacaaggtgcagcgtctaatgcaacggttcgaccagcacttggcacaaatgccagacgacccattggattaccgatcctggaccaacctgttcacgatcgatagtctctgcgacacattgatcgtggcaccgaccgtgtga

SEQ ID NO: 22025 - DNA, 573 bp, A.fumigatus
acggatgacaacaacagtgaggaccagaccaatgagaaggtgcgcaaggtactttctgggttaagcaagtcgactcttgttgttgccccactggcattgatcaaacagtgggagtcagaaatagcaaccaagatcgaggactctcataagctacgtgtttgtgtctaccacggaaatactcgtgcgaaagcaacggacagcctggacacctacgatgtggtgattacgacatatggtaccttaacctccgaatatggagctgtcgataagaacaagaagaaagcgggacttttctctgtttattggtaccggatagtcctagacgaagcgcataccatcaagaatcgaaatgccaaggcaacgcagtctgcctgtgcgcttgatgcagaatatagatggtgtctttcgggaacgccaatgcagaacaacttggacgagctccagagtttgatcaagtttctgcggatcaaaccctacaacgaccttgcggcttggaaggatcagatcacaagaccgttgtctaacggccatgcgcccttgcgatttttctccacagggcgagatccgttatgg

SEQ ID NO: 22026 - DNA, 240 bp, A.fumigatus
tcatacatttacgcaccttccacttgtccccttactttgacctcacgctataaccagttgccctgcccatcttacctcttcagtcttacctgcttgcttattctgcccaacatggagctctctgctggttcttcctcgaaagccactcagtctaccacttcccaggcgtcattcaactctggagacgttacgttgtgggttttcgtcgcactcgagagaccctcacgctcaagtcgttga

SEQ ID NO: 22027 - DNA, 183 bp, A.fumigatus
ggtagtgaatcaagacatgtcagatctactctgtcagtcaagaatgtcttcactattccctattctagaaagatgcgttcttcccagaagtccaacccggtactggtacgcttacatcataatgggtctacccctctaggtagtcatacatttacgcaccttccacttgtccccttactttga

SEQ ID NO: 22028 - DNA, 240 bp, A.fumigatus
  unsure (125): Identity of nucleotide sequences at the above locations are unknown.
ggcaagtttcgagaatacctcgagaggaccacttatataaaccaagtattgggcacgggctatgccccgctgcaaggcttctcgtccaacctctaccgcccttaccaaggtcgcgctggtggtanaaagagcggtgttctagttcgtcaacgacttgagcgtgagggtctctcgagtgcgacgaaaacccacaacgtaacgtctccagagttgaatgacgcctgggaagtggtagactga

SEQ ID NO: 22029 - DNA, 330 bp, A.fumigatus
cttgacgcaggatatgtagaagatctctccaagggcaagatgctccgatttgaagaatcactcccccgcctgccggtcccctcgttagaagaaaccggccgccgttacctgaaatcagtccacgccgtggtttccgaggccgagtacgagcgcaccaagaaagccgtcgaagcctttatccgtcccggtggtgaaggtcagcctctgcaggaaagattgctggctcgcgccgccgatccaaagtataagaaatggctcacggaatggtggaaccacgccgcctacctgggctaccggggacctgtcattccctacgtctcctacttctaa

SEQ ID NO: 22030 - DNA, 216 bp, A.fumigatus
gtgctgtgttatactcatgcatctattaagtcaatcgtttacatgatcctcatcatatcacagtggaggaacaaccctaaaattggccaaaaatcttcagcttcttatgtgagaagtacatctactagctcaaggctcttaaccttctggataatatgccacagggtggttcatcccacccccaagctggaaatactaaattcccggaaaagctcc

SEQ ID NO: 22031 - DNA, 570 bp, A.fumigatus
ggagcgccttctttatggttgacggtcttgatgagtgtcaggctggtcttccagaacttcccaacaagatcacgcaaaagtgatcgtcatactcctcctaggcttgactctctgtataaacagatgatgcaggaaatccgcaagtcagaagagcatgagccatgtagggagatcctcaacttaataacagccatttatcatcctatcatgctacaggaactagcatctatccgtgaaatcctagcagagtatcccaataatgctaaatcactgaaagaagctataagactttgtggctccttgacaatccataaggggactgcattctttgtgtcagccaaggactatctcacaggaatagtctctcaggaactctttctttcgggaatagaatcggttcatcataccatttttttaagatcattatccagtatggagttgactctgcatcatgatctttattctctccgtaatccaggtttccctatcaacaaggtcaggcgccctgaacccagatccactaagtgctgtgttatactcatgcatctattaagtcaatcgtttacatga

SEQ ID NO: 22032 - DNA, 549 bp, A.fumigatus
tgggtttctcttgccatcatgctggccgactcgcttgtcagtcttggttggctggttttgaagcccgtcatcgccaacgcaccaaggctcaaggccagattcttttccagccgcgccggaaattggattttggcccaagcgtcgaacaacggttctcgccattcttacgtcagatattccgccctgagtcccatttctgaggagtcatcgacagcagcctattccacccacctcccagcaaggcacggcgaacccgaggaagaagatgatgcgccgccttcccagctcatctctactcggactgtggtcatcctgcttcccttgaccctgatgctgaacgtagtctgcatgcacattgtcttcggcgacgttatgtctcccttgctctccagcctggccaccctcctcgccgtactactatcaataatgggcgttcgggcacttggcgagacagacctgaaccccgtctccggaatcagcaaactaacgcagctcctcttctcgctcgcaacacccggtttgcaccacgccgctgaaaggaaagaagct

SEQ ID NO: 22033 - DNA, 348 bp, A.fumigatus
tcctgccgcgtcgcgcgtcaagcattgaagagagaacgagatagttcctcttgcgactcaacagcacagtgcgccatttctcaagagtctgtatggattgacaatggatatgatctcaatcctggctcctcttgccagagaaattatgagtctactcgcaattccgcgtcgataatggcgtgcgttcgttccttaggcctccacgaaccctcggccttacctttccttgtcgcagaggatctcctgcctcctgatccatcggagaatcaatatgaatggagtacaacggttgacgaatgtccgaatgggctcgtggatgatgaacttgtctggactaccagctgtgtc

SEQ ID NO: 22034 - DNA, 540 bp, A.fumigatus
cattatatgaccgcgcagaacgagattgagaatgctattgcggagagccagttgtgcatcaatgccttcgtgggccctgtttttgcagtcgacttctgctatgttgacgaggactcgcacaacctcctgtccctggtggctcatcatctggtcgttgacatagtctcgtggcgtatcattctggaggacttggaagatttcctgctaaaccctcaaggctttgttttacagaatagctcccttccatttcagacatggtgccgcctgcaagacgagcaatgtgagtctgtggctttcgagaatgatgtgcaattagaggatcttcctgctccagaccttgcctactggggaatggagcatcgtcagatgacgtatggcgacgtgatctgtgagacattcgagcttgatcccggcagcactcagtcgattctgcttgaatgtcatcagagtgtacgaacagagcctgttgacctgttcctcgctgctcttgtccactcatttggacagactttcggccgagcgtaccgtgcctcgtgctag

SEQ ID NO: 22035 - DNA, 513 bp, A.fumigatus
atcgtggtgggtgtcaccaaagctgttagtgattgctttggcagcggaggaattgcagaccgaatgatctggtccaacggcttcccgttcgtagacaataaagaagagcatgtcttcaatgtgcctgtctcgcaggccatgacgcctgatcctgtctcgcttcctgcagcagacttccccgtgcgtgaagccgagcatcttctgaatgacaacaaatttcaagggttccccatcgttgaggatcgttcaagtaaggtcttgatcgggtacatcggccgcactgaactccgatacgcgattgaccgggcgaagtcggagggtatattggcccctaatgctcgctgtgtattcacgaaggaagcagccgaagccgcagtggcgcgcagggcatctgtttcgagaaatcagttggtgcccaatacctttgatgcaattcaaactagtttaggggcgcctttcgtggatttcagccgagtcttcaccacaggcgccgacggatgcgcaataggagtt

SEQ ID NO: 22036 - DNA, 426 bp, A.fumigatus
  unsure (39): Identity of nucleotide sequences at the above locations are unknown.
aaaagctcgcgatggtctgcgcttcttccagccctggcnacgctcgacatcgtcggggcagtcctgttcatcttcggtgttggcctcatcatcctgggtacagcctggggagggtcgacgtatccctggtcttcccccgaggttctagtgccactgattgtaggcggcgtatgctttgcgctgtttttcgtatatgagtgcttcctcgagccggacagattgtttgctcggatgttcccaaagcaggtgcccatgttgccgtatagcatgtttgctagacgcgatacgatctggcttgcggttttggagttctccagtggagcaggtactgatgtcatcttttgcttctgtggtcaacaggtactgatgctggcattgcagctatgtactccgtcttttatttcatcggtatatatttcacactag

SEQ ID NO: 22037 - DNA, 201 bp, A.fumigatus
tgtcatcttttgcttctgtggtcaacaggtactgatgctggcattgcagctatgtactccgtcttttatttcatcggtatatatttcacactagttgaagcctatcctgcctcgagagcaggcatcaacctgctctactacattccaggattaggaggtatttcgcatgccccctgctttaattccagtatccacagctaa

SEQ ID NO: 22038 - DNA, 273 bp, A.fumigatus
aagacagcaccaggggcggcttgcgttcctgtagcgggcgcgtctccttcgcctgccaccctcaaccgcatgccgtcctcaacaccgccagggatgtcaactgtaatggttttcttgtcccgaacgactccgttgcctctgcaagtaccacattcagaaccccgagggacgatcatgcctgctcctccacaagcatcacaagtggctgccacctggaaaccaccctgcatgaagtgcacacgagtgccggagccgttgcactggcgacattga

SEQ ID NO: 22039 - DNA, 546 bp, A.fumigatus
gctgctgatatcaatttcgaggatctattcggtgctttcacgggcggcgcacgtcggagcggccggggcagacgcggcccttttcaggagattttggtaggcgaggacattgaggtccagaccaatatctctttcatggaggctgcgaaaggtacatcaaaagatgttgtcatcacgcccttggttgaatgcggtacttgtagaggcggtggtctgaaagagggtgccaagcggtctcaatgtcgccagtgcaacggctccggcactcgtgtgcacttcatgcagggtggtttccaggtggcagccacttgtgatgcttgtggaggagcaggcatgatcgtccctcggggttctgaatgtggtacttgcagaggcaacggagtcgttcgggacaagaaaaccattacagttgacatccctggcggtgttgaggacggcatgcggttgagggtggcaggcgaaggagacgcgcccgctacaggaacgcaagccgcccctggtgctgtcttctaccacaggggccgaaggatccgcgcaatgcgtgtg

SEQ ID NO: 22040 - DNA, 300 bp, A.fumigatus
  unsure (286): Identity of nucleotide sequences at the above locations are unknown.
gttcgaaaatatcaagggcgggcgcacatgtcaaacggtcgtatagactatcacttacactattgtacaatattctacttcatgagctttccccatcttttatcactgggatgtaagtatactatgtttctgcttcatgcctgtaccacgaaaaaggaatcggaggaaagcttccagcaagtcaaatgcaatcatccattaaatgtcattaaggccatcctcttttttttttttttttttgtcttcacacggggctggaaggatcagagatctcatttcagtccgngtttcagtgcttca

SEQ ID NO: 22041 - DNA, 501 bp, A.fumigatus
  unsure (404): Identity of nucleotide sequences at the above locations are unknown.
gttaatccaagcgttgtgcttcttcgacgtggtgaagactgcacggaagtcattacgatcagtgccgcaggcgtcgtgttccatgaccaattgaccgcgatcaatatcgcgggcttgcttattaccattgccagtattggttgctacaactacatgaagatttccaagatgcgttccgaggcacgacgaggcacctgggagcgcagcccgaacctggactcggaaagtgacgactccggtcgtgctcggtcccgttcgcgtggaacgtatcacagaattaacgatccggagaccagcatggtcactccagtgtcgcacgtgccgacaagtgacattcccgctcctgtcgatgggttgattggcgaccggcgctcgttccaagtgagggccagcggggccagtancaacatccatggactcacaatttccacggggaatctcagcgatagcgacacgcgtccgttctccccacgcctggccggtccctctccgctcaagtcc

SEQ ID NO: 22042 - DNA, 627 bp, A.fumigatus
  unsure (142),(385),(393): Identity of nucleotide sequences at the above locations are unknown.
cttgctgctgagcagcatcttacgtatgcattctgcatcttcttaagggttcctcggtctataaatacggatgattgctgctcggttcgccggtcgtccttctcaatcttctcccgtctggtcctctgctccactcttgtgntcggagtcagtatcatctttaagacccccccgcgcatatttgcctccttccccgctgcgtcttgttcacccaactatacccacactgccaacatgtcgtaccaacaagagcgctacattgccgaactcgctgttcagcgagcaacacttctgacacagaaagttttccacgagaaggccaagggcacagtttcaaaggacgacaaatcgcccgtcaccatcggcgacttcggcgctcaagctntaatcatncaggccctccgcaagaatttccccaacgatgagattgtcgccgaagaggaggctaactctcttcgggaggacaaggcgctgagcgcagagatctggagactggtcaaggacatcagattgggagataacgagagcaatgagctcctgggtggtctcttgccaagtgaagatgcgatgctggacatcatcgaccaaggcaagtcttcaccacggccctggaaggaccagcaattg

SEQ ID NO: 22043 - DNA, 189 bp, A.fumigatus
agatttgggttcgcgataactgaaaggactatccataccagctatgacagcgtgacacaatggtacagtgatttaccaagaagctccgatcggaatttcaacctgagttccgcgattgggctacagggctcaaaaacagtggtcctcaaggccatcatcaactatttatctacttccgccggtgactaa

SEQ ID NO: 22044 - DNA, 558 bp, A.fumigatus
ggcaacatcgcgtcagtctcgtcgtattcgctagagagcgtcttccgtctcatacctgttttcagtccgttcagtcaaagcgccctgctcatcctgaaattgctcatcccttttgccatcatcagtgctaatctgggtatcctcaaccgtcggcttgaggttgcgcctagcgctctgttcatggttgtcatgtctatctcggacgtcatgactctcaatttcttctatatggtacgggatgaaggttcctggctggacatcggcaccaccatcagccactttttgatcgccagctttctgtgcacctttgttgcgggacttgagttccttagcgaggtgtttatcagcggggtggacttcggaccgaccactaaggcgatcggggcctctatcaccaagaccgttggcgggactgcggggagcgatgtcgtagattcgcagtccggccctgaagatgcggcgaacagcaagaaggcggagggtctagaaggaagtgaaacgattcgccgacatggcggcttatatagcccaggggccgaaagaaccgcgtcagtgttt

SEQ ID NO: 22045 - DNA, 456 bp, A.fumigatus
ccctcgcaacgtcacgatctggggccaatccgccggcgccggctcagtggttgcgcaggttctcgccaacggacgaggcaaccaacccaagctcttcgacaaagcgctcgtcagctcgcccttctggccaaagacctacgcctacgacgcccccgaagcagaagccatctacgaccagcttgtcactctcaccggctgcgccaatgccaccgactccctcgcctgcctgaaatccgtcgacgtccagaccatccgcgacgcaaacctcatcatcagcgccagccacacctacaacacaagctcctacacctgggcccccgttatcgacggcgaattcctccaagaatccctcaccaccgccgtcgcccgccgcaaaatcaaaacccacttcgtcttcggcatgtacaacacccacgagggcgagaacttcctcccctccggcctgggcaagaccgc

SEQ ID NO: 22046 - DNA, 480 bp, A.fumigatus
  unsure (2): Identity of nucleotide sequences at the above locations are unknown.
ancagtcccgacttcggcggtgaccctcgcaacgtcacgatctggggccaatccgccggcgccggctcagtggttgcgcaggttctcgccaacggacgaggcaaccaacccaagctcttcgacaaagcgctcgtcagctcgcccttctggccaaagacctacgcctacgacgcccccgaagcagaagccatctacgaccagcttgtcactctcaccggctgcgccaatgccaccgactccctcgcctgcctgaaatccgtcgacgtccagaccatccgcgacgcaaacctcatcatcagcgccagccacacctacaacacaagctcctacacctgggcccccgttatcgacggcgaattcctccaagaatccctcaccaccgccgtcgcccgccgcaaaatcaaaacccacttcgtcttcggcatgtacaacacccacgagggcgagaacttcctcccctccggcctgggcaagaccgct

SEQ ID NO: 22047 - DNA, 252 bp, A.fumigatus
agaggtatcaatagtactccgcagataggtgcaggtaattattggctggtgatgtattcatacctgaatcacaccgcctcagaattccgccccctcttcatttcaacgaggacaggctccgctgtggctacgaccatcaaaaccaactccacaacagacccattggccaacagaaggcctgtgagatcgtggttggtttttccttccgagcatccgaaaaggtcctgttgtcccagtaatcctccatactag

SEQ ID NO: 22048 - DNA, 339 bp, A.fumigatus
atagggagtctctactcacgtatgacagactacactgttccagctactgagatagaccttgcggaagcccggaaaacttttgaaaccaacttcttcgcggtcatctctatttgccaggccttcttgccattgctcataaaggcaaagggcaccattgtcatgatcggtagtgtggctggggttagtaaatccacttcactgatatcccatttttctggttttgacagtctccctctttgtaaagatcataccttatgtgttcgggtcggtctacaacgcctcaaaagcagcgctacattcattcagcgacacgctgcgggtggaacttgctccctttgg

SEQ ID NO: 22049 - DNA, 234 bp, A.fumigatus
accagcggcaccgtcacgacctctacctacagcactgtctcgaccgtcactctgacttcaacttcgaccatctgcacggcttgcgaggccagcgccactcctgccccttcgtttgccgcccctgtgaccacggcccctgcccctgaggatatgaccactaccgtggtgacatacgagaccgtgaccacctgcccaggagccttttcacaacggactggaaggtccgcaatggtt

SEQ ID NO: 22050 - DNA, 633 bp, A.fumigatus
  unsure (13),(89): Identity of nucleotide sequences at the above locations are unknown.
tcatgcttgaccntcgggcggcggtcgtgtgaaaacgcgacgacacaggcgcagtgcaggtcttcgacgtcgcgtcgcggggcgatccntgaagtacgttggaaggaccaccggcagccggtgtgggtgaccaagttctcgccgagcgatccaacctcggtgctgagcgccagcgacgaccggaccgtgcggctgtgggatttgccgagccagagcgccgcgcggacgttcctggggcatacagactacgtgcgtagcggggcgtacatgcctggctcgctggcggcgtcgggcttggtggtctcggggagttatgatcggacggtgaggctgtgggatccccgcgtggagaaccgggcggcgatgacgtttaagatggcggcgccgattgagagtgtgttgccgatgccgacggggacgacgctgctggcgtcggcggagaataaaatcgcggtcctggatattgtggcggggaagccgctgcatatgatccagagtcaccataagacggtgacggcgctggcgctggcgtcgaatggggagaggttgctgagtggtgcgttggacgggcacatgaacgtgtttgagaccactgggtggaaccttgtgtctgggtccaagtacccccctccg

SEQ ID NO: 22051 - DNA, 372 bp, A.fumigatus
  unsure (282),(358): Identity of nucleotide sequences at the above locations are unknown.
acgtcatcgccgcccggttctccacgcggggatcccacagcctcaccgtccgatcataactccccgagaccaccaagcccgacgccgccagcgagccaggcatgtacgccccgctacgcacgtagtctgtatgccccaggaacgtccgcgcggcgctctggctcggcaaatcccacagccgcacggtccggtcgtcgctggcgctcagcaccgaggttggatcgctcggcgagaacttggtcacccacaccggctgccggtggtccttccaacgtacttcanggatcgccccgcgacgcgacgtcgaagacctgcactgcgcctgtgtcgtcgcgttttcacacgaccgccgcccganggtcaagcatgaag

SEQ ID NO: 22052 - DNA, 633 bp, A.fumigatus
  unsure (545),(621): Identity of nucleotide sequences at the above locations are unknown.
cggaggggggtacttggacccagacacaaggttccacccagtggtctcaaacacgttcatgtgcccgtccaacgcaccactcagcaacctctccccattcgacgccagcgccagcgccgtcaccgtcttatggtgactctggatcatatgcagcggcttccccgccacaatatccaggaccgcgattttattctccgccgacgccagcagcgtcgtccccgtcggcatcggcaacacactctcaatcggcgccgccatcttaaacgtcatcgccgcccggttctccacgcggggatcccacagcctcaccgtccgatcataactccccgagaccaccaagcccgacgccgccagcgagccaggcatgtacgccccgctacgcacgtagtctgtatgccccaggaacgtccgcgcggcgctctggctcggcaaatcccacagccgcacggtccggtcgtcgctggcgctcagcaccgaggttggatcgctcggcgagaacttggtcacccacaccggctgccggtggtccttccaacgtacttcanggatcgccccgcgacgcgacgtcgaagacctgcactgcgcctgtgtcgtcgcgttttcacacgaccgccgcccganggtcaagcatga

SEQ ID NO: 22053 - DNA, 186 bp, A.fumigatus
ctctggatcatatgcagcggcttccccgccacaatatccaggaccgcgattttattctccgccgacgccagcagcgtcgtccccgtcggcatcggcaacacactctcaatcggcgccgccatcttaaacgtcatcgccgcccggttctccacgcggggatcccacagcctcaccgtccgatcataa

SEQ ID NO: 22054 - DNA, 429 bp, A.fumigatus
  unsure (32): Identity of nucleotide sequences at the above locations are unknown.
cgagcgcagtaccttccagtcccgtcgttaanagacgggactctacggggggtactgcaacctgcgtcgtcggcagcgctggtgggtcaggttctgttacatgctgcgcagggggtaaatgggatggggatggggtcagggaacgggaagcagtgtcaggggaatggggcggtgggttcgagggggctttctgcgacggaattttttacgtttgtcgaagggggtggggagtttgcgaccacgagtggcaccgtgtcgggacaagggccgtatacggcggcgggtggctcatggagtggacggatgatccgggagatagtgaaagtgttgcaatggcatgttagtaaggtgctgacacttttggaggcactgcaagggacatcgccgttggcgcggtataagatgagtctacatcagcagtgcatgtag

SEQ ID NO: 22055 - DNA, 237 bp, A.fumigatus
gaaaagccacagccgtataagatcactacgtcctatcccaccttctcttcctccccacagcttccctcacccgaattcccccactctgactatcggaatcctcagcctccggcaaaaagcaatatctcctacttgccaaactacctccccaattcccttttacagttaaatcctcccccgccatgccaataccaacccaccggtccccgttcccttgagcctgcccccttgaacacc

SEQ ID NO: 22056 - DNA, 312 bp, A.fumigatus
atgtatgactttggagtccggggtgcaagcgacgtcgtcaaagcgctggcgctgggcgcaaaattcgtctttgtcggtcgtctgtgggtttgggggctcagtatcatgggcgaggaaggcgtgcgccatgtcatgaagtcactcctggcagatttcgatatcttaatgggagttggaggattcaatagtatcaaagactttgataagtcgatactaggtatgtcgagctcagtgaagaaaggcacggccgctgatcatttattagagtcctatcccaggtcgtatacctacataccgggcaaggttctgtga

SEQ ID NO: 22057 - DNA, 507 bp, A.fumigatus
  unsure (7),(8): Identity of nucleotide sequences at the above locations are unknown.
gggggtnnactgaaactgatgctctatgacttccatccccgtggtgaagacatcatattattcagcttcatgagcctcagtgtccagggtccaggtgcttccccagaaataattcataaagcagtctatctctccaccgtgttgttgttatattcgtcgcgtttctcaatctctaccgtcgttcgttcccatccgttccgctcgctgtctatctatacagccaccatgcaattcaaggcgctcgctaccctccttttcgccgccctggccgtggccaatcctgctccggcccctcaggctggcgacctgaacgctctgatgggctccattcccacctctgtcctcggcgtcctcatgacggctattcccccctctgtcgtttcggcccttgccaaccctacccaggccgctagcatgttccagcagatcgagcaaggacagatcccagactggtacaacaacctacccgacagcgtcaaggcctgggctactagcgctgccattgct

SEQ ID NO: 22058 - DNA, 630 bp, A.fumigatus
  unsure (7),(19): Identity of nucleotide sequences at the above locations are unknown.
ctaatanatagcggatcgntgccgggccgttgtgaaaatgcggtgaatgttgttctgactcggctcctggacgctgcggacacacttagcacgtattcgatcccacggagacctctatccagccatgactggggttctggtgctggtgtctcgcttgatgagcttaccagtcagcatgccgaaagagcccccgagctcattcaccttacaaagtcagcaattgcgtcggaactgaccagcttcgactcgtggaccgagcgcccatttgcagatgagcacgctaagcgcttcatggcagaggtctggcaaagcttagggtctattgtgctcgatgccgctgatgcgtccccgaacgagtctaagctggcaatgtcctacgtctttcgtatccttgctcgtctacaccattctggcgcagtatctgaccgcgtgtacaaatacgatcctccaagtgcccatcgggtggactttcggccgccgggaatgcaccttttgtcaactcacatcatgagcgtgttgaccgacgcggcttggttggcacatgaagcagaagtcgcagccaaggctgctgctgcaggcaagaagtcgccatacctccctttcgatctaggaatacgggaacttggacat

SEQ ID NO: 22059 - DNA, 642 bp, A.fumigatus
  unsure (527),(573),(609): Identity of nucleotide sequences at the above locations are unknown.
ttgctcgtaacgcaattgcggtccttccaggccgtggtgaagaccgggaggttagtcgaccccaacacgaaacgggtgtacacaccggggatgatttccaaggcgctggaccagttgagctcggcgagcgggcagcagcagatgcagcaggaggggaatgggaacgggaacggggcaggggatgagaatgggccggcacagccgcggaagccgctttggacgggcgtgacgccgaataagtcggcgaagagtcaggcgctggaggcgatgaaggcgttgattgcgtggcagcctatccctgtgatgcgggctcggatgcgactccgtgtcacttgtccggtggcgctgctgaagcagtctgttaaggctgccgcggcgcctgggccgaacaaggagagggaagggccgtctggcggggcgaaaaataataaaaagggtggaaagggtggtaaggggaaggctgtgcggcagcaagactccgatgtggaagctggtggctcggacgcggagatggcgcctgctttganagcccctaccaatgtcaaggacaagatcatgagcttcattgagtcngtggagagtcaagaaatggttggcggtgatgagtgngaagtggttgggtttgctgaaccaggcgccttc

SEQ ID NO: 22060 - DNA, 252 bp, A.fumigatus
ctcttcgccgacttattcggcgtcacgcccgtccaaagcggcttccgcggctgtgccggcccattctcatcccctgccccgttcccgttcccattcccctcctgctgcatctgctgctgcccgctcgccgagctcaactggtccagcgccttggaaatcatccccggtgtgtacacccgtttcgtgttggggtcgactaacctcccggtcttcaccacggcctggaaggaccgcaattgcgttacgagcaaa

SEQ ID NO: 22061 - DNA, 258 bp, A.fumigatus
  unsure (2): Identity of nucleotide sequences at the above locations are unknown.
gncggacggaatgagatggaggctagggcacgcgccaagaaggaaagtcaacagaacaacggaaacaccccgagcaaagatgattcgaacagcaaagcttctcccaaagggaagaagcggaagcgatccgacagccgtggcagtggcaaagagcaggatggagaccgcgatgtggaagaagagaacaagatcgccaaacgcaaccggatcatttctagaaaaaggatgcagcgcaaagctcggaaagggaaggcctaa

SEQ ID NO: 22062 - DNA, 462 bp, A.fumigatus
agacttcctctaacggcaagtctcaaccagggtcctctcgacctccgggtcaccgaattgcctaccccatccccctcgccatacaagtacttgatcgaggtccactccgcaggaaccaatttcttcgacctgctacagatccagggtaaataccagcaccagccgcccctcccttggatcggaggcgccgagtttgctggcacgatcctcgctgtgccaaccggccagaagaagacccaattcaaggtcggtgaccgagtatttggcgcgacgcagggtgcctacgccacgcacgtgctcgcgcctgaagcgtcgctgctccccatccccgctggctggagctttgaggatgccgccggcttgtttgtgaccgcgccgacctcatacggcggtctggtgcatcgggccaatgtgcagccgggtgactgggtccttgtgcatgcggcggcgggtggacttggg

SEQ ID NO: 22063 - DNA, 234 bp, A.fumigatus
ctacccatagtgtttttctggtgcgtacaaagcttctggaacatattgaagagtcccacacggagtctaagcaggaagataactccgtggaaaagggctatgcacgatgccttgctcgcagctaaacagaaattaagggaatactatgacaagactgaccgagaccatgggttcttatacgctacggggacaatgctcgccccgcagtataagctctgggcttttggtgacacg

SEQ ID NO: 22064 - DNA, 717 bp, A.fumigatus
  unsure (162),(182),(691): Identity of nucleotide sequences at the above locations are unknown.
ttgacgtacctgaagctgacgttgcttgtagcggaagaggcgattagaatgtactcccgcgtactcagaagtgaactttttggaaacactgtcccacaggctgatctggattcactgtctcctgatccactattgggaattcccaacggtctcaatgagaanacacgctctcacacaccccntgcacacaccatctcaaacctaccgcccgccagtatcacgccatcgacgcctcacaaaaacctgttcacttacgcttctccaagaattggatctggtcaaccaacaccatccaagacgccccgcagtcaacatggtcccaacttaaatgtgcgatcagaactctacagtctatcgccgatccgatacgacagtcaacgcatcctcgagactcctcgcaagcagcctcgctacgttaataaagtaccctataaggttctcgacgcacccgatttgcaagatgatttctacttgaatctggtggactggggcagtagtaatgtgctaggtgttggcctaggcaattcagtgtacatgtggaattcgaataccggacgggtgacgaaactttgcgaactaagagatgatactgtcacaagtgttagctggattcagagggtaatgagatttctctatatgttggcaatgattattatgtgtttcatgactgaggacggcacagggcacattntttacgaccgccaccagaagataatt

SEQ ID NO: 22065 - DNA, 357 bp, A.fumigatus
tctatgccagacgccgatgaccagatccatcctgcaggtcgccatgtcccgcagacttccggtgaaccctcagagggcctaccagcatggatcgaatcggcgggccccaactgctccattgagaacacggatattgtcctctggcatacatttggtctcactcactttccgtctcctgaagacttccccatcatgcctgcggagccaatgactgtgctcctccgccctcgaaacttcttcgctcgcaatccggcgttggatgttccccctagctacgcgagaactccttcccaggtagccgctggaacaaatgcatgttcctgcaagaagattgatgggtccagcgtccaggtctga

SEQ ID NO: 22066 - DNA, 231 bp, A.fumigatus
  unsure (231): Identity of nucleotide sequences at the above locations are unknown.
ccccaaaaggacatggaaccggggccttcttttagggcggaaccaatggaaactggggtttgttccctcccgtattgttttttttttgttgaccaaaaaggcaacggttgctctcgaaagaagcgcatgcaagaaacggtccaacatgagctggcgcatcattggttcgaaaacttgttgacattggacttctgggacggcttgtggctcaacgagggatttgctacttgn

SEQ ID NO: 22067 - DNA, 948 bp, A.fumigatus
  unsure (82),(116),(169),(178),(212),(910),(937),(938): Identity of nucleotide sequences at the above locations are unknown.
gctggcgcatcattggttcgaaaacttgttgacattggacttctgggacggcttgtggctcaacgagggatttgctacttgnatgtcgtggtattcctgcaacgcgttctacccgnagtgaaagtctgggaaacgtatgtcattgacagtctgcagagcgcgctttctntggactctntgcgcagcagccatcccatcgaggtgcctgtganacgggcagatgagatcaatcagattttcgacgccatctcctactcgaagggctcttcggtcctccgcatgatttccaagtaccttggagaagatgtgttcctccagggtgtacgtaactacattaagaagcacgcatacggcaacactcaaaccggtgacctgtggtccgcccttgctgacgccagcggcaagccggtggagaaggtgatggacatctggaccaagaatgttgggttccccgtcgtctctgtgacggaaaatcccagcgcttcttcgatcaagctgaagcaaaaccgtttcctgcgcacgggcgatgtgcgtcccgaagaagacacaacactgtaccccgtcattttgggcttgcgcaccaagcagggcattgacgagaacacaatgcttactgaacgtgagggtgaattcaaggttcccgaccttgacttttacaagctgaatgctgaccattccgccatttaccgcacttcttacccacctgagcggctcagcaagctgggagaagcagccaagaagggacttttgacagttgaggatcgtgcaggtatgattgcagatgctggtgctctggctgcgtctggttatcagagcacttctggtctgctgtccctcctgaagggcttcgatagtgaagctgagttcgtcgtctggaacgagattctgacccgtgtcggtaccgtcttcnacaggcggtcaaagggcagctctattnnaaaacggccc

SEQ ID NO: 22068 - DNA, 219 bp, A.fumigatus
tggtctgcgatggttatatttcgagacggtgctaactgtcttccgcgacaaaggaacgcgccgtatgtattcggcattcgatccgcggcctgcgcgctcgcagccggtaacaccaccgttctgaaatcctcggaactctcgccgtgttcatactgggcaatcgcgcgtgcgtgttgcagatgctggcctgtcttcacgcggggtggaagaggcgtgcat

SEQ ID NO: 22069 - DNA, 399 bp, A.fumigatus
acaacatttgacgtgatcagcccatacaccaacaaaccgtgttggactacagccagtgccaccccccaagatgcagtccgcgcggtcgaagccgccgagaacgcattcccagcatggtcgcagaccaaaccgaccgttcgcagagacatcctgctcaagtccgcggatatactggagagtcgcctggtccagaacgccgagtatatgcgcactgagatgggagccgacgtcggcgcatcgcagttcttcatcgtcccgctgggtattcgcatgctgagggaaattgctgggcgcatcacttctatttgcggaagcgtgccggttgttgaggaggagggccagagtgcaatcatttataaggagccaatgggcgtgattctgggaattgttccgtggtag

SEQ ID NO: 22070 - DNA, 468 bp, A.fumigatus
  unsure (442),(457): Identity of nucleotide sequences at the above locations are unknown.
ccttttcctcagagagactatgcgccggattattcgtccatcccaccccacggtcgctggcagcattttgacgttggcgggaggccccgtgtgaatcaattgcttcagtcttggcctagcacaatcgatgcgcaggaacggacacggcgtctgattgaccttttcgtggtctccgtccttcttgatgctggtgcaggcacgaagtggtcgtacaaatcaaaagaatccggcaaaatttattctcggagcgagggattagcggtagccactctggagatgttcaagagcggcttgttcagtagtgatcccacggaaccatgccaggtcgacggtgcgggcctaaagaagatcacagtggaggtattggctagaggaatgcaacattctgaacataatccactggcagggcttgaaggacgcgctggacggccgatgagtcttnttttagcgccagcantgaaagtatga

SEQ ID NO: 22071 - DNA, 906 bp, A.fumigatus
  unsure (22): Identity of nucleotide sequences at the above locations are unknown.
cctattgttgcagcttacgagnagattcagcccgttgcagctgcagtaagtaccacaaagcttgtagaatatatacatttaacagggaatagatatatattcaaatctaatgatcgactctacctgcaatactgccaaaagactggtctccaaccacattttgtctcgaatagccgcgggctaaaggggttctggattggcagtccctccgcgaaatatatcgtgatctacttccatggtatgcagcgcagcaaggatgccgaaaaattactgatgatcggaacaggcggtggttttgccatggatgcgacagctccctaccttgatttttggccgcggatacagacgactctcgcaaatgctggcatagaaaatgccttgttccattgcacatataccttgacgccgcacgcggcatatccgactcagttttgcgaagccgttgaagctctacggtatattctagaggatgttggccactcaccgtcgcaagtcctactagttggtgactctgccggcgcaaatctgtgcctggcagtactgtctcacctaacgcatccctctgaagacgtgccagagctagtcattaacgaacccatcaaaggtgttgttcttatgtctccgtgggtttcatttcgccaccattggccgagtgtagaagccagtgaacatagggatatcgatgcagcggaggtcctgacggagtggtcgcgagcgtatctcaatgggagggagtcaaacaactatatagaagcagcggaagcaccagagtggtggtgggacaacatccgagtccggcagacactggtgctcgctggtggtgacgaggctctatcagacccgattaaaacttgggtcaatagcttcaaagtgtcttcaccgcgggtcttaaggggcgctcgatag

SEQ ID NO: 22072 - DNA, 597 bp, A.fumigatus
accatgcttccttccagccgtctggttttgacagctgacggaagatcggccccaacccaaacccagatttctacgggaactcccttctggtacacatacagtccggaaccatatcccccctacacggggccttcccaaacttcctccccaacctcacttattcctcccccgccgccaccaccgggaagccctgggtctgtccacgttactcaaggcccaccgtctcccaccccccggccgggcaacaacccgaagaacggacacatctgcactgcgaattgtattccggaacccccgtgcctcatctgtggctgcattggcccaggctgtcggggtggaggccactgtatcggtcgtggatgcagcagtggaggtggatccaacggaggaggcgacgacacgaacagttgttccacctcgcacactgccgatatctgcaccgattacatcagcagctactccatcacgggcatggacagctcctcgaccattactcaggtattcactcttgccatggacacacggtatccattcgctaacgatgctagactgcttgccgaaccaccactgcctgcgaggtcctgggcacaaccataa

SEQ ID NO: 22073 - DNA, 513 bp, A.fumigatus
  unsure (505): Identity of nucleotide sequences at the above locations are unknown.
caaatgtatcatcagaacgccatgctatcgcccttgtcagcgccggtaggtctggcactccagaacggcagcattctgccgtttgttggagccccgcaggaatacatgtccacggtacctaccaatgagacatttggctccccccctgagagcagtgttgcgccctctgccaagcccgcatcatcatatcagagacccactcctcgaccagtggcctctcacgaccggaacggccctctgatagtcgatggctccatccctttgagtgaacagcgcactttggtttccggagaggcttatgatcagtatgccactatgagccactgtacttctgcgtctgacgatcgcaacacggacacccccgccagcatctccgactcgctttcccaggactaccaggacaatagctcagtcgagatcgaccaatcagcgtacttcaccaggcagacgattgatgctcccaagtcgcgccatgcaacggttttcaccagccggccggaaggancagcgatc

SEQ ID NO: 22074 - DNA, 549 bp, A.fumigatus
atacgaattgcgcggattcttcggcgcttgtggagaagacccccgcggatcaaaggaaaggtcattctgaccacaggcgtttcctcaggctcgcttggtggcttcttcgtccaatccattgccaaggccaagcctgagtggcttatactggccgctcgcaatgccgataaactggcccagatggcagcagagattgctaaggcccagcctgatgtaaaggtccgcacactgaaagttgacttgggctccttggaaagcgtgcgggatgcagctgcacacgtcaactcctgggatgatgtccctgttattgatgtccttgtcaacaacgcgggaatcatggcagtggattaccagctctcgcctgacggattcgagtcgcatctggcaacgaaccatctgggcccgtttctgttcaccaatttgatcatgaagaagattgtagccgcaaaggaacccaaaatcgttgttgtcagtagtgatggccatcggttgaatccattccggttcgatgactataatttcgatgtaggtcgttcgatggctctagac

SEQ ID NO: 22075 - DNA, 237 bp, A.fumigatus
atactctgtgaatggcgtcctgcagagtcagccatcattagtaagcagggacctactagccccaagcggttagactttctgcctcccaaccgtattgcttcgctattgttgtatctcgtcaccatgctttgtcactgtgccacctttcttgtcaccttcctggaacacgttcatcattccaaggctgtcaccccatctgatggactcgacaacttcatcctcacggttctcggttag

SEQ ID NO: 22076 - DNA, 483 bp, A.fumigatus
actttctgcctcccaaccgtattgcttcgctattgttgtatctcgtcaccatgctttgtcactgtgccacctttcttgtcaccttcctggaacacgttcatcattccaaggctgtcaccccatctgatggactcgacaacttcatcctcacggttctcggttagcagtcctcaatcgggcccttctgctggcatacagaagggccggcagcgcaccattaccgcgtgcctgacatgccgccgtcggaaggtcaagtgcgatcatgcgcaacctgtatgtactccatgccagagaggcggccgtgtttgcacgtatgtcactccacagcctgtctcacaggcaccctcccgtgtggggaccggcagtcgagtgtcgcggaccaaccttcggtctggccaagaggagatccgtagtcgcctcgaacggctggaacaaccactggagcgagcgttcctgacaggccgggatggaaaggtactgcgt

SEQ ID NO: 22077 - DNA, 420 bp, A.fumigatus
  unsure (15),(16),(17),(18),(19),(20),(21),(22),(23),(24),(25),(26),(27),(28),(29),(30),(31),(32),(33),(34),(35),(36),(37),(38),(39): Identity of nucleotide sequences at the above locations are unknown.
gaacctgatcccctnnnnnnnnnnnnnnnnnnnnnnnnngaagacgacgctcccctcttcgcacatttccggcgacagtttcaacagaagagtgaagaggaccaatcggatgtgtgcattggcaagttacacgagaacctccgggcggtcaataaccttgaagaagcctccggggtcatctacagtgctctgagtgggaagattgcggcgcatctgtctgttccaatcgagagcatcgatgcctcgcatcccattacggagtacggaatcgactcgcacatggcagtggagctgaggaactggatcgcgaagacgatggagagcacagtgccgatcttggatattctggcgagcagtacgttattggatctagcgggcaagattgcatccaagtctagagtggttcatgtggaagaatag

SEQ ID NO: 22078 - DNA, 192 bp, A.fumigatus
ctgtgtctttgtttagatggcggagcttgtgtcgccatggtgggcaaggactgcgttgcaattgcatgcgacctccgactgggcatgcaggccttgaccgtctccaacaacttccccaagatcttcaactacggtccctcaacctacctcgggttgagtcttcaccaggggcaagaagtaaagaggtctcga

SEQ ID NO: 22079 - DNA, 204 bp, A.fumigatus
aaaaaaaaaaaaaaaaaaaaaatctattccttctccttttcctccgtagacggcctccctagccgtttcggtttactattcccatatgctacacaaataacaacatcagctcaactcaattctcataacaaggagaagcacatactccgatcatacaacacccacgacgtatacaggaatatcggcagcgccacaatagtcgat

SEQ ID NO: 22080 - DNA, 651 bp, A.fumigatus
aatgatgtctccatgatccaagcagccgatgttggaattggtattgtcggcaaggagggtcgtcaggcctcgttggctgccgactttagcatcacgcacttccaccaccttacgaagctcctcgtttggcacggccgcaattcatacaaaagatccgccaaattggcgcaattcatcatgcatcgtggcctcatcattagcgcttgccagaccatgtacagcattgcaagccattttgaccccaagggtctgttcatcaattggctgatggtcggctacgcgacggtctacaccaatgccccggtcttctcgctcgttttcgaccgtgacgttgacgagcacctggccaacctctaccccgagctatacaaagaactcaagtccggtcgcagtctcagctatcgctccttcttcggctgggttcttgtgtcggtttatcagggtgcagtaatccaggggctctcgcagatcttgctgaacaccatttcagggccgcggctgatcagcgtctcattcacagccctcgtcattaacgagctgctgatggtcgctattgccatcacaacctggcaccccgtaatgatcttctgccttatcggtacagctctggtctatgtcttcaccacggggctggaagggtccgcgcattca

SEQ ID NO: 22081 - DNA, 543 bp, A.fumigatus
  unsure (14),(33): Identity of nucleotide sequences at the above locations are unknown.
acacatataaacantcttctgaaggacctcggnaaaggtgcttcaaatgacgtgaatgtcctagcttggtcgcctgatggtaccaaatttgcagcaggcgccactgcccaatgtgatgagggcaatatggagtacaatcggggcaacaacttggttattggggatttgacgtgcaatcgcctcgaggaggtgcctggccattacataattcgccctcctgggagggctgcgtctcaaagggccttaagtgacaaccgtctcttcatgagtgttactgctatgcagtggttcgatgatacactttttacagccagctacgataataccgtgaaactctggaggttttccggaaaccacataacaaatcacaaaacgctcccacatgaatcgaaggtattagtcatggcgcgttcaaattttgaaaagaatctgctggcaaccggcgcgcaatctttcagactatggaacatcatggagtcaaaagatgctcccctgataattgaatccagaagagaaatgactccgacttgcttggctgggggg

SEQ ID NO: 22082 - DNA, 579 bp, A.fumigatus
ccaaccacgacccccttcgccatcaatcatagcgtacaacgatcgcgggtgatctgtgttttaaataaacctttctggttctttcgtcgtggtaggtttggacggaatttgcccatactctcgtctccctcctcgtgcctttttctgcccccactaccctcaccatctggacgggccctcccatctcagtcgaacagccgattgatacaaatctctcgatgtagcaatagggtggtacctgttctttacatcatgcaggcagcctatcacgaacattcctcgcctcatggggagccctccgcctataccgaacatatggcccaggaccagacccacaaggcccccatccccaagaacgttgcctttgagcttttgcttgacgaaaattccaaagtgcgggctcggatacccatgcgggtacagatatatcctcatgatacgacggattcaatcgtgactaccgtcaagaatttctatggcatctatgacggtgccgccagtggtgtcagctttgaggatgaaaatggcatcaccctcatcgtcttcaccgcccggatgcgacgacatcgctgggcaagt

SEQ ID NO: 22083 - DNA, 543 bp, A.fumigatus
  unsure (9),(10),(11),(12),(13),(14),(15),(16),(17),(18),(19),(20),(21),(22),(23),(24),(25),(26),(27),(28),(29),(30),(31),(32),(33): Identity of nucleotide sequences at the above locations are unknown.
gatcccctnnnnnnnnnnnnnnnnnnnnnnnnngaagaccccgttgttcctggaacatctgttccgtccagcaccccggccattcccggcggctcgtcctcttctagcgaggcagtcgcatcatcgactcctttggttaccttgacactgacagtctcgcctacgcccgcgcccagctcatccgaatccagctctaccgatttgtccagctctacacagactgacgtcggcactgccccatcgcaacccgccggtccatcgacaaccgccactgccaccacgtcctcgtcttcctcgtccaccgacgagagttctactactgtcggcagcggcaacggcaatggcagcggatcgacgaccactaccgcggcgaccgactccatcaccgctgcgcccaccgccacctcttcagccactgctaccggcgccacctcagagcctgtgaccattaccactgttattgtgacttcctacatcgatatctgccctactggcttcactactgtgactactacgtacacaaccacgtactgcccaggtact

SEQ ID NO: 22084 - DNA, 486 bp, A.fumigatus
  unsure (85),(100),(474): Identity of nucleotide sequences at the above locations are unknown.
agccgtggaccgggacccgatgtactcgtcgtggcactgcaggccatccgtgaagtcgatatcgagagtctcgggcgggccgtanccccaggggtggtanttgggcatgccggtccagcagaggtgcacccaggagccgttgcaggtggcctggttgggctcgcaccagccgccggtgccggggcagaggcagccgtaggcgtcgatgtcggcttggttgtgcacgcagtcgaggctgtgggagccgttgtaccaatggaagttgtttaccgtccaggtggggatggggcagccatcggggggtgtgatggactgcgtaaaggcggtggaggtaaaggccacaaggccggtgacgaagttgagtatggtcattttgaaggtatggttacatatgttccggatcgaagggaaaaagcgggaggaaggttgatctttatatacagtggaagcggggaaataaagcctgggacatancaaacgatctga

SEQ ID NO: 22085 - DNA, 543 bp, A.fumigatus
  unsure (49),(423),(438): Identity of nucleotide sequences at the above locations are unknown.
agcccgatccagggtcaaaatcaggtcattgccgactcagatcgtttgntatgtcccaggctttatttccccgcttccactgtatataaagatcaaccttcctcccgctttttcccttcgatccggaacatatgtaaccataccttcaaaatgaccatactcaacttcgtcaccggccttgtggcctttacctccaccgcctttacgcagtccatcacaccccccgatggctgccccatccccacctggacggtaaacaacttccattggtacaacggctcccacagcctcgactgcgtgcacaaccaagccgacatcgacgcctacggctgcctctgccccggcaccggcggctggtgcgagcccaaccaggccacctgcaacggctcctgggtgcacctctgctggaccggcatgcccaantaccacccctggggntacggcccgcccgagactctcgatatcgacttcacggatggcctgcagtgccacgacgagtacatcgggtcccggtccacggcttcatttgacatcagccgataa

SEQ ID NO: 22086 - DNA, 342 bp, A.fumigatus
ccacgaggacccggagcaaaaggtcggaaaagacagactcgcatcgttgctcccacaatggtcgctttcagccaacttttgctcctccttcctatccccggggcgctcgcctccaattgtaccccggactcggaggcccccatcgaggccaccaagtcctttgatttcctccagcacatgggaaacaccatcttcaacaccactgacgctagcctcgatcgccgcgacatcacactcagaaccagccaagacggcgtgaataccgtcggctactactactccctatacaacgagatagtcctagcattgtcttcaccacagggccgaaggaccgcgcatggt

SEQ ID NO: 22087 - DNA, 390 bp, A.fumigatus
  unsure (336): Identity of nucleotide sequences at the above locations are unknown.
caacctgatagtgcattcgcaatgacctggggccccatggtctgggccatcgtcgccgaactcttcccctccaagtaccgtgccaagggcatggccctagccaccgcctccaactggctctggaacttcttgctgagcttcttcacccctttcatcaccggcgccatcgacttcgcgtatgggtatgtcttcgcgggctgtctgctggtcgccgccttcgtcgtatacttctgcgtgattgagggcaagggtcgcaccctcgaggagatcgactggatgtacgtgcaccatgtggcgccgtggaagagcagcaagtttgagattccgcaaactgantgggaagagggacctggggctcacagccggaaggaggagcaggcgttccatgca

SEQ ID NO: 22088 - DNA, 390 bp, A.fumigatus
gagccctgttccttccagccctgtggtcaataccgtcttccaggcgccgggctctccaacagcttcgtcacctcggtcatcctcggcgccgtcaacttcgtcaccacctttggcggtctgtacgtggtcgagaactttggccgccgcaagtccctcatcttcggggccggcttcatgttctgcatgttcatgatctttgcgtcgatcggccacttcatgcttgatgtcaacaaccccgccaacactcccgaggtcggcaaaggcatgatcgtcctcgcctgcttcttcattgcgtatgtcccccctttttttttttttttttttttttccctctttcttttttccctgtctccatcatacactgacaacctgatagtgcattcgcaatga

SEQ ID NO: 22089 - DNA, 435 bp, A.fumigatus
  unsure (21): Identity of nucleotide sequences at the above locations are unknown.
gccccaggtccctcttcccantcagtttgcggaatctcaaacttgctgctcttccacggcgccacatggtgcacgtacatccagtcgatctcctcgagggtgcgacccttgccctcaatcacgcagaagtatacgacgaaggcggcgaccagcagacagcccgcgaagacatacccatacgcgaagtcgatggcgccggtgatgaaaggggtgaagaagctcagcaagaagttccagagccagttggaggcggtggctagggccatgcccttggcacggtacttggaggggaagagttcggcgacgatggcccagaccatggggccccaggtcattgcgaatgcactatcaggttgtcagtgtatgatggagacagggaaaaaagaaagagggaaaaaaaaaaaaaaaaaaaaaaaggggggacatacgcaatga

SEQ ID NO: 22090 - DNA, 357 bp, A.fumigatus
tggagacagggaaaaaagaaagagggaaaaaaaaaaaaaaaaaaaaaaaggggggacatacgcaatgaagaagcaggcgaggacgatcatgcctttgccgacctcgggagtgttggcggggttgttgacatcaagcatgaagtggccgatcgacgcaaagatcatgaacatgcagaacatgaagccggccccgaagatgagggacttgcggcggccaaagttctcgaccacgtacagaccgccaaaggtggtgacgaagttgacggcgccgaggatgaccgaggtgacgaagctgttggagagcccggcgcctggaagacggtattgaccacagggctggaaggaacagggctctca

SEQ ID NO: 22091 - DNA, 240 bp, A.fumigatus
ccacctgctaggacaactgctgatttccttacttcaatctgcgaccctaacgcccgtcaattccagcccggccgagaggcttctacccccaagacccctgaggagcttgaggctgtctttaggaatagtgagacttacaagactatctgcgacgaggtggctagctatgacaagaacttcaggatacggatcaggaggatacccgccgcttccagaagaacgttgcccaatgtaagtttg

SEQ ID NO: 22092 - DNA, 321 bp, A.fumigatus
  unsure (10),(11),(39): Identity of nucleotide sequences at the above locations are unknown.
ggaatgaccnncaattccggtcgcgtgaggaccactaantcgtcgggtgtttgctgggataactccaccagaggtttggacgccagtacggctttggattatgccaagtctctccggatcatgaccgatgtcagcaaacgtactacatttgtgaccctctaccaagccggagagagtatctacgaactcatggacaaggttctggtcattgattccggacgcatgctctatcaaggccctgcgaacaaggcgcgcgagtactttgtgaatctcggtttccattgcccagagaaatcgtatgtctctctgtccctcacttga

SEQ ID NO: 22093 - DNA, 471 bp, A.fumigatus
accaaatattaccttgacaaccaactggcgaatcctctgggtcgtattttcgaacccattcttggagagaagaaagccaatcaacttctgactggtgaacacacgcggtctatctcagtagcggcgccgaccttgggaggtctgatgaagtttgcgaagaagacccaaacctgtatgggatgcaagaagcctctttctggtaaagaagaaatggctggcgctgtttgcgcactttgccgccctcgaatcggcgagctctacacaaaaacattgaccaaagtatcggacctcgagattcgatttggacggctctggactcaatgccagcgatgtcagggtagcttgcactgcgaggtaatctgctcgtctcgagactgtccgatcttctacatgcgaatgaaggcaaagaaggatgtcgaagatgcgcagaaagagctttctcggttcgattttgacgctggtgcatggtag

SEQ ID NO: 22094 - DNA, 588 bp, A.fumigatus
ggcacttatctcacacagggccgccgcgctaccttcgccaatgcccttgctgctaccacagacaaagacacgtccgtcaagggcattcatcacgaaccagacgagatcggcctgatgacgaacctcttcttgaacgtacctgctctcgccgcgacggctctggactaccgtccgcaccttatcctcttcaacgccccattcgccgctgtagagctcatcgagaagagaatcacgaattccctgcaagacccaaaccttgttggcacagttggccgactgcagacggcgttggacgaacccgcggaacggggcaatgccgacaccagcgccgatgaggagcatgggaccgtcggaggcaaatcgcttggccagaggattggccatcaggccacggaacatgggaacgtggagatccagattccggggatcgatgcccttccgctccgcatcgatgacctgtctggcgagccgttcaagatatccggatccgactccggtccgagtaccgcccctccagtcctcggtttccgccacagacactgcaatctcaatgagtctacggcacttggtatcctgcctctggcatga

SEQ ID NO: 22095 - DNA, 834 bp, A.fumigatus
  unsure (109),(129),(130),(131),(154),(159),(162),(195),(213): Identity of nucleotide sequences at the above locations are unknown.
gcaccggaacccaaaggagaagaagatacttcatgttcttttctccagcccaggggccaggtgctttccgggatctccgcacggggtcatacatcaccgtttccccagntactccaggcattccctctnnntcagccgcccgtcgaccatctcntatcngtnttgcacaccgtgatgccacgcttatactccttntcgcaagaccccctgatntcatgccagaggcaggataccaagtgccgtagactcattgagattgcagtgtctgtggcggaaaccgaggactggaggggcggtactcggaccggagtcggatccggatatcttgaacggctcgccagacaggtcatcgatgcggagcggaagggcatcgatccccggaatctggatctccacgttcccatgttccgtggcctgatggccaatcctctggccaagcgatttgcctccgacggtcccatgctcctcatcggcgctggtgtcggcattgccccgttccgcgggttcgtccaacgccgtctgcagtcggccaactgtgccaacaaggtttgggtcttgcagggaattcgtgattctcttctcgatgagctctacagcggcgaatggggcgttgaagaggataaggtgcggacggtagtccagagccgtcgcggcgagagcaggtacgttcaagaagaggttcgtcatcaggccgatctcgtctggttcgtgatgaatgcccttgacggacgtgtctttgtctgtggtagcagcaagggcattggcgaaggtagcgcggcggccctgtgtgagataagtgccttacacgccggggatgaagaaagcgtcggagcg

SEQ ID NO: 22096 - DNA, 267 bp, A.fumigatus
  unsure (80): Identity of nucleotide sequences at the above locations are unknown.
gaatgcttgtgggaggcccctggatatatgctatcctcctaccctttaaagtcgtggtatcacgatatcgcgcagggaanagatttggggggcctatttcacgatattctaggaatacaagatgctggagttgacgacttcctacttgagctggagtggaggaaggattccactgatgtggaatatgacctggtttatgacttatatcaggagcttaatgcgagacggctggggatggatgacaagaccgtgaaaaagatccggtaa

SEQ ID NO: 22097 - DNA, 228 bp, A.fumigatus
tcggatattgtctcctcgcatgccgtgtacaacatccttgcgcgggagaggcccgacgtgcttaagacgctaacgcagccaatttggtattttgatcgcaagggcgagacctccaagggtcaggatgagtacatccggacgagtgtgatgtatctcgagcgcggcgagaacccgcgtgtgtataccaagtatgggcccccttttcttgcactgcgccgtatgaactag

SEQ ID NO: 22098 - DNA, 327 bp, A.fumigatus
tggttgctgtggtccaggtgggatccgtactatgtccgctcgctcacccgcttctccgatgcgggaatcatccccccgctgtctgcggcgcagctcgaggcgctgcaggtgctggaggacacgtgtctgcagaacgcgctgcatatggttctggaggtcggcgatatccagttcctggctaactcgcatgtgctgcatgcgcggacggcgtacaaggaccatgcgccgccggcgccgaggcggcacctgatgcggttgtggttggcgacgccggaggatgcgggcggttggtggttgctaatcagcccggcctggaagaaatgcatc

SEQ ID NO: 22099 - DNA, 195 bp, A.fumigatus
  unsure (99),(104),(113),(143): Identity of nucleotide sequences at the above locations are unknown.
aatttatatctctttttcagctccaagatgcgaggtaaattgcacattgtgccttccatggaatataatccttcgaacgagaccagaatcttcttccanggccngtgggtgcnggggttggcctgcaaaattgcctctcgaanttccctctccaaattcgccatattggtatggggaaaagaactggatggcaac

SEQ ID NO: 22100 - DNA, 852 bp, A.fumigatus
  unsure (52),(82),(91),(96),(817),(830),(832),(833): Identity of nucleotide sequences at the above locations are unknown.
ttgccatccagttcttttccccataccaatatggcgaatttggagagggaanttcgagaggcaattttgcaggccaaccccngcacccacnggccntggaagaagattctggtctcgttcgaaggattatattccatggaaggcacaatgtgcaatttacctcgcatcttggagctgaaaaagagatataaattttacttcttcgttgatgaagctcactccatcggcgcgatcgggcttcgtgggcggggagtctgcgatttcttcaaggtcgatcctgccgaggtcgatatcttcatgggtacatttaccaagtcctttggtgccaacggtgggtatattgcggcagacaaggccctcattaagaaactgcgtgccacaaatgctggacaagtcttcggcgaggctcctgctcccgctgtcctggcacagatttcctcctccttgcgactgatcgccgatgaggatccccaacacccaggccagggacttgaacgcgtgcaaagacttgggttcaattcgcgatatttgcgactggggctcaaacggcttggttttatcgtctacggacatgatgattcgcccattgtgccgctaatgctgtacaacccagccaagatgccggcattctcccatgagatgctacgacggaagatctctgtcgtggtggtgacctatcccgccaccccgctggagctgtctcgggcccgactctgcgtctctgctgctcatacaaaggatgatctggaccacatactccgagtgtgtgacgagatcggcaatactttggggttaacatattccacgggggggtgtnttacacgcccggngnnggcccgaaatgggcgcgga

SEQ ID NO: 22101 - DNA, 717 bp, A.fumigatus
ttgccagttggttacacaaccgtcgctctttcgcagactatcagtggaaagctcccctcaaaccttgccccgccacctgcacccacgaatgctcccaagaatttgaaattgctttctcgcgtgaacttgatgttgtccgaccccgcacagaatcagcgcctcgcaagcttagctcaggtgtatgacttggttgcacttcgccctaccaatgaaaaagccctcttgaatgcatgcacgaatctcgaatgcgacctgatttctctcgatctctccgtgagacttccgttttacttcaaattcaaaatgctctccgccgccatcgaacgaggggttcggctggaaatttgctacgggcctggggttacggggagcggacttgaagcccgtcggaatctcatcggcaatgctatgtccttgatccgcgcgacacgcggaagggggatcgttgtgtcaagtgaggcaaaaagggccctgggcgtgagggctccatgggatgtcatcaacctgacatgtgtatggggtttgtcacaggaactcggtaaggaggcaatcagtgaagaagcaagaaaggtcaccgcactagccaaactgaaacgcacaagctggcgtggggtcattgacatcgttgacgggggacagatgtcaaagtcacaagttatggagtctggaatggggcagaaaggcatgtctaagaagaattctcgcagggtccggtga

SEQ ID NO: 22102 - DNA, 624 bp, A.fumigatus
  unsure (464),(544),(570): Identity of nucleotide sequences at the above locations are unknown.
agacccgagaagtcttggcccacctccatcctgttcatcgataagctgcgcccctatgtcaaatcgatggcgcttcgttacgttctggtcggacttaagcaaaaccacaccttgcagctctgggatattgggcttggcaaggccgtgcaggagctcaagttccctcacgagaacgaatcggatgccatctgtagtgtcgcctaccacgcagcctctggtatcattgttgtcggacatcctacgcgcaattctatctactttgttcacttgtccgcccctagatataatctacagcccatgtcgcaggcatctttcatcaagcgctcgggtgaaaaggactcgagcttgcccaagccggaatctacagcatgcatgagtggcattcgggaaatttcgtttgcctccaaaggccagttacgcagcttggatcttctccctgccattaaagctcctggagatagcanagaaaacagtgcgctcttcgagctttacgtgatgcactcgcgtggtgtgacttgcttgaccatcaagaaagaagacctgngatggggcgtcgacaataagaatatncgccctgtgaatgcactggaggagggctacatcgaaatttctgagcttcaggcc

SEQ ID NO: 22103 - DNA, 219 bp, A.fumigatus
agaccttcaccagtccactcgccttcccttacagcctccaagtggtggatcggatccctcggacgctccgcctaccatgcggtggtgatggcgcagttgttcattgctggcaagaactacgggcctcaccctttcatcgttcagattcgcgacctcgagacgcatcagccattggagaatatctacgtgggggacattggacccaagtttggttactag

SEQ ID NO: 22104 - DNA, 225 bp, A.fumigatus
  unsure (33),(36),(37): Identity of nucleotide sequences at the above locations are unknown.
attccatttcttgaggcccgtcccgtacagtanaannaagggaacgggatgtgcaaatcagccatccagaagcgaatcagcgtgcgaggctcgaacggcgagaaggaccattttcggtatctatcggtgccagatagtgagctgatcgagtatgctcagggcttgcttctgtcgggatacctggaggaagcattcatgtacgtcattgaatgggagtggaagtga

SEQ ID NO: 22105 - DNA, 657 bp, A.fumigatus
  unsure (600): Identity of nucleotide sequences at the above locations are unknown.
ttcggggtggagatgggtgggacaactgctgtatttaaagctctgtggaagacactgtggcagtactttgcgggcatcggtatccccggctggcaactcattcgccaggactacaacctcaatttcgagacttacgtgccccactcgattaactgggcctgggggtcgatggtgcccgagtacgatgccgtcgcccggaaggcgatcgagctcattgccccgatcccgctggaggggagcgtccccgatgcgaccgtccgcgaagtaatcgagttctcgaactcagtcaagcgcgtcgcggtcgactcgaaccggttcaatttccgctgggacggtctcctgcgctactatgatatcttcctcaactacgatgagaagaagaactggaaggacgtgttctcgcggcagtgcaaggggtgcggagcctggcttgtctgtcgccctgactggcgcaaatgctactcctgcggcaaggagaggaccgaagaggaggcggccatcgcctggaacccgcctctggccgtcgacgaggtcaaagccctggtgcgggcatcagatgccaaacctgcttcccgggcggccaaggaaagggctgtccangagcagctcaaggacgggacggtggttgtttcgcatgcggtggagattactgtatag

SEQ ID NO: 22106 - DNA, 402 bp, A.fumigatus
aggtggatctccaccgctggtgaatatgcaagattccatgatcgcgagggagacaagaagacgaaccgccagacgttgccagtcattgttggcccccgatggcatggagctctacgctgggcaaccgctcttttggttatgggaactggaatcatgcctttgtgtataactggcaagctcgtctggaacggccaagacacggggtttcgcaacaagcgttggatatacaccggcaccgtcatcaccgcaatactgcatgtcgtctttgcgtctctttcgggccttcgatgcgccttcagctggggagaagcagcttacgaccgtcagacctacaagcgtttctacatgctcgcggcctacaccatggtctgctacctatcctttgcttatttgaccgcatga

SEQ ID NO: 22107 - DNA, 462 bp, A.fumigatus
gtacatgttgcccaatgctgtacgcttttcctgtctcttaatgtccacgagggtcatccaaaaagcatgacgaaggtcattattgctggcgtgactgggttcgtgggacaggaggtcctttcacagtgcctggcccatccctctatcacttctattgttgccctatgccgccgtgaactgcccaccacacatcccaaactccatgtccacggcactcaagaaagagatttcctctcgtattcagatccccaactcactgcctctctccgaggagcaggctcttgtatttggacaccaggcattactccctcgcgtgcttctgatgaacagaccctccgcccggtgacgctggaattatacagccaagctgccaagggcttccaacaatgcctttactgcttccaaatgaaggcaaacaaggaagctctgccgggttcgaaatttccttttggtgtatgttaa

SEQ ID NO: 22108 - DNA, 609 bp, A.fumigatus
  unsure (14),(18),(22),(62): Identity of nucleotide sequences at the above locations are unknown.
cgcacggttttccngccngccnttgattctttcgtctcgggcgttgtacccggcggcttcgntacggcgtcgacgtatccactcgacttgctgcgaacgcgtttcgcggcccagggcaccgagcgcatttatacttcgctgctggcgtcggtgcggaacattgcgcggagtgaagggccggcgggattcttccgcggctgcagtgcggcggtcggccagatcgtcccgtatatggggctgtttttcgcgacatatgagtcgttgagaccggtgctgtccgggctggaaaacatgccgttcgggtccggtgatgccgctgcaggagtgattgccagtgttctggccaagagcggggtgtttccgcttgacctcgtgcgaaagcgactccaggtccagggcccaacgcgcacactgtatgtgcatcgcaatatccccgaataccgcggcgtatttagcaccatcgctatgatagtgcgtacccagggagtccggggcctctaccggggactgacggttagcttgatcaaggccgcaccagcaagtgccatcaccatgtggacttacgagcgatcgttaaaactcctccgcgacttccgcgtcgctgaatga

SEQ ID NO: 22109 - DNA, 249 bp, A.fumigatus
cttatcaccaaagactgctgcgcgacggttggaatggccgccaatcgtaaccatcagtatcggcaactcggtaaggcgggtcgggcacgctggttgaatatcggtcccacagtccgtggtgtggccatggacgctgccgatcaccctcacggtggtggacgtggtaagtcgaagggtaacgttgatccaaagagtccttggggtctaccggtatgtacatgcgtaatcgcgggactgaatgcgttatga

SEQ ID NO: 22110 - DNA, 288 bp, A.fumigatus
catgttcttcttcttttcagttcctcattgtattcgagtattctcatgtttaaatgcggaggatgggtcctccgctcacactgtatcatattttgtctcgattcgggcgccaggcatgctgtcttcgatatcctccaaacttcttgtgattattacctcgctgttatggatgatagattgtatttccatacatttgccatggctatcacgtttatgcggtcgaaatacacagaattcactggagaaaaagatctcttcgtctacacgccggggtggacgattcgtcga

SEQ ID NO: 22111 - DNA, 417 bp, A.fumigatus
gtaattgctgatcaatttctttcactagtcttagctgacatcagtcgctctacaggattgcccaacttccgtttcaagcttccatctcggaattggatgatctttttcaccatcaccggctcacttacggctgccatcgtctatgatcgtcgcgaaagacgtcgtgtacaacagaagtggtgtgacttggtcgcacacctctccaaggagacccttcctattgaacaaacacggcggaaattaacgatatttttgtccgcgccgccgggcgacggacttcgcattgctcgtgaacatttcaaggaatatgtgaagccgatattagtcgcggcagctctagactacacagtcatcgaaggcagaagggagggcgatgtgcgtgcagcgcttgtcttcaccacggctgagaatccgcct

SEQ ID NO: 22112 - DNA, 840 bp, A.fumigatus
  unsure (20),(27): Identity of nucleotide sequences at the above locations are unknown.
gcttggatttggccacgtcnggactgnatatacaatgggcctgagcggagctgccgggcatacgatcgcgacttggtcagtgtcgcaaagaagaggggattcagctaccttgatgataggaagggctttgactcgctgaatggcggatcggaggccaagctgcccctcctgggtctgtttgcggagaaggacattccgtttgagattgaccgtcgtaatcagaacgacgtttacccgtccctggaagagatggcccgcaccgcactcaagatactcagcgatgctaccgctgatagcgagcaggggtttttcttgatgatcgaaggttctcgtattgatcatgccgggcacggcaatgatcccgcagcgcaggtccacgaggttattgcgtacgataaggcattcgctgcagtgctggacttccttgggaaagactcgacgcccggtgttgtggttagcacatctgaccatgaaacgggtggcctggcggccgctcggcagctgcatacctcctacccggagtacaagtggcttcccggggttctggccaacgccagccattccaccgaatacattgacaacaagcttcgggagtttctctccacggagacggaaaagaacaagcagcaacattatgtccgagagctcttggagaagggtctaagtattaccgatgccaccgacgaagagatcgattctattctcgatccaaattcgccagttagctcgcagtatcagcttgcggacctgatcattccaaaagcccagatcggttggtccacccatgggccctctggtaagttccaagctctataccatggaccaatggagattcggtaa

SEQ ID NO: 22113 - DNA, 342 bp, A.fumigatus
tacagactcaggctgggcgagtggggtttctggtgtcttggcgtccaacatcgactcgtcaccctcatcactctattcgccctcgtccccctcctccttttcatcgtcctggccgctttgatctacagacaagcgggacgcgtctggatcgggtttagtcaacccggaatctgtggcgccttccaccgtactggcgccagaaccgtgaacaagcgcagcatcagccccatctcctggcgcgaacatgaccttcttcctgcgtcccttcccaaaacccttggccttgcgcttgggaggaggtgggcgtgttttcacacacggcggctggaaggaccaacaatg

SEQ ID NO: 22114 - DNA, 414 bp, A.fumigatus
  unsure (29): Identity of nucleotide sequences at the above locations are unknown.
atattcggtccttccggcggcttgttaanaagccgctcttcattgtgtcctaagcttggaacgtggacatccagacatggccgcgtggtaattgtgggtgatgccgcgcatgcgattcccccggctgctggtcagggtgtcaatcaggcgtttgaggatgtttttacgtattcgttgatgcttggacggtctgacaaggatgctcttgcgcgatcactgaaggtttggcagacaagacgacaagagcggatagataaggtgcttgcactcaacacgtatatggagagacggagggtgccgagtttggaggaagaaaaggacgccgaggacgcgcccctggacttcgcatcgttgtataagccggatttcgtagaaatagtggacacgtggctctctaagcacacctcctgctga

SEQ ID NO: 22115 - DNA, 201 bp, A.fumigatus
attataacccacattacctggtatcggcagtctttggtgggcagccggccaagtgggaaagcctggggattgccggcatctcgtctgcccatcaccacgacggaatgtgcaaggtcagtctacatcgcccataaatgctcatccgaaggagccattcgcgtgtatgagctggacgaaaagacttcagccttccggggcagt

SEQ ID NO: 22116 - DNA, 312 bp, A.fumigatus
ttggccagactacccgggggcgttaatattgtaggccgagatcaatcggcacggaattgtcaggtggccccccacaaatgtgagcggatcaacctttttagtgggaaaccctgcaattcggtcttctcgcggccgtatgattttacgcggcacggggacacgatccactacgcccgtaagcagaaggtccgatgtcatctgtgcacggaggagaagaccttctcgcgcaatgatgcgctgacccggcacatgcgggtggtccatcccgaagtcgactggcgtggtaagcagcgacgcaggggccgtgattga

SEQ ID NO: 22117 - DNA, 189 bp, A.fumigatus
acagaccatgaaacttgtcatgtgatctctgtttacatccatccactgtcgacatatccaaacacagatagccctaccaacaaattgaataatacttcgcaagatgaacccgccttcgcggccagtcaaatcatttatagaggtgttcttcgaatacaccactcgcccgtctttgtaccaatgccctga

SEQ ID NO: 22118 - DNA, 678 bp, A.fumigatus
  unsure (19): Identity of nucleotide sequences at the above locations are unknown.
gtcgcaggatccttctcanccccgtggagagagaagtgcaattgtcgagcttctcgttcattccccttcgtgtcgaaggtcatgggtgtcgacctgattgagatggctaccaaggcgatgatcggcaagcctttcgctgagtaccctccagttaccatccctaagaattacgttggtgtcaaggtccctcagttctctttctctcgtctctccggtgccgacccagttctgggcgttgagatggcttctaccggagaagttgcttcctttggtcgtgacaagtacgaggcttatctgaaggctctgatctccaccggtttccgtcttcccaagaagaacgtcttgttctcgattggttcttacaaggagaagatggagatgttgccgtccatcaagaagttgcaccagttgggatttaatctctttgctacttctggtactgccgacttcctaaaggaacacggtgtacctgtcaagtatctggaggttcttcctggtcaggaagatgaccttaagtccgagtcctcccttactcagcacttggcgaacaacctcattgacctctatatcaacttgccatccaacaaccgctttcgacgtcctgcgaactacatgagtaaaagctaccggactcgtcgtatggcagtcgactaccagactcttctgggcacaacgtga

SEQ ID NO: 22119 - DNA, 561 bp, A.fumigatus
  unsure (8): Identity of nucleotide sequences at the above locations are unknown.
aaacctcngaagagaccgaatcccagaactggtgcagatccgcccgtggttgttcgcggggcactgtatgcgggagggccatcggactcgagcatttaccaatatggcggaacagtctcttatacgaacacgagttttcctggtttccaaaacccaacttcgtcggagtatgccctttggtcgtacaacaccagcaatggctcttgggatcaatttgacgtcactctgggcgctgagtaccggcctgcaggaggagcgtatggcgaggctccggatcaggaattggcattctatctcaacggatacatcaacaacgggacatctaatgacctggaggactcggacgaccttctccgctatctggatggtttgattgtcattgatacccacacgcagatggcgacaaacatatcgacgagctcactggcaaattttccacgagtcaggggtggcatggtctacatccctgggatagggcccaaaggcatattggtcgcagtgggcggtgtcaccaagtcagcgagtgacggtagcgcgtccaatgaaggaacctacgtaggt

SEQ ID NO: 22120 - DNA, 561 bp, A.fumigatus
tacgactatgcgcggatgcttgggccgccctcgtggatgaagacggacaccgccagcgtgcctatgccccatggtgccatgagtttgggacagtcgcagaccgagcccaggaccatgtctcccaaggatgcggtgcttgatttcaatgagactgaagatgctagcatgccgccattgttcccttcgagtcaacctgacttcaatctcagtgaggctttgggcttgcgacgtgagagcagctcgtcactacgacaggcacagaactttccatcgatggattcgttctccagtcagttcaatacacagactagctctctctcccaacaatatcccttcgtgcagcaacagcagaaccaccgccagccgcaactccagcaacaacaaaacaatctgcttcaccatactcccgagtttcccgcctctcttccgcacctcgattctactgggagcgaagtcattcaaaatgatatgacttcgtctcaatctaacatgaacatcctacctctcaaaggagagattactcggcccgacaatacatctacggatggtggcacttacacc

SEQ ID NO: 22121 - DNA, 546 bp, A.fumigatus
aacaagggaggtggtgtcattcaagtctctgctagtgatgcagtcgcgacggtgatgatcgctgctcgggaaaggagggtgcgcgaacaagcattggctgagggtctcaaggacggaacggtcgagtacgaggaccgtgtgatggagctgagaccgagactggtggccctgggtagtaatcaggctcatagcagcaccgcgaaaggcgcactacttgctggaacgaggtatcgcagcgtcactgcgcggctagaggacaatatggaaatgaccggaccacggttacgagaggtacttgagcagtgcgataaggatgggctcaccccatattacatcacgcttggcatgggtacaaccaacacttgcgcgttggatcgctttgcggagatcaaggctgtgttgaaggagaagccgcattggcagagaatctgggtccatatcgacgctgcctatgctggtgctgcgcttgttgcggacgagtggcagtatatcgccaaggactttgcggaagggtcttcaccacggggatggaaggtcacgcgctcc

SEQ ID NO: 22122 - DNA, 354 bp, A.fumigatus
ggacagagctatatatcatatttaccatatgccaataaggagtcccccaagatcaacattattcatgcccagcgatctatccaacatcacttccatatcacagataatgactggactcttaatctaatatcacccatttacccttctgcttcatttgccattctcattgtgccatacaaagactgttgtcagctatgcagacatgactctgaaaggatgtggtctaggttgctgctggccaatcctaaacagcttctattctatcactgttgcggcaaaatatatggaacattaaatatactgcgtgttgcacatactaagctatacagcgaaaggatcaacactcaccgatga

SEQ ID NO: 22123 - DNA, 189 bp, A.fumigatus
actatgatcatagcgcggttctttaacggcctgtctggaagcgcgtttctgagtgtcgctggcggcacagttggtgacctcttccaccggcaggagctcgcggccctgatgatggtttatactgcgagcccgttcctggtccctgagatcggtcttgtcctacacgcccggagatggaagccattgggt

SEQ ID NO: 22124 - DNA, 288 bp, A.fumigatus
acgcgtttccttccatcccggcttgaagatgcggctgtcgtgaccgtcaagccgggcgggatgcgcgagatccactggcatccgaccagcgatgagtgggcatttttcatccgtggccagggccgcgccacgctgttctcggcacccagtacggccacgacgtttgactaccgcgccggggacgtgggatactttcctaagtcgaacagtcactatattgagaataccggggacgaggacctgctcttcctcgaggtgttgcaggcagacaagttcactggtgcgtag

SEQ ID NO: 22125 - DNA, 750 bp, A.fumigatus
  unsure (5),(60),(85),(89),(129),(138): Identity of nucleotide sequences at the above locations are unknown.
acttncccattcccgggaagaagaccagttcaaggacgtgaaagttttttggcccttgtngttaggatggctttttcccagggtntcantagagaaccttccttgttccgttcaagtcatatggatgtngtccagtcngagactcttcgcaggctgtggcatcagatatgtcatctcgacttccgttccgcagaaggtaggggccaggagcccacaatagcagacgaggactacactacgctgctaccacggaacatcaacgacgaagatctcattgaaggagcgcatccaactgcggaaacatactcacctcctggatttaccgacatgacaggccatttgattcgcttgcatggcatccactgcttccgaagaatcgttcggagcacttatcggctggagcggagaatcaagtcttcggttgccaacggaaatggtaacctatatccaatcgcagagcttcagtctttgtttgtcgaggttcgaaccatggtggatgaaatggtcaatcatctccaaactcaatacttgcaatactgcgacccccaaattccgcaccagcgcatggcccttggtcttgcggccgtaattgaatggcgatgctggtcgattttctggctgcgaaccccgaaacaataccgggaggccgtcgtgtcccctgagatccgacaaacgtatgtttggtgctgtcattggagcagagaacgtcttttttcgtgtcttggagcgaaagctaatgaatgtgtttag

SEQ ID NO: 22126 - DNA, 231 bp, A.fumigatus
  unsure (115),(142): Identity of nucleotide sequences at the above locations are unknown.
gctatcctgatcatggaaaacatcgaaagtccgcattcggataccccgcagatcaacatcaggacctatctagtcattctgatcaaaaaaacagctggttcacacattttcatanggtttgctcatctcaccttggctaatntgactccacatatatggggcgacttcatccttaaggggcgtaccgacagcgaatccttgagcgcctccgacatgctttgcgttttggaa

SEQ ID NO: 22127 - DNA, 300 bp, A.fumigatus
tgctttttcctgcagtgtcacatgagaccacccattcacgctttccacctactcttactcaggagtgaggtccaagcctcttttccaatcgagtgcggcgagatgacaacccacaccctgcctaagcagaggatgagactggtcgctgatcgtgctaggacggcccaatgcatgtggtttggaatcatttatctcgctctgtttacgcctcatattttgtgctactcatgggccaccggtgctgaacctttggcgtccttgggtagcgactcaacgatggctttcgatcagaagccttga

SEQ ID NO: 22128 - DNA, 471 bp, A.fumigatus
gcagcacaaagtaaggagctcaactacgcagacagcatccatgatctggcatatggcaatgttgctgcctcctctgttgattcccgcggtgatgtctggttgaacctcaccggctttgctgtgaatgaactcccgtatatacaggaggctgtgggcatcacctccctggacaatgcacgcgagctgcaggtcattgcaggacttgttagtacagcagcaagtcagcaacagtggggtgatgttgtttttctgtacaacgtcttttccatgaatgctcatcccgagttcgccagagttgtgagcccgcaaatgcaggctggtttgctggatgctgtgagagaccgggcctccaacgctggtcctgatgatcgtttgattgaactctacgccagtacatcgagctccccgtccctagttgaggcatttagagccctccctgatcttcaccccggggctggaaggaaccgcaat

SEQ ID NO: 22129 - DNA, 453 bp, A.fumigatus
  unsure (151): Identity of nucleotide sequences at the above locations are unknown.
agggcgcaacatccttcagcttgtcgttcagcaagtttagcgtctcgggcacattgcggtcaggctcatgcgtgttccacgggtaaagcacccgcctcgcgtagccgtgcgcattcagcacgcttgcgtccaccacaacctcctcctcttnttcgcattctttccgtccatgattcgcagcatacactttcttcagtattctcagctgctctttcaacccagcaatctcattctccgcaaccacactcctatccccattttccaacaacgccagcccacgcacacagaaatcatacgcatcccgataacacccacaccgaaccaagttcctcacaagcaacccgtaaatgctcccgatcataccgtcgtattcctcctgcgatatctcctcaaactccccctcctcatcctcatcctcctgatcctcgtgctgactatccacccgccgcgtag

SEQ ID NO: 22130 - DNA, 669 bp, A.fumigatus
ggaaggactggctcaaagggaggcagagtctccgagaatcttccatggttggattggatggcgaaattacgtcgccgtgataggaactcaagtgcaagaactcatcgcaactgtaacttacaaaacatgcagggtcccgttaccgaggagattatgtttcggtctgccattgtgcttctccatctcctagcgaaggacactccgggccacattgtttttgtggcgcctctttattttggaatcgcacatgtgcaccatttttatgagttccgcttgacacatccagatacttcgatctttgcagcattgtttcgatcagtgttccagtttggctacactaccatcttcggttggtatgccaccttcctgtatcttcgaacgggatctttgctagcagtcattgtcgcgcacagcttctgcaactggtgcgggcttccccgactgtggggaagggtcgaggcaagtgtccccatcggaccgcccgtgggtaaagccaaagaagacgccgatgtgaaggacgcacacgccgcctatggtaaactgggcttgggctggacagttgggtactatgtactccttgtatcaggggcgattgccttctattacgctctatggccgctaagcgactcgccaaatgcgcttgatacgtttacaggagggtccaagtga

SEQ ID NO: 22131 - DNA, 792 bp, A.fumigatus
  unsure (9),(12),(13),(19),(23),(24),(25),(34),(49),(789): Identity of nucleotide sequences at the above locations are unknown.
atagaaganccnnctgggnaagnnncgtacgagnaccttctagccacgngtcaagacccatcgccttcgaagtccggcagcccccggacccggaataaaccatcacagtcaggaagccgtagcagtggtagtgtcgctgacacccgaggaacgcaaccagggtccatggacatgctggagttcttgacatcccccgaacctgctcgtcacgatgcagaagccaatacggctaccctgaccagcacgtcgtctccgcacagtatcacctttttcgactttgtaaacatgaacaacccgcccagtatgctcaagttaacgaacaaagaatcgatcgctccgaacgcactgacgaccatcctcttctttatgtggggcgtcgcgtatgggctactggacatcttgaacacgcaatttcagcagatcgtccgcctggactcgtggcgctccctgggccttcatgctgtatactttggtgggtacttggtgggcccacctctggtcgggcgaactgtgttgaagcgatgggggttcaagtcgacatttataacgggcctatgcatatatgcgtgtgggacgctcgtcttctggccctcggccgtattgacctcgtattctgcttttacaatctcgaatttcatcgttggtttcgggctcgctgtgttggagacggccgccaatccattcatcgctctctgcgggccgctggagaattccgaaatccgtctcaatatctcgcagggtgtgcaggctattggaagcgttgtttcgcctcttctggctaaaaaggtntgg

SEQ ID NO: 22132 - DNA, 321 bp, A.fumigatus
accaatggaaccaactccaagtgggcaactgccgtcgacggcctgctcaacaacaccctcgatattttcttccccgccaaatacggcggcaacatcatgtccgaggtcctctgcgagccgaacgaagtctgtaacgacaacgagatcctcttcaagggcctcgtcacatcctggctagcgtttacggctcttctggtcccctccacctacgacaggattctccccaagctgcagggatcagccgtggcggccggcgcaacctgcacgggcaacggtaacaattcctgcggagtgcgatggtacacgtccaagtgggacggg

SEQ ID NO: 22133 - DNA, 198 bp, A.fumigatus
ccacttacatataccaaaataaaaattaacaacaaaacaaataactctccacccatctttacaaaacacaaccaccaccaaacaaaaaacccaaattacattcaacaaccaaatatcatccaccccccaacttacaaatactccattattacaacaacaaataaacccatcaactttccattttccatccaactttaa

SEQ ID NO: 22134 - DNA, 183 bp, A.fumigatus
caagaaaaatcatatccactaaatccctccatcattacccccttaaagacgaactcctctaaaatcaaatccatcacccctctaaaacctcaacttatccaacaactaatcaccataactcctggagctgatggtcaatttaagcctttcagggggcgcattgtttgcttctggggtccttaa

SEQ ID NO: 22135 - DNA, 525 bp, A.fumigatus
acattattgcaagcgatcctgggacatatgtgccctatcaggctgagaaattgccgccttgcgaggagttcacagtcgctgttctccaaggaagcgtgcccctggctgaggagcacagatcacgtattggccatattcgagaaaccagtacaaaccaaggaaattttgggcccgaatgattctctccgagacgaccacagaagaaatttctttccacctaaaaagctacatattcttcttgaatccccacatcgccactggttccggctatccgcatgtcgtcccctggggtgggtttcccacctctttcccccctcccttctgttccgctcttcctcggaaccgcttgaattacccccgcgggttttccctgctccctcatccttctggttacaattttctcccagccttcctccgaattctccaccactggaatctcctttacctcctccacataaaacccccccctttatccccccctccgttgttatgaaagggttccccttccaccccacggggccctcc

SEQ ID NO: 22136 - DNA, 405 bp, A.fumigatus
gagggccccgtggggtggaaggggaaccctttcataacaacggagggggggataaaggggggggttttatgtggaggaggtaaaggagattccagtggtggagaattcggaggaaggctgggagaaaattgtaaccagaaggatgagggagcagggaaaacccgcgggggtaattcaagcggttccgaggaagagcggaacagaagggaggggggaaagaggtgggaaacccaccccaggggacgacatgcggatagccggaaccagtggcgatgtggggattcaagaagaatatgtagctttttaggtggaaagaaatttcttctgtggtcgtctcggagagaatcattcgggcccaaaatttccttggtttgtactggtttctcgaatatggccaatacgtga

SEQ ID NO: 22137 - DNA, 549 bp, A.fumigatus
  unsure (17): Identity of nucleotide sequences at the above locations are unknown.
ggtcgtatcgttagctncgtccctgcggagaagaactcgcttgcacgccccaccctttctgttgttcaagcctgtcttttgctggcctacgaacaattcggatcgaatcatgacagtggtctctggatgtatctaggtattgccattcgaatggctcaggatcttggaatgcagaagctgcagggactgcaacacagttatgggcggaggggcgtgactccaagtgcagttgtgtctggacgggcagggcagctacgggaggaagaatatgatcaaagcaatgatgctcaagtcccgttaagcccaggcgccgagatgaatcatagtgaggaccatcgcgcctgggagcgtgagaaagtcgacacgttctggagcattttcttcctggatcgtgtaatctcctctggtactgggaggccagtcacgctacgggacgaggaaatagagttatgtttcccgctacagtcagaatcgaaactatcgaacggctggcctgcaccgttcccaccactcattcgcatcatacacctttacggaagagtcacggat

SEQ ID NO: 22138 - DNA, 183 bp, A.fumigatus
ccgaatagcaccggatcgaacgtggctatcgtccccgctgcatctttgccagcatattcggcatccaaggctgcattgaacgtgttcaccttgtctctccgtgatcagctgcggaattccaacgtggcagtgattgagatttcacctccgccagtgcagagtatgccatcccagcacccttga

SEQ ID NO: 22139 - DNA, 489 bp, A.fumigatus
  unsure (207),(235),(299): Identity of nucleotide sequences at the above locations are unknown.
gacgcgttccctgtacccggtagtgaatacaaggcccgtggtgttaattgggttgtaattggcgactggaattacgttgagggaagctccggtgagcacgccgctttggagcccagacaccttggtggtctcgctattatcacccgcagctttgcccgtattgtaagtctttctggccctcattttgcaatctgcgtaataatactnacttttctttcacagcacgaaaccaccntgaagaagcagggtatgtttcctctcactttcgctgaccctgccgattatgacaagatcaaccntgaggacaccgtcgacatcctttgcacccagctcgaggttggcaagcccatgactctccgtgttcaccccaaggatggcagcgctcccttcgacatctccctgaaccacaccttcaacgagtctcagatcgagtggttcaaggatggctctgccctcaacaccatggcccgcaagtccggtgccaaatag

SEQ ID NO: 22140 - DNA, 234 bp, A.fumigatus
ttggattggcaaagaagccccacgggaatccctattctttatacaagggccggggcaaggataccacccattcacattttccatggttgccccatggttgaagtaaccgtggccaccttgaacaacaatttaaccaacatgtggattgttctagtcaacgtggagaacggcaaggccaatccgttcaaggacaagttcattggggaggtaagacgcgttccctgtacccggtag

SEQ ID NO: 22141 - DNA, 303 bp, A.fumigatus
ccgggccacattatcccgctcgaggcgaaggacggcggcgtgcgtgagagaaagggacacacggaagcggcggtcgaattttgccgcctggcgggtaagtcgcctgttggtgtgattgccgagttggtcgaggatggtgatctcgttgagggaatccccgagatccggggcaataatggtatgatgagacgcgatgggtgcttgaagttcggcaagaaatggggtatcaaggtgtgcacgattgaggatttggtggagtaccttgagagaacggagagtcctttgccgaatgggaagcattga

SEQ ID NO: 22142 - DNA, 243 bp, A.fumigatus
gcagacaagacgccatttgggtacaatttctttctgctggacaattctcatacagccatgtcgtcccccttgccgagccaacgccactatttgtttatgtgtctattattagatattcacgggaaaggtgagctgacttgtacgtactctgtctactcgaacgccctcacctttcttcagctgcagagccgtggagcggaactccttgcttccccgtttacatacttgggaattgaaatcatg

SEQ ID NO: 22143 - DNA, 261 bp, A.fumigatus
gcttcgacattcaccgtgttccaagtacttggtggattagaagcaatgcgagaagaaccgtcctctgctcagctattcaagccgctcaaggtgggaagatgtcatctccaacataggatgatcatggcgccgacaactcgattccgggccgatggacagggggtcccgcttccttttgtacaagagtattacagtcagcgtgcatcggttcctggcaccctcctcatcaccgaagcaacgtcttcaccacgggctgagatc

SEQ ID NO: 22144 - DNA, 192 bp, A.fumigatus
ggaatcgagatgtccgactgctcgctctccatcacccccatcatttggatttcgtacatccggacccgcggcacaaaaagcttagactgtttagtgacagtgaatggaatcggcgcgttggggtctttcttcgcaatgcgccgagcttctctgtacgtctctggattccagtatgaaatatcaagccagtga

SEQ ID NO: 22145 - DNA, 480 bp, A.fumigatus
ggagactttcacagcaccggttattcgcatgagatgagccagtcgttcagtttcgagagtcggactccccatatatcaccaaaatctaccatgcaaggctcgtttccaggaatgacccgcaaggagcatctttccgctcgctcagacgagtggaaatacggcatacctcactggcttgatatttcatactggaatccagagacgtacagagaagctcggcgcattgcgaagaaagaccccaacgcgccgattccattcactgtcactaaacagtctaagctttttgtgccgcgggtccggatgtacgaaatccaaatgatgggggtgatggagagcgagcagtcggacatctcgattccttatctattggagggccagggcgtttcaccgcccctcaaatgctggtctcggtttgggcccaagtgtctttcatatagggttccttcagacgcaattaggtattcaccacgggtggagatc

SEQ ID NO: 22146 - DNA, 333 bp, A.fumigatus
  unsure (140),(174),(175),(190),(271): Identity of nucleotide sequences at the above locations are unknown.
atcgcaacgaggcatactttgccaaactgggttccgaaaacgcagcgcgctcggcctccctgccgccctcgcaggacggggaaatacaccagcttcagcggcggctttgcccccacggcaagatctaaaacatccccccncgccccgggcggtgccggggcctccacaatttcnnataaggatcccgtcnggcgcgctaaacaaaagggtttggctgggtttacaacagctgtggggaataagcgcgaaaaacggtcaatgaatatgtatntcccaacccaacggcgaaaaaccgttacccccgcccccttttcctggttggggaaaaattaa

SEQ ID NO: 22147 - DNA, 234 bp, A.fumigatus
gcctcacctaagttcggaaccttcatctgcctaaactgcgccggcacgcatcgaggattgggtgtgcatatctccttcgtccgctccatcaccatggatgccttcaaaacgtccgagatcctccgcatggagaacggaggcaacgacccctggaagaccttttacgacaaccaccccatcacgcagtccgaaggccggaccttcgaagactcaaccatcaacgaacggtactaa

SEQ ID NO: 22148 - DNA, 867 bp, A.fumigatus
  unsure (65),(69): Identity of nucleotide sequences at the above locations are unknown.
tacgtattcccaaagaaaaaggaagtactggttctcgaagagatgatgaaggatgcagagggcanaganagagagcccttgaggcactaccgaaccaagacaaagcagtggtttgacctggacgatcgagaatatcaacgtttgcgacgcagtcgagagcctttcttgcaacaatgctttgagaactatttgctttgcctcaaagaaagcgacatgtataacaatgatgcgctccgcttctgtgccttatggcttggcaaatccgatagtgagatcgcaaacaaagctgtctccaaatatctcaaccaggtcccgagtcggaaattcgcgccactgatgaaccagcttacttcccgtctccaagacacctctgacgattttcagaatatgctctttgcattgattttccgcatttgcgtcgagcatccgttccatggcatgtaccaaatattcgccagcagcaagtccaagggcggaaaggacccgtcagctttgtctcgtaatcgagcggcaagcaggctggtagattgcctgaaaaatgacaaacggattgggccgacatgggttgcagtgcacaacgcgaatatcagttacgtgcggttcgcggtcgatcgactggacgagaaggtcaagagtggtgcgaaggtgccattgaagaaactcctgacgggccagcgactagagcaagacgcttcgacacaaaagctgccgccacctacgatgaaaattgccatccgtgttgattgcgactacagtgaaattcccaagcttgttcgatatcatcctgagttcacggttgcatctggggtgagcgcaccgaagattgttcttcaccacgggctggaagatacgcgtaccccgtgttac

SEQ ID NO: 22149 - DNA, 546 bp, A.fumigatus
  unsure (100): Identity of nucleotide sequences at the above locations are unknown.
aaaaaagggcccttgcttctggacgctgatcttaaatatctgtactctgcttttaccaaaatcccctgtttacgtctagcccccgaccatcgcgcccgcntaatacgtgggtacgaggagtttccctttgacactgcagttcctctccatgctttcaaaaacttgagcgtattagagattatcgatatagactaccgctcattcttcggctgggaccgactgtcggagcagttgcgaacattgactctaaaaagggcgaacgtcgaggacatggcagatctgctgaccggaatcgtgcttgatgacattgataaacgccgacgacggtcgtcgaaggctcagcattcgccagttcttggatggaacggaaatgcccatcctcaaccagtgcataagcctgatatttcaggctccgtttccgctcccggctcgccagtcgttgaaacggcgtttggaacaagcactagccccaaggcagtttctatgatgcgagtcggctctgaaggcgctgcccccgggcgagcacggactgaaagcgtttatctt

SEQ ID NO: 22150 - DNA, 342 bp, A.fumigatus
tgccgacacctgtcccagcgccacactcagcgaatgactcgtcgactgaatctcccggataacagcggtattctctatttgtacatccagagtgatcgagataccctgcacatctgcgtcgggcggcatgctcatattccccgggtgatagccataccgcggcgcaatggaattaggcagcgtataccgcaccgcgtcactctgcgcatcctgcttcagctccccgacaagcgtaatctgtacgacaaccgtctctgcaggtccaacattcccaagtcggatggagagtacatccgaggcactgagcgaatgggccatcagcgccgcggactcgccctttga

SEQ ID NO: 22151 - DNA, 666 bp, A.fumigatus
agcgcattgctcgtgtccttcggccgtgtggtgaagacgagaataacaggaaggtgtttctactcgagacctggaagccgctggagtgtttccatggccaggacccttgacggcatgctcctgcaacaaaggtatcctgaatctagtgtcacggatttttttgcttcaaacactgtgattcttgttgatgaggctcaggcttcatacaaggactcttacttctggaacacgatcatcaaagagcgaaggtctggtgaaggcatgggcataaagatttgtcttttctgttcctacggaagccctctgacaggcctggagggagaccacgtatggtttactccagctacttttggtcccgcgcagcgcattacactgacccctcaacctggcaaagattcgccaaagctcggcttattttatacaccagatgaatttgatgaagctgtgtcacttttgaccacaaacaagtacgatgaaaagttcacaattgatgaagaggctatgagctacctatacgagctcacaaatgggcatcctggaagggtgacatcattagtcgattatcttcattctgtatgtaccgttcttgacctcagcccagaaagtgaacggatcggctttaggcttgcgtgtccaactaactctagtttaggtgcatcgccatga

SEQ ID NO: 22152 - DNA, 615 bp, A.fumigatus
  unsure (603),(604): Identity of nucleotide sequences at the above locations are unknown.
cgcagtttgcaatactgcctgacttggctgcggtgggccaacggtcggctgggcaaggccatcatcgctctccagggcgcgctcaaggaatgggatagcgctaaacgggagaacggcgagggtgacgcctcgttgttgtcgcagcgtatccaggctgtcaaggaggatgtcctctcgaccttgaaacaggtcgtcgatgtcgtctccaagtatgccggcggagctctaccggagaacgcgcgcaacctggtccgtcgccatctgacttccctgccgcaccggttccaggtcgcctcgacgtccaagcctcctcccgactcctctgcatccagctcagacgcaacactcggcgctcaccgcattttggtgctggcgcaggagggtttggacatgatggcacaggttagcggtgtggtcaacgataccctcgttagtgctgagctctggtgccaaagactgggcaagaaacgcccagagagggacagcaagcaaccggatggtatgcaaccgcctgactcccatcgggagcagtacccggtcgatgtcaagcagccgatacgtgaaggatgtcttcaccacggggctggaaggtgcagtctattnnaaaactccccc

SEQ ID NO: 22153 - DNA, 201 bp, A.fumigatus
aatccctcttctaagctattaagctttatggataatacggtggggctgctatcagtggacccacttatataccccttattaagatccttaaccttgttgtctgtgctctgcaacgcctataggactgctatctgcttctactactatattactataatctatatatctgtgggattaacctatagtgcccttcttctatga

SEQ ID NO: 22154 - DNA, 255 bp, A.fumigatus
atcgaaggcgaactcttcccctctagccgaagctcacgccccgtactggaccaaggctttctgcacagtgacctcacctacaacgtcccctccgtctgggacgggcgcttcttccgactagacgaccacctcaacggtctagaagccagctgcgcgaaactccgggtcaaaccactcttaccctgcgagcaggtcaggcagatcctagtggagatagtcgtgaaaacagcatccagaatgcctttgtcgaggtga

SEQ ID NO: 22155 - DNA, 228 bp, A.fumigatus
gccaaccctacggagacaggaggactctttgcactaggcctgggtgtcggccgaagtattagcgggcggctcttgaaacttagtggaaggtggaagggtcatttatatcacctataccaccatatctggaaggattcatctgccatcacgggaaagtctaagatagtcaccccatgtttccccggctccgacaaccctctgacaactcacgactctacagaggtctaa

SEQ ID NO: 22156 - DNA, 762 bp, A.fumigatus
  unsure (725): Identity of nucleotide sequences at the above locations are unknown.
gtccctgggacgaaaccccaaagaggcgccttccaaagggcaggtggttcccgatcggggtacgtcggtgtacgcaggaaaaaccaacaatcgaagagagagcaacaagttcggcaatacgtcgccaatatccagaagcaaagcaccgtcgagtcgaaaaaggacacattatcgtctcccgccaccgatgctggatcgggtgtcgcaccttcaaaagaagcgtcgacgccacgccaaccattacctcccaagcaatatcgtctacaagtccgattatttgatggaagctcagtgcgcaacacttttgcacccgcacatactatccgcgggaatgtacgcccgtggcttgacggtctactacagaatgagaaacgcccatataatcttaagcatatcttgacacccttgcctaatcgaactctcacgattgccgacgaggaacgtacactcgaagatcttggactaggatccacggcgaaccttgtgatgatccccatcaattcgtacacagaggcatatacctcgtcagggcctagcttacccgtgcgagctgcatattctgcgtacggcttgctctcctctgcagttggcaccgcgacggccctagtgggatctttcatcgggtataacccgaccccttcagactctcccgggtcttctccaacctccagttcgtctcctgggaatggaggtcggagtccacagcctgctgcatgcacagggtnttcacctaggaacgtcggcggaaccgaagttagttgg

SEQ ID NO: 22157 - protein, 199 aa, A.fumigatus
LLTWLSSSLLGYSASLRFQPTKRPQLAAQKPKPKPALPKSTPGAASAPAPPVKTTLADWAATEEDDVNGFYIGEKRQRGGRKKRKKNREAQAFVQNWDDIYDPSRPNIYEEYKHSDEQIAEVREWKDRLYAHRMARSPSRSSHSADESRPMNSKLFFAWRSTVKNAHEFFAEQFAPPQSFAPPPNLNESSPRGWKETRY

SEQ ID NO: 22158 - protein, 214 aa, A.fumigatus
CRGSFQPRGEDSKNFIDYEEYPQSAEIQNRCVSMIARLFNAPINSDDEHPVGTSTIGSSEAIMLGTLAMKRRWQNKRKAEGKDTTRPNIIMNSAVQVCWEKAARYFDVEERYVYCTEDRYVIDPKQAADMVDENTIGICAILGTTYTGEYEDVKAINDLLVERGLDIPIHVDAASGGFVVPLINPNLLWDFRLEKVVCINVSGHKYGLVYPGVG

SEQ ID NO: 22159 - protein, 80 aa, A.fumigatus
VVWRSPEYLPKELIFHINYLRAEQANFTLNFYKGASQVIGQYYQMIRLGKRGYRSIMVNITRIADYLAQQLEKLGLIIMS

SEQ ID NO: 22160 - protein, 136 aa, A.fumigatus
TAPCRSAGRKPRDTLMWRSATSTVPRTAMSLTPSRPLIWSTRTPSASAPSWEPPTPASTRTSRRLMIFWSSAALTFRSMWTPLAVALSSRSSTPICCGTFAWRRSFASTCPATSTALSTPAWAESSGAHPNTYPRS

SEQ ID NO: 22161 - protein, 76 aa, A.fumigatus
MLHVGSFQPRGEDRPVSCYTLLSGFRLPWPPSGCLDELTPFVVSDERAFRHLNLAFGSSRIASSAYQKWPTSNASF

SEQ ID NO: 22162 - protein, 66 aa, A.fumigatus
ETLITKYNTSTIIILYNKIEVITGFLPKNNINKIIYIINYNLFKLYIIINIIIGYLAPTLKNKTII

SEQ ID NO: 22163 - protein, 112 aa, A.fumigatus
MSCTGTWMTRNRGLYRSTHIRRWLKMHTRSGRLTRTLTSAKLLPMPVPEVSVSSPKSICPVVWQYHTAVQPNPGQLDIIYDKTYDIVRDVYNELSGVFTDNWFHVGADEIQP

SEQ ID NO: 22164 - protein, 133 aa, A.fumigatus
RLSIQDAPLYPYRGIMIDTGRNFISVKKILEQLDAMSLSKLNVLHWHLDDTQSWPVQINAHPEMVKDAYSVRETYSHADIRQIIAYARARGIRVIPEVDMPSRLAISYCRSTQPGPAGHHLRQDVRHRSGCLQ

SEQ ID NO: 22165 - protein, 102 aa, A.fumigatus
RLHTTTILAPYCQVSPGLRAATDQCDNKSRGLKLADLAIWDGRGAHAGAKLRMFLHDLSEYYLAKPQTFNNNINKILYATSQLSVDVKNAWQERHPKGYKAS

SEQ ID NO: 22166 - protein, 71 aa, A.fumigatus
KSGIGLPSLENKQADVNQMQCAWLGERVAAPNLNGVTTNVILGKTGGNWGPRRSDKTGAVRLWQAILDSKN

SEQ ID NO: 22167 - protein, 63 aa, A.fumigatus
TSRCPGKQLLKVPGNATTSEDCLTVNVFRPHGAKGKLPVAVYVHGGAYNRGTGEESANKHGHV

SEQ ID NO: 22168 - protein, 62 aa, A.fumigatus
  UNSURE (62): Identity of amino acid sequences at the above locations are unknown.
IAHHIMNYDLGTSLFHRAVLESGAATSRAVHAYNAQIHETQFQEFITEAGLHHGAGRSSAKX

SEQ ID NO: 22169 - protein, 86 aa, A.fumigatus
GNHCSIGALGFLPSTVSAQEGILNLGLHDQILAFQWVQENIEAFGGDPSQVTLIGLSAGAHSVWRPRRYNQRPALISIVRRSHTIS

SEQ ID NO: 22170 - protein, 144 aa, A.fumigatus
KAVLKFIAPYTRFSLSFISKHIKISVPEVQDILSYLILDKKLNAKIDQENGTVVVESASDVDRLRALQDWSASLRSLWQATLIDGEGFKSDDPAQLHGMRGGSMLQSAFGDEAPTAGLRASNFRVRTGWKGKGGQGSKAGVGAF

SEQ ID NO: 22171 - protein, 201 aa, A.fumigatus
LCNCSGSFQPRGEDYSIIVWLNPTLCIMPSVVALDLCQLFDRSVARTPHQLAVDHESGSLTYTELDVASSNLARKLKQEGVVPGEAVLLLTEHGTRNVVALLAILKAHACYVPLDRSSWSSERIQAVLDGTDSRILINTTVEPFESPRHKVIHLTSADVTTLSTDRSTTKVIPDIAPEDLACLIFTSGSTGVPKGVMIPHR

SEQ ID NO: 22172 - protein, 179 aa, A.fumigatus
HSLRQKTVHSDISKRQRHKRSAQTTVGKQATEKTRRKEKTKNRQQEKVAEHTTTKASNQEITETASTKKEEKERETTEKEGEKRRQKADQKEKQPQKRKKERQEERKRTGKKKADAQGKRQEAIRNRNDKREEKEEERQTREGRRHRIKREKEDQREQEITGRVSHHEGVKEPAKCRGK

SEQ ID NO: 22173 - protein, 147 aa, A.fumigatus
TPYVKRLYTQTSAKGKGTNDPPRLRSANKLQKKHAGRKKQRTDSKRKSQNTQRQKHQIRKSPKPHQPKKKKKSGRQQRRKAKKGDRKQTRRKNSPRSGKKKGKKSESEQGKRKPTHKGRDRKQSATETIKGRKRRRKGRHEKDEGIE

SEQ ID NO: 22174 - protein, 129 aa, A.fumigatus
SLPTSKDCTLRHQQKAKAQTIRPDYGRQTSYRKNTQEGKNKEQTARESRRTHNDKSIKSGNHRNRINQKRRKRAGDNREGRRKKETESRPEGKTAPEAEKRKARRAKANREKESRRTREETGSNPQPKR

SEQ ID NO: 22175 - protein, 70 aa, A.fumigatus
IMTFTTVWWRSYTWFNCRKPWIPRHSILSFKDLILLLELLLAFLDRKTLYSIKLPSRSLIFFKLFLMCSL

SEQ ID NO: 22176 - protein, 168 aa, A.fumigatus
HIERFDVIELSSGFLSFPEDDWLGLVDKVHAYKLKAKPELGIQFGAGGDTPASGLEAIGTSDPGKLVNMGRKFLDVGVERLMIESEGITENVQSWRTDVVSTIMKELPSERVMFEAADPKVFNWYIREFGIDVNLFVDHSQIVQLSCLRQGIWGTADTWGKVVSFRSE

SEQ ID NO: 22177 - protein, 106 aa, A.fumigatus
GFRVRLADPGRYAIRVGRSTSVNGPFQDKDGKNLTDGGGTVVYASNHGVVYAPGGVGVLPANEKHPEILYYHYRESIPSLCVWFTDSTVNTSMGLKDNVSRITTKQ

SEQ ID NO: 22178 - protein, 78 aa, A.fumigatus
  UNSURE (78): Identity of amino acid sequences at the above locations are unknown.
HAKDARLGWSYLEYKDGWPVARYVHYPKETTSTDPCRAVENSGMASRPNYILCISALIGTHSVKVFTTGLEGSALIYX

SEQ ID NO: 22179 - protein, 63 aa, A.fumigatus
TVSLIAEALTNDAYRFDGRTIRVDKASERPARNNGGFHGRGGYNQSEGAPGNGICSHQIVQRI

SEQ ID NO: 22180 - protein, 98 aa, A.fumigatus
NKVPTAEEAAEIVDTINYLRTQLSRDIEFMNLRMAIYYNQKHGSALNLKRGEKVYLLRRNIKTKRLSQKLDHQKIRPFIITEKLGLVNYKLRLPKSMT

SEQ ID NO: 22181 - protein, 214 aa, A.fumigatus
  UNSURE (211): Identity of amino acid sequences at the above locations are unknown.
IDVKADGSQEIVRPSKSGLARVSVLRGSGVHEGVPFIDDYITIKEPIVDYVTQYSGIKPGDLDPRTSQHNLVPLKVAYKKLWLLLNLGCVFVGHGLASDFRKINIQVPKSQTVDTQYLYFHPGKNRRLSLRYLAWAVFKEYIQEEPADNNQGHDSIEDARMALRLWKKFQEYEDAGIVNQILEEIFREGSKLGFRRLHHGAGRISDGHIKXPPP

SEQ ID NO: 22182 - protein, 144 aa, A.fumigatus
LPWRGSFQPRGEDSGDRIIFRFLTGAYHDWLQGGEDEDDETAEKRLVPHIESMAQEFERGNEKYMQEMQVLEAENRALRDQIEELEKNAPDMAKLDKHFRILEDDKRKFEDYNQNVQGKIEKYENSNQVLEEENQNVEAELYAV

SEQ ID NO: 22183 - protein, 86 aa, A.fumigatus
GLSRSIKSLLKLCDFCFRRYLNLNSLILDMLYILLHLFFYFKHIYLCLFFNFIYIFIGCIAYLRVTIIDLFTKFGPVCCRTNHNIH

SEQ ID NO: 22184 - protein, 149 aa, A.fumigatus
  UNSURE (135): Identity of amino acid sequences at the above locations are unknown.
GQADQIDYEYHDMDQTLVLNLNQAAINAIRAAGATSQYIFVEGNSWSGAWTWTTVNDNLKALTDPQDKIVYEMHQYLDSDGSGMSATCVSSTIGQERVQAATQWLKTNGKKGIIGEFAGGANSGSQSAVTGEPIXYSSRRGWDVTRGGY

SEQ ID NO: 22185 - protein, 62 aa, A.fumigatus
SLYLFLKVKSINSGSGDLNNARFLSLVAAYSRLTPFTEEVWLGDGLLGSGIRPLWGLSGRGS

SEQ ID NO: 22186 - protein, 130 aa, A.fumigatus
  UNSURE (2): Identity of amino acid sequences at the above locations are unknown.
LXNSMSRALHLAIFSNGTRPAHYAVFIPTGDAGKMGKLIHVTGTTATGFFLEFKRNYDFNLTQRKHQLILLAQVNAQYITDTVGTGQQSADTIARDRLESVATTVPPPGRSANPFDPSVSRPHRWNSHAY

SEQ ID NO: 22187 - protein, 135 aa, A.fumigatus
DTMLDPFFADRYLDNKYGMGTSAERASAMTDYYKRGLYIPGLRVNGMDVLAVMAAVKHGREFIRAGNGPLVYEYVTYRYAGHSMSDPGVGYRTRGELKAERASDPVSNFRAQLIDWRIITEAEASSLTEDARIRA

SEQ ID NO: 22188 - protein, 120 aa, A.fumigatus
RLVSARYISQTARVAANGSNILRRQLPSPLHGRCSAAGIAPRFTAGPSVHSQNAVTRRYASSTASGPVKKTQLYDLHIARGAKMVPFAGYSMPLQYSDLSHVESHHWTREKASVFDVSHM

SEQ ID NO: 22189 - protein, 160 aa, A.fumigatus
  UNSURE (94),(128),(129),(139),(140),(144),(157): Identity of amino acid sequences at the above locations are unknown.
VLPIPAMLIFEDTLNLTLGRVQHHLSGPGAMELLMKVTPSSLDKLKPNSSTLSCLLEEGTGGIVDDTVITRLDGDAFYFVTNAGRRTEDLAFLXAEIEAYRQTHGADSIKWENLADRALVALQGPLAXXVLQPLISSHXXGLPXDTDLNTLYFGNWXSPN

SEQ ID NO: 22190 - protein, 65 aa, A.fumigatus
CTEFIKLCREDGVVDFSVMAGRELCYGCSFDLDVLPIPLIYDSMVSKDHDMIRSLEILSYPRVRL

SEQ ID NO: 22191 - protein, 139 aa, A.fumigatus
RLIRNITEHGVIAVGVGMNVSQPGDVSNAIFPALRNAAITMQIGTHWNETAPWSQMLEDQYKMTNEYVPQLEAVTPGSGCYQNEANFRQPNWKDTFFGVNYSPLLKIKQKWDPSYFFYALKAVGSDYWTVDDSGRMCHA

SEQ ID NO: 22192 - protein, 113 aa, A.fumigatus
  UNSURE (102): Identity of amino acid sequences at the above locations are unknown.
RQQVLIIAMAVSFGIQSWIEGGVIGAVIGLNIVVGVYQDYAAEKTMDSLRSLSSPTGTVTRDGKTSTIPANEIVPGDMIELKVGDTVPADLSCVKSYQKNIXSRSLTGRIGLV

SEQ ID NO: 22193 - protein, 90 aa, A.fumigatus
  UNSURE (5),(6),(7),(8),(9),(10),(11),(12),(13): Identity of amino acid sequences at the above locations are unknown.
TLETXXXXXXXXXEDRYEDVLRELAVDPDQGLTVGEAKRRLQQYGPNELEGGEGVSIVKIVIRQIANAMMLVSLSLLLDRQRQTTDDSRS

SEQ ID NO: 22194 - protein, 78 aa, A.fumigatus
  UNSURE (65),(66),(67),(68),(69),(70),(71),(72),(73): Identity of amino acid sequences at the above locations are unknown.
QKGETNQHHGICDLPNDNLDNGNTLSPFQFIRTILLESSLRLPHGQTLVWIDGQLTKDILIAVFXXXXXXXXXSFKGS

SEQ ID NO: 22195 - protein, 71 aa, A.fumigatus
RHAFSRHMSLLTPAGAIALTVHPLRPKSAAKQRVNPSMAALLPAYSAWPGTPSPAAIEDMRITRPPGWMWS

SEQ ID NO: 22196 - protein, 216 aa, A.fumigatus
  UNSURE (202),(212): Identity of amino acid sequences at the above locations are unknown.
SSPQPQRSPFVTAGGPRHRAGIGLELGRRRGLRGNQLRPKRQVGPRGGRSNPGHRPPAGRHPAGFDVRAQHRVVHPEGRRPLGRVEHCGVQFRHGKVQALGGDHAGGLQRGVQSQHAGADVRRALRLRPHPAGGAGDPHVLNCRGAGGAGPRAVRGQQGGHRGVHALLGGRFWAQGVHSQCDRAGGGQERHVAGERMSSPRXWKYSSVSFKXPPAR

SEQ ID NO: 22197 - protein, 205 aa, A.fumigatus
  UNSURE (191),(201): Identity of amino acid sequences at the above locations are unknown.
PPAARGIGPALASNLAVGGASVAINYGPSAKSAQEVVEAIQAIARQPVAIQPDLTCVPNIESFIQKVVGHLGGLNIVVSNSGMEKFKPLEETTLEDFNEVFNLNTRAQMFVARYAYDHIQPGGRVILMSSIAAGLGVPGHALYAGSKAAIEGFTRCLAADFGRKGCTVNAIAPAGVKSDMWRENACLHHGXGSTAVSVLKXRPPG

SEQ ID NO: 22198 - protein, 207 aa, A.fumigatus
  UNSURE (5): Identity of amino acid sequences at the above locations are unknown.
QLIFXMRLLIIKRNTAIPTKKSETFSTYSDNQPGVLIQVYEGERARTKDNNLLGKFELTGIPPAPRGVPQIEVTFDVDANGIMNVSAVEKGTGKTNKITITNDKGRLSKEEIERMLADAEKYKEEDEAEAARIQAKNGLESYAYSLKNTISEGKLNISDADKEKVSSKVEEIISWLDNNQTATKDEYESQQKELERYVSFLSLLMFT

SEQ ID NO: 22199 - protein, 189 aa, A.fumigatus
NIPFKLLLLGLVLVLGGSLVVVEPADDLFDLAGDLLLIGIADVELAFADGVLEGVGIRLQTVLGLDTGSLGLILLLVLLGISQHALNLLLRKTALVVGDGDLVGLAGALLNGRNVHDTVGIDIKGDLNLGDTTGGGRNAGKLELTKEVVVLGTSTLTLVDLDQHTGLVVGVGGEGLRLLSGDGCVALDY

SEQ ID NO: 22200 - protein, 76 aa, A.fumigatus
  UNSURE (55): Identity of amino acid sequences at the above locations are unknown.
LLSTITISKSTIILIILSIFFTPINIYLKLTLYLKKEVITITMLLIKSLNLINYXLCFPIIIIAYDFLLLILVRVI

SEQ ID NO: 22201 - protein, 83 aa, A.fumigatus
HYFLRTPSQCDRALINTKLSTEQEAALIKYINILIKLDIPLWLKAISNTVNSILFYGHTDPITPPPLISVHWMKCFLKYYLEY

SEQ ID NO: 22202 - protein, 90 aa, A.fumigatus
APFAEDEKNGWKQILTHTSIAIDLLKKMLVIDPDTRISAQDALRHPYLAPYHDPTDEPVASGPFDWSFDSADFPKETWKIMMSVFAFRLH

SEQ ID NO: 22203 - protein, 73 aa, A.fumigatus
RRQRYGVQVDVWSAGCILAEMLRGKPLFPGKDHVHQFHLITNILGNPPDAVIEKITSKNVSALDSPSQDSPPH

SEQ ID NO: 22204 - protein, 188 aa, A.fumigatus
YRYARCSAPGVKEQYTRVYLDDTPWAQSTQAPKQWHGAPLPTIRKAIGALGSPRIGRVPQDMVMKLTILRDLYYLDDEEEAERRYQLQRPSQDDDYHYQDSDEGDDDNGKEEEEEEDEDADDDDDDETEPGTKGGKRCPKWTKQEARYPKRQRQRESRFEWDLGPDATAEDAIRKFGPVLLGPGRRLK

SEQ ID NO: 22205 - protein, 152 aa, A.fumigatus
PIPAPSSPLHALWPIPPTHAGGPRTTRARNGRQPSLQLPKRPQPPPPCTAPPDHPRPHAALHLRAARAARPPLRPRLRHPRRLPLPSLATGRLVPPHPVPHPQGQAADAGGELDLRRPRPSSQLDAPAPLLARRLLAVFFCLRALARRGTHG

SEQ ID NO: 22206 - protein, 185 aa, A.fumigatus
RRKTLLLLLGRGPWMALNLPENREYRIDFLGPHDRYLPHHLLCMPCGRYHRRTQEGHERLEPATVVNPLYNCPNARNPLLPAPRHRITHARMLHFTFVQLALRAHRFGPAYGIPVDSLSRRWRRDGWSHHTRYHIHKGRLLMRVVSSTFADPDLAPSSMRLLLYSRDDYWPYFSVCAHWRDGELM

SEQ ID NO: 22207 - protein, 70 aa, A.fumigatus
AYINKTIQGILNEFCVVYLDNILIYSQMEEEYEWYIKKVLQHLNSANLYAKLLKYKFYKTEVKFLSFLIG

SEQ ID NO: 22208 - protein, 198 aa, A.fumigatus
  UNSURE (14),(126),(175): Identity of amino acid sequences at the above locations are unknown.
GGRIFQPRGVNNSXEQGLKNVMVNYNPETVSTDYDEADRLYFENINLETVLDIYQLESSSGVVISMGGQTPNNIALPLHRLNVKILGTSPEMIDSAENRYKFSRMLDRIGVDQPAWKELTSIEEAXGFCDKVCYPVLVRPSYVLSGAAMNTVYSEHDLATYLNQAADVSREHPVXITKYIENAKEIENDAVARNRVMV

SEQ ID NO: 22209 - protein, 168 aa, A.fumigatus
  UNSURE (43),(155): Identity of amino acid sequences at the above locations are unknown.
NISGLVEIGSKIVLGIDGVHGSSRKHVGGPDKHWVADLVAESXGFFDAGKLLPGRLIHTDTVKHARELVTILRAVNHLRRGTQNLDIEAVEGQGDVVRGLTAHRNDHATRGLQLIDVENGFEVDIFKVQPVSLIVIGTDSFRVIVDHDILEPLLXGIIHATRLEDTPP

SEQ ID NO: 22210 - protein, 201 aa, A.fumigatus
ARPKAILASQPSLPSSDFTAGDVRSATFAANGHSPMTFQGPSHQYEEHKQQTGLPPGALAQAMNFNQMAGVTFGNASPAYQMNGDMFASSHMKREDTSFDFNNMSSRNPSEMDLESDGMGAIPYYLSPNVSKNQFIDPNALGGHEVVSAGPSTQVGRMYPGMHQQQAAMAKAAQQQQKQHEMLRQQQFQQVFTTGLEGAAP

SEQ ID NO: 22211 - protein, 96 aa, A.fumigatus
RKHKMKLPFVLFTALYASCALAAALPPDHVDADKAILLLADGTTKTIEKTDLASHLNGTLLEAPTDNFPRSIKSVNFNSLEARGGRLHHGAGRSRT

SEQ ID NO: 22212 - protein, 135 aa, A.fumigatus
ISIGVSGAPDPVHVEIQQRALPNAPDGYTPSTVGCPASRPTIRSAASLSPNETSWLETRRGKTTSAMKDFFNHVKIQDFDAAGYIDRHSSNSSDLPNIGIAVSGGGYRALMNGAGAIKAFDSRTPSSPRGWKDAR

SEQ ID NO: 22213 - protein, 66 aa, A.fumigatus
FYLFTPIIGMLILFIRVNKSNLNLTNTMVVNLAEVSKYLSIQSYYLLRIIVRQDLKSNLLLTYIIN

SEQ ID NO: 22214 - protein, 114 aa, A.fumigatus
FREKVINMLLKMVNIEHTANTVIGNQFIRGVSGGERRRVSIAEMMITSATVLAWDNSTRGLDASTALDFAKSLRIMTNIYKTTTFVSLYQASENIYKQFDKVLVIDSGRQVFLR

SEQ ID NO: 22215 - protein, 279 aa, A.fumigatus
RNQPPNRRYHRTAASPRISSNSCPPPPPPPPLPHPPPPRPPSPHAPPPPAPPPPPPPPPHPPHPLLPPPPPLPPPSPTPSAESNHAQRHALIAIPPTSPPRPPPPPPSHAPPPPPPPPPPPPRPPAPPPPPPPPPPPHLPSPPPPPHPPPPPRHPPLPPPPPPPPPPPPPPPPPPPPPPPPPPPPPAHPPSPPPPPPPPPAPPAPPPSPPPPPPAPLPPPPPPGPPPAPPTPPPPPPPPPPPPPPPPPRPPPPPPAPPPPPPPPPPPPPPPPPPRPPPP

SEQ ID NO: 22216 - protein, 146 aa, A.fumigatus
  UNSURE (8),(12),(13),(14),(15),(16),(17),(18),(19),(20),(21),(22): Identity of amino acid sequences at the above locations are unknown.
ASEFLDRXSNLXXXXXXXXXXXLAGLYIPTALALLLLAVNASTSIEVKLTLTMLNNVINHRTADTTEPPLRREYHRILAPPPPPHPPSPTPPPPAPPPPTPPRPPPPHPPPRPPHTPPTRSSRLPPPSRHPPPPPPRNQTTRRDTR

SEQ ID NO: 22217 - protein, 187 aa, A.fumigatus
SPSPPPPPPAPPPPPPPTPPRPPPPPHRPPRAPPPPLPPPPPHPPPTSPPRPPPPTPPPPPATPPCPPPPPPPPPPPPPPRPPLHPLPHPPRPPPRTPPPPPPPPPPPPPPPPPPPPPPPPPLPPSPPPPPPAPPPPPPPPPPPPPPPPPPPPPPPPAPPPPPPPPPPPRPPPPPPPPPPPPPAPPP

SEQ ID NO: 22218 - protein, 277 aa, A.fumigatus
STTEPPIPPNRRFAANIIEFLPPPPPPTPPPPPPPPPPPLPPRPPAPRPPTPPPAPPTPPPPAPPASPPPPATLPHPLRGIKPRAETRANRHPPHLPPPPPPPPPLPRPPAPPPPPTAPPAPPRPPSPPPPPTPPPPPLPAPPPPPPPPPPPPPPAPPPPPPPPPPPPPPAPPSTPSPTPPAPPRAPPLPPPPPPPPPRPPRPPPLPPPPPPCPPPPPPPPRPPPRPPHPPPPPPPPPPPPPPPPPPPPPPPPRPPPPPAPPPPPPPPPPPPPPPPP

SEQ ID NO: 22219 - protein, 188 aa, A.fumigatus
GGGGAGGGGGGGGGGGGGRGGGGGGGGGGGAGGGGGGGGGGGGGGGGGGGGGGGGAGGGGGGEGGRGGGGGGGGGGGGGGGGGGGGGGGGGVRGGGRGGWGRGWRGGRGGGGGGGGGGGGGGQGGVAGGGGGVGGGGRGGEVGGGWGGGGGRGGGGARGGRWGGGGGRGGVGGGGGGGAGGGGGGDGD

SEQ ID NO: 22220 - protein, 276 aa, A.fumigatus
GGGGRGGGGGGGGGGGGGGGGGGAGGGGGGRGGGGGGGGGGGGGGGGGVGGAGGGPGGGGGGRGAGGGGGGEGGGAGGAGGGGGGGGGEGGCAGGGGGGGGGGGGGGGGGGGGGGGGGGGGGRGGWRGGGGGWGGGGGEGRWGGGGGGGGGGGAGGRGGGGGGGGGGGGAWEGGGGGGRGGEVGGMAISACLCAWFDSAEGVGEGGGRGGGGGRSGWGGCGGGGGGGGGAGGGGAWGEGGRGGGGWGRGGGGGGGGQEFDDIRGEAAVRWYRRFGG

SEQ ID NO: 22221 - protein, 285 aa, A.fumigatus
GGGGGGGGGGGGGGGGGAGGGGGRGGGGGGGGGGGGGGGGGGGGGGGGWGGRGGGRGGGGGGGGQGGGGGGRGGGRGGRGGGGGGGGGRGGARGGAGGVGEGVEGGAGGGGGGGGGGGGGGAGGGGGGGGGGGGGGAGRGGGGGVGGGGGEGGRGGAGGAVGGGGGAGGRGRGGGGGGGGGRWGGWRLARVSARGLIPRRGWGRVAGGGGEAGGAGGGGVGGAGGGVGGRGAGGRGGRGGGGGGGGGGGVGGGGGGKNSMIFAAKRRFGGIGGSVVDYVIKHCQG

SEQ ID NO: 22222 - protein, 181 aa, A.fumigatus
VVTHCAAPSAPVVKTLLANSTFANHPYAQKQIMEACTSILNDRFFSTSDQVENCIKPYKFEIEVEDPEWAKGRENVSRVLKEELKACDAAYRRVEEAVGKKKFKDVMAFVDKVRKGEVVLEGDGAAGAGGFSSALLNKGMLCLSQLTVPARVLTKRTGREGVFLRDRADLIKMRLLAIRSK

SEQ ID NO: 22223 - protein, 69 aa, A.fumigatus
  UNSURE (59): Identity of amino acid sequences at the above locations are unknown.
FPRLINNSSSVNTFAKIIIYYYLVNSLKPKLLIRTNIIYNKGFMLNFKFSIIVLSSYIXSTQGPKIRAS

SEQ ID NO: 22224 - protein, 79 aa, A.fumigatus
VYAFPVDSISDLLTDISSRMGKGGSSGKDALGIAEGNRMIFDHVSVSWGRDETFSINGDASNITSSPRGWKDAQERKQS

SEQ ID NO: 22225 - protein, 121 aa, A.fumigatus
ASIATSISRSNNEPEHTNHQQQQPTPTNDFDDHLNNFPSPQTISSFIPADLLRIDTDSFPDFISPDPNISSVPELDVDWTDELLGGTELSSEYPETGSVSHSHGGITGDLDRDLGLALDSY

SEQ ID NO: 22226 - protein, 145 aa, A.fumigatus
LTIIIDYHYCHIFLSFLYFVWNDYSLLQVVMASSDSATRPSFNADQPDSQSQLLQPESTLTVGQSVTLTLGNDALVIVGEQCLTIHACMSWLHIAHTNQLLVLLTDDRSTQKPDRGCCGLLSNSSRFFQYSSFYLVNISVCLGYQ

SEQ ID NO: 22227 - protein, 82 aa, A.fumigatus
  UNSURE (79),(81): Identity of amino acid sequences at the above locations are unknown.
VDNTETKETQSIALYNILHAEVSSAGLTITYADPVTKHDVTVGRLAIHHCRRRQSKGRNICGQGLHQGLEGAALSGYQXSXS

SEQ ID NO: 22228 - protein, 137 aa, A.fumigatus
  UNSURE (106),(107): Identity of amino acid sequences at the above locations are unknown.
LGSFDPRGEDRADYSYLSQQLASATPSGTKKSEYTPANSALQSCPPVNGDWLATASPLPPSPNGDLCSCMEESLSCVLKDTVSGDQIEKLFGTVCGYDVCEGVDYXXPAYNPQTPPGGPPSMERTVSAAPSSSCLMP

SEQ ID NO: 22229 - protein, 68 aa, A.fumigatus
SNYSTMLTLWFPRLINNSGSTNAFTKITIYYYLVNSLKPKLLIRTNVIYSKGFMLNFKYSIIIISSYS

SEQ ID NO: 22230 - protein, 83 aa, A.fumigatus
RSLLLVYLVSKLAVYLKTDLLANYNFIFNLLDGSTLNRATIYIYIVNYKFSFIKVCNKTPTLIIVTYYAYIGTISNTNFITAY

SEQ ID NO: 22231 - protein, 277 aa, A.fumigatus
  UNSURE (29),(36),(68): Identity of amino acid sequences at the above locations are unknown.
PQNAIERRSRNCPPKVLISSLLLSPPILXTMTGPTXISILGQESIVADFGLWRNYVAKDLISGCPSTXYVLITDTNIGSIYTPGFQKSFEEAAASVSPSPRLLIYNAPPGEVSKSRQTKADIEDWMLSQSPPCGRDTVVIALGGGVIGDLTGFVAATYMRGVRFVQVPTTLLAMVDSSIGGKTAIDTPLGKNLIGAIWQPSRIYIDLEFLETLPVREFINGMAEVIKTAAISSEEEFTALEDNAETILSAVRREVKPGQRRFGLHHGAGRIRGGALN

SEQ ID NO: 22232 - protein, 155 aa, A.fumigatus
VPSFVKDCASILPVHNEFQPSASLPNRQRRTPAQGQNSGGAPLAGPSQSFVDPSYNLSSGPETVGSGTDMDLSPGFDDNGNPISEGSTSSAVKSSSNTSYVGASSTSSPKVRQHSPLNFSNRTPSHTLGSSESVHAPSGTAKSSPRGWKEPRSRA

SEQ ID NO: 22233 - protein, 137 aa, A.fumigatus
TSQAPDLHYHDGTYYLYYAVSSLGSQNSAIGVATSKTMEAGSWTDHGTTGIESTPSSPYNTIDANWIAVGGTQYVNFGSYWNNLFQVEMENGLKVKSGATPHQIAYNASGIHRQEAAFMFERNNYFYLTFSGGIALG

SEQ ID NO: 22234 - protein, 114 aa, A.fumigatus
SADPSTPVVKTTQRLYHRPRRQDQPLGMLPFPFTSVMPPKHPRPPTCTTTMGHTTSTTRFPRSARKTRPLELQPPRPWKRAAGPTTARPASSPRPPARTTPSTPTGSPSAAPST

SEQ ID NO: 22235 - protein, 83 aa, A.fumigatus
  UNSURE (83): Identity of amino acid sequences at the above locations are unknown.
VYCGAVIELRCVIGKAYRILFFFKFKVSFLDIYIVVSEKRVQVPEAIYRIATATRALDTCHNSTVCEVLICLCTSCRLNVKDX

SEQ ID NO: 22236 - protein, 60 aa, A.fumigatus
SFQPRGEDTTIDKVVKVNVFLSDMDNFADMNSVYMQYWGDVKPCRTYVTSRLCIPVLWGI

SEQ ID NO: 22237 - protein, 132 aa, A.fumigatus
GIFTHTTSMISGTLTEALELDNHYLRYHADKARRIKERGTKCCKTAPEAMDGAIELLEELCVPNTLYPDSITQPYTLIQYSTSYLPERYPSMFRKTATGIANTITGESFNTTQRPLPEDPMTTCARLIQDDL

SEQ ID NO: 22238 - protein, 67 aa, A.fumigatus
LSADPWRLVEKIHQIVRLTYFSEDLSRHVIVQVAKAIEYLHETSGVVHRYVPSNISDLYIYICDNQY

SEQ ID NO: 22239 - protein, 114 aa, A.fumigatus
QPVLIMSLSSDIKPQNLLFYPIPFVPSKNPRPVQPGDEEKVDEGEFIPGVGSGGIGTIKIADFGLSKVIWDSQTMTPCGTVGYTAPEIVKDERYSKSVDMWALGCVLYTLLCGF

SEQ ID NO: 22240 - protein, 117 aa, A.fumigatus
IMLTATAILQALALMSLVGNIPLSLSELHALSSDILDLAGDTSVDASWYTKRLSVSAIYASAEVFMTRDSSPDLSATQAFVDRRIEDNKYIGDKITGIKQCLGFMGFTAIGLGGVGV

SEQ ID NO: 22241 - protein, 127 aa, A.fumigatus
RSSKLQRLAKLLPDRLICNGKYSPTGKSNRKKVYLIQCWNSTSDYESNIHSTYIPHFSCSLYPSRLDLQTPTPPSPIAVKPMKPRHCFIPVILSPIYLLSSMRRSTNACVAERSGLESRVMKTSALA

SEQ ID NO: 22242 - protein, 65 aa, A.fumigatus
LMQRYRPLSSFFIKSTSATAGLDNSLIYPFLSILLRYLHRASSFSYNIVNRGLYSSNFLLSSYIL

SEQ ID NO: 22243 - protein, 102 aa, A.fumigatus
FIMPLQTYHHTSSIKGLSSITTLIVGASESILVDPPFLIPDALSVVRWIKETTENPLKAVFVTHHHPDHFFSANPILDAFPSAKFYAASYVLEGINREYDDK

SEQ ID NO: 22244 - protein, 170 aa, A.fumigatus
  UNSURE (106): Identity of amino acid sequences at the above locations are unknown.
VNGSGQLENSGLPKKPVSKKIVLPEFGFFKNPSWFHKQRAYSSWEGVFLFGSSIISSKAQAHGVSTNWSYQMVAFLNVGSVLEEAIPGFIADFPGRFNALIVTVAXCFLCNACLWLPAAGNVPLMIVYCVIFGFASGSNISLTPVCIGQLCKIENYGRYYATAYTIVSFG

SEQ ID NO: 22245 - protein, 140 aa, A.fumigatus
YSHRDSNCWRDSQPLQWRILGSDCLYNLLLCPGSRMRHCSEVNSCWLASTVGRLLNPLSFECLFRRLPAYLHPKKHQKMQQQLQREIDGSYGRTAGSQPTDKKNTRDPQNRNLENNFSSNYATGRRTRSLVQDDDEMIQM

SEQ ID NO: 22246 - protein, 62 aa, A.fumigatus
WLTDAWISTLTGIPIAGEILSRCNGEYWGLIVFTTCCYALGLACVTAAKLIHVGWRQPWDVY

SEQ ID NO: 22247 - protein, 67 aa, A.fumigatus
LMGDSLPLNVPETPAFGREAFQHKIKLLVEGVAYDDTYTLNTQSGTQWDGFRHGLHHRGRRIRAMRI

SEQ ID NO: 22248 - protein, 68 aa, A.fumigatus
HTPHPTTTHLPPPPPTYSPPPPPPTRSPLPTPPPPPPHPPPPRASPPPPPPPPPPPPPTPPPRPYIFD

SEQ ID NO: 22249 - protein, 146 aa, A.fumigatus
  UNSURE (66): Identity of amino acid sequences at the above locations are unknown.
ILTTPPPPRAILPPPYGPHPPAQPRPYHATPPRPPPSPTQSPLHPQPLTYEYPYSITPTPPPLLEXEASTPALKPHPPLTHSPPNHHPPAPPPPHLLPPPAPPYPLPPPHPPPPTPPPAPPPRLPPPPPPPPPPPPPHPPPTALYL

SEQ ID NO: 22250 - protein, 64 aa, A.fumigatus
YWSYSICLFKWIERCIMLSLVTLLSGTAGLALTASAQYFPPTPEGLKVVHSKHQEGVKISYKEV

SEQ ID NO: 22251 - protein, 64 aa, A.fumigatus
LTTNNQDTISIGVSLFFLDYKYNIKLLKVKLLDYKGATIDIAYLLKKKAKVIITKIKEAINIAV

SEQ ID NO: 22252 - protein, 79 aa, A.fumigatus
INPLGRIDLVLLYSRGAILVTILFFTVMPRKHPSNTEVWRRYHNNTGGWSDGVCFVIGLINPAFSVGVPDCITHLSEEG

SEQ ID NO: 22253 - protein, 181 aa, A.fumigatus
QCFYIVMKPQIRVPQGTMLQMLTAFVTTFVYLIALLYSIENLDTVLHSEFSSFPTAEIYRQATGSRQGAVGLVAVLFVTAFPTLVGVYITGGRMWWSLARDKATPFASYFSNVHPTQKNPVRATVAMAGMVSFLGCIYISSTTAFQALLSSYVVLSTLSYLGAILPHVLTGRSSPRGWKDP

SEQ ID NO: 22254 - protein, 91 aa, A.fumigatus
NPECKWIRSQCFSQGPNSASQNKIPSLREQWDCAKFVLLSHFTVELPQIWLVSQFDRAPWYVSNSMSAGFSTPWLNSSVCLRRFLFPPFGP

SEQ ID NO: 22255 - protein, 165 aa, A.fumigatus
  UNSURE (113): Identity of amino acid sequences at the above locations are unknown.
QYVRRLFHPMAQFFGLSTSVPFPSVWTMMYQIAIFFVLEDTWHYFSHRALHWGPLYKAIHKIHHQYSAPFGMAAEYASPIEVMILGFGTVGCPILWCALTGELHIFTMYVWIXLRLFQAIDAHSGYEFPWSLHHFLPFWAGADHHDLHHEEICRQLFRVTSGGWE

SEQ ID NO: 22256 - protein, 65 aa, A.fumigatus
RHPEDESFRIRTPADSVIGPIADSATALRHVRLFVDFMDIETIPLWKRAAGTTQRKIAFADLWIS

SEQ ID NO: 22257 - protein, 244 aa, A.fumigatus
  UNSURE (2): Identity of amino acid sequences at the above locations are unknown.
MXMKSVERASFQPRGEDYMNNQDEMWSSDPSDQCLLDSSDPTDPLAFVNATCRQGNMPSHYLEVHSAKDVIEAFRYSNCSGQRLVIKNSGHDYLTRSSGRGTLALWTRNLRSIRYDPAFVPSGCKRTGLKYKAITVGAGVNFDEAYAFAQQHNVTILGGYSSTVGLSGGWVLNGGHSILSPVYGLGVDRVLEFKVVTPDGVFRTANEYQNADLFWALRGGGGGTFGVVLESTHRVEPAVRFVSA

SEQ ID NO: 22258 - protein, 116 aa, A.fumigatus
LVHVPNHPAPTRGSVWVRVLPLIAENQWLHLSLITDLKKACKEVFPVAEYAYTTIPTYPSGQIGFMVCCKDATRNVREPVRTWSREEEERLCRYYNQDIHRASFVLPNFARKALDV

SEQ ID NO: 22259 - protein, 104 aa, A.fumigatus
FHFLVSCLRLDESLFLFKCFYKSYLPMVWWELLLDLEDQNKIMCHNVVVVHCAYKGSSVWKTGSKSNIIRTSFSLSNYIYMLTVSLIHTSRALRAKLGRTKLAR

SEQ ID NO: 22260 - protein, 65 aa, A.fumigatus
  UNSURE (58): Identity of amino acid sequences at the above locations are unknown.
TLVNDHSDLQGDADTIEYTILHTEFYRGRAQPGMLIIWLRLTYVLLWRLGMSGIWARXNKCDFGP

SEQ ID NO: 22261 - protein, 173 aa, A.fumigatus
WLGSFQPRGEDVLACRVLGPVCGSLLFAFFDDLNCVDSLVAVGELLKVLASLRIADCLGPLTKVAVHQFFHLLFHLSANPQLVVDDHLSQIVDTAGEVLDPPGSPLKFVCRSNIEYEISINDRNDFLRRHIFRKQFRMPGFGTSIATNENVISLLGCNQSETDRKLAACSFIV

SEQ ID NO: 22262 - protein, 61 aa, A.fumigatus
  UNSURE (16): Identity of amino acid sequences at the above locations are unknown.
LVKWRKKSTFYCRITXGQRIDLFGAKKQDFFDIWTKLVDAEMESGHAYAKSLRTIKVLPPV

SEQ ID NO: 22263 - protein, 105 aa, A.fumigatus
LVWCQEARFFRHLDEARGRGNGEWSCLCQVAPNNQGTAARLRLSFLADVFYQSCVGTTWCRFGIGDSVGMAIRLEERYKSIRSPHKLKGAVSGCVRECAEAQNKE

SEQ ID NO: 22264 - protein, 165 aa, A.fumigatus
FPISFGLIATEKGYNIFVGGNGGAKPRHSELLAKDVPPEKVIPIIDRYLIFYIRTADKLQRTARWIENLPGGINYLREVIIDDKLGIGAEMEQQMEELVNSYFCEWTETVRNPKRRKYFQQFANSDETVDTVEVIKEREQQRPTYWPKDSAGEDVFTTGLEGAEP

SEQ ID NO: 22265 - protein, 92 aa, A.fumigatus
ALICYLRARREDIQLNSSGFQQPNGQGVVSRAIPETPLEYNLFITNLAHGKHQSRVSETHLDECASRAKNIETAIQAWLGPCGVENNIGPIF

SEQ ID NO: 22266 - protein, 185 aa, A.fumigatus
SLRDGALVEPLSVAVHACRLAGDMQNKSVVVFGAGPVGLLCCSVASAFGAAKVVAVDVVKTRLATATKYGATHRYEMDAEKKNAEELSATAALEDGADIILDATGAEPCLNCGLDILRSGGTFVQVGLGNPTLMFPVGQVCDKEVVFKGSFRYGPGDYALAIGLLESRRVQLDVFTPGSKITYEC

SEQ ID NO: 22267 - protein, 121 aa, A.fumigatus
NKEDAGVLMEQKAALEKRKKEAEEHASEQESRRDRKIRTIGNYVHESVPVSNNEVGYLSRSCYWHRKLICLKDDNVVVRTWAPENVFVEKRNCLSHHEVLTRLDGYDSERGVKIVAIVDFV

SEQ ID NO: 22268 - protein, 262 aa, A.fumigatus
RHFRDGNYFYQISSEYRVARPESRGSWFPQKKPDKQVPSTGASENPRDSAVNGHSRSESVETPATPSKSKNKATIMLSKMMKYDVDPRKRSNRPEVIDLHYDRLHNPDNCFHIELSWMNTTPKLIEDAVLSWAATAEKLDSSSARWQIAKACRSARRNLLGSHIEAYSQFQLLRAPVPQVSIPVPFCNWAYRTDITTNKLCLRNLILVWTSKQRSAFPADVEVAYSWGTADYQYPEYIHRSGSFLVQITDQGDSLVFGQPNL

SEQ ID NO: 22269 - protein, 109 aa, A.fumigatus
PPLKRLCHFVVKTQFDYLIRLDWRYSLAYLLSSLFLRLDSLSLFAMLTFLLLLFFFPAALCSFFFLSSFLLFVLPFLSCSLFFCSLPSSRGLSASPLLDFLRLCLSLAD

SEQ ID NO: 22270 - protein, 103 aa, A.fumigatus
  UNSURE (96),(100): Identity of amino acid sequences at the above locations are unknown.
SPPRPSFFRVGAFLVSRFDGDLDFFDVRFLSSGFSLDLAGFSLADLCCLSFFAAVLSVPDDFVAYVLPADPGRILILYVTMEPCGYRLSGIVPCVXRIFXSMA

SEQ ID NO: 22271 - protein, 165 aa, A.fumigatus
ESDRDRPGGHKRQNHRGRRGQRRRRRDNTDRRGRSRQDPKRSPKKGSEHQRNRGRHQSGRRGTRRRGRRKGEEAINQQGRGKGGGSRGGGKRTNRGRKEGSKRKESKRGKATQKEEKKRGRRKSKEQQEKRTAEGEKSASQRGRGYPDGETKTKADKLGSTSSLT

SEQ ID NO: 22272 - protein, 208 aa, A.fumigatus
  UNSURE (26),(30): Identity of amino acid sequences at the above locations are unknown.
VRPTSPGSFTTFKNVLDPRSPSSHRXEDPXHTRHNPRQSIPARLHRHIQDKNPTGIGREDISDKIIGDGEDSGEEGETTQIGEGEAGKIQREARRKEANIKEIEVAIKAGDEERADAEEGRARRRSISKGEAKAEEVEEGGSGQTAGGRKGAKEKRAREERQHKKKKRREEEERAKSSRKKEQQKEKSQHRKEGEAIQTEKQRRKQIS

SEQ ID NO: 22273 - protein, 145 aa, A.fumigatus
ATKSSGTERTAAKKERQHRSAREKPARSKEKPEERKRTSKKSRSPSKRETRNAPTRKKEGRGGDQSARERQRRRKSRRGEADKPREEGREQKKREQERKGNTKRRKEERKKKEQRAAGKKNSRRRKVSIAKRERLSRRRNKDESR

SEQ ID NO: 22274 - protein, 69 aa, A.fumigatus
GCFITHYLRYLLIPLHTGIIDTMMGRLKQFTPELTIYRYNTYILVGCHGDVRSTSSSAGQRFASLHPSS

SEQ ID NO: 22275 - protein, 60 aa, A.fumigatus
  UNSURE (5),(6),(7),(9): Identity of amino acid sequences at the above locations are unknown.
QTAFXXXRXDGSAPSSPVVKTADDAASCGGDGDGEQGHDGFVVESALLIFAGMRAKDFTA

SEQ ID NO: 22276 - protein, 144 aa, A.fumigatus
RHGTVHEYNITIKVWTDISPTPMASTYYGYGGLSVDLQVPGTLMVAALNCWWPDELIFTSVDSGATWSPIWAWNGYPNLDYYYSYDISNAPWLQDDTSTNQFPVRVGWMVEALAIDPFDSNHWLYGTGATIYGGHDLEKWDTVH

SEQ ID NO: 22277 - protein, 66 aa, A.fumigatus
VQYYLSLTRCFCHYINKYAYIIKPLQEHKTHMLKGSPLKGPERCIFTISKVINTPTNYKTKAFCQL

SEQ ID NO: 22278 - protein, 159 aa, A.fumigatus
ILLIIYPPYSTHSLQLLDVGIFSPLATAYSKQLEEFLHRLMGLSYITKQDFFRLFWPAWEQASSLRNILSSWKTVGISPLDPEIILQRFTKKKDSRPSTSESSHSILQAEDWRKIERLLNHIVADIYDKNTKKLSLIMHHLSTENILLKLHCQGLESAL

SEQ ID NO: 22279 - protein, 74 aa, A.fumigatus
  UNSURE (68),(69),(71),(74): Identity of amino acid sequences at the above locations are unknown.
IHLPLAHELLSSDDFRKYIVSIRNASYAIAVLAKISSIEQGTVTAGMRFDIEVGSSPRGWKVDECSFXXQXGPX

SEQ ID NO: 22280 - protein, 191 aa, A.fumigatus
  UNSURE (13): Identity of amino acid sequences at the above locations are unknown.
AIHSEFYDWRVSXRRGLLLFLFLFLFLLLLFFFLLFFFLLLFFLLLFFLLFACRCFSSFFFSWRFLLLLFLFGLLLRRASFLLLAPSLFLFCCLLLPLLPLRLVFRSLWCRLPFLFFLVRLVLGAYLAEFSCFSASSPRSFARWPPPSALAAFFPGCSLISCCRSCGFRSASSCASWRSLWGWIKRGIAIC

SEQ ID NO: 22281 - protein, 151 aa, A.fumigatus
  UNSURE (2),(7),(10),(38): Identity of amino acid sequences at the above locations are unknown.
SXGRLLXMVXRYARIVPSYRTRWNKRYILNFMTGGYLXEEGFFSSSFSSSSSSSSSSSSSSSSSSSSSSSSSSSSSPVVASLPSSSLGASSFFSSSSAFFSAARRFSSSRRPCSCFAAFSSLFFRCVLFFAPFGVVSLSSSFWFDSFSARI

SEQ ID NO: 22282 - protein, 176 aa, A.fumigatus
  UNSURE (5): Identity of amino acid sequences at the above locations are unknown.
LEGIXKKRASSLPLSLPLPPPPLLLPPLLLPPPLLPPPLLPPLRLSLLLFLLLLLALPPSSLPLRPSSPPRVVSPPRAVPVPVLLPSPPSSSAASCFSLPLVSSPFPLLSGSTRSRRVFSGVFVFFCLFSSFLRALASSFCSCCFFSWLFFDFLLPVVRVPFCFFLRFLEITMGMD

SEQ ID NO: 22283 - protein, 184 aa, A.fumigatus
  UNSURE (179): Identity of amino acid sequences at the above locations are unknown.
QIAIPLLIHPHSDLQEAQEEAERNPHDRQQEIKEQPGKKAARAEGGGQRAKERGEEAEKHENSAKYAPRTSRTRKKRKGRRHQRERKTRRSGRRGRRRQQNRNRDGARRRNDARRRRRPKRKRRRRKRQEKKKEEKQRQAKRRKKRRRKKRRRKKKRRKKKRRRRKRKRKRKRRSPLLXDTLQS

SEQ ID NO: 22284 - protein, 171 aa, A.fumigatus
  UNSURE (171): Identity of amino acid sequences at the above locations are unknown.
SIPIVISKKRRKKQNGTRTTGNKKSKNNQEKKQQEQKEEANARRNEEKRQKNTKTPLNTRRERVEPERRGKGDDTKGSEKQDAAEEEGGEGSKTGTGTARGGETTRGGEEGRRGREEGGSAKRRRRKRSNDRRRGGRRGGGRRGGGRRRGGRRRGGGGRGRERGREEALFX

SEQ ID NO: 22285 - protein, 119 aa, A.fumigatus
CTPFSPVVKTQINYVTSNNMNVSLTDDVTPKVEEIDGAEDLRSIKTLEAENTIASASNHPNTTTTTTAAPANVPRKRGRPRKHPLPVPGSQIKITKGRSKTGCITCRRRKKKCDETKPS

SEQ ID NO: 22286 - protein, 102 aa, A.fumigatus
LLFLFILFFYLPLFVSPFIFSPLSLPSPPPPRRDCLPPPGENQFRSLTGTKRIVSFGGWAFSTQPSTFNILRTAVTADNRAQFASNVAQACLPYCRGVSGHG

SEQ ID NO: 22287 - protein, 126 aa, A.fumigatus
CCAGMSSLLPRGFRARLTLLQFVVNNNLDGVDFDWEYPGAPDIPGIPAGSPDDGPNYLAFLQELRSILPTGKTISIAAPASFWYLKAFPIAEISQVVDYIVFMTYDLHGQWDYNNAFSESSIHRLL

SEQ ID NO: 22288 - protein, 62 aa, A.fumigatus
CGGRGRFGNVMLQICLKAGLNYYNLVEYIINLGSTGMMNNILYKGARGPVIPNIIISIRKGL

SEQ ID NO: 22289 - protein, 111 aa, A.fumigatus
TFNSTEAASMVEHIELLRQELRRLFCFHNHRERWSTYVWHLLFHPSYVFRLKTGVSNSVDNNLYRLSVMVSSEFAAKSCDSQQNISSAFFVCSSTQILRIRKLTTASQASI

SEQ ID NO: 22290 - protein, 138 aa, A.fumigatus
FQGKFQDIYLPLHVFSNYRYPRKAKDFVSLWELKYSAEFSLYTKFLDEPIRCLVVVLIVFCDYQHCRNLVRFGYDERAFWLFPWRADIMLHSGSKYLGGHSDIIYGVLAVRGEEWYRQLWNGFTWVPLSVKWRPGLPL

SEQ ID NO: 22291 - protein, 266 aa, A.fumigatus
LMDYLPISSHRSHPEWGICEDPIGRNDPQRPCHSGVVRRVECLRGEMKMDFEIFPAFNYARDRHTGHWIAPESSSGALRKYSFESETQKLDLTIHSGIDTSLEPADAISPVDLNLQEKEGPKGPGLHARVRMIEGQSISFVLHNPETSLPEEGALQHYLDRLEKETLDFWVGWIAHCMFRGHYREQVERSLLVLKLLTYKPTGAIVAAPTFSLPEYVGGSRNWDYRYSWLRDAAFVVYVFLKNGYPLEAEAYTSSLTELPGAAQEL

SEQ ID NO: 22292 - protein, 163 aa, A.fumigatus
LQNIEFSGGTCSGGHGLSIGSVGGRDDNTVKNVTITDSTVTDSANGVRIKTVYDATGSVSQVTYSNIKLSGITDYGIVIEQDYENGSPTGTPTTGVPITDLTIDGVTGTVESDAVEVYILCGDGSCSDWTWEGVDITGGEKSSKCENVPSGGLHRGLKSAPWE

SEQ ID NO: 22293 - protein, 198 aa, A.fumigatus
RPFFTYYSEYFLLTCSACLTAIHPTKISDHLNAEHPGTHVTQQALDSIRVAALTTSHNQIMTEQPIHPIPTLASPREGFQCKLCKLVRLGHRTMRNHIHDIHQINGYGPQDAEMASCLIQALEGTSYLFRVNPPATMPNQASTSTRASRKRTREPSLIGSTPGPSIQRSRVHSPDQPGTSTIHQSYLASFQAHRQNLK

SEQ ID NO: 22294 - protein, 89 aa, A.fumigatus
DAYSVYLLCRWLDLPEVPTFQYRRCNLLIELVYRIADFPAMQILSPHGLSCKLIRKLELSLIKASEYPGLTMVSMSYTASSPRGWKDQR

SEQ ID NO: 22295 - protein, 76 aa, A.fumigatus
DLLTDRHYHWWRRSNRAITDAQLVVLEVLRSHLDLSAPRIRDIADKTLTLSICFVAGWIFQKFQPSSTVDATSLSN

SEQ ID NO: 22296 - protein, 196 aa, A.fumigatus
  UNSURE (94),(167),(192),(193): Identity of amino acid sequences at the above locations are unknown.
EAGHCFQKSIEIDPRCAMSYWGLAYAVGPNYNKPWEVFDKQELESTVQRTRRAAEDAKANAKLASPVEAALIDAMQYRYPQDRPAGDCSSWNQXYADAMEAVYKQHPDDLDVAVLYADALMNLTPWALWDIKTGQPAPDARTLDIKAVLDRARHRREDSLIRVCAFXIHLRRVRSPDAQEAATTPGKGPQAXXTWG

SEQ ID NO: 22297 - protein, 318 aa, A.fumigatus
GNFFCGAYEGLSWVSKKGQGLGSKWPRVLSARSKAQARPDGRWVGVPFARNRKQARKEENRQTAARGEVVEDSSDEERMRRRKKKEERQRESRSGTGTPVSRAKPRFRAAREIEADMDGLEVPNVLKSLIDATGKEQRVLTSTAGLMTPLEFVNQGEGEALKIARRARHDLEAFADEWKGLTERKKFAELEEAQIVEQLDTNQLKTDELTNLITAIGQLEIFEEDSTLARFDELTSKLESIEMKYRSEIDEYRLSETAVAAIHPLFRQAMEDWDPLQEPTFLVSNLRRLQPLLSRKKNDEAVSRQSSPRGWKEPCHDQ

SEQ ID NO: 22298 - protein, 61 aa, A.fumigatus
SKTSLDFSHTIILSILPLYLDKPSIPLHIREISFVIHILFSIYYLFSFHNTRICPTGGNPR

SEQ ID NO: 22299 - protein, 109 aa, A.fumigatus
CLVSSPLRQSTYKFLLLLIPHHDFFLSNHQGMLIDGEKWACEACVRGHRVTTCKHNGTYSSILSLSFSKFSQTHIECYRSTIDPHRQKGSPLFDLLCMQLHPMPSSRGS

SEQ ID NO: 22300 - protein, 88 aa, A.fumigatus
STSRVIRVNNTKSAHTPSYIGSNQIEAALCFYKALKVYPQPKDLISIYDKTVPKDVLEILAEMVAMDAGLKLGSFTGEGGSADNHGVE

SEQ ID NO: 22301 - protein, 80 aa, A.fumigatus [sequence omitted]

SEQ ID NO: 22302 - protein, 86 aa, A.fumigatus
DVLVSIEYNRIGQAWWLTPMIPAFWEAEAGGLPEVRSLRPAWPTWQNPVFTKNTKISRAWWCAPVIPATREAEAGEPFEPGRQRLQ

SEQ ID NO: 22303 - protein, 101 aa, A.fumigatus
  UNSURE (25),(26),(27),(28): Identity of amino acid sequences at the above locations are unknown.
LSQHVINKDVLCCLQSPGFFFFFFXXXXETESHSVAQAGVQWHDLGSLQPLPPRFKWFSCLSLPSSWDHRCTPPCPANFCIFSKDRVLPCWPGWSQTPDLR

SEQ ID NO: 22304 - protein, 72 aa, A.fumigatus
STRLSLPKCWDHRREPPRLANPVVFYTHKHISIWTRHIFKCCIVKWGEWPVLLQRCPTRADPRSSRKWKFYL

SEQ ID NO: 22305 - protein, 139 aa, A.fumigatus
  UNSURE (20),(21),(23): Identity of amino acid sequences at the above locations are unknown.
SIKMFYAVFKVRVFFFFFFXXCXRQSLTLLPRLECNGMILAHCNLCLPGSNGSPASASRVAGITGAHHHARLIFVFLVKTGFCHVGQAGLKLLTSGNPPASASQNAGIIGVSHHAWPILLYSILTSTSQFGLATFLSAV

SEQ ID NO: 22306 - protein, 105 aa, A.fumigatus
  UNSURE (103): Identity of amino acid sequences at the above locations are unknown.
LQNAGPFRVLECVRRLAYYIKLPSTWKIYLVLSVAYLEPALATPNLFYCELPKPPAVINAEVYPSEDDIYKVKCLLNKHTVHRGHKYTPYIEYLVAWKGYRLXDD

SEQ ID NO: 22307 - protein, 81 aa, A.fumigatus
KKLAVIYTLEFLCNLKQLEHYLGLTICFHHYGSKYAHIIKPLQECKTRMLNSSPLKGPERCAFTTGKAINAPTDYETESFC

SEQ ID NO: 22308 - protein, 177 aa, A.fumigatus
YTHSSDPSAAVVKIIGDDDQKVRSGRHLQGQSDLEAASCEYRHKFDFLEKSLSNDEGNSIYTPLLSPDSWVAKPVGNTPAISWNMSMRKSNRIEETQPVSSHNQAQPLHHRRLKWLIATQHAIPCFHAVPAVLWGSLEDCHRSQQESANCHFASHLVHVTQCESPRLHVRRWKQAIK

SEQ ID NO: 22309 - protein, 78 aa, A.fumigatus
RGSFAPRGEDMLGYTLWNFCELVFVYFFYVETKGNTLEEVARIFDGDDAIAHIDLQHVEKEIEAEATYHETVPNKSAA

SEQ ID NO: 22310 - protein, 290 aa, A.fumigatus
  UNSURE (20): Identity of amino acid sequences at the above locations are unknown.
LWSARLFFKIRPNEGPECLXKVGIRSAIESVQNSEKKKYGRSYQGDRLFRLERIYIRYLSESGSWDSARETFKGLVGRRGNSYEFWLTYYHWELISWSKFVQGEGTADAARRTPNPSFATAVLKQAIKRTDLDWPEKIMQVYIAHCEDYEDSDELQQAILETRKAMKAITARREKEAAAALQQQQQAAANYASQAEKRKRQDDTGVNGYPSSKKARAEEPTPAPAPAAPQPEPVALRRDRENATVVVKNLPHHITEHRVRQFFRHVSFLPWFPVVFTTSSNLDSAGQSKA

SEQ ID NO: 22311 - protein, 183 aa, A.fumigatus
TCGPSRVAGYVDPASTQQGSLAWAEMLFSDTCIILSPDKEVLASLEQKLKEIDEECRGEESRRVDLELSIMEVKDNLKKAEAGPVTLGTTVDTTHLENVSPRVSAGTAASGLLAGLPGHGLGWVGHISLPLTQPLLSSYNHSPKLSHLPLPQTVPQSTLQPHSRTGLSRSWSQAKALYSRKPR

SEQ ID NO: 22312 - protein, 90 aa, A.fumigatus
LVREGLEGAKSPTGFLFLRQSCSVAQAGVQWRDLGSLQPLPPGFKRFSCLSLLSSWDYRHPPPCPANFCIFSRDGISPCWPGWSRTPGLK

SEQ ID NO: 22313 - protein, 71 aa, A.fumigatus
VAGITGIRHHVQLIFVFLVEMGFHHVGQDGLELLALSDLPASASQSTGITGVNHRTQLELYFFKLQSSKHY

SEQ ID NO: 22314 - protein, 85 aa, A.fumigatus
SQLLRRLRQENRLNPGGRGCSDPRSRHCTPAWATEQDCLKKRKPVGDFAPSRPSLTSQLSLSSNLHRCSCLFIHLYNLNKHKVTP

SEQ ID NO: 22315 - protein, 172 aa, A.fumigatus
TEIPGDTNSPIRPTQCPTTKRNYTVQDPCTNCHYLPATATLFYWPVSTTGGDLCHQNGTTVPATATGNGPNTAVVNGHTFISPSIYVSFTSIYARSNQRAHPGGSCGGEYEDVIISVNPEAVTSYRNHLNAKYPRIGTAYPFNFAEFQPHVVGNYSVPLIPCFKRRDWKVVV

SEQ ID NO: 22316 - protein, 60 aa, A.fumigatus
RLTRYPSDSDHPTITTLFNHIHFWEDITILFHFTIPTFPRLHLYITSPSSYSEQSTSEPQ

SEQ ID NO: 22317 - protein, 107 aa, A.fumigatus
  UNSURE (44),(76),(77): Identity of amino acid sequences at the above locations are unknown.
TINIRATMKFSPAYLLAFAPIVAAHFRLQYPTSRGFNADTMANXPCGELAQSSNRTQVSLSSGSFPVALRMGHDEXXCEVLLALGNESGSNFKITLHPTFRIEGLGE

SEQ ID NO: 22318 - protein, 62 aa, A.fumigatus
KNKFFGDTVHYVSVQTAQIGKDVPLPMCSATAQKNAELNINKAIFACLHLTRIERYNKYEHY

SEQ ID NO: 22319 - protein, 63 aa, A.fumigatus
PLNVSCFVVLKYIYSYLIKSNMQLGINYINKLDFLKAYLKAYIEAFKLENIKNSFTVTRLVLF

SEQ ID NO: 22320 - protein, 232 aa, A.fumigatus
  UNSURE (201): Identity of amino acid sequences at the above locations are unknown.
GGHSLSLAELGSLFSREFGFRVPIARLAKNSTLTGHLQTVRAIRDGHTAAVQADLPAVLRADATLDEDIRPSGDVKIRSVTDAQTVLLTGVTGFLGAFLLHDLLETTSAHIICLVRFNEPADDDQPGGVARIRRNLLDLGLWRDSIMERVEILPGNLSRSRFGLSPEAFDELAARVDVIVHAAATVFTTGLEEGVQHKSNXPRHESAQLIYTSHIPHQFILHKPIDNNTTKL

SEQ ID NO: 22321 - protein, 88 aa, A.fumigatus
ICTCFTGILTSLLLTLFPFTPTYLLILCSSYTTLHTTTPLLHSIHIRIFLSSITYRYVYTLPVMYIDSSPPPFTYYTSPSVVRMSTRV

SEQ ID NO: 22322 - protein, 66 aa, A.fumigatus
NMMSHMPSATSLSLDATSLPSYTTSRYTLALLLFVTRRLIPPYHHSLPSAASTPCFYLLLVIFIPL

SEQ ID NO: 22323 - protein, 159 aa, A.fumigatus
  UNSURE (1): Identity of amino acid sequences at the above locations are unknown.
XTRYLLAPWGRSFWILGSSIRSGTGWPQCGELDILENINGNLVGYGTAHCDVNPGGICNEPNGLGGSITIPDQSWHTWRVTWDRTPSNWQSEKITWYMDGQQFHQITGSQIGNSGVWATLCHDPLFFILNVAVGGYWVSPVNLFLLISPLSEHFHPKYS

SEQ ID NO: 22324 - protein, 215 aa, A.fumigatus
  UNSURE (170): Identity of amino acid sequences at the above locations are unknown.
LTHRAPLQPPVKTFLIPSSKLAFHDPSTNTYRSDKSTSAMGRISYPAGLDSPSRQLLQDLTRDLEQLQIHSTELKQVKAWERKSFYERLDRIDSEREAIHYTALDKVAARHDQVREEAQEMLRAHQRAVEEERRRKEEEARREAERLERERAEKLRREQEEAARRDAERXAAEEAKRKAEEEAEKKRKAEQEEKERKEKERLEEENRQRQAEAQK

SEQ ID NO: 22325 - protein, 168 aa, A.fumigatus
HLCLASRRRRNHKKQGRRDLSAELHKRGMFLMVDTVINNMAYITNGSDPATHIKYSTLTPFDSSSYYHPYCKIEDWNNFTQAQWCQTGDNVVALPDLYTEHPDVQSILEKWAQDMISTYSIDGLRIDAAKHVNTGFLANFGKALSDTFMTGEVYQQEVDIICDYKNNY

SEQ ID NO: 22326 - protein, 163 aa, A.fumigatus
TLTSTPREDYCSPKCVSSSRVFYLSSNLIAKHYEPSDVEGALKATEVASQRGIRCPSVRKISKNHENVYVGMNRVEGTTLDVIWKELGWFMTVKLGLQLRRCVKIDRSITSPTAGSLVTGECRSFWRDDRYGLPANSGPAEIAHFCQVLGELYLHASSNAYLA

SEQ ID NO: 22327 - protein, 74 aa, A.fumigatus
  UNSURE (47),(52): Identity of amino acid sequences at the above locations are unknown.
PLSISFPLHSPCTCHQCFGRLNTESEPRYDWHCSLSIGDGESKPSHXQDTWXFAYLPGFVSLNFFVYTLPNDSL

SEQ ID NO: 22328 - protein, 238 aa, A.fumigatus
  UNSURE (1): Identity of amino acid sequences at the above locations are unknown.
XLIGLGRPGSGCSTFLKTLSGELHGLNVDEKTVLHYSGIPQSTMIKEFKGEVVYNQEVDKHFPHLTVGQTLEFAAAVRTPSKRLGGMSRNEYAQMMTKVVMAVFGLSHTYNTKVGNDTVRGVSGGERKRVSIAEMALAGAPLAAWDNSTRGLDSATALKFVESLRLAADLNSSAHAVAIYQASQAIYDLFDKAVVLYEGRQIYFGPASNAKAFFERQGWFCPPRSTTGDFLTSVDHPI

SEQ ID NO: 22329 - protein, 85 aa, A.fumigatus
QPQVKEKLKKFQNLDPSNADFIPTIKSLMADLAEHIKEEETNDLVKLDQALSHDDSVSLSKSFDRTKIVRRRAPYYTARQEGNRG

SEQ ID NO: 22330 - protein, 110 aa, A.fumigatus
QFSPIAARSVSTSPIQMIGRITDTVKQDHREIEACYQRIINAKDRDEQTRYQNLFTWELARHSIGEELVVYPAFEKHLPDGISIAEKDRREHQTVFCRLEPPVIETDNHR

SEQ ID NO: 22331 - protein, 68 aa, A.fumigatus
KIFRALIPSSFRSLFSLKGPVQKSLVKPNQGFGQIIPFTPTAVGKLSQRFSGLSGVEKPPVPFEGRTY

SEQ ID NO: 22332 - protein, 71 aa, A.fumigatus
STLCTPGEQTTHAAMPKFLTSQLTFLIASSIFSYAGLRYGEKIEANWSHKIFANRRLPANERLFGNLHLTI

SEQ ID NO: 22333 - protein, 79 aa, A.fumigatus
  UNSURE (43): Identity of amino acid sequences at the above locations are unknown.
RYTMHMQPRWAICILNMSYPHLTVNSQFNSPFNMFDKGCLYVXQRWRLVLTRIEAAFRIIEWLGKKYPYANTGNILSET

SEQ ID NO: 22334 - protein, 213 aa, A.fumigatus
VHHAPVHLDACCLIMIWSFFHNMAPLSPILTDFFASHRTHYWLITQEPVLCCTILMISSRYHTLPGPSGATRGFFIHNRLWQHCQHLILRIMLGQEKFSKAKTRHLGTVEALLLLSEWYPRALHFPPENDGWDSDLMLTAPSERDPPPVTEESPMQDPWREDVVEPTRRSDRMGWMLVSSCLALAHEPCVFSTSNRSDLGDHRIVKPDVKAYV

SEQ ID NO: 22335 - protein, 186 aa, A.fumigatus
AAPLPDVIVMQGEIPVDTVVGILRDIRVWKANNRAQGKKGIEAGPDVIYNPAPAPPGGLPEDVYTAVDHIIMNETEAELMSPSEEHLLQVVPGVEKESRNEKVARYFHQLGVTYVLITLGSKGVWYSATDAGTSGPADGVNRFTKQIPAAKVSKVLDTTAAGDTFVGAYAVEVARCLHHGAGRIRA

SEQ ID NO: 22336 - protein, 114 aa, A.fumigatus
ICTSLLIYLALVITMRKTFSLFKKQRRMPSYTSNKPTVEPNWTFQMALNANEEWFRYTRSRFLSNQTHEMAIRYVKFNMDELVKHAAESVGLSSAQCVPVEKIPEGNFNKNLPL

SEQ ID NO: 22337 - protein, 81 aa, A.fumigatus
  UNSURE (53),(54),(57),(58),(63): Identity of amino acid sequences at the above locations are unknown.
DIIPLMSFRNRGRWQFIVFHRSHIFFDLRYYSHTLNLEHSQFLSNIRLLGARXXLQXXTNRPXFGGGGRGVFPNIKTGGGK

SEQ ID NO: 22338 - protein, 71 aa, A.fumigatus
  UNSURE (33),(62): Identity of amino acid sequences at the above locations are unknown.
ILLSSVHFLCIRPYLNPWDSLLTNALLDREATXKDIAMNNSDIYFNYALNMVHWLHTNRLLXENNCVKHRA

SEQ ID NO: 22339 - protein, 206 aa, A.fumigatus
  UNSURE (1): Identity of amino acid sequences at the above locations are unknown.
XAFQEMDAISFLTPHTKFAVRPPSLAFVAGAVKNAYRTCWYGRPGPTFVDLPADLIQGKSAPGFHLPQPEEILVPSPPKASGDPAMILKAAQLLKAARAPLLIIGKGAAYARAEGGIRKLVEQTQIPFLPTPMGKGVVPDSHPLNVSSARSAALKHADVVLVLGARLNWILHFGEPPKWSSRAKIIQVDICAEGLHHGAGRIRGGA

SEQ ID NO: 22340 - protein, 73 aa, A.fumigatus
VYNFLLFISFKYIHTNYSVFIKYSIIILLYIDNILILLNSNNLINNFLKQLGKLFKYTNNSKVSVYLGINILY

SEQ ID NO: 22341 - protein, 91 aa, A.fumigatus
  UNSURE (71): Identity of amino acid sequences at the above locations are unknown.
SKHLFGVFTQAKNAYRERKAQIQSERNAKIAEREALRALQNYHIDDAPPSVAPSRRSRSTHSRHHRHRRAXSHYEQDLHLVASQTESYYAS

SEQ ID NO: 22342 - protein, 104 aa, A.fumigatus
TTIAVVKDYPRPLVLRRLAGSKQPNIRPPHSEAVDNAIGAVSMGPRCASGDPTYLSALSGTASYASCRSKINNSTPYRTTLSPGDPLAPSRLYLVGGSLHVFFL

SEQ ID NO: 22343 - protein, 88 aa, A.fumigatus
  UNSURE (31): Identity of amino acid sequences at the above locations are unknown.
AYTHFNAYISGVPLNNALLHLTSAPAPAHGXASFPLLSPPSCPPSGLAQSIYTTITRSPPARNNAATKKIYSNTKTNRLATKLSPPDN

SEQ ID NO: 22344 - protein, 61 aa, A.fumigatus
  UNSURE (61): Identity of amino acid sequences at the above locations are unknown.
GVDDRPDARFVLGFSLAVGRVLQLTVCSAGKYQLQVLPEAGHFIQEDMPAKTAQILVDFYX

SEQ ID NO: 22345 - protein, 94 aa, A.fumigatus
KLTYRCSTRSRTIRNRASARVSVPSLLYKEETPSDPAKPWVWRTDLSATKPFWEDWFIGLSRKFLEARGGKLLLLAGTDRLDKELMIGQMQGLF

SEQ ID NO: 22346 - protein, 291 aa, A.fumigatus
  UNSURE (19),(20),(25),(82),(116),(288),(289),(290),(291): Identity of amino acid sequences at the above locations are unknown.
SVSKGVPIHQPYCHAVSAXXSSLLXFKLGFVLSNFGEIGQNSQILIDYFVGTGALPCLPDANPAEWMLDVIGAAPGSHTSIXWFETWRRSPEYARVQEHLAELKHERRHQTNLFRXTSGQKREDKDSYREFAAPFWAQLYQVQVRVFQQIWRSPTYINSKTALCVLSALFVGFSLFHTPNTIQGLQNQMFGIFMLLTLFGQLIQQIMPHFVAQRALYEVRDRPAKTYSWKAFLIANIVVELPWNSLMSVLMFLCWYYPIGLYRNAEPTDAVHLRVFPKGPKIRASVKXXXX

SEQ ID NO: 22347 - protein, 190 aa, A.fumigatus
  UNSURE (13),(185),(186),(187),(188),(189),(190): Identity of amino acid sequences at the above locations are unknown.
NTNVATKQTCSAXHPAKSAKTKTATASSLLLSGPSFTKSKYESSSKSGGHPPTSTPRPLSACYPLSSSASPFSIHPTPSKASRIKCSASSCYLPCSASLSNKSCRISSPSARCMKSATDLQKPTLGKPSSSPTSLLNSPGTRSCPSLCSCAGTTRLVFTAMPNQLMRCTCGSSPRGRRSAQALKXXXXXX

SEQ ID NO: 22348 - protein, 67 aa, A.fumigatus
  UNSURE (64): Identity of amino acid sequences at the above locations are unknown.
ADPLQTIRSGTSVEHNVLYEYQFVSTQNVYMGQIQTETACVFHHFLEHNVFTTGLEGSAGRQSXVVN

SEQ ID NO: 22349 - protein, 74 aa, A.fumigatus
NLASPSDPSGMWEVHARVGGFAGSQQTTRECAKTPETVITEADEKCIVAYMLMHVTPSASNLYLENTWLWVSDQ

SEQ ID NO: 22350 - protein, 185 aa, A.fumigatus
  UNSURE (184): Identity of amino acid sequences at the above locations are unknown.
APKPWDDDQRLKADVELQQSLLKTDANLQRMFMESLHTKPDTLSASQFMSQFWSTRLHLLRAHAIERSQTRGSYNVLSSLKPRVEDNVTKLNISKEQIQLIFSQHPLVKRVYDENVPKLSEQQFWSRFFQSRLFKKLRGERISENDATDAILDKYLREDEQANLEREAPARSYTDGARRTRAKXE

SEQ ID NO: 22351 - protein, 102 aa, A.fumigatus
ILSRNSTSGQVAKASHLYLPAWVKIAMRRSGVQFPSCAFLFSTKVLISKAAFSSISNYFCYLLDFCRLSLVEDFLKYFIIFFLFCGNVYICAGLTSYILLNF

SEQ ID NO: 22352 - protein, 76 aa, A.fumigatus
SIVFVQAVESFIHLPDPPPLSNTATTAKYFFYLFNQGSSKFQHKYIQNDQQVFIYVTRLIINVGLHHGDGRIRGGV

SEQ ID NO: 22353 - protein, 62 aa, A.fumigatus
KGDVIMKYTADEARSLKAYGELPEHAKINETDTYGHEGFEDNVEFDEDRESEDEKEIDVDEL

SEQ ID NO: 22354 - protein, 293 aa, A.fumigatus
  UNSURE (76): Identity of amino acid sequences at the above locations are unknown.
VRPWPGSKPFVFYRRAKMGAFWFPLKREGLVRIPTLLFGSEPGGWPFAKGLETGSIWSLILDPPGRFSGTAVIVEXWVTVTNAIWITVFGLLMLPTALLFVRVYGELEFGFSLIKIMLVIGINIMALVITCGGGPDGQRIGFRYWRDPGPFVQYLDVPGSWGQFLGFWTTLNNALYAYSGMENITVAAAETRYPRQSIPKAARRIFARVFLFYILSIFMVGMVVPSNDPTLLRSTGNASQSPFVIAARRAGIQAVPSIINAAVLTSAWSAGNSNMLGGSRILFGLAMHVFTRG

SEQ ID NO: 22355 - protein, 101 aa, A.fumigatus
  UNSURE (32),(62): Identity of amino acid sequences at the above locations are unknown.
SPCDSFSPQKPYLFRVDVQYLGVLSECSSLAXRVFYEKKYITLPIYLSLRYLTLVKFSEQAXIDCPKYAENLPSWSRTPVSCRYSPKMNAKTHLRSSALKR

SEQ ID NO: 22356 - protein, 74 aa, A.fumigatus
SPAVLIVWWAWTMLKYVTSPGMRLIIIPDQYDILCLTLFTVMIIMVNSTCYPQNVEGYVKLTQTRAKAFMRRCL

SEQ ID NO: 22357 - protein, 68 aa, A.fumigatus
  UNSURE (4),(5),(6),(7),(8),(9),(10),(11),(12),(13): Identity of amino acid sequences at the above locations are unknown.
EPLXXXXXXXXXXRQYQKYYVDRVLVMDDHTINYHEAVSYSTFLETLLLLYISMTSVRAMPQSPLRPH

SEQ ID NO: 22358 - protein, 152 aa, A.fumigatus
KENKRKINGKINGKINGKINGKINGKINGKINGKITGKINGKINGKINGKINGKINGKINGKINGKINGKINGKINGKINGKINGKINGKINGKINGKINGKTKTGNKGEKPYQAFLRTEPSVIRVEYVNLTVLFQPNHERDIHITLLAQFK

SEQ ID NO: 22359 - protein, 191 aa, A.fumigatus
  UNSURE (182),(184),(188),(191): Identity of amino acid sequences at the above locations are unknown.
FELCQECNVDVSLMVRLKENGQIYIFNSDNRWFRSQEGLVGFLSFIPCFRFSIYFSIYFSIYFSIYFSIYFSIYFSIYFSIYFSIYFSIYFSIYFSIYFSIYFSIYFSIYFSIYFSSYFSIYFSIYFSIYFSIYFSIYFSIYFSIYFPFVFLLFSFYPTPRPFYSFLFLLLNFGAILMAASXCXILYXGRX

SEQ ID NO: 22360 - protein, 136 aa, A.fumigatus
GFSPLFPVFVFPFIFPFIFPFIFPFIFPFIFPFIFPFIFPFIFPFIFPFIFPFIFPFIFPFIFPFIFPFIFPFIFPVIFPFIFPFIFPFIFPFIFPFIFPFIFPFIFLLFSFYFPFTPHPVLFILSFSFCSISGLY

SEQ ID NO: 22361 - protein, 176 aa, A.fumigatus
  UNSURE (153),(154),(158),(161),(164),(166),(169): Identity of amino acid sequences at the above locations are unknown.
QMVPFAGRLGRVSLLYSLFSFFHLFFHLFFHLFFHLFFHLFFHLFFHLFFHLFFHLFFHLFFHLFFHLFFHLFFHLFFHLFFHLFFQLFFHLFFHLFFHLFFHLFFHLFFHLFFHLFSFCFPFIFLLPHTPSFLFFPFPFAQFRGYTNGRKYXXYPVXRAXMCXVXAGXSNIYGRR

SEQ ID NO: 22362 - protein, 162 aa, A.fumigatus
HLVFDQLADEFSFQDLFNRIGPVSNLSLVYDRAGRSEGVAYVTYNRANDARTAIAEFDGANAKGQPIRLTLVASGPGRRGRNPFDNVERPKGSLFDRIERPRDARSLSPGSENGDVEGGARRRRGRRSGGGAGHRRSDVSKPAPEHIDRYVPGQRSPVRRST

SEQ ID NO: 22363 - protein, 154 aa, A.fumigatus
VQLKRGSVQPRGEDCLSPAHVPAILAKSVVHILKGCNEYHSGEWHSSPRHDGVGTSDYPAPQPLFIGFTFWREPTSLQGLQNQMFAIFMLLVIFPNLVQQMMPYFVTQRALYEVRERPSKAYSWKAFMLASILVELPWNILMAVPAYFCWYYPI

SEQ ID NO: 22364 - protein, 101 aa, A.fumigatus
LRSHHCLRPPQDCGKFENQVIEAHNVAIHIANIKQLHWRLTCDTPYLSLLFRVTDTVFSDLFSATTTYIYGIEYGMRLYLHQIASVFTTGVEGSALSVMAI

SEQ ID NO: 22365 - protein, 150 aa, A.fumigatus
RLASPFLQGFDSFRSWRRDVHRRLMEWQESAPTRRETGVQFSVEFLELNYWQAVIMLYQQSLTVPAELAAELTPAEDVSSPSFSNVDETEDEDEIYYKVAEAGQKVIRIYRQMHRVRLVNYTYLATHHIFMAGMTKSLTRYHDAAYTLLG

SEQ ID NO: 22366 - protein, 127 aa, A.fumigatus
WDLDSILWPILHYQSGADFNEDYWKAYQCVNEIFADTVANQAQDGDLIWVHDYHLLLLPALLRERLKSQGKTCRIGFTLHTPFPAGDFWRSLPVEKELLKGVLACDVIGFHTEEYKRNFTEACEQCV

SEQ ID NO: 22367 - protein, 83 aa, A.fumigatus
  UNSURE (2),(8): Identity of amino acid sequences at the above locations are unknown.
SXALQRRXGDCPVRLEPLDDLKWFGWPGINIPDPEEQKKAADALEEKGAKGIFLEEKLGHAHYNGFSSPLPKPDFGRPRADGI

SEQ ID NO: 22368 - protein, 155 aa, A.fumigatus
  UNSURE (153),(154): Identity of amino acid sequences at the above locations are unknown.
ASQEPGEDVSDWVYSAHSLPGRGLLALPAGREGTAQGCSCVRRDWLPYGRVQAEFYRGVRTVCVGTNACNPDWVALTVNRGAQATDSNGITFDDHCAHVGVFVVGIDPQKFDDALRDDAVIKRIQELDEQYRDKIVIAGVDRLSTASNERLQXXR

SEQ ID NO: 22369 - protein, 110 aa, A.fumigatus
WRGSFQPRGEDGPAYFFAMVEHLVASATALGLSKEQATRLAAQTCLGAGKMLVESSEEPAQLRKNVTSPNGTTHAALQTFESLNFKEIVDKAVQAATSRAAELGETLGKL

SEQ ID NO: 22370 - protein, 67 aa, A.fumigatus
RRPRTLQSIQSIQTSIHSKHCSLSPVLTNTNIELGTTASKTTRTSITISLPLTTPPSHFISIEQVSP

SEQ ID NO: 22371 - protein, 172 aa, A.fumigatus
  UNSURE (94): Identity of amino acid sequences at the above locations are unknown.
DRTSRGSFQPRGEDFDGYHHTSAGDPIVLPNVVCCHEIDDGILWKHTNYRTQNAVVTRSRILVLQTIITVGNYEYIFAFQFTQDASVTYEVRAXGILSTAPINLGQTVPYGTIVAPGVMAPYHQHLFSLRIDPAIDGHMNSLMVEESHAMPLNDPSVHNPFWSGIHNWEPHR

SEQ ID NO: 22372 - protein, 135 aa, A.fumigatus
  UNSURE (1): Identity of amino acid sequences at the above locations are unknown.
XSEVVGLDPSCLAGSFFFPFGCIVRFLFASCLFCCFRGRLLFFFLLVVFLFLFFSFWFCLPVVLFVALLLPCLPAWLFPFSVSARFFAGSCLCFSPFCSSSCLFVFFFLSSLGLVFFLLGFLCFLLVLVFGILGP

SEQ ID NO: 22373 - protein, 165 aa, A.fumigatus
  UNSURE (165): Identity of amino acid sequences at the above locations are unknown.
TKKIIKKTTRGNKEQRKKRGRQTQQRKHHYGPNIPNTKTRRKQRKPRRKKTRPREDKKKKTKRQEEEQKGEKQRQEPAKKRAETENGNNQAGRQGSNKATKRTTGRQNQKEKKRKRKTTKRKKKRRRPRKQQNKQEANRKRTIQPKGKKKEPARQEGSRPTTSLX

SEQ ID NO: 22374 - protein, 162 aa, A.fumigatus
  UNSURE (160): Identity of amino acid sequences at the above locations are unknown.
SKRQPEETKSKGKKGADKRNKGNTTTAPISQTLRQEGNKGSREEKRQDQERTRRRKQKGRKKNKKGKSKGRNRRKNEQRRRTGTTRQGDRGATKQRKERQEDKTRKRKKERGRQPKGKKREDDLENNKTSRRRTENGQYNRKGKRKNPQDKRGRGPPPHXTK

SEQ ID NO: 22375 - protein, 217 aa, A.fumigatus
  UNSURE (190),(192),(194),(195): Identity of amino acid sequences at the above locations are unknown.
NDILMEYTEFWNEPATYDLGAIHSIINSSQVLHVSFSPGPPDPFPAILPMIGTMGSFDYPSAGLDEPLDCYLHGYVSSRIMNLARKAEGDGLPVCIAASRVDGLILSLTPNSHSYNYRSAILHGYARPVTDEADKLWAMKLITNSVLPDRWDHTRVTPDNAEMSSTVILKVKVVDGSGKIRDGGVSDERXDXNXXDVTTRVWNGVVPVLELIGRPCS

SEQ ID NO: 22376 - protein, 63 aa, A.fumigatus
  UNSURE (14),(15),(17),(19): Identity of amino acid sequences at the above locations are unknown.
NRHNTVPDPSGHIXXVXVXSLVGDTTISNLATAVDNFDFKNNSRRHFGIVWGNTGMVPAIRQH

SEQ ID NO: 22377 - protein, 203 aa, A.fumigatus
GPPTPAGSAGPDRPGLQARSSAVPTQSLSTTDHRDHRHGRRLARRPVDKESGPIPGLHPPLRDPRTGLVVYGVREKADLFACQFFPPPPQASLDDLRGYDYPEPLSVPEFKEHEVLCALRSVKPDKAPGPDRITNRVLQAAGHVLVQCLTGLYNQCIRLEYCPNNSGNAALTPSASPESRIYSVARGFRTIALLNPQTNFLKA

SEQ ID NO: 22378 - protein, 106 aa, A.fumigatus
  UNSURE (106): Identity of amino acid sequences at the above locations are unknown.
LDRVSSRLLTSTQQLYQTFYGLFVCPWYSYSQIMISEVTPRGHEFLFFSLFSIIGKTSSFIGPLVSSAIIDASPSGNVSTPFYFLFALSVGLHAGCRGSLYGPSKX

SEQ ID NO: 22379 - protein, 66 aa, A.fumigatus
PLQALGIYAFWFIQRRYNLGTKAMFNAIAVGIILLDGWGMIGIWAQRFGFHHAWEIWVSVQPNVAS

SEQ ID NO: 22380 - protein, 251 aa, A.fumigatus
IRYLLLIFLSSGWVSYAASSICSALGEYRMMPDADTACCLINGKNGYVRGNNSWVLGRIMRDYEYWMGEPVREKTESLIQARWDFDRQRQEREVPGSGSRVPRPSQAGLVVSLWQPSTTKPSGEPGHDLLHWSGIIVTVIQLGIAAVPLGLSGDWGILMITAAATILCYVTGALGQWKVEKWACRRLDTREKKNFVLTRGNGAQHAIAIISNARGLDLEDLATGFSKIDSPSITLFAQLATIIHPGLEGPR

SEQ ID NO: 22381 - protein, 73 aa, A.fumigatus
VGEIEAIPENIEQGWDRAEDRIEQKWDGAVDDIEEFPENAAEWTGRKVGEVEQFGDYIGNAYDEGRAEGRDDW

SEQ ID NO: 22382 - protein, 68 aa, A.fumigatus
AGGPGSRLVLCLHSNKLTISNDIGPFAGLLLADYGASVLRVDRPKSISTDQLTRRKTSITLDLRDIFT

SEQ ID NO: 22383 - protein, 67 aa, A.fumigatus
ATVSPQPMPGATCGDQQCCQGSSRAYIQLCSVNVMIAIQHLLFINKYIMTCNTAMPEMYKSPCQNAV

SEQ ID NO: 22384 - protein, 129 aa, A.fumigatus
FSSGSCAMSSPRLPTPTTTTTTTTTTTTASTSSSSFSSFSSSSSSSVARNRLASISSQIMGSSSPSVFSTAVVPAAPEDPLFGLAQAFRQDPSDKKVDLVIGAYRDNNAKPWILPVVKKVIPRPHSTAS

SEQ ID NO: 22385 - protein, 124 aa, A.fumigatus
ESENRRSRTGKIPAFCVSITHTIHCLTRLLILIWILRHVFPASSHSYNYNNYYYYDDDRLYVLLFFFFFLIIIIILRRSKSSRLHLLTNHGFLKPISLLHGRRARRSRRSSLWSGSSFSSGSLR

SEQ ID NO: 22386 - protein, 139 aa, A.fumigatus
GRGTSSLVVKNCMFGCGNYPTWPNLLESIRKESVYNVRRLRHHPSIVIWVGNNEDYQVQEQAGLTYNYEDKDPENWLKTDFPARYIYEKLLPEVVQEYSPGTFYHPGSPWGDGKTTSDPTVGDMHQWNGMFIASHFTNH

SEQ ID NO: 22387 - protein, 126 aa, A.fumigatus
LKMQTHIYLTQVVQAETMMFGYRGWRRQWGDERHCGGALLWQLNDCWPTISWAIVDYFLRPKPAFYAVARVLNPIAVGVRKKHHDWSVTHAQPPKTSKFDLWVANSRPPEIPRYVELRFLSVNTGT

SEQ ID NO: 22388 - protein, 379 aa, A.fumigatus
  UNSURE (234),(285),(286),(291),(293): Identity of amino acid sequences at the above locations are unknown.
LIITGYAADGYARVNGISALITTFGVGELSAINAIAGAYSEFVPIVHIVGQPHTRSQRDGMLLHHTLGNGDYNVFARMNAGVSTTVGRLNDTHEVATLIDNAIRECWIRSRPVYITLPTDMVTKKIEGERLNTPIDLSLPANDPEKEDYVVDVVLKYLHAAQRPVILVDACAIRHKVLQEVHDLMEASGLPTFVAPMGKGAVDETHKNYGGVYAGDGSNTGVREQVESSDLILXIGAIKSDFNTAGFTYRIGQLNTIDFHSTYVRVRYSEYPDINMKGVLRKVIXXLGRVXCXPGAHLNNNLPDDEPNSGDHPITHKWFWPKIGQWLKENELVIPETGPGNFWHPGKTRCPAGFPANQSNFSGGTLGFSLGSLARKPPL

SEQ ID NO: 22389 - protein, 201 aa, A.fumigatus
  UNSURE (87),(89),(94),(95),(146): Identity of amino acid sequences at the above locations are unknown.
QWRLPGQAPKGETQGTPREIGLIGGKTCRAPCFPRMPKVARPSFWDDEFVFLQPLANFGPEPFVGDWMIPRIRFIVGQIVVEVCTGXAXDTPQXXNDLSQDPFHVDVWILGVSHSHVCTVEIDGIQLTNAVGETSRVEVRLDRAYXKNQIGRLHLFSHTSVGAVSSVNTAVVFVRFVDCSFAHWRNESWQAGGLHKIMNFL

SEQ ID NO: 22390 - protein, 261 aa, A.fumigatus
HFAGVFGLLQLVAFAEFVRSFVPSKQFQRLLTAMIFITFGLGLLGLVVLTVTGVIAPWSGRLYSLWDTGYAKIHIPIIASVSEHQPTAWPAFFFDLNFLIWLFPAGVYMCFRDLKDEHVFVIIYSVLARYFAGVMVRLMLTLTPIVCVAAALALSSILDTYMATTLPTPASEAKTNEDSSSPPLRSVRKPNVGITSHVSKIIVTASVVVYLLLFVAHCTWVTSNAYSSPSVVLASRMPDGSQYIIDDYRDFHHGLDGPRLH

SEQ ID NO: 22391 - protein, 95 aa, A.fumigatus
  UNSURE (23),(26): Identity of amino acid sequences at the above locations are unknown.
FTFFLWIKAVKNGSIMWGALTAXFYXYMVSAWGGYVFITNLIPLHVLFLLCMGRYSTRIYISYTTWYALGTLVSMQIPFVGILAYPKQRPHVRLG

SEQ ID NO: 22392 - protein, 80 aa, A.fumigatus
YWRNSGGYPAVCEILVYVGARITEWLFVRERPQSVRGVKVSSPTSQSDPSQSAIFPYWFTTSCACHVSYALWTIDVSSSL

SEQ ID NO: 22393 - protein, 142 aa, A.fumigatus
LSPAPIQWRPVMPRALAVRLTCQACTRRKVKCDKKSPCTNCLKHEITCVVVERPRWPRGRSGNQAISREQDLSDRVAKLEQLIEGLSHSKRGTGNGSSSGGENTIPSSGRSPKSPSERAQTTEDLFHLQPVSGMPLIVVTIL

SEQ ID NO: 22394 - protein, 243 aa, A.fumigatus
  UNSURE (156): Identity of amino acid sequences at the above locations are unknown.
CNWGYKDESGNGRFQFVFDFKMQVQTTIAAYGIYGSRNYCYALCLNSHELVINPLHTLAKVSSLDLLTSHIAIIYREIVMLYFRDFDFFSGTQTCNIKYGPRYMFQQRVRQLRSMRVSSMYKTSPLVEDQVQPSCAITAPSILGVTVFRPPNWRDXYSNGGVNSPPPSIMFTSLSSTPSGGALTSSPAKNQTTISAATCASSCPSPASIAFKYLCTICPSHPHLLPNSRHVSLFTNTSNSKCP

SEQ ID NO: 22395 - protein, 170 aa, A.fumigatus
VGESVPSSPAVKTASLNSMASSWMQENSSPKSSRRRGIDLQKKVDELVHKYFKIKCPSPALRDILRSTEKSDLLVSAVRLQVSLARCRSQNFNDGQITIYDKALLTLSKNGNEPAELSVLELYLTEYLGIVPIANTSYSLNVATKRLGLHQALAKGLSTVNVIYFFTQSC

SEQ ID NO: 22396 - protein, 72 aa, A.fumigatus
  UNSURE (4),(30): Identity of amino acid sequences at the above locations are unknown.
SLTXELANSTNLDSAQGIETSIKTGIAVIXTLSRAKALRKDHQFDTFFIPGGVGNAAADLGPNPATTHRKAG

SEQ ID NO: 22397 - protein, 108 aa, A.fumigatus
SIHLLVPGVQWQKRARWVQDGKFLTSSGVTAGIDAGLVFMASTYEAQKASAQGEEASIPGFSREKALHHAHFVAFGLEYRWDSLLKMSHKSALIPLNESSTWDNAVRY

SEQ ID NO: 22398 - protein, 87 aa, A.fumigatus
  UNSURE (2): Identity of amino acid sequences at the above locations are unknown.
FXPSHGRRLSGRTTSSTPFSSRAGSAMLPLIWDPILLQRIGKLVDRAANILTVCTGSILLAATGRLDGRKATTNKRLYDELTPKCMI

SEQ ID NO: 22399 - protein, 112 aa, A.fumigatus
  UNSURE (110),(111): Identity of amino acid sequences at the above locations are unknown.
EIVQKLQDLHNVLKGYTPPTVVHPSVESLDPKPKSSFFGSLFGRQSAKAETEIPENLPKGLYMYGDVGCGTTPLMDLFYETLQAKIKSHVAHSPSPRAGTCRACDTNRGXXP

SEQ ID NO: 22400 - protein, 130 aa, A.fumigatus
VRISCAHPACHEYDLCVPCFAAGEKSKNHDPSTHPYQVIEQNSVPIFEEDWGADEELLLLEGAEIYGLGSWADIADHIGGYRTKDEVRDHYIRTYIESSNFPLPERADPDDTSLQDVFTTGLEGPAISVK

SEQ ID NO: 22401 - protein, 205 aa, A.fumigatus
LSDDSAQKFIPRYTRQAISRLSRHLPKDFNLTALDVLAMQNICVYEHISLGGSSFCSLFTEQEWRDFAYNVDVQYYGDYAYGSPTGRAQGIGYVLELAARLQGTLIYSSDTSINFTYDNNLAQFPLDQPFYLDMSHDDILLSVITALGLRYFRYGPHGLPGNVDHALNRTFAMSQMTPFGARLMSEVWTCHRNASLVFTTGLEGS

SEQ ID NO: 22402 - protein, 182 aa, A.fumigatus
PVVVDNEGDHQMSDIMKDRAVSGASRYSPLSPSKRRDSRAVDLPESDGQPLSTSPKSQIMIRMPNGAVRINWPHLYKQRRRLEENWAKGRFTNFQLPHPAHPEESHLECVYAIQFIGRWLVSGSRDRTLRVWDLETKRLRYRPLVGHTKSVLCLQFDPRPSEDVIISGSIDRNVIIWGFSTR

SEQ ID NO: 22403 - protein, 66 aa, A.fumigatus
YEEERGGYLPCEEVARAIIQGIGYQGFVSMELFSRTMSLEGSHVPVEHARRGIKAWEMLKERLQLQ

SEQ ID NO: 22404 - protein, 109 aa, A.fumigatus
SLTQSRFVPSPTVEDERVNFLAVTQRIIDSVIASPLDHSLATAAYWIVIRQEIYYALTRETVPHLRFDSDRWPNASIANNMIMFVGKVAQWRWGQKSLDEWSKYALSSK

SEQ ID NO: 22405 - protein, 223 aa, A.fumigatus
CTSPGSFQPRGEDSLWKVIKHSQVGVRNALAAAERQGTTLFDTMVNILVNGKVNDDISKEVFQLYGRRPVWRTEYTTLNVEEGATGIDVTLTSPMEEHRLEFILEQFCMALNLIASNPRQTVKATNLVSETELQFMLQSHKNLPDATRTLNGQFEATVRTYPNRTAINYQNEQFLTYAELDSEANRMTHYLSELGVVPGDIVPLLLEKSPLMIKAILALFKLG

SEQ ID NO: 22406 - protein, 176 aa, A.fumigatus
YFLWQAYFDVSPRVPLGKISQQAWAQLHFPFHVALILLLEGSQILALTLDVTLKLTYLTETIQFACEEPRLEAEVAIRLLRSTIADLDIEHGRGAMKEKAIISDILEELLTLPLCPTNVTSNGYFVTHDRMDDLVGHVTAALFSSMGITPSEGRDISQLNNSQLFMMYIDHRWHVT

SEQ ID NO: 22407 - protein, 293 aa, A.fumigatus
  UNSURE (27): Identity of amino acid sequences at the above locations are unknown.
RAMSQNESSCLRSERETARSRKAPPHXRLDPLRIHPPDPRPSTAGASRSPSPLLPPAPHPPRKASAYPHPEDPFLRGTSSQARGPDENALRKPTYRSPTFPRSPSPNLARPEDDFQRPSYRRGPPPGRPGLRISMSTSRMYSSRPRGPPPRERYPNESPSRGLALPRYTPNGPSDVYSDEALRSSVNSAMTSRSSIEQASGTERSSVLTKSSSITDLSPDTPDGPYEKDGGMSVEDAISMYLDGFSDVTEEPASPGFGDDSKMRPISPRPPTELTYDYGHRSDEFLPATEGRI

SEQ ID NO: 22408 - protein, 88 aa, A.fumigatus
SNTYLNKILAYGRVGCYLAPSRHSDRILSRTSKKESEDPASKHLFFNEDPGGKSVMPTPRRRIVSPELSGLPIIILRSAYRRNLRIVR

SEQ ID NO: 22409 - protein, 314 aa, A.fumigatus
  UNSURE (166): Identity of amino acid sequences at the above locations are unknown.
TSILAILSARMGHSSDTFSYSPLNPEAAEIRLLTILPDRDGNNPVRCTLQTVSLNSAPQFEALSYVWGTVAEMVEILVDDIPFQVTTNLNAALQCLRHSRKKRVIWVDFICIDQNNGKEKNTQLPLMGRIYKDATSVVAWLGPVNPNMEQTMSMIKRRESSLAAIXQDVRQMTRPLSRKNRRDTIGSILDAIQGFLDIVSAPYWGRIWTFQEYYLPEKLPVCMVGNIPFTLPALVDLGRHFPEILAPFVENLDKMAPRAGDAADIESHQTLLSRVKEARQRLAQSNPMQDFAHDIAARSSPGWKYTCIGEGRRA

SEQ ID NO: 22410 - protein, 260 aa, A.fumigatus
IHSERSIDIAVAHSQVLFSDPLKYVGTISHELEQPSASRTGGVLRGEQQSENSLGDLVVGKLTEQVRRLLGVFHRESLGNLLVVLGRILLSLDPCVHDTGDLSTSSHMSLALGSTVGEFFKNHIRRLLSVPSLGEREDEREVDQLQSGCDHVVVIRNLLDGRISHIVADESPARDGTHQLTELGLPRLGLVIGGLGLFQEILGVLGINIFPYREEWKTEPSGWKEPVKSLFGIQRASCQCKNNQLARPKNLGARSNTQAL

SEQ ID NO: 22411 - protein, 154 aa, A.fumigatus
SQPLWSWSTSLSSSLSPRLGTERRRRIWFLKNSPTVLPRARLIWLLVERSPVSWTHGSRLNRILPSTTRRLPRDSLWKTPRSLLTCSVSLPTTRSPRLFSLCCSPRKTPPVRLALGCSNSWLIVPTYLRGSEKRTCECATAISMLLSLWIYLTR

SEQ ID NO: 22412 - protein, 379 aa, A.fumigatus
QGLGVRPGAQVLGPGQLVVFALARSPLNSEKGFDRFFPPAGLCLPFFPVRKDVNTKYSKYFLEKSKATDYKPEPWKPEFRELMCAVSCGTFVGHYMTDAAIKKIADDYYMITAALELVNFPFILPFTKAWYGKKASDMVLEEFSNCAAKSKAHMAAGGEITCIMDAWVKAQQDSAKYNEKIAKGLPVEDSEKPSHLLREFTDYEIAQTVFTLLFASQDATSAACTWLFQLVADRPDVLERIREENLRVRNGNINAPLTMDLLDEMKYTRAVVRETLRYRPPVIMVPYLVKKDFPITDSITVSKGSMIIPSVWPATHDPEAYPNPDSFDPDRWITGDAEKQAKNFLVFGTGPHYCLGQTYAQLNLSSPRGWKGPCIHKSA

SEQ ID NO: 22413 - protein, 205 aa, A.fumigatus
NEHRRTSSPVVKTLGPKTPPKSRAPLKPPKGGIFGHMLDESRKIFARPEPPRTAPARGSKIEAWLSGTPDPFLEDMDPDVEVPAPLNTRTNRAKSHRREDKHDRNAESEPSPESESRRRSTSKRHGRSREGSVTSERKKSEERKVSSKQLRDDSSPPHRKKSSEHRHSRSSSGAKEATTRDADLKADDHDTDTQPFSDGSEVFRE

SEQ ID NO: 22414 - protein, 203 aa, A.fumigatus
  UNSURE (17): Identity of amino acid sequences at the above locations are unknown.
SATDRPLLEQGLVRITXINHVNYQILVSKLQKGDPLPQDLNPDETTGTLADESSYSDIGQKKMVVNQQHLKNAWDASQKSTREDWQEWIRRFSVELLKESPSPALRACASLAGIYQPLARDLFNAAFVSCWTELYDQYQEELVRSIEKALTSPNIPPEILQILLNLAEFMEHDDKALPIDIRTLGKYAAKCVFTTSARIRIGT

SEQ ID NO: 22415 - protein, 153 aa, A.fumigatus
LLLRPYISSNNSVYEMTTICTTPNSPPELSGSKSSKSSSFRSSSQLSGPDGILADISNFEEIGLEDDPEMPYMDGVTAVYGKSGVMVRSTTARLQPKTPTTTTRDLTSNVKPTRTPHPSLKGHANGALTKPKHSSTKIGSGKSSRRGWKDTST

SEQ ID NO: 22416 - protein, 325 aa, A.fumigatus
SRSCQPVVKTEDDLTDDEETDEQEAPDVEAAATEKADIEGLEAEEQMVIDGGLDRDDQRRNKNLIVPARQIDAYWLQRQVGSVYTDAHIQQEKATQALEILGGKAEDGTEKSLRDVENDLMELFDYEHPDLVAKFVMNRDKIVWVTRWRMVAEDADARHLVESEMVEAGHRAILDEIRGKTVRDEAAGRPEKKIKLDLMDVDVPSAPAPEEKPTEGGLVGGLQPKRLINLENLVFHQGNHLMTNPNVKLPQGSTKRTFKGYEEIHVPPPKPKRDPGEKNIPATELPEWARIGFGSAKELNRVQTKCYPAAFHDDGNMLVCAPTGS

SEQ ID NO: 22417 - protein, 108 aa, A.fumigatus
KMKSPASRSLPKEDSIEVSRSPCETGSNLLHEFLTQSLNQNLYWLQVKSQQYIFLRSHGIPVPKIYGYSAVADNPAGTEYIFMELVQGQNLGDIWFTLSEQERITLVT

SEQ ID NO: 22418 - protein, 131 aa, A.fumigatus
RPPVLPFAEEKNHVLNMKQVKEHLYKFQSLSSEDAEFEPTLKSLWSNLGQHIKEEESDDLPSLEKTLDQDDSEKHTKKFMRTKKFIPTRSHPSAPDKPPFETVAGLMAAPIDHLADLFRKFPEESKSQLPP

SEQ ID NO: 22419 - protein, 137 aa, A.fumigatus
  UNSURE (27),(48): Identity of amino acid sequences at the above locations are unknown.
PGMSQQTSISTIGKTTTLKAPTTIVTXTLLATKTSTITIVGVTQTVTXLKTTTIESTVSLRRRTLTVTKSTVSTIHSTVTLATPTSTVVKTTTYRLKLSATFTSRATSTKTTTVKKTVTQTQTVTKTSKGAGTCPTN

SEQ ID NO: 22420 - protein, 65 aa, A.fumigatus
SLRRCRPHHITSCHFTWLAHEPACPSWVGLSDDIRFNDYMDNVSMWIWRGNTEPTATLVYFLISG

SEQ ID NO: 22421 - protein, 224 aa, A.fumigatus
ARIVPAPVVEDPMSLVISSFAPVGDFRKTWTPALRSVEDVGDTVLMFVDLSFGRKTLGGSALAQVFNQVGDECPDLRDVEIFRDFFDATQQLQEAGIVLAYHDRSDGGLFTTLAEMMFAGRCGVEIMLDNICPTNSTQDLVSTLFTEELGAVFQVRKEHEIQFRSCFATCGPPAGLIHKIGRVSERPKQNLAIYYKASLVYRNNRASLQQTWATTSYHMQKIRD

SEQ ID NO: 22422 - protein, 226 aa, A.fumigatus
VTDLLHVIRGGSPGLLEARAIVAVYQAGLVVDGQVLLWPFGDATDLVDQASRGATGGKARAELDLMLLAHLEDRTQLFREEGRYEILCAVGGADVVQHDFHAAASGKHHLRKSSEETTIRSVVVGQNDACLLELLSSVEEVPEDLHIAEIRAFISNLVEDLSEGRAAQGLAAKREVNEHQNGVTDILNAAEGWCPGLTEITDGREGRDHEGHWVFNHGSWHDPRLD

SEQ ID NO: 22423 - protein, 329 aa, A.fumigatus
RQKKAASSKAGVSQVLSRYTYASTLSHLRRTNTPIGRDGKIAKPRQLHNTHWGLVCPAETPEGQACGLVKNLALMCYITVGTPSEPIIDFMIQRNMEVLEEFEPQVTPNATKVFVNGVWVGVHRDPAHLVNTMLSLRRRNMISHEVSLIRDIREREFKIFTDAGRVCRPLFVVDNDPKSENCGSLVLNKDHIRKLEQDKELPADLDPEDRRERYFGWDGLVKSGVVEYVDAEEEETIMIVMTPEDLEISKQFQAGYASSGRRQSQQSLFVSILIQKGPHFERNGKINPHFDSWGVGANIHFLSRDSNPVRLWNYLSNSGNGANKPLGFV

SEQ ID NO: 22424 - protein, 124 aa, A.fumigatus
VITICDGIARDQRRLMVCIGKYVAAVLKNPSESLGAQILAAEDYYTPTRILQEFEEVTGQKARFVQVDPDTFKSFMPGLIGEEMLQNHLFIENPGYFNGRDLKESNDWLEKAGYQLMSWREFLE

SEQ ID NO: 22425 - protein, 66 aa, A.fumigatus
  UNSURE (1): Identity of amino acid sequences at the above locations are unknown.
XGKPRVEQNIRSTGVRVTFVLPGYFMSNYPEVGMLRKGEDGVYNLAYPVGQNAKFPLVDIEADMGR

SEQ ID NO: 22426 - protein, 183 aa, A.fumigatus
VWDDLASIPAVLEPADGEAVVSLLSDASFDPEFPSTAEEPFEPVETELLPPQLTPSEIQMIESFRRHAALETSTPTPATEPLSLTHRLTSLSLVPDIQSVLDSVPAAQATDATALRDAVLKGLPGVAEWIAVEERYHDEVWGYLRPTLEAAAKEMEERKEQGAPVEDGPAVRRLKMILRHMQT

SEQ ID NO: 22427 - protein, 207 aa, A.fumigatus
KSKPNSKASVPSEQGETLTSDIYQVCICLKIIFNRLTAGPSSTGAPCSLRSSISFAAASSVGRRYPQTSSWYRSSTAIHSATPGRPFRTASRSAVASVACAAGTLSRTDWMSGTRLRDVSLCVSDNGSVAGVGVEVSSAAWRRKDSIIWISDGVSCGGRSSVSTGSKGSSAVEGNSGSKDASERRETTASPSAGSNTAGMEARSSHT

SEQ ID NO: 22428 - protein, 100 aa, A.fumigatus
TSSSIFETTLSDTVTDNTYIMPPSEQQSGNSTPRFTSQTTSAEDLLKSQTVGLVHLSDFRKRRAEVLEQKEREAHDKSLGRFTSGNSRSATPSTGDVTDR

SEQ ID NO: 22429 - protein, 142 aa, A.fumigatus
GDWILFTHEGGVDVGDVDAKAEKLLIPVNLRNYPSNEEIAAALLSKVPKGVHNVLVDFISRLYAVYVDCQFTYLEINPLVVIPNAEGTSAEVHFLDLAAKLDQTAEFECGTKWAIARSPANLGLATVPQTGLHHGTGRIGVS

SEQ ID NO: 22430 - protein, 201 aa, A.fumigatus
SYISIVMSAKSILEADGKDILNYHLNRAPVIKPTPLPPSSTHKPHPRLASIYFPEDAAVKDVLDQTRLFYPWLLTPGAKFVAKPDQLIKRRGKSGLLALNKTWPEAREWIEARAGKEIKVETVTGVLRQFLVEPFVPHPQETEYYININSVREVSDSGDSQNGARFGRLMNFSRVTGSSSLTRVVWTLAMLMPRPRSFLSP

SEQ ID NO: 22431 - protein, 239 aa, A.fumigatus
QADVVVYAGGIDNTIEAEGRDRTTIAWPGNQVNLIDQLSKIGKPLVVVQFGGGQVDDSSLLSNPRVNALLWAGYPSQEGGSAIFDILTGKTAPAGRLPVTQYPADYVNQVPMTDMALRPGSNTPGRTYRWYDKAVLPFGFGLHYTTFKISWPRRALGPYNTAALVSRSPKNVPIDRAAFDTFHIQVTNTGKTTSDYVALLFLKTTDAGPKPYPLKTLVGYTRAKQIKPGEKRSVDIEVS

SEQ ID NO: 22432 - protein, 200 aa, A.fumigatus
CSTTGVVVRMLERPDDFQDITHVVLDEVHERSIDSDFLLIVLRRLMQKRPDLKLILMSATLEAQRFSSYLGGVPVLNIPGRTFPVEMKFLEDAIELTNYRLLENEANSVIDEDLDDTPSDNGEGDTAGGLLATLEGYSKQTRETVLTFDEYRLDYQLIKKLLVKLASAPEMASYSRAILVFMPGMAEIRRLNDEILSDPI

SEQ ID NO: 22433 - protein, 87 aa, A.fumigatus
  UNSURE (69): Identity of amino acid sequences at the above locations are unknown.
FQGRDEPSGFGNLKRRILKHVEQGLGPYSSAGRQEVEKRRQVLSFILEHEWKPARLCKIYGTEPRRIFXISLARRVNEELGESKADV

SEQ ID NO: 22434 - protein, 75 aa, A.fumigatus
  UNSURE (36): Identity of amino acid sequences at the above locations are unknown.
LYFPAEQQNQSEDGAVSNVCLTLSKLLIDSARQGYXKDSPRLRPINLAKTSWFPLMLKDEGKYLPSFFHFLSPCR

SEQ ID NO: 22435 - protein, 245 aa, A.fumigatus
RGLIGLYDPPRPETAGAIRACAQAGIAVHMVTGDHPGTATAIAQQVGILPSDLGSVAADVADAMVMTAGQFDKLTDREVDALPTLPLVIARCAPQTKVRMIDALHRRGQFAAMTGDGVNDSPSLKHADVGIAMGQAGSDVAKDASDIILTDDNFASILNAVEEGRRIFDNIQKFVLHLLSENIAQACTLLIGLAFKDLDGQSVFPLAPVEILWIIMITSGMPDMGLAMEVVFTNGRQEGQTVPPR

SEQ ID NO: 22436 - protein, 254 aa, A.fumigatus
AGGDRLSFLAAVGEDDFHGQPHVRHAGGDHDDPEDLDGGEREDGLAVQVLEGQADEQRAGLRDVLRQQMQHEFLDVVEDAPAFLDGVEDRRKVVVRQDDVRRVLGDVGARLAHRDADVRVLQRGRVIHPVARHRGELAPAMQRVNHPHLGLRGAPRNDQRERRQRVHLAVGQLVELARRHDHRVGHVRGDASQIRREDPHLLRNGRGRPRVIARHHVHGDAGLGAGADGPRGFGAGRIIQPDQASSPRGRKDPS

SEQ ID NO: 22437 - protein, 211 aa, A.fumigatus
RRGGTVCPSWRPLVKTTSMASPMSGMPEVIMMIQRISTGASGKTDWPSRSLKARPMSSVQACAMFSDSRCSTNFWMLSKMRRPSSTALRIDAKLSSVRMMSDASLATSEPAWPIAMPTSACFSEGESFTPSPVIAANWPRRCSASIIRTLVCGAHRAMTSGSVGNASTSRSVSLSNWPAVMTIASATSAATLPRSDGRIPTCCAMAVAVPG

SEQ ID NO: 22438 - protein, 74 aa, A.fumigatus
KCVATVFSCSDYQMTFGFRPDARREDPSNDIATELAILGPPGLAEHHAQLQLVWANHINYSSCFQESILFFWCA

SEQ ID NO: 22439 - protein, 322 aa, A.fumigatus
PLEHGMDMGRMKSEVSIFSRSATVECKIRDVLIGIDFKYLTPKLRLEPSMLSDSQVFSKTFHMVCSSSRCITIVEDILRRRDDLWKEGKAPSATGATKRPIFIWEPVPDLCTPEEQDRFLEAARVVDVVSPNELELGMMFGQPGWTEDSEFGRDVVTRILTSGIGPESEGHLVIRAGKDGSYTFSRKERIWLPAYHQPGTSGVTAVVDPTGAGNSFLGALAQGLISSERDPGMIISSVLAKCGDWQTITKASAKQRDMLVALICATVAAGFVVEQIGVPRLTLSSEGKELWNGTEFTERVRLYTQRLYRTFEESPRKHFRNN

SEQ ID NO: 22440 - protein, 62 aa, A.fumigatus
RHDRAGGPDASTGSGFPLTLLLDGAVPSLYLESPTAFLWQFDSDPYLSFVSYPSGCRLQKCS

SEQ ID NO: 22441 - protein, 243 aa, A.fumigatus
VIGSGILADAGCRRGVADEILARRGEERGRKRELGDSDPFNDSHHAAKRSRSESSHSMSSVSTISTSRSHSVSPPRHELYTESMGRDRAQSMSSPQPQSRKRRYSVSLSYHTDSSFSSGGRQRSRSREWETDRNTRRRRRESSPEERGRPRNISEDGSRRGRTRSLSMDQSRIAKERLSATPDTVKGRHHPTRESRGNLSRSRHLDRQRDHAFSRPTSGSARKERSLSPYSKRLARTGLHHLG

SEQ ID NO: 22442 - protein, 67 aa, A.fumigatus
LDFIVAKTNTIYLPQIQYQRAQLLSFYTTIVIWLTGTETCVLLLCSNISIYAGHTISAKYAYNHLEV

SEQ ID NO: 22443 - protein, 112 aa, A.fumigatus
FSNTSQDEPWFADGKNLDFQHGNSREKCPFAAHIRKCRPRGDVKDTSTSSMMRRGIPYGDEVTKEENDEQITKKERGMFFLCYQSNIANGFRRVQERKQSNHCINTTYYLAP

SEQ ID NO: 22444 - protein, 222 aa, A.fumigatus
KYSREEYGEGQEQEVGGSIHGSNEADCAWSLPWKCRGIIQMGNASKSRINAFVSLTDARWVWWNTTTREAGIPAHRHKWVQGADSSTQDLLAHMSDICYFINQMASPVLSSLSSLVIEHKHDTNDEPCRAPPEAILIHCDFGISRSPTIIVAYIMRKLCMPQADVLQFVQSKQRIKPSPNFTRLLKFERRLDIKYGRTKTRQSRRHLRSHMVFIHGGWPIGR

SEQ ID NO: 22445 - protein, 126 aa, A.fumigatus
RQPFVIGTLLELSAARAVNELGGNDESGDVYAYAQRLMANWDAGNFSRDVTNWFTVDRMLQENVPIYNGITLALQVEGVASDKTVSGPLRRRLNNLRLLIANHNEMAPENVHQKPTLGYHQSQLLH

SEQ ID NO: 22446 - protein, 136 aa, A.fumigatus
VTCPRSLPKLRYVPPPPLRPAPPRRTSPLGLTTPNNTSAMPLPSSFPPNHAWRCVFTRSAHGSMLNGVPLWVRRMASGTTSRTAVTREATAGGRSMWDRSNPSDSWSRVSPTPRIVMSARFAASTARAIARSGSTT

SEQ ID NO: 22447 - protein, 280 aa, A.fumigatus
QSLSRRPAYHRQHDCATRWQFFFGKGTLEETATVDLVQGQSYQIKVQFASGLSSKLVKPGVVNFGGGAGRLGMVQVVDPERAIARAVEAAKRADITILGVGLTRDHESEGFDRSHMDLPPAVASLVTAVLDVVPDAILLTQSGTPFSMLPWADLVKTHLHAWFGGNELGNGIADVLFGVVNPSGEVRRGGAGRRGGGGTYLNFGSERGQVTYGEGIYVGYKLLRKSPTSCALSIRVRSAPVHPCCFRSNSLLTRFVPQARFVVHLLCVLRFDGRHRVRYT

SEQ ID NO: 22448 - protein, 72 aa, A.fumigatus
TNAKDRFLIVLWTLYLRYTYLKRDPVSLLDAETHLGLLPGAAANAVAYHWVATAHPRMEMSRDNTFSSLQPP

SEQ ID NO: 22449 - protein, 200 aa, A.fumigatus
LFELRRYDHRSASASSSANDSFNSPFSSSTSGKSGIAIKASTSKPNRFTQLFSTSPKSKSEPQSAQSALQAASGTFQPSPVAPPISSASLSLPTISLSTATAGNPNMDEPPTTLFQPPSPEEARRQAKQHAQFGPIGHPSHRYSSRHPGGVFPEPVMDEPPYYYLLTTYISYLILIAFGHVRDFFGKRFREENYRHPETR

SEQ ID NO: 22450 - protein, 88 aa, A.fumigatus
LLITEFIPSSALHHRRSTTATWTMINHPISWVHTYSMHLGYQSRGRFDSFITTWVLTMRGASCSRHYQPKLCRPSILGLGLCLCPPGK

SEQ ID NO: 22451 - protein, 142 aa, A.fumigatus
RLWSDSSLISPRIPPNCRFEIDDFESPWSYSQPFDYIHGRELEGAIRDHDTLFRQAYENLRPGGWLEMASMDVNSYSDDGTHLKAVNMVEGVKNMHAASKKHGKDMTTAPTWKAKMEKAGFINVREDIYKVLLCHTFLVKPY

SEQ ID NO: 22452 - protein, 132 aa, A.fumigatus
HTQGHTMSGIGWGAYGTRVGQSQGVDVYSLGHNLLLKASEYAAKYNLNETVEYDPKWSRCEAVIVHGPWATISEQRRGETNQNPMWDILYYQYVVKRKAKAPWTTKAREFEGFEGAVSSNDHPSWGGLIWAY

SEQ ID NO: 22453 - protein, 122 aa, A.fumigatus
SFLTPMAAGTQATREGWRASYRALGIADAVLLGLFIFFYEETKYTQVVMGVSSSVQVGDAPNISVKDIKTDRQPDIECTTSRQESDTAPAQHRELDYNIPLKTWRQRLALVSYTAEPIWPCL

SEQ ID NO: 22454 - protein, 82 aa, A.fumigatus
  UNSURE (82): Identity of amino acid sequences at the above locations are unknown.
TSAKRTLTDALPGDDSWLDLDTWLWTGSRLPNCSRSQTDTYPRSYNALFRLFPFYFGDNLVYLAFPQHNMRWSLAGLLPSLX

SEQ ID NO: 22455 - protein, 82 aa, A.fumigatus
NVLHAALLGGHLAVVEFLVIIWPELKYGLMDIPPCDIWLIVTAGHAPIVEYQLFTGVGFKLWCALLWFFPKRLCSPQLLYMA

SEQ ID NO: 22456 - protein, 75 aa, A.fumigatus
VDSNYAFLLPSWLQPGNGRFSLFLLLDFPIVESIYVSDTPTLSVNPVNPSSIWLLSASTAFDRFPGISRPTISLS

SEQ ID NO: 22457 - protein, 86 aa, A.fumigatus
LSATAAKAALRRKKVHEKNLEQTTAQIAQLEQQIYSIEAANINQETLNAMKAAGAAMTQIHGSMTIDKVDETMYVFICNSYREGRY

SEQ ID NO: 22458 - protein, 141 aa, A.fumigatus
KRFRPHTPSLMQRQLRGRRCIILLCSFLVRVSLLLSLAIGLLQILRPDKPGISTVPGNEFLVRPLLDDSPSGHHSDVIRLLHRRQFVRNGDSRAADRDIIQRALDNLLSLGIKSRRGFVQQQNRRPRNDTPSNGNPLFLPS

SEQ ID NO: 22459 - protein, 281 aa, A.fumigatus
RHLPRQYETQIGERARMLSGGQKQRIAIARSIVSRPSVLLLDEATSALDPKAEKIVQSALDNISVGRTTITIAHKLSTVQKADNIAVMSAGRIIEQGTHQELIARDGAYARLVRAQDLEKADGKAQEQTDSDEETTEKDDATSAAKLSLHQTRSVGAESLSADDKAKTAAKETMGYSLIRCLWLLIKEQPQLWGLYSLVAIACILGGQCAQNISQTLPLTNGRGHIPSTSHHSGADIASLSTKRQRGCSAGRFLGADVLRCRPCQPLHLLPPGMAVNTTGL

SEQ ID NO: 22460 - protein, 67 aa, A.fumigatus
METPQLPIFRICPVPPTACSGRWCSHIQPHYGKRAHNIPAPELNTGRCHFSNFKTPFTLFMQSTRAL

SEQ ID NO: 22461 - protein, 345 aa, A.fumigatus
  UNSURE (253),(260): Identity of amino acid sequences at the above locations are unknown.
DHPHITTRFHISSHPTQQIMFARVFKAMPARASALTSVNASIPARFMATVRQQRPAHERATFTIRDGPIFHGKSFGARTNISGEAVFTTSLVGYPESLTDPSYRGQILVFTQPLIGNYGVPSAERDEHGLLKYFESPNLQAAGVVVADVAEQYSHWTAVESLGEWCAREGVPAISGVDTRAIVTYLRERGSSLARITVGEEYDADQDEAFTDPEQIHLVRQVSTKAPFHVSAADPQCHVAVIDCGVKENILRXLVSRGAXITVCSFDYPIQQVAHHFDGVFISNGPGEPIHCQETTYQLPSLEWRPLSCPSSVFALCHQLLALAAGAPTSNPTMVNVLITSPLRN

SEQ ID NO: 22462 - protein, 78 aa, A.fumigatus
FTAMYSSTPSPITLDYTLHDLYIASQEDGLNTVLIYYPLQFGHNHEGKSAKFAYGYKVEEEDEFATSLTMAANLVPQR

SEQ ID NO: 22463 - protein, 252 aa, A.fumigatus
  UNSURE (246): Identity of amino acid sequences at the above locations are unknown.
LEDVRQGLYLAVDLGGTNFRVCSIDLHGDTTFNLTQSKIMIPRELMASGTSKDLFLFLARQIEAFLRIHHNEHFEAHLRRRREPNSEEELFDLGFTFSFPVRQLGINKGTLIRWTKGFNIPDAVGHDVCALLQNAIDELDLPVRVAALVNDTVGTLMARSYTSPGDTSTFIGAIFGTGTNGAYVEKLDRITKLQTIEHADYEKSTGEMIINAEWGSFDNHLSVLPNTKWDKELDEDSNNPGIQMFXKRVSGM

SEQ ID NO: 22464 - protein, 63 aa, A.fumigatus
RPADVSGELIRSDITENQAGVPLYVDVQMVDSSTCEPVTGVYLDFWHCNATVSLPCIGANGCN

SEQ ID NO: 22465 - protein, 142 aa, A.fumigatus
LCPVLTHSLNETTVNANNTLQALYTAHSAHVGQIFFDQDLISTVEKLSPYSTNTQELTTNDEDSILAEEADTIDPFVEYGFLGDSGSDGFFAWISLAMDFLQSSFGTPAAYYTEDGGARTATSGGPVVPVGSGFGGPWRGFS

SEQ ID NO: 22466 - protein, 136 aa, A.fumigatus
PTPSTKPPSTPTTPSRPSTPRTPLMSARFSSIRTSSLPSKSSRPTLPTRRSSLLMTKTASLPRRPTPSIPLSNTVFWVTLVLTVSLLGSPLPWTSSKAALGLLLLTILRMGGPEQQLRGVPWSPWAPVLVAPGGAS

SEQ ID NO: 22467 - protein, 180 aa, A.fumigatus
GGEVFRLLRGDVCVAVDRRSQDTTSGFNTEREGSNVEQQDFVGEFGRGVTRQDSRLNGGTVGNGFVGVDGLVGFLVEEVGDETLDLGDTGGTADEDDLVDGGLVELGVTQDTLNRLHGRAEEVLAELLETGTGDGSVEIDTLEERVDLNGGLSSGREGTLGTLASSAQTAESTCVGGEIL

SEQ ID NO: 22468 - protein, 155 aa, A.fumigatus
  UNSURE (127): Identity of amino acid sequences at the above locations are unknown.
TGLATVNRDTIGKGSTYLLVLSLEFINKVVNKTVVEVLTTQVSVTSGSLDLEDTLLNGQEGNIESTTTKIEDQDVTLALGLLVKTVGNGSGSRLVDDTEDVQAGDETSILSGLTLRIFELGGERDYXLVDSATEVSFYGLTPPGPGPWEEISSRG

SEQ ID NO: 22469 - protein, 218 aa, A.fumigatus
PLRRVSSRSRLPLVTLTWVVRTSTTVLLTTLLMNSRESTRRYVDPFPMVSLLTVANPVHRISPPTHVLSAVCALLASVPSVPSLPLLRPPLRSTLSSRVSISTLPSPVPVSRSSARTSSALPWSLLSVSCVTPSSTSPPSTRSSSSAVPPVSPRSSVSSPTSSTRKPTSPSTPTKPLPTVPPFRRLSCLVTPLPNSPTKSCCSTLLPSLSVLKPLVVS

SEQ ID NO: 22470 - protein, 116 aa, A.fumigatus
FKDSQRQATKDAGLIAGLNVLRIINEPTAAAIAYGLDKKAEGERNVLIFDLGGGTFDVSLLTIEEGIFEVKATAGDTHLGGEDFDNRLVNHFVNEFKRKHKKVCRSLSYGISIDSG

SEQ ID NO: 22471 - protein, 175 aa, A.fumigatus
PCSQDLTTNARALRRLRTACERAKRTLSSAAQTSIEIDSLFEGIDFYTSITRARFEELCQDLFRSTMEPVERVLRDAKLDKSSVHEIVLVGGSTRIPKIQRLVADFFNKEANKSINPDEAVAYGAAVQAAILSGDTSSKFTNEILLLDVAPLSLRIETAGCVLTPPINRNTNIPP

SEQ ID NO: 22472 - protein, 222 aa, A.fumigatus
  UNSURE (219): Identity of amino acid sequences at the above locations are unknown.
PKQMAEEVRNASVAIPRAILLSVLINGALGFGMLIAVLFCLGDLDAALATPTGYPYMEIFRQATDSLAGALGMTSILLIIGVCSVIGMLAATSRQFWSFARDRAVPGWRIWSKVSYPHPHALSRTITDMLPRQVSPTNCLPTYSIMLTMTVCCLLGLINIGSSVALNAVVSMAVSGLYLSYLMVGSLLLYRRCTGAISQYDHGEDGVISLHRGWKAFQXTIT

SEQ ID NO: 22473 - protein, 168 aa, A.fumigatus
GEDMTGRHTIESPIGTTNLIVIGWVTVIGWQAAFASSSFLAGTQIQGAIRLGHELYQAKPWHGTLLMWAAVLLALGINVVGGKLLPRLETVILVVHLLGFFAILIPMTYMADHKSTHEVFLEFVNSGGFPTQGLSWFVGMTGCVFAFAGGDAAVHVWNSLRTPLQKIG

SEQ ID NO: 22474 - protein, 265 aa, A.fumigatus
RRIDKTSIHCFLLRNPRLQYINVSGLSTVTNSAMKIIAQKCPHLEILNISWCTGVNTTGLRKVIQACPRLKDLRASEISGFHDEEFTLELFRRNTLERLIISRTDLTDDSLKVLMHGIDPEIDVLTDRPIVPPRRLKHLDVHQCPELTDVGVKSLAHNVPELEGLQLSQCPQLSDDSVIDVIRTTPLLTHLELEDLEQLTNNTLVELARCPGAERLEHLNIIYCESLGDVGMLHVMKSCPNIPFVEMGYTRIPDLTLKEAIFRVR

SEQ ID NO: 22475 - protein, 74 aa, A.fumigatus
YIRSFYKDKTSSLKFFLFAWSIRIISSSLKHNITLIGAGTIGISLAALYLAHLYSLESLTIIDIWPDLAAVVED

SEQ ID NO: 22476 - protein, 84 aa, A.fumigatus
RGCRPRVKTDDSVAAQIYKFNAVDMCELAKHSVEQSGFELSLKKRWLGANCSLRGVAGNNVAKSNVPDIREQFRHETLLGELAL

SEQ ID NO: 22477 - protein, 63 aa, A.fumigatus
GRVLILVNSKQYAIRPTIRGNNKFNRDSVIKTIADVVGPEHPVDLKNYDLIILVHLIQVSCLI

SEQ ID NO: 22478 - protein, 70 aa, A.fumigatus
WNDTQHHLSGQPSYKATHLDKMDKDDQIVILEINWMFGAYDICNCFDHTIPVEFIVAPYCRPNSILFRID

SEQ ID NO: 22479 - protein, 318 aa, A.fumigatus
GETVISAQSLENAKQDKVDVWAYGCTLFEFATGNPPNSNLRERMQIGRQLNRTTPRLANEDYSEGLKDLVSFALESDPILRPTMADIMSHSYIAETDEQYPTSSLSELVRIYYQWSQRGGQRISLFHPGGAAAAEFPDYEPDFEEDWNFSTTDGFERRFSVIDLDRIAASLAELEEEMSPATTNQQDRDSFDEPAGPEMSMEDKANFDERVRRGAAAMEGLFNEDMPSYKYETKNDFVPIEPKPPASDLPLRTETDRSSVTSTFIDIDIGSFDSSHYAAGAASAQPFQLADADTIRANRSAGRQQHKSSPRGWKEQRH

SEQ ID NO: 22480 - protein, 179 aa, A.fumigatus
EQLVISLRKGSSSPSHESWLLACVRFTRLVSSIGTLRVCSFGCRNLTQLLTPLVAANILIHEEGRLQICDFGVAGVLQSHVDKRSTWIGTPHWMPPEMFSTRGEAHKYGSEVRLSFLLSPLRMLNKTRSMCGHMAALSSNSQRETPQTPIYGSGCKLEGNSTVPHRVLQMKITVKALKT

SEQ ID NO: 22481 - protein, 258 aa, A.fumigatus
ITPRESFEMRVRLPRTRYGVSLVFRCVVCIGSSASHVDQTQQVAIGNGALEESQGKAMVDEALKRNVKFFVYTSVDRGGESSTTNPTRIPHFIHKHNIEQHLMEKARNTEMRWFILRPTAFFDNLVPGFFGKVFATCFKMALKGKPLQMVATSDIGYFGAEGFLRPDTYAGRGLSLAGDELTYDQMVEIFEQKTGQQIPSTFRPLCSFFMASMKDMGYLFKWFHDARYNADIPELKRINPNLKDFGAWLDEESEFRKR

SEQ ID NO: 22482 - protein, 63 aa, A.fumigatus
AVPKTAEVIKGNGPYLTQLACHPEFYPEILSWVDPPPSCIDGAFRHQPCSRPGILSEPIASKS

SEQ ID NO: 22483 - protein, 177 aa, A.fumigatus
KLGILGFSRALAIEGAKYNIKVNTIAPNAGTNMTRTIMPEEMVQAFKPDYVAPMVALLCSDMCPEPSSKGLYECGSGWFSSTRWQRSGGHGFPVDVKLTPETVLKNWKQITDFDDGRADHPQDSQAGTEKVMANMSNRSGGEGGNNILANIEKAKQATTEGTAFDCLHHGAGRSRAT

SEQ ID NO: 22484 - protein, 96 aa, A.fumigatus
QGLHQHERMISGTAVINVHLRGTYKVTKAAWPHMLKQKYGRIVNTTSTSGIYGNFGQANYAAAVRPRIRSCSLEPYGFANRGLEIGYPWFLPRSGH

SEQ ID NO: 22485 - protein, 100 aa, A.fumigatus
RSHQLTARGKDDLLIDAVAENMQQWTRLQGTLEEQLSQARHFVSQYQRYSETRRFSEQMHQTIDAAERDIQNQVDKLEQTMRDLLQIASYITPFHVQHQN

SEQ ID NO: 22486 - protein, 177 aa, A.fumigatus
IRLCHRASMGTVAVAHTVWLFVLARLLQGGATAMVAVAGLALMTDSVSFDNLGQTIGYLGSSIALGFLLGPLLGGLVYNAAGYNAVFAMAFAIIGVDFVMRVAVIEKKVARAYLSDSPEENPREEYPQRPPQISETATGWRNIALLRIASQPRVVISSFALLVQGILYSAFDSVRSS

SEQ ID NO: 22487 - protein, 143 aa, A.fumigatus
  UNSURE (112): Identity of amino acid sequences at the above locations are unknown.
FLACRTINNLAYLVPILTNVLVGRRTMHHGPFYLGHAPGMAVNIITVAWLVFAIVFFSFPYYMPVTGECKLVDKKLVASAKADRLDSGEYELHLCLCWWIPAHRVALVGCCXGQVLEEYAEGARGGAKCCSCYDGYSRGKRVG

SEQ ID NO: 22488 - protein, 84 aa, A.fumigatus
VPVEFSGLSLETAASLFRECKQLSNASHFVLRNPPNMQSSWAKVNPHFETPFNAQLCVGIITALLGCIYLGSSTAFNAMMSSAV

SEQ ID NO: 22489 - protein, 202 aa, A.fumigatus
SSLVGIYEKQSTPGPAYSSLDIQDSVHQSSSTHKRHSSLKPSEWSHQRLSENKAVDSESDDESDGEWKDMPALGEFDVYDDYGRLIARGAKEEGDDAVYQGLGGAGKGYTRVQLDEDAQSATSLDQDTSYLFKETAGNSVGVEGEELRDPLSQLQATKDLLTESQRIAYVGVTRLMIYQMTQDLEKLPTTKASRKAKQKAAD

SEQ ID NO: 22490 - protein, 208 aa, A.fumigatus
NLGNMHILPGSQHAAELDNSGTLIHSVHCDPEQKAKNIPQSTGIAQASSEWRPSYHLAAPRGWMNDPCGLGYDPTTGLYHLSFQWNPHGNDWGNISWGHATSSDLVSWQISPEPCLTPSAEYDRCGVFTGCFRSHGPDGKPGVLTYVYTSVNHLPLHYTLPYVKGSESLSIAVSRDHGKTWQRIDSNPIHPGAPAGLEVTGWRDPYLN

SEQ ID NO: 22491 - protein, 76 aa, A.fumigatus
PGSKALGDITAGENNGMASKAHELAACFEAEPCCWSGDDNSLTGESEMQWGWRHGGVGRIAFCQVCGSFTDELIMA

SEQ ID NO: 22492 - protein, 236 aa, A.fumigatus
IGALPDSVCMDPSLSHYQFICERSTNLTKCDSSNPPVTPTPLHFRLTGQTVIVTGPTAGLGLETCRQLMGLGCHTIILACRDVAKGFRTRSTLLSEYVTRAAMHGSPSVKVLKLDLGSFDSVLLFASQVKSEIPVVDILILNAGVGFLKDFRSTPDGHELTLQTNYLSNVLLLLELLPYLQQSARGRQPARVTWLGSRSAYDSNLVRMVAPHSDLFGVSGRVSSPRAGDPRLGDPQ

SEQ ID NO: 22493 - protein, 121 aa, A.fumigatus
YLFHTTTVSILILSPVIHDQILGMPSGPRKRMPSVSDDCNNSESFQQKKAKKEASISSSPHNMHNAVNWKIDANGDKFWELSKMRRVTISSFRGKTLVNIREYYEKDGQELPGKKVIMRST

SEQ ID NO: 22494 - protein, 231 aa, A.fumigatus
DEVIPEEQWLMAVDADDDTIENAIARKEARVERRRLNKEKRQKRAMGIESSPEPSRESSETPQPKKRGRRGPAPKRKAEEPVEETPQPKRKRGRQPKPVETLSSEDRATLQRILNTAYQALMDMEQELPADSSDSEDGPVTRSIIEPFMKPPPKSQYPDYYLIIQNPIAMEMIRKKINREEYQNLKDFRNDIHLLCQNARTYNEDGSILFQDANDIEVSFSSVTLLVFLLS

SEQ ID NO: 22495 - protein, 204 aa, A.fumigatus
YFRATVASFQPRGEDSSAGNSDFLTAATGSSISPFTSDTSSGTASSVAVASVGSLMATSPLACSPVVVMGSWVDSTVAGSLATASVSGDSLTGSGTTVSGAGASSVSGAAGASPLDLAAFLSLASTSDSFASSRVTGCSSNPGSLVSVTTAGFSLDSASSTAEVLAVPSETTGSLTSDGLGAASATDSWVTGLSSVRVSVARSS

SEQ ID NO: 22496 - protein, 283 aa, A.fumigatus
ENFLLRRTSSAISGRHQRKESHYARGRRVRNRGSEETPCQTLPCRGAFPRKPQLKSLQKKSPQFNKCQNLSKQTLREHAQDDLATETLTEDKPVTQESVAEAAPKPSEVSEPVVSEGTAKTSAVDEAESSEKPAVVTETKEPGFEEHPVTRELAKESEVEASDKKAAKSKGEAPAAPETLEAPAPETVVPEPVSESPETEAVAKEPATVESTQEPITTTGEQAKGEVAINEPTEATATEEAVPEEVSEVKGEIEEPVAAVKKSELPADESSPRGWKDATVALK

SEQ ID NO: 22497 - protein, 246 aa, A.fumigatus
SGQAVRMAISMNLGTLAGMSHSDELRQGKAVILGCFVVDSLLSFRIARRPCMHPRDLTGVGLLEEDGLEEWNSWADVLPSTGTARGRTPRRGPLLTLSCFNRLVELASVLNRIARDAVGLPNVHTFAQQLVLELKQWDDRLPLGCRLIGPESIYPERHSSVLPHQSYLGLTYVATLLWLYLRIVPQELDLHRSQRPAIEGAKKLLFRALPMITQHLENFPTCTLPPIFDFLHAQSVFTNGAWKDPR

SEQ ID NO: 22498 - protein, 106 aa, A.fumigatus
PHIYNMSGYNGRRAPNFSQYLEDLNAIPSPYDQALQQQQRQDTFNLDAELSLFTNTEFFDFDNLGDLNLPSFDAVNEDSAKTTDQQHGGPAAHNPDMEFLDLLGGE

SEQ ID NO: 22499 - protein, 248 aa, A.fumigatus
RRPQQEPLAHYRRLRTNHVRHRQLLPYLLRGPCRPSGPHDVGLLWLRALYDDGIHSPELQGKGKRACNVLSLRCVLLSLHAHLRRICQLHPLGLRAGDPASSRQSERNRRGDFFELDLGELSVLPFERRLLIICVQNFFVVMITPIIINRLQWKAYLIFMCTNFAFVPLVYFCYPETANLTLEEIDYLFTNPQKTAVKISNELHKEGKRHGHTSLAHINARGRDRSVIEDTQEKAPAIQAPGEHLENV

SEQ ID NO: 22500 - protein, 155 aa, A.fumigatus
DGINLVVYGVLAKLLSRPVTDKDRSYFIPTVLNSNVGLSKNLSLIIGGCVQIMFVIGSFFPTFFVDRVGRRVPMMWGSFGLGLCMMMVSILLSFKGKANEHATSSASVAFFFLYMLIFGASVNCIPWVYVPEILPLHARAKGTAVGISSNWIWVS

SEQ ID NO: 22501 - protein, 66 aa, A.fumigatus
RTRDLSAPVVDTQNMHIANQDWFVGIVAIAYDSVNGLGECSALPLVIEDNTGSSYVQSARWGYELR

SEQ ID NO: 22502 - protein, 359 aa, A.fumigatus
  UNSURE (343): Identity of amino acid sequences at the above locations are unknown.
LGFLSVIEVLLQQNGQPTRTIVLAFGFDEKSHGFLGAGSLSSALKKKYGPDSFEFILDEGGMGLESLGDDVVYALPGVGEKGSIDIVLSLDVAGGHSSIPPPHTGIGIMAEIIYELERQALFVPVLTDDHPSRRMLECQARYSPNHVEPWLASGLQSSDHVALAEKLASSRGDAFRYILQTSQAADIFNGGIKANALPEKISALVNYRIALHQTPELIKQRAIDIIAPIADKHNLLWTAFPETTAATAHKPAVNNQLTLTTLSTPLVPAPVSPTNIDTDAVWARFAGVARTSFESVPSLKGKTVVVSGDIMTGNTDTRFYWALSRNIYRWSPSRRGRSLNIHXVDERVAIDVHLEAMVL

SEQ ID NO: 22503 - protein, 60 aa, A.fumigatus
QDQSWLTAFIFAAQDYNEQNCYFNSPPFVGCSKKKANEAFIFWALYVPRLLVASWFFPQW

SEQ ID NO: 22504 - protein, 70 aa, A.fumigatus
DCSYLSIDIKPISQLPVLYTGKDTTTAVTMSDFPTAFRAAQILGLTGAAWLSGLSIAPLSNITYQTLTLI

SEQ ID NO: 22505 - protein, 98 aa, A.fumigatus
DQGIAATAATTAPTKGNAPLTAFNTPHLSISDSTSVLVASLSSLDPTFASSDRFVPIINANVYGTIPTVNNPDTAYRKLLFGAATSDNAVPSRTDQDR

SEQ ID NO: 22506 - protein, 425 aa, A.fumigatus
  UNSURE (40),(81),(110),(338): Identity of amino acid sequences at the above locations are unknown.
WWWAKFTTSKSPSFLVGSTGTGSSLFGAQLQLFNPRVLGXFGNNQGHQHKIGLGTSSFSGTTQQAQPLHSKQAQQPVPEAXQASLLDGNPYGNQSIFSGLPAPSAPSPGXLATPLSSSIKQKQRTPLPVYKITPTAANRLITPPKRQGYGFSYSTYGSPSSTTSTPTGLGSSLLGGSLRGSVGGSLGRGSFSKSFSTSNLRKTFDPETDSVLSPGALSGTSRLSSGSLKRLTIDRSLRNDLFARPASTPAAPITNGEDATQTTDKLKKRVSFDASSSKAPEATTGGEIVPVASESPEPTPEELGFLRSIRKPGSVNGINGVKASTDMVARPEMESVRXKDLPVVPEDSEHAATDRSNKIPFVPGSDPKPGEYWMKPSRAELSKMSPEDLKHVVGFTVGRQRCGQVTFDEPVDLTTIELDQIFRGL

SEQ ID NO: 22507 - protein, 154 aa, A.fumigatus
LQNLDALSNLRIISIQSNRLTSITGLSSLKNLEELYLSHNAITDLSGLESNTSLRVLDFSNNKISKLEHISHLKNLEELWASNNELSSFEEVERELRDKEKLQTVYFEGNPLQTKGPAVYRNKVRLALPQIMQIDASKFSFFAGRALGWVADDI

SEQ ID NO: 22508 - protein, 65 aa, A.fumigatus
MSLWERIHTLGGLTAELRETDWSTGEQQLHCLRQVLLRKSRTLLLDEATSRFGAHPISGRFRLDC

SEQ ID NO: 22509 - protein, 94 aa, A.fumigatus
VPCLYIFFVVSVCLTLAIVNTFWCYLMPILGAYIADEFWGRLKTIQVSIAFAMVGHIILIISALPSVIAHPHGALGCFAVGLVIFGIGVGGFKY

SEQ ID NO: 22510 - protein, 159 aa, A.fumigatus
HVCNRSNIAPLIAEQHKETRSFIKVIPKTGERVIVDPAQTITRIFLYFYFMINVGALVGSIAMVYAEKYVGFWLAFLLPTIMFAFCPAVIFACRNKYEVTPATGSVSAKAFKLWAFALQGRWSWNPVRLLVLLTPCRVFFVLTPLVACGIASLLTSGRE

SEQ ID NO: 22511 - protein, 66 aa, A.fumigatus
HLMTNGSMKYAELSKRVLSFSGILSTVCVHITNVVNKTYRDDRVGLWADDQQSDLAGSHNAAERCP

SEQ ID NO: 22512 - protein, 160 aa, A.fumigatus
RRRLGRLNRHGVCREIRGILACISSPNHHVCVLPCCDLCMPQQVRGHTRYRLGFRESIQALGFCSPRPLVVESSAIVSAPHSMSSFLRTDSPCSVRNCQSPDFWERVKPSRVQNKPEWMTFDDQWVDEVRRAVKACAVFLWYPVYCMCPYHKRREQNLPR

SEQ ID NO: 22513 - protein, 93 aa, A.fumigatus
RHADFPWASLGDALVVDVGGGVGGFPLQLSKVYPQLRFIVQDRGPVVKQGLEKVWPRENPEALHQGRVQFVEHSFFDTNPTEGADIYFLRYVL

SEQ ID NO: 22514 - protein, 60 aa, A.fumigatus
QVLSCSCKLINVTQSLLLHSSMQITPHPVADLDQSYPAPTKKEMHFCFLVRSPSRRPTGV

SEQ ID NO: 22515 - protein, 282 aa, A.fumigatus
ERGTFQPRGEDPPLLDYPSSRSRLAELGHDGIRCHHWGPSPVRKCPKITSSPCITSDWNRIYVVRAVASKFFDYRINKTQRHLEDLQKQRDETIEKLKVATKYNSTQQLLEKYGAESPKPSRPKGGDEKRKTDAKRKQPSTPQQPVMRTGLPPPPTANIRRPTPAQSPVSSPGQPQSPPSYLIQEQPQLQNSHPPVPPALDEPGFAPNAFPSAPQYVEHSSLVRPFARHPTRRGRDPPHEPDGVDMRHLPTRQRGSPAGGQDPGITWAAGGVGTCRGMGRGK

SEQ ID NO: 22516 - protein, 66 aa, A.fumigatus
SVVPSSRGVKTLLYSIILALVLGWQNWGMTEYAAIIGGPVLYENVPRSPRVLVSRLTGTGSTLSEP

SEQ ID NO: 22517 - protein, 247 aa, A.fumigatus
IARDFRLLSDTYERDPRRSQEELKLDYIVTGSWSLKAAQEATRLVGAKHVNIALDARTASNGKFGKIPAEDTWTLSPSKNSAFVYFCDNETVDGVEFPNFPKILESDDRIVVADMSSNFLSRNVDVKKYSVIFVRILPCDEVWFSSLRANGQQGGAQKNIGIAGISIVIIRKSLLPPQTPTPAPALLHRLNIGGLPGSVVLDYATIAKNNSLYNTLPIFNLWIAGQVMAELVQTYGVQKISGHQQIS

SEQ ID NO: 22518 - protein, 151 aa, A.fumigatus
VSALVGHQETNSVYLGGYFKYENTSNAVAWIGGEGWKTLPFDGLNGPVESILKNDDGHVIFAGSFDGVGNSTSSKKKEQIVNLQDATITSDAVSSRSGYSDPRNVICQTSGADGEGKTWLLADTSPGFWRADMGFQYRPTKLRLYNTHFEG

SEQ ID NO: 22519 - protein, 86 aa, A.fumigatus
GTKTFLFRRLPDNGIMNFTYTDPDTGYDVHCDSTCPLSDRADEKYRDFEFVNVVGMSGFHIEISDWYGSGAGLNGIELFQESEINP

SEQ ID NO: 22520 - protein, 244 aa, A.fumigatus
  UNSURE (167),(185): Identity of amino acid sequences at the above locations are unknown.
PFRGLLKPNMTDFFAYAVDAFNEPTCASIKYPSKATRTGSWSTTESGQSSSKYLTAHVTDSTADSASVVFEPDINQSGNYSILLYTPGCIQDGTCGSRGVVNVTATVTTDSDQHIQTVIHQTNLYEKYDNIYTGHVDASDSSFRPQVKLTTVAGQGDITVVASRVEXKLTNAASNSTSGDLNGLXEYDPASKDTSENLTQSVVNAAGLQLDSRASVKTLAKHDNRIYAGRKFSKFLNSQYQVFP

SEQ ID NO: 22521 - protein, 208 aa, A.fumigatus
EGLAHLTAIPGLLLHVNSWNIGAPNFFVSLRIMPRNIIQGGGSILRYLHRSNALIRPSRVAIANGFIRRICVSMNSQLVSPTMKTFRPSVILSRPLINSFATTITPDDETETTKSTGSKTGKKNTKKRSSKAATKAKPKPRKKLTDKQKEAKKAEKMKELVKQLKKTALEPPKKLIENPWNLTIATVAKGLQARGVNGTDFIMQCSQL

SEQ ID NO: 22522 - protein, 181 aa, A.fumigatus
SHIKTLITLASNNLVASLKAELEAQKKLGQQSRALQKQLKERDAEVAELKSQVSEAKKQLTSAQSEVKALQTKLAAARNTTASLENAAAKVPGSAIKNNRANRAADAEAAQAAHLSQLKEELYSDLTGLVILDVKKRESDHLYDCLQTGVNGSKFYFEKGGLQDVFLTPRQLFTSNWLSQQ

SEQ ID NO: 22523 - protein, 254 aa, A.fumigatus
  UNSURE (2): Identity of amino acid sequences at the above locations are unknown.
IXGLSLGGYFRGVEDPGAPGGLLEIRSLQSSVVRTNCMDCLDRTNVVQSMLGRWAVSRQLMDAGVLRPGEAANDDREFENLFRNIWADNADVVSKAYSGTGALKTDFTRTGQRTRAGMVQDLCNSITRYIRNNFLDGPRQDGFDVFLGTYLPPDSALGNIQLFVDRRPLIIQSIPYILAAGLFMIFVSIFTKRLPDSAVWPIRIFIFFWVVVSAWCARFIFAHGMLYVSFTFTPLFAWSFVPNIPGLLGPPGPN

SEQ ID NO: 22524 - protein, 62 aa, A.fumigatus
WSTLNTENGEFIIVLDSQDRENEGDLIIAAESITDSQMAFLVRFTRLVHPFLHSIPDSQSAS

SEQ ID NO: 22525 - protein, 229 aa, A.fumigatus
ETGAAAGQGAVNPDTLKSPTSPSVHKVTKYPHSPVPPRPLIPARLPSYTAAPRNSRAPQKTLVLDLDETLIHSLAKGGRMSSGHMVEVKLATPMTTALTPGGPPTTLGPQHPILYYVHKRPNCDDFLRKVCKWYKLVIFTASVQEYADPVIDWLEQERKYFHARYYRQHCTFRNGAYIKDLSSVEPDLSKVMILDNSPMSYLFHEGTSEESIFNVCLLFVSYSDLTVSR

SEQ ID NO: 22526 - protein, 69 aa, A.fumigatus [sequence omitted]

SEQ ID NO: 22527 - protein, 63 aa, A.fumigatus
GVQWRDLGSLQAPPHRFTPLSCLSLPSSWDDRHPPPCLANFFVFLVATGFYHVSQDGLDLLPL

SEQ ID NO: 22528 - protein, 81 aa, A.fumigatus
  UNSURE (27): Identity of amino acid sequences at the above locations are unknown.
LPPSGEGLGSSQILFSYFFETESHSVXQAGVLWHTLSSLQPPPPGLKRFSCLSLPSSWDYRHSPPCPANFCIFSRDRVSPC

SEQ ID NO: 22529 - protein, 117 aa, A.fumigatus
  UNSURE (27): Identity of amino acid sequences at the above locations are unknown.
YHLQGKAWVPARFCFLIFLRQSLTLSXRLECCGILSAHCNLHHLGLSDSPASASRVAGTTGTHHHALLIFVFLVETGFHHVDQAGLKLLTSGDLPALASQSAGITGVGHHAWPIQIF

SEQ ID NO: 22530 - protein, 95 aa, A.fumigatus
ALCHHGAGVAPAWVVKFFFKKTSQKIIFLSQVWWHVPVVPATREAEAQKSLEPREAEVAVSQDRATAFQPGLQNKTPSQKKKKKSSSFSRITIYK

SEQ ID NO: 22531 - protein, 76 aa, A.fumigatus
TQGPSSSSWCPVTLGEAVVPPLQSEEKGPDVAKLFYGFKSPIGLLPPSWTYDVWTSRYIQLRFVFFFDIVICIFKV

SEQ ID NO: 22532 - protein, 63 aa, A.fumigatus
FLCLSLPSSWDYRYMPPHLAEKNYFLRSFFKKKLHHPCRSHTCPMVAESLHEPRGPHPHPGAL

SEQ ID NO: 22533 - protein, 83 aa, A.fumigatus
LTDPSAQCPHPDYHISLLYVDNNSCLNCEYDCLSLNGGGNVTFAKCVMQCQLETCNPLGNLHVHHARRSYPLSSPPGWKDKRW

SEQ ID NO: 22534 - protein, 214 aa, A.fumigatus
SLKLATTATYTMPATVLPAIDDPDTRPPADMVDSDQDAEGEDETDLYEMDQQLQNAVHRAYSGENTDGDQDADYDEDEDAEGEPDTELNINGGNDDAEPVGAVKMPDTAGSLDNDDVASAAADAEDDPAFENLSDTDTPAASPSSSESEADEEWEAESNNREDAEVDTTVRSNCMWVHYSPYAHPVVILSDAEIGEVACLHLEEPIRIINPPPK

SEQ ID NO: 22535 - protein, 64 aa, A.fumigatus
NYAKIFQATLDLTQLYNNVHDVLYSGMRTSNQMMLMGDYVKYVDDFRLAILRWKSRWGSLSCRA

SEQ ID NO: 22536 - protein, 131 aa, A.fumigatus
PHMLTLSATYAFAGSTPMRATMQLSYEYLRLYTNAFAFQAAISQSLVSKHKNNNQSQREHLRATFNNVASMQDARFIYESVDAAKAYLTILVDEVHPEKHLHFMPLRFYLYGIYAAVFLYKVSRSFKMIRV

SEQ ID NO: 22537 - protein, 75 aa, A.fumigatus
QMKPFQRAVLYKNIKFAGVCYTDLHTMKCDWPLKPKWPLVGGHEGAGMVITVIILSVVRLHLICILNKEQSASAQ

SEQ ID NO: 22538 - protein, 217 aa, A.fumigatus
SFDRRCEDHQTRAETRARGPLAAMCWVNVLNAIDLLLSSRVSFDEQIAWMTKCGQSKTADSSYWRRLVWSIEMAFNYRRINTPWQIRAVPAFDRHDPGFVPDKVKFLRQCALRVCGSLFVVHFCTLDLRDAHLAGILSEISDSKKVLLPTWGEWTARRAILQMLFTISFGLLTRAAILGTYSLLAMFFVAVGAYEPVDWPPVFGNVSDMYSLTRVWG

SEQ ID NO: 22539 - protein, 120 aa, A.fumigatus
  UNSURE (13),(23),(30),(34),(44),(67),(71): Identity of amino acid sequences at the above locations are unknown.
HLGTIMSAQLTCXASEPQQKVHXPFLCHKXRVEXLHKLGQECDXLVENYLSSTLKKYGLDYETLRSXHPKXYMQVLQGTAKTGHTTTGLGTMSWPKLKITHAHHWKQKPRIFQVRVTVTD

SEQ ID NO: 22540 - protein, 285 aa, A.fumigatus
PRSIAYNSQRPIVEKHASFAFYHPATEAIAGVVSDIPVKFLMAIAFNIILYFLSGLRREPSQFFIYFLITFIIMFVMSAVFRTMAAITRTVSQAMTLAGVLILMLVIYTGFVVPVNYMHPWFKWIHYLNPIFYAFEILIANEFHGREFTCSQFIPAYPNLPGDSFVCSSRGAVAGRRTVSGDAYIEASYSYSYSHVWRNFGILIAFLIGFMVIYFVATELNSATTSSAEVLVFRRGHEPAHLKNGHEPGADEEAGAGKTVVSSSAEENKQDQGIVFTTGLESARH

SEQ ID NO: 22541 - protein, 228 aa, A.fumigatus
  UNSURE (54),(64): Identity of amino acid sequences at the above locations are unknown.
VAGVLRTQSRIFSVYFHTYQLDSPSTSSIGILKVLSYISQTIDPIESLFQPQWXPSPSKKRPPXPCTTTTTPQPTHPGLIQVNRSPKAFGSSASSLVSLPAGAVFAKITTATPSKKAYTSVQTGRDSHIELNSDLVFCNHSCDPSLNFDMDKMEVRVVDDRPLKVGDALTFFYPSSEWEMDQAFNCNCGSTKCKGWISGAKTMGREELEGYWLNPHIEEMLRERDGQL

SEQ ID NO: 22542 - protein, 63 aa, A.fumigatus
  UNSURE (25): Identity of amino acid sequences at the above locations are unknown.
YEWGKNTLMAFITLFPLAFGRGMVXGITVSAPGNAQQFARVCVCTIIMFSVFLIKRDRSSHLT

SEQ ID NO: 22543 - protein, 68 aa, A.fumigatus
SQVGLIFPRLQYSPSTKNSGSSEPSGIAHLRQSDRPSFARPSTSTDLASDPMNIDDFIVPIESPAESS

SEQ ID NO: 22544 - protein, 107 aa, A.fumigatus
PCHDGIMSGMSHGGAPKAARPTPTAVSASSGYDIADADRSSSSHFHHTSQLSDDFSRGSPISPPDSAHVQDGLLQDSLFPEWRNAAPRAGVESPDEMHRKDPLATHI

SEQ ID NO: 22545 - protein, 107 aa, A.fumigatus
KLYSRTKAQLPNQERMENLTWRMMAMSLKRKERERLQQNKRYVYDNSGAWTIAFFEVRLDSSSLVYNIVLRRRTVAARSRAVLPISVSPTALPLHGHQHPPILPPTP

SEQ ID NO: 22546 - protein, 169 aa, A.fumigatus
EPRDSFMIGVPRFQLRRLNFSGSYIYGPRATFISDIQTRWAVQFSHSQRHNMTTVVNLPRDPNTLSNYNNWVSTHITANFDILFDQRKLAGNVIHRFRSTTDGESNHIILDTNHLDIGSVKVNGQPSEWEYLPRLEPYGTPLKIKLDQGVKLNETIESSPRGWKEPRHH

SEQ ID NO: 22547 - protein, 258 aa, A.fumigatus
NAPHRRFPHQRSSVAEIISFEASWVRNFTLHVPGNFYYNHGAQSVQNVDFCNVTVTYSHPGYDDRITVETWLPRHWNQRLQATGGGGWRAGRFVLSQFFMGGAIGEGYATTTTDAGLGDTMPDAWALKSTGNVNLEYLHNLGYRSLNDEAIIAKDLVRSFYGIPPAYSYWSGCSQGGRQGLMLAQRYPHAYDGIVASAPAQSWPEFVTAVYYPLLAPLWAGEPSPLSCELDFRTAEAVKPCESPEGIVDGIISGPEQL

SEQ ID NO: 22548 - protein, 67 aa, A.fumigatus
PICAFLGLGHSELSRFVPIYQSLEGKAQRKTAILYNMTRMAHHGIPPTGILCYDLSLSDADIISSQH

SEQ ID NO: 22549 - protein, 73 aa, A.fumigatus
LAHGWKSPGGRLHDAEHALEKGQVVAFMAEGKEHACMVGPLKVGTEEMKEKKKGVVMDEGHYLGDGLWKMHWD

SEQ ID NO: 22550 - protein, 106 aa, A.fumigatus
  UNSURE (61),(85): Identity of amino acid sequences at the above locations are unknown.
KCGDAVDRIPTAIAGNHTPPSANLSNSLIMTSCPCLPSQSMPNYIADPEMAVPHDCVFTVXLIGWLPESPAESPFAKLNSRLGLXRRNNIFAQYLIGLWYQPNQVF

SEQ ID NO: 22551 - protein, 344 aa, A.fumigatus
  UNSURE (342),(343): Identity of amino acid sequences at the above locations are unknown.
FKKIGWGERASSEERMRQEAIFSKKYRARRTTQANFSKRKGAMARHFLDPAGERRSNTATGAGIGPDLDMRPSGVDKVPIIRTLNMLSEKIMANVAPVDRDPSAPVGIDDETYKELQLRDLRGDDEQNRILLNIRDQSRFFSQAKVTEDEQSRLFAKQDPDQILRDLRGQIDRDLPTDGTAPLGKLVEPEELEDEDEQKHDQRVGSQANLQRASKQILDAIRDRRNQTEATSTGGTYGLSANLYDRLTLTHATTTEFLHQFWQAFLSGNPDRAAEVASLVESLNRAMERIQSVAPHAEAQRQVEVNRLKQHAREVLEATGKKIVFTTGLYAPRVVISTCAQXXF

SEQ ID NO: 22552 - protein, 147 aa, A.fumigatus
  UNSURE (128),(129),(130): Identity of amino acid sequences at the above locations are unknown.
FSRTLSMHNPKEAAEELRRCVEKYGFLGALVNDTQRAGPDGDDMIFYDQPEWDIFWQTCTDLDVPLYLHPRNPTGTIYDKLWADRKWLVGPPLSFAHGVSLHVLGMVTNGVFDRQSSPGVERGYKSSXXXKNVINRNKGRNWYYIKI

SEQ ID NO: 22553 - protein, 125 aa, A.fumigatus
IPTSISQGEAPVSHRDGLERLPFEEGFGAFRVSKKKTRWWVSLFSTDPETHVKEITDITKIRIQYADKHGVGYQILSYTAPGVQDIWDAKEAQALAVEINDYIAEQIKEYPDRFGAFAYVHSCFL

SEQ ID NO: 22554 - protein, 112 aa, A.fumigatus
  UNSURE (61): Identity of amino acid sequences at the above locations are unknown.
LSFQIAQDNARPSLFHNTQHKVIYFIVKLGISNVLEECHEAFHEDSPIVFINCQLDLPEEXCETYKNKEHSCPTGTWADEAGISVKDHIKDERDSNLYLLSFSERPCLWCSL

SEQ ID NO: 22555 - protein, 73 aa, A.fumigatus
  UNSURE (2),(7),(8),(16),(25),(31),(37),(40),(43),(57),(63),(65),(68),(71),(73): Identity of amino acid sequences at the above locations are unknown.
PXPRPKXXINFCKNIXSFPGPTHFXNAILLXYPAISXAHXALXAGWLKVWRLFTAAXVGAGIXSXVSXTKXEX

SEQ ID NO: 22556 - protein, 68 aa, A.fumigatus
GCDESTQIHRLWKSQRNSSLCRWIEPENSYSVYDAMKTNNASMVESHLNRPTTPSVIIGTGVKVPVEV

SEQ ID NO: 22557 - protein, 67 aa, A.fumigatus
ITLTGFLFVVINFITILWYNPALDHDCPPWVYASCAIGLFLYQTFDAVDGMQAYGLPSSFPSASRLD

SEQ ID NO: 22558 - protein, 158 aa, A.fumigatus
ISVVYSNRPLPSELTSTSQQPAHFLISTATMHSTSSSEGTSSRQSPLQIHIDELSSLPLHDTIQSLVHLLPELTTSITPTGERLVTHPTYEGTGKLDDLGALYLRAADRCTRERASFKTRLLHISLDSMIEALYASSQEQLDKGLEDGTVHLPPVFTR

SEQ ID NO: 22559 - protein, 290 aa, A.fumigatus
RHTTAAAEEACALLDGKPNSQNDANMIVELYHGPVPSALNPQRRNTIDHTATRNMLGNGHLARSSRFNGTFQSLEKLAAPNSSLQSNGDALTSNSESGSRLQSIFSPQSPIGNGVHDLPRVSGKSMIDQDPDEDTGELLKDPVGYAENGHSSSATLPRRSTNPQYPTNRFGNLSLSTNMTSPPLHNYAPGGSGRMGVPTPSSAFPQAINGNTMMGGHGYPYGSQHTPRHSLPAANPNDLNPPCNTLYVGNLPPDTSEEELKALFSKQRGYKRLCFRNKHNGPMCFVEFDE

SEQ ID NO: 22560 - protein, 124 aa, A.fumigatus
  UNSURE (68),(95): Identity of amino acid sequences at the above locations are unknown.
FPRTTTKMATTPNRPAQRSSSQKKRTSFNVPLRRGEVRHHFRIFSILKLKVADISTLLGIDLTTTVAXLDATASDIVAQQRDALIQRKELAQKTXDFRKLDDASKLAEYKGLLKWLGPWPFRPG

SEQ ID NO: 22561 - protein, 261 aa, A.fumigatus
KIPKFKSSQTCLRIFLDTKFSEKVRTPSVMEAYAKENWVQHLHSVQPEETSLEDKKTIASMLARMFGTEENMARWLGMRSWVSTSDNLKAVQRWWNDAEIVESLAVKEAEFVLSVKEKPVETFRPIAELCTKKWLAEDDWVPTAPAAMIISYLKCQRGIDEDFMEHFALTAAEVVEAAEWGQIEKTSRWYQRVAVVLRYTGHIDEALDYFTKALALDPDNWIAKAGMAIAHLSRKEWATALVLDEEIEAILSSPRGLEGPR

SEQ ID NO: 22562 - protein, 85 aa, A.fumigatus
LSGIVHCASSTGECTGPKCHKVSCTGPNCQNGVCTGEGCESEDDDCEAKEAEVCTETVYSSIITPASTYTTEIYVFTTRLEGHAL

SEQ ID NO: 22563 - protein, 70 aa, A.fumigatus
NSAGQYYTLLHFQYTCKLLTAEQSCLRCQKSNRTCAGYQEQASKTLIFQRNYTQSASANVFTTGLEGAVR

SEQ ID NO: 22564 - protein, 207 aa, A.fumigatus
TRVLLAPALRPGISHVILLNKFTQSPVLPLGPTINYLSTIRLRTLDGRYVAVDSNPPGNTNLILLTLVNAPTDNTRFLIRHYRRDSSWEWPFSGNLDADSCNANGNVRLVHVDSRVGDDTVVSCAKNSGGFMYWGVGWGPANDWETFLPYDPANPRSSAKILDGSVIVLRTLWHMYWKAGNDENLYTRLNASTGAIEDATRFVVKKA

SEQ ID NO: 22565 - protein, 210 aa, A.fumigatus
RESNLGHYMKLPPRVTFAGQLVACLWSSIVQICTMNWALGAINNVCDPEQANHYTCPNGRVFFNASIIWGVIGPSRMFSPGQIYSGLMWFWLAGAILPVVIYLGARYWPKSPIRFLSAPVIFGGAGLIPPATPLNYLSWGIVGLVFNRHIRNRFRGWWMHYTYVLSAGLDVGLALCTILIFLTLQLTNTDFPSCWVFTSGLAGTAPISTP

SEQ ID NO: 22566 - protein, 173 aa, A.fumigatus
  UNSURE (47),(87),(92): Identity of amino acid sequences at the above locations are unknown.
FLPVPPGWLLTYGLSFATIIGGAHSYWGSPMEKKLWAGFRKFGKRKXNVHARLMSRFKTVPLWWYAVLSLVMIGMGLGVVLGYPTHXSWWAXFVSLIIAAVWFVPIGLVQATTNIQIGLNVITEFIIGYMQPGRPMAMMLFKTFGYITMSQGLYFCQDMKLGMSLINTEESSN

SEQ ID NO: 22567 - protein, 231 aa, A.fumigatus
RQETVSGKPDIISSQQPKSTLTPKESIFTYTNPFEQLAAASPRKASPQIKSRSASPAVELTQRQKINVTATADVAPVSQPAASSAVQRPSSPILDAEQREAVNQVVGKLVDQIVGRDVAEVRDKTAKEEESLPVRTDKDEGTKAAISSVTSHLRDTTAEAKQAAKIEAAAAQDPAAGSPAAINETTNGESGEALADSWESAEDSAAKEEERVVPVYNFPLKPFISISLKGN

SEQ ID NO: 22568 - protein, 184 aa, A.fumigatus
FLIPNNACKVGVRENVSKIDFYGIIASSIGIIFLLIPISGGGSYFQWNSAMVISMLVIGACSLVAFVFIEWKVASLPMLPGALQLVPFVNSRGADLWTVVFFKNKVLCALFLQSFLLGAVYQSYLYYLPLYYQNARGWSPIVSAAMTAPMVGCQALASIASGQYISRTKRYGEVIWAGFGLWTL

SEQ ID NO: 22569 - protein, 240 aa, A.fumigatus
RTFEEIIYDKAIFKTQLAVRVVDKKNPIRWASKKLNEYLFPAKPVKQHDISEFVGKDPHVLDKIIKEDNGEERAIRKIALTETFQREDNDKLTEEERKDVQQELDEERLRRTDPEAYQRLIFERQRKEEFVRDGGRRREAERLAIMVPMSQPQGQSWPGRPVLPIHYAAAQQARVPSSQVPPPSTAPSRPRDWGHRVHTYDDGPFTHARNRPTSPRSQSTSNAELAVSQNGAVDGTQPGL

SEQ ID NO: 22570 - protein, 102 aa, A.fumigatus
  UNSURE (39): Identity of amino acid sequences at the above locations are unknown.
ESVLILNPCSCLGFDIPGANRVVIFDLSFNPIWKDKVVXRAYRLGQQKPVFVYRFMVEEPSRRLSTTRPSLRHNLPFGLWTKRTLFAGRLRSSTSTSSPLNR

SEQ ID NO: 22571 - protein, 202 aa, A.fumigatus
RRLMFGGKAILYDGSPFLPDAKFLIELLSKYKVTHFGTSPRYLHELRKNNIRPKDIADLRALRIVTSTGMVLSESLFEWFYDEGFPSQTQLANISGGTDLAACFGLENPLTPLYVGGCQGPALGIPIAVFDQADEGATAVKGTAVPDGVPGELVATAAFPTMPVKFLGDDGPQKYFDSYFARFDSKSPTLPTLPMHLPSTNL

SEQ ID NO: 22572 - protein, 317 aa, A.fumigatus
FPCRETLWPDPSPPVEKTTTPAPAPAPVPAPAPAPAEEQQPAAEPAAGHKAAESVPTPASVPTSAPAPAAANAPAPVPVPVPVPIPVEKGPEPVLPKQPAEVPVTPSTSHITPPKDGLTKTNLEQIPDVSPPAPTATAASTVGSTLDANSIAAASTPARQPAQAAFPSSAFKSGARAPGSQRRVMEQQEAVVMPGNHAVDRAAVQFGSMGLNGDAADVDIDENRENAETRAQPPQHSPVAPRASLPPSTQAQPSTEAPPVSRPAPGLPPVPQVSAADSSFTDFARYTEAQKPYDPFSQQVSQPQPQVQEPFANQAPV

SEQ ID NO: 22573 - protein, 249 aa, A.fumigatus
KRYVRYFSGHTDKVTCLALSPGSDAFISCSKDDTVALWDLSSRNAQGKLKLATPYLVAFDPSASVIAIASQSTSSVLLYDFRNYDKAPFSTFDLAPYEERYTPSTRGRAWTRLEFSNDGKHLMVGTDFHGHFILDAFEGNIKAFLLGKNGSPGRAAPVSTTGKPLGQGDACFTPDGRYVLGGSGDQSDVLVWDMQQTPDANSLLQPMTKLPNRGRTAVLEYNPRYNMLATADKEVVFWLPKKNSRSGEK

SEQ ID NO: 22574 - protein, 59 aa, A.fumigatus
NNSWHPWGQRGPYSVPQLTQVGKTIILGTDCQAWNKWETQPPVIIVKGPTAKTDPQCID

SEQ ID NO: 22575 - protein, 265 aa, A.fumigatus
  UNSURE (258),(259): Identity of amino acid sequences at the above locations are unknown.
NLKRGSGYSRGQYVEPSSGKVLVWSSYRKNQYGGTSGGLTQTAMWDPNTGEVTQREVSDTEHDMFCSGISMDMNGRVIVTGGNDDSITSIYDSFSDTWHGGAMMNIERGYQASTILSDGNMFVIGGSWNGPQLRNKNSEVYNVVADTWTELPNAGSSYMLTNDNLGPYHQDNHGWIFGWKNLSIFQAGPSRQMHWYSAHGQGSVADAGKRNSDNDQMCGNAVMFDAAKGKILTFGGSPNYEDSTATNNASLIIFVFTXXGSKLSR

SEQ ID NO: 22576 - protein, 238 aa, A.fumigatus
SACVFVGHRQTLGHFKWAAANVTRLTCPLSLHAEIFNDNAKKKGHRLRPSHRVELCLLRTHTGKWQVTTVDNLDMGVIPPEEPIDLFRGWPNPALLPTSALAQASATVLSTPSIRTPALLYGPDDGYLPLRKSVAEWLTHFYKPRDPVGFDRICITGGASQNLACIFQVFTDPSYTRHVWMVAPAYHLASRMVDDAGFAGRVRAVPQDDAGLDLDYLRREMEAAERKANEEQRFEPVR

SEQ ID NO: 22577 - protein, 203 aa, A.fumigatus
  UNSURE (16): Identity of amino acid sequences at the above locations are unknown.
PPRKANFELVFRTEGXLSAVRVLLMNFSRNYVGLQSITVTVENISTRYPQLAALIGRGGFSSLGLRNGVMTQRGPRDSARVYVFFTAADGFTGEGKRAASVTKEQLLSDEALLGRFGDSVKELVAVGVACDKTADLPEGVVEVKPLYMLPVGAAWAHKPGVTIVGDAAHLMCPWAGEGVNLAMCDALMLAKVIVKVWEKWTGC

SEQ ID NO: 22578 - protein, 206 aa, A.fumigatus
TNDGNTMLKDMSVMHPAARMLVDLSAAQDVEAGDGTTSVVVIAGSLLGAAERLLGKGIHPTIISESFQRAAAAAVEILQNMSRPINLMDRATLLQAASTSLSSKIVSQHSGLLGPMAVDSVLKVINPKTAENVDLRNIRIVKKVGGTIEDSEMVDGLVLNQPVIKSSGGPTRIEKARIGLIQFQLSPPKPDVRVSTSKARYRYTGC

SEQ ID NO: 22579 - protein, 68 aa, A.fumigatus
VSGGNDNQFMVGDQLNGTPFIRFSDHTAAVKAIAWSPHQHLLLASGGGTADRTIKFWNTAIGSLIKGS

SEQ ID NO: 22580 - protein, 103 aa, A.fumigatus
SREVDTGSQVCNLAWSKNSDEIISTHGYSQNQIVIWKYPRMEQIVSLTGHTFRVLYLAMSPDGQTVVTGAGDETLRFWKIFNKRSGREHGRESGKLAEWGTIR

SEQ ID NO: 22581 - protein, 70 aa, A.fumigatus
PGSSGRAIIGAGVGIVKVAAPVLIQEISHPRLRPILGSCYQTFAYIGIFFAAIMTCDSPRPTRSTFSANP

SEQ ID NO: 22582 - protein, 149 aa, A.fumigatus
RRPKIWAETLNGTIVGGEKGGWYHDDVWNRKYLRGFKWADRMEQVQRESSEREAKRRIENTRPRKEDKVFLQGVEQGKFLQGIQKKNEEKKKKKGETGTGEGSADAAANASELKVRRLFKQNEVKMGRDKVKDISALEDDAKRVLSKIF

SEQ ID NO: 22583 - protein, 166 aa, A.fumigatus
GILHVSDSVLGNHLTGTNFNDPNFEAIEASSQYSCTIPDVVLVKKHYARKKNKKTRNWRLKRMAREYEEEALQQQGASISRKQEQERERMEADFEMFLRDVEEDQELRSTLQLYKNKNARPNNRMQVEGGAGGMEMDEDESDDDAPKISMEELLDDFDELNMDDEE

SEQ ID NO: 22584 - protein, 310 aa, A.fumigatus
  UNSURE (21),(22),(23),(24),(25),(26),(27),(28),(29),(30),(31),(33),(34),(35),(36),(37),(38),(39),(41),(42),(43),(44),(47),(48),(50),(51),(53),(54),(55),(56),(58),(64),(85),(97),(101),(124),(166),(205): Identity of amino acid sequences at the above locations are unknown.
TKRQKNKAKRNQKVMLTSGFXXXXXXXXXXXSXXXXXXXLXXXXFFXXLXXPXXXXNXPSFPPXSPFSFFLFFFPLFPFLLSPLXFLFPFLFFSLLXFLFXPFLSLPPFFFSLSLFPLLFFLPXPSFSPFLLFPFFLLFLLLLFPSPPSFSLFPSLSPPLFLFSLXSFFFLLSFSLPLFSPLFLSPFFPFPLFFSPFPSPSFFFXFXPLXLLLSSSSFLFSPLFLFSSPXSFLFFFFLFFLFSLFFFFFPSXXSFSPFFPXLSFSFFSSFLPFFLLFFSXLPSSFXFSLLFLSSSSPFLPFSFSSSFSLP

SEQ ID NO: 22585 - protein, 296 aa, A.fumigatus
  UNSURE (6),(8),(9),(11),(12),(13),(14),(15),(17),(18),(19),(20),(21),(22),(23),(24),(26),(27),(28),(29),(30),(33),(34),(36),(38),(40),(41),(42),(44),(50),(71),(83),(87),(109),(152),(191),(193),(195),(: Identity of amino acid sequences at the above locations are unknown.
CSQADXNXXPXXXXXCXXXXXXXXLXXXXXFFXXFXFXFXXXIXLPFPLXLPFLSFFFFSLFSPFFFPLFXFFSPFSFFPSFXSFSXPFSLSLLSFSLSLSSLSFFFFXFLLFLPFSSSLFFFFFFSFFFPPPPLFPSFLPFPLLSSSFLSXLFFSFFPFLFPSFLPFFSPPFFLFPFSFLPFLPLPFSFXSXPXLFFFLLLLFFFLLFFFSLPLXPFSFSSSFFFSSPFFFFFFPLXXLFLPFFXFFLSLSSLLSSLFFFFSSLXFLPLXXSLSFSSLPPLLSSLFLFPPLFLSP

SEQ ID NO: 22586 - protein, 303 aa, A.fumigatus
  UNSURE (14),(16),(17),(18),(19),(21),(22),(23),(24),(26),(27),(28),(29),(30),(31),(32),(34),(35),(36),(37),(40),(41),(42),(44),(46),(48),(49),(50),(51),(57),(78),(90),(95),(117),(159),(198),(200),(203: Identity of amino acid sequences at the above locations are unknown.
GKEESKSNAHKRIXTXXXXIXXXXLXXXXXXXSXXXXLFXXXFXSXFXXXXPFLSPXFSLFFLSFFFPSFPLSSFPSXFSFPLSLFFPPXFPFPXLSLSPSFLFLSLSLPSPFFSSXSFFFSLSPLPFFSSFSSPSFSLPPLFFPLSFPFPSSLPLFSXFFFFPSFLFSSPLFSPFSLPLFSFSPFLFSLSFPFLFLXFXPPXSSSFFFFFSFFSSFSFLFPXLLSLFLLPFFSLLPFFFFFSLFXLFFSLFSXSFFLFLLFFPPFFSSFLLXXSFLFXXLSPFPLFLLSFPPFFFFLLFFSP

SEQ ID NO: 22587 - protein, 285 aa, A.fumigatus
  UNSURE (25),(31),(50),(58),(59),(81),(101),(104),(106),(145),(187),(210),(214),(226),(247),(253),(255),(256),(257),(258),(260),(261),(263),(264),(267),(268),(269),(270),(272),(273),(274),(275),(276),(: Identity of amino acid sequences at the above locations are unknown.
GERKRGGKRKREERRGGREEKEREXKRGRKXREEKKKKREERREERERKXRKKGRKRXXRGKKKKKKGEEKKKEEEKEKGXRGREKKKRRKKKRRRRKKKXEGXEXKEKGRGRKGRKEKGKRKKGGEKKGRKEGKRKGKKEKKRXERKEEERRGKGRKEGKRGGGGKKKEKKKKKKREEEKGRKRRXRKKKKEREEREREKERREREKGXEKEXKEGKKEKGEKKXKRGKKKGEKREKKKKERKGRXRGKGRXIXXXXGXXKXXKKXXXXEXXXXXXXRXXXXXX

SEQ ID NO: 22588 - protein, 290 aa, A.fumigatus
  UNSURE (24),(25),(30),(31),(50),(58),(81),(101),(104),(106),(145),(187),(209),(214),(226),(247),(253),(254),(255),(256),(258),(260),(262),(263),(264),(267),(268),(269),(270),(272),(273),(274),(275),(2: Identity of amino acid sequences at the above locations are unknown.
GREKEEEKEKGRKGEEEERKRREXXKEEGXXEKKRRKKGRKEEKKEKERXGKKGEKEXEEGKKKKKREKRKKRKKKKRKEXGEEKRKRGEKRKEEEERRRXRGXKXKKKEGEGKGEKKRGKGKKGERKRGEKRGREKERRKKKEXREKRKRGGEREGKREKEGGEGKRRRRKRRKKGKRRKGEKEGXGRKKRRGKREREKKKGGRERKXGKRKXRREKKRKGKRKXRGERRKGKRGKKKRKKEKGEXGGKEGXXXXEXGXEXXXKKXXXXRXXXXXXXEXXXXNXXXXGX

SEQ ID NO: 22589 - protein, 255 aa, A.fumigatus
  UNSURE (25),(26),(31),(51),(58),(59),(81),(102),(104),(106),(145),(188),(210),(214),(226),(247),(253),(255): Identity of amino acid sequences at the above locations are unknown.
GGEKKRRKKKKGGKERRKRGKGERXXKRKEXKRRKEEKKGGKKRRKRKKEXEKREKKXXKREKKKKKGRREKKGRRKRERXKGKRKEKEEKKEKKKKKEEEXGXRXERKRKGKEREKRKGEKEKRGREKGEKRGEEKRKEGKKKXREKRGREEGKGKERGKKRGGREKEGEEKEEKKGRGEREKKKEXEEKKGEGRERERKRKEGERERXGKGXEGGKKRERGKEXKEGKEERGKEGKKKERKKREXKGERKXNX

SEQ ID NO: 22590 - protein, 416 aa, A.fumigatus
  UNSURE (208): Identity of amino acid sequences at the above locations are unknown.
RPVWCALSPNYPSLVIARIFQGIAVSTVECLPSATIAEIYFLHERAYRVGIYTLLLLGGKNLVPLVSAAIIGRMGWRWVFWIVAIIVGACLVLLFFFVPETFWDRTPRPRRSHKRPHPMRSVSDLLRGRQLHHRLENPASNGDHTSPAPRKSNKGHVGFVEDQDQDGNPIDEKKRNLEDNDQILPSETPAEHNDQSVLANPEQHDAPXQIPAPAVTRESDSQRDLEFARRPAVSPARSESVGSAVPLLPSQVYTNRLREKPRIPFTHYLRVWNGRISHDKWLRVAIRPFILFAYPAVLWSSVVYALSVGWLIVLSESVAHLYQGPHGYNFTPLQTGLIYISPFVGGLLGTAVAGKVSDVIVRFMSRRNGGVYEPEFRLVMAIPIALSTSAGLMAFGWSTAVKDLYQGDRGIPRYGH

SEQ ID NO: 22591 - protein, 105 aa, A.fumigatus
NWRHTPKVGKQSRNQNFRNAVDKDGTRLPTRIYPAPAVSTIRADLVDLTGRPMFSMTGNVISCGRLVALAHCLGLNRDPSNWKLSPQEKDNRIRLWWGVVIHDRW

SEQ ID NO: 22592 - protein, 189 aa, A.fumigatus
SIELLHTTIQAVDILSATHSVDDYNVSTAGFIGFYHSIGRYPLPERSTYFYKTLFASVLRVLPHTNPSVNSGAVRQNHKMDFISTQHHDTYPFIAQATHHNHRVLITGASRGIGLATAHSFARAGAPSIAIAARGPLDTVETALLSTAKEAGHPPPTILKLTLDVADDASVAAAAEEVAATRTPRHPDQ

SEQ ID NO: 22593 - protein, 65 aa, A.fumigatus
NKPTRSCYRLNDIEDGSTLRRGKPAAHLKFGLGQTVNAATFLHAEAVRYTLEHLGPDCSMLMLKL

SEQ ID NO: 22594 - protein, 296 aa, A.fumigatus
SSSCSAGPSSPVVKTDVTDAIIELDKAFRCAKAPLSPISRPDNNSVEFARTQENGNSLSLPELPPILDSSLELAVFTHPGLSKDSKLTYDRLEILGDAYIELIATRFIWGRYEGFSSGQISQIRELLVKNETLSEFATLYGLDNRASVPRDLLSQPRRWTKTKGDIFESYVAAVILSRPSDGYHVAERWLTQLWLPRLTDAVIPRTALDAKENLAKRIMGKGVKLKYVDERSPAQSRGGMQTFYVGVYLTGWGWQNKHLGSGHGPSKAVAGDAAARQALFEWSSLKFIIPTKKENP

SEQ ID NO: 22595 - protein, 102 aa, A.fumigatus
SPHYVPAPSCQNNSSGHAGWLGWPANLGPAATLFAKVYTDAGSPAAVRGLATNVANYNAWSLSTCPSYTQGDPQLRREEVHQRHGASSQGSRLRCPLHHGYL

SEQ ID NO: 22596 - protein, 103 aa, A.fumigatus
VLIPIADVCRLINVSARNGVQPTKQNAWGDWCNVIGTGFGVRPSTNTGDPLQDAFVWIKPGGESDGTSNSTSPRYDAHCGYSDALQPAPEAGTWFQVCHPLAR

SEQ ID NO: 22597 - protein, 113 aa, A.fumigatus
HRITCQPRRVRITHQAMRAGSDGPPTWAPPQHSSPKSTPTRVPPRLFVAWPPTSPTTTPGRSVPAPPTPRETPNCDEKKYINAMAPLLKEAGFDAHFIMDTCKCLFQSPMCAD

SEQ ID NO: 22598 - protein, 169 aa, A.fumigatus
  UNSURE (55): Identity of amino acid sequences at the above locations are unknown.
WRFCSVSAREGMIITDFASMPFARQLEKTAANDCRSKNRWTMVASLVIATILRVXWVIISYGCKVPVGIFVPSMAIGASFGRLVGILVQALHEAFPNSAYYASCKPDVPCITPGTYAFLGAGAALSGIMHLRISVVVIMFEPYGGLTYFLPTMVSQSGLVGIITKHYIG

SEQ ID NO: 22599 - protein, 95 aa, A.fumigatus
LGGWTLLIKSIALPLAIASGLSVGKEGPSVHFAVCTGNVISRLFSKYKLNASKTREVLTATAAAGVAVAFGSPIGGVLFSLEVGDFEAHVFGGLC

SEQ ID NO: 22600 - protein, 72 aa, A.fumigatus
SRPQMMNPFRTGQLVMFQVQYDRTWHFFELIFFVLLGIFGGLYGVFVIKWNLRVQAFRKKYLSQYPIVESVI

SEQ ID NO: 22601 - protein, 319 aa, A.fumigatus
CTHFLPSRRLRIDSCDVRGSLEGLKEMLSELKSAKEIAIDLEHHDVHSYHGLVSLMQISTRDKDWVVDTLKPWREELQILNEVFADPGILKVLHGSSMDIIWLQRDLGLYVVGMFDTYHAACALNYPKRSLKFLLHKFVNFEADKRYQMADWRIRPLPSGMFDYARSDTHYLLYIYDHLRNELLENSTPDHNLVDYVLEQSKNEALQRYERPVYDAATGQGQGGWYDYLYRNPAVLSKEQFAVFKAVHQWRDEVAREEDEGVQCVFPKHILFKIAQVMPLDQGTLFRTLSPVTPIAKDRAADLLEVIKKAKIEGATGPE

SEQ ID NO: 22602 - protein, 204 aa, A.fumigatus
SLGIHLSFVRLGENTVAMSRARSHTRSASRSPSAYSRSATPSDDEEAARERERIRRERRQDAERQLRQSRMGTERRIQMMAREQNRDISEKVALGLAKPTQTSESMWDSRLFNQTSGLQSGFNEDNPYDKPLFAAQDAINSIYRPRAQLDVDDEEGAEGEMSKIQKTNRFEVLGKAKDSFRGAAEAEVRFDSPSAPPPSRMPLS

SEQ ID NO: 22603 - protein, 297 aa, A.fumigatus
SPLLAPIFNLPNPVSLRQRNAIFQSYCDFISERSKAIKLIKMSAHTLKKKSWESLSSTFSNLEISVSQDSCYASDELSISPTNPVTAGTSLASFTPARQNSLHSLLKPILKRPYSDIEEDEEPESGYGTDDSEYDYASVSDEHDDEMYAVSTWDEASDASDAILENCNDDVESVDGSFISFESMVRFDTNVRYIEAPEPQEEETETPRTELTCHELMEMARASGTLRLQGEQVAESDSSDKMPEHDELDDSIKQWPEEHPSDIVDLDKRLFIGYINRINGNADPGYKVRLPERFDDI

SEQ ID NO: 22604 - protein, 67 aa, A.fumigatus
  UNSURE (22),(23): Identity of amino acid sequences at the above locations are unknown.
PGPLFADDRIHVGAFASWCTPXXVLTTPLHHSMIGVPRRNLPTRTIAVTPLPRTAPHILLCTPLQVR

SEQ ID NO: 22605 - protein, 65 aa, A.fumigatus
TSIADPSSPVVKTSIEGIPLATFNHVDYGVFGFCKGGECTNIGRGYTTGMWFRLYSSKQVAGYHS

SEQ ID NO: 22606 - protein, 266 aa, A.fumigatus
HPSDEISNTDNSEFDLPSSTRRALSSILIGHPVAAFLTLVCLCLAAAAHLHAPSHSPRYLLALLILLLTTLLDSLLAFLVDILLFGPHLGWGGWIVLGATILLVISGVVTCAMRRTLVSRKARKRRIAENAEMSGENYYNRQNAAAPVVASGFTGPRSAALNAETKEAILTTSPNSESGPMFATFRTTTHSSDDDQTPLNTQGAPTDIPAPDSQYAARGHGDRMPSGALFDESRNHPYASSYRPGPRMRPEPGDPRLRPQYSDGSM

SEQ ID NO: 22607 - protein, 115 aa, A.fumigatus
ARFLPGPWREDQTFLSVCLATSVLAVTNHAENLAHQASLPHHRFTLDCLSSSKRLFIGQCTRGDSLRRPADQQMQRSYAHREYPQDRHLVNLCPRKGWCNGTIGVERLSLFDAGL

SEQ ID NO: 22608 - protein, 98 aa, A.fumigatus
GGGKKSKKKKTGNYQQTIGIIFPQNNTQGEEYRPRVLQGQFGMATLTSVGIEGIGLRGTTGIGTLRKVNCGGKNDWFGTTQLNPWVRRTVLPLASMEI

SEQ ID NO: 22609 - protein, 95 aa, A.fumigatus
SCTPRLLHFVTSKSESTRNLVLSAEHEPYFVILQYLLAFSYKKVVLARDTFGECSTQCYTYLSLYLCTVQSRSAFQSSTLVLRYRLCFSRNPCPT

SEQ ID NO: 22610 - protein, 337 aa, A.fumigatus
GGGTLCRCLLSGIFARTLVHLWGSRNSKSIWRTRTFFPMDAIREVKYLQEFSHPNIIALHDVFSFKDQNLNLVLEYLPRGDLEMLIKDENIHYGVADVKAWMGMLARGVWFCHENFVLHRDIKPNNLLIASDGEVKLADFGLARSFADPYLNMTHQVITRWYRPPELLYGARQYSGAVDVWSMGMVFAELLLRVPFVAGNSDIDQISKICEAFGTPSEENWPGVSTLPNYIPSDRQSTVPLQGRDFFLRQFPTAGPAGADLLMSMCTLDPRKRSTAYQILQHGWWSTEPRPTAKEDLPRKSGGTKKMGDDLSRRGGDVDDGPFKSAARQLDFMAVKR

SEQ ID NO: 22611 - protein, 274 aa, A.fumigatus
MVAQALNGFGHPDSQVPFEEPSPAPYPATYSPHTPQSSFTQHQPPTHFSSGALASATPHFTPSHIQNGAHTNVDEDIDESMNEHWQQQLQLAAESRQASSPHYHARSVARQAKGIQIAPSQPETQEQVPDGQNGVVKAKASSRQGWHALDFGGQGLRALSTSLFNYIFLEKLYLNHNKLKALPPAIGQLRKLNHLDLSGNDLTELPEEIGMLTNLKKLYLFDNNIRTLPYEMGYLYRLETLGVEGNPLNDVLKSHIMKEGTKALIKYLKEEMPG

SEQ ID NO: 22612 - protein, 64 aa, A.fumigatus
RVWASRFPSSIRRAITRTIPSNLFTTHTTIKLHTTSTTNTLLERGIGFRDSPLYPKPHPKWGSH

SEQ ID NO: 22613 - protein, 125 aa, A.fumigatus
RPSAPNASCTPETYDHILGMIDKYVRRERSQRRWRLAHFVASVVVSIGCFVGVWWTGDHLPYVAFILCLVSTLSFGAGILDGLIGGLFVSSELRALKEFEWEVRNAKRIVERAGAQGTIKIEESQ

SEQ ID NO: 22614 - protein, 240 aa, A.fumigatus
RTSPRTHKWCFIPRDRQPRFTSPKAGVHSTNRFHPFVKQETSKHALTGSAPLERKSRARPEADDDWSAAGSEFDSSDDDDDERPGGGSAKQLASILFGTMAPPRPLSAMDDKSPSKSSTPVQDSPVASLPVPESNGSLSAPAAPPPPPPPPPAAVPSYDPSVAPPPPPAPPMAPPAPPPGPPPPPGPPPPPAPPAASGPPTPAGAPDRSALLASIQKGKGLRKVQTNDRSTSSIAGRVLD

SEQ ID NO: 22615 - protein, 93 aa, A.fumigatus
ICTDCYRDIAKALELFMISLVTKAAKEARDRNSKRVTATHLKQAVVKDEVLDFLADIIAKVPDQPAGGTKHVFIHEGGKNPRKGIHNPPIAPA

SEQ ID NO: 22616 - protein, 187 aa, A.fumigatus
SIFLAMTDQDSTYRPRSPDLSTFQSSVPPAVNSPIYPLASPLAHRASYDASPFFAPQYQQPPAPLGRVPQQYIPPFVDPNSPLSPDMARRSSRLARATEVAPMPEVSYAQPVLSEEPQQLPPPPPQPNPVASIEVKTKFPVARIKRIMQADEDVGKVAQVTPIAVCTCIPLHFVPASLESVLTAIVI

SEQ ID NO: 22617 - protein, 201 aa, A.fumigatus
LSEQAFSLSDTPIECNMTKSAFLFLDIQNGIVERLDDPDTYLASLAPVIKAARKSVVKVIYVKTAFREGYPDTHPRSTMGTRVRESQSFHEGDISVEIPSIVSPDANEPIITKRRVSAFTATDLDLVLRCLGAEHLVVVGLITSGAVLSTVRQAADLDYQLTVLEDLCMDRDQEVHDVLMKKVLSRQARVVSSAEWLAELD

SEQ ID NO: 22618 - protein, 100 aa, A.fumigatus
FLLVCCILILRGSAYNLSQMASRSPSEEAPKPAPFSNFPQDPAEFDSDPRISFSKLDNKFILETEDGQEFEYDTVLKRWIPTVCARFLCSWSIPFVSCDR

SEQ ID NO: 22619 - protein, 83 aa, A.fumigatus
NDGFRRCVRASSAAGRFPLYLAIVELLPFLSPSCYELPFYHTVFFPLAKYHIWSTAFDCRYTAIAVATWSVFTTGLAGSALSV

SEQ ID NO: 22620 - protein, 229 aa, A.fumigatus
LPPLLVEMGMMENNNRFRSYSVNAKEKYADDEILEYATRYSQIPSGTVTLSAAATAAQLAATQAQIHQHNLAVQAFANHASVNRPRARTAGVLEAPPQRSSIRNYLATPSRLENSFSAADLHIAETGEYDELSEAVQMMNLGGNGGQNLGLRASGEAADESNQDGPTRALWIGSIPVSTTVTSLEAIFGIYGKIESTRVLTHKNCGFVNFERLESAVQAKSLLNGKEIF

SEQ ID NO: 22621 - protein, 125 aa, A.fumigatus
  UNSURE (113): Identity of amino acid sequences at the above locations are unknown.
RSQTDSSGGGGDLTTMTRTSTPPTLLQLQSADSVSSQAAVLRSLKNETIGHDQRKEIYIKRGIIPVLTKVLTSRKLSGGSVTAPVKESSGIKSEEDDACLQAIIILGSLAQGXFPVICPNNASGH

SEQ ID NO: 22622 - protein, 86 aa, A.fumigatus
  UNSURE (3),(12),(18),(22),(23),(31),(40),(41),(78): Identity of amino acid sequences at the above locations are unknown.
HNXTNLGVNDLXGMEKIXRDKXXLRIWITSXYLFEIRTLXXVIALHKRSISTQLILRNLLSMILHGKWTGALTWGNCXLFSTSWCS

SEQ ID NO: 22623 - protein, 78 aa, A.fumigatus
PVAMNRSITSINSRACIQTLYWSLNPSIPPQRSCFSWTALHLPYWSNGALQGENSPDYPRSSQSTFIHRHRQKPIQSC

SEQ ID NO: 22624 - protein, 74 aa, A.fumigatus
WYVTEKSVVISLLTIIGSERARTAKTAGSTLAEAGKINESLMYLGQCLQMQSEIQEGKVRFMMPTILFPCLHHG

SEQ ID NO: 22625 - protein, 264 aa, A.fumigatus
TEALRPSIPGRASKPSTGPSTPQSPLKGAVSPGPRCTYRIGPTALFKERIRRTILGPPKAPLFTATDRSPFNHAKQSSHILQEPTPALIFPRRNMPQKPNVLPRLPDVSHLTVELNHNSEYIVLVSMYEVYNDRIFDLLSPAVVPGQGSAMSRQGANAQKDRRRPLLYKSTEGSPDRKVVAGLRKIACSTYEEALAVLEVGMTERRVTGTSANSVSSRSHGFFCLEVKRRMRNKRTGEETWIGNTLTVADLDGTSLRNRLSFLF

SEQ ID NO: 22626 - protein, 231 aa, A.fumigatus
  UNSURE (2),(3): Identity of amino acid sequences at the above locations are unknown.
SXXLQKSSSFTELIGHAVSLNKKSSSVGETECGIGNTCAWKMCGIDPSSSYGVYFEIANQGGPAAVQPGLQRGMMQFLTYYQHASGHYHLRVTTVARPLSGPAGDPTLAQSFDQEAAAVLMARIAVYKADVDDGPDVIRWVDRMLIRLCSRFADYRKDDPTSFRLEKNFTLYPQFMFHLRRSQFLQVFNNSPDETAFYRHVLNHEDVGDALVMIQPTLDSYFLEHEGSQHG

SEQ ID NO: 22627 - protein, 78 aa, A.fumigatus
  UNSURE (15),(42),(61),(62): Identity of amino acid sequences at the above locations are unknown.
ILPGAWTSCFLERRXGQLHGGHRFLTDSSTSSQFKRCLVRVXDKNANDNFWMGFNASLEVXXYKRAQVSPNLSVMQFL

SEQ ID NO: 22628 - protein, 139 aa, A.fumigatus
LPANLEQLESAPPPSSAVFVMAANQDTPTKVPDGQPNPVMVGPGMKSLGEEAYTNASNATPSLETDKKHPLVNDAPSYFSQVPGTKQSSTVSDTALPGSPADAARDAKSPIELLRRLSLGRSPMIPDVDPREQYPGLNL

SEQ ID NO: 22629 - protein, 139 aa, A.fumigatus
YQRGHRAAVLQVTDKGDIASSSVLGFGFSLVREFHLVDGYSAVGTKLFIVVLPISIFISSAVIFFNLLASLLVTSNLALRLILIPLPNYRVRRLNPWPPMPKRPPIHPLPFPKLDLSIFAAYQHFLVPWDPPQKHPSGY

SEQ ID NO: 22630 - protein, 166 aa, A.fumigatus
RRGTTAGGSISGGVFLRGVPRHEKVLVSCEDGEIEFGEGERMNRWTLWHRRPWIETPDTVVGEWDENQSEGEVAGDEEGSEEIEEDDGGADEDGDGEDNDEKLRADCAVAIHEVKLANETETETEDGGRSYVPFIGHLEDSRSMASLILGICGVFTTGLGGATCSQ

SEQ ID NO: 22631 - protein, 243 aa, A.fumigatus
DGQTKKALNLILSDLKDVSLAISFAKSQDDPDLWEDLLNYSMDKPRFIHGLLVEAGTSIDPIKLVRRIPSGLEIEGLREGLTRMIREHDLQASISQGAAKVLQSEVAVGMATLRKGQQRGIKFNIIEEKAVSDTGDRNEASSNTDTEKALSPSRPPTFQPGRCAGCHLPFYPNGKLPCLDYTKMSSVLIHYVRVKKRKSSLASHVDMSSTYRTFTRMIPQQPRTETSPECRPHARCQKLAYPP

SEQ ID NO: 22632 - protein, 115 aa, A.fumigatus
  UNSURE (113),(114): Identity of amino acid sequences at the above locations are unknown.
ATLLRLYKNVLSVDPLCSRKEKEILVGFACGHVFHLSHVHSDDTSTTSDGNQSGMQTPRPLPEIGISTLNELPLSMSSTVGAKVTTARLLRDRIGNGCRICSLAKEIEALGEXXT

SEQ ID NO: 22633 - protein, 89 aa, A.fumigatus
GGHANSDFALKDLGGTLADTRLQVVFTNHAGEAFPQPFDFKSAWDASDKFDRVDGRASLNKEPVDEAWLVHGVVEKVFPKIRIILRLGK

SEQ ID NO: 22634 - protein, 293 aa, A.fumigatus
RSKFLVQKVTQVPELPNMLFGPILFWHDDESMITDETAKVFLRHLLSKGKTQVRDLRVESDQKRREVDNAKRVRENVRQGKDNRNEVEVVRSIFFLQEALHEVERKRLAAEVETSTIISVVGDLSLGAKNHNFKSQTFKIPTNCDLCGERIWGLSAKGFDCRDCGYTCHSKCQMKVPAECPGEQTKEEKKKLKAERQEQAGAMPALDITPSNGTSAAPSLTRQNTMNSLSSGYAASANRSLSNVTSQPASATEPAAPATPAAPAETKPAVAAPKRNRIVAPLSGTVCYRSSPK

SEQ ID NO: 22635 - protein, 135 aa, A.fumigatus
LRSLDGSGWMRVRAGSRQGLVPASYVEVLPTASHAPTASPGITDRPGSTYSNSSASLSGSMAAKRVGPAVAPRRGAKKLQYVEALYDYEARSDMEWSMVEGDRFVLVNRDSGDGWADVERGGVTKSVPANYIQEV

SEQ ID NO: 22636 - protein, 78 aa, A.fumigatus
QLFTILPQVVARICHPHATVYELLTRIVAKVANAFPQQGLWTVLAVVKSSSKDRASRGINCLHKITVSAQNHRIEVTY

SEQ ID NO: 22637 - protein, 61 aa, A.fumigatus
LKNSSSLSGEASKLVIDNYLRSLAHGNKYVFQSLPRILTLWLEHAATVDKPFDPKRGDNEY

SEQ ID NO: 22638 - protein, 79 aa, A.fumigatus
  UNSURE (40): Identity of amino acid sequences at the above locations are unknown.
IKTLSIPIFIIFSFPRRFGQLLICHLVYLGIYCAFGRSGXRQKRTQPPPMNPLEKKVLDMGPIMYEWSDKFYGMGECKM

SEQ ID NO: 22639 - protein, 181 aa, A.fumigatus
VNGLQPTPAPFEPVMEISNPFTCNESSILSEINSSSEPTTCNPVSNNFGGSRASPLHRAVQMGHSKIVRLLLEHNANCNEKDSDGLTPLIHAIIGGYEDMVDMLLSHGASIGLVDDEHRSALHWAVIRRRDRLLTRVLKHCVGNSTLVNQCTKDGRTPLLIAIDIGFEAAVEVLLESGAVV

SEQ ID NO: 22640 - protein, 193 aa, A.fumigatus
MLLRVRNSSCAGAQAGESLHRVRLVYPKARLTLHTSGKSTLLLSLLRLLELQSGQIELDGVDISQVRLDILRRRCFVAVSQDPLLLPNETLRFNLDPDASISDDALVVALNKVGLWSHFFEGHTYFGGEPATVINIPGSNEHPILDQKVSIFQELSVRQRQLFALCQALVKVSSFRTFWSETPWFSWTSLHPS

SEQ ID NO: 22641 - protein, 94 aa, A.fumigatus
DRQARRRLYVPWLCWSHVPLHVLWLLRRSFPDVRILVSLHNGLLGIFVTSTEFVSETLTTFRFMGSLTNNGRKLANFAGFYKGIQSAGAAGMWR

SEQ ID NO: 22642 - protein, 82 aa, A.fumigatus
LVLPSKTAGTQLRESQSQSMCPRPKSPLENFDSLQPNILTCCVGAQYDNMILLHICIGQDFYYCITAFLVMFRLLRRGWMFE

SEQ ID NO: 22643 - protein, 104 aa, A.fumigatus
RLNIRTRSLNSLLYWLMQMVGAFVFGKLLDLQFLSRSMRAKLNWLILLVITMGVWGGGYAFQKQYTLETAKQDVDFTSHGYVGPMFLYMFYGFYDAAFQTCAYW

SEQ ID NO: 22644 - protein, 92 aa, A.fumigatus
TCKGILVDMSDICSMDAEKTPFMTQFASCWGLLVGSLLIASPIIFFKIKDHVDVEEDLKFSDETTEDVTGIAIEDRRDSTKGESVTKHVSAS

SEQ ID NO: 22645 - protein, 116 aa, A.fumigatus
VVPLPTLIHNFSLFTGWEAIREWPALTATFQTACNVYLIFSANKSGEYYGYARMMSPIKEDETLALEMPVRPDHGPPEPVELHVVPTQATATAPTGRIIDDSASSPRRLEGRTIQA

SEQ ID NO: 22646 - protein, 70 aa, A.fumigatus
VTSVCALSCYCALEDVFEIDYLPVWKYMSRFLDGLIPSQSGRARPNIYLRTLNFLETIEQHRDWIISRSA

SEQ ID NO: 22647 - protein, 223 aa, A.fumigatus
GSCLVRMRETEQNSLNRRHSTTQHYQTFDTPPPKSRGRPNSGQSELSGGNSNLQQHGSGSDDESRSPLPKKQMAVLAMIALCEQTALNSISPYLPDMAASFPGVESQSVGIYVGTIASAFALAQFITNYFWGWLSDRVGRKPVILLGTILTAVCMLAFGFCKTLWQAILVQALMGAVNGNQGLVSTCLGEITDRSNQSKAFTYLPVLYGIGGITGPLIGGLLF

SEQ ID NO: 22648 - protein, 128 aa, A.fumigatus
HLENSPWFDGGVKMASVHPCRHASVMKTLLDRADAALKIRRDKLKQAHSADQANRINSERGLEGLVDETRGLSLNEQQGHSPGGDEWEVLQHDEEDQVAIRVDQYLVVFLKFIASVTPGIEHDFTMGV

SEQ ID NO: 22649 - protein, 146 aa, A.fumigatus
EYYIPAESSSIHFLRSTLCVGCARGFEVVSLETTETQSLLDQADTSLDFVARKENVKPIHIERMNGEFLLNYSDFSFFVNRNGWRARPDWKISWEGNPNAFALSYPYILAFEPNFIEIRHIETSELIHIMTGKNIRMLHSSTREVC

SEQ ID NO: 22650 - protein, 255 aa, A.fumigatus
RKIARNEGTLALWRGLSPTLMMSIPANVIYFAGYDWLRADEKSPIKRFFPAAYAPLVAGSVARIAAASAISPIEMFRTRLQATPGTGAGHFKATLEDLHQMTQVHGYRALWRGLTLTMWRDVPFSGLYWWGYEECKRYLLDLRREAYNHHLLRHVSSSALQHDLDTPTFLESFLSGALSGSLAAFVTTPFDVGKTRQQVFRHMGDGGPSSLRGSVAPETLRPEQLSLPKFLMHIFREEGMASLFRGWVARCLKVA

SEQ ID NO: 22651 - protein, 89 aa, A.fumigatus
HTQPELAHPWEVLHEKAELVIASPKGGEAPLDPASVKMFENDPVASKFLNEQKSLWTNTVKLSDVLPKVSEFDAIFYVGGHGRTFPDST

SEQ ID NO: 22652 - protein, 83 aa, A.fumigatus
RKVAMFDLVNDETSIALIEALSAARKPIAAVCHGPTVLLKAKAPSGVPLLSACTVNGFSNTEEEQGANVVRECIYAGRRSCKK

SEQ ID NO: 22653 - protein, 180 aa, A.fumigatus
  UNSURE (37): Identity of amino acid sequences at the above locations are unknown.
SASTTTGYITLQLAKLAGLKVICVADVARHGAKLLDXGADFFVDRHDTARAAEIIRGVTKERLRYAIDIVGKDTATLLQQTLDSAVHEDGSHAHLLGLTGLPKERDSRIVYHTVPIKLFHTSPAVGEAMVTWLEELLQTETIRLPEIILADGGLEGINASLEALRQGKASGKRIVMNLRR

SEQ ID NO: 22654 - protein, 253 aa, A.fumigatus
ETGALSDSEQQIEPGPPAAAQTYNADLEGGPELHALMRAVEMIARKRREEDREASDTKPYLSPLESYFLSQSDVSTSASSLNSQDPSPIPEKLLKTNSASPAVPTTSKTPPVAPVAPVAAPRIRSRAQGGYLCTDLDVYLTHEPCLCCSMGMLLSRFRAVIFPRKGRMVTGGLASEPVISPASDTVPEGEPEESESKAPMDESSDPATKRKYYGLHWRKELNWRALGFEFVEHDDADELARRTEDQTGVAFHA

SEQ ID NO: 22655 - protein, 76 aa, A.fumigatus
  UNSURE (23),(40): Identity of amino acid sequences at the above locations are unknown.
TSISTTCEFASAVVFAHEYGILXASLQDRPFIPTALVSIXGIPESARSAFRKWEKPSGQMRPQVFPLNAAIESIRS

SEQ ID NO: 22656 - protein, 173 aa, A.fumigatus
  UNSURE (173): Identity of amino acid sequences at the above locations are unknown.
MEFQQVYYSQTMNPSISRELNPLDPAVLRATSDHLHHTWAKTFYSRPELYIRPRSIAEIQKVVTLARRCRRRLVTVGSGHSPSDLTCTSSWLVNLDDFNRILHIDRETHVVTVEAGIRLRDLGRQFEEHGLTLSNLGSIDSQSIAGVISTGTHGSFLAHGLISKCIISLTLMX

SEQ ID NO: 22657 - protein, 68 aa, A.fumigatus
ICTRNSGPKAVSQAFYTTTYVSSPRTVQQTEYLTDLQFRQKPSSHLNTPQPPPANHTVSSSLAVSAMA

SEQ ID NO: 22658 - protein, 85 aa, A.fumigatus
  UNSURE (3),(4),(5),(6),(7),(8),(9),(10),(11),(12),(13),(14),(15),(16),(17),(18),(19),(26),(27),(42),(44),(46),(47),(49),(50),(52),(54),(56),(57): Identity of amino acid sequences at the above locations are unknown.
FPXXXXXXXXXXXXXXXXXFFPLFLXXLFSPPQVYNNFPFFXSXNXXSXXSXIXFXXLGFFFSLFPRFFPGFGGPCARGFGAVLS

SEQ ID NO: 22659 - protein, 181 aa, A.fumigatus
GCSCDHFHYPVTSFYPFRSATFCRPHRRRRKFLQSPLLLFNCSVLEIHQQLPEDMSEVQTRPSASRGRVSARGGRGGYSSRGGRGGSRSAKADTSDQTTFEDEGEIGQMKKKYSNDLPTLKELFPDWTDEDLVFALEDADGVLEDAVERITEGMIMDSVSCISYPYICCSLEFALTLIVPS

SEQ ID NO: 22660 - protein, 104 aa, A.fumigatus
RYDHGFRELYLVPLHMLLTGIRSNFDRPIITGNVSQWGEVKKKTADRNRSKAKEAQSTPTEATTSSVRTGRGRGGFEGRGRARGDRGRGGRGAVFTTGLEGAAP

SEQ ID NO: 22661 - protein, 63 aa, A.fumigatus
KTPYFTATLIKYLIIRILISLFQFEFPFFGAPFSVPGLFPLKYYLPSFKSLLNSIFLLHLPST

SEQ ID NO: 22662 - protein, 65 aa, A.fumigatus
MSLGFIHFELLGVTNLRGFINQWDVLARLSNNNDDWHGVQWKWYSIEAAKSVFTHGAPEGSSAKA

SEQ ID NO: 22663 - protein, 287 aa, A.fumigatus
GEGVLESAREQLEERSGPSQRKNPKREARDRVEKERQEARAKIERANCRKRKLRLSVKQPRSEKGPSERPRKPRQRQSAKQLRLELKDLLLWPRKERLEPKPKPKKRPQKQKPRPRRRPLRKRLPQRPLLKRKPMPNSPRSRKLLRRSMRKRRPKMPRKPQLESRQRRKQQAANPQQGQRLPGPRLQKSQRIRAVLGHQQLRTRMMPIRSGHTTDPADPMRVHQVPRSILNLPMPLRSRRPGRPRHLQPEAPTRPKIRTRLSSEAFMPSITPSCEVLWRSWSLAKGW

SEQ ID NO: 22664 - protein, 264 aa, A.fumigatus
SKDRAGELPEAKAKAEREAAEVRERAEREAAEAKTKAEREAAEARAQRLAALAKEREARAKAKAEKEAAEAKAKAEKEAAEKEAAAKAAAKKEADAKFAALKEAAAKKYAEKKAKDAQEAAAREQAAAEAASSKSATGSTAPRTPSPKKPAYTGSARTPTTADEDDAYSFRPYDRPRRPYAGTSGSSVYSESSYAPSQSTARTTPPPSTRGAYSTKDPDKIVIRGVYAFNNAFLRSPVAQLVSGQGVVTDGLVLRSLHPQGAEG

SEQ ID NO: 22665 - protein, 236 aa, A.fumigatus
THSSVPSAAVCEDKTALYFAVESGDLGKVTALLEHPDVDVNLRTDELGDGQSLLHCAVNQQCVDPEIMKALLARPDINVSARDYSGRTPLAFAAFNGEAELVKLLLQRHDVDVFPQDRFGDTPLLLAAKEGEIHIVNMLSKVPGTDTWHRNNWDKTALGLAGESGHTEVMRRLLDPDLKATREIICDAMENTKEALDAIRRTPRSVLGSENESLAQERKIEEAYKLLSAGLNRTGS

SEQ ID NO: 22666 - protein, 126 aa, A.fumigatus
  UNSURE (112): Identity of amino acid sequences at the above locations are unknown.
PYLHNTGTQHGCLIPMASPPPVSTATATATGSSHHFPNDSVLKYSHIGQTEKYVFSAFAGVVWYNAIELIVLCLTTFKRYRGCYFWSLLLASISLTTYILGSFSSSFSPCPXPPMVASASSVRAGA

SEQ ID NO: 22667 - protein, 202 aa, A.fumigatus
NILSSHQPPSNSPAQAKHAAITIKKSKMPSKITVAVAQARTHIATQATLSALSRIAHHARIRGVHLLLFPEAYLGGYPRTCSFVCAVGSRAPHGRDQFLAYFRSAIDLGDTPAGAGDDWVQRRLPVAEGRSERGDGTREEMERVARETGVFLVVGVIERAGGSLYCAVVYVDPLRGCIGKRRKVMPVSLPCSFSFSFSSRFH

SEQ ID NO: 22668 - protein, 61 aa, A.fumigatus
TGTERLIWAQGSPSTLKAVTTHLNGVPVTLAAAICWENYMPLLRQSLYAQNVNIYLAPTAD

SEQ ID NO: 22669 - protein, 151 aa, A.fumigatus
PSSSSRYTHAGDPHRQQRNTNCPPRAQSPPQQETRPSLSPPAPSPPSSHRRARSAPRLQATVVEPNHPRRPQGYRRDQSPSGNRPGTGRGRVGRASPPHIRRSRYVGIRPDRPRGRGGGARRGCGRGGRCGRGRREWLVLLCECGLGRLPR

SEQ ID NO: 22670 - protein, 307 aa, A.fumigatus
GDVVVANDHQNPDIFWALRGGGGGTFGIVTRATMRVHLNSPVCVSEVAVSGSRNNSLLWTKGITGLFSILRSFNQQGIPGQFILRPLSKDQVNASLTLYSLNTDDTRRSAENMLSIRNILESTTLPFTLASRCLPKISDALRKGPDMLPVNYGIITGSVLVSEDLFNSEEGPLHLAKQLEHFPMGPMDLLFTSNLGGNVSANTGKKHRDTSMHPGWRQAAHLINFVRSVSTPTAHEKARSLEELHSVQMRQLYDIEPDFRVSYRNLGDPLESDAAQVYWGPNYKRLLEIKRLHTGLEGPTVLRQSMG

SEQ ID NO: 22671 - protein, 135 aa, A.fumigatus
SPEDVWVLVVIGHDNISLHSHSELQYKDTILQVIKDVSTNLRRHDLKFEDIIYSQTVDEAVETGHSASLEKTARSAHGRTLPPDDHPSITGTSCIHLPQSHSSAYAHGWATVYIGAEGPEVVMSSPRGAGRIRAQ

SEQ ID NO: 22672 - protein, 207 aa, A.fumigatus
SLDSGRRINWPGIPCWLNERRMENRPVIPFVQSNELFREPDTATSETQTGLLRCTLIVARVTMPKVPPPPPRKAQKMSGFWWSLATTTSPYTAIVNFSTKTPYCKLSRMYLPTFAVTTSNSRTLSTARPSMKLWKLDTPPPWRKPPAAPTVGHSPPTTTHPSRAPLAYISPRVTPAPTLTAGPRSISEPRARKLSCLHHGGLAGSAL

SEQ ID NO: 22673 - protein, 173 aa, A.fumigatus
  UNSURE (6): Identity of amino acid sequences at the above locations are unknown.
RVSRSXRRKGDAKGPWAEKAGLTASPAETKPAGPAAPAKEAAKKDDSRMEMTRVVTASTPVDKVKEYLKRPSQKSNDAIVGLVRPIIQDVRDGGDAAVLKYTHKFEKATSLTSPVIRAPFPPELMKLSPETQEAIDVSIANIKKFHSAQKDSNDVLQVETMPGVVCSRFSRPY

SEQ ID NO: 22674 - protein, 74 aa, A.fumigatus
  UNSURE (32): Identity of amino acid sequences at the above locations are unknown.
TCGSVTPPVAHPGAVPPRPMKLGVPPWLAAAXKMSWGSPPPGQWAHPPPRIVLLPPPNLETQKTCPPPGVSQAL

SEQ ID NO: 22675 - protein, 111 aa, A.fumigatus
  UNSURE (93): Identity of amino acid sequences at the above locations are unknown.
TWSFQPRGEDKDLQARKADAPAGSYTARLFNEPKLTQAKIMEEADELCRATTKEEIAFEAADLLYFALTRCVAAGVSLEDIERNLDLKSLKVXKKKGRCEGAVGGEGWSDC

SEQ ID NO: 22676 - protein, 139 aa, A.fumigatus
SCIGPGLIPALVKQAKAKRIVHVHNEMTCLPNQSRNGNDVNQSTPPYVRQTDCLESRVESLKMISSSSAPHPPSSSESPPPFSSQPEPTPPLSPVASPHASQTIPPAPGPPLPASHAQPYTSSSPAAEPDIPRWPLPFD

SEQ ID NO: 22677 - protein, 65 aa, A.fumigatus
CEGCHGGQQLNLPVVDFFWSWSIFDQSKDGHCATYDFGYENCRRNGTKGDWKVRRKLMEASTVSK

SEQ ID NO: 22678 - protein, 77 aa, A.fumigatus
  UNSURE (26),(64),(67): Identity of amino acid sequences at the above locations are unknown.
TLKRGYHTVFAGYLIHNIAVSFYVNXLTVYDSYFHNATDILVEVCFHYHYATRSGRRRSRQSAXSTXAETIPKFFWG

SEQ ID NO: 22679 - protein, 270 aa, A.fumigatus
  UNSURE (237): Identity of amino acid sequences at the above locations are unknown.
RCIAHCELKTGMRLEFMKFLPNDDDDDEGEVTVVWTAHHSLIDGYSLGLILARVQQASQGVASSRVSSFVDAAWNLLSVQKQRDTEARRFWEQYLQPVRSLTKAEATTTPVARPYLAQEVLFKHVGGVDELHRLASSCSVTLAAVYYTAWAMTIARTTKSTLVTLGVVFSGREILPDDAQAVGPLMATLPLVCRIDGEASIERQLQTTFEGLATISTYAWSAPDQIGYRVDSLLATXYDFPTYDQPIPAAKEQFFENTNFALSLLVEADA

SEQ ID NO: 22680 - protein, 89 aa, A.fumigatus
GIDPVLYKFCIVNLVYISILKLKVYKSLSLWHNIGDVWLKTYQVTLVILLNNIITNILKKLYILLVLSSPIQFLSFQSNFITSSLKLPV

SEQ ID NO: 22681 - protein, 166 aa, A.fumigatus
  UNSURE (61): Identity of amino acid sequences at the above locations are unknown.
LGQWAASRTDIFPPEMCNIMSSLHSHAPAHSLHQTKKTISKAFNGLPFEEIFEEFYEEPLXVGAIAQVYRAKLKPSLAVMDDQALTLEDRSFRGKVRKECRTWLVKNSPGTGFRLRTWPLKYSIQKVERVIRKGLGIHVFLPHHGLMPSPQCTGCLGRMRYSSLVR

SEQ ID NO: 22682 - protein, 245 aa, A.fumigatus
ARDPEGTWDSCLSSASWINAIPTMHWLSWPDEVQQFGEMMKLQLDLRIEASNVVIFRQKFKSRTTAWFPYPYLEYTTREVLVEEFAQGIPLETFLDVGGGVYQQEIANEGLDAFLHMLLIDNFVHADLHPGNIMVRFYQPAELDLSLGKRSRVSDAPTAAEADVTETVLARLRPHAHNREAWHAALSQLNAEGYRPQLIFIDTGLVTQLNETNRRNFLDLFRAVAEFDGFRAGQSYTDRAGRTRD

SEQ ID NO: 22683 - protein, 100 aa, A.fumigatus
LPTLSAAPSTPVVKTMLNKRNHVHHLDTNTDEDMIPIFTHDVNNKSRNNKRLLPRRNWCAIREYQPGESMFRPYEISISLTEDRLHTSGFARIRRGPSTG

SEQ ID NO: 22684 - protein, 92 aa, A.fumigatus
  UNSURE (64),(76),(77): Identity of amino acid sequences at the above locations are unknown.
FLPPKTLAPTVGFPHSSRQLRLILARKIFCMATDAAKKDINHGRSMLDNESSLTRQLQCAYGLXWLPKSIPLGCLXXWCSKSRHHLSTVQSR

SEQ ID NO: 22685 - protein, 66 aa, A.fumigatus
  UNSURE (61),(62): Identity of amino acid sequences at the above locations are unknown.
SAYRLNFTCLQSRLSLIKQLLDIVIIQGTFFNRMQCNFATCFYLHIVITPRGWKETRPPKXXKMGG

SEQ ID NO: 22686 - protein, 75 aa, A.fumigatus
EHPAKMPGILPMKVIKVGNGSQSRIAQACDRCRSKKIRCDGIRPCCTQCANVGFECKTSDKLSRRAVFTTGLEGT

SEQ ID NO: 22687 - protein, 111 aa, A.fumigatus
  UNSURE (12),(15),(18),(62): Identity of amino acid sequences at the above locations are unknown.
FNQSGLGAKYPXSVXIVXPPVLVLTKIKRWSTLAESTVPQSIKKADSDIDDIEVLLKWLARXQFHIDFEGYLAKPKEELLSGVRKLYQMHAAFRPLLETTLDEESFALINN

SEQ ID NO: 22688 - protein, 238 aa, A.fumigatus
PPRTKRLLSWARPSRTTLPSSAGSRSSTLRSSPSSVPGTALCWALTPTTRRTLKMPSRLPTRPSPSLRSTSLPIPTWLVSASPSPITSVPLSSPALSLPFWTRLGAPRTLPSPDGTTPSSTRLLSRPSSPALSSLRRLSSTLLPRRRRSPRLLLLLPRLLLLLLSPRPSLRRSPSTLLRLLVSPSLSLMSGSVSTPTRTPAPLLCPGSGRTTSRKSTLSMLLTTSTTTSSSSPSWLTT

SEQ ID NO: 22689 - protein, 88 aa, A.fumigatus
GGFHARLEASRKYLFGAQSVYGENYNCVIRGVFLVRGQDWKPAFEVAPDWESYDFRKLDPSNPEDKKLVEDMWAWDTSVTVFTTGLEN

SEQ ID NO: 22690 - protein, 386 aa, A.fumigatus
ISLATPPFGRKFPKMELTLFDRCKPPLVPNILRLTGTKVTSQNEKTTLLGKTKQDYAAILRWLSFVNAEVLPKLGAWYRPLLGLDPYNKKNVEDAVKAANKALAVLEKHLTANTYLVGERITLADYFGASLLTRAFATVLDKAWRSENVAVTRWYNTIINQAPFKAVVPSPVFAEEAIKYTPPKKEEKPKAAPAPAKAAAPAAEPEAQPEKKPKHPLEALGKPEFVLDEWKRQYSNEDTRPVALPWFWQNYKPEEYSLYAVDYKYNNELKLTFMANNLIGKILLLWLGLTPPSDFSPKVVSTPVLRLPASTSSVLSPFTARTTTALSAVSSLSVVRIGSPPLRSPLTGRATTSASSTPPTPRTRSSSRTCGPGTPPSLSSPRGWKI

SEQ ID NO: 22691 - protein, 77 aa, A.fumigatus
KFISSPSRRECKIKHIGVSSVTSATLRRACKIANVVAVQTEYCVFSRDIEGPSGTNLLAPCLELGVALVASCPLGRG

SEQ ID NO: 22692 - protein, 83 aa, A.fumigatus
PLIADQLYLSSLYGDNEELLGKWFRRTGKRDQIFLATKFGFVQGGKPHEINSSAEYCKKACEASLKRLGVDSIDLCSHLNPAY

SEQ ID NO: 22693 - protein, 88 aa, A.fumigatus
DQSSCGQEGKGELPHQNLRREVGAIPRSSIPLVWTYMNTTVDQTPNLDPDFDKNDFKAPMAGFGYGLPISRLYARYFGGDLKLISMEG

SEQ ID NO: 22694 - protein, 68 aa, A.fumigatus
REPRYDGKSSLPQLSYYNEFLLLPLDIRLINEGWLLETYQVSQNGLWRVSVLNDRTADSISQETIRLY

SEQ ID NO: 22695 - protein, 62 aa, A.fumigatus
YSKCALCTRQGRLCKKDFHTKKEWDLLKRAEKKIASELSVTNNKLELLYPELQQLQEHLEKI

SEQ ID NO: 22696 - protein, 307 aa, A.fumigatus
  UNSURE (303): Identity of amino acid sequences at the above locations are unknown.
SADQSLNVIESQLMPYKHHRVLFIDKGQNGLQAENIIKMLKQLELEPIVVRDEDHVPPPEIQDPSGKESGHAYDVIIVDSVDTARLLRTYDDFKYVPIVLVCPLVCVSLKSALDLGISSYMTTPCQPIDLGNGMLPALEGRSTPITTDHSRSFDILLAEDNDVNQKLAVKILEKHNHNVSVVGNGLEAVEAVKKRRYDVILMDVQMPVMGGFEATGKIREYEREAGLSRTPIIALTAHAMLGDREKCIQAQMDEYLSKPLKQNQMMQTILKCATLGGSLLEKSKESRLSSSGEIHHHSEGKRXGMET

SEQ ID NO: 22697 - protein, 99 aa, A.fumigatus
LHPKTATMVRKVVVVTGSASGMGLATATSLASSGAHLALWDINSSKLKEIAKSFKAQYSGKILAQTVDVSDRSAVKAALIEAQHHLGPINAIANFEGLV

SEQ ID NO: 22698 - protein, 112 aa, A.fumigatus
  UNSURE (86): Identity of amino acid sequences at the above locations are unknown.
ASPVCPAFDDANVSGHLVDYAIGHNVLVPRTLLDYLRVLFGVPVEAMQDLVIVTPENQIDFGNPVCGIICYSDILRKPRVRDRDHXVTTFIKTQVSRKLLSDHGGILDVQRG

SEQ ID NO: 22699 - protein, 170 aa, A.fumigatus
AFSLQCVLRFHWLTRAKVSTWNLIFEMLCGSHPFWDSGSPVKIYENILRGRVKYPPYLHPDAVDLLSQLITADLTKRLGNLHGGSEDVKNHPWFAEVTWDRLARKDIDAPYVPPIRGGQGDASQYDRYPEETEQYGQQGEDVYVFQLRIILDQSTNRNSCYRHGHLFPDF

SEQ ID NO: 22700 - protein, 121 aa, A.fumigatus
LHRGSFQPRGEDILIMELSSGEHAVSTSGILYDEGFKGYTPPSHYSLEVYISSDADMLMHCTWSLEDSKVVRGPEAHSHTTVQPVRPVRITTGRQTSLDKRSWRSHHFTRLFGKSMLAITS

SEQ ID NO: 22701 - protein, 138 aa, A.fumigatus
LRMLMFPPQTRPSCLLVSTISPSSSMVRSMNTNTSVENNPEVMSHLVHQLGLPPTLGFTDVYSIDEPDLLALVPRPSHALLLVFPITPSYEASRVAEDGPLPEYNGSGPGEPVMWFKQTIRNACGLIGLLHAVANGET

SEQ ID NO: 22702 - protein, 193 aa, A.fumigatus
PSIDIYQPLDCEELFSVHFLLKLKCKYKDTIMGSPRLLSRTPLTSILRLPIQTTNGANLIPRTLSRVHRSFISSQTKAAPLKMSNTDTLIELAKARRTIYKLGKNSPVPDSKIEEVVNAAIQHVPSSFNTQSTRLVVLLHAEHERLWEIVIDTFMQLVQSGAVPETTWKIQTLPKLQGMNNGVGTVCLCVESL

SEQ ID NO: 22703 - protein, 63 aa, A.fumigatus
ILEANPSLQILFYEDPAHIKPFSEKFATYKDYFQPWGGALERPAPVLPYVPPPPVSAAIRARA

SEQ ID NO: 22704 - protein, 86 aa, A.fumigatus
TPVNLEWVGRCKERKGGDFHMIYQPMSLPHTTDICCDAADLGLEYLGLTYSYPQRRFDTQPGCSQATEIDANTIDLHWFLRARPGR

SEQ ID NO: 22705 - protein, 126 aa, A.fumigatus
LHRQTPHEILPKLFGTLRERYAERRGGYTRVLRIEPKKDDQAPSAILELVDGPKDMRFAMTARTVARQRAQGLETLNELTTLNVHKVTRFRKGGVEDLEKAIKRLEIEQKKAPTTHKGEKEVESKQ

SEQ ID NO: 22706 - protein, 292 aa, A.fumigatus
  UNSURE (283): Identity of amino acid sequences at the above locations are unknown.
GRGESLEGEWENVGSRSEGIRNKNNGAPGRNVECVRRISRKGTPAVDPGRRLPYNEAHLLVWRTRSMARWRDRLATAKNANEMCRVFSKFNALLVRPKIRGAIGEYQTQLIENVKQDISALHERFKQQYGHSEAHAMAQLHDLPPVSGAIVWARQIERQLDGYMRKVEDVLGEDWHLHSEGQKLQAESNLFRKKLDTRPVFESWLHDVQRRHITIAGRLFNVTRNRAAGNSLELSVNFDAQIIALFKEVRNLIWLNFQVPHAVSSISKEAKRVYPYAISPDGXSPTGQISVA

SEQ ID NO: 22707 - protein, 66 aa, A.fumigatus
LTTTFSSMCLEDVNGTDLMHVLSCRHVYHAHCLEQWFLGRHFSCPLCNRSFFEEVEPGPEPGPDNV

SEQ ID NO: 22708 - protein, 67 aa, A.fumigatus
RGIFVQVRRNAARTSASTVVKETKQHSDTEMLQKLESICPTKPYDEWVEHTQTEQDLSDRSSAHFTW

SEQ ID NO: 22709 - protein, 101 aa, A.fumigatus
KCWLSIPGLIYLVAVPMWPRARRFGNVYAFATVDCLYAILWFSAWICVASYVAQGKAEGKSNSDNDKNKDDKKSGCDAWKYGNASKCKISTATVILGVVIL

SEQ ID NO: 22710 - protein, 160 aa, A.fumigatus
VSSPILVFRTKFLLMSLVCSLLFVATAWMSFRNVMHFRRTGTLPDAVSDPTFAAQSKAAFSSNPAHDFDEEEDDFRSGRAGMGASVRNDQDEDYALLHQSEVDDLGNGNGRTAMHGAYDPTATTGSGSVLHDYNTSYGGAHGQHYAQPSEFGSTLSGYGR

SEQ ID NO: 22711 - protein, 90 aa, A.fumigatus
TWRLLQSRHGFPHWLMPESHCRSLDPKSTREGRHFRQGGCPQGRLWCACEWSHVDSAFTVAFDDQYDNLLTAVREATNTGIKVCLSMQEL

SEQ ID NO: 22712 - protein, 293 aa, A.fumigatus
  UNSURE (136): Identity of amino acid sequences at the above locations are unknown.
LLYSPKQQPTATLIHPSLTASNCNELKPANPDPQISQNGSGSADLDRGVIGDDDDDEDAEENGVNTETPNVGKLNQPPFPNLDQVHVTTTDGLCITEKKKKRKKSNKKKKKKTKSGALPATELKQTSPPRVLVSTXFPSEYPVGELVPYDCTARTTDEELRYNSRLWDDDFLPDYRQAAEIHRQVRQYAQKELIKPGATLLSIAEGIEAGVRALSGHQGLEPGDFFKAGMGFPTGLCLNHIAAHWTPNPREKDVILDKGDVLKVDFGVHVNGRMLIRHLPSLLTTSMIIFLLQ

SEQ ID NO: 22713 - protein, 80 aa, A.fumigatus
IPSLAVVRYLLTTIYAWDVAHPASFMDSCMTSRYYGTIALTIFLKEELSCLRVGQIMQHICQRINKRTIHRLLTFVILVI

SEQ ID NO: 22714 - protein, 178 aa, A.fumigatus
SALACYPRIKNFHGRSQGSGCLGFLPSLVLDSSSRIPMSDCASSASFRAGPPSPSSPASGSLKENHPPYISSEHFPQTPTSPPLMSVSASNYATNIASSQPPSQATSQPANLSSPPSSAPMSTQTSQQPTLGPTNSFPTPASSVSGHFMGPTSVEDSEHVGTSLGSSPRGWKDPRGCY

SEQ ID NO: 22715 - protein, 225 aa, A.fumigatus
EINGQNGVPRDTSMNFMQDHSGAGISMSHPGHMSQMYSNTPEGAPMHSPFIHSFNYDHFRGLNQQQHNPSHLQGSHFEQSYVNSKARPSLQAIDRTSSDGRSPMTPKTPALGALTLGTPESGSFPTQPIRTGLQPRHQKTLSNQWDGTPGSAHSFGMESPISSPGHPSHHAAISEILKSGKHASLPAKVDTHIPGSAQDLESQEAKRRRRRVFTRLREASGCKSK

SEQ ID NO: 22716 - protein, 126 aa, A.fumigatus
LRQIIKTMSTPRIEHYTTDVHAHWEGIHPQDWAEVDLIGYENAMDKMYRTLCENPDAALVQVGHRSKLLNDHGSDYRFNGKFTSEQTKPERSHHDYNHFGKLMKWEGDRWYKYDFEVEVTDHTRSE

SEQ ID NO: 22717 - protein, 75 aa, A.fumigatus
ESYDSHSNTRHDIMILLHPEEQFAQQFNNLETPYLSRLPFSRLKNPLYFYPIQNSNYISSQATAYLVGNSDFGRS

SEQ ID NO: 22718 - protein, 178 aa, A.fumigatus
RGSFDPQWVKTTLLNIWNQWVDSDFSYIWARENFLQQRSLTRARDVRDQLAKLCDRVEVTISTCGSNNYVPIQKAITAGFFPNAARLQRGGDSYRTVKNGQTVYLHPSSTLFEVNPRWVIYYELVLTSKEYMRSNMPLQPEWLVEVAPHYYKKKDLETLGLDRKVPKGQGAAGEKSKD

SEQ ID NO: 22719 - protein, 299 aa, A.fumigatus
  UNSURE (6),(64): Identity of amino acid sequences at the above locations are unknown.
AFSFCXSPTRGGELDQVAFHSIMAAFLGGNQHRHPSSGAKLYHSPSDLESDSDSEDDTAGTRFXEHHRGRSSTQMKNKSRTVSKRRFKPSLTLATGTQNGSAGGEMNSNIEMRKRDTSLESSGGRASRLMARQSFSLNDDPPITPQTPAMATTSFANLPSSDRRNFLLLCVLYFLQGVPMGLATGSVPFLLKPYLSYGQIGVFSLASYPYSLKLLWSPIVDAVWSQRFGRRKSWITPVQVIAGLAMIYLGGHIEEMMVKAGANGGAGVWNFTYWWFLLVFFCATQDIAVDGWASSPRGC

SEQ ID NO: 22720 - protein, 142 aa, A.fumigatus
NINEHIVTNAIYAFDLGNIMEPLVSFWQRLLLNSDRYVYDKIGAGDDPDDDESDFKAVEFSDLEDALLFEPDPEEKYACWDVKYIRRLFGFETIQHAPAWQELGKVRMPPGRLISFPNAFQYRMGPLELQDKTKPGHCRFLN

SEQ ID NO: 22721 - protein, 89 aa, A.fumigatus
DCLWGNSPLDAFQVRLWQTFFIGKIGAEIITLFSLTITHLNNIHSFSVFDIATNIDSRAPCPEGCKAQVHFDCLLKVLWMFLFTPSNNE

SEQ ID NO: 22722 - protein, 82 aa, A.fumigatus
  UNSURE (32): Identity of amino acid sequences at the above locations are unknown.
RRSATVLLGTRLTDYYPINSLTDWVPIVPVHXIILAQTTLSFSVFRPIVNTFSDAHSSEIDSLTAVPLVKASLIAARTPKPL

SEQ ID NO: 22723 - protein, 378 aa, A.fumigatus
  UNSURE (205): Identity of amino acid sequences at the above locations are unknown.
TPCPDSSRLVCEDAKALCVKPSLLLLDDPTAHLDLEACVWLEDYLKKWERTLVLVSHSQDFLNGVCTNMIDMRMKQLLYYGGNYDSYHKTRSEQETNQMKAYHKQQEEIAHIKKFIASAGTYANLVRQAKSRQKILDKMEAEGFIQPVIPDRVFSFRFADVEKLPPPVLSFDDVSFSYSGSWDDTLYEHLDFGVDMDSRTALVGXNGVGKSTLLRLMTGKLQPIAGRVSRHTHLKLGMYSQHSAEQLDLTKSALDFVRDKFPEKSQDYQYWRQQLGRYGLSGESQTALMGTLSEGQKSRIVFALLAIECPNMILLDEPTNGLDIPTIDSLADAINAFSGGVVVVSHDFRLLDKIAKDIMVCENKTMSSPRGWKVPTVV

SEQ ID NO: 22724 - protein, 350 aa, A.fumigatus
  UNSURE (163): Identity of amino acid sequences at the above locations are unknown.
RHGLVLAHHDVLGDLVEETEVVGHDDDTTAEGVDGIRQTVDGGNIETVGRFVQQNHVRALDGQQSEDDTTLLPFGQSTHEGSLGFTAQTIATELLTPVLVVLTLLGELVTNKVECRLGQVELFSRVLTVHTELQVSVTADTTGNGLEFSGHQTEESRLADTIXADQGSSRVHVNTKVKVLVQGVVPAARVRERNIIEGQDGRRELLDISETEGEDSVGDNRLNEAFSLHLVQNLLARLSLSDQVGVGTGRSNELLDVSDFLLLLVVGLHLVGLLFAASLVVRIVVTTVVEELLHAHVDHVGADTIQEILRVRNKHQSALPLLQVIFQPHTGLEIQVSGGVVQQQKRRLDA

SEQ ID NO: 22725 - protein, 108 aa, A.fumigatus
  UNSURE (55),(96),(100): Identity of amino acid sequences at the above locations are unknown.
EPILPIPHDPTVPGMNRRNSWVQRRRTVDQWKQRFSQLREESTRYVYRPDTGCCXYGYPFTYNGAREILGFVVRGTPGMFPWNNALGQLVWRHGIXPKFXCYAPQPES

SEQ ID NO: 22726 - protein, 152 aa, A.fumigatus
CVCAIAYGHPLVLADRKIWHNPVHERDESNESETAKTCFKFLDLTSRSFSAVIKELHPELVLPMCIFYLTLRGLDTIEDDTLIPLKTKGPPLRGFKDLLEQECWNFTGNPPGRKRPVNCWFNFPNVHNPSQKNGTLASRPVFKDFPGKKGPM

SEQ ID NO: 22727 - protein, 75 aa, A.fumigatus
FFRIAEHGPWRKSDTVSLGIAYDNFALEDAAEIEQITSLALYEASSIEIRRADFISGRKTFLHSQYTTLAVLGVV

SEQ ID NO: 22728 - protein, 133 aa, A.fumigatus
TDANSPELVNQYNFLNTSIPIVFSHASYLTVKDAELLRSTNQYISITGESERHYGHDHPSSPYIMDQSSLGIDTHFTYSADIVGQARMWLQEVRLRLYAQVLDCWDIPPNNPMSVEHASYWQSHPAVQGPRLS

SEQ ID NO: 22729 - protein, 99 aa, A.fumigatus
TVINDGQALDQLSDSIRIPLHRRTEEQRIAEQAFLNDEKHSGLKVLESTMFKRTLICIDFITHLLRLLLFYQMQRAIIARFSRENRLFDLITSIYHGSI

SEQ ID NO: 22730 - protein, 65 aa, A.fumigatus
SICGLILVATDILNNWPLLSQPQYSVFWNMAGRELLYTVIEQTCIVLIYMSYCIVYLKGIICSPC

SEQ ID NO: 22731 - protein, 60 aa, A.fumigatus
GPVFVATNCIATMGGGSKVAIVGAGFAGLRCADILVQNGAQVTIFEARDRLGGRVRSQAR

SEQ ID NO: 22732 - protein, 145 aa, A.fumigatus
FVARGPNWIHGTEKNPITGVAEVTGTTIEDFEGEQIIFSRAGKLVDEATSARISEFVWSTIDEAFEYSNALKDSIPPDQSLLDFFKERVSKTGLNPEEKELCIETCKLWGAYVGDSIERQSLKFFCLEECIDGSTCHIFSMAAIC

SEQ ID NO: 22733 - protein, 184 aa, A.fumigatus
RTRIFQLRRCNMEPLDAHSSRSPNIVMSLIRHHLLGRQDVSTVESSRSYFVHQQLRSQLSHDVWWIALAVLFITIAESPHYSDNPIAYSTFNIIFEVVSAYGCVGISVGFPGRNYSFCGSWHTISKLILAAVTLRGRHRGLPVAIDQAVMLPNESLAWAEEEDAVLRREQTRTYGSDKMPVGTV

SEQ ID NO: 22734 - protein, 89 aa, A.fumigatus
RGAGASDEDSREEMLTHSVVDLTDDKILVQMGSLREGKTPEEKDQYIAGLKQIINDMRRDKVKDFNTVATEIAAYRRRFLQDPSRVLPL

SEQ ID NO: 22735 - protein, 234 aa, A.fumigatus
  UNSURE (2): Identity of amino acid sequences at the above locations are unknown.
WXPACPRKRKLLAAFVPSDELSKEVEEYIRNHPVTLALRQNPAYTESRPHMKIPQELRARHLTAGILATPGGIVVPPYVFCEEGGKSLTAIFYLGSDVSGHPGIVHGGLLATLLDESMARCCFPALPNKVGVTANLNIDYRRPAMANNYAVLKAKTVKVEGRKAWVEAHIETLPEDGKEPVILVEAKALFVEPKQAAVSPFPGAVGIRNNVLTMISGHGESVQNYQLVCSGTSG

SEQ ID NO: 22736 - protein, 267 aa, A.fumigatus
  UNSURE (4): Identity of amino acid sequences at the above locations are unknown.
TPTXCGAVCTLLESIVCGRNRLENGSMEAWARAYKVHAAGIRSVKMTQNGIRQEGISLLLKEGLRHASALEVLDLQDNTFTIMGSTALAGVVAGWPSLRELGVGDCLLSARGGVKVAQALAEGKNQNIQTLRLQYNEITAEGVKLFLHATKTALPSLRRIELNGNKFLEEDPNVTELQEVLEARKEEHGTDDDPDDMWGVDELDELEEESEEEEEAEEEEEEEEQEEEERKADKFLKDNVKAEDEKVAQRQDKDVDALAEALGKTAL

SEQ ID NO: 22737 - protein, 227 aa, A.fumigatus
IAPLALKGESLTQWRNAVVGAPSPITHKYNNDLRLSGIDFSDQEALTERLAAVMDYDKHCNLQMVLYEDGREEIRKPGRKIIGEMKKDAIMARLHAWTPELRSGSFSAHDLVEPRTLRIMCDAMSALAKHLAQNLDTGAEGKTSNCVAGQKKIFMSLSRLMVDLGEAIVRCDGVEAFVVTSLFLFLTSEEIHSNLCESDQAAIHSILVVFLRNYVATILLVEATVSS

SEQ ID NO: 22738 - protein, 190 aa, A.fumigatus
GLEFYHPTSYSISRYSNALTTTMVFGWRTPTYEDAKMKQLFDGFSEFAEINQTGTAALIDFFPWLRMLPDFLLPTQKRAKELHEREKALYLGHYLRAKQDIRDGQIKPCFCVGLAEAQKSDGFSDDQAAYISGTLLEAGSDTTSNTLYAFVQAMLLFPDVQRKLQEEIDRVVGPRMPTMDDEQDLQYVRA

SEQ ID NO: 22739 - protein, 72 aa, A.fumigatus
CTAAVSKLKGLIARKASEVSGLKAQLCVEARKDKSKSVSLKSHEYLKIYLNRKKHQPLMASQDLTKDLLEGK

SEQ ID NO: 22740 - protein, 182 aa, A.fumigatus
EPDSQTSPEFGYSPQSSSQASQQSGYKPQSSSQASAQLGYQPQSSSLATPQTGYQPESQSNLESGYNPQSESQFIPQSGYIPQSASQSPPEFGYSPQSSSSQGTSQTGYQPESQFNQDSGYSPQSASQKAPEFGYKPQSSQPAAQSGYQPQSSSQSSQFSQSAPHSGYQPQSSQSAAESGYK

SEQ ID NO: 22741 - protein, 82 aa, A.fumigatus
RSSLTIRLLVFSSSFSWHSTFGYYRGLVSYLFSSLLIFLPITILSRRLSIIAKIIHSLSFLQSVSIASHGHLRQCGCSREAD

SEQ ID NO: 22742 - protein, 77 aa, A.fumigatus
  UNSURE (46),(57): Identity of amino acid sequences at the above locations are unknown.
IILFHLRYMPNVAQIEKNPLMNLICTVSLSGSKFGTGLSNLLTCDXAKRTNMTVAPXTRWLHINGGYQLTTTCGTGL

SEQ ID NO: 22743 - protein, 115 aa, A.fumigatus
LDLQRPYQCLFMAACAHVWHYKCISRLIHTPEYPMFQCPNCRAYTDLSAEVDDSNDANDVDTSKENDDSQEPAQTSAAETSNGIQEPSAESDTAAARTQERTESSRQTRDVPAVV

SEQ ID NO: 22744 - protein, 75 aa, A.fumigatus
NLILPENENVWERKVSHHTTATLPCQRRNGYDTSFLQSPYTIDYPVFSSHASPERGDSLCLQTSPEEDSIGYDRT

SEQ ID NO: 22745 - protein, 134 aa, A.fumigatus
NAGNLANGETRVGFLTMIVPLYQAEICHPKIRGRVTALQQFMLGVGALCAAWISYGTYVGFDPTNNAQWQVPLGLQIAPAVILGLLIMFFPEVIRWNIFLTECDADTRTVTSLAHRPWLQRKGLGDPCKTPCSW

SEQ ID NO: 22746 - protein, 68 aa, A.fumigatus
RLCSGLVVSLFTAGAFFGAGFAGPAGDYLGRRWTIAIGCLVFCLGGGLQTGAQNISYLYSGRFFAGLG

SEQ ID NO: 22747 - protein, 90 aa, A.fumigatus
DGIFSLQNAMLTQEQSPRWLIDHGYNEKGLATLAKLHAHGNEDDAWVRAEYNQIQESIVYEHEHEAKSYSELFTNRSSFRLLLPRPVPYL

SEQ ID NO: 22748 - protein, 296 aa, A.fumigatus
SPRADCLSTSPGARARISPNFPPIALYPPKYPQSAGVRRSRSGNRGYSFRRTIFAKNIQTQDVTSPGAFELSPGVSPQPLPETSTVNGQPQATGDEKHSDVVRPTVTSESSPKDDGSTTYYSGPKVGRHLSMSVSYERWLKRKAACTIIKVRLENAVETVRKAILQIKDIPPTKDGRHIDLDVTRTEDLIDERTGKPYVGNWIRSSRYSFWSFFPRQLFAQFTKLANFYFLVVAILQMIPGLSTTGTFTTLIPLLIFVGISMGKEGFDDWRRYCLDKEENNRLASVLRPGASLTVS

SEQ ID NO: 22749 - protein, 137 aa, A.fumigatus
RALDAAFPRDPAIPVNHLRRFAKHSQLPESLRSAISHNDSAPQTIFVLISPPLPEADALQKVLAPFAPASSTSADDQAEAAPAISLHTIKIPTQPPLNAKQAEKWTSTYWPVVYNPAAPRATIAPPPQILNRALESI

SEQ ID NO: 22750 - protein, 165 aa, A.fumigatus
WKLRFVFALFAILLSFPAIVRAISTVPLYRSKVFRQLEKRLEYSVTSDKMPVPSSYDEVKAHLQHVLDDHSTPLDISLIDKLKLELTETTDRRVPSTLLTLISQLLPVLQEDPTPITTLGIKATVYFSFTDIRSVEPPIDFIAGFKAPSPPVNLYSPRGSKKPRC

SEQ ID NO: 22751 - protein, 64 aa, A.fumigatus
NTPLRYLLSHSGLVSMPAILFVSQHICLIFTYDTSSGASWDEMVTAYGEMRICCKDSTLPFLKP

SEQ ID NO: 22752 - protein, 62 aa, A.fumigatus
LQAHGHEYMADLDYPHHLMRTCKASSNSVLTRQGVYRLQWYVNMLGLTAIFGYVFAAFMAMH

SEQ ID NO: 22753 - protein, 61 aa, A.fumigatus
EARILKVKKEIEEKFEQEKWHKIADSVAADGGNKYPASAIQKKFKELNKRTQAAAAGEAED

SEQ ID NO: 22754 - protein, 129 aa, A.fumigatus
  UNSURE (44),(57): Identity of amino acid sequences at the above locations are unknown.
KMQHPNLTQESQSTCAPVNGTPRKRGRKKAADGDADADSTETPXKKGKTSPKKGLGXIPASPESAGLADKMVLRMRDEEGRSWSEITNVWTRMTGIKVEGSTLRKRYTAMKANFISISAEDVSDRPVSA

SEQ ID NO: 22755 - protein, 76 aa, A.fumigatus
EDCAPNIKRFFSGKRFPFATLSSMDDQMFFFGPSLLDGRLLFPDIMSKIDPAQPVLTIPKLIKVFIRALTCLTRRS

SEQ ID NO: 22756 - protein, 78 aa, A.fumigatus
FKMTVKIPWPAVYLAIAASVYMRPQYAILDSLTATFVVLSLAVTSFRIIYAFVLYPKFFTPIKHIPTPSVRTFIARPE

SEQ ID NO: 22757 - protein, 241 aa, A.fumigatus
  UNSURE (103): Identity of amino acid sequences at the above locations are unknown.
THCADPSTPVVKTCQAKRPRYGQVLKNMIRLASPAKPFKLTPKGTTQRHAVYADYAEEIDAMYATHEKQLGPKLPSTIDSESVHCYVHEVITSLTGRSDIRPXDDLFGLGLDSLQATQLSNILRSAVLSYNPALSTDNITVQNIYTRPTTDKLAGLLLGVLQEKKEQAAIAPTESRSERIAGLVSKYTADLPARYVNSPTQLPRLSTVKTNGIYRFAGHLYPFRPIKRSSRGKSILFQSRR

SEQ ID NO: 22758 - protein, 261 aa, A.fumigatus
  UNSURE (148): Identity of amino acid sequences at the above locations are unknown.
FPSTQLISQLDTSTPQLNCLGSRLLKLTGSTGSLGTYILSGLLNDPHVAKVYCFNRAADAATRQRQGFAEKGLDASLLEDPSKVEFLHVSFGDKHFGLDDSMYSKLLDTVDLIVHNAWKVNFNHPVSSFEDPHIKGVREFVNFSLEAXYNTHLAFVSSVSTIAGWTPSSDESAVPELPMDTVDAVLKQGYGESKHVGERICLEASRTSGVPTSVLRVGQIAGPDSRLGLWNPHEWLPSVVKTSKSMGSLHHKGRRTPAGLP

SEQ ID NO: 22759 - protein, 145 aa, A.fumigatus
RPHKVLQVLADNVLRRGDNGLQVYVMCEIPSNVILAAEFADCFDGFSIGSNDLTQLTLGVDRDSAELADIFSEQDEAVKWMIARVITVARQKGCKIGICGQAPSDHPQFAQFLSDLGIDSISVSPDSFVTVKRHLIRSERGVPVC

SEQ ID NO: 22760 - protein, 72 aa, A.fumigatus
KISSDFCSRPHPSFKRLSFIMGDVAVESSATNVTPSKSAPFDTIPNIDSLEGTDADGGDEYATLKRLQRHLE

SEQ ID NO: 22761 - protein, 121 aa, A.fumigatus
GLIYIPECMRTKIITKYHNNPMHRYMGTEKTAEAISRNYYFLNMRRKVQGYIHQCETYIRDKPARHQPYSKIQSPEAPKQSWEWITINFVGPLLELKGYNYLITVTNRLILHPGAGRYRDA

SEQ ID NO: 22762 - protein, 212 aa, A.fumigatus
DLSAQCPGLHISFQVGKLTPGLFSVGLLQLNCLTSALGSDGCSELTDFACHCQKSGLVEQVVPCVKQACDVADQQGTNMKKTHSTLRLILSNPRRVAVSKVVVSLCSGVGHPVSVPPVDASAPTSTAAASFPTTASSSNSTTVSGLGGSSRTSFAASPTSTLGSTTLATVNTASPSPSFSSPALSNGASGIQSGVAQVAGAAILLASVLFLV

SEQ ID NO: 22763 - protein, 83 aa, A.fumigatus
RQLTGQGAHWDCLGDKIEVATNPNPDKSPVAYVHPDKYINYKLNPDLETAHRCIDMLTKAGFNASGNPTFDWIHDVYLILIHM

SEQ ID NO: 22764 - protein, 190 aa, A.fumigatus
FPRRCPSSPPVKTRQTRRALSSVLAEWSSGLWTSHEFVRVWWMPYEKSAVVWHADKTDLPLRKPPKTFYGEWIGYHIYHNLLALSNYFPRILPWVECFVFGLQYGFKAEKTVTEAVEPAREGLLMNCLYSQFVNEWALPLAKGPEAITRLSAWLHGDMETARIPFSANGLWVHCPIEVRVADSTYLGKPR

SEQ ID NO: 22765 - protein, 106 aa, A.fumigatus
KVGLGFVGAPISVAITDWLMPFFLFLYVYFVAGSECWNGLTNRAFRNWGPMIQLALPGLVMVEAECLAFEVLTLASSWLGTTPLAAQSILSTIASITFQIPFPVSI

SEQ ID NO: 22766 - protein, 66 aa, A.fumigatus
GEERRKDVAKLAGLYLKVVALGAPGYACFESGKRYMQAQGLFSASLFVLLICAPFNAFMNWFLVWV

SEQ ID NO: 22767 - protein, 104 aa, A.fumigatus
NPSSSSPGVMKTLSSAARSTWFPRPSCTPSFSKWHRQLRLMFVLTFGPRFTKDEMQRELLEQMYRNNELDELLKESDYTIRRRKECQQMVESLSRASEIVSQVQ

SEQ ID NO: 22768 - protein, 161 aa, A.fumigatus
CGCCSPVVKIRSFSLMPSIASTAIAPHFSSSLRRRLDCPQFLLSRCWPRHTLPRSTVAPFSTAAVTMGSIQRITEHLEKPELDDRSYRVIRLSNKLEALLVHDPETDKASASVNVNVGNFSDADDMPGMAHAVEHLLFMGTKKVGCTYTCRTSGFLLRKFK

SEQ ID NO: 22769 - protein, 95 aa, A.fumigatus
  UNSURE (71): Identity of amino acid sequences at the above locations are unknown.
FPKENAYNQYLASHSGSSNAYTAATETNYFFEVSATDDSGDGQPNGQSLTNGTTNGKTNGTTNGDYAFAKXDTSETLVPLYGALDRFAQFFVSPL

SEQ ID NO: 22770 - protein, 297 aa, A.fumigatus
  UNSURE (255): Identity of amino acid sequences at the above locations are unknown.
LSTTDLRLYYARNDERNEDGKDKQEESPGDGTDSKDAFGYRKNRMAVDGMPVTTLTEQQEAQQASHNTAYAQFMKPKFARAPIKEAGRVAYLGESSNLSLLVQDRHGTTDVVHYPLPPNIRGSRARLTDLDNLELDILHQRGAFLLPPKPLCDELVEAYFRWVAPIVPIVNRSRFMRQYRDPKNPPSLLLLQAILLAGSRVCTNPQLMDANGSTTLAAMTFYERAKALYDANYEDDRVTIVQALVLLGWYWESPXGLFICFVRKSACSNSYRPDEERLLLDQSGHGRPHRAPACTQR

SEQ ID NO: 22771 - protein, 304 aa, A.fumigatus
ILVLLWSLALLAVAWPIAIAIVSMFIGNASAAGQASEPLCWRVGFKWDKDALACSRNYVTLSISPYANDHNPGSAAFSYGAEAVLCVLFVCLIQANQTISLHCLELLVNLSRDEGIWRQAYSETGEAPGTQLTVNPFRAAVSSWENAVLFIAKTVLHWIIGQSLIPSVAMEESKDTDFAKDIESWASIPVQDLSAHVQKLPFKRGFQFDMVYSRLIIYAILAVLVATFATYLALRRRKGCQPAALGHLPTLVDLIDDWKTDQEGRMWWGDKAPELKAGQVRHAGTCWDKMLLGPICTTARYAGG

SEQ ID NO: 22772 - protein, 249 aa, A.fumigatus
NSHSRLADKLTNSRRIGVTTRDRPAAAPQTGPFDLGFRAIGNPTFAVGITASATIFCSSAATSAFLPVISEMRKPRDYPKAVYLSMSFVTTSYLAFSLVIYAWCGKWIASPSLGSAGETVKRVAYGIALPGLIVSGALYVHVGAKYLFVRILRHSKHLQANTLVHWGTWLGCTITLSAISFLLASAIPIFTYVLALVGSLCYSPLAICLPGWLWLYSHQHYRRGSVGRLVIYGLHVGMILLGIFMTLGG

SEQ ID NO: 22773 - protein, 65 aa, A.fumigatus
IICFRRATSIYQITAYQSVFQRKYHSAWGSVDTASRVGPSGPNPAVFILHHLIHTNSKIMADTWC

SEQ ID NO: 22774 - protein, 108 aa, A.fumigatus
GTTTSGIPPGDFTNNESGATQPSMPPRISYSITVRATASSISPDIPASNDSEAAQAGVLPNVPGAVTVGATASDVPPVMTPRAAVWCTSQCFRWHGYWSTCCWSHKPF

SEQ ID NO: 22775 - protein, 239 aa, A.fumigatus
  UNSURE (215): Identity of amino acid sequences at the above locations are unknown.
SPCNGRCPGPCGEDFSGAQNSKTDGHAGNHQEDEVGNKAVKKPQASDLKTECKNLELPLDYSASRHHAGIEQILQALEDFHPQLDTPCKLWTFFALAKLYDIATTPKICDLILSWFYESTNVRFIEIHPEISYRISCGIQCASLCRDTFSILVGEEALLLLANRDEPARLGRPQETWHGRLRESLDDTELQRIEYASKSFLDYVIDRFVHLMGAXMAWLHDLSEYQKVYHFQPRSSPGR

SEQ ID NO: 22776 - protein, 60 aa, A.fumigatus
RKGIIRLLMSAKTDSYYIARTKNPMISSKYGLRNPCRQRTAVVSFDLLNINTESASKGVV

SEQ ID NO: 22777 - protein, 104 aa, A.fumigatus
NHRLHTLIAIFEHTLQESQFSNLAFKSFQIITMDPNMNNLLKWSIENSTSARQAGNSNGTGPAPASRSNLNPEMLSALFGGPSDADLMKAAMEAVHSDVFTDGR

SEQ ID NO: 22778 - protein, 81 aa, A.fumigatus
  UNSURE (46),(62): Identity of amino acid sequences at the above locations are unknown.
RVQLPLPVLVPLPQLKKEHNYQLLLMMDRKDYLNLGLKSIYGTPLXKMNEPLCLPQKIRGRXEVSKTVGYPNYLLSFNSPG

SEQ ID NO: 22779 - protein, 77 aa, A.fumigatus
CNSDPWWIFTTCSLFYTIKREYNFGIVELVSVSPRFGIMLASMCLSIAFMIVDTCSVLNVFSHSSLPTGIEPFWKVC

SEQ ID NO: 22780 - protein, 78 aa, A.fumigatus
LALSFQPRGEDKNRPFMSRKVSLFYIGTVILAQPYWVLEIYANFAYFNNYNKIFLTTRPLEPIFRFVSRHWALQADIG

SEQ ID NO: 22781 - protein, 64 aa, A.fumigatus
RRRYISRIIIIYSRYTSSIVVRAVYSSYISYGFYLVSYLLYLVIIIYKGLFLFNTSKYSLYFIA

SEQ ID NO: 22782 - protein, 70 aa, A.fumigatus
AHTFNNYNSFIIPLNNYIGSLTVIYYSNNLRCYIESYYKASFIKVLDIIFIDAMFLNSSMYSFKLLFYNL

SEQ ID NO: 22783 - protein, 267 aa, A.fumigatus
  UNSURE (265): Identity of amino acid sequences at the above locations are unknown.
ITNGLMRCLLGDFSFARSLAVQHRCRDILATCYDSEEMLYSKYPQAKQHVQDLLGSFSNKRKQCDPDGSETEKESNQEIKKGGEQSNKKQDCKRRGPNVLFAVDARKLGSPSGGGKDVRTGFARRERKRPAWQDNRQKIELATNTGGPWDIICFNFPHVGGLSTDVNRQVRSNQELLVAFFKSCVPLLSARPQVWNGDDEDEEDDHWSSSEDSISDSSEQDDQDIPTHGRRGRYRTEPGQILVTMFEGEPYTLWNMVSHKPKEGXCS

SEQ ID NO: 22784 - protein, 287 aa, A.fumigatus
DMCLGGGIAGLTASIALAKELTKVEPDLDMAIYESRDEHSMGEGGAISLTPVAQHHLDQLGVLPELSRMGDGAGIEVDEINLYSLRSGRSLGPLRFADETGRGYGGYKSRRVRRSALFRAMLAVARRYAQISVEFDKKLSSTTMDGNTVTLAFDDGTTTTGDLLLGCDGVHSAVRTQLVDPGNHSEYTGIAFIQSLAPAERVSLPSHLNQSAIHLTKQGSLLASYCDPSHQTLFVAAIMRVNEHIIERYRALASTGTNTAALTSAQMALRYPVRSSLTGADETRAYV

SEQ ID NO: 22785 - protein, 64 aa, A.fumigatus
IIIKKALIQPTTFSPLVHSLTTNSITTVNPSVQSIINQHLSNKKASSQYHVTPINTTAPSKAND

SEQ ID NO: 22786 - protein, 224 aa, A.fumigatus
QRGFFEPRGEDQLFSYIKMAIWDSISGRKQAQGSEAFDPSTAQDATSFLSEALIPDPTQLHPLAGLNQDTLDYLTLEDSALDEIPGSRSVLPSRGWSDDLCYGTGTTYLTALTIGGAWGLAEGLKRTPVTAPPKIRLNGVLNSITRRGPFLGNSAGVVAMVYNGFNSGLGYARGKHDAANSIVAGALSGMLFKSTKGLKPMMISGGNGASIAGTGLYVHSHFFF

SEQ ID NO: 22787 - protein, 121 aa, A.fumigatus
GFTAVHIAAITATCWILFLNALVGFQFLDDGTPVSVGLCVASALVFFIGTGYIALDTAFDWTGEFAMTPSDHYRNIALYVLYQLFPFVLLVAFFVLESVLVIRVLGEFRPMCMLNPQGLLS

SEQ ID NO: 22788 - protein, 77 aa, A.fumigatus
LTGYAVYLSAAGLLFAIGQIFNYVISTHLCQASHGKINGALFETLFTLLSVVMVWIFWSSITEDDWPMPMAVGTGYN

SEQ ID NO: 22789 - protein, 61 aa, A.fumigatus
NGTAAVVPGRAHCDPLSDGCTPRCDSEQPPPGGHYTGPAHALPTQSRCLALFSAAPPRSGT

SEQ ID NO: 22790 - protein, 150 aa, A.fumigatus
IHPLCNSNRPLGSETERRPLSLGEHTAIRYPMDVRHVAILNNHHLEDIIQVLRMHFQHNLVAWRCSRLLRRVPERDNRPGRVHRNPQLGFEDTLVPAGETEAKRRGVVPLAPELEEGEPRAVVEHACLADLPGLAEDGEEFGSGIFDRVV

SEQ ID NO: 22791 - protein, 90 aa, A.fumigatus
CPPGGGCSESQRGVHPSDNGSQCARPGTTAAVPFQTQVDGSSCTGGGSITGQLIFGLAWTSLWLTAVDSCCCGHCWPTSRVGCRGRLIGI

SEQ ID NO: 22792 - protein, 197 aa, A.fumigatus
LNEALELRGEYPPFPIAIRPESITRHEVIVTVTNRPEPWHSLDYSIEYAGTELFTVLGQPWKVSQARMFHDRSGLPLFELRCQWYDSSSLCLRLPGGDQCILEAKLRVAMNAPRAVVTFRNAAEQPRTAPSNEIVLEVHAQDLYNVLQVVVVQNRNVAYIHRITDRSVLAQGQRPPFRFRPKWTVRVAQGVDLSLVS

SEQ ID NO: 22793 - protein, 92 aa, A.fumigatus
QRSLSSERYPQMGVAESQYRFGMQCFQQFLTKFVQGAAREIESTVTITIKISGEMFYVIGYVSLRYNLLVIRVANAHMTQHNRLLSIISSGN

SEQ ID NO: 22794 - protein, 171 aa, A.fumigatus
PDAGGAGKTQTALHYAVQNLSKYPSGIAFINATSVISLSADFDRLHDLLRLGDSKDKIGAVKGWLSRPENNKWLLVFDNADDLDNVPLHKFYPAVNWGHIIITSRDQAVIGSIAENGHVLSPLTENDAVQLLLEKSGIQNPTEGDIEDARTVTGLLGSLPLALVTAGAFVR

SEQ ID NO: 22795 - protein, 178 aa, A.fumigatus
RPAMLKAVEAKFKEAALKAKDAEILLEHEAGFLEPEGELERTYKVRQDEIRDNVAIETAKKGFELKLEDLGPYRADYTRNGRELLLAGRKGHVATMDWRKGKLGCELQLGETVRDARWLHNNQYFAVAQRKHVYIYDHAGVELHCLNKYIEPLFLDFLPYHFLLVGAVRLTLFFGSDT

SEQ ID NO: 22796 - protein, 174 aa, A.fumigatus
  UNSURE (14),(15): Identity of amino acid sequences at the above locations are unknown.
PFNTPKIGKPSSSXXDQIPGDIYRGESSRIFFEFLNPFARTIAFKAADAGFPSGTSPFRYRQGQRIWFYMPFIHAEDLDMQELARIKYAEMAEDFTRLLDGDATGLSDDEAQCRQILLENRARLEEQLTTHFRVQREHYEPIARFGRFPHRNVALGRETSDEERRFLEEGKIFG

SEQ ID NO: 22797 - protein, 93 aa, A.fumigatus
ACDSFPKDDPKKPVHLTASMGYKAGMTTVVRDLDRPGAKMHKKEIVEAVTIIETPPVCSLTQGFGWLRKRGGHLHLLSIACCCRCCRLHRLHR

SEQ ID NO: 22798 - protein, 260 aa, A.fumigatus
PKGQNAITRQELDAKPLLQLLATSIRRPLTMLVTEYVVFFSTLWSAFTVGTLYLFTQSVEQVFVGLYDWGPVTAGYVQAAIVIGEVAGWFCSIPSAQLYFASASRNTEMPGLPIPEARLYLSVAGSVVGIAGGMFVYAWTSYPTLPWVAPAVGLFMVGAGSVVVVSGLADYIVDAYSQYAGSVMACFVLGENTFSAFLPLAAMRMYNTLGFQWASTLLALISLSLVVAPVAFIVWGRKVREKSPYMREVIKEKRMQAGLQ

SEQ ID NO: 22799 - protein, 275 aa, A.fumigatus
ERVSFQPPWVKTDRLLQASLHPLLLDHLSHIRTLLAHFPPPNDKRDWGHHQRQTDQRQQRTGPLEPQRIIHAHGRQRQKRRKGILPQHETGHDTAGVLAVRIDDVVRESRDHHDAAGADHEQAHRGGNPRERRVRGPRVHEHAPGDPNHAAGHGQVQPGFGDGETRHLGVATGRCEVQLGRGDGAEPPGDFANHNGGLDVSGCDRTPVVQTHKHLLDGLGEEVQRADGKGRPQRREEDHVLGDQHRERPPDARGQQLQQRLRIEFLARYSILAFG

SEQ ID NO: 22800 - protein, 72 aa, A.fumigatus
RMKIPAGIVIPVPSAIVVIYSVPHNNTLAPPVARSIPHNTNFGSYLRGTWLFTVAYYNNIADRMLFLTCVFA

SEQ ID NO: 22801 - protein, 214 aa, A.fumigatus
  UNSURE (202): Identity of amino acid sequences at the above locations are unknown.
ILQIHCSHRSLHHLQSLEHIVQNLLRSGLATHVRRKELALVEIGVNGTINLGSGLLLTQKLEHQSDAAQSSDGVGDALALDVGGTAVAGLANSETITDVGAGHETQAANQSSSTVGQNVAVQVRGNNHIVVLGLTEELVDHGVDNLLLHLNRGKALRGESLAGGFPEETVCLRQDVRLVGDGHHGLGAESRAASGITDRPTXSPSEPRRIRARV

SEQ ID NO: 22802 - protein, 188 aa, A.fumigatus
  UNSURE (1): Identity of amino acid sequences at the above locations are unknown.
XRRTIRDAAGSSALRAKPMVTITHKSNVLSQTDGLFRETARKALAAERFSSVEVEEQIVDSMVYKLFRQPEYYDVIVAPNLYGDILSDGAAALVGSLGLVPSANVGDGFAIGEPCHGSAPDIEGKGIANPIATLRSVALMLEFLGEEQAAAKIYGAVDANLDEGKFLSPDMGGKATTQEVLDDVLKRL

SEQ ID NO: 22803 - protein, 205 aa, A.fumigatus
RRRSISRHRYDPDFSSTTYLSPVVHEDVRIHRSASTGARRRRELQPPPPPPAVIVDINNVSRNKSTNRSANKNRKHRQEDTTIVDIESEDETVLRKHRRPRASTSVSREASPRHEASPRHQRDFELVIDQRMLEKNDVRQDLELMKQQMEIERLERELARRRGEHENNQTQLIREEETWYEDEISDRLRRLGLPHGAGRIDGGQS

SEQ ID NO: 22804 - protein, 61 aa, A.fumigatus
IHGRRSVESVNVIVYSDSLEYLNSLCIIHAALLRSSASHSTQAESLDYCTIFRGSMRSSCA

SEQ ID NO: 22805 - protein, 98 aa, A.fumigatus
AHFSGQPHQPLGCCTLAYAYDLWRNETLLSYLSFVPYAIDTLSYEERYSPDALIPCRIINQSSNPIEKDAIDSWRGRKTLKSIRRMLFTTSARSANRS

SEQ ID NO: 22806 - protein, 63 aa, A.fumigatus
TISYVFYICYFAIAIRITMDGFLGKMIEKFAEKATGGSSNSGGDGYSSLQQKQPQLRWTGAMV

SEQ ID NO: 22807 - protein, 68 aa, A.fumigatus
LIIFLLIPLIFTSRLALARNGALNFTNSPGFLTFFIFSRASLVEPSVTLSIVPLPLPPLTRSPIFHNY

SEQ ID NO: 22808 - protein, 107 aa, A.fumigatus
LARLPISKILNKIPTAHENLASTHDAWLTTARAICTTDTFPKLLSRTFALPSSPGRTYSLAGMTKGAGMIHPNMATLLGILCTDAPIDPSALQSLLSLHHGSCRIRA

SEQ ID NO: 22809 - protein, 229 aa, A.fumigatus
TLDMAMPASKQKYIPSSGSYPKGFLVSGTHVGVKASNTKFPDLALISSETPCSAAAVFTTNKFQAAPVQVSKKTLESRQGQGIRSVVINSGCANAVTGKGGLEDALNMGKKVDECNGLSEPSTIVMSTGVIGQRYIPLPLPQPPPPPPAPAHTHTHTQSYESLTSHDLPDFLSPRSSTKSPRHTRTSHPRTTPGSPPPAPSVQQTPFPSCSREPSPSPRPPAAPTASPA

SEQ ID NO: 22810 - protein, 72 aa, A.fumigatus
RHETRHQRSSSKLKGMPEQAGKYLASWSSECIPSSFVIALGPSITVQGLSAIDNRSTHRESDIWYLRVFVKN

SEQ ID NO: 22811 - protein, 135 aa, A.fumigatus
CVQGSVTLLGDACHPTLPYQAQGAAMAVEDGAVLGLLLHHVASSPDYRSKIPQALKLYEDLRKPRTARNVQGAIRNRRGFHLEDGLLQRLRDLVLSWSGLTRETDWIGLMSSRQRAVLGFDVLQEVEQRMPELST

SEQ ID NO: 22812 - protein, 72 aa, A.fumigatus
ICRNGQTIMRLPDVNSHPETSSSGCRRSALNSSGVLHRNVDTNPSNEQTTENSGTTYVKNRCKGECQYCCSV

SEQ ID NO: 22813 - protein, 375 aa, A.fumigatus
GSPSGRWLRLSTDVEVESRTSEAPASLLWSLSGSVEAAKEGESGLRRVSLGKPSSIARYFALVRVWIPWLGPRHGKKNFSLTEDAVLCSFLRTDGSHLVLLAVSGISDVLTVLASNEKGEVVIKAKSDHTEASKFQVLASAADDFEVAMSAVIYEARKMVRPYATEGLSDRSPTPVSPMDNDIVVVEKDPQAQWMSEWYDGLGYCTWNGLGQNLTEENILFALNSLKEKGIEIQNLFIDDNWQALDNEGESQFNRAWTRFEADSKAFPQGFKRGIETIRQKHRNIQHIAVWHALFGYWGGISPNGDLARAYKTKEVQITDPATGGTVAHASEKGSLLAIDPEDIQRFYDDFYSFLSSVGVDSVKTESCPRVDNPR

SEQ ID NO: 22814 - protein, 136 aa, A.fumigatus
DWDRLRSIIAPTLTVDYRQIGLRKWDDMPAEDYMAMISDMDFLGDPTVKTQHLLGESWWEKISDTEVIGHHQLRAAHQVYTDSTLQTVKLKGHGHATNEHYYRKVDGVWKFAGLKPTVRWNEYQFEDVFRAAKPSV

SEQ ID NO: 22815 - protein, 198 aa, A.fumigatus
LIRLILYAETKILSSIMASSQDNFVSKTNPDPYDQIIVLSQKVINAGFKNMWKLAQGDDDSPLTHFKKSIHGEYIEADVGIPSVKLHVESREPMLYFLLALKNGEMAVYESDDSDTLFKWDIKDWVLAFNVVLSKCNGCPSTGRSMEPAPNHPSLPLLDQKKITKDSEEYRKFKERAGLPESNFSLAQLFIDASCGCP

SEQ ID NO: 22816 - protein, 67 aa, A.fumigatus
GVLGRVVQATNAKVRAVNEYAPSFPPTSIDYFCYPWRGVDGSGANKDDQDSNALAYLLMSDFKNPRL

SEQ ID NO: 22817 - protein, 72 aa, A.fumigatus
  UNSURE (34): Identity of amino acid sequences at the above locations are unknown.
PSLLGVAWLIFSKDFEEFADSPLGCSNLLVAICXKKPVNKFCFTFSQFCGNTARFKFRFQIGHFPIGINQSL

SEQ ID NO: 22818 - protein, 105 aa, A.fumigatus
SFHGRGEEFDASVQMNVTTLSVRYMLKPFKPGDKLSDHAVPIGVVMQQLQTQLAEYRALKEQLAVGGAGITGVSSSSPGAEGQDTGESDPSSASSSFLQLATSSE

SEQ ID NO: 22819 - protein, 80 aa, A.fumigatus
DETQEEKTPRYTPYVSPLRWFKAYRYHPRFTENVSGGFRSLTYSHNIDSEKYLCSYKATGGVCNDRSCELQHFRDITLSR

SEQ ID NO: 22820 - protein, 326 aa, A.fumigatus
MCSAAPTSETPPPLLNQLIPAGHCACRSATIFSCDSCLQCSASTLPPSPSPPHITFDPNEYSYNETQCHSFFPGLFEDPTRAQTFWQAKNGIRRADLDNVQMMNGMVRAAVYKGRLYVLTALARGEDHRRKIIGVLSSIHRALISASDLAVIPDTEFIFSVEDKMEDIAGPGHPLWVLARKPHEESVWLMPDFGFWSWGHLDSQIRPYDQVVEHVRQREVPWDQKRDKLVWRGKLSFAPKLRRTLLEVARGYPWGDVREVEWRNKANFLSMEEHCDYKFIAHVEGRSYSASLKYRQACQSVVVIHKLQYIQHHHYLLVSSGPQQPF

SEQ ID NO: 22821 - protein, 73 aa, A.fumigatus
LQILRHIGIIVDHGKSTLTDSMIQRAGIISAAKAGEGRYMDTRPDEQDRGITIKSTAISLYAKFPDPEDLKEI

SEQ ID NO: 22822 - protein, 71 aa, A.fumigatus
NLGCAFFFPYCCPAMIITYYCPSDFSSRLTAYKALEVDTRYLRAPHDCLVSVPCISFLNLAMQIRTHLLTD

SEQ ID NO: 22823 - protein, 220 aa, A.fumigatus
LKFNNTGSIVRHFCGDHPGWPHTCPHAFAMGRKPNQLIVEFFIRGQKLEDASNRYQHTCRACGEKFPKGRIDSLTNHLVKKCQAIPLRDRQRVLLRLHELPDLADGDQNKDPNLAGQGKGKSVNLPYTTGQNFDGLNVLAEASRQVGASDQTKRGGPAYAQSVTVGGKTVVVDPALEAEGFQGHPTQPEHIEEDIKPPGKILFFPLCPHHEGQDRLIFAH

SEQ ID NO: 22824 - protein, 268 aa, A.fumigatus
SRSCSIARPLMVVARYSIIWSPAENGIQRSIFPSVTTTHAVHPLILFQKHFKQKSLIILRSCNELLRRLSRAEDTVFCGRVFIFLFQSFPLGDKSAVNLRGEYHTENVTTFDEITKSGAKESDDMDVEMPDAKETLTATEALGHDHDGQPPPSASASQTLVQEQAKIPKLIVSKTEDKDSEKAVDLNALYPVFWGLQTYFSAPTKVFDSHHFSSFMTGLENTLIAFKNIRTDLENQSASKTAEEIRKSTKRKRSVDGQKIASSFNPSI

SEQ ID NO: 22825 - protein, 95 aa, A.fumigatus
VVVTEGNIDLCIPFSAGLQIIEYLATTINGLAIEQLLDQPKYQTGLALFYAQSASCSVTRLDDWGQPLSEKIEIMSSKFHMRMNEGSSIVVFAYR

SEQ ID NO: 22826 - protein, 114 aa, A.fumigatus
AFDDMLKEICAALLSADVYVRLVQTLRKSIKSSVNFSSLPPAVNKKRLIQKAVFDELVALVDPHAEPFRPKKGRSNVIMFVGLQGAGKTTTCTKLARHYQMRGCLHHGAGRTRA

SEQ ID NO: 22827 - protein, 270 aa, A.fumigatus
LKYSALLALRDEDLKNVYHNYRASLPLRRSLGLPVYLPISPPPAPSTSSTNNKTTPFREAVKSQNLSRANFQLVRRAAYDVRRMIPFTLILIVCGEMTPLAVLALGNAVTPFTCRVPQQIKKARLQHAARKRAALAAHQAQARGSVTGPAAGSDAERELLAREFAHPGWVEKASAQEILQACAALGLVRTHTRPAALVPWLYRPRLRRYVEYLALDDELIRQGGGVPAMEAAEVSIAVEERGGVGVADGKEYWEAEREERRWLERWLGRA

SEQ ID NO: 22828 - protein, 204 aa, A.fumigatus
RPQERLPQLPRLASPPPFSRSTRLPPHLASPGTLHLLHQQQDHTFPRSREIPKPQPRQLPACPPRRLRRPPHDPFHPNPDRLRRDDPTRRPGPRQRRHPFHLPRPAADQEGPPAARGPETRGPRRPPGAGARLRYWPRGRLRRRARAAGPRICTSRLGREGLSAGDPAGVCGVGACADAYPARGTGALVVSAAATAVCGVPGAG

SEQ ID NO: 22829 - protein, 191 aa, A.fumigatus
ALPSHRSNHRLSSLSASQYSLPSATPTPPRSSTAMLTSAASMAGTPPPCRINSSSSARYSTYRRSRGRYNQGTSAAGRVCVRTSPNAAHACRISCAEAFSTQPGCANSRASSSRSASEPAAGPVTEPRACAWWAARAARFRAACCRRAFLICCGTRQVKGVTALPRARTASGVISPQTIRIRVKGIMRRTS

SEQ ID NO: 22830 - protein, 87 aa, A.fumigatus
PPPPPWPGRLPPAESTHHPAPGTPHTAVAAADTTRAPVPRAGYASAQAPTPHTPAGSPALRPSRPNRDVQIRGPAARARRRSRPRGQ

SEQ ID NO: 22831 - protein, 243 aa, A.fumigatus
PGCCSSLGAFEYLTIGHTVFAIGRFLTAFMQWFLKPRWVLMLSYIGMIVFAVLCMKTTGSTAVAMSLMVYLFESGAFSTIFALSLRGTARHTKTAASLLATAISGGAFFPFAQYAAELSGGVSYSYSVLVALFCAGAIFPLYLNFVPAAKKQVDPVPDEYLRRHRRRRSCVAANKTLAPVPREKDNPSVGGVLSRRRSVLSDPLPTINLPETTYNPMSSPSRTNLPEEAVIVIICQERRRAHA

SEQ ID NO: 22832 - protein, 73 aa, A.fumigatus
YGELSGCMGFSGEGYQAYLTEIDSLKKAIYMMCIFNSQYSGIFIHRGFIFGYTFTLTPESFMYMSARCTAQYF

SEQ ID NO: 22833 - protein, 128 aa, A.fumigatus
TAGFSVAPLGDIHPAIEVSFLAMMYISSDFPTAITMRKTNVYEERSVGVYEHDSVSEAESRNGKHVGLAVHIQRQLGFDLWYVMLEIFLIAITEGGRLQKAADETTFSLFSVPFEIVSYGTAGLSGIS

SEQ ID NO: 22834 - protein, 73 aa, A.fumigatus
LSTSSLCDATATMAQTLAAASLVLVPLVTAQQIGSIAENHPELKTYRCGSQAGCVAQSTSVVLDINAHWIFTT

SEQ ID NO: 22835 - protein, 77 aa, A.fumigatus
VRHEFCNLETPFEAKAHDQAESASHRTRYKTFRQTQSVLRLSSDSSPMIVGAKDNRGRQPIQQIFLYLLSMIPLALL

SEQ ID NO: 22836 - protein, 127 aa, A.fumigatus
PARPIRVSASTTRIAGETPVVRYARASIVVFPTDHQAYQWYRTSDTSWRAHEIYGDNPPKWNFAAQRPADLVVINIGTNDNNPANNVSSTDYYNDYITLVGNIHKIWPKADIVLMVSLLGKLDMVGC

SEQ ID NO: 22837 - protein, 161 aa, A.fumigatus
SGGHQHRHKRQQPGEQCIEHRLLQRLHHSCGQYSQDLAQGRYRSDGESPRQIGYGRMLMTQSLWGGFGASGDTYVQGPLWVDEIKRVYQHYEKQGFIHYFDTAGILQHNDIAPQWHPTDVGHLKIAAHLMQWVKLKFGWEFGATGPEVYHGTLYWNDQANY

SEQ ID NO: 22838 - protein, 63 aa, A.fumigatus
DAFPSSPRREEWKTRWFVLDGWLNLVYLFDIGFVAYLWRPTANNRRFAMSDEVCLGQRFHGAR

SEQ ID NO: 22839 - protein, 203 aa, A.fumigatus
RLLVLRGSAGSGKTTTLSLLSDKLGFDVLEWRNPSGSEFAAKGFTSTTAQFEEFLTRGNRFRGLEFHGATGSSASKFNSSDHMTPRVILIEEFPTVFDGDSPGLAAFRLSLQRYLSVSSSPRSNIRNDIERHGSSPVVIIVSETMLNTEGSYSDNFTAHKLLGPDILSHPCTTIVDFNAIAPTFMFKALNLVLEKHIRRYRSA

SEQ ID NO: 22840 - protein, 285 aa, A.fumigatus
  UNSURE (184): Identity of amino acid sequences at the above locations are unknown.
VGKVAAAGSVAGLLSLLYYVPPRHGSLQLPHAFYQLQAYLPSLHRLLPSSMTGMRLPQGGFANGFAAAALLSAIITGIVGMQVSKLTKIDSGFTRYPPRIKSKPSPKADPHSIPGFLNPKDYKTLPLVQKALLAPNVYRFVFQLPSATDIVGLPVGQHVAIKATVDGQTVTRSYTPTSNNLDRXYLELVIKCYPDGLLTGQYLANLQVGDKVHFRGPKGAMKYQRNLCKKIGMIAGGTGITPMYQLIRAICEDDKDTTEISLVYANRSEGDILLREELAAAQRQG

SEQ ID NO: 22841 - protein, 248 aa, A.fumigatus
  UNSURE (143): Identity of amino acid sequences at the above locations are unknown.
SAPPAAVLHDRHAPATGGLRQWIRSRSPTLRDHHRHRGDASVETDQDRLRLYSIPPSYQEQAESQGGSSQHSRLPQPQGLQDAPSGAESPPRAQRLPIRLPTAISHRYRRPPGRPARRHKSHRRWPNRHTIVHANLQQPRPRXPRARHQMLPGRPSDRPVPRQPASRRQSALPRPQRRNEVPAQPVQENRHDRRRHRHHPHVSADPGNLRGRQRYHRDQPGVCQPQRGGYSVARGAGRCSTPGLKVMR

SEQ ID NO: 22842 - protein, 71 aa, A.fumigatus
ASVQMGVSSLKACLLGCKISVNSNSYPEDVDDVILRLFPGEVATYTLAGGNPEAASRSGCQPTRSFASGSQ

SEQ ID NO: 22843 - protein, 125 aa, A.fumigatus
  UNSURE (77): Identity of amino acid sequences at the above locations are unknown.
NSFRLDNVSKDSTDWIGPKPGGSPGLDCLPIGAASEAKYRRFTERFRPEEQLLLKDIVYQIMRSYLNIPLGSLEDTXSGLLFFTALAGNLARVEDLVKVAHAASSESAHWLCKYVFTTRGWKNQR

SEQ ID NO: 22844 - protein, 158 aa, A.fumigatus
KVRQGQLWIPEAWNTDSKGSFRSDCFARFSISLSSMLFTAVTLALLGQALAGPVELEERQSSCPNIHVFGARETTAPTGYGSSSTAVNLILNAYPGSTSEAINYPACGGQSSCGGVSYANSVVAGINAVVSAVNSFNQRCPNTQLVLVGYSQVFVSPD

SEQ ID NO: 22845 - protein, 67 aa, A.fumigatus
  UNSURE (57): Identity of amino acid sequences at the above locations are unknown.
NIQSRLILLQGGQIMDNALCGGGDPNQGYTNTAVPLSSSAVNMIKAAIFMGDPRLCXGSSRTSSAPA

SEQ ID NO: 22846 - protein, 204 aa, A.fumigatus
RIFVGHDQDVDCVCFHPNSAYVFTGSSDHTVRMWAVTTGNAVRMFTGHTGNITALACSRDGKLLASADDQGSILLWDLAPGRLLKRMRGHGKGGIWSLSWSVESTVLVSGGADGTVRVWDVTGPAQDPSQGRVVGDGGAGTKVDGGNPSAASTQPSTSVAPGMGKKKGKDVVVTPDQISAFPTKKSPVYKVKFTNMNLIIAGVF

SEQ ID NO: 22847 - protein, 88 aa, A.fumigatus
LRNYLCCRKLRIPLIPLFSYYYLAGLFMTIITIINACIITMQSSVNLCNGKHSRTQTPMDLMMLLIANRGRRLDFNYQMEQREVSHTL

SEQ ID NO: 22848 - protein, 65 aa, A.fumigatus
NLVIQISQLINIIIIKIINFQYFPQFIQFVYIIIIIVKFIFDLSIKILLFNQFLSIYIFLLFIIS

SEQ ID NO: 22849 - protein, 263 aa, A.fumigatus
IWKNSLIIFDIKPKKNKRKLIHNKISDNFLEEYGLSSYQELNRNVDDYNSIYEKKQKELLTRNNLNNIPIEKLDGFIIGESSLIDKINTTDKSKNIKKSNIQILTNDEKQKDIDRQKLIEQENFYRQIKNKFNNNDDNVNKLNKLGKILEINNFDNNDVDQLAYLNNKILQNDNSKATTTLDNDLDLLLGISSDGKDDVDKVESNVKQQDDNFDTFINKLTINDKDETFKNEQHQSKLSFDKVNKKQNQNDAKDLDFLDDLLG

SEQ ID NO: 22850 - protein, 219 aa, A.fumigatus
  UNSURE (16),(17): Identity of amino acid sequences at the above locations are unknown.
GAKAAIGGLSPLQTQXXPPSLPGVVVAWSALKQKYREVMRVAAYGSPSVQIHFIYLKVDKDILIERVKHRDPSQYMKSGMVQLQLQAFEEPPGEWDALPFNGDGPREEVQKTVFQLVSEKLAEYQGLGYSGFACLMTIFFFIFFFFFFFFFFFFSGELGSVARIAWISCAVRCLWSFRAAHSCFWEHHDLSLSMESASYPGVPIGCESLCLVMVICLLF

SEQ ID NO: 22851 - protein, 101 aa, A.fumigatus
  UNSURE (13): Identity of amino acid sequences at the above locations are unknown.
RPDASPMGAGAEXPVIIDQSRIYAPPDPFETPSVGVEIPAAVNRPRTITAKVPLKEMVGYLKHLRSLSAGRGTFVMSVDRFELMSAQRQNAVLAELRGGFY

SEQ ID NO: 22852 - protein, 214 aa, A.fumigatus
VARVLPSPWVKNEHRQRIYEERSALIRSRSEQFAIDTFGSSIWDQSLYKAWAGIVHKLIPNLTVIERFLTAFAKRIDAEEVILFERSTFLTVTSVSSEIGDMNPIYDRHERLSNIMKAFKHCAARNTHTTPATAGFLVMHTKTPQFNVFLGRFTDNTYIFMVVPPGEAAYNCAVLNTMLAREGFSKAAAAGYGDGFPLPASDPPEANMANGVTA

SEQ ID NO: 22853 - protein, 342 aa, A.fumigatus
  UNSURE (62),(282): Identity of amino acid sequences at the above locations are unknown.
GTFNYGLGARCTICLGGAGPIHGGTGCRNGNFHFAFTLDSGGLLTTFFWQIPEQDWLRAVIXHLLVDPKMALACPPQLFYNTPPSDPLAQSLDFFVHVIEPIKDAMGVAWCTGSGYVVRREALDEIGNFPLGSLAEDVATSTLMLGKGWKTAYIHEPLQFGTVPEDFGGHLKQRTRWAIGTVDTAVKLKFCLWGDAVRQMTVAQRFSGFLYATLSLYTLLLTASIFAIPIILLWGKQLVAYATQEQLRWLIWACFASTISNRICEFALFIPAGYHTGQRGSXYQLWMAPYIALCIVRSFILPRWLGGQAQAFKPTGSLSSALEERDPQRRKNLTRRLEINTL

SEQ ID NO: 22854 - protein, 103 aa, A.fumigatus
QRMPRGFRNTYQAGLISDAAGWLDNTITEPLYGKATSKTSATFHTFGPYTAAICLCCVLEQNSGQRAIDEGLCKGTALARGRGFRRGKSKNLPKMPTSRREAL

SEQ ID NO: 22855 - protein, 246 aa, A.fumigatus
LPPVANTGAEYIMELTDKTKADVKGGTIIDYEGKARLLEIAQVPKEHVNEFKSIKKFKYFNTNNIWMSLRAIKRVVEENELEMEIIANEKSIPADKKGEADQAIYQLETAVGAAIRHFKNAHGVNVPRRRFLPVKTCSDLLLVKSDLYRLEHGQLVMDPNRFGGVPVIKLGSDFKKVSDFQKRIPSIPRIVELDHLTITGAVNLDRNVTLKGTVIIVATEGSTIDIPPGSVLENCVVQGSLRILEH

SEQ ID NO: 22856 - protein, 272 aa, A.fumigatus
SHIVSTALSLSQRHQDCQITLLEQSPIIPNPYGSSVDSSRIVRADYSHPVYAKLAAAAIDRWRNTEWGREGRYTQNGLMLVWTPGNEKAKNYATKSYHNVKQLEGDKVELLPSADDVMRIVPEYGKELNVAGGYINWGSRWADAAAGVRFAKKLLDEQGKVVFKTGEVDRLLLADGQSATSQRRVTGVVLTDGTTLTADLVILATGAWTGKLVDLRGRAISTGQAISYMHISDEEHRRLENIPTVLNFANGIFIIPPRNNLLKIARHAYGYH

SEQ ID NO: 22857 - protein, 66 aa, A.fumigatus
NGPAAEVDKLTCPGACRKDDKIGRECRAVRQDNTGDSALGGGALAIGKKEPVDLAGFENHLSLFVQ

SEQ ID NO: 22858 - protein, 125 aa, A.fumigatus
PQRLSLSAVSTDIYDVSLEELTEAETALAERETEDQYSLRALRTLFGRLYNVRKSILCCLLALGADGGGSDIVRWSTAVEQMRDLTQVTGANTRKMTNILNEDDREFSPQCRVFSDDPPLTLFVR

SEQ ID NO: 22859 - protein, 99 aa, A.fumigatus
TPFIAGRENYRFEYLLIFVDTLYNARVWLNIAIQRPERICWASLNRGGTTKAGCRRQWQLQPAGRARHMIYRRSLVDAAHQSSFASLPFLKEASDIRSN

SEQ ID NO: 22860 - protein, 60 aa, A.fumigatus
  UNSURE (15),(16),(19),(30),(39),(45): Identity of amino acid sequences at the above locations are unknown.
TITFRLEPARPEGYXXEEXGHSRQNFSGSXTVKLRFPIXRATVQXLRFIPHRKYDLLLAC

SEQ ID NO: 22861 - protein, 88 aa, A.fumigatus
SQGFVYTSSTDRILGTPHNGSSLAAMGKVLANIVSAFSPIRTPRALIGTLQKDSEVLLEITEDFLKRRRKVQLVSFYELEFTSIGPFL

SEQ ID NO: 22862 - protein, 200 aa, A.fumigatus
PAQSGHRVSLVLATWFCSPVMLDAYFRGQTKVQIGNNKNLFDFTENTNVAYSHYLAAAALVTCQNSLPGDDAKVDGEAFFITNDEPIYFWDFTRLVWGYAGDTTRPEQVQVMSRTWALLLAALLEWIFWAFRLGEAPLTRTKVRLSCMTRYFCIDKAKQRLGYKPLVGLKDGLRTAVEDCLRRRTAAQSTHTSNVKEKGQ

SEQ ID NO: 22863 - protein, 129 aa, A.fumigatus
  UNSURE (105): Identity of amino acid sequences at the above locations are unknown.
NTDCVAIIMPLTPEQVQIIKATVPVLAEHGTTITTVFYKNMLTAHPELNNVFNTTHQVTGHQARALAGALFAYASNIDNLGALGPAVELMCQQTPSLYIKPEDYXYCPGIPGSKQWGQVLRGSPPPPRS

SEQ ID NO: 22864 - protein, 208 aa, A.fumigatus
ERCSFQPRGEDSQSIKTTRDVQFLQWAGDKTRDFSANAVSAATELSRLLQEGDNCDQGIFLSQSKDVIVGVYIGSDIQRASAVDILQNFGNSAPSGPVKASQLAAQACENGNKTAQTLGVFADATGNLASVLNALQVWDKGQCLTGADNQQVWSNTPINVLNRHTTVRSDNTTIAARLKTKVLPRDTCTYVQAIANDGVFTRRGRTKL

SEQ ID NO: 22865 - protein, 397 aa, A.fumigatus
VTFALKRQALFMGLNMGMGQLGLATGPIIGGAFTTKVSWRWCFYINLPLGVVVGGFLLFNTIPEPKPKSPPLEILGTAIKSLDLPGFMLVCPAVVMFLLGLQFGGNQHPWNSSVVIGLLVGAAVTFGLFLVWEHRRGDKAMVPFAMVKHRVIWSTAMTMFFTLSSVLVADFYIAIYFQAIRDDSPLMSGVHMLPITLGLVLFTVVSGALISILGYYLPFLLAGGAISAVGYGLLSTLSPTTSVAKWIGYQILYGVASGCTTAAPYIAIQNLVSPAQIPQAMAIIIFWQNIGAATSLIAANAIFSNSLRHQLQERVADIGLAPDAIVAAGVRSIRDLVSGSPLAAVLEGYAKSIDRVMLLGLAVSLAVLVFAPGLGWKDIRKVKDFQVIGIHSPDGGE

SEQ ID NO: 22866 - protein, 66 aa, A.fumigatus
IVRSRWHVPLQIVGTVIAVVAYFLGHAHKGRQFGKNVHASFANLLMLMLVVQVVIGLYLKLSSPGV

SEQ ID NO: 22867 - protein, 184 aa, A.fumigatus
  UNSURE (175): Identity of amino acid sequences at the above locations are unknown.
LTISSHGIDSLNCTLASLLETAAMGFGSSQLGAYTALVPCLAMYFSTWETYHTHTLYLGYINGPTEGLLVAIGIMIASGYYGPQIWSRPIVEFLNFPQIFGNYSVKDVWVPFLLLSFFVGHLPGCVFNVIEARKKQGLPVSTIFKECGSNDCLPHLQHCWALLSLLDSAGSKSTXLVLVGQSRL

SEQ ID NO: 22868 - protein, 345 aa, A.fumigatus
  UNSURE (18),(23): Identity of amino acid sequences at the above locations are unknown.
VGDCVGIVTEVLHTGTAXSGLSXHAGQVLDVFLVLYVPYCGGFLTQYLSTIGLAIYFSAGITFIYRGAFVSSFIILALVYFRRYKHGGFSVTNFTSPVDTVLNSYLDLGDRNYLIVYFCPVTKHTISLFSRSHIMADKPAILQPRPRRVFDLTPASNESSESPTPAEPANSDLLNPKEAASSSVSRTASIMNLTSSTLYGIYSPTAFEGEGQTPISESPPIIKPSPDTPVRQSLQRTRSRLSHGLFRGVILPQVFRSVLLFGFGVAYGVITVHLHENHWITPVKLENIRYYDSWQYLGLWGLAGVALGHVLPWLDSFAGEWNTDRSQTVKGQENNRLRESSPRGW

SEQ ID NO: 22869 - protein, 61 aa, A.fumigatus
IHLPVQVSDLYSQWGISTLLNNRRGWYKTGNNWWVKGSDKPRDCGMYISPKGSVVATLTMQ

SEQ ID NO: 22870 - protein, 71 aa, A.fumigatus
GKKGGGVNFGQEVKFSWGTGREKFGKNYPHLKRPIVNPLFGYPYFINIKQSPGFLAFLPAESTRKSEVRRR

SEQ ID NO: 22871 - protein, 75 aa, A.fumigatus
  UNSURE (45): Identity of amino acid sequences at the above locations are unknown.
CPLSRHNAYPNAGLVLLSLPRVTPRQLICLPIHGGPVPTFGISYXWMEPPAPEILPQNILQQATPFGYLRNFMYM

SEQ ID NO: 22872 - protein, 129 aa, A.fumigatus
SPNSFQGTERSIPILPQLTDPEATSPTDKRLMETTDAFPSSAAFDVINSALQSDEAERKDAIKNAKAIVAFNLKNASGQEESWYLDLKDKGVVGKGAAPAGGKADGSFISLTFENQWSGLDWFQADHVT

SEQ ID NO: 22873 - protein, 105 aa, A.fumigatus
RLCALINALEFKPKHLLAVDSVPSRLELARSLGAEPWNFKTDGEGLRKRVEELTNGRGADAVIEVVGLSPALRTGFDLLRPWGILSSVGVHNGEVSLHQPSGIQA

SEQ ID NO: 22874 - protein, 84 aa, A.fumigatus
RLMKTHLPVVNTHTAENAPWPQQIKSSPQRWAKPNHLNDSIRSSPIGQLFDAFAQSFSVCFEVPRLGTERPGKFESGRDRVNCQ

SEQ ID NO: 22875 - protein, 114 aa, A.fumigatus
ERIVRYPCSQESGPLRLNTKALGALAPHFPEPDWSAVLRAAGLAWEPSSLLPPQPKPFPSLQSLIFLPLYYCFHPPIPTPLSFFLLLTPSRSLSNVFTTGLEGSAVAHCPTAVH

SEQ ID NO: 22876 - protein, 63 aa, A.fumigatus
RFASRRSVVRSESVRNIIRERRMLEHLNHPCLCNLRYSFQDIEYMCVLQQVSWMAMRLVANIS

SEQ ID NO: 22877 - protein, 85 aa, A.fumigatus
SYIVVDLMNGGDLRFHISRKCFTEEAVRFWMAELGCALRYIHSQGIIHRDVKPDNVLLDSEGHVHLADFVCGALFEQCDPIHFIR

SEQ ID NO: 22878 - protein, 74 aa, A.fumigatus
LFFLLQNVASDFRPGKPLTSKSGTLAYLAPEVYEGGGYYCEVDWWSLGVTFYECIYNKVWTCLGRNSGFSHYSN

SEQ ID NO: 22879 - protein, 100 aa, A.fumigatus
RPFEGRSQDVLSENIKKAQPKYYVTNPAVSVPCLRAMAALLEKDRSKRIGATGFDTFTSHMFFAEIDFVALERKEVPPVFRPSSDKTNFDATYDLEELLL

SEQ ID NO: 22880 - protein, 152 aa, A.fumigatus
PSSWTLLPPMAIQSMRLTTGPLSRPLCRNGATWRQKSRTWRPKAKRRSRFSWINLIATIRPGRLPLARISPCCTRRATHRKRTTTTKTRKSNPTRRSLWGPGTGTGQNSSNATMRTTTPMSWNSNSNPWPPCTKSTSASETRRTCTAISPPS

SEQ ID NO: 22881 - protein, 74 aa, A.fumigatus
  UNSURE (19): Identity of amino acid sequences at the above locations are unknown.
ALTVGGSGIRLTLSHEFSXGDSPYPTLRATAPPGTSARECSGPAFRTYSRRISTGPPIIPEGLFPNQPHKNEFL

SEQ ID NO: 22882 - protein, 273 aa, A.fumigatus
  UNSURE (254): Identity of amino acid sequences at the above locations are unknown.
NVKPLLTRTIRDSTSPVIKAAAIHCLGVCTSFGGAGEDSIVDQMTFFLDIAASDGHSIDAADDGATVTAALQEWGYLATEIEDLEAESEEAVQIFMDQLNSNDPARQIAAGENIALLYEKSYTPQEDDDDEDEEVESDEEEFMGARDRDGPKLVKRYNAYHNTHELEQQLQSLATVHKKHISKRDKKNLHSNFASILTTVENPRRGPMYNKAIDQDSNRQYGSKVRVKIGREGVMSIDRWWKWYPTDSLPRVLXGRFAVPYFEGNRPSRNICP

SEQ ID NO: 22883 - protein, 214 aa, A.fumigatus
FLTIRGSFGPLGEDRSHRGMTSAAYQKKFDEYLSQGYRVVQVNGYTVGDKVYYAAIWDKSPSAGWVTRHGMTVESMQKYFDEYLKQGYKLTHISGYELRGEERFAAIWEKQNDKVAWLSYANMTSAEYQSRFDKYVKDGYRLIDVDGYQVNDHVYYAAIWDKLASGAWVARHGLDSPSFQAAFDKYKEEGYVLRAFSGYNSGKEDRYAGLWIKP

SEQ ID NO: 22884 - protein, 124 aa, A.fumigatus
  UNSURE (12): Identity of amino acid sequences at the above locations are unknown.
HPRWITVSPQLXIVIILYCSHHHHCHHIITAYFNYSIVTFHCFVIRYIVHALLELSSLPLSLDMTDMSKNLDSIPYDVFYQIASGLDCHDFIHLSRVNQALNKLMRNESIARKTIEVCIFLTSA

SEQ ID NO: 22885 - protein, 178 aa, A.fumigatus
PGTPPRPRCCIEQLTFPDQALLQLTCGKSLFHICMYEMDALVTFGAVFTSTGSFSLSSLLTIIYSLFLKPYLAPLTVNITLISQSTDFAPTAAEIDAFLREQFGEESNKWRCTLTVKLNRYNGPARNAFHVSQVQYTIDCTRVEVDAYGRVSRQPSSTLVLPMRAHYGSLLSDHFAGN

SEQ ID NO: 22886 - protein, 83 aa, A.fumigatus
KPSIFKCSILTVRLYNTQFAHLFFVSTESDPSSGCHKSYRIETGSCIYSYRFDDTEFMHPKLASPGHLNRIGILIPHVVHSHR

SEQ ID NO: 22887 - protein, 85 aa, A.fumigatus
SGRTLTDIHDTTSFEYTNNIHFRKSIGTLAECHSNIILQRASSFLSDGIFSVSANSNKISTSRLWWFWMALTFPLTVIAMAAWWA

SEQ ID NO: 22888 - protein, 94 aa, A.fumigatus
  UNSURE (53),(69): Identity of amino acid sequences at the above locations are unknown.
TFLARNYGGDIPMSAVEKFPILFSEAEEERSPVLPCFSHEGINVCETHAKPAXHGLRSFRRSPQRTSSXIRTSYFGSRAHRECRIWLCYFSVIV

SEQ ID NO: 22889 - protein, 158 aa, A.fumigatus
LCAVPHPRYITQESHKLEIQARPPIAVTNAVSWRSEGIRYRKNEVFLDVVESLNLLVSASGNVLRSEILGAIKMKCYLSGMPELRLGLNDKVMFETTGRATRGKAVEMEDVKFHQCVRLSRFENDRTINFIPPDGEFELMSYRLNTHVKPLIWVKCLV

SEQ ID NO: 22890 - protein, 77 aa, A.fumigatus
  UNSURE (9): Identity of amino acid sequences at the above locations are unknown.
YLYIRHSNXYILALTKRNTNATEILLFLHKIVEVFTEYFKVLEEESIRDNFVIIYELLDEMMDFGYPQTTESKILQE

SEQ ID NO: 22891 - protein, 61 aa, A.fumigatus
LRAKKVYSSLVILRVLDLWKNNDTKAHWSPWPFKVKKNTGDALVEGKENGGNRRKCSGNPL

SEQ ID NO: 22892 - protein, 242 aa, A.fumigatus
HAHPPDRLKLIVQQTGAKFVISEPVVMDSLILDGTANILSLTDCGGSINEPGLTPCQLPSVKPTDIAFIMFTSGSTGTPKGVLIQHESICTSIQYNGEAEMVTSSTRGLQFSSYAFDTSVDEIFTVLSRGGCVCVPTEAERMNHLAAFISRFDVNWLSITPTVARLIAPGEVPSVRTIVLGGEEIDPGVVNHWKGSCRIGCILRPGGGIHCLRCVARDECRWRCPAWPTCGLVFVGSRSLRP

SEQ ID NO: 22893 - protein, 255 aa, A.fumigatus
IIGKDHAELVASYGPAEASIACAASPVTSVVGDALLGRPVASSLWVVDPSDHDALMPIGTAGELVIGGPLVARGYLNDPDRTSLAFVCPKWSTELNLPFNRFYRTGDMARWNVDGTLSYVGRLDTQVKLNGQRVELGEVERHLLAQPCLQCSTCAVPQSGLLANRLVGVIGLQTPQISAADEFHCLEISQARTLVPYASDAEESLRAKLPPYMVPTVWIGVQSLPLNASGKLDRRKVNKWLEVFTTGLEGSTDAL

SEQ ID NO: 22894 - protein, 114 aa, A.fumigatus
PSVQVDNFGFGAEKRRMLELKVLNGTLAFRYVIALGRNSKIYNNSGPKNDPARDAFQAMLDSVRLPFNECLRIVQENIQLDPSFVNFYLWAKEKSIPIVILSSGMTPVIEALLV

SEQ ID NO: 22895 - protein, 72 aa, A.fumigatus
NMPQSSSQMEGRHQYLNGNPKAIFFTDFDGTVTLQDCKQYILALFTSSYFAKPLLRSLSGNDYLVITSHTDC

SEQ ID NO: 22896 - protein, 170 aa, A.fumigatus
GRLVKNRRVRPLLDPPSLRSPPPLRRQRLRPLLPSPHRRRPRVLPRPHRLPRARQQPPRRRLAIRRLGDHLGRHRDPSRQRRPHIGPPVKQTHLLQPPLRLRPQPSRAAPPRCRPTRPRSRVYRARGSCPRIRAHALLRRALLHGFHGGDRRRGRLLAALPGIRCVSWCG

SEQ ID NO: 22897 - protein, 165 aa, A.fumigatus
KIAGFALYWILQVCDHHRHFGDSAYARSFLPRIDGVLEFFHAHIDSLGLVSNLPDDVWQYVDWVTTWGATETHPDKGVPTSGRQSNRHTFFSLLYAYVLNQAAQLLHDVGRPGHAAEYTARAEAVLASVRTHCYDGRFFTDSTAAIAGEGAYSQHCQVFAVLAGA

SEQ ID NO: 22898 - protein, 203 aa, A.fumigatus
VLDNVRRMKQVEFEMDSQSVMRHCCKLLTLDSVQEGPEGRNFYILPKLLKMGVRPDRDMMNVVLSNAFKTGDEQLGLDMLEYMKNNGLEPDSYTHLILLNDAVARGNRDRVSSLIREIESNEELLKNPWISSKIFHAHFVFTAKHINPDDDPDAVFYSMLEMYNKLHDITPLKELSILPPEYTPPPGGDNTPPTTIALFFFTS

SEQ ID NO: 22899 - protein, 64 aa, A.fumigatus
AAAMINYNWAQNPALLAEPINKGIAALMTAIVWVSAAWYLKKGVKTNGVAVAAMGALHAWAAFR

SEQ ID NO: 22900 - protein, 158 aa, A.fumigatus
FLGDGVTDDTAAINAAMSDGGRFSPASRDSSTTTPAIVYFPAGTYIISSSIIDYYFTQIIGNPNSLPVIKATPGFTGLGLIDGDQYQGDGNQGWISTNVFFRQIRNLILDLTAIPPGTAATGIHWPTGQATSIQNVQIKMSSGAGTQHQGLFIENGKP

SEQ ID NO: 22901 - protein, 163 aa, A.fumigatus
RFSGSYRVVEDTVKETQLMLSYSPPVAPALRSLSIIFPRGSFTDFVRGSNPNSELTHQKHSVLSGLSTYLEKHLAMKLNLGDLDSGHHPVNQPVRLTKIACGSFVLAGDGKMKLVAPSGQAGSSSEDGATAARESRDRLLSRANEALLQAVIRRAAMTGDEQT

SEQ ID NO: 22902 - protein, 182 aa, A.fumigatus
TMSQMRSSPYSTHANKEKQKAPLRKKACQNCTKSKVRCGLEKPICSRCRSKGHSCQYPPGRVAAPQIGVTGTANDIGEDYTALLGIQGYVDSAIVPAPASLIPESGRAAASRSPRPRAVTSGQTRRLDLDFTDIDLTPSLNAVDIRDRWLRPYLLPPLGRDEILKAYHLFTLQVLTTECRSP

SEQ ID NO: 22903 - protein, 165 aa, A.fumigatus
  UNSURE (156): Identity of amino acid sequences at the above locations are unknown.
LMQSLKATTVQGIERLIKTAIVDKTPSVSSAALVSSYHLLPIARDVVRRWQSETQEAASASKSSTGFLGFGGSSSSHAISQSNFMTQYHAIGLLFQMRSHDKMALVKMVLQYGAAGVVMSPAALVLLVRLTTNLAEEDPGLTKPMMQMLDGWLRHXHEMVNFDAA

SEQ ID NO: 22904 - protein, 101 aa, A.fumigatus
YVRIWLSVVKTSNVPTNEATTLFFGISKLFQNKDPSLRQMVYLILKELANTAEDVIMSTSIIMKDTAVGSDILYRANAIRALCRIIDVSILRYTTFLKLSS

SEQ ID NO: 22905 - protein, 112 aa, A.fumigatus
QANFSPAKIGITEYAAKSLGDVVFVELPDADLEVSAGEAVGAVESVKSASDVLSPVSGKVVQGNSVLEDNAKFINQSPEGDAWIAKIEVSDVAELDGLLDEAAYKASIDADH

SEQ ID NO: 22906 - protein, 74 aa, A.fumigatus
FFRKFILRTFDQSIHYWQSDVEHFNSISDSHISFGLDISSRDQTIFMSDAVLFYSRNEIEYLRLIPEYLTAKAI

SEQ ID NO: 22907 - protein, 94 aa, A.fumigatus
LYTIPIMVYNYPGVAAGLDVDSDMLVKLSAHPNISGAKLTCGGIGKVPRVTASAVRPFSVLGGQIDWMGPAMAVGAVGAITGMANLYPRVSIFF

SEQ ID NO: 22908 - protein, 82 aa, A.fumigatus
  UNSURE (13),(14),(17): Identity of amino acid sequences at the above locations are unknown.
SLNRKGKLEDIVXXVSXPDTSPGLDGCTSTYGILSLSISFLQQLNQLNGGLVYSGVQNCKTSPSQGFKVRNTLAENTSEGSL

SEQ ID NO: 22909 - protein, 136 aa, A.fumigatus
  UNSURE (6),(19),(48),(113): Identity of amino acid sequences at the above locations are unknown.
SVAVQXLPRRLTCRRRIPXLRTAVNTPNLSRSAFGRNLSVLLADQAKXAVRRRIAGVLTANVDLSEALNEASGKGKITGLTNSDVFLFPSWYEVQSSNTPPEFFWALKVPLKXHMPLESPHIEIPPEALKKWGPGL

SEQ ID NO: 22910 - protein, 210 aa, A.fumigatus
  UNSURE (174),(186): Identity of amino acid sequences at the above locations are unknown.
YEEREPWIVRKMKCGYPRFFIHPVIQDLATEVVKLHGNPKTETASLFPSLKTASVCRSFILSRISSQESPRIRIVNFVPAPHTESRPQTIRSPLSCVIYPTEYASIAKQVWQHSGNGISSRRGEFCLSALRDGFLVEDKEPAQVDQSSQKFSKGPRRYQGRGSANEIVRGGSVXASTPDLSAENTXTQDSCEYAQFIEERFRPELERFTG

SEQ ID NO: 22911 - protein, 113 aa, A.fumigatus
  UNSURE (32): Identity of amino acid sequences at the above locations are unknown.
VMFGALNRFIGRLDAEPVQHPRTPSGDNAFGXQVLRNKDPELPLEPWFDFIVGINGHSIVRALTFAIVTELTGRLQEDPDPNLFATEVRNCAGTSVTFEIWSAKVRMDWTCHQ

SEQ ID NO: 22912 - protein, 261 aa, A.fumigatus
  UNSURE (193),(201),(248),(251): Identity of amino acid sequences at the above locations are unknown.
RTQGQKTHSVSIPVPASNPTLGLALQLAPLSSTQHIWHVLSIPSPLSPAYRAGLLPHSDYIIGTPSGTLRGDAALGELVEDHLNRTLVLWVYNSEFDVVREVELVPTRGWGGEGALGAELGYGALHRLPVGLGEEVEGPGEVVFETREDGTSAPMAHATDAGQTADTGAGSFLVPANMVSPPPLSAPNRALSXASPSNNRXPATPRGGRTRHMGVSPNLAFEEYFGPGEQKSKGAGLYPVPGKGTPLXSAXQAPNRVGFCW

SEQ ID NO: 22913 - protein, 61 aa, A.fumigatus
PSSAPSAPSPPQPRVGTSSTSLTTSNSLLYTQSTKVRFRWSSTNSPSAASPRNVPLGVPIM

SEQ ID NO: 22914 - protein, 60 aa, A.fumigatus
RAVGINYITFSCFTIRTKHYPTSEEFRFPSSNGHHQYIMSSIIQTAVTLKSHSAEAQFEC

SEQ ID NO: 22915 - protein, 97 aa, A.fumigatus
LTLSAMSQIELFGDNEHFTTLLADGVCIATPTGSTAYNLAAGGSLCHPENPVILVTAICAHTLSFRPIILPDTIVLRMGVPYDARTSSWASFDGRER

SEQ ID NO: 22916 - protein, 140 aa, A.fumigatus
AGYRLCSAPVKILYTSWLFQHVVPPVLSFSLGSLGFLTRFDFNQYQSTLETAFKDGVVVSLRLRFECTIMRSNRRSEDDATNITKRDLVEELIGEEMEGTLTHRPDKVFQILNDVVLDRGPNPSKSIPEALGLAWKWAPD

SEQ ID NO: 22917 - protein, 189 aa, A.fumigatus
FRITCQRVDQLMVNPGDGSAENATEVCFAFVEWVNRLEQWEQMVEREEGGTYEKSSEGEQAAQLIDPGITGHTLWFPSVTIANVLTHLWAIHIVCLKEIDKLRATFSSNVEPCIPAKFCSVEYQQTQVLTLSKRICHSMEYLLQDELKLFGPASTAFPLKVAHDSFRECGTTQEGYIKFVNSRLRPLDS

SEQ ID NO: 22918 - protein, 187 aa, A.fumigatus
  UNSURE (5): Identity of amino acid sequences at the above locations are unknown.
KTACXQPPFSPTEAPKAIEPRKGEFSEKNNRISIQSVSASSSSGQDPASSSGCLAGGGCCCTAAVEDEDEITEHKCTCSGNAPASESSKPIPTAAAETEETRQLKASAQPEPAQSHHLNLLSGRPQPRIIIRKVLEKAEGESAVVVCGPEGLSDDVRRSVVYLSDERAVHKGTGAQGIYLHVEAFGW

SEQ ID NO: 22919 - protein, 198 aa, A.fumigatus
  UNSURE (1): Identity of amino acid sequences at the above locations are unknown.
XPDRLERSAAIKCPTVLNQLAGSKIIQQVLAETAGPDHLASFMADTDPATIARLRETFAPQYDLSSSGRGRELALNPETAVNHVLKPQREGGGNNVYKSAIPDFLRSIPESEWKRWILMELIRPPAEAKNVALRSDGEVLSGKVIGELGIYGTILWDQSNGNVLQNEQGGWLMRTKAKDVNEGGVATGFSSIDSILLY

SEQ ID NO: 22920 - protein, 72 aa, A.fumigatus
YSSINQSIIALDPQTTPPILAIAVREGDSPFSSNNKTSICIIIELLRPCTSFRDEDDHESTPRGWKDTRGVY

SEQ ID NO: 22921 - protein, 131 aa, A.fumigatus
QVEPILQCCRNWRAVHTAAGLAELMNNQQAHKTEQKQGDIEEGLKNDSHAKERETHGIETPSDSSSTDDDKLQRDLTESKAYRNRRKVALVQGLNRPFFHIDLTSALQSALANSAPDLHVDPAEVNATTDA

SEQ ID NO: 22922 - protein, 270 aa, A.fumigatus
  UNSURE (174),(178),(181),(183),(186): Identity of amino acid sequences at the above locations are unknown.
YLSVPLHYLEHTKLTKSRMWIELGQVFDRLSQDPSVRAIVLSGAGEKAFTAGLDVTAASQGLLSADGDQAVDPARKAAHLRRHIVSFQDCITAVERCEKPVIVAMHGFSLGLAVDLSTAADVRVCTRDTKFAVKEVDIGLAADIGTLSRLPKVVGSFGWAKEVALTARIFGAGXALPXGSXTXVFXIFAAVFVRRPVLCFPWLVPLSLSFRPFFSRFSSFPPPLLPPVLFVPPLPVVSPLLPSCFPLVFSSLRFVLPPRLFPLSCPVSFL

SEQ ID NO: 22923 - protein, 62 aa, A.fumigatus
  UNSURE (25): Identity of amino acid sequences at the above locations are unknown.
ALINRTEKLQTSLVEARQNHNTMAXNNYNSFKYFIIRFPAEHQYVAHVEINRPDKMNAFFEA

SEQ ID NO: 22924 - protein, 217 aa, A.fumigatus
  UNSURE (85),(88),(90),(93),(97): Identity of amino acid sequences at the above locations are unknown.
QERNRAGKREKTGREDKPKGREHEREARRKKGRNNRKRGDEENRRKKRRRKGGETGKKRAEGKGEGDKPGEAKNGATDKDGGENXKHXSXRPXGERXSRPKYPRRQCHFLRPPKAPDNLRQPAQRPNIRRKPDIHLLDGELGVPRADAHIRRRGQINRQTKREAVHRDDDGLLAALDGRNAVLEGDDVTAQMGRFARRIDCLVAVCGQETLRCGGDV

SEQ ID NO: 22925 - protein, 187 aa, A.fumigatus
  UNSURE (85),(88),(89),(92),(96): Identity of amino acid sequences at the above locations are unknown.
RKETGQESGKRRGGRTNRREENTRGKQEGRRGETTGRGGTKRTGGRRGGGKEEKREKKGRKERERGTSQGKQRTGRRTKTAAKMXNTXXTDXRGSXSPAPNILAVSATSFAHPKLPTTLGNRLNVPISAASPISTSLTANLVSRVQTRTSAAVDRSTARPSEKPCIATMTGFSQRSTAVMQSWKETM

SEQ ID NO: 22926 - protein, 214 aa, A.fumigatus
FPNFAVFFSSFAHFGTMRPFRLVLLVWPPLYMLVPYLVLLPSILQTAAVYVTFISKITLHVIAFPSTAILLANAAPSSKVLGSINGAAASTASLSRALGPTITGLLHSKGLESGYSIIAWWACGLVCVTGTIQSFWMEESEPRRDSEKAGNSDSTAGIPMRSSFPAGKEYATPEEERRLLSSTRTSVDDLDISNLDLTQIEPAPRSNPLAFAED

SEQ ID NO: 22927 - protein, 216 aa, A.fumigatus
KGTAPPLEGFAISINGWNRCKIWGPKSQSLWPIMYSSATNGRSHELVDQFPSPWSYSGQQLSVIGRSSLAALPLAPKLPIPRSGSTPTSRQRTPRACELCRERKTKCDGAKPICKQCRLLKTACTYSGSKRERQQLAIECARAKVKVYESVLRQIYEESRENGRTSIEEIFHVSLSTCPYRALSYYPVSGRAKVVTETLSRFTRIILFAPRLEVAV

SEQ ID NO: 22928 - protein, 201 aa, A.fumigatus
VVTTFEAMAVIFTAIFFDAEPVKSFELRHKAREAANKLGRLVELNVKAIKSSGLIATLLGNMPANRNALFEYGVHMVERLLQSGLDPEQVTWSQVLPTAVAMVPNQAQVFTQIIDYYLSDKGRKHLPDIKRFAKEDSPASDEVLLRYCMEAIRLNGIFGSYRKSQTNLTLDDKRGKVHIKAGDNVFVSFVCLLCRIAIVRC

SEQ ID NO: 22929 - protein, 162 aa, A.fumigatus
  UNSURE (93): Identity of amino acid sequences at the above locations are unknown.
NVPRFSATLNGAAVLLRISSTVTPSAVSARVRPSVGLTSKTARSVMIFQTQRGPVRGKVHSGKILGLPFLSVCSMVTTTLVFSGLATRSMAPXTPLTLPGSIKFARSPYRVTCRAPSMVRSNRPARIIPKLSWEPKTEAPELRMTVSLPDLIRSGSSSPGLG

SEQ ID NO: 22930 - protein, 63 aa, A.fumigatus
  UNSURE (11): Identity of amino acid sequences at the above locations are unknown.
TLSRSWRLGLXTRRYVDKVIQSTEKIMIEKLTFAKDPSEMLQAGMQASIILILYLRANCSRIW

SEQ ID NO: 22931 - protein, 111 aa, A.fumigatus
GYRSPRTHRQARRQRTPGLHVRQPRCRYPPDQPRLPPRRRQNCPSGRQWDPRSGSLTQARRGGSRPDQVGQGNRHPELRRLRLRLPRKFRYDPRWPIRSHHARCPARYPIR

SEQ ID NO: 22932 - protein, 68 aa, A.fumigatus
YYISVLTAPGSGEATARREHIVKRAANELQDCMFVNLGVGIPLINPAYLPEGVKIVLQADNGILGLGP

SEQ ID NO: 22933 - protein, 162 aa, A.fumigatus
  UNSURE (70): Identity of amino acid sequences at the above locations are unknown.
PKPGEEDPDLIKSGKETVILSSGASVFGSHESFGMIRAGRFDLTMLGALHVTRYGDLANFMLPGKVKGVXGAMDLVANPEKTKVVVTMEHTDKKGNPKILPECTFPLTGPRCVWKIITDLAVFDVSPTEGLTLAETAEGVTVDEIRSKTAAPFKVAENLGTF

SEQ ID NO: 22934 - protein, 61 aa, A.fumigatus
IRLTQGPIMLWSNVPHYFKVIWLPHAIHVMPITEYYVIFIQTFLFYLVYSQNVFLGLKTES

SEQ ID NO: 22935 - protein, 98 aa, A.fumigatus
RYGPLLDSTSLDKHTTLSFSYESYLPHIIFCEHDFLHTSLDMSQPTTDLIIQLQLQHADHYFEASKGNRATPRTKSYSSVNRRNCKVFISHLWIDEWP

SEQ ID NO: 22936 - protein, 232 aa, A.fumigatus
EHIMADKDASSTPNTNTIYAQSHRNQTYSITNNPPSEEHPRRALKPGVYIPLLAFFAPETEELDESTVAQHAIRMAKAGAMGLITQGTYGEAAHLSHTERARINRTTRHAVAAAGYPQLPLIAGCGAPSTSETIELCHDAFESGADYALVLPPSTYKAQYTLPSLKAYFEDVAGASPIPVLVYNYPAVMGVDLDAETLVSLAEQPNLVGCKLTCNDIGKLSSTPSGRRNEHG

SEQ ID NO: 22937 - protein, 276 aa, A.fumigatus
FGIRATLNVFWRFVWDILQDNANLQMGIIELREMFESSNQEVQNLRDQILSHQPLTSTGEIDEREPRPSSITLNNELESKESRRVSQEFHIHHHYHTPAISVGSKKEKSTIFRRSKKRRSLGATTVMHSASTSQASRKFSHQHQSSISSTSTILSQTSVSIPPAAASRRWSLQSPAADSSLASSPQSGYRASSIFDRVERGCESSQPTSPESTAVSSPVMASRHKNVPFDVPFRPLDGLERTERVGDDSMHLAYDDSGDHPNNVPHEGQGSAQSYG

SEQ ID NO: 22938 - protein, 108 aa, A.fumigatus
MELLRRRANPDVEDSYGFALTQAIRGGNVELAMELLRRGANPNAEDSYGFALTQAIRGGNVELAVELLRRGANPNVEDSYGSAITQARGSGSKRLEEAFLGCFSDFCG

SEQ ID NO: 22939 - protein, 251 aa, A.fumigatus
  UNSURE (28): Identity of amino acid sequences at the above locations are unknown.
FGTLRFRTFVASSPMENYTIPLEKAVDXMPVSSQLVRLFSPVVFPCSGTRSFPIQYTELRPQDTFTNAQALWSFVGGYGVYGGSTVAHCLVAAQKTIPSDYVAHSLYCSFVPPANPKQRIEYRVERTRDGKSFLTRTVHATQKAKVISASIVNFVRAGTYSKSSDTDRAGRLEHGPKRPEGLTVPDEAEMDGKGIDGPFEMRWGEVVYRGSFPGSSRAWGLLALWTCLDLRWINRKVRRLGPHSDPILDAS

SEQ ID NO: 22940 - protein, 80 aa, A.fumigatus
TERSDDLVHTRIRYWMRAKEPMQQTDPQVQLAALSYMSDAYFIGAAVQVYDVPGQTFGTKMAMAASLNHAIYFHHPDAGF

SEQ ID NO: 22941 - protein, 139 aa, A.fumigatus
NTVGSFQPRGEDPLHVQLTLSHFAMSSADLGVDESFAQKMVRTTMDVDCPPWLDFLHGGLNFQVVHHLFPRLPRHNLRRAQPYVKEFCRDVGIPYVIFGFTRGNKEVISRLGEVADQLRVLEECRKVAAKDLIGGRHGR

SEQ ID NO: 22942 - protein, 88 aa, A.fumigatus
HLSRSRANLTILGSFTGLFCTVGFLNSFGAFGEYYAKNQLANKSESTIAWLGALSIFFVLSVSVVSGPILDAFGPRVRPPYILEMLCS

SEQ ID NO: 22943 - protein, 194 aa, A.fumigatus
LWSSSDCRHGHGVRRYVFPTPLQAPRLTTPGPLMVAKSVQQYIQAGVAGFHIEDQIQNKRCGHLAGKKVVSMDEYLTRIRAAKQTKDRLRSDIVLIARTDALQQHGYDECIRRLKAARDLGADVGLLEGFTSKEMARQAVQDLAPWPLLLNMVENGAGPVITTKEAKEMGFRIMIFSFASLAPAYLGIKSALER

SEQ ID NO: 22944 - protein, 109 aa, A.fumigatus
GTTDTISNGKMFYGILGDSNGDSPQVTGEASWLMARTCFPNEGLNGNNGHTGVDVTCMFFSAIALPALMQADIVFTGKNAVLPSSALTKNYITNLSSPRGWKDPTVCED

SEQ ID NO: 22945 - protein, 164 aa, A.fumigatus
PTYSPVLSSSPTLSSVSSSIWSCVVWEKWPLGCPCPPASLAMPSVSVTLLLDSPLVGRMSIYHGLPSRLRRVADTFGHYRYWFKYIIVTPNQLTAGALVISFWIDASRVNAGVWITVFLVLIISINYFGIRFFGEFEFWLSSFKVIVIVGLILLSFILMLGGGP

SEQ ID NO: 22946 - protein, 75 aa, A.fumigatus
QLTNLQPGSILISYSFVGFIVYLVMCGLGEMATWLPMPSGFTGYAVRFCDPALGFAIGWTYVNLSWFTVKTASRR

SEQ ID NO: 22947 - protein, 131 aa, A.fumigatus
TSIIMAEVAENGPVPVNNENTAPGAATEEKEQTEKTEQTNGDAVTVFHDPENFNVKHPLMHEWTLWFTKPPSGKVRAIAIDIRVDSLTLFDLQGDNWNDLLKEVVTFNSVEEFWGIYVRHFIYRCLSGELY

SEQ ID NO: 22948 - protein, 133 aa, A.fumigatus
NNITPTSELGLKADYHLFKKGIRPEWEDPQNKHGGKWSYSFKDKRSVPIDDLWLHAQLAAIGETLENDGDNEVMGVVVNVRKGFYRVGLWTRTVGKSIPGDKNGRTPAQGKEILENIGRRFKEVLRLKETDVV

SEQ ID NO: 22949 - protein, 169 aa, A.fumigatus
DAGVSTVLGLCVFILSILSLYWAVQFRSEDRLHTLTVWVVDFDNQVDPYRNESITPIVGPAVTDVANRLIKSEREHVGYEIRSPADFNFDPWAVRQGVYDEHAYAAIIVNPNATTLLYEAVTNGHSSYDPTGAAQFIIISARDQATYSNYIEPALSWFQLEVFAEFGPR

SEQ ID NO: 22950 - protein, 98 aa, A.fumigatus
PCLQKSRKAMADSSDYPDFRFVKLAIGVPDMTKAMEYIRSHNVRILKEAGVTQGSEVVATFLGCDMPDKGFDRPLWEAAVAVPFVEDPDGYLIEIIPY

SEQ ID NO: 22951 - protein, 94 aa, A.fumigatus
  UNSURE (2),(4),(5),(8),(11),(19),(49),(51),(60),(66),(75),(88): Identity of amino acid sequences at the above locations are unknown.
EXNXXERXEYXRIPERKKXEKEKLSAVSEYPLRFEWASWELGNLPKNAXNXLPQKGPNSXNGKAVXPPQFIGNIXIGKPTTFFWPALXELRKIY

SEQ ID NO: 22952 - protein, 133 aa, A.fumigatus
  UNSURE (11),(44): Identity of amino acid sequences at the above locations are unknown.
ADTNPNNSRRXTKQCQINGKWVSWTHTAVAYTAFLSALVVGMSXHFHKIVQNEHYGYPDEWFPSVSATIGDRYPERSFFQVFIAITSGPRFALVFLWYLLTARPQLDSSQDRCWCWAVPDFYVWWLDICHVDR

SEQ ID NO: 22953 - protein, 204 aa, A.fumigatus
  UNSURE (4): Identity of amino acid sequences at the above locations are unknown.
WECXYISTRSCRTNTMDTRMNGSLLCQLQLVIGIRNGHSFKSSSPLPQVLDSLSFSFGIFLLHGPNSTLPKIVAGVGLFRTFMCGGWTYVTSTDDHDWHDIFMISYLVATLPWTLGCLALSPNNRRAVKYRKIMAGLFFGTLVPLIYYFIQHKVHKVAGGEFTLFLYLAYRSLTTLRSLYEICLLRVVSYLVRRGIRCGHGIGL

SEQ ID NO: 22954 - protein, 165 aa, A.fumigatus
RKEKGPYQVVGAVDLGVGIHDGGAVIGAHLGCADEVVAAGHFGEDVGRRAGPLDGVRGLLEVVEELLQERSKGLLVLGGLQQGVGFDGSGAGGVDAQHAGGCGAVGEVQFHGDDAVAAGAAGGLEEAGDAVGGDVRGPELKAMAALGEDAGTAGVQALREGIGGG

SEQ ID NO: 22955 - protein, 179 aa, A.fumigatus
PATNPFAQRLYASGSGILTQGGHRLQFWTSNVASDGVTRFFQASCSPGGDGIITMKLYLTHGATSSGVLGINAAGSTTIESDPLLQTPEDKEALTSFLQELLDDLKKASYTVQGSSSPADILAKVTSGDHFVGTAKMGPDDGTSVVDTNTKVYGTDNLVRSLLFSLHPLHLAKSSTAVY

SEQ ID NO: 22956 - protein, 92 aa, A.fumigatus
YIVDASIHPDLPTGNTQAIVMIAAEAAVARILAQGSGPSSSSSIAVSAPSQNTAIAAVSSTPSATAVPVPVPIPTGGQETPGGDSRCSAYRN

SEQ ID NO: 22957 - protein, 62 aa, A.fumigatus
RYRPLSSFFIKSTSTATRLDDSLIYPFLSILLKYLYRASSFSYNIVNKGLYSSNFLLSSYIL

SEQ ID NO: 22958 - protein, 163 aa, A.fumigatus
TQPIAAVLTRAKIRVEHRLDNFKILSGEGEGDIRLACAPFVKSRLLLPFPYHISVMSHPQYTYGGPPQPPYNSAGYGQPGAHQQQPAPFYPPQQPGGYPPQGAPPQQFPPSGQYQQPYGAPPPQQQWPGQPPQHIPQVGNPPPQHLSASRELTPKINTLHRGQ

SEQ ID NO: 22959 - protein, 68 aa, A.fumigatus
  UNSURE (68): Identity of amino acid sequences at the above locations are unknown.
SYSAEAVVRRRCRDTQERWENFFIGVPDWVYEEEVISGTAVTWWSNDAKYIAFFRTNETSVPEFPVQX

SEQ ID NO: 22960 - protein, 248 aa, A.fumigatus
YISRPFGKKLLPGLENYPDVREIKYPKPGAPNPVVDLQFYDVEKNEVFSVQVADDFADDDRIIIEVLWASEGKILVRSTNRESDILKVYLIDTQSRTGKLVRSEDVAGLDGGWVEPSQSTRFVPADPNNGRPHDGYIDTVPYNGYDHLAYFSPLDNPNALMLTSGEWEVVDAPAAVNLQRGLVYFVGTKEAPTQRHVYRVQLDGSNLNPLTDTSKPGYYDVSFSHGTGYALLTYKGPSIPWQAIINTH

SEQ ID NO: 22961 - protein, 175 aa, A.fumigatus
TLRGSASRVKTAVESSMTALSKSPNKHNRLYVTAQPLGEEVSLAIESGKINPRDDFKARARLLADDYGWDVTDARKIWCFGPDTTGANLLVDQTKAVQYLNEIKDSFVSGFQWATREGPIAEEPMRSIRFNILDVTLHADAIHRGGGQIIPTARRVLYAATLLAEPSLLEPIFNV

SEQ ID NO: 22962 - protein, 96 aa, A.fumigatus
IQVPEQAMGGIYGVLTRRRGHVYSEEQRPGTPLFNVKAYLPVNESFGFNGDLRQATGGQAFPQSVFDRWVYAPGVGSALGAAGGGRGWGAGGEDCV

SEQ ID NO: 22963 - protein, 288 aa, A.fumigatus
VSPGNHDSVGDPLALHAIFTTRSPPPPPPRGSQRRTHPGSIDPAVEDGLREGLTTGGLAEIAVETEGLVDRQVSLDVEQRSTRTLLLAVDVTTTAGKDTVDTTHGLLGNLDLDVEDGLQETGLGEQGSGVQDTTSSGDDLTTTTVDGISVQSHIKDVEADRAHRLLSNGTLTGGPLETRDERVLDFVEVLDGLGLVNQQVGTGGVGTEAPNLTGIGNIPAVVISEETGTGLEVVTGVDLAGLDGEGDLLAEGLSSDVETVVLVGRLGQGGHAGLHRGLHTRCRSAQSL

SEQ ID NO: 22964 - protein, 169 aa, A.fumigatus
NSNASQSDKFYIRAPVEYPVYLGAQYDASTTNLTYRIDSHSTVSSAAGPVALTVSFLSPITPTSTLRQSIPASYITVYVHGDVPVNVYMDLNGRWVSGDAGSQIVWQHDTFGSKGKKPTLQKWQFRRQNELLLSEIRDRAEWGTLHFTGPAVSNLFIPLVIDRSINWLY

SEQ ID NO: 22965 - protein, 91 aa, A.fumigatus
HPMLREIHQYDEPHIHILDSRVDWDSYAPHLEYTHEYAPSHKRMQRFDSAPQSTLSGQSQSGNGLSGSQIGGIVRGLLRRPVLSRLILLVP

SEQ ID NO: 22966 - protein, 112 aa, A.fumigatus
AGLAPGGEEAPGRCPQSASRIGRSRTVIAPIEWTGGLSRIAACACVRGRTRGCTRDGERSCPSRRASRGCGCAVRHIGVFHAALDVIRPRTGPGVLEMFLSADNGGLLFVCV

SEQ ID NO: 22967 - protein, 107 aa, A.fumigatus
QSITENKAKDVQFSGASTPLQTLNTNQASRPDSKSKSESANPPPHSSTTLDEMTSTPKRLYREHLETLQTSLASPPTGGPAGNYHTFEFLRVTQNEKGPTLAWEEHQ

SEQ ID NO: 22968 - protein, 107 aa, A.fumigatus
SALQTYGYCASIISSTIGQPGWYSYFKLPAEGEPGYASITTPAISTANGVFSAGGAVGTLFIMWSCDYFGRKVNIQFGAFFSLFGGALQAGANSLEYVLIRIFLVKA

SEQ ID NO: 22969 - protein, 69 aa, A.fumigatus
DTHIEKMTIDDYLSVLRPKYFGTWNLHRHLPADLDFFVMLSSISGIIGNATQAAYAAGSTLPRHIRHVS

SEQ ID NO: 22970 - protein, 121 aa, A.fumigatus
VMTPKPQAALLRADASYILVGGLGGLGRATALWMADNGARTLIFVNRSGLSSQAAQETARDLKQKGVRVIIHACDISDSKKVKKMVIELERNAPPIRGVIQAAMVLRVRSFNRRRLHPCGS

SEQ ID NO: 22971 - protein, 224 aa, A.fumigatus
EDIADIIKTSYPNKSGIIYCLSRKTCETVAEALTSQHNIRAEYYHAGMDSSKRAEVQEWWQSGRVHVIVATIAFGMGIDKPDVRFVIHHSIPKSLEGYYQETGRAGRDGKRSGCYLYYSYRDATSIMSMIDKGEGGKQQKNRQRQMLRNVMQYCLNLADCRRVQILAYFNEYFRPIDCNKSCDNCRSDGIFEHRDFSQQAASVLKIVRYCLHHGAGWIPQRVYE

SEQ ID NO: 22972 - protein, 177 aa, A.fumigatus
LVVKRQCPNVLLQMNLNLLSTTTLQRIRHLKSFIKRCHGCFFTTKDMTKQFCPRCGKDTLTRVSCTTDANGQFKMHLKKNMQWNNRGNRYSIPKPTHGSASGKWKGGGGKDGWGIELILAEDQKEYIRASVEESRRLRKERDLMDEDYLPGILTGERTKHGGRPKVGAGRNVNARRR

SEQ ID NO: 22973 - protein, 159 aa, A.fumigatus
TNPAPDENTLQTLIETNDELSVALSKYQHAFLSARKATGNSGSQSPTPSNGAADTGTNRPLPVAPVPQRQGQSASPSVFSPPSPPPRQQQQQQQQSTATVAPLSATSSAAAPVGNNAARYEYRSEDFQVPNPFADDYSTTTTENQQQAGSYQRPTQHTL

SEQ ID NO: 22974 - protein, 81 aa, A.fumigatus
CICRVSHDRATVAPCTCSAPTFAPVEGSLFNNSHHNGDSVPMKYDPPPSYILLLQISASIPAVLQPSLIKLIFTYLPVNSG

SEQ ID NO: 22975 - protein, 61 aa, A.fumigatus
YMGMRGMNWGIRTFIAAWTPQGRKANQVRAVKLYLYRLRRTAEYLLPIDIGYWCCYVLCSI

SEQ ID NO: 22976 - protein, 66 aa, A.fumigatus
KFVSPSSCLACPCTTRVLYPCEGIWTRRVISTDRYQANHETTIKLKRKAKGRAYLLINNKKLKRQP

SEQ ID NO: 22977 - protein, 78 aa, A.fumigatus
TPMTTPDAFRDAEYIADVSGISYGNVANLTEQDANVVPRENERMRKLQLAAKVAFIDRLLRDLDILIYCELSALYYME

SEQ ID NO: 22978 - protein, 289 aa, A.fumigatus
  UNSURE (266),(287): Identity of amino acid sequences at the above locations are unknown.
YVSPSPLTLSLQVIDFGPFLKGTPSDKHAVAVSITNAFKTSGFLYLKNHGIPFSTVSQVFETSARFFARPQDQKDSLCWTSPQSNRGYVKTGREKLSLPEDNVDKDAARLATPDLKETMDIGRDDVEGHPNRWPDHIDDEGKEFKKVIQLFFGMCKSLHTEVMRAIALGLNLPEHYFDEFVDAGDNNLRLLHYPSVPKDVFKKSSGQVRAAKHSDYGSITLLFQDRRGRLQVRSLKGHFVDATPIANTVVVNAGDLLARWVNDIIXSTRHRVVEPQVLHVFDGDDSXYT

SEQ ID NO: 22979 - protein, 196 aa, A.fumigatus
RGSTQYININPTILQPKNQDRDMANVPHTYGNEVYANGLQNIKPAISFNPPDWETQARDLLSADSYNYIWGSAGLRKTDTDNRDAFRKWALIPSRLVCADFPSLKTTVLGHEYDYPIAVAPIGVQRIFHRDGEVAAAQAASAQRVPYILSTASSTSIEDVAAASGDRARWYQLYWAPREHDEITVSLLQRAKCAGV

SEQ ID NO: 22980 - protein, 141 aa, A.fumigatus
PVDILVSSPFLAKYSQPRRVATRLLQELAALRRQLPMVRIHDPARFQFDTPDGGKSLLDLFEGRKQLTLYHFMLGPHETQGCVGCSFCVNHIPDLRHPWSRDTSFVAWLPRPCLESLPIGIRWAGSFRSIVLQKRTNVGRS

SEQ ID NO: 22981 - protein, 69 aa, A.fumigatus
GIMVYKLVFGIPRDLTGSSISKLSCHGRLERPRIPSSLAPYLFSDAVERYIIPGTEYLIQRLPASKCVS

SEQ ID NO: 22982 - protein, 70 aa, A.fumigatus
  UNSURE (14): Identity of amino acid sequences at the above locations are unknown.
LRRAEDSGYEDEYXVEDLELTGSDYVIPTFAGSFDHVWEQTGANGEEVSETLQLNNMKNISGASRIRRLM

SEQ ID NO: 22983 - protein, 268 aa, A.fumigatus
  UNSURE (226): Identity of amino acid sequences at the above locations are unknown.
LDSMFSLSTFEHQLVMYVTSTDKETFAAAFDISTVPVVTQEQALAEERTKKLTTATPTLKAPSAGPPKGKANGVAEAATAAATQKYAEQLMQIPELKAYGTLLKSSVPVELTESETEYVVTAVKHVFKEHIVVQYDIKNTLPDTVLEDVTVVATPSEEEVLEEEFIVPAPKLAANEPGIVYVTFKKLSGEHSFPVTSFTNILKFTSKEIDPSSGEPKIADMRTSIXSRTWNLLAATMSFPRLPAALTTSGSRPARTGRKSARLCNSIT

SEQ ID NO: 22984 - protein, 134 aa, A.fumigatus
THRATIDTRVRRIIRRIKIQQQLHLKSSSFFHPSIHSSAIVVLSKRSCTANSETNWSAASYNTQIPSHTIANTSDRSNTPSARNPSSTSPPTKPNWYVPSPAKSAISTATSPASSSPSAAASILLRTRRRPAPY

SEQ ID NO: 22985 - protein, 69 aa, A.fumigatus
LAPPADPSSPVVKTSPDLVMIKRVPKFSLFRSVIGSGTTFIFPRIPSFLIKARFIKLPVAPKSIITSAD

SEQ ID NO: 22986 - protein, 70 aa, A.fumigatus
YITNTTGSKTKSITTNSRGYWKKDYQDHFIGNVITTGVYTNTSKDTRDINKYYGLLVTVIIAVSTIIINI

SEQ ID NO: 22987 - protein, 285 aa, A.fumigatus
EPWKKFPGKLNRENFSPTQGKRKHGSRRSKHRSRWPAIEAVEAQFDPKDLAEQFAIRRDPMKLHYLDDFSTIEPGVDKHVRAPVTNTDYNAELKSESDFAEDFGRFLAELPRDPTAADWVRFAETVRMTHGKEENELNPHSALVPDLLAPGESISGERKEINFFKETDPRARESEEVTDALKQLLLTTGYSQKEIQDLRTKTLVSHAVVNQTRLGKVRRQYCLSIAGNGNGLLGIGEAKSEEPADAQTQSRYRAIRNMQPILRYEDRTIFGDVEGLPHGAGKNRA

SEQ ID NO: 22988 - protein, 306 aa, A.fumigatus
RLYRKVAPWFGSSRQSVRAVNDLSMDVRKGEIVVLLGANGSGKSTTLDAISGLTTITSGSIDVDYGDSGGRFGLCPQKNVLWDKLTVKEHIKIFNRLKSTGEVDSNEQLLKLLNDCDLAQKVSSLTKTLSGGQKRKVQLAMMLTGGSSICAVDEVSSGIDPIARAKIWDILLAERGSRTILLTTHFLDEADLLADHITILSKGSLKAQGSSVELKDRLGSGYRIHVLNVPGSEKVTGLQFDSIEKEVHFDDTVYSAKDSTEASRLMSVLEEKGVTEYRVSGPTIEDVFLSVAEELDSDRLREEPYI

SEQ ID NO: 22989 - protein, 231 aa, A.fumigatus
SSSLYHFQFDSCSDTRISMPLFSSSSSSSSSANKLTQFPRAQAFENASTSVAASQMRNALNALAETVPDPEEKKRFEAEMDNFFALFRRFLNYKAKGNVVNWDRINPPAPNQVVDYNDLGAEASVEFLNKLAVVKLNGGLGTSMGCVGPKSVIEVREGMSFLDLSVRQIEHLNRTYNVNVPFVLMNSFNTDQDTQSIIKKYQGHNVDIITFNQSRYPRIIKDSLLPAPNNV

SEQ ID NO: 22990 - protein, 65 aa, A.fumigatus
FMHFFFYSTTISSLYIIAPFVNFATIIIPIDRAPFIISNLIAAAIPVSACLSFLLLLLLLLLQIS

SEQ ID NO: 22991 - protein, 126 aa, A.fumigatus
TRSTPTRTPSPSSRSTKATTSTSSPSTNPATLVSSRTLSSPLPITFDAPLHDWYPPGPGDVFELLYNSGTLEKLLDLGVDYIFPLQCRKTPAPVVESPDFCTHHGGTLVAQLHFWNLTEQQPMPNF

SEQ ID NO: 22992 - protein, 208 aa, A.fumigatus
  UNSURE (206): Identity of amino acid sequences at the above locations are unknown.
SPSPRYIPAHLQEEVLGTAARSPTPESASSAADYPSIACAGLTLHSDTMTDMSGSDKKDGSVPPTGGDVRSSSPGIKRSAPNADQDVDMDLGSTEKRSVSLTHHTDAMDITTAEGNSNGSSDNSGSDNVYPTPSSMSTFTASTATRRESKAQASISSHDLPPIDDQVAQVTCTMAQPLKEKQKGYLVSMSWLKRLHAPGLEGHAIXSH

SEQ ID NO: 22993 - protein, 104 aa, A.fumigatus
  UNSURE (66): Identity of amino acid sequences at the above locations are unknown.
CNKHGLNTKMDLLNLMQLGEFRPSVHGLGDFEPNITFVPSKPFLSDGSTYHADTIFAITPVSALVXNASRSFHNVQSSSSIVIIYLFDSHGTRSTTKFEYIGSI

SEQ ID NO: 22994 - protein, 63 aa, A.fumigatus
CNSLNPMRPPSHFEQEMQRSKASFQAYTWTAYSTISPCPSFSFLMSLLVRKITVNDIFEYLLT

SEQ ID NO: 22995 - protein, 242 aa, A.fumigatus
THSAVPSTPVVKTSVMIRNCQEGHLRAERDFLVASAKSRWVVPLIASFQDHNYLYLIMDYMVGGDFLGLLMRRNILPEHFTRWYAAEMILCIEEAHKLRWIHRDVKPDNFLISASGHMKISDFGLAFDGHWAHDQAYYNHHRYSLLEKLGIQIDGDGEDREERKSQGASKNHNELKPDRNPPSVNVLDWRDNNQRRGFARSIVGTSQYMAPEIIRGEAYDGRCDWWSVGIIIYEVHPSKIGL

SEQ ID NO: 22996 - protein, 65 aa, A.fumigatus
RQWSMRSKQLKSYLRWMYLVYYDAYTPPVTSPVVRFSSDDFWGHILAGANDATGKSAPLVIVTPV

SEQ ID NO: 22997 - protein, 198 aa, A.fumigatus
TEILEISLFHHPLDHISRLQMRTLILVFLWLTAVSSYPRGIDWDYAIAYHQQVLQGENDRGFGLNEPFIPTPSHILPEKKPFYIDETVHYYERHFNGSGENGEYRRSSCPAVNALANRGYINRSGRNITYAELAHAVRKVWNFGDDNVILPPKESLVLHSTNSFPQSMLVLAPNVRNAWLGRKTLNLDYSMQKYVLVS

SEQ ID NO: 22998 - protein, 223 aa, A.fumigatus
SQYSDATYGPSVPHIQNPFTATGTGKNYGRNDSGLDPETEAQIAQWQSAYANKEEAPGGKVAGRRDGATGMPGATVGTNTPTSATATSTPTLASHPEQNAKTVVRSGGGQTWTDPTLLEWDPAHFRLFVGNLAGEVTDDSLLKAFSRYSSVQKARVIRDKRTQKSKGYGFVSFSNGDDYFAAAREMQGKYIGSHPILLRRATTEIRPTTNPKAGKKNAGGHSG

SEQ ID NO: 22999 - protein, 91 aa, A.fumigatus
KNRSDQFDLDCTVSGHSICQVGPSGTRAARLIILTYSNSIFLMSFCTSLEGQTVMSLGAYATSAFSKHSLISTVLVVQNVVNGKCYNPARL

SEQ ID NO: 23000 - protein, 81 aa, A.fumigatus
  UNSURE (47): Identity of amino acid sequences at the above locations are unknown.
HPWCKTRSTALVNYSLHSTQFISTYGSSITAGQPSSSGLGLRGLSVXYGQRNGHRIVDDVWTDPSNENSVESYSLSILNAW

SEQ ID NO: 23001 - protein, 82 aa, A.fumigatus
LNVPEWEVASRILLYPAYNDTSPGTSTVVFSMIAECHADGIVGGATLTSDDNNVANDQLCDVIGGFIYSSTPYTKPYLTSTG

SEQ ID NO: 23002 - protein, 144 aa, A.fumigatus
PGGEFSKALPEKREFLQRADVLSVHYVLSERSRGILGAEDLAALRPDAMIVNTSRGPLIDERALLETLNAGRIRGAALDVFDPEPLPVDSPWRTTAWGVDGRSEVLLTPHMGYGEEELINGWYKEAAENLERWLDGKELHVRLN

SEQ ID NO: 23003 - protein, 141 aa, A.fumigatus
YTKIHSRFKMSTQKAVVITGPKQADLVTHPIPKLRDDYILIKTVSVALNPTDWKHIDRLVAPGVLVGCDYAGIVEEMGNDVQKPFKKGDRVCGFAHGCNAVQPEDRTFAEYIVAKGDLPIHIPDNLSFQEGPTLGFPYHHH

SEQ ID NO: 23004 - protein, 73 aa, A.fumigatus
VIVSQLQNGQLRGGGRLEYSPEYVSISGWPDLSSGISHPEVAKSSCSNQEQTSPRLARYTTYKTERPYQPSNH

SEQ ID NO: 23005 - protein, 77 aa, A.fumigatus
RDILHTRQNVLTNHQTIKSLDFHFQYSDNDSVYSLYFASDGRYSTNITGTKHWHLQHSLAISDAPLVFYHRGGSHPR

SEQ ID NO: 23006 - protein, 362 aa, A.fumigatus
RQGQYGPGVGTPRPDWALSSDDLNKIVRSSAVTGSGLGTSPNVAGTPDEEVGYIATDEYTHRMATPAPESRRSSRLVGESPLRNTDVPASEVGVEREGRKSEDAGVIHVDDPYHPLHHPDGFAPTPAPEEQSHEMGAGLEDEDEPILAADEVRPESAYQHPAVSPTFDRRPSEYDGRSHTPSVNHSRSNSRSAPHQGGMPTLVRYNSRDEREETHTPLDDVEEYEPLFPEDDKDKTSISAADRFKQRPEMLKHRFPSEDIWEDSPNSLQLHATVSTPDIPKQEAFETPEQESFRRSHAPHLDPRQVAEHILESEESKEKTQPRPEICKQRFPSRDIWEDAPESQTLVTTIEVLHRRGRKNTR

SEQ ID NO: 23007 - protein, 171 aa, A.fumigatus
FLMDMASHSGPEFDQFCTENSIIPLYMPPHSSHLLQPLDVSCFSPLKQAYGQHVQKSMVLGINHIDKDEFLTIYSSICTAALSERNIQSGFRATGLVPYDPEQVLSRLNTQMCRPTPPGTSHSSQSSWVTATPHNIRQVELQAEKVKGYMQQCMQGPSSPSSPRGWKGRAR

SEQ ID NO: 23008 - protein, 65 aa, A.fumigatus
IQSLDLQQKLKLYHGKYMSVAITSLCFLLVLSALACVTLPNYLFSTAWPRQQVTRLLRRINCGTE

SEQ ID NO: 23009 - protein, 255 aa, A.fumigatus
  UNSURE (228),(233),(234): Identity of amino acid sequences at the above locations are unknown.
RFQHSIMIGMGQKDSYVGDEAQSKRGILTLRYPIEHGVVTNWDDMEKIWHHTFYNELRVAPEEHPVLLTEAPINPKSNREKMTQIVFETFNAPAFYVSIQAVLSLYASGRTTGIVLDSGDGVTHVVPIYEGVALPHAISRVDMAGRDLTDYLMKILAERGYTFSTTAEREIVRDIKEKLCYVALDFEQEIQTASQSSSLEKSYELPDGQVITIGNERFRAPEALFQPXVLGLXXGGIHFNTFNSIMKCDVDVRKG

SEQ ID NO: 23010 - protein, 92 aa, A.fumigatus
  UNSURE (75),(80),(81): Identity of amino acid sequences at the above locations are unknown.
RSWPSVVTHSPLPLSVKLFVTSRRSFATSLSTLSRRFRLPPRAPAWRSPMNFPMVRSSPLVTSVSVLPRLSSNLXFWVWXXAVSTSTLSTPS

SEQ ID NO: 23011 - protein, 67 aa, A.fumigatus
RWVRSSGMCKAGFAGDDAPRAVFRKSTPHPIMLNIRVNPLCPISSLDVTVQIVARGMCQPLPLRPVG

SEQ ID NO: 23012 - protein, 290 aa, A.fumigatus
  UNSURE (22),(23),(28): Identity of amino acid sequences at the above locations are unknown.
SLTDVNITFHDGVESVEVDTAXXQTQNXRLEESLGSTETLVTNGDDLTIGKFIGLLQAGALGGSLNLLLKVESDVAKLLLDVTNNFTLSGSGECVTTLGQDLHQVVRQITAGHIDTGDGVGESDTLVDGDNVSDTITRVQDDTGGTTGSVEGENGLDGDVEGGSVEGLEDNLGHLLTVGLGVDGGFGQEDRVLLRSDTELVVECVMPDLLHVIPVCDNTVLDGVSEGENTTLRLCLITDIRVLLAHTNHDTVLESSATMIRASVTAQDEERGENLPMVTGATDNGGYLAS

SEQ ID NO: 23013 - protein, 156 aa, A.fumigatus
FVLRLFLDNLLYRYLTVSLASVPTAEILARAGLDDTGDDLKGDLCRCQSGGLALVIVARGDLDDIRADNVQLLNAAQNADELAGGPAARLRGACSRRGGGVQHIDVDGQVNGLFRVEANAFDDLVHDAHGAQLVDIIGVDAHGLHHGAGRITSHRG

SEQ ID NO: 23014 - protein, 163 aa, A.fumigatus
MRPLPSAPMRRDPSSPVVKTMRIHADDIDELGPMGIVDKIIERIGLDPEQPVYLSVDIDVLDPSTAPGTGTPEPGGWTTREFIRILRGIEKLNIVGADIVEVSPSYDNKGETTALAAAQVAFEIITSIVKAGAGEDLGGWYGRKADGQVSVEKIIKEETKDEL

SEQ ID NO: 23015 - protein, 405 aa, A.fumigatus
  UNSURE (83),(100): Identity of amino acid sequences at the above locations are unknown.
FQRRMKFSILPPAKGSPHLSHPSKVTLVDVEKEIAKFFAEKNGSSKEVDLEAQGGARKKRHAFISSIRYTALDIYRRLFSLVXLANLAVFIAVMTADRKXLALVNATAANVLACGLARQPLVVNAIFVIVCSIPRSAPLRLRRVAAKVYHYGGVHSGCGIASFLWYAGFVGLMSKEYWSPAAGAGNAAFSILPVVLSNIILALLLAIILVAHPAFRMKKHDWFELTHRFSAWVVVVLFVILLLVFSGEASRAANQPLGTFLLHLPAFWFLVITVLAIIHPWLLLRKVSVVGETLSPHAVRLHMNHTSTTFGKGIQLATHPLQDWHGFATFPDPDGASFSCLVSRAGDWTSARIKCPPKHLWKRGVLIYGFAYAMRVFKRIIIVTTGSGIGPCLSSPRAGSIQADI

SEQ ID NO: 23016 - protein, 192 aa, A.fumigatus
AVEKYNDASDQGSETRSPRLVGHPDAAHSSPWELDPDADDALWEMYKDIARKFEDNEDEVRPLVQPEKPEVYFDEDDEIPDEDNKGPKLSPKKRKELTKLSVAELKAMVRKPEIVEWTDTSAPEPKASSSISRLTKNVVPCACFHGFLKKRISCSSKNEGVDQTPFWPLPKIHTRKNGYLKKMPKCRLWEKT

SEQ ID NO: 23017 - protein, 62 aa, A.fumigatus
KIVLLCNHGCSPARDLPWIMWHADTWILQVPSSIVYYLSTTTLGTSQHNFFLSTTQIIDDTT

SEQ ID NO: 23018 - protein, 287 aa, A.fumigatus
TPYAVPSGPGREDARCMVRDPAFPEAATDWLILSTPDGHYLNLPVMNETGEIVGMVDVLKLTYATLEQVSQSFFRKSGLSTDPRCKINSMQSHDDEGPAWNKFWLSMDHESDSMVSGSHQAPNRSVLSPESPRHGVDSVLPNESASHHGGDELSEYHDHHHNHDENTPFPFKFKAPSGRVHRVNVVTSAGVADLVAQVTAKLGNELEAVGGGATVEEGKLSNTGYALSYLDNEGDTVSITTDQDLADAVSLARRSHRDKVDLFVHDPSQPPIPATLDPQPAPAKVVE

SEQ ID NO: 23019 - protein, 227 aa, A.fumigatus
  UNSURE (120): Identity of amino acid sequences at the above locations are unknown.
ISPYLTDLPPSLPFLSTSKFSIQDLDRIEEPTMDIHRCRFVPYNPQAINALSFSHPPSAELAGRGVPTLRLAIGRANGDIEIWNPMRGAWLQETVMRGGKDRSIEGLAWTLDPPEAGPDXTKIPGKLRLFSIGYSTAVTEWNLEQGRPMRHSSGNYGEIWCIAAQPRWQATKRGKDGKPLPPAEGEYTGQHFAAGCADGSIVILSTADGDLKFLTADASIHKESQSP

SEQ ID NO: 23020 - protein, 62 aa, A.fumigatus
CSKAVGSQKGGSTGDAFIFVALFSIPFQVDYYVGTSDTEDIVMRQKETIILCLLETRYHIHV

SEQ ID NO: 23021 - protein, 61 aa, A.fumigatus
FGKHVGRRRMMKGKKEKKREQKTGWVELIGKEPSKDKAVGKESAFREDQTRKEAWPQHRVR

SEQ ID NO: 23022 - protein, 64 aa, A.fumigatus
LGKRESLIADRKIDCEFNVTRIVWANLRCWKFVRLWCFKLDDIRNRRFEFEQLNDNTESRLKHV

SEQ ID NO: 23023 - protein, 278 aa, A.fumigatus
GAPKCGSFRYMIRVVVNNKPDGESDARKSLASAGKKVRIIPTVDEEPPLNVFEGDDVYCTRKEKDVKRGLMRGKLGRLVVAASQPKPIQLTAPQYETKESVGTVATIHLRFDPVGNEAPPRLGSVWSRLRVSTYYAAVPWEDYPSALSATMWAQVGKSVYTETVPLSTLCVASAQWTKHSASSPVRRSSLESTSSSESLTGPSASFSRSTYYTASVVVPVSLPASKAFVPTFYSCLISRMYTLDLSISYHTPNANILTPTASLRLPLQLTSQPKADTS

SEQ ID NO: 23024 - protein, 154 aa, A.fumigatus
LRPSTRQRSLSGQWQPFICASILSATKRRPGSAASGVDCAYRHTTPRSPGKTTPPPCRRPCGHRLGRVCTLRPSLCLPSASPRPSGLNTRPRARSAGAPWSRLPRPNRSPDPLPLSRGAPTIPPRWWCRSPYPRPRPLFRPSTPASSPACTLST

SEQ ID NO: 23025 - protein, 132 aa, A.fumigatus
LFILRQSTEMLTGASYKHGVIHPLIEDSLLRSVRNEIKEHLDFTEKETDIYKIFQSGDLANLDGLDDASLSKLPSLLKLRDALYSARFREYLSAVTGSGKLSGRKTDMAINIYNEGCHLLCHDDVIGSRRLS

SEQ ID NO: 23026 - protein, 76 aa, A.fumigatus
ERLSLSILHNSSIKVSIYTCKMKRKTDTREALNGNGQPESKKRALSNEEVAARFRDGLFEPSEQQKYTKAYAQSSP

SEQ ID NO: 23027 - protein, 197 aa, A.fumigatus
APGLILQANENPPSGQQSQQIRSEEDDRSIRKLREVFPPVETSLSQLPEAKKLLILHSLLLLVLSLEHYNAWSRVLMLFVTSSLGLDVKLLNEDEVKVARGLLDTALALSSNAPRQDESRSRDSSRKWKVGIASVAGAALIGITGGLAAPLVAAGLGTVMGGLGLGATAAAGYLGALAGSGVVISGLFGAYGGRMTG

SEQ ID NO: 23028 - protein, 63 aa, A.fumigatus
TGHPPTISTEKSADDNTTSSESSEIPCCGGGAKPKAAHDSTKPSCNKGRSQSTSDPDQGSTRN

SEQ ID NO: 23029 - protein, 72 aa, A.fumigatus
RMCQDHARRWQSFLGRVGLSRPLFKKILNTFKPWTMLGSATAANEKELPAFRALEQALEIDPNNLDALMGAG

SEQ ID NO: 23030 - protein, 351 aa, A.fumigatus
  UNSURE (248): Identity of amino acid sequences at the above locations are unknown.
MMDEFAAQQPGQIPGTAPQPFAMEQLRRELDHFQTTPPRTGSPGWAAEFDTGEHARMEAAFAGPTGPLMNNGSAFTPAEFARFQQQSRVGMPQTSSPATSVSPVMAGYQRPMGMGYMGMGGMGMMRPSYTPMGMQQQPAEAATQDKGKGRMVELDDENWEAQFAEMETAGNQTLDDEANAAIEAELNDLDRSVPTTDTGNAQDYDAFESVWQRVQAETATSRKLADEDASFEINDNLHMGDLGEWDGXDNLQTRLRDPQLGDYMFEEENVFRNVANPFEECVKIMREGGNLSLAALGFRGRCSKRSSTRSNPGPCLDPPQRQMRRSFLLFVPWNRRWRSIPTIWTPLWGLA

SEQ ID NO: 23031 - protein, 69 aa, A.fumigatus
  UNSURE (26): Identity of amino acid sequences at the above locations are unknown.
IGYRTPSSPMHTMWQAGDPVSVHNKXPMVKELKWYAFYIALEKYQQSHYSLDSSLNTAPIQRVTPNPDE

SEQ ID NO: 23032 - protein, 266 aa, A.fumigatus
  UNSURE (207): Identity of amino acid sequences at the above locations are unknown.
AVFAGLNVNPDSWSCIMQRQRKNLMPAFSYRHIKNLYPIFWSKSIEMVKLIEKDLHSRADAKDNIVRVSEWASRATLDIIGVAGMDHDFGSLHDSNNELTKHYRRLLEEPPLAMRIIFVLGVLFGSVGVVESLPLKRNREIRESSLYIRDVARQMIRKKEAKMKSQASAETGTDIVSVALESGAFTEEELVDQMMTFLAAGPQTTPXPSHCYCTPCANFRTCKRPPARNSLPLSPISPRDPKPSSEAKFNSFLYSNPSGKKVFGSP

SEQ ID NO: 23033 - protein, 269 aa, A.fumigatus
AQSRWPHEFRGEAIYTAEVDVHSPKLTVGDTLYFAARARTPRHIFGGVNATQYAGHMRDVIMAMFGISHTKNTIVGNDFIRGVSGGERKRVSIAEACLSNAPLQCWDNSTRGLDSANAIEFCKTLRMQADINGTTACVSLYQAPQAAYDYFDKVLVLYEGREIYFGPTSMAKHYFLQMGFVCPDRQTDADFLTSMTSHLERVVQPGYEDRVPRTPDEFAARWKASPQRAQLMQHIKSYNAKFALDGEYLDKFKQSRRALNRRTGQKCVE

SEQ ID NO: 23034 - protein, 93 aa, A.fumigatus
  UNSURE (10): Identity of amino acid sequences at the above locations are unknown.
YFPDYEGGAXYAAACDYILNRFVSLNQAEQKQIYTHFTCATDTTQIRFVMAAVNGASSEDPCILFDYRPLTSSRYHYPREPQTLWSDLMSHYT

SEQ ID NO: 23035 - protein, 70 aa, A.fumigatus
LNKRTLLEYILINVVSTSLPQFGLGEEGVWCRKGKEGSKQATPKMYLYLNPRRTQDVRVWEGHLIVYVIQ

SEQ ID NO: 23036 - protein, 145 aa, A.fumigatus
TCRNFATLAQRGYYNNMIFHRIIPNFMVQTGDPTGTGRGGSSIYGEKFEDEIHPGLKHTGAGVLSMANSGPNTNGSQFFITLAPTPWLDGKHTIFGRVKRGMRVIQRMGLVKTNSEDRPVDEVNIIRAKVVKKASSRRCRKGPCT

SEQ ID NO: 23037 - protein, 201 aa, A.fumigatus
RRPLMFNSSKSLFAYCLPLIIDCILGFRHQGQIPSPFACITKILGTTPKHPIHTMATFSAVSRRPFIALPFLIPSCEPVALELRRNQSSYRRTKQRLRVKPDASFGFSSDQTQDHIIFNPPSSAPSVFHTPTKFLPPDDARRTLRTDVSMKSDQNPENLPPVFNSPTEKKYHLTPSDIEEIRKLRLSDPMTWSRWKLAKRF

SEQ ID NO: 23038 - protein, 104 aa, A.fumigatus
IVQIRIANPLFLQRSAALKIDWVKVTSSLGLRGQTAASLQAFKKRNDDARRKVQLLSEQPQTVNFDHYRSILKNQAIVDEIEGYVKNFKPATYDVNRHLKAMAA

SEQ ID NO: 23039 - protein, 91 aa, A.fumigatus
NAIADPSALVVENEWGDTVGSWKNEGAPDLHLLTKEEVELCNVLHIQPKPYLVIKETLLKEAMKQGGSLKKKDARAICKVGSTSLLFRSVF

SEQ ID NO: 23040 - protein, 62 aa, A.fumigatus
  UNSURE (31): Identity of amino acid sequences at the above locations are unknown.
YPGIQAKCLILSGQYNGLKPYLGWNALPFLXFAISILVSQTKMLVRKKNGTPPGIRNPGTSP

SEQ ID NO: 23041 - protein, 88 aa, A.fumigatus
SDPQSVTPVVNTYLCFWHSVGNSVDLSVSRDPMSTLLCMGFEMISTARAEVTGQEYLEYYLEMKYIDFQPLQTAMQPQWVCGEQAPAF

SEQ ID NO: 23042 - protein, 73 aa, A.fumigatus
KQLTNTRISHSGYAYILSYIRFIPSVDSTASFGKLLKKRKSTETMATSYQPPSQEGHYPRKYYFKAEPDQYTC

SEQ ID NO: 23043 - protein, 120 aa, A.fumigatus
SPSIFARPASALSMVSSSAGGSSVSAVSNEFSASTSAISSTRSSSGREKPAKLAIQSPSGKILRLTRKADHMISSDSSDPTADGSVWETVIKIGERGTWRGLVLADRVARWCVFCEWECF

SEQ ID NO: 23044 - protein, 100 aa, A.fumigatus
  UNSURE (90): Identity of amino acid sequences at the above locations are unknown.
HFCWVCAHGWEALRRGWAHGEVVERCWYGCKPFFPLLRILTRTGAVPYAKTALPVTLLSFESYNGLWGRCLNPHVPEYSPGGSTGGEGAXCLPLGPGGVS

SEQ ID NO: 23045 - protein, 151 aa, A.fumigatus
RINRDQKQKERAARFASLSPDYHTAFTASDKSIINTPIEQLVESVHKSHLSPTDVLRTYGKVAVKAQERTNCVTELLLPEAETWLQKEVNLKGPLAGIPVSLKDSVQVKGFDTSVGYARMAGKPCAEDGPMVKLLKDAGMAANLFFLCCVS

SEQ ID NO: 23046 - protein, 254 aa, A.fumigatus
QLAQLPRNSTEGLGRIRHSSDLTKRLAELETEYHKSYTRPANSGQVAVRPCLHLQEGFVARSINSEEDQLYVNHIALSLGPGLDSGRLRFAWQDTADNSEILRTCFAPLEKEIVQVVLTPGGAISWTEDEYDSLEDCIKEQRARQQEISRGIIKNMTDVPPVRFHLATLSSKRPLVLFIAIHHALYDGESFSMLLEDVAARYVGEPVTRRGSPAAFIDHVYGQNLEKAQQHWVNALSDCQPTTLPWFHHGGRRS

SEQ ID NO: 23047 - protein, 184 aa, A.fumigatus
  UNSURE (178): Identity of amino acid sequences at the above locations are unknown.
MYRTGDIGRLMSDDSVEYVGRGDDQTKIRGQRLELGEVSEVIRSSSPVQIGVVTTVTKHPGLARPQLISFIARSGDKSRQRIGDATIIHSDLATLGKELRDACQRKLPAYMVPEIILPITFIPLAPMSGKANIKELHSMFSSLPLASILQGNNPGTSDTAAFTDRPLSSDKKAVVSEXLRCDQG

SEQ ID NO: 23048 - protein, 317 aa, A.fumigatus
LSVSGQPPGLTGDVRLTEGKIRMGATRSFCPQYAWIQNVSVRENILFGSDYDEEFYDRVIDACALRADLDIFPNGDQTEIGERGITVSGGQKQRINIARAVYSKADIILMDDPLSAVDAHVGRHIMDKAICGLLKDKCRVLATHQLHVLSRCDRIIVMNEGRIDAIGTFDDLVRTNEHFRELMSSTSQQEKQSDDDDVDKKSNEGEPLKDQIDKARPAAALMSKEELATGSVGWPVWKAYITASGSFFLNFIAFLVLLACLNGGLIMTGLWVSYWTSDKFPNLTAGQYMGIYAGICAAQALALYGFALHVTHCRSGL

SEQ ID NO: 23049 - protein, 68 aa, A.fumigatus
HQFPEVFICPYKIVKGTNSVNTAFIHHNDSVAPAKDMKLVGCQDTAFILEKTADGFVHDMSSDMGING

SEQ ID NO: 23050 - protein, 246 aa, A.fumigatus
  UNSURE (239): Identity of amino acid sequences at the above locations are unknown.
HSARRHGIPRPNSTYSFVSDMGGDGRNLSPGASPYLHARTSPRNSSSPDVRPLSFVDLLNTPYPQPGPTPGQLDNSHLKSWVGNNASLLSHKQTFDMYLANVKKTDDPAVQYEFAVFMVNAMLEMPPDDHEARKDAVYGGKAAGITRHSLLKEAKSIFQRLADRSYPFAQYYLADGYASGLFSKGKEDYDRAFPLFLAASKHGHVEACYRTALCYEFGWGTRVEAARAQQFYRQADSPXHREMAIK

SEQ ID NO: 23051 - protein, 66 aa, A.fumigatus
  UNSURE (10): Identity of amino acid sequences at the above locations are unknown.
RPQNIATILXASENGGGELHPQDFRPSDVAILSTFASSPFEGSDPFPALGHEVQKFRSLGICSLFF

SEQ ID NO: 23052 - protein, 82 aa, A.fumigatus
LPKHKPFPVVCQSLDPLLQRPATELTYLPSNFLEQVVHLLSSSVKVTLNKHSVLRQSFDNCNDFLRRWPAEIDDIGKGEVHV

SEQ ID NO: 23053 - protein, 258 aa, A.fumigatus
FSQFISQNTERLLSFSQCSGWQGSALIVLPDFQRAWTQQKVENRNAHITPGSREGRKLSPYRVHMEHQKAILKAQLRLAGELRRPVSVHSVQAHGAVFDVFKELWSGHERRVPSRRERRRRLSVEGAHAESDAEDEQVQKSLKREGSPLPYPPRICMHSYSGPVEQLKQFLNPSNPSDVYFSFSNVINFSGPSSQKVIAVVKALPEDRVLIESDLHTAGQQMDDLLEEVARQICELRGWSLQEGVQRLADNWKRFVFG

SEQ ID NO: 23054 - protein, 67 aa, A.fumigatus
RCQVVAVYIAGEAVGALTQTAIGDRLGRLRFMALMCVVVTIGTVIQTASINIGMFLAGRALAGYAVG

SEQ ID NO: 23055 - protein, 78 aa, A.fumigatus
  UNSURE (40): Identity of amino acid sequences at the above locations are unknown.
EDFPMAPRRVLYSLSYRGMVATVPIYLSEISAPRHRGLIXSISGCGISFGTMASNWVGFACSFAPYGPVQWRLPLGIQ

SEQ ID NO: 23056 - protein, 71 aa, A.fumigatus
QGQKDCGERVVGDKPSDFNRNIRINQTTQKAVEDISPVWFLRQGKLQAIFYQFTDSMINNTVNVYHGIMHG

SEQ ID NO: 23057 - protein, 287 aa, A.fumigatus
LFSSLAEPCLFRLNLFFTIGSITANVSALPVGTILDRYGSRLCGFIGSALLVAGSVLMSLSFSRPDFDGYIIANFFLALGGTFVFVPSFQIANAFPKHAGIIVALVTGAFDASAAVYLFYRILYESNPETFTPQRFFLAYVAVPVCLLLALLTIMPAQDYQSSHQLEIKMEQAKDSTRDIHESDQEIESDTELRRVRSQRAEERMDDMRQIDRVLGDADERRHREEQEAERQATSVVWGVLHGLPARKQMATPWFILITLMTVLQMLRMNYFIATIRGLHPRSQNRR

SEQ ID NO: 23058 - protein, 70 aa, A.fumigatus
AHIFNNYNLFIIPLNNYTGSLTVIYYSNNLRYYIESYCKASFIKVLDIIFIDTMFLNSSIYSFKPLFYNL

SEQ ID NO: 23059 - protein, 73 aa, A.fumigatus
KSNMLLNVGINYLMGCKKIPPSVVIRLSGRGITFSEERISLSERTGHYLLVVQINLNLEHPPSLQDISWKNIP

SEQ ID NO: 23060 - protein, 65 aa, A.fumigatus
RSSSWQVVIAQPFHTIIFQATNFLDCVIAWFLILTVFPSFGSYGKRPENSVRRMLAKSTTNQRLG

SEQ ID NO: 23061 - protein, 218 aa, A.fumigatus
GGAGGFSRLWRIAFKGPLRQLIVSLPSAPLVALPLTLPSFQEVQGLSALEASIRILPSLVVGVLLNLVIGVFVHKVPAFWIATVTSLLCAGSPLLMAVIQPSWPYWGNAFVAQLLQAVSFNALYTIGLIIITNSFPDDTQALAGAVFNTAAQFGSALGLAILQVISTVVTEESAADGTGALMAGYRASFWTMFGFMILCTLLGYFGLRKAGKVGLKRD

SEQ ID NO: 23062 - protein, 140 aa, A.fumigatus
  UNSURE (12): Identity of amino acid sequences at the above locations are unknown.
HSPAYDESHLTXYITMSQIFSIWVVPFHVSPVRLTTVINLTTDSGVQKPSMVNGNHTLYYITKQEDLYQVSEWIKFLVPHVGYLFVLAFQSFATLFCLLGVVILYPIMWLEERRVIPYKILRKGNLVYNIERKIPEIKKE

SEQ ID NO: 23063 - protein, 290 aa, A.fumigatus
RQIFDESGSLRRLDTVGGTSISSVMAGLAFEELVISVADALDQLLSQIVALLEARPKPRLWFPTSIEYAVGWVLRRDARTPVAGQSSDPDPDDHAVQTDEAQQLFRRISRGYRVKQRSGLGRVVLGVYHWFISAEGLFALRMVILTIALAVPAVIPSSSGFYYREKGLWGLIMGQTTLLVYMSDFMFSLICRAVGTIIGGAVGLAAWYIGSGHGPGNPYGLAAISVPVIVIFLWGRLFLSPAMLPATGMSAATLFLIIRYSFAEYYALCPPSPSPSPFGLFCFLIPDHRT

SEQ ID NO: 23064 - protein, 66 aa, A.fumigatus
WTEANLFPRVLVRAAWGSHSPSLDTDKITDNKDFKKWINNYLGVGEWVMDQSVAVLSSTSYFERKR

SEQ ID NO: 23065 - protein, 60 aa, A.fumigatus
AATRSWRPKPKSIANTAKKLRDLFRCTVSARNQSALTVQNFWIWIRHEITVSITNEIPCI

SEQ ID NO: 23066 - protein, 70 aa, A.fumigatus
NLLIQLFHSPAPKDDTLSASIIVSSYEVLATQAQEYRQHCEEATRLVQMYGISAQSVGIDRAKFLDLDSP

SEQ ID NO: 23067 - protein, 64 aa, A.fumigatus
  UNSURE (24),(31),(49),(60): Identity of amino acid sequences at the above locations are unknown.
RIAASFHPFVTGALHIVTPDWITXRIIILLXPLFLNVTSYSVLGTGYYXFWEWYFIYSIXILPN

SEQ ID NO: 23068 - protein, 323 aa, A.fumigatus
  UNSURE (41),(42): Identity of amino acid sequences at the above locations are unknown.
FPTNAFPRNPLVTLLLGFKPGFFTQGPNPQLSGKDVIFVWXXCRGPWNPNGIGCFWGITPSLHAIMGHDYAGTVVAVGDSVRELFKVGDRVCGLVKGADNTRRESGTFAEYIVAKAAIQMKIPDGVSFEDAATVGVGATTAGQCLFGPSCLKLQWPEAPNQIENRDTILVYGGATSAGSWIIQFAKLYAHFLSSNDISLTVDRAGFTVLTCSPNNFNLVRQYGADVVFDYHDPVCARKIREHTSNTLRVVCDTVATQESVQICEAAIGDAGGLYHSLLPVQTTRADVQATFANCCTMIGETFEYGPDRWYSRSSPRRRRSALV

SEQ ID NO: 23069 - protein, 64 aa, A.fumigatus
  UNSURE (22): Identity of amino acid sequences at the above locations are unknown.
LIFFAAHSIQAFTMKRSVETLXATVSVFYAQTDIEKEPSLSAIEYAAASIQPYSPVSNVVGCCI

SEQ ID NO: 23070 - protein, 63 aa, A.fumigatus
DLISAICSRFEFRTNLLHSTNLYAVTHPSEPNYCAAVGGDTFGMDNDNFNQIPANVFNGRGSS

SEQ ID NO: 23071 - protein, 222 aa, A.fumigatus
  UNSURE (54): Identity of amino acid sequences at the above locations are unknown.
TPKPLLGKSIQKPFLNPEFKVFTYSTKETYVNDYVGKHNPLVLYDSVTKNSTRXRQIKNFTSFEDDLANKKLPQWAFITPNMTNDAHDTNITFGAKWERSWIAPLLNNSYFMNDTLILLTFDEDGTYSKSNKIFSVLLGGAIPDELKGTQDDTFYTHYSVIASVSANWGLPSLGRWDCGANILEIVANKTGYVNYDVDTTNLRLNETYPGPMSAGEYSKVFT

SEQ ID NO: 23072 - protein, 92 aa, A.fumigatus
  UNSURE (8),(13),(14),(28),(30),(39),(43),(48),(59): Identity of amino acid sequences at the above locations are unknown.
NKMFNFPXPTEDXXIFFHLLGGRVVTIXIXLAYLSLQSXNAIXAGSYXVSTFSKGTRGXFTHGTSTSVPPTHHETMIGSGISEQSDQFPSRT

SEQ ID NO: 23073 - protein, 83 aa, A.fumigatus
KTYVTSYRRQYHLAIIKQGTDLIFSQKKGGSAKKQIAQLQAQAAHNKSAEAKKKEAEKARREAEKKAAEAAKKGTLELFKPVQ

SEQ ID NO: 23074 - protein, 360 aa, A.fumigatus
KPKDADFCATFGVTVLNLFQVAWALVLRLYTGQDDVCFGYLASGRDSNVSGIDDIAGPMINMLVCRLQPTRDKTPRELLKQAHKHLTLALSHQHVPLAEVQNRLRTHGTPLFNTLVNLQKSNVGQGISHLTISTIGANDPNEFTIGLQIADNGQSIDVLFGHWLSRVSVDQADLLASLLSSTVNNIMARPRARLGTINFCNGVHAQKMAEWNEQARRPVVESTLHSIIQDQARQRPSTIAIASTEAMWTYEELERAADQTARYLLRQGVQPGTILPFWMGKSSRAIRGYAGRSLRLGLRLCRLLDPASPPQTGWKLILPPNLGPNIGNQWTPVSMEFLEPWKGTCGTYLAFDPTWGGKPS

SEQ ID NO: 23075 - protein, 225 aa, A.fumigatus
LTEIGKPYHVALEEDLTEAITTIRYYSGWADKIAGQTISTTSSKFAYTIRQPIGVVGQIIPWNYPLSMATWKLGPALACGNTVVLKPAEQTPLSALVLAELITEAGFPPGVVNIVNGYGREAGAALASHPLVDKIAFTGSTQTAREIMKMAAGTLKDITLETGGKSPLLVFPDADMEQAVKWSHFGIMSNQGQICTATSRIYVHQDVFHSFLERSSPGAEEGRST

SEQ ID NO: 23076 - protein, 160 aa, A.fumigatus
LWMPSHPVVKTPRSRQCELSAATAPIPRLPTANICFQAPPLKSTPVLTKTKERISDPVIAAFIAGGVAGAVSRTIVSPLERLKILLQIQTVGREEYKLSIWRALVKIGKEEGWRGFMRGNGTNCIRIIPYSAVQFGKLPLLPKGKSRGLLPRSIELWPKR

SEQ ID NO: 23077 - protein, 82 aa, A.fumigatus
  UNSURE (2),(6): Identity of amino acid sequences at the above locations are unknown.
SXAGAXGSKIRTGNLRRWDYGLFKIGLNADAMDKYVDDWIVGITDVTEVFKAHSKMPGRSTGWKNPTRLVPAQKVYPFVPRI

SEQ ID NO: 23078 - protein, 74 aa, A.fumigatus
  UNSURE (60),(73): Identity of amino acid sequences at the above locations are unknown.
QISTTPYTVASILFRASPIDPALHPSSPPAPQTHDLASYNRSTSIDDQSTTQQPGADAIXGASPKFFKIGRYXD

SEQ ID NO: 23079 - protein, 187 aa, A.fumigatus
RGEDSRGERVTPTNAYLDWLAVSLFRQWLVDNTTPPPAPILKNASTNGLPAAGANISVSAGNNTSRSHRTQETTSRAPPPSPPLTPAQVYRLIGSPSTQAYLSHDELKKFLKVHPTPSADSLYTRDVLKRFERKMDEIKRLAREIVKPLLRNFLELDLKGTDLGDSALGALPYLTCTKVEDEDIPWD

SEQ ID NO: 23080 - protein, 182 aa, A.fumigatus
RFAVFGSEARPFDPEKKPPHVPADHTHQWRVFVKGVNDEDISYWLKKVQFKLHETYAQNVRTIEQPPFEVTETGWGEFEIQIKLYFVPESGEKPQTLWHSLKLHPFGPGAEVKKERREVVISQNYEEIVFNEPMEPFYDLLTGGPTSQQTQKGKGGKNTKQAAQQRGGRTASSPRGWKEPRH

SEQ ID NO: 23081 - protein, 60 aa, A.fumigatus
ESKNITDICNYLHITIMDKLLVRTLTMTRFENCSQAPFQLFDYLSSFDTILLYCSIFIST

SEQ ID NO: 23082 - protein, 214 aa, A.fumigatus
  UNSURE (2): Identity of amino acid sequences at the above locations are unknown.
EXDPSSIHFKDGQLQGTILKSISANEKVKLPLVISFLESGAARIVVDEEKRMKGEIDLRHNSQVRKERYNEAEQWALVGGLESSKTAAVDTESETGFTKVLYGPDNKFQAIIRHAPFSVDFQRDGQSHVRVNHKGFLNVEHWRPKVDVAEGDSVQEKSIPQQDESTWWEETFGGNTDSKPKGPESIGLDITFPGYSHVFGIPEHADSMSLKETR

SEQ ID NO: 23083 - protein, 226 aa, A.fumigatus
  UNSURE (189): Identity of amino acid sequences at the above locations are unknown.
AAPIRMTPQQQIGTHFLEELGTGYNSSNRMVLLLHTQNRTMLTAAEANEYNTSTYQERQLTAEEEEEEEIQNIKQEMRFIKQGDVASTRNALRVAAQAEETGRETLARLGAQGERIHDTEKALDVAAIEGRLAEKKAKELKTLNKTISPVQLSNPFTTPRRQRDQNKKIFETHLLKRAPREGTPIKAFXTTPRIEPPFPGRLKKNPVNPFGKTGTNFPGPFPIYHF

SEQ ID NO: 23084 - protein, 114 aa, A.fumigatus
TACWIRLDERTLSHQHPCTWRHPTPHTHHGYAPNQYGNQGGYGADRFGNAGGASTSRYGPGGYGGLGSTDPNDPTAADRDALFGGARDRVQQQQQNGPPPPYSEPNNAYGGGSQ

SEQ ID NO: 23085 - protein, 76 aa, A.fumigatus
  UNSURE (3),(10),(12),(13),(14): Identity of amino acid sequences at the above locations are unknown.
KYXFHIYYIXIXXXNTPPLAPFCVSLRFLPFIFRMTLVTFGIIIQGIMAKERAPLIISTSYVQTRTGRFHHLELHQ

SEQ ID NO: 23086 - protein, 143 aa, A.fumigatus
VRCGACTDSGRVRECQAVYLVAHSCLSIDSWRSTNIPFPRFLRVLLVALSLFLNLSFFLSFFLSFFLSFFLSFFLSFFLSFSLSFSLSFVSFFSTNKLLQSCCLSALESPVPLYIPVPDPFVQRSVLSSWRPLLPACQAGHCP

SEQ ID NO: 23087 - protein, 209 aa, A.fumigatus
TSLSFFLSFFLSFYLSFFLSFFLSFYLSLSLSLFLLFRSFLPTSSYNLVVCPLWSPPYLCTYLFLTRLSNVLSSHPGAPFCPHVRQATVPECIHYCPDGFPYPLGYERNFPCSHRCFVVENEPPLLPNDATVFLLWVPSLDNAFWQSPLWLTNHECLHCHPLVTAGLPTSGVWILESSPPLFGQFPPNPLFICPGCLGWVAFLPPLSSR

SEQ ID NO: 23088 - protein, 179 aa, A.fumigatus
  UNSURE (48): Identity of amino acid sequences at the above locations are unknown.
SPVNITNAQVPDPSWEWAWPSWYVDMSGDVDDQGWQYSFSFSSKAWHXTHPWFHSFVRRRRWVRLRVKRTLEKTRRGRSGFEMAHMLNEDYFTIHSPRKQSRATSSIAVSGNLSRTTTGVEEEALLEEIGNIPTLMYALKAAIVDREKINVLKRFIEDGGEELHYLDSKVSQSLVSRCQ

SEQ ID NO: 23089 - protein, 250 aa, A.fumigatus
RRRDKVAGEKEQRGVEEDAKKENVSIEGKSDHTEDPSPIPVNGGGSSDTKSFASNGGNEDGGRKGKKGSGDRALQKPSVPEFYPQVMAIPIAKRPLFPGFYKAITIRDPNVATAIQEMMKRGQPYVGAFLFKDENADGDVIENLDDVYDVGVFAQITAAYPLRGEASGVTAVLYPHRRIKISSLLPPGEQSKAGNTEDKAPEKKGDVVASFEEGVAEPAPKDLYEPTSFLRKYPVRLSSSSGSDRIRENW

SEQ ID NO: 23090 - protein, 167 aa, A.fumigatus
SFALRSTNEPISFTLSFCMFGPERRTNKADFKLTKSPSPCLTSSLFGLFNFVFSILCRNILPMNNLSTIVVSLCCAFVFLYALGALWIYGRTFADRTRIQYGSASPTLLTEEEMQRQQLLRLLQQNGKKKRSSAKAVQKTFKVDVPEVVSPGKGWDRYMPPREEYFI

SEQ ID NO: 23091 - protein, 155 aa, A.fumigatus
YHVSSSGAAVLSASPIAKALAMGVTSHDVIYGGDVSIDATANGNGGFIFRVSNATAGPDSYNGYYAGIGVGYVVLGFADRQWNELKRAPAADITAGQTYRLLIRTRGDSIAVYVDDLNTPRMVVQDGRYSAGLSGLRAYMTTMSVSNVRIYHGLC

SEQ ID NO: 23092 - protein, 96 aa, A.fumigatus
RISGQFEETQGRHWKGGLESRATNGLILTRLARTTQNATDPPISTSLRRPTSLVLGVLLSTSPGLLNARFGATTRLVFSSETGWISLHAGGWKVQS

SEQ ID NO: 23093 - protein, 67 aa, A.fumigatus
STPRIVEYTRPTYYPSASVQKQQDVPGGIPRREYTMDPRPRNCFKTDGPSRMLLITVFGLTRRNSLF

SEQ ID NO: 23094 - protein, 194 aa, A.fumigatus
LCFSYLWHVFPVVPQWYSSPDRYGSLVAEEPVLAMGLIMTASRYHPLSGFNGHARSERIHWRTWPWFQRVLQSSMWGSPVMRKLGSVAALLLLIEWHPRAINSPEDLVGDCSEIELFDPQGQPYEADTRESAEHDQLPESSSIPDRLITLAPAYRSNKMSQVVFPGESTPWTLVPVIALRLTDLQGCSLSPFLA

SEQ ID NO: 23095 - protein, 139 aa, A.fumigatus
YCILHSWSGIRFHSFNLLSSYFHVTMRSIHLLSFVFGISPVLAWTELHHAPFMNKNIDAIVAPGTYTSHMHTFFGSDAITNVLPTSAELQRGCYSGDNPNDLSVYCMLHITPILPVSHSIFSNSGVPSLHHGAGRARQL

SEQ ID NO: 23096 - protein, 168 aa, A.fumigatus
HECINDKDWSFSLPSDAAQSFTSLTGQEADLLAYLLSPKPGPYASLLLAYRDSSPNHRPYLNKLDSLYLEKKEELPHSAFITSCYAAAHPGPYGAYLFDAIERQRVFVDKMVGYLWIRSPGVHGTLSRAITRYEYFLQLFKLRPGTTLVPTLDIDLVWHTHQCSASMY

SEQ ID NO: 23097 - protein, 126 aa, A.fumigatus
  UNSURE (120): Identity of amino acid sequences at the above locations are unknown.
IRMRCSFRPGGEDVLTDVWLSGPTDTGMQRLALSEEDKSVRDWFIDTAKALKCNITIDEMGNIFAVRPGRRKDVPATFIGSHLDTQPTGGRYDGILGVLAGIEALKVIDEMGIETEGGIXVVNWTK

SEQ ID NO: 23098 - protein, 312 aa, A.fumigatus
  UNSURE (65),(236): Identity of amino acid sequences at the above locations are unknown.
HFHSEEGARFPVSMISSGVWAECIPLSRAHDLKEVPTVASLPTAASSPETMKSALKKINYLGSVXCSYKETPMAAHFELHIEQGPHLESANQRVGVVTAVQAYRWYRLNVIGRDTHTGTTAFQHRADALYAFARMMVRAREVASSHGCLASVGIIEAKPGSVNTVPGLVSFSLDIRGPETELVAVVEAELRKDFDAIAAEEGKGIGKPCRVEWTMDFDSPAVKFHPDCIECVQESXEAVVADAGVSDPKSLVRDIMSGARHDSVFHPKRVPPNMIFVPCKDGLSHHPRKILALWNTGATRASIHSGRQYSQY

SEQ ID NO: 23099 - protein, 207 aa, A.fumigatus
  UNSURE (13): Identity of amino acid sequences at the above locations are unknown.
VGQSQRLVDLGGXLLARRSIRPEMRSDGYRIIMKPYLHKSTSSSRFISTSYSIIDVTLTMTHLRRIHHQQGSHTFHDHQAVYMDEISRNTTLTLTRNHHLDIILQTNIQQIPSKMAPYKTEEESIRPFSETKSDFVEKYVLRPVGKPLTKEYRVYFNLNDKLLSPWHDLALYPGSNREPVVHMVVEVPRWWSAKMEVSPLCVLIDTQ

SEQ ID NO: 23100 - protein, 74 aa, A.fumigatus
  UNSURE (72): Identity of amino acid sequences at the above locations are unknown.
RHQIAKDEYLHPLKQNIQDGRLKYVPNIFPHKGYPFNYGMLPQVSSFICLQLRDLQTDRNQIDIPRSRDPRXPH

SEQ ID NO: 23101 - protein, 247 aa, A.fumigatus
TVDHLRLVAKFKPCPKVQVCRVIGRPGIEDLYRLPSPRLKVSFHPVSPEASAADLNTDTLYTLFRPYGKIRDIETQPSDGKVTPRYAYVEFSRPKYAGMAKNCMHGFTIPEQEGGGKSGTRLKIKYERKIKLSMIKDWLLNHPRIVIPVLAALLAAITVTIFDPMRTFFIELKIKSTLQTEENGVMQWIRKQVNKANIIYFGRKGADPRGLTAIWEDRPEDITPLQSWLMENVENFIHIHGPRGSGK

SEQ ID NO: 23102 - protein, 257 aa, A.fumigatus
GPPIQQTIRNIWADVLGRTSESIGLQRSFFALGGDSVAAIRVVAQCRQANLQLTLQDVFQARTIQSLAACATAIIEKPMETVSSLLEPSQCENPESELAKLDSEVLSGLGGPENIEEIYPCSPMQEGILFSRSSIGGSYDTRLVVEVLPRDGGEVDLDRLKNAWAAVVRRHPILRTVFADRPSDDSAFIQVTFRKYRPVIMGCETSEQSLDDMIAMPVQPFDDRMEPSPSLHRLHKLTTGLYSICLRFIKFLTECCP

SEQ ID NO: 23103 - protein, 212 aa, A.fumigatus
  UNSURE (143): Identity of amino acid sequences at the above locations are unknown.
ALSRRKWKDWQVRYAFSRDPLDSKLIVQTTSQHDYDLLCSFQAYLVYTILMYFSPLGNVSAVTDKIMMTLMELAFRTAQNGLLCTAETTHTRPNWESWIVVSAKRRAIYTMYLLTSVYNSDRGLPNFVADEMKGVYVPESKVXWEVTDREVWEKEYDRHLLEWEDGMLEISELWRSTETGSTERRERIGRWVRGVDEFGMMLFAVCAHIHGC

SEQ ID NO: 23104 - protein, 90 aa, A.fumigatus
CNHAGNHPLIYGSLGKDPLMIIIIICVMTGVATFMNLIKPNCNPISFSVIGVLIYFTVFKLSSFSVYISMMMWIENKHTGFIVSTDRISI

SEQ ID NO: 23105 - protein, 78 aa, A.fumigatus
GCSAAIDHDIPACPPSARDLTSTYVAATSYNALKMRRCLSHVLCAPTLDVDSSASTRLFMWAKSVASDISMVWQNRMI

SEQ ID NO: 23106 - protein, 125 aa, A.fumigatus
GGRLEHRTSRDPHPRYCSERQLSSPSFRTEIFGFFTETTAFSHCTFVLILALDFQQIKAGESFSVLPASNGPGLPGAFPSAHSRAANVEFKEKNYHGRMVYMLISPRSSIKPRQTASPQQGMMGT

SEQ ID NO: 23107 - protein, 111 aa, A.fumigatus
EYIDSGYRDTKSRILYSLRSNARYKLIVLCCAFVRLIYISIQNGFRFASIKALVIGLGLCMGSCSCNLSRMVLALFPKLPYAIPQSPTFIGRLLPNSNAYALLNGLTNLRM

SEQ ID NO: 23108 - protein, 339 aa, A.fumigatus
HCVSFQARRCKTRGWLQASLGPVLVWVRLKFVDGGSAVMRIPCYGRSMFPEEKIQREVSVMRFLEFHTSIPVPHILRYGMAEESPDELGPFIIMEYIDHKYDLVDALNTPGIPDDERPMLDPQIAEERLIFAYGQMAGIMLQLSKHTFAEIGCIARANEDDDFDDVWVVKHRPLTSNMNELVQVGNFPPHLLPDGPFPTSSSYYRALADMHLAHLVTQRNDAVASPEDCRANCIARFLFRKLAREGRFCKYHERGPFKLFCDDFRPANVLTNAEFQVVGAVDWEYTYAAPLEFAYSAPFWLLLDLPEYWPGGLDDWTNVYETRLGTLLQGTRREILHRG

SEQ ID NO: 23109 - protein, 170 aa, A.fumigatus
RTIAGVKVIQVDEPALREGLPLRAGKEREDYLTWAVRAFRLATSGVSDGTQIHSHFCYSEFQDFFHAIAALDADVLSIENSKSDAKLLKVFVEEAYPRHIGPGVYDIHSPRVPSEQEIKDRIEEMLPYLRPDQLWINPDCGLKTRQWPETKAALTNMVNAAKFYRQKYTK

SEQ ID NO: 23110 - protein, 150 aa, A.fumigatus
DALLLLRREGRSLVSRSFRSTSLLCVRVSLCVLARSVRTTLPGPCVLSVWLPAVSPMVLRSTLTSATLSSRTSSTPLPLWMPMFSALRTASLTPSCSRSSSRRLTLAISDLVSMTSTLLVFPASRRSRIASRKCFLTSALTSSGSTLTVA

SEQ ID NO: 23111 - protein, 186 aa, A.fumigatus
KSQSHHLFGVLLAVELGSIDHVGQSSLGLGPLTGLQATVRVDPELVRAEVRKHFLDAILDLLLAGNTRRVDVIDTRSDMARVSLLDEDLEQLGVRLAVLNAENIGIQSGNGVEEVLELRVAEVRVDLSTIGDTAGSQTESTHGPGKVVLTLLASTQRETLTQSRLVDLNDLDTSDRPSRRRRSNAS

SEQ ID NO: 23112 - protein, 292 aa, A.fumigatus
  UNSURE (4): Identity of amino acid sequences at the above locations are unknown.
EDGXMNGLVATSVSGSSMGQDEIYERWLRKPLEAHGAVLIWFAGRWSILVTRPDLLTDMFRNEDLYAKAGSQKKIPWSVIATLVGDNIINSHGDTWKLYTGIMKPGLQKKNFDTAPLLLKSRRFVDEILAEQNSAGRGTGILVNTFVQQWAVDVMGMSFLDLDLQSLEKPHGTVRLEAIQSVIKLMLFRPLFFNFPDLDQFAWLIKSRQRAYEIMHEFGDTLMATVLGRIDSNREKGIKPAEEMVVHMLVDAYRDGRLTEKQFKDNLKIVFLTAHENAQQLVNSTFVFTSGK

SEQ ID NO: 23113 - protein, 62 aa, A.fumigatus
KKESRSTVKMVRTSVLNDALNAINNAEKAGKRQVLIRPSSKVIVKFLSVMQKHGRFYLFFLP

SEQ ID NO: 23114 - protein, 115 aa, A.fumigatus
RSYKFPKLFLFLCVWQLLNLRYILTDLLSGYIGEFEEVDDHRSGKIVIQLNGRLNKCGVINPRYPVQLPDIEQWAVQLLPSRQFGYVVLTTSAGIMDHEEARRKHVAGKLLGFFY

SEQ ID NO: 23115 - protein, 171 aa, A.fumigatus
  UNSURE (136): Identity of amino acid sequences at the above locations are unknown.
KQQGRNEASTRYDKTETDKIRLSPRAISQGSHNCPHTLPLHYLLSSYLPRGITSSSHYTSSAIPITRPAMTSIQILDGGLGTSLQDQHGVTFDSSTPLWSSHLLVSDPTTLLACQRNFITAGCDVLLTATYQVSIXRASPAQEPRVPRWHPPPRYRKISPNCTGRRRTSAG

SEQ ID NO: 23116 - protein, 326 aa, A.fumigatus
RGSLAPRGEDEASSGAAFVRILGLKLDPANAPRLHLFAWNVGARHPPPSAMPTAASATAVPIVDIISQDEMRSLMTFYFEKVDPCYPFLDRDVVLRQVSRRWLPSSSESALPYGPYDAVLCGITALGFLFSRRRAVPAEYRVAETARRILEHGLLVDTPASVDIVTGWVLRVAFLRMTASRHVAWMASCTLMHLIEASGLHREPLPETSLSQTSTPCAPEIRRRLFGMARHLIVWISFELGRSRVVLHGGGSLPLGPRSPNGPSEYFNLSPVLGKPRTPSKPNTPAAWNPSFAGCPRRFFQVSNVPSSVAGMEPPRFWPGTGRLLP

SEQ ID NO: 23117 - protein, 210 aa, A.fumigatus
TPEVQQIIASEGGKVQYIIAPDIEHHLHITTWKRAFPDAQILAPEGLYEKRKTSRSYPDDPAFDHIFTKDGKHSLSISDEFHADFEVEYMDGHGNREIILCHKPSRTLIEADLLFNLPCKEQYAQSEESPTAGLLNRAFISLLQATASPPTAHRRFAWYVLSKQDRASFAESVRRIYNWDFDRVIPCHGDVIENRGKEVFRSVFEWFLER

SEQ ID NO: 23118 - protein, 70 aa, A.fumigatus
SPQFSVRASCANESETIKLIEDSAPSKGEAQLAGDYLNAREYTVGYLQLSQVKRTARHPLLLCLLWASRR

SEQ ID NO: 23119 - protein, 77 aa, A.fumigatus
  UNSURE (32): Identity of amino acid sequences at the above locations are unknown.
LVPKIIEDSFRPSQHKFIHFKLDSRKFCILAXSIHTICTRLHGAVKPVPLFGGSKQDLFLTRTYNKNFTISQVRHVE

SEQ ID NO: 23120 - protein, 136 aa, A.fumigatus
  UNSURE (129): Identity of amino acid sequences at the above locations are unknown.
DLITDIVLDQTRLWSRLLLHFWALEAEREVDRTSKLDPIEYLQRAYEETIRATTSPNEWLGTTTTVTALLHFTGDNAENAKPLLYVTNLGDCKVLVIRPSEEKVLFRTTEQWHWFDCPMQPSTNSVDTXRKDAKLS

SEQ ID NO: 23121 - protein, 66 aa, A.fumigatus
LRCPRFFREYSQFLPILDIGLTPNAYYSQSPFLFWAVIGVACRSYPKNPTLSSPRGWKGPCNQCRS

SEQ ID NO: 23122 - protein, 168 aa, A.fumigatus
  UNSURE (6): Identity of amino acid sequences at the above locations are unknown.
TGETIXIRLFLGGFDLTPTFRDVNKKYSTRYYLSLVLIDEGKQNKKMKALACSDIFCIGLDCPIDSLWRTKCRLYDLESRSPLSRRCLLPALVPEVSICSTCPMLSHGIPPRHFNSRSAIEITSDQSWRSVDSDRLTCDLIPNGKIPHAKPHLDDPTRVAAPLGPGFS

SEQ ID NO: 23123 - protein, 157 aa, A.fumigatus
AGYLTTLGQELANESAAPHIRTAAGLALKNAFTFRDLAKLREVQERWISGISPEVKAQVKELALKTLASKDARAGQSAAQFIVSIAAIELPRNEWPELMNHLVQSVATGTDQLKQASLITIGFICESQDPELRESLAAHSNAILTAVSSPRGPTDPR

SEQ ID NO: 23124 - protein, 91 aa, A.fumigatus
QSGPTNFCHVNDLTLIARAHQLVNEGYKYHFANQNVVTVWSAPNYCYRCGNLASVCEIGDDLKPTFKLFSAVSDDQRHVPVSRPGRSEYFL

SEQ ID NO: 23125 - protein, 130 aa, A.fumigatus
TFCYSAMGLIAFILDGICKHCSTQSTWVLVGIGLLSILAVSVIINVLQQLLFKNPHEPPVVFHWFPFIGSTISYGIDPYKFFFDCRAKVCIVAAKFMCLANQICFLAVWRYLHIHSTWQKENGVSWYERQ

SEQ ID NO: 23126 - protein, 208 aa, A.fumigatus
  UNSURE (9): Identity of amino acid sequences at the above locations are unknown.
IMYHCGTSXPVVKTDGITASPQSFRPPLTDATHRLNNCATPKSEKGSHIEAEDLLITPDRMSIVTSPLATRENVGENRASPNPNSQAGSKRNSAISTTSNVSGKGKRKTHVGPWQLGKTLGEGATGRVRLAKHAVTGQTAAIKIVSKRSAAIAQSESIAAMDRNASLFSGTGTRQMPSGIEREVVIMKLIEHPNVISLYDVWENRGEL

SEQ ID NO: 23127 - protein, 251 aa, A.fumigatus
  UNSURE (17): Identity of amino acid sequences at the above locations are unknown.
HFVSRYLFLEYVQGGEXFHYVQNHGPLPEEEAVRLFRQIIAGLGYCHRFNICHRDLKPENILLDSWRNVKLADFGMAALQPAGHWLNTSCGSPHYAAPEIIYGRKYRGDKADIWSCGIILYALLTGYLPFDGGDLPSTLRQVKRGEYTIPPELSVEAADLIQRILQKRPEDRITMHGIWMHPLLKKYEHFHQAMSHHYLGPAPPLTAQDCGPPVLSRQDIDIDILRNLQTLWHGVKTEGLHHGARRSALMR

SEQ ID NO: 23128 - protein, 152 aa, A.fumigatus
IPRPGRRRARCRQQRPHQYRRLAAPGIRRPRDPRGAATRVQGGARRGRCPRVGMEVEMAQRSDRRATHDAAEELCLVSVVIILAVLALRLFPIFIAVLICLCHHVAIVSGMSRVCILQTERRTKGAFLFFYSFLLIFCHVHSSFSILDVLNA

SEQ ID NO: 23129 - protein, 270 aa, A.fumigatus
HSQCMPLYHSSATILGFMSCLMSASTFVIGHKFSARSFWKEARENNATIVQYVGETLRYLLAVPPQIDPVTGEDLDKKHSVRAIFGNGLRPDIWNRVKERFNVPTIAEFYAATEGTSGSWNLSSNDFTAGAIGRNGALTKLILGASLAVVEVDHESQEPWRDPKTGLCRKVPHGQPGELLYAIDPNDPSDKFQGYFQNSKATESKIIRDVLRKGDAFFRTGDMVRWDLEGRWYFSDRLGDTFRWKSENVSTSAVGLHPTGLDGSALIGGK

SEQ ID NO: 23130 - protein, 137 aa, A.fumigatus
AGFNRRPPPRGEDQAGVSTSMAGQEGVASVFSPMARTLDDLTYFTRAIIGMQPWKYDNTVHPIAWRSSEEKEAQTKQLRIGLMSSDGMVANIHTYTKLTVPRSRPSDARHQPCHCHHCRCTHSCRPHSLRDHTPGIR

SEQ ID NO: 23131 - protein, 204 aa, A.fumigatus
  UNSURE (166): Identity of amino acid sequences at the above locations are unknown.
PSPGVVPPTPAINRAIATTVAALTAAGHTVSEITPPASADPFTGLTLASQLLNSDGCTTFNSHRYSFEPSDPGAEQLTRIARLPRPLRYLYYLYVRYIRRDTKWAALIRSFEHKSAAEQWKLVARREAFRATWHAWWDAEPQQYDFILCPVTPRLVFRTKANRQAXSSCGVSFRGKRVNTLRGVYTFSHLNRKKDALLAPFKPV

SEQ ID NO: 23132 - protein, 110 aa, A.fumigatus
YARPLTAPAIYFTKLTLLLLYLRLFLLNRPVKFGIWGGIVFCTIYYTAAFFLNLFLRDLHALSKLAYSVGVFSVVSDVYIITLPLLAIVQLRLSRAKKWRVAAVFLTGLL

SEQ ID NO: 23133 - protein, 71 aa, A.fumigatus
SILNLLVDYTFFNNYRLFYYKHSLSEQPGPSIQRARRPLIRLISWAKPTFTTHGTLTKHAWLLLASNNSCQ

SEQ ID NO: 23134 - protein, 142 aa, A.fumigatus
VRCICSCSFWVEVFTDWRLSFDMTSIEEGGIVFHPKENNNEDVKVAYKEYGDMKMESTAQDLAESIADDVKQNMTAALESVSETLSQAMANANRLCLPAAGTFFMKDPVFNEGGDLLVKLEYDGYVLSNVYLSVLCHSNLTV

SEQ ID NO: 23135 - protein, 153 aa, A.fumigatus
LPLIPCLSNRPILSSFRTISSVSTSSVNMMFTKAFFAAAFATLSTALPHVIQRSGNSSASGGGVQIVNNLSQTVYAWSVADSVSDMHTLSADGGSYSEDWRTNSNGGGVSIKLSTKPDQSDVLQFEYTQSGDTIYWDMSCIDMGTDSEFSKFG

SEQ ID NO: 23136 - protein, 96 aa, A.fumigatus
STLGLVRLDSPFLFPRNIQHQKTDSVQFADYPIALWNLILAASAAVYCDKAGRRPLFLTSVAGMLCSYVVVMGLSAGFANTKQSSLGIAVIPLLFM

SEQ ID NO: 23137 - protein, 63 aa, A.fumigatus
PSPHSYFGFYDMAFTPLPIAYTVEILPFTIRSKGMALFTSTATMGNAFNQFVNPIALKAISWR

SEQ ID NO: 23138 - protein, 84 aa, A.fumigatus
WPCTDSCMLSYAVYIAILLFYFCFIFFMFHETKRLSAEDAARVFDYNRKGAVMDNAGDDVEQGPVSPDNEKQESRSVVEVKDRV

SEQ ID NO: 23139 - protein, 129 aa, A.fumigatus
YDRYMHMSTTNIIIGQRGNDKASLALSSFIHALFELECYAVARLVVKENKPPVMVLLAPSIEPDYECLLEVQLPFAEDVRTYRFPPLDKVITVSGKVVTEHRNLPNKDLLDAMSEYVDSMELVDTDETG

SEQ ID NO: 23140 - protein, 190 aa, A.fumigatus
PRAEDVSRPGNEGPIAWMPTIPSKRKQMVGGGVGMKGIISAMAVNPVGDGILAAGTFSRQIGLYGANGIGESLGTFSITKTDAHRHIGGAGVTQLLWSPCGRYLYIAERKSDGVLIFDIRVTGQLLGWLEGRRAFTNQRMKIDVVPVAQGESHEIWAGGTDGYMRVWRNPTHTAGPQKCDWEWKVHDGKQ

SEQ ID NO: 23141 - protein, 123 aa, A.fumigatus
IFEEHDFFTPQPRIADAYFLRLILHDWNDADCTRIVRQISSALRPGARLLIMDAVLPEPGEGSLQSERRLRRSDIGMYTLFSAKERSLAQMRRLVEDCDSRLRFEKLYTPPGSHASMLSWICE

SEQ ID NO: 23142 - protein, 318 aa, A.fumigatus
RGSFEPRGEDPWSFLPRTLYNEFSFFFNIYFLLVALSQIIPVLRIGYMSSYIAPLAFVVSISLGKEALDDIGRRRRDAEANSEEFTVLSFDKPVGRRAFATPANNYSDSDEVFEITKKSRDLKVGDVLKVRKNQRLPADVVILKTISNDSVTARRSSSAEVTADLMRPDPESVQPSEVEPSSSAAADEIGTSSASDTFIRTDQLDGETDWKLRLPSVLSQSLRLRDFTRLKVTASAPDKRVNEFLGTIELGSQSGFYDPLVDKAQTGGEASSEDRQANSAPLTIDNTAWANTVLASNTITYAVISLHHGAGRIRGGVS

SEQ ID NO: 23143 - protein, 68 aa, A.fumigatus
  UNSURE (17): Identity of amino acid sequences at the above locations are unknown.
VSHSIFLNIYSMEGLIXSRLLFSRETGYLVIPGFLSPEDITSLLTETNKLLDDFPLRIPPTHQIHHWR

SEQ ID NO: 23144 - protein, 254 aa, A.fumigatus
  UNSURE (201): Identity of amino acid sequences at the above locations are unknown.
ESHPLTKFTTGDDETDKNNTHVGDDYFLTSGDKIRFFFEPEAFSSTLDPATGKPTLLKPKQQAINKIGHALHSLSSPFEKVSLSARNAAIAKSLGFVDPRVLQSMVICKQPGIGGAVPPHRDSEFLYTRPPSAVGWWFALQDAGPGNATLGMWKGSHRQGIKRRFVRKVGENGKVLGTEFVENDGPKMPRGAEGDGQDPDXGPDVKDEKFEILDIMAGSLVLIHGNVLHMSEKKYSPRNPVAYSFHVLEGADRM

SEQ ID NO: 23145 - protein, 288 aa, A.fumigatus
RSDEPSEQDLKPRPGTSALFDSFAYLGSGETKWSHTLVGWTGDVETIQDVSVPLQHIPVSSGARLPPALNGVAVPLNKAAGPVAVDSKQRPPSHPLLERFRVSQEDRARLDAQLSSGRYGEIAPVWLSDESEEPEESSIFLEDQGRWRRYAEKELYPLLHYKQHGPTDGRSERKWWGDYVRMNRLFADRIIEEYQEGDIVWIHDYHLFLLPSLLRQRIPNIYIGFFLHAPFPSSEFMRCLAKRKEVLTGVLGANMIGFQTFSYSRHFSSCCTRVLGFDSNNAGVDAYG

SEQ ID NO: 23146 - protein, 259 aa, A.fumigatus
APHVRTFLAYGPKHRDSWRFRPLPDDGKLDIQEWNKQLVQLASAVGPTVLGSLASATCTGTTVAAKIRSRNCAESPSRSIQRMLNSSKHWQNYDVFKRQKDSTFVKSRAAVEELASRYMQIVADTRLAQDESKEAAQKLLFIEMTEIALWGNATDLSLLANLTLEDLQNLQGREAIQKSQRNIVDNDTDDVWAYLQRTAGQTRRQIDIILDNAGFEFFTDVLYAAYLLEAGIATSIRLHTKEFPWFVFHHRGPKDPRYA

SEQ ID NO: 23147 - protein, 125 aa, A.fumigatus
LANIVAITFLQHTDPTLPHYQPEAWDFTRGAAATIDRDFGFVGRHIFHGIIETHVLHHYVSTIPFYHADEASEAIQKVMGPHYRSEAHTGWTGFLKALWTSARTCQWVEPTEGASSPRGWKEPRS

SEQ ID NO: 23148 - protein, 207 aa, A.fumigatus
WGFIAGPSTPGEDWKISHGKHHKATGNIARDMVFVPKTREEYATRIGRAAHELSELMEETPILTATNLVLQQLFGWPMYLLTNVTGHNNHERQPEGRGKGKRNGYFGGVNHFNPSSPLYEAKDAKLIVLSDLGLFLVGSLLYYIGSTYGWLNLLVWYGIPYLWVNHWLGKLLSSTFLAAWNRFLLTCKYSCHHFPSAHRPHPPPLPA

SEQ ID NO: 23149 - protein, 170 aa, A.fumigatus
EDVTIFMISGNPGLIGYYHTFLSLLADKLGSRGAPSTIQSRSHTCEFQIYGHSLGGFELEQHEDLDGRKRLFDLEDQICYVQEKLDEFLAGGETKQKVILVGHSVGAYIAMEILRRHRERSDAKVRAGADKADFDIVGGIMLFPTVVDIAKSPSGQKLTVSFLPRFTVQY

SEQ ID NO: 23150 - protein, 93 aa, A.fumigatus
CVKGASNGRRHMASDEMQTITSDKWGDDVWGVSTASEPLTRLFFYFGRNDHWVAERTRDEIIDLRGRVEGGPTMSVCELGLPHAFCLSEWFSG

SEQ ID NO: 23151 - protein, 109 aa, A.fumigatus
SKLYAIRAILTQELFNAPFSDSLKMLFIGTATTPNNLHIRNQRQHALKPIRKDRNIPPIKSLTIIQLIMALQARIPLDQPNSPAHILRDIAQRRSNPQYSHSSEDPTAL

SEQ ID NO: 23152 - protein, 75 aa, A.fumigatus
INALEFECMPKSAFYWIVNPSHPWNLRLISFDFMFPYLHYRQSVDNGLTSLYFTGISAFYPSVFTTGLDGPALKK

SEQ ID NO: 23153 - protein, 168 aa, A.fumigatus
QLTADLTDCLTFLDKFIKETQRRHNPSYQPGRTAKVDMILPGGYKLPQDSVVIGALHHLHNNPDVWSNPARFDPDRWDTEEVKNRHKTAYIPFATGPRMCIGFNFALQEVKVFLPKLVYRYKFTRENDGHIEYDPMFQLIRPTNLYVRAERRVKWPPRSDNAVPSPSL

SEQ ID NO: 23154 - protein, 108 aa, A.fumigatus
KQERWCPSASPHIWHSPVLHDGMWEDEAHAMINNIITPITPIIGLNPTNICSSLSHEGLVLNIKGNQGLHLRCSVVHLSKNNQSTPKYLLINNSALAHTEYSADTSIL

SEQ ID NO: 23155 - protein, 149 aa, A.fumigatus
PNAGHSQSWSVPAVPPRPPLEAQQFGNGAPSHYRFQYSACTGRRRALLIGINYIGQPNQLRGCINDVTNMSTLLHERYGYRREDMVILTDDQKNPLSIPTKANILRAMQWLVKDAQPNDSLFLHFSGGWLWVCTLRGDTEVLRAWRANS

SEQ ID NO: 23156 - protein, 88 aa, A.fumigatus
QDVWMLQSSSRSDHLIERIPQKQTSKPTSDILFFPLHDIRNKARRRKGLLILETLAYELQTNRGSLIPLMTILGPLARINLAPGAIPP

SEQ ID NO: 23157 - protein, 195 aa, A.fumigatus
LGVTRVDNTINNDLGAARIINGTTVEVEMPSEQLDIDSGYDAALRNLRDRLEVPPPPVSENHQQEDYYRAVRTCMVSIWMVANVILAMSVSEIYGVDSGGTNVYLGIILWSVAVLALIRAVGSTTYAILLVVQKIVEGKTKFDAGNIVNSNAATSSYVSSRSTAQYGGGTSFKDKVTEAGWTLKRTAGKAMFWKK

SEQ ID NO: 23158 - protein, 63 aa, A.fumigatus
GGYRPRSEVDAREWAKYRHERYEGAPIGLQLVGKRFKDEETLAAAGLVSDIVQGKEEDIRSRL

SEQ ID NO: 23159 - protein, 233 aa, A.fumigatus
  UNSURE (72),(76),(80),(98): Identity of amino acid sequences at the above locations are unknown.
DKTVPIVFLPVWVLVTQEPIKLRSKLLNIFLGGRETPASLLSWTVLMLARHRAEFHKLRQTIVDEFGTYDQXRNIXFAAXKSCQYLQYCLNETLRLFXVVPGNRRSATRDTTLPRGGGSDGTQPIYIRKGQTVVYNVHILHRRKDIWGPDAEEFKPSRWVDRKVGWDYVPFNGGPRICIGQQFALTEAGYVLVRLLQRFDAIEDVQPHLEIRHSLNLTSAPADNVTVRLREAA

SEQ ID NO: 23160 - protein, 162 aa, A.fumigatus
PLNVTDSDLTADMVQPPAERDGATEMTLSLIGFESISIVRKVSFIPPRHRQVRTTSSASVTELSLPKREALAEQLQSRLETRYLAYCDPADPFLFVSATVARLIIARVWLMVHYPCKRADSKGVSAALLQASLQDKIFHLAIEILERSCSVLCNLSIAHWAW

SEQ ID NO: 23161 - protein, 237 aa, A.fumigatus
DEHRRDSAESRPGEQMSRIRRSLHRTLRDSHHGQQGHNARGKKQRDSMSSEVVPEDEQDTKEGEGLSRKAPQFTVHGKKASIVTFGSEWQNMTPEERLRLRKPTPSEEPRASDPAILSGGDSNGTEPINPGISQSLRSGSTATRISILDPVESEGCRDGNPTANLEDTMVKSDPNIDLSSRLPTSDGAGPSTAAFPGSSVLPKDQPSSPSTSADEAAVDEYTIQKLQSSPPEQAVHA

SEQ ID NO: 23162 - protein, 94 aa, A.fumigatus
  UNSURE (82): Identity of amino acid sequences at the above locations are unknown.
WRWAVHRGISGIIGIAQRSAVVPFDIRRRGSCRRIYDPKTAVEPTRASCTCIKSILKTITSIYDFLPDSFQFFLSLCFGVDXRRLKNSFRPQYA

SEQ ID NO: 23163 - protein, 80 aa, A.fumigatus
PRRDHHGRILSISEWMGYFLLYESMLDTVLYARDRYLAPGGKIFPDKATMYLAAIEDGEYKDDKIGCESSLAYVRLLKEY

SEQ ID NO: 23164 - protein, 161 aa, A.fumigatus
LGIVWDNVYGFDYSPMKEIALTEPLVDTVELKALVTDPCSIITFDLYTVTKADLSFKVPFSLPVKRSDFIHAIIAWFDIDFTACHKPISFSTGPHAKYTHWKQTVFYLRDVLTVEEEECVSGILENKPNDKNPRDLDIQISYKLETTDKLRYDEGSCFYRM

SEQ ID NO: 23165 - protein, 82 aa, A.fumigatus
RLPVVENGIPVDVILRSARYAYDNTPDCESRLRAHYLAMIIRARHIFKSSGTMQFDMEMGHRFYFDLFVVMCNHMDDLEGLE

SEQ ID NO: 23166 - protein, 65 aa, A.fumigatus
SNRFLLSDTHSWFLRGGPVCGLSNPWFYHFLILLACRVACFVYSDVTFLKAVFHLRGWKVRDSRD

SEQ ID NO: 23167 - protein, 93 aa, A.fumigatus
SSYERVKSGLWAGSEWVAWGTQNREAPVRKIEPGHWELKSLDGLANMYVAMAAFLGAGYLGLEHKIPLTVKDCLCMLPLLSSSFHYMKLPDGY

SEQ ID NO: 23168 - protein, 77 aa, A.fumigatus
ADDAATLTDAQREDLGITTRLPNTLAQSLDALESDHALQELLGPFLVRSYVIVKRAESKKLAAMGDEERRKWLIERY

SEQ ID NO: 23169 - protein, 285 aa, A.fumigatus
GVRFLPGPWCRQALMQTTLFETFRKQDTSSPLAKRQMKIFFFSLLGMTLWQFLPEYVFPFTSSLAFLCWVAPRNPVANFIGSGMGGMGFLNLSLDWSNINWNGSSILLTPWWTQVVLFLAFAFNCWVLLPAAKWGNLGSYKHGLMSNSLLTTNGTKYPILDLLTPDFRLNQTAYEEIGPMYMGLQNVWATFFEYAKVTASVAWVATYGYSQVKGNLLKMFRSRNKTSQTKGEGINHQYTDRLNVLQRSYQEVPLWCHLVMFMAGFIILIVSIACGSSRTGRKDNA

SEQ ID NO: 23170 - protein, 159 aa, A.fumigatus
WLNERRQTELGAYYNQRLFSSARIAIILKQLAQIVQNASNNPGEAIGRIDFMTDDQRSLLPDPTSDLHWSNFRGAIHDIFAQNAEKHPDKLCVVETKSEQSPHREFTYRQINEASNILGHHLVRAGIERGDVVMVYAYRGVDLVVAVMGILKAGATFSV

SEQ ID NO: 23171 - protein, 191 aa, A.fumigatus
TQYTREFRTGYVEAAIDYFCLLCLNADLPGSLGKSQASVCHEALREFVLETRDFAKLLGDIRSDGTRIKGLIEQRMSLIKLVDQEEFLKTITIQAAAIADDKGLVTDAVLLYHLAEDYDRVIDIINRALSDAVALELGSPGMKLQPLRPRTDLQQHANDEHEEAVEPGSSLSLTAVDDPVVLAKNMIGLYN

SEQ ID NO: 23172 - protein, 79 aa, A.fumigatus
AMPDTVDPLADTAFYLLLSGVIIFNSLNHFVIRKESVDYDTLLSYNIFAGIYMALYHRWKTTAGQVVPNQPQRNQSQHS

SEQ ID NO: 23173 - protein, 135 aa, A.fumigatus
ITSLFAKSRLITTLCCLTTSLLASTWPSTIDGKPLPDKWFQISLNGTSLNTRDVAEIAERTPITVCERTVIAVGGCVGIASYVVTFARSIATTIKDLSNGGNCNAMHGTFEGLKWTYYSTGRNCDTTAQHDTIAG

SEQ ID NO: 23174 - protein, 269 aa, A.fumigatus
VVNRERLNVSELERQFERIYQIAQRAPPVGVLTVANRDLWADARKKLLAANPANEQALRDIESSGFVVCLDDATPVTLEERAHQYWHGDGTNRWFDKPLQFIINDNGTAGFMGEHSMMDGSPTHRLNDHLNNLIFNNKIDLSEKPVRSNLPDPRPIEFHLNSEVLEAIDAASKEHRQQMSAHELKVQSYQGYGKGLIKKFKCSPDAYVQMIIQLAYFKMYGKNRPTYESASTRKFQEGRTDTIRSVSDESVAFCKAHADPSVPRQEVVR

SEQ ID NO: 23175 - protein, 62 aa, A.fumigatus
QELVRSTGSTAPVSPAEGADNPQKNPAKEDENIVVVRKNQFFKGALSCQPGASQRLRAGEAV

SEQ ID NO: 23176 - protein, 189 aa, A.fumigatus
  UNSURE (166),(182),(189): Identity of amino acid sequences at the above locations are unknown.
PHRDLLPREHRHHLHHDRPDGRPAVRQHPRRRNRRLRPLVDRRLPVHPRRHRHPLRPAQSPTQQLRAHPPRHFTPRHCRPHLRRRRRRHLHFYRAQPPPPGPRHHRRIPPRRRGHIPRPRLRRRHPLPALLRSAALSAEGMAGYDPLRALLDKAASRCKILGGCVXKSFPAYARGTLLGAQXGWPRCRX

SEQ ID NO: 23177 - protein, 309 aa, A.fumigatus
  UNSURE (284),(299),(307): Identity of amino acid sequences at the above locations are unknown.
CHLANFCFALHRRSKRFSSTSAYSTCLINILIDIMPAPPAYPPARALFNFSPQWFVMPQGTAIISVILHQLHYQFGALRILAKIVWIYTIVLLAMTLFLYILRLIRYPREVCDELRHNLIETSCLASIVITYTTIVQMVALQYGSTHGVAIGVYVLWWIAAFLSTLAVIGIPFVQLKVQPSSFERIPPAILLPVIAALTCAAGGGVICTSTALSPRLQVPVIIVAYLLVGAGISLALGFDAVILFQHFSDQQPSPQKVWQDMILCGPFWTRRLRAARFWEGACXRVFPHMPGGRCLAHXAVGPDAAXKP

SEQ ID NO: 23178 - protein, 69 aa, A.fumigatus
EHYGTFDRPGFTVFTAIDHKIQVRRAIKGFVADNPEYERLLPHVKGELDTFYPCWTGTIDVWNWWLISV

SEQ ID NO: 23179 - protein, 104 aa, A.fumigatus
EDMGGKSATKAAYFDKLKSLLDEYKTVFIVGVDNVSSQQMHEIRLALRGQAVVLMGKNTMVRLIVLVLLFLQPLTIKSRFAVPSRASSPTTRSTSVCFLTSRVS

SEQ ID NO: 23180 - protein, 145 aa, A.fumigatus
KTRTYVAIKSVNLSKLNKKLKDNLSSEIHILKGLYHPHIVALIDCHETTSHIHLVMEYCALGDLSLFIKRRDTLGDHRYTRDMIAKYPNPPGGALNEVVVRHFLNQLASALKFLRDRNLIHRDIKPQNLLLCPSPSSYRNGVTQV

SEQ ID NO: 23181 - protein, 302 aa, A.fumigatus
DVAGNAVDLLPEEPRMIIGLHWADTSSNLIVVASDSKISELAIWDDSLRPDEFPSPQVVDGSVYDLSWLGDKQAYASGHGVVYQCDVDSSIRIAETFSWGESDRVWSFVRCANAGSSPVAVAASSDTAAFWVPTHDMHLDDAHQGDITSIEIRPHPEPCEKTQHGHSVVLASASTDGAIKIWQIDLEAKRFICLHRLVLGQSMPTLAACFSPDGYAVAAASRDRLFIWNAERGGTAMATWVVPGSDEAKSDGEADHAANGQNGAVGLLPDRSLSWDTDGKKLAFGFAKQVCLLLLVNCLTIY

SEQ ID NO: 23182 - protein, 98 aa, A.fumigatus
TNCLTEVVFEDALEQARRLDQLFEEKGQLAGPLHGIPVTLKDQFNIKKVDTTLGYVGRSFAPASEDAVLVEMLKGMGAVIIAKTNLPQSIMVCIPLGP

SEQ ID NO: 23183 - protein, 252 aa, A.fumigatus
CQMARSSFTAFLVAFTTVVNTISPSYAFNSLLHRASDSCPASYEQCNNSNLPSSFCCPSTSTCVSLDNDSSAICCPSGQSCAFIEPITCDVSQQNATLHPKAVVKTIRLGDTLPKCGDSCCPFGYSCQSNSICAMSTSTTSIATNSVSSLTTTASSIPSAPSTESMTSMTSTVPTAATSSSKVTDSASSTDGVHPTIITASDPADPSAFGAASSCHGTTATMTDACPSFPTKAIIAGFFPGVFYHREAKDQR

SEQ ID NO: 23184 - protein, 80 aa, A.fumigatus
RHAPYLRYTNRIVGRGTELLLDKENATGHACNSTTLQTVNTKFMLMQLPNTLLFDFSAMQFPQHSQRGTRKIKNVALWSQ

SEQ ID NO: 23185 - protein, 179 aa, A.fumigatus
GGGRRSSSRRLIHQRRCSQATKALYERELAKGVSENEEIFTGEESVSTGAQPQWASKYRPRKPRYFNRVQMGYEWNKYNQTHYDHDNPPPKVVQGYKFNIFYPDLIDKTKAPTYRIEREHGRKRGQSFAAAGEEDTCLIRFMAGPPYEDIAFRIVDKEWDYSAKRERGFKSTFDKAYPV

SEQ ID NO: 23186 - protein, 65 aa, A.fumigatus
PGNAISMIGAHTDSPVLRVKPVSNKRGEGYMQVGVETYGGGIWHTCPFTDFYPYMAHSKLMVVRV

SEQ ID NO: 23187 - protein, 157 aa, A.fumigatus
RSGPGKGNDFSYSTTQPNNEEQIGATLGGGIGRLLGHVGYAADTVLSMRVVVVDQSGVARAVEASPDVNSDLFWGLRGSGHLFGVVVEATFRAYPWTHDTWHSCLVFPPSDAGLVAEAVEKVHYQGGMQGRLVFCAPNKQVSLSRTLYWNPLADFEN

SEQ ID NO: 23188 - protein, 73 aa, A.fumigatus
PIVLLQMWYMGSHEEAASKFQPLLELPSMTDHPLNFVGRRIPYPNLNDSSDRICGYGGRKNLAAFGLKIFTTR

SEQ ID NO: 23189 - protein, 140 aa, A.fumigatus
ADMCPQVSYAVQNQRPFVVRGGGHSNGFSTVDSPGIIIDLSRMRKVTVDVERQVVVAQGGATMGDGVKAASSVGMAVATGTCNEVGLVREMTSPIPPRNLIMRNRSALPLEEGSGAFLGTLDTPQTPCSRCGSLWWTRAE

SEQ ID NO: 23190 - protein, 115 aa, A.fumigatus
FDPRPPGFSCPSASKIQSYCDAADPYCCNGNDANTHQGYGTEYGQAALTFVKSKLSSSGSGGGSGGGSGGSGGSGGSGGTVAHYGQCGGQGWTGATSCQSPYTCTVISQWYSQCL

SEQ ID NO: 23191 - protein, 250 aa, A.fumigatus
FHRGRALSYQMINATNGGPSYTWSSIALTDAFQKAEMPMPLVVADGRYPGELLISSNATVYEFNPWEFGTFDPTVFGFAPLEYLGTKFNGGSVPSNESCVRGFDNVGFVMGTSSTLFNQFLLQINSTALPDWLKSVFTDILKDIGENDEDIAQYAPNPFYHFSNTTNPSAAELELDLVDGGEDLQNIPLHPLIQPERHVDVIFAVDSSADTTYSWPNGSALVATYERYLKFLRHRQRVLPFLPFPDQNNL

SEQ ID NO: 23192 - protein, 93 aa, A.fumigatus
RQLGGLLHSATYLSGLSGGSWLVGSIYINNFTTISALQTHQKGTVWQFQNSIFEGPDGGSIQILDSATYYRDISNAVSGKSDAGYPTSITDYW

SEQ ID NO: 23193 - protein, 124 aa, A.fumigatus
FDYVAKLELNSYNFHSPLADRLGCYLHPYAALINHSCDYNSVVGSDGDALYVKALRPIRKGEEILVSYIDATNPYKIRQTELLERYYFKCRCPQFGKSTNTREERFLREPHDLSVLEKAEKRRH

SEQ ID NO: 23194 - protein, 162 aa, A.fumigatus
SFQGPCVKTAFSVVQRNSTYPSYNSGQDASIISQFFPPGSDQTINFPTFLNILSSLLAPLSSRQELMNALAAFDDDDSGQIDVAELRDTLLHTASEDGQLPLTEKDINEVLGGFTGRRVFSSKAGKLSTGGKRGEVFRYQEFIDSAIGGSASGRRDPDTVAR

SEQ ID NO: 23195 - protein, 72 aa, A.fumigatus
QTQLSDYLPNILSFSSSHPNEAFYTPHHPTTLPSLIHKITSSSQASNHAERAITSASPDHPSVFFGIAGSLT

SEQ ID NO: 23196 - protein, 156 aa, A.fumigatus
KGDNLSKPRPSVSLLWHSWIFNIRLLQQFAISHLWLLITHLIAIFEPATNMNLLDLPTEVLVMIAEALQTAHDINTLARTSRTLYSCINYVLYQSDVQNGNGKALIWAARRNKPATAQKSLQAGVKKLKKMASPAPDALVKGRPRNHDAVVIGQKC

SEQ ID NO: 23197 - protein, 75 aa, A.fumigatus
WQTGFGLVVIMTTDGGKRVLILYHYDILVRGLALAVTLSSSSSISDYGVSEKLGVLIPCYQPYIFLLYLSRGNGR

SEQ ID NO: 23198 - protein, 182 aa, A.fumigatus
PARSALGLLDMLAQSLPPSQVVVPLLHALGQYFNNSNPDYRRAGIMALGMCVEGAPDFISTQMQDIFPMVLQLLADPEPKVRQASLHAVARLADDLAEDLSAEHEKLMPLLFKNLASAMQEYKGEEDGPTIDIMKAGISAIDAVVDGLDEKDVAPYQGELVPILHKLFKHPHVIRQGWKVCV

SEQ ID NO: 23199 - protein, 271 aa, A.fumigatus
LQSAYTIWDFLNVASIHNSSTTTPPPRSRELFLLANIEQYNLAYNTSEPIRAVAGSTLAGEVLQGLNETIASKGKSKLNVQFGSYGTFLSYFGLAQLPAATVDFTGIPDYASSMAWELVTNSTLDEFPPASEISVRFIFHNGTISSSSTPAEYPLYGQSSVTIPWSDFVTQTEKIAITDDEQWCKACGNTDGACAAYTVSSSGSESSSAGLSSSKDGVSRPVAGVIGAMVTLAVILGLEAIFLLVGGFRITKKRSAVSGVETTTVEGPKKV

SEQ ID NO: 23200 - protein, 123 aa, A.fumigatus
  UNSURE (9): Identity of amino acid sequences at the above locations are unknown.
ERHAYFLGXFFPPPFSKPMGMDDSIIEDALTFRGFRWCEDPEARSTSLVSISPSNMHFGYGRQACPGRFFAANTNKAILGRLIADYEFKFEGDNNKRPRNLTLGEQIMPNMHTKILLKKRAFV

SEQ ID NO: 23201 - protein, 86 aa, A.fumigatus
PPHYEDWLRPQEPVDITAILLVKSLTHHSKTQHNNLTHLQWHTRQEETHRFIFAQYSATFSRSKYSPIGIPQPTSNHWCIWNSRGT

SEQ ID NO: 23202 - protein, 131 aa, A.fumigatus
SLYLHRDVNTNTLSTSDHFAHVDDDHQTDIARHRTLVSGILLERVASSMFVLGSYPSRSQERQTRRITSLARDPELPQLSSQASLGRNSKFYNLTPEDREALGGIEYRSLRLLLKITLGESKLEINSVQRT

SEQ ID NO: 23203 - protein, 214 aa, A.fumigatus
  UNSURE (12),(24),(41),(45): Identity of amino acid sequences at the above locations are unknown.
DPRNEQIFGSRXTSSPSPPGQLNXMLNPKSLAAFQALGGLXGLEXGCGTDLTSGLSEDEALLDGTVDFQEATQNDQKLSKQISHNAPVAPAPAPELGGGSRFQDRIRVFSQNKLPARKSTGFLKLLWFAYNDKIIILLTIAAIVSLSLGIYETVDEGHGVDWIEGVAICVAILIVTVVTAVNDLQKERQFAKLNKRVGGMVSALLSICSNHVIE

SEQ ID NO: 23204 - protein, 144 aa, A.fumigatus
NSDREVKAVRSGKVAMISVFDITVGDVLHLEPGDSVPADGILISGHGIKCDESSATGESDAMKKTNGHEVWQRIVNGTATKKLDPFMISGSKVLEGVRTYLVTSVGPDSSYGRILLSLQESNDPTPLQVNLGTLANCIGWISSK

SEQ ID NO: 23205 - protein, 227 aa, A.fumigatus
  UNSURE (163): Identity of amino acid sequences at the above locations are unknown.
GELGKGDFQLYPAGVFSWQHDMRIYNKTDTGMILSLFNNANTPTETVAASTGLSYAVDLVNRTAKTLRTLSDSKDVIHSVSQGNYQQLSAWGHVVLGYGSIAKLKEFDANNKPVLTAQFGTDNEVASYRGYKCAWKATPFWAPAIVVRRVSDDSAQVFMSWNXATEYDNWAVMAADAPDSVRTSIVATFKRTGFETSGTVRGLKTRYLQVVARRGDIPLGMSPIVSL

SEQ ID NO: 23206 - protein, 217 aa, A.fumigatus
RPTWDLDMAPSTFSTIPTGEIYTVTLQGNFVTPDHSVPESFIDLHESHISDRNTLLVTAYNVTQQSLTSIGGTPEDYMLDSLFFEIDIATNEIVHSWSALEHVDQIALTDSKQGIDIDHGTHEQPWDAYHINSVELFDEGYLVSLRHYWSGYYVHGNGTVMWQFSVFPFPPSPSFFWGMLDTDETRANWARVTFNYTRPGSSPGSTTCASTTRQIPA

SEQ ID NO: 23207 - protein, 192 aa, A.fumigatus
  UNSURE (3): Identity of amino acid sequences at the above locations are unknown.
PGXSMSTPVEEHPAPRYIDEKKKERLDDVDVSASDDGTYVHDGSAVSNHNHLRVDTSYDDTQRLPLRSPSAARERSLRLEDDLALLEAERVASRSTHEEMEKGSKAESISRIRSHRSRNVDEFDEATNPLHEKAAVYNPPENPNTKISKFIKKVHESSFIVRYITYIVPLVVILLIPLLVGALAFPDANVGG

SEQ ID NO: 23208 - protein, 172 aa, A.fumigatus
PDRDIEEVMPLTEEQKQHWLEHGFIKIPQCFTKQDADNWTASIWARLGISPTDKSTWNTERVNMPGHTVVDVKDFAPKAWDAICELVGGEERVTDWCKGWRDSWIINLGKPEYKPDDPLDFRTLDNWHNDGDFFTHFLDSGEQALLVIPLFSDIRSKGGGTVLCTDGIGLVA

SEQ ID NO: 23209 - protein, 157 aa, A.fumigatus
MRGSSWILMNQSATPENLRKSFKVTDRFFPRDVITGLLHQIPKIFAHNKKPEPALLPTLNAALSALQATGGKIICAVATLPTWGPGALVRREDPKVHGTDAERKLFTTENAAWRSTASKLAGAGIGVHMFNPAPNGDLYGTLLRSVSLFCLGNEVSH

SEQ ID NO: 23210 - protein, 95 aa, A.fumigatus
SQLHQDTDPQALSKFTVPVIQQLRQAEMTVKVGINGFGRIGRIVFRNSFSHDQLQVVAVNDPFTNPKYGIRSHPSLTKFSQFPNGLNKGIGPISK

SEQ ID NO: 23211 - protein, 278 aa, A.fumigatus
VLLVNQELGGTGVAVVDRLGQLHRIRQNAVAHIVRQILGGGDLNDLLVTALDGAVTLEQVDDVTVVVTEKLDFDVLGAVEETLDEDGAVTKRRAGLGGSTLKGVPQIGLIADDTHTTATTAEGSLDDDGEAIGVGEGLDLLVALHWTRSTGDHGDAALDGQLTGRDLVAEGFDGLRGGAHKDNTSILDLASKLSVLRQEAVTGVNQVHTMLLSNLDDLINGQVGRNGGILTAMTDHVGLVGLLAVHGQTILIRVDGDCLERKFVGGTEDTDGNFTTVG

SEQ ID NO: 23212 - protein, 278 aa, A.fumigatus
ANRGEIPIRIFRTAHELSLQTVAIYSYEDRLSMHRQKADEAYMIGHRGQYTPVAAYLAIDEIVKIAQEHGVHLIHPGYGFLSENAEFARKVENAGIVFVGPTPETIEALGDKVSARQLAIKCGVPVVPGTPGPVERYEEVKAFTDTYGFPIIIKAAFGGGGRGMRVVRDQADLRDAFERATSEARSAFGNGTVFVERFLDRPKHIEVQLLGDNHGNVIHLFERDCSVQRRHQKVVEIAPAKDLPNDVRDRILADAVKLAKTVNYRNAGTAEFLVDQQN

SEQ ID NO: 23213 - protein, 182 aa, A.fumigatus
FTPVTASCLRTLSLLARSRMLVLSLWAPPRRPSKPSATRSLPVNWPSSAASPWSPVLLVQWSATRRSRPSPTPMASPSSSRLPSAVVAVVCVSSAIRPICGTPLSVLPPRPALRLVTAPSSSSVSSTAPSTSKSSFSVTTTVTSSTCSSVTAPSSAVTRRSLRSPPPRICRTMCATAFWRMR

SEQ ID NO: 23214 - protein, 291 aa, A.fumigatus
DAQAKLNGELSLDNADLLFSYGKALYNVAVSKSDVLGSKVAGEPQAQTNDLPPSGSKSFAHVPGESIIKNAIASGVAKQEHSKDSKSSSGKTLNQAFFQFSGDENFDDSDSEAEEGDGGADGADDDDDDFANAFEVLDLARILYHKKLAAVEESCEEGKSAGLLPDVKYIKERLADTYDLQAEISLEGERFTDAVADLRTALDLRQSLFSMEDPSLAECHYKLSLALEFASVNNSSEGTTEGDSGRRGKVDEAMREEAATQMEKAIESCRARMAQVQKKTMMTVWRTVTQY

SEQ ID NO: 23215 - protein, 89 aa, A.fumigatus
VLFIILLLAWKLMGHSLVGLGYLKVFVPPEKILRWIEGKLNLLGRLPHYVSVDQKTYGRYGVLPTATAAVGGERPTPLSYLGTNQRLGP

SEQ ID NO: 23216 - protein, 280 aa, A.fumigatus
FIDGPEAPGEDRETELRNMELAEQERKRAQQEEDSQAPVPLKTNGDATSPAAEPNIGLEKKPQAGPVMRIVNGEIVLDAASLHVDRYADAARNAGDLEDVVESSLTRKINQATWGKRSKTESWDEEMTELFYRGLRMFGTDFMMISKLFPGRSRRQIKLKFNNEERRAPERIKETLLGPRETIDITTYSEMTNTVYDDPKVVQQELDEEKKRIEEQHAKEKQAQEDLLRNPDGTTGGDAAPGLDNASNVPVKGKRNNKRQAMRAMGGGTEEVIGTIDDLP

SEQ ID NO: 23217 - protein, 263 aa, A.fumigatus
PLNIVLGQFFDLLNIFNINGYPSETHAYLFNGDFVDRGSWSTEIALLLYAYKWLRPNRIFLNRGNHETDDMNKVYGFEGECKAKYNERLFKVFSESFSALPLATLIGSKYLVLHGGLFSDDKVTLDDIRKLNRHNQRQPGQQGLMMEMLWTDPQTEPGRGPSKRGVGLQFGPDVTKRFCEKNGLEAIIRSHEVRMEGYEVEHDGRCITVFSAPKYCDTTENKGAFINIGPELKLDFKVFEAVPHPDIRPMVNPVLSCLLKLQS

SEQ ID NO: 23218 - protein, 86 aa, A.fumigatus
  UNSURE (57): Identity of amino acid sequences at the above locations are unknown.
SFLPTMTVDSKPQLQRLAADADVDRMCRLLEEDGAFILKGLLPFDVVESFNRELDVXMAIPPPKGERLLADQSPPHFKYVPDVAPT

SEQ ID NO: 23219 - protein, 178 aa, A.fumigatus
CSGISPCTNCIKNNVECTFDASADKRRRGALKRKVNQLEEKEELLIQLVSILRESGTRRTIQLLNLIRSNASLSEIQLYIDTQLKSELEQTPELIEVCNEIQRFEPMGSRSWRRILDAQRAFVEPLFRVPAAPWTTVTADDEFVSHLISLWFTWVHPFYYWIDFHHRGRRIRAMRLGQ

SEQ ID NO: 23220 - protein, 196 aa, A.fumigatus
TGKMASRERSPPSTASTTTMRPPTTALLIYPVTLLVGSLFSILSPTARGSRQSRPARPASLAPSITTDVNLSPPNPVNYFARKDNIFNLYFVKVGWIWTTLAFLSLLVSQPAYTAPSAHQPRRLVQAALRYSVATLVWYLMTQWFFGPPIIDRSFVITGGKCERVVAETSGNPGGGCCAGGICFCGSGKVVYGGSL

SEQ ID NO: 23221 - protein, 77 aa, A.fumigatus
  UNSURE (44),(75): Identity of amino acid sequences at the above locations are unknown.
LRAGNASALWRRRRAIPAVAVAQAGSVSAGLEKLFTAAACKAGXGSWTGGHDVSGHVFMLVLATSMLGFEAVGAXRA

SEQ ID NO: 23222 - protein, 146 aa, A.fumigatus
SPIQTRCSSEGTRSAEDFKPIDPSTSLEQALAGAVTDTQPPSTAETAQAGDKQEHNSSSTPTHDDKANTGESTEPARKKQKIGEENGMAKNGQTAGPATDNSTSNVTGNDEKKSGRSKKVKDTAKRTVHSDGIGSRTRSRTKAAAT

SEQ ID NO: 23223 - protein, 172 aa, A.fumigatus
NDALEDIDEFNPGFRSQSQQTMRMSFSSSRSRTVRNVPKQRAASAMSVRQTVNPGRVSPALSAPSQGSGLQVPDDGRQESTSRLSTILNTTIKGSFGRRGRPGYATSSVHEGSLHADSLHERDSEEDFRRMMEQDSDRLENVRACCDGKHDVSSLSRTSRYSPRVNRMHSHH

SEQ ID NO: 23224 - protein, 161 aa, A.fumigatus
  UNSURE (18): Identity of amino acid sequences at the above locations are unknown.
RRGMQCQCSIQVGEVVNXFFQFGLGVAYEYGLMGCPVDLRQSFFWYTHAAAQGEHQSELALSGCILTGSEGILQQSDTEAYLWARKAATAGLAKAEYAMGYFTEVGIGVAANLDDAKRWYWRAAGKSFRAFYQWSLCVKLTYLLYPTSSRFPQGSGASRGN

SEQ ID NO: 23225 - protein, 236 aa, A.fumigatus
TWAIRTMLSCGPLATRLVLSWSKDDSPRGIAAAQSLTVALSDLPRLCFLAVAFFSFEFIIFGCAALLPTYVRYAGFPLDVQFYALTVLNSMSFLGRVLPGLAADQLGRFNILLALVVMTLLVMGSVWLPFGSRGQATLYAVVAIFGFGSGGWLSLAPVCAGQLCQTEEYGRFYGTIYSVAAFGVLLTVPVGGELLQSTTPKVLIGFYSAVLMVGLVSVVMARWALLDWRWKWRVKL

SEQ ID NO: 23226 - protein, 101 aa, A.fumigatus
DPTRDAGLGTWWHLGYRLMHDISHPDQELGRIYWHNGNTGLQTRELCHTTGTGIWFSQHSAWDGILLKSLYTYLCIVTLSSLSYVSVLSGLTRSSMSNKIL

SEQ ID NO: 23227 - protein, 280 aa, A.fumigatus
MDRLSNTQNSSVSPRTPLHANQQPAVRAFPATEPDWYMSHKVYAPSQGTSGPIFVDDQTMSTWPLLADQQPSPSPSDRHTSHNGSPVAMSGSNAFHQRRISQGMDTALVNATSTVTHTFSGIPFAVTTESCTPEQVSTTAATAPVQWTVPHWYPLPPGAISQPPPVQFYPPAPPSPPSTSPVDPTMQAPHSQVDFSAYLPNYSGPSQYQVCENFDRVKSWKRVMSLQYTPDTTALNPRAERPEVANYADWKASLPSQISSFHSHGILESPVSISPSMLQN

SEQ ID NO: 23228 - protein, 163 aa, A.fumigatus
  UNSURE (157),(160): Identity of amino acid sequences at the above locations are unknown.
KKRRSGFGFKRSTAPTLTLRSIFLPSISPNSSTSFQVLSLYSLHLSSIFLCSYSVQIEAICRTKSTKAPSALTLVRNLHSFFYFLKIYSFFKKKGYHIYHNTIFTKKLSFAKTSIQAQPTPALPTMKAPTLRSVCFLEGITFGRNRPGHGSFVHQKXGRXINL

SEQ ID NO: 23229 - protein, 63 aa, A.fumigatus
SFKSEPTSPFFSLFFFNFVFYFASRLVFPPNSAPWLEKVSNVNALVMVFSQRAWKVHEYCAKK

SEQ ID NO: 23230 - protein, 147 aa, A.fumigatus
GGIPDLSTLVLKKSDPPTTPNWFLAQLYRQSTWVYLYRTIRPSKPSDKIAQVVDDGLSYLDQLPQDSGAFSIVLMPLFLLGCSAFLPRQRERIQKGFESLKAYSNLRNIEPAFKVVRRVWEIMDTKTEDSWDWEKIINDMNMDFLIT

SEQ ID NO: 23231 - protein, 225 aa, A.fumigatus
RLRSDLAQHFLMKANVTAIRRVRKTDNNRIARATGATIVNRVDDLQESDVGTRCGLFEIEKIGDEYFTFLRKCQEPKACTILLRGPSKDILNEIERNLQDAMSVARNVIFHPRLCPGGGAIEMAVSVKLSQLAKSIEGVQQWPYKAVADAMEVIPRTLAQNAGASPIRVLTRLRAKHVEGQHTWGLDGDSGNLVDMKEYGVWEPEAVKLQSIKTAVEVRPKTIPI

SEQ ID NO: 23232 - protein, 70 aa, A.fumigatus
CHCLTRKPSYCYTNKHETNTDKMNTTCSIVWFANVDLNGLIEIAKLVILAFFYRLKPQQNNMVILVRDIN

SEQ ID NO: 23233 - protein, 246 aa, A.fumigatus
TLKERWENRLPKPHVYRVSPKDRECIDRTFDPLREAGKLSPATGHTPSAYPVFVVWKTVTDQNGQTKEKGRVVIDLRGVNKEVVPDLYPIPIQEDIINMVRGCRYITVIDACRFFYQWPVKRSHRNRLAVVSHRGQEIFNVAIMGFINSVPYVQRQMDRLLNDLEFARTYVDDIIIASMTFDEHLNHLSTVLQRLQDIGIRLEPTKAFVGFPSVQLLGQRVDALGLSTPEEKLAAIRTLEFPRNLK

SEQ ID NO: 23234 - protein, 208 aa, A.fumigatus
ISIGGPIQIDVFVFYLFIRPSAFAVRPVMLSSTLYAGWLLSLAAPALCVVQEKLSAVPSGWTLIEDASESDTITLSIALARQNLDQLESKLTTLATPGNPEYGKWLDQSDIESLFPTASDDAVLQWLKAAGITQVSRQGSLVNFATTVGTANKLFDTKFSYYRNGASQKLRTTQYSIPDHLTESIDLIAPTVFFGSSPRGSKQKRCGR

SEQ ID NO: 23235 - protein, 72 aa, A.fumigatus
  UNSURE (62),(67),(68),(69),(70): Identity of amino acid sequences at the above locations are unknown.
LSKDNLTAGLDTMAISKVQPAILVFIHSVFWPYCSFLNKINKSLVINLSAYLSVFTTGLEDXSANKXXXXPS

SEQ ID NO: 23236 - protein, 135 aa, A.fumigatus
  UNSURE (84),(130): Identity of amino acid sequences at the above locations are unknown.
QVAADAIDIYVLGVQGLDEIVAWSTASVHGLPLASAVPGNTFDPVQLTHECKQISQAIIKAKGAMPLGIGAIISMICLSILGEXRHVLPISHFQKEYGCCFTLPLVLGTKGNSLNNSYPVNGGGMGWNPXVFPSL

SEQ ID NO: 23237 - protein, 212 aa, A.fumigatus
SPQSSLTCTLTDSDCTFSTALVIMLSTDGPRIGIIGVSQVGAAAANALIMNSVARELILVDIKTELRNAQVQELSDVSRMSGRAETRVRAGTYHEAGQCDIILITAGSKFSVGETSVQHMYHNLGIVRSVIQAMRPFRSDAILIVVSNPVDLLTTLAQQLSGLPRSQVMGSGTLLDSVRLRGLLANKVGVREDRFQNVIWLTVAMTGRRGRH

SEQ ID NO: 23238 - protein, 75 aa, A.fumigatus
PLLVEWGLEMYSQIYGWGTLSYGVHYLFHSMRTSPEGESCLSLMATFYNTTDRYQGTLHPNTLTAEIVGSISPSY

SEQ ID NO: 23239 - protein, 111 aa, A.fumigatus
SNKLTLYPSSTIDLQIKKQKSSAMPPKRKRSTESDVHDDAARNKRFAYLKPQVRQVSERTIKSKWTTLPEPVQDKVRDMFRALERPVIVRQPNERKRIEGLHQAAGRIRSM

SEQ ID NO: 23240 - protein, 68 aa, A.fumigatus
LVTPGKLLQALLLPLSHPELSTGSCPTSCFDISSTIASPLLVSLFILVDLPISNSACWFVCSIYVQQL

SEQ ID NO: 23241 - protein, 150 aa, A.fumigatus
SVDYFAAIPSVWRSYRKPSHRLPDQTNQTDFYPQLWCKPRFTTSMATSTVKEPAPQPSVDFLHRPYTRAALPFINGGLAGMTATAVIQPIDMIKVRLQLAGEGVRTGPRPSAFGVARDIIASGKVLDLYTGLSAGCLHHGAGRSRAERIH

SEQ ID NO: 23242 - protein, 118 aa, A.fumigatus
YVRETIDCGRTESRTHQRSEEAISPADISILVHFAERALVANKFDMLLLSSEGFQGMETSEITLWNDNITLHLRDDYNCLGAQSNGTAEEERTKVHCVKQQVLKSTHEVKPTTEGKLE

SEQ ID NO: 23243 - protein, 136 aa, A.fumigatus
  UNSURE (82): Identity of amino acid sequences at the above locations are unknown.
QRVSFQPRRCKTAMQLQLERFFLIRNTAAEMRFVDQRSRYLVEVLTVPWELTGEEVEQLRLEAEAEEEQAEKEQERARMRLXRRVEREEKDQRRIQRMWEREEQFREKEAVLCQEAGRRAMRAIQRKRVMNISSEM

SEQ ID NO: 23244 - protein, 145 aa, A.fumigatus
RGTFDPCGEDSTGAQGAQYLTGTGDKHTAIPAAGKSLAGPSVPDILAATRADLSEAQRARSELQARLTELSTELEKLRKRSTQDSRRIHVLESEVTHLQMRVKDRDAELKGKAKLLEACHSFIRHAATRLLTRSLRRISKTNSPL

SEQ ID NO: 23245 - protein, 148 aa, A.fumigatus
HIPPGVWTLIFGAMIGVERFTVRKLAGVIASLIGIILISRVDLSSTDSPPGDDGSSGTFPHKTTAEIALGDAMAAFSAVMYGVYTIVLKRQVGDESRVNMVLFFGLVGLFNMLLLWPGFVILHFTGIEPFVLPDTGRIWTIVLVRNTS

SEQ ID NO: 23246 - protein, 72 aa, A.fumigatus
GPMCAQPAFVSKEEKNAYVEEVIKMLDMEDFAEAVVGVPGEGLNVEQRKLLTIGVELAAKPKLLLFLDEPTR

SEQ ID NO: 23247 - protein, 316 aa, A.fumigatus
  UNSURE (252): Identity of amino acid sequences at the above locations are unknown.
DNLALISACANWCSGLDSQSSWAICNFLRKLADAGQAILCTIHQPSAILFEQFDQLLFLARGGKTVYFGPIGENSQTLLKYFESHGARRCGDQENPAEYMLEVVNAGTNPRGENWFDLWKASKEAAGVQSEIDRIHESKRGEAESKDSTNPKDREHEEFAMPFFKQLPIVTVRVFQQYWRLPMYIAAKMMLGICAGLFIGFSFFKADTSLQGMQNVIFSVFMLCAIFSSLVQQIIPLFITQRALYEVRERPXKTYSWKAFMIANIIVEIPYQILMGILVFGCYYYAVNGVQSSERQGLVLLFCIQFSSTRAPSLNL

SEQ ID NO: 23248 - protein, 90 aa, A.fumigatus
WRRDYFDTASFHVGSKEYQGGRWHDYTFTHHPFMEAKIETSFWYDGETLTLRVDTLCRFKEKAPDILAWGYEDSLEVSTPGHQKVAQCIL

SEQ ID NO: 23249 - protein, 63 aa, A.fumigatus
  UNSURE (10): Identity of amino acid sequences at the above locations are unknown.
PWYSSAAADXKTCDVEHPRAFWSFASSQISRNKYIEGMQLVVTIWVFPGEPKTADAKMSSLPT

SEQ ID NO: 23250 - protein, 87 aa, A.fumigatus
IQNLPTDAQSMYLSTVKVPTVMMAISRSTKNQYSFMSNNQRRIYAIELLVRSLHYLIWLSSKVHIYTKLSPPIFLSTWFYRKQAHPN

SEQ ID NO: 23251 - protein, 254 aa, A.fumigatus
VGRDCGSFRPLVKTVLFFATHNSAQELDLDLWPPSAAMTFAALPYVKSFYSAVYHRLFGKLERKWIAEVQPRQADINEFDDNAPPEHPEGRNDAENGQILMEIDLEFQVGMGNDVRQGILGLHAGENAQNNGQNQGGGQNENNLGLARPHDLIHETSNLPDIILGALAFPAISASMGGLLKYILPKSWTTAPSALERGRPGLLQTRWGRSVIGGCVFVLLKDALVLYCRWKLAQTHRKRKVLNYDRKKKKVVDH

SEQ ID NO: 23252 - protein, 192 aa, A.fumigatus
PQWYGSFQPRGEDKGATVIATAGTERKRQVAQEFGADYVIDYCNQKWPEEVKKLCAQHRTGNGKAGVDVVYDPVGMIDASLKCVAWNARLLVIGFAAGKIEKVALNRVLLKNVSLVGLHWGQYAKFEKETVGVVWKGIFDLVAQGKFRGTAFTDERFVGLESVPRALQALGSRETWGKVVVKVIDDEAKSKL

SEQ ID NO: 23253 - protein, 62 aa, A.fumigatus
  UNSURE (14): Identity of amino acid sequences at the above locations are unknown.
DEGLDVGLPIFSTXNRSPQHATYVFGLMTLCLFGISTFADMRDSLTATDFQYVCILPSETCK

SEQ ID NO: 23254 - protein, 63 aa, A.fumigatus
DVFKLLGSEPEFKKPVMALYEGARQVLHNGMRFMVLSPVERYVTTSNQGRRLGLTFHPFFSSM

SEQ ID NO: 23255 - protein, 342 aa, A.fumigatus
PRGEDVSLEPIPSSTDTFWIHIHIANPSAFVEPDSSIMEYAAVRNQTLYVPERTYPMLPSSLTQNHFSLAPGRPTLTFSAKMNLQGEVLETKIANGIVRNVIYITHDKLRSLFETTTGSSDTLTVGGTITQPHSREELQSSLTPEDERAFHTLRKLMLAFREYRLKNGAMEWPSPADNSVSVFAGTAPMKPYTMDITNGRYHLGDPIIQLRLQDVDPHEVPDLTKRNLVSTLMNFACWISGKWCAERNIPAVYDGTCYHPEYPRLTNENMAEYGGEGWLHFTPPKGISSSTPIPHIPLGLDAYIKSTSPLRRYVDLLAHYQIEAALRFAHAHGRPLDASKDT

SEQ ID NO: 23256 - protein, 61 aa, A.fumigatus
PVVKTSPWSLFQARPTRSGYTYTSPTPPHLSNLTAQSWNTPPCVIRLSMSPSAHTRCCPAH

SEQ ID NO: 23257 - protein, 141 aa, A.fumigatus
SIPGKTLRKFLLFIRALISAEFLSRSPFTLVSSLAVCVEEDEAEEAEEGSSLPLWPIVPPTAPPTMAPMMMKARIAPTIHPRFLLPPPGFGFTQRPFSPASRPAPGTGPYDVSAALLPPKSPPRFPKTPPAAAPPAAAGMA

SEQ ID NO: 23258 - protein, 266 aa, A.fumigatus
ISLWGQPLPPLDSWTPGQSVSHLSSTNPSQRNLYDIPYQDVGGLNAGPYQRHSAYSSNDLPVDINPDEIVDDGDDGFVPAPNSGSGARKSQAIPAAAGGAAAGGVLGNLGGLFGGKSAADTSYGPVPGAGLEAGEKGRWVKPKPGGGNKKRGWIVGAILAFIIIGAIVGGAVGGTIGHRGNEEPSSASSASSSSTQTASEDTSVNGDLDKNSAEIKALMNNKNLRKVFPGIDYTPWGVQYPLCLKYPPSQNNVTRDMAVLTQLTKS

SEQ ID NO: 23259 - protein, 107 aa, A.fumigatus
  UNSURE (37): Identity of amino acid sequences at the above locations are unknown.
PRRTQWPQTEADGFRTYHVIMYDIDLSDRDILSSLTXTAFRVKTEESWHLTTLNDTDSTINEMQLELFREQWERYKENPWDTEMRGQIFFRQETQIQLFERIIDLEE

SEQ ID NO: 23260 - protein, 157 aa, A.fumigatus
  UNSURE (10),(12): Identity of amino acid sequences at the above locations are unknown.
AIDNTGTPPXTXHINAKRKKKNADALPQRAAAARTTSSAGGAQGADDKVIQHNSGGQVNIDGFTVYDFGKLYRSCGNCDEQYARTVTIKNVVANSGKTLVGINSNLGDTASIDSSTCATDVKKICVEYKGNDTGAEPEEISEGPSDACQYSEPLSSC

SEQ ID NO: 23261 - protein, 190 aa, A.fumigatus
ERCSFQPAGLKTNRYAELPVSELLFELASPCDPESVTSTGLCPTEDGIGEIISDLLVAFVIKSLLTVVTFGIKVPAGIYVPSMVVGGLMGRIVGHVVQFLVVKFPNFFLFSTCPVYSGMESCVVPGVYAMVAAGATMCGVTRLSVTLAVILFELTGSLDHVLPFSLAVLCAKWTADAIEPRSIYVSLAPI

SEQ ID NO: 23262 - protein, 68 aa, A.fumigatus
VGDSIDDMTAGHTAGAATVLLVNEHNTHLKDHAHTDLCIERLDELIDILENGFVGHRRDKPPTSDRDE

SEQ ID NO: 23263 - protein, 153 aa, A.fumigatus
  UNSURE (33),(38),(42),(50),(82): Identity of amino acid sequences at the above locations are unknown.
RQRGHDAQGRPPNRRSERERERQPPKHPNRQRXRESKXPCSXWPSRFDRXTRQTYRDRQDYGFHNSRQRSLSPNARSSQGRXNDRRQPPLRSPLRNRLEPSRRTRGGGNGGSRDGRGGRGGGNKRGGASGTSNGDGYRPMPSAAKKNWDRYRL

SEQ ID NO: 23264 - protein, 99 aa, A.fumigatus
LSRPTQCIRVRIAECVVRGAASAADKAGASKLARQPSYDTNYFDTLEQSDGGALAPGDKALLDQVGDALARLGRVKRVGLAVKEKQDFLRSWTKTRRTW

SEQ ID NO: 23265 - protein, 188 aa, A.fumigatus
TTDKASSRLYPHFSWTLYEGAVSHRDDWAIVSLSKIIDKMRISSALLALGLLPEALCKSVHPAETYKSCQRITPDPLQGCPHGTVFVSQTDHRAHFKSIQAAIHSLPNDTSSHVILIGAGTYVEQLNVTRSGPLTLLGQSNRPWQRESYGDINPNTTVQNDVQIYWNAANHNAAFPVFTGRLAGHRPN

SEQ ID NO: 23266 - protein, 286 aa, A.fumigatus
  UNSURE (35),(44),(54),(58): Identity of amino acid sequences at the above locations are unknown.
MGPIRDWRTIWNSDAIGTFDAALVPSQQSLSRTEXVYLPRQPQXVTASPRLSSXSHLXGSQQQPPPLQRPHASPERSSSYGSIQSPFQYHSASALSAGAQSQRGQSPPPPAPPFASSGSRDSYSASASYNTAASLASPYTPQPASSTGPFPEQQQQQSYFAQQRSQSIQSVLSPPPATNHSFPPRDSPSSAASQSHPSQLFSPPAHGSLPGTPRASATTSLPRQTTPSTRPQSSGHDSQSHHGSSPWVGPDSQVHMSPTSMPRASRQDSRHRELTPRQFPPRVDRR

SEQ ID NO: 23267 - protein, 125 aa, A.fumigatus
LSALSPSASSIAFLRLEIYPTDSCSSGSKLSKLKSTISSLTRQQYITFVVIGELCTETSSVRPVRIKTTDIIEHILWQLLPANNLISVRTLLWNMVRYWLCPNLQMPFLRAPDSAWSAIESLGEI

SEQ ID NO: 23268 - protein, 78 aa, A.fumigatus
HYLQSFNRKSDLCRHYRIHTNERPYHCTVKDCNKSFIQRSALTVHSRTHTGEKPHVCDHEGCHKAFSDVSLLTPGMSS

SEQ ID NO: 23269 - protein, 266 aa, A.fumigatus
GRPMLNVSWHHPELLVLLSQLGANMKRRAKLHQWSTLFHAPIKGCVNCMRTVLELGVDSSAVDEGGLSTMSYAAWEGPLQCMLLLWSHRSESQLPQKPLDILNGLRLQEPNLTTMNHEIVASSDMDTADGIPDLSLPPPIIPLRRYGHNFLDKKVFVQILFEPGSSGSLCFDQAGRHPAARLTISSKLSDLIPRTIMLPIQEDSRTISFHVDNLESFAVDFEVFPTFGSKVIAKSVALPTVFRADKSSTGSCTLPLFDPRLRSIGQ

SEQ ID NO: 23270 - protein, 199 aa, A.fumigatus
  UNSURE (5): Identity of amino acid sequences at the above locations are unknown.
VPLSXRKQVKHPYNGGKPPAGAPPGKKGDPEKTKPEWWPADVVHKEPDHLRKDRTCTPPEGFLCHVTLLTDVERLSLLIHIIRKLGRFGITTDQLQEIAHDCKRQLRGPHRLQILDEVFRVRRMEERYERGEVGRQHLLFMKFILTAVDEPQMPTRLYMLSTESRTRKRRMLTPTWIWTRSMSKKTIMRMRHFPFTTLR

SEQ ID NO: 23271 - protein, 183 aa, A.fumigatus
RASDANTIVYVVNRESNPKEKDADSNVDLDQKHEQEDDNADEALPIHHSEVNSTSLMSSSVEHMGMAAPSRPMNIGDERNQLFPLPESLSFGEAPRDDRTFFPTTSEYTEDYASQQMLRTPATTALVSPNEPPAAFDYMTQAPITSPGSGAYFPPPPNYPWPCQNRAVSNPGTLRFQTNLFNP

SEQ ID NO: 23272 - protein, 67 aa, A.fumigatus
  UNSURE (67): Identity of amino acid sequences at the above locations are unknown.
TRYFSRIPNLRVDEVPVPRLVAKTMTYPKVVTGYTKKKLQQRVRNGPKKWQGANYIIKRVSDFKLFX

SEQ ID NO: 23273 - protein, 219 aa, A.fumigatus
KYGNLNMIADQIQEGDVIERHIEDGDIVLFNRQPSLHKLSILSHFAKVRPHRTFRLNECVCNPYNADFDGDEMNLHVPQTEEARAEAMELMGVKNNLATPKNGEPIISAIQDFISAAYILSSKDNFFDRRSFTQICLYMLGPETRFDLPPPAVLKPQMLWTGKQVFNILMRPNKDDPVLVNLDAACREFKPPKDGRPKDLDPNDGWLVIRNSEVMCGVS

SEQ ID NO: 23274 - protein, 114 aa, A.fumigatus
YAIIKMNWHNLSTILAVLTSLLALIVCGQEDNLGLKNGYISLSTANWDLKLVKDAQVLASLTPKGKSFDFLPFDYLSVRTENQQYHNGDITFSYRATGEIFTTEVDGPANIHGG

SEQ ID NO: 23275 - protein, 70 aa, A.fumigatus
VLIHHNGTGKRPGVALVAASANYWSMLIAILLGGHLSDDTVDTRYLTPYVVTDTANPLNTTLIPPRVRMT

SEQ ID NO: 23276 - protein, 151 aa, A.fumigatus
FQKEHFIEDFGLLRLKWFTWPSSYSWLPISLTTRPELQLLQLPQHPPVRSKSQQMERRSRHGCSHGLRNSIYYLAHCLFYAMVVLTEIHSRPKTLDDVAAQDHTTKVLQRTLQASNVRHTRLPTKVNSKMNVTDRTSSSSTTRSGGSALRI

SEQ ID NO: 23277 - protein, 63 aa, A.fumigatus
ALKCISTITPHPKPTATYLSLFSNPTVTNVARIRIPDKTVTVINPFLYSGASTCRQTICGNHA

SEQ ID NO: 23278 - protein, 105 aa, A.fumigatus
YIIAGAGYGLSGLLMAYVFPFSVGVSQTEDNRWAHEICAEDNEERALVVGSMNEMAYVFQAWLPQIVWRQVEAPEYRKGFITVTVLSGILILATFVTVGLEKRER

SEQ ID NO: 23279 - protein, 329 aa, A.fumigatus
  UNSURE (268),(272),(287): Identity of amino acid sequences at the above locations are unknown.
ESPVRVQHQVPNLYDDPSSYWMQLTDAGANGADMSSSTSAAANGTGKEVDDGSDDDGTENPPAVAAEHSTAKKKKNKKRKPKKKQPKVQTDPPSIPLSQLFPNNSYPKGEEVEYKDENRYRTTSEEKRHLDNLNSDFLSDYRQAAEAHRQVRQWAQRNIKPGQTLLEIANGIEESARCLVGHDGLTEGDSLIAGMGFPTGLNIDNIVAHYSPNAGCKTVLAQNNVLKVDIGIHVGGRIVDSAFTMAFDPMYDNLLAAVKDATNTGVRXTGIXVRVGELGGYIQEAMXSYECEIRGKTYPIKAIRNLCGHTILPYSIHGTKMSPLSSRTT

SEQ ID NO: 23280 - protein, 96 aa, A.fumigatus
  UNSURE (15),(19),(35),(79): Identity of amino acid sequences at the above locations are unknown.
PARGGQGCHQHGGAXNGHXCPCGRTRRLHPGSDGXLRVRNPRQDVPDQGDSQPVWPHDPAVLHPWNKNVPFVKSNDLTXMEEGDFLAIQTFGNTGI

SEQ ID NO: 23281 - protein, 69 aa, A.fumigatus
GYRLCDQLSRRWPGIRLAGLIDQSETFHKFTLKSRMDVVLAVIPGHLLTIYQAFNQGAGHYNSVGSQPS

SEQ ID NO: 23282 - protein, 121 aa, A.fumigatus
KSSAQTRVSGLWTAIMGVETASLQDRLERWAQRLQNLTVSPLTRDYPENQKADLKRAIEAFESLKLPRDVHTGLQKLSGPSSGFITFLAAFVVLVARLTGDEDIACATSSAEDGRASVLRV

SEQ ID NO: 23283 - protein, 74 aa, A.fumigatus
YLDKNSLNFASVYGLKQGTHLHGQDYAWLGSIFYFGYLIAQYPAGYTLQRLPMGKVLSITTISMSLLRTHLDQY

SEQ ID NO: 23284 - protein, 135 aa, A.fumigatus
LETIATMADDCGIQGVLTSLATFTFTTNFKHSSPYAHLLPPWSALLTHPIDTIGQALAVFRMHVQHTSMETKEKRLKRVEDAEKKRQYRIAHGLEEPNEKTERQNPEVVDDQSPVAVDIPAVGPDEYVDWDRKKK

SEQ ID NO: 23285 - protein, 176 aa, A.fumigatus
ALRTMTILVLGGRGKTASRLSLLLHNAGVPFLVGSSSTSYVGPYKMTHFDWLNEDTWTNVFLRASLDGIDPISAVYLVGGHAPELVDPGIRFINVARAQGVNRFVLLSASNIAKGTHSMGILHAHLDSLEDVQYVVLRPTWFMGKFPKTTSCRRFAEPPPREPPGGSTCQLDQKGG

SEQ ID NO: 23286 - protein, 96 aa, A.fumigatus
GRPGSWVSFQKPHPAGGLLSPLLENLLEDPHVSWIKKEDKIYSATGDGKIPFISADDIARVAFSVLTEWKSQRAQEYFVLGPEVFSPTGEGTKLSV

SEQ ID NO: 23287 - protein, 209 aa, A.fumigatus
DNAVNSLNVIHVSGTKGKGSTCAFTRAILRAHGMRTGFPKRIGLYTSPHLQCIRERIQLDDHPVPEDLFTKYFFEVWDCVMPEDIQQDSGVARQPRYLQFLALLAFHTFIREGVQAAIFEVHHGGEYDVTNVIQSPVATGITSLGVDHVAQLGPTIEAIAWHKAGIFKPGAPAFSVNQKPGPADVMRKRALDKGTTLTFVSTNYISPGR

SEQ ID NO: 23288 - protein, 139 aa, A.fumigatus
LNLPSVTDAVNDDNSVIALSNNTMETLQLFRGDTVLVKGKKRKDTVLIVLADDDLDDGSARINRVVRHNLRVKHGDIITVHPCPDIKYVGLPLCILSNENGKLTLHLSAGQADCRPSHCKHRIRSDWIPFRRLPRPILP

SEQ ID NO: 23289 - protein, 63 aa, A.fumigatus
RQAYIFDIWARVNGDDVTVLDTQIVPHNTVDAGASIIQVIISKHNQNGILPFLALHQHCVTTE

SEQ ID NO: 23290 - protein, 97 aa, A.fumigatus
NTKLFLARCPLHVVKEVELIGHFDHIVSIIIGNANGTCQPTVDAVCKTLRDSRYHAKVNWSMDKVHIHMFKAKPFQRASEFVFQTVRLEKDVCRVWP

SEQ ID NO: 23291 - protein, 238 aa, A.fumigatus
LRKMSVAGSQHVLQTGLHSGMSATEGPMHSPHPNPVDPKMSEESYVLPSEIIPDSRARITLRGKAHDVLVPYICIGAWSWGDKATWKYDAERDLPRIRAAWSKLRQVGLTFVDTAPAYGDGDSERICGQLFKDMRREEFIIQTKWMSWPDPTNVFLQSHGLENELRSSLERLGLEHVDVYLVHGPIHLSMISTVAQGLANCVNSGLARTVGVANYDRDDMIKMADELDLLHHVERAAR

SEQ ID NO: 23292 - protein, 97 aa, A.fumigatus
SRLSSALRDHTGAAHVTLPLVTGETWVKVPESISIRLVGVPKPGIGGKDVILYILQQLKRNTVASDRIVEFSGAGVQYLSADARFAICNMTAVRRCS

SEQ ID NO: 23293 - protein, 195 aa, A.fumigatus
LMKELGGITGIFVPDQITRAFVANRRLQRHKNLITYFRPDNDAQYAAELDIDLANVQSFFARYPRPDDVVPVSDYAGMQLDGCFIGACTTTEEDLILAALVLEQGLKKGYRPVNHGKRKMVPGSLPILHRLRELCLTGVFEAAGFEIGVPGCSYCVGMSADQAVSGEVWLSSQNRNFENRMGKGLHACRLSRLFS

SEQ ID NO: 23294 - protein, 182 aa, A.fumigatus
WRNTSPWMSETFKLTPNDRFTMLSGIAHDPIQRDIFTPLFLGAQLLVPAREDIQNEKLAEWMREYSATVTHLTPAMGQILVGGASAQFPALHHAFFVGDILIKRDCRSLQALAPNVNIVNMYGTTETQRAVSYYEIPSYSSQEGFLDTMKDVIPAGRGMVDVQMLVVNRFDPSRICAIGAVC

SEQ ID NO: 23295 - protein, 223 aa, A.fumigatus
MQVMHSVFSGERCFLASERWHAVMRQRINSFYSEELEDLLEEFIALFTLAPSLVHALYDIKASDMTSPATWKKASETLTRILEMQNRLLEWYSRFSRIAPPACERLSATNDAVYPTVLYYSDLNIASIFNSYHAYMAIIHEALRTLGYPGEHGAMVAFFRDQICKSVEYNGAGPLGPYRMGFPLRVAYEVADPKTKAWIENRLAHMSQYYAAVQPNNFATQFD

SEQ ID NO: 23296 - protein, 68 aa, A.fumigatus
NHNNYRKRWYTVAVVDPFRWRFASSSPLVLLAPFSVAQEHPISVIVVVAATETPATKRHRSNLSVRYH

SEQ ID NO: 23297 - protein, 151 aa, A.fumigatus
  UNSURE (60): Identity of amino acid sequences at the above locations are unknown.
VTKAYSTPIRIADLTRVLVGAPRRSGPIPNSSGTLAVNTQTSYSFDSHSKTNEIRVLDIXTGRSALITNDPGASSPQWLENSDQLVWLKTKANGNTSFIVGDAREVDKTYTAGTVPGPVSDLKVTVVEPGKIDLQWWEGPPDSSPHGWQPQ

SEQ ID NO: 23298 - protein, 196 aa, A.fumigatus
YWYATTVWNCHSLTNFLVTFSYTTAFWSWEDWELQLDWMALRGINLPLAWVGQEKILVEVFREIGLTDAEISSFLSGPAFQAWNRFGNIQGSWGGELPYSWIDSQFELQKKIVRRMVELGMTPVLPAFTGFVPRAVSRVLPNATVVNGSRWEEFDERYTSDTFLEPFDPSFMRLQRSFIKKQQQAFFTTRLEGTDT

SEQ ID NO: 23299 - protein, 67 aa, A.fumigatus
QPLADPSSPVVKTIYKTDIFFSTAVYKATPWIIQETGVCPPKSAPAAWILGGIAYSGVSPKSGLSSE

SEQ ID NO: 23300 - protein, 195 aa, A.fumigatus
RACGVASSTTETPLFQVCFNYRMGAGRTAALQGVEMKFLDYVDAQNPFDLVATVDDLDDGTAMITLYLQDYLYDQEGAQLLATMYANVLQVLAENPERLVGSVSISNATLEDEGVKLGTGPILDLVAPSTPTLSKIFHTWVDKDPHALAVKDTTGKSKTYVQLAERANAIAASLLNAGAPPSVFTKGSGIRVAIA

SEQ ID NO: 23301 - protein, 61 aa, A.fumigatus
SNCLWNRVPAEVDGTPQNPHRFNLLHPDFPTDMGVHLYPLKTNGRDVELQSYDRTKKARAS

SEQ ID NO: 23302 - protein, 136 aa, A.fumigatus
AGTQEGPQTTDFQFQISSGGYEPFRRCFPTGMFRSPQNKNFDCGAREREKSHLAHPPRRKNLAQCSNAPVHGAIMVQLPLTQTSADSPAACYLLAPVNIALLARVPGTMAVRLFKRVGYSLKILPYNSMGSTGPAL

SEQ ID NO: 23303 - protein, 79 aa, A.fumigatus
DLVTDPRAVCDCTTGGLTGISYRGSRAVDLRAVFWNYESNKFLSDKGTILSDHNPITTNFTWTLSNAFRQSDIFGGPHG

SEQ ID NO: 23304 - protein, 122 aa, A.fumigatus
TRFLRSARGRRVFLSCLRPFCSKADLHRSKDDDVKARSANLQQLADYIKVNSAGNAVLVFGDTNARYTRTGDNIRVFQTQNGMVNPWVELILQGAAPAEGSNALLCRNPSTTSDCETVDKIL

SEQ ID NO: 23305 - protein, 82 aa, A.fumigatus
PGCRGQGTDRPDTLSFDDSDNASTVYFTPRNRGTGAEPNSSYSPRRIVDGETGHEPNGDTIIGAFGINIVLWGYGRLRLQPS

SEQ ID NO: 23306 - protein, 60 aa, A.fumigatus
SRVLTCAACSSCPYQRADARSTFLHAHITAADNPANTYTGAAVRDQRIKPYADDDAPGRL

SEQ ID NO: 23307 - protein, 360 aa, A.fumigatus
SPPLRRAEPFSPVVKRHLDRAPTQPHLALDRKPTLPMVADLDAEDKAPTVPTLSRSTTQTTLPPYTSRPGTAAPERNPTLPTLPDVSWTEKPAMSRTVTQSSAHSESTSYSGATAVSGYSPLDRGSLPAPPVPPVPTNVPMPGARSYTPISRPPTTRPTRTPAPPSATNASSRMPTTMHQGDYEEAPRRYPDPYSTDAPYDENYGAHPSYSAAPDPYSRSVTRGIAVSPGEDYPTRTLSPQSHRGTPQPSSSDPPTSYPVRAYTPGNAGTARPPLAVDAAASYAERTYTPVSQRATPRPQQQSSQQQGGYVAFDPSSMGPSQPSAGIRPTHSPVYHAYSGPSSATSPNGPSNRGPPVRAY

SEQ ID NO: 23308 - protein, 91 aa, A.fumigatus
RVSFQPRGEDIFSALKYLVLIESAFTLNFAACFAYRGVPAILPAILRQGTTVVQQLRPVLYPNIFAILDIDCMGTGILNKVQALGLVLQET

SEQ ID NO: 23309 - protein, 74 aa, A.fumigatus
DNGKLEYHIPAQYDTDRPGFNYTVVKHSMGINKHPLAASFPQATGQPSLLGDPADLASVCLCLTPRGWKVRSLR

SEQ ID NO: 23310 - protein, 82 aa, A.fumigatus
FSNRISGKMTAALTIYSATFMRYALAVSPKNYLLFACHFINCSAQMTQGYRYLSYWKYVLYSPPPHCRPLCLLLLSTQLWNV

SEQ ID NO: 23311 - protein, 113 aa, A.fumigatus
AESVGSNLDTSSSAVRVEKFGLRLDIDPELLLFGPSFINDTISCTLSQWGPHPFYNRLVAAKITTERCFNNEALTKDRMATCYYYKALYLIKSISAFKIQKTGQIEFGMKQLT

SEQ ID NO: 23312 - protein, 183 aa, A.fumigatus
HIDFRRVVKTVRQWRHRALQLLSSEPPENLVSPPTLKSASPLQSIKDLLEPPGSQAEPISIKVDVTSPKESHPPGAPNFTAERKSPVLSPLKKFAISPSDGPVQALLPALQTSPPLATAKSPENHQQHSLPSIQTALAEISGPYSLPPVSTSPPSIPRNESAWDHQRPGQFAPPQVPPSPYSH

SEQ ID NO: 23313 - protein, 162 aa, A.fumigatus
YQKIRQSWSKYNLFNLSRFRAPPTANRTFFQQKWTAKSVARAYHGEQVRESQWSRMFTRRIRSVVPMSPEKLASDDGSAMSAGRGAGLESEASGDGTAGAQDQTSLTPYTQMTFAPLERRLDVAIFRAMFASSTRQARQFVVHGAVTVNGKKLCFFGLVVRR

SEQ ID NO: 23314 - protein, 67 aa, A.fumigatus
MACSQPHIEVGASGFRTSSKVQNFDVQGFLNFFVPTGGARGNILFKLLVQSPRLWLFDYRGLKIWRR

SEQ ID NO: 23315 - protein, 84 aa, A.fumigatus
YTRRWIKTSNSIFDFVICAASIIIEASTYRADFRVSEAYHGNNIKITIMQLPLVGDNWNGSWLDCCLSVLGTCQCLDEICPFAS

SEQ ID NO: 23316 - protein, 400 aa, A.fumigatus
LGQAVPPLPRRQRRRVISNKSPAGAVLPMGPRAKRARAMLTFTNPRGFGLGSSFTLTAQWTSGVDSFKSDLCERIPYKNIQYHDGSDPIRMHNYYTLLFSKLVYEPMTGRYGPSNSLLFARSSAPGGQAYSVHWDGDCESTYEAMAESLRGGLSLMLSGYIFWASDIGGFEGTPPPALYKRWVQFGLLSSHSRLHGSSSFRIPWIYGEDACTVLRDCVKRKILLTPYLLLEALRGHRQGVPLMRPMFLEFPDDLNTYPLDTQYMFGANLLVAPVFSEDGSVTFYVPRTPEDACGKWRSWFDHAKTYESGQWYTETHGFDTLPILVRPGSVTPVNPKFNVPEGDALDGLELLVNGTLAADVDVEVVYPIKTYATLRTVRVSPSGDTVTVADANIKVVCIHQ

SEQ ID NO: 23317 - protein, 135 aa, A.fumigatus
PADTALPTLSSSPAHPPQAAKLTPSTGTATANPPMKPWPSPSAAASPSCSRGISSGPRTSAVSREPHPQLSTSAGSSSGFYPRTPASTGPPPSASPGSTAKTPAPSSATASNARSSSPPTSSSRRCAATAKAFRS

SEQ ID NO: 23318 - protein, 65 aa, A.fumigatus
KPELDPALVESWGWGSLETADVRGPEDIPREHEGEAAAEGLGHGFIGGFAVAVPVDGVSLAAWGG

SEQ ID NO: 23319 - protein, 181 aa, A.fumigatus
LFFSLYIQLTLAGSPLNRLSFLRSEHPFLSAALKHPSTRFVLLKDLAPLTKSPSELYYAKYDEVRKLVPENFFDKSEEEMIKQFDSRKTSAQLIFLGLDETRKQDGLAWKIYTGAPYFALDVTPKGSEEQQANAKDIISTVVAKGLSLYQSRVVMTFIGGRGYVNCRQRQQVFTRRPGPSR

SEQ ID NO: 23320 - protein, 116 aa, A.fumigatus
  UNSURE (52),(89),(92),(95),(96): Identity of amino acid sequences at the above locations are unknown.
LMSRLSRLFDKSKQTLPVTSASPDGPAWTEVGNAADHLPAELESLYWTGVNXELDCIVSTLRRWQAPHFQHIQPDADNTLVNGFDTFVXDVXPQXXQTPSQLPFQVFTELTVKGVW

SEQ ID NO: 23321 - protein, 191 aa, A.fumigatus
LSLTTHLALLSTRLPKLKSKGEEDPFFDDDWNVAEYLYPRQSSGNATTPSPSQFVRPPVTLLVISVADNIIFDPSREEIAVADTVLALSVSRDGETGSLKLISMRTIDPPSRLTQPGVPNSENVTTIGSSAAAEDAAILSPSTGEEEVPGVWKPRRGGVKRSTIARMVKAVLEKGGVGEDVLEGLEGVSVG

SEQ ID NO: 23322 - protein, 261 aa, A.fumigatus
GLDTSSAACKIDSSARLPPGNRSRPTPPPAQSSKPPAPSTSLPVRPKAPARIVPQLSQESLISTHRHREKGTEAYKRGDYAAAHDAFTSALTMLPDKHPISIVIRSNRAMTALKVGEPKVAISDADAILELIGPSKGEAETIDLANGEAAKSMKDFYGKALMRKAEALEQLERWADAAQVWRQAVENGHGGSTSIQGRNRCEKAAGISKPAQKPPAPAKRPPAPAPKKPSALDDLQGGSLSTGGSSEAVSRLRAANQAAER

SEQ ID NO: 23323 - protein, 158 aa, A.fumigatus
LTRLSRTSSQIWKRNLAYTKLHQAVLNEQVDEVKALLSRGAPIDVPDRKGNLPVHYTAGHQDEKIAKFLLGYRVGKIEPLVKQDLARLTLDHRNTDGNTPMHLAISARSLNYDHQKSIVTHLLGAGGNPYIPNNLGVTPIQKAVELVFPNNELGLWTS

SEQ ID NO: 23324 - protein, 260 aa, A.fumigatus
  UNSURE (237): Identity of amino acid sequences at the above locations are unknown.
SQRTSSNASTLTTSFGMDGAAVTSLVLGDEDMPTEQAQVPHDFSENKGHAANTIGEDERLEEPPRELPTAQATQQSNLVGLARTSSPLKRVHDDNQSRISAWNNFHAVAARDEAAENARRLEESQDNSASQLPHSLTWRKISVDEDDPVRKVTTVEKPADENESETKKQKTGHAVSATKNSDEIPLDLDSDSDQGISTTAETQGATQKQNAVVTQPAAPDVTGESKLSGTTQQDKPXVRSLDSQDVRNLLPTSFSQPESF

SEQ ID NO: 23325 - protein, 286 aa, A.fumigatus
FHSSRLLLESAISTAMIYSLRILQWLCITAGLDLLVPSLAADTSAWKSRSIYQTMTDRFARTDGSTTHPCNTTEGLRCGGSWRGTIQHLDYIQGMGFDAIMISPIVQNVEGRVQYGEAYHGYWVQDMYALNPHFGTHQDLLDLSKAVHDRGMYLMVDTVINNLAYITDGRNPATSIDYSALRPFNDSMFFHPYCKITDYDNYPLAQTCWTGDDVVPLPDLKTEDSQVQSMLMDWIRKMMATYSIDGLRLDAAKHITPISCLCSKTLLALLLLEKSSRRGWKEPRCG

SEQ ID NO: 23326 - protein, 132 aa, A.fumigatus
  UNSURE (127): Identity of amino acid sequences at the above locations are unknown.
DSSSRFRFLPAARSDISLSLSLSSSLPRNSFSSSCTAACSSASYPMGDISLSPENFRISSLNCDPSSSSVQNPPVSSSDDDSQPLSSSFDPGEIGSPRSSGCTGSRYGSSSNRFQSYTSRDRSTSVXQSRAP

SEQ ID NO: 23327 - protein, 209 aa, A.fumigatus
DWKRLEEEPYLLPVHPDDRGEPISPGSKELESGWLSSSDDETGGFWTDDDEGSQFNEEILKFSGLNEMSPIGYDAEEQAAVHDELKEFLGSDDESESDSEISLLAAGKKRKRDDESQGTDEDESDGGQGEEGEMEGSRLSQRIKRSYERTTGLKEVATADTTSTAELTHTSLPKERSGGETDDALNDLNESEEPAVLHLGVHVPDIFKG

SEQ ID NO: 23328 - protein, 82 aa, A.fumigatus
LVAKLDKGNIAAHSRLNPERRDHNGAYWIGSSSLSLVLVSAAICLASSLTPTMSIIVMFQWYFLLITNLRTYVLDGAATLDC

SEQ ID NO: 23329 - protein, 115 aa, A.fumigatus
SRTCAHSYRPSRYIGEPADQTLRTPDFIHHTDGYPCYDDAAPKIKQYCPRFEADFNHIPISESSLIIRGIQALVAMATQEHKKTLGHAVKLHSIVADIHVDIMTMIVVLIGRRHH

SEQ ID NO: 23330 - protein, 161 aa, A.fumigatus
APEEPKKPALPEIVKKFSRRTVRVTREHNAECKKLLKLMGIPYIDAPTEAEAQCAVLARAGKVYAAASEDMDTLCFEAPILLRHLTFSEQRKEPIQEIHLNRALEGLGMDRKQVGDWLLPRIPSWIRSSHAYTRLHSLLIYAFFSAVTIWNLSQRSGQTPL

SEQ ID NO: 23331 - protein, 230 aa, A.fumigatus
GRGPVCCACAGREGLCRCFRGYGHVMFRSANSSQASYVQRAEKGTHSRDPSESCSRGTRHGSQAGRRLASPQNPFMDTIFSCLHPAAQFIDLCILLGCDYLEPIPKVGPNTALKLIREHGSLEKVVEAIENDPKKKYVIPEYWPYQDARELFLHPDVREADHPECDFKWEAPDVEALVEFLVKDKGFNEDRVRNGAARLQKNLKTAQQSRLEGFFKPVASSPRGWKEPLH

SEQ ID NO: 23332 - protein, 162 aa, A.fumigatus
IRMPRKAIDSRIPALIRNNVQEKKRSFFVVVGDRAKDVIVNLHYIMSSVDVKQNKSVLWAYKKDLLGFTSHRKKREAKIKKEIKRGIREPNQEDPFELFITLNQIRYVYYKETEKILGNTYGMCILQDFEAITPNLLARTIETVERGGIVLLLLKGMKSLKQ

SEQ ID NO: 23333 - protein, 77 aa, A.fumigatus
KTNGFSLNPVVLSPKATVGEAKALKAKWGFGGFPVTGKHTILLSLSCHPYMMILQPISYNFRSSGATRVAMYKNYFI

SEQ ID NO: 23334 - protein, 232 aa, A.fumigatus
  UNSURE (114): Identity of amino acid sequences at the above locations are unknown.
FTSVTITVRKPLSNLCFVTENGTLRSKLVGMVTSIHIQFHTNLDDPVTAIMSTDLVTAPAGTTLAEANDVLRSSKIGKLPIVDADGNLVSLLSRSDLMKNLHYPLASKLPDSKXLICAAAIGTREEDKHRLKLLVEAGLDIVVLDSSQCNSIYQIEMIKWVKKTFPEIDVIAGNLVTREQAAALIAAGADGLENWLGLWHSPAIPPKILGFRSSRGRCRSQVVSLAAQSGVL

SEQ ID NO: 23335 - protein, 245 aa, A.fumigatus
  UNSURE (124): Identity of amino acid sequences at the above locations are unknown.
PLGESEDTGLSSQGNNLRTATASGGPKTKNFWGNGRGMPEPKPIFQAIGTGSNQSCGLFPSDKVAGNDVDFGECLLHPLDHLDLVDAVTLAAVEDDNIKTSFDEKLESVLILFTSTNRSSTDQXLRIGKLRCQWVVEVLHQVTARQQRDKVSVCINDGEFSYLGATKNIVGLGKSGTGRCGDKVGGHNCSDRIIEVGVELDMYGCDHTDELGAECSVFCHKTQIRQWLANSDCDGGKSLCVVDFR

SEQ ID NO: 23336 - protein, 88 aa, A.fumigatus
HSPHHSKLDDHLRSLDSQIHKSSLISALHLSSDKMERPNKPSAIGVAASLPQPTITFRQNKIEATLPTGESVTVHLYGATVTSVFTTG

SEQ ID NO: 23337 - protein, 205 aa, A.fumigatus
FRGSFQPRVKTAAFAKAVRANKGCLIMDTTWRDAHQSLLATRVRTIDLLNIAKETSHAYANAYSLECWGGATFDVAMRFLYEDPWDRLRKLRKAVPNIPFQMLLRGANGVAYSSLPDNAIYHFCKQAKKCGVDIFRVFDALNDVDQLEVGIKAVQAAEGVVEATICYSGDMLNPKKKYNLEYYLEEREHTVRLIPDILGVSDLNI

SEQ ID NO: 23338 - protein, 122 aa, A.fumigatus
TSPRKPVTRTPTLTVWNAGVVPLSMSPCASSTRIPGTVCASCARPCPTFPSRCCSAVPTGSPTRLFPTTPFTTSASRPRSAVSTSSVFSMRSTTSTSSRSVSRLCRPPRVSSRRPSATAETC

SEQ ID NO: 23339 - protein, 162 aa, A.fumigatus
CPPVAVGYSCPHDRSAEHRQGNQSRVRQRLQFGMLGWCHFRCRHALPLRGSLGPSAQAAQGRAQHSLPDAAPRCQRGRLLVSSRQRHLPLLQAGQEVRCRHLPCFRCAQRRRPARGRYQGCAGRRGCRRGDHLLQRRHAEPQEEVQPRVLPGGAGTHCKTDP

SEQ ID NO: 23340 - protein, 197 aa, A.fumigatus
DVRDQSYSVFPLLQVVLEVVLLLGVQHVSAVADGRLDDTLGGLHSLDTDLELVDVVERIENTEDVDTALLGLLAEVVNGVVGKRRVGDPVGTAEQHLEGNVGHGLAQLAQTVPGILVEEAHGDIESGTTPAFQTVSVGVRVTGFLGDVQQIDRADTSSQQRLVGITPGGVHDQATLVGTDSLGKSRGLHTGLEGSAE

SEQ ID NO: 23341 - protein, 100 aa, A.fumigatus
AHRKHGRCRHRTSWPACRSGKWRCREETSRRPRWHRGAASGRECWARPCAACADGPRDPRRGSAWRHRKWHHPSIPNCKRWRTRDWFPWRCSADRSCGHE

SEQ ID NO: 23342 - protein, 109 aa, A.fumigatus
ADLSITSVLKRKFHLSGVILLFFGTIQIMEYVFGTLSLLLPVLDLIRKGKRSIRDMKQLLQNESDMEKLVFSLKKLLDGLKGVSFDEDIPELHKDLYISLEKKMYESIR

SEQ ID NO: 23343 - protein, 80 aa, A.fumigatus
EFAAQMNLNLGNGWGIVRTIVDRIRALDAEEEEDKVKKYVLIKDPNRPVIRLYSVPPNTFEEDDEAAEEQEEKAEDESEE

SEQ ID NO: 23344 - protein, 63 aa, A.fumigatus
IVIIIEFCTLSYQNIILQLNYINQACSKINFNQHHTFPEFRSQTATPTTQHRQPDQVWKLAHS

SEQ ID NO: 23345 - protein, 159 aa, A.fumigatus
HYRRGCFCWAATHASRFEPSKFQLIHFHPPGQGPRGGPGEPLNLGDGQIIEASATARLLGVILDQRLTFESHLKHVDTAATRRLQAISALGGSKWGLRLRELRHVYTACITPIMLYAASVWYAPPVRGRKRLHSQQTKVLNQIQRRAGKLIAGAFRTVK

SEQ ID NO: 23346 - protein, 86 aa, A.fumigatus
GGSASEEHSSLSLWLYSSACLSELDTQHWAWASVILDSEACHSKVRDQTYQYQEAEKNQQIPFPRCIGPSAKRDARSSTQKILLPW

SEQ ID NO: 23347 - protein, 60 aa, A.fumigatus
TFSRSTSLLFFIYILIIIFIYYNYFCPSLVLPFFFFFFFFFFFGGGGVLRGIICYNFHFL

SEQ ID NO: 23348 - protein, 369 aa, A.fumigatus
LTIVPHPRHSKPDASEGQWTHDLHETVAGDEPTNKPSAVPESMSDFAPKPVPTAPRSTPPNRSFSSTTLIGNVPVVVFLQGMARPIPFPAVPKKQHTRLPQHRPPLRRDKPVRISLPGQSPRYIFPSTERSFIFIPRALMPNQQGYRGRGRGGFYGGRRPSFYAGSVYTPSVTASRRSSMGKPASHDGYPSPAASVLSRHTVVTTENGKPIVRLPPPSRPLGGVPPAAAATGPAAVVPASLPQPMPQPQPQQPSYRESRPAPIPMHQPRPQKAVSVADIETPARFSFNAPQPQQEQPFQHQVPMPINGPGYGADVQSAHAAGTPSSHIPERAIHAQPFQPYGFQQAQPFYPAAYPPGLHHGAGRIRGGL

SEQ ID NO: 23349 - protein, 373 aa, A.fumigatus
NLYTIYDGPHGTLEMGRIQRHQTQQPSNQPGRRQRQHPPTEDKAQLPPVHRSQIIIHQRHPSSRTRQALGRRHGQPQPGRQQHRDGRAQLRRKPSGRRHLRDLVTQRPHDIIPVEPEPQTQQQARNHKEPHRRRRLGIYRASTVRRIHGGPRPHRIRHVVAPVRNRHHHGRDHLAVGPEVLDAVVVAARARVDVAQQGGVVRDHVAGDALQEAELDPAEPFPGVCPGEVGDRVEEAFVRAEVFLAGFELRGGLGGVGCAFDVVSGLEEFGVGGLGLLRLLLGGVEVGFRAGEDFAVGVFVVVCDEFVALAGEVERACILEKPWAEGEVVDADAGVLLDEAAVEVWEEEDYSDEEAVEEDAQDDADRFAGAEFL

SEQ ID NO: 23350 - protein, 180 aa, A.fumigatus
SSSSHTSTAASSSRTPASASTTSPSAHGFSRIHARSTSPAKATNSSQTTTKTPTAKSSPARKPTSTPPSSNRNNPNPPTPNSSSPLTTSNAQPTPPNPPRSSNPARNTSARTNASSTRSPTSPGHTPGNGSAGSSSASCRASPATWSRTTPPCCATSTRARAATTTASSTSGPTARWSRP

SEQ ID NO: 23351 - protein, 283 aa, A.fumigatus
RSDERNPSPLHRRRSPHRPLPRGIRRRQSGRHHPGRLLRLPLHRSSLLPPILPPPPRQAGRPRPRLPPPPRPMASQGYMHALLPRPRRQIRHKLLRRRLRRSPRRRESPPPHHRAATATIPTHRHQIPRVHSRHRTHSRLRPIHPGAQTPQETPRPARTLPPPGRRPPLDTPPEMARLDQVLPPAGRHPRRGHARLRPAARHPLARAPLRRPRRALLDLLPGGLAHDDVDCAREQRRGECGGAVGRRVCDVPCWRGRYRGADAGVVPCDCGLAAGSGVLVLRV

SEQ ID NO: 23352 - protein, 382 aa, A.fumigatus
LAATSAILALFIVVEAPTAPSLEEFGAGKAVGIILGVFFDCLFIGVVFFLPYFHRRLVKQDARVRVYHLPLGPWLLKDTCTLYFPGQGDKFVTNYYEDAYGEVLAGAKAHLHTTEQQPQQSQPTDTKFLESTHDIERTADSAQSTPELKPRKKHLGPHERFLHPVADLPWTHPRKWLGWIKFCLLQGVTRDVVTHDSALLRDIHSRARRYDDRVEHFWTYCQVVSPMMMSIAHGSNDVANAVGPWAAVYATYRAGAVDTEAPTPVWFLVIAGLLLGLGFWFYGYNIVRALGNKITQMSPTRGFATELGAAITVLLASRLGLPVSTTQCLTGAATGVALMNYDLGAVNWRQLGFIFSGWVLTLPSAGLIGGLLCLMALNTPHF

SEQ ID NO: 23353 - protein, 99 aa, A.fumigatus
  UNSURE (40): Identity of amino acid sequences at the above locations are unknown.
KVKLRYQVLQQRENYERWAEWKDDIVRHEREQDRLAAAKXERISREGAQKHASRNSVFGDFPKGLGHGMMGAAWQILGMQHAGHKAFDQPIETSLAPSY

SEQ ID NO: 23354 - protein, 228 aa, A.fumigatus
ILRNEELIRVDQDVLGLQATLASRGLEVDVLTRSLEGGDRLITVLNRGDGVAVVSVPVEWMGLQRGCPYVVKNLWDGEVQVLEEEIVIRLNSHATQVYRIALPDECSTVIPTGIVFNTASGNCLTDENGERVGFEACRGSETQIWQVSELGYLRPLSRTSHCLTGGSQASVQLCTEQKNQQWAYAITGILKNEHTEMCLTEGTGISQCGFERDSQVFGLPSGVNIKPS

SEQ ID NO: 23355 - protein, 168 aa, A.fumigatus
YRRRATAPPNAGDIPPTRVPNPSTTTPSSTSPCSGTSSSSACRPPTPSRTASTPSTSSCRPGKASILLPACARTRSNGTWTPAPPKAERCGSMSTRSCRTLWRLKTAARGPLPLARSSSLPCLERQQVGYCAKGTMRMPVLRRKAMRIVKRLGCGCSAASRLPVSGYT

SEQ ID NO: 23356 - protein, 172 aa, A.fumigatus
GLTHAWILPGRWLISETGDRAAKRRRHSSDEGPEPVYDDTVFYQSLLRDLVEQRMSSSDAITNGIDTLHLQLPSRQGIHPITGMRKDKVKRDVDTRASKGRKMRFDVHEKLQNFMAPEDRGTWTITAREEFFASLLGKTASGLLREGDDEDASSAEESDEDREEVGLRLFRS

SEQ ID NO: 23357 - protein, 142 aa, A.fumigatus
LSLIDLGGDRFGSFVLDYFKHVSRPTLKHMGLSLLRKTASPHDTLFYTVCVNSMAYKFINCLLMDEDDGQLSQMLRERAAKYKRTAQNALRRIPLLTSPSLALLQATLCGVSHKTFRFFCHNLTESRFSYARGQVRLSCAVI

SEQ ID NO: 23358 - protein, 105 aa, A.fumigatus
RIFIHVDEHLTRDYLDLNKKSIGSVLTVHLQDGSELAEVLIEYPAGHVRNPATARAVQEKFTKNMRLMFTETEISKILQETRKDNLLIMDFVDLFVKQSPPGPRL

SEQ ID NO: 23359 - protein, 86 aa, A.fumigatus
  UNSURE (12): Identity of amino acid sequences at the above locations are unknown.
AKHLVRTVSIRXPIGTWGSRIMEIWMPLNTIFASGGPAEQYCGNWDYGLPLSRAYAEYFGGSIAIQSLWGWGTDVYLTLQGVGKIE

SEQ ID NO: 23360 - protein, 298 aa, A.fumigatus
PRGQQDGHAGEGRGESSRSVYEGLADSILQNRFNIQLHAPAVVLLYLTTRKYVLSSMYPYMTLLGQSLGSLVVAYDAFNLLVPDVFIDTMGYAFTLAFCKMLFPSVPTGAYVHYPTISTDMLQSLDDSTGLKGVNAGAGKGFKGQVKRKYWLAFARLYGWVGGHVDVVMCNSSWTSAHIRTIWGPSRTSMTFKEPTVIFPPKAVSEIESTITVDEDSERSREPIILYIAQFRPEKKHPLVLRTFARFFIERKTKPPSGALPQPKTGPHGVRSVTPSPEKNPPLINSGRLAQQNSGIRG

SEQ ID NO: 23361 - protein, 217 aa, A.fumigatus
KRPTAENASANVEAEVLDHFGQFANSEKLKLQERRRNQASYDRTVKLNELMKFSKNFKLATPVPKDMVRILAKDPQKQEEIIQRAQQQAEEKLASKTASGVTEQKPTSRVSGTVQTTTQPERPNYPRGRQMYPPTGPQAGPAGRLPPQGMHPGRPGTGMLSHRLADNLQQRKGAAMAPVPTPLPIQEVRIPPSGRAADQPGVSSPNKTQTLTSENSS

SEQ ID NO: 23362 - protein, 210 aa, A.fumigatus
RGLDPILVQQIKRWNRTAAVPTTGMIPRLALRSVHDENVRREVYLASRTSSKRQLHRLEELLLKRAELAKLSGYESFAHMTLSDKMAKSPEAVSNFLTALVESNRKLVREELSQLQVMKGAPLQPWDHAYYVHQRVLQYSQARRSRELSAVPEFFSLGTVMQGLSRLFDRLYGVRLVPQEPAPGETWNPDVRRLDVVSSPRGWKDPSGVQ

SEQ ID NO: 23363 - protein, 142 aa, A.fumigatus
RWMRAMHVDAFFEYCLGHPHPYYTQLPASNAAVSDTRDGVPLEEDLALRALVPEWKPKRGRKRADEREQANEKPTKRPQLDTSVGVLHAGSFTDQSATFPQNAIPFSAFPDNDPWMTAASSFPADGSTDNQQGQELRWRPLE

SEQ ID NO: 23364 - protein, 313 aa, A.fumigatus
  UNSURE (262): Identity of amino acid sequences at the above locations are unknown.
TRIITRGGRQTVLFKDQLVEESLFSGDDDDAHFHKETKPTSAKWPILDAPPDVVFQKLKEVDPVIASRWHPNDVRKIRRSLEIYFQTGKPASEIYAEQKRQKYATGTNGESSPGIGQLRYPTLIFWVHSEKETLNCRLAKRVDSMVEQGLMAEAQRMWAYIREKKGQGITVDQTRGVWVSIGFKELAPYFDALENGELSEGELEALKQSSIELVKIATRQYATSQIKWIRNKLWKALADASANKNLYLLDSTTVEDWQKWVXEPSEHLTQALLNDETLTGPLISLRTWQEKTYAPGKVRRRNTPTKFFPTFTC

SEQ ID NO: 23365 - protein, 73 aa, A.fumigatus
ALYSRDFQTCVSCHSTTPSCSVCEEGYTCTMISPSCCQCATYQCVQMFTSRQKPPFPPPYGSRYQCWGLFARR

SEQ ID NO: 23366 - protein, 230 aa, A.fumigatus
  UNSURE (24): Identity of amino acid sequences at the above locations are unknown.
SRLRPAPPPGGPLEYVWTTFFLTXSRRRPHEARVLHNLRSKPANLARALIRAAFEVHHVTTYGPDGTVISDLNTASESGFFSALHSPASASAPENRRHILNCDACRKEEFERQTARSAAAVETSKEAAATSSTDVRAQNFSDTGSPVPRKTLADASSSTVVSDTRQVLSPGAQEFNARISIGGMTCASCVNTVTKEVQQLDFVREVTVNLLTNSGTVGYTGPQTNHWKDC

SEQ ID NO: 23367 - protein, 212 aa, A.fumigatus
RRRHAHQILSLEHFLHIDVELRVQRFVLNHAPWLKAVLARVYYSHIVLGVIFLVYGYTFFQREKYQGVRRTLALENVIAFIILTLWRCSPPRLLPEEYGFIDMLHDNDAGSAWTQNKFQLTIAAMPSLHFGNAFFLALCLLRYSSHWILRVVAPLWPMMMGVTIIATANHFVLDALVGVCVTLTAYRFNHAVLVLLPVERVLFKLLRIEKPQ

SEQ ID NO: 23368 - protein, 62 aa, A.fumigatus
LISNQCSRLSAIFRSALHYPDRDNFAMGATRHIIVCQYKYWLCSISIVLFTQVTAAGTCLLR

SEQ ID NO: 23369 - protein, 62 aa, A.fumigatus
TLIKENLWLTIYVYIVALFKVNLSSGLKIKLWLASKSVFKYTASLLTEYAGRRDLCFIYTTV

SEQ ID NO: 23370 - protein, 137 aa, A.fumigatus
LTHCAGPSGPVVKISPRYNEPEYLLYIKSNKPYNQHDQPNDKDPGYQAFLNHPAFKRGDFPESKDKPYVFIVNVRPIVTTYNKYRATFPLQNHLHTHLSEYLHTQELIPVTPTTNNLTTIYIIKSTHKPTRLIRIHS

SEQ ID NO: 23371 - protein, 127 aa, A.fumigatus
YYTTTKIRINSILEYYKICLNTGCFSTIRNTEFIKALSSITITKLTDSIIVLGIGSCYQSNHSTMLTLWFPRLINNSGSANAFAKITIYYYLVNGLKPKLLIRTNVICSKGFILNFKHSITTISSCS

SEQ ID NO: 23372 - protein, 98 aa, A.fumigatus
AKPHQITYTVVYIKQRSLLPAYSVSKLAVYLKTDLLANHNFIFNPLDRLTLNRATIYTYIVNHKFSFIKVYNKTPTLITVTHHTYIGTISDTNFITTY

SEQ ID NO: 23373 - protein, 142 aa, A.fumigatus
  UNSURE (30),(114),(139): Identity of amino acid sequences at the above locations are unknown.
SLRWNLRCRFPLPNPYDPRAFPLSIRFSLXTNPPMKRTRARQNRSPLTGSDGSESDFVGSSPDWDEQRDATYETDVTEPDVTEPDDRPSPRKRLRSDQKDPALEPSLSNEADEXYDDPLDDTGIDPCEIDVLTSRLDGXAMR

SEQ ID NO: 23374 - protein, 77 aa, A.fumigatus
  UNSURE (52): Identity of amino acid sequences at the above locations are unknown.
TFPMGYKDIIKKYITHHVNNHSHKEECGKQPVCNKVVQWLQDANIFPTFMAXTTPRVGILKVKDKSLLKLTILWSIV

SEQ ID NO: 23375 - protein, 66 aa, A.fumigatus
SRNTALLHHDTVQKTFEMTAAELDAMISCTYLGTGAEMARYMKHISLAFSNGPQMVNSLYWKVFGV

SEQ ID NO: 23376 - protein, 173 aa, A.fumigatus
VEEYPFTSLSQEERKEQIRTRYMGAIIDIIAVAIFIEIVGVTYQLTGLIAMERELGMSQLIDCMLPNTSHWQSQAARFIAAHLALDIVYCPAWIISGAILKFGVYGKTSAGIVIIYNILAGLALSSFSIFGASFFRKAQLSGITVVILCLILGVIAQLAPASTNGAVVILSLL

SEQ ID NO: 23377 - protein, 250 aa, A.fumigatus
  UNSURE (237): Identity of amino acid sequences at the above locations are unknown.
RPRADKTARCVADHLLGIQDKESPINTRHLIHRAQFGRDDMATNANAPTKSFIIKHMNTSHADSLSLYLRAYCGVSAHFAHPAILQDISHSDLLITAKGTRYSVPINPPMTSLAETRARVVAMHKDSLQRLGLSDITIAEYRPPQGLQVVSLVLVVATLVVFGRRSNFLPESAFYETVGLDRYPVFTRFCYDVAPVVVGLLLGSHLVEATLSAVKMLRPHGVRFASGLWVVWIVSNXVERFPAWRRFDEM

SEQ ID NO: 23378 - protein, 119 aa, A.fumigatus
  UNSURE (3): Identity of amino acid sequences at the above locations are unknown.
YFXPRGEDNPTTRTMSLSDREQLVQLSREFDALIVTDDVYDFLQWSVDPDCPLAAPDEARVPRLVDIDRYMDGGPQDEWGNVISNGSFSKLIGPGMRTGWAEGTAKLAYGLSQTYFLVN

SEQ ID NO: 23379 - protein, 152 aa, A.fumigatus
SVLNNACWSCGEIAVTEKANLAPYADKLYHGLSTIINNEEIIDSVNENAAMALGRLGFCCSDQLASRLAEYAGSFLKSMNKIEFTREKASAFLGFNHVVMKNPQALESCLGEYFQAIATFPTKSLHQEDYRDIQSSFQQVRCSFIPLFDGIC

SEQ ID NO: 23380 - protein, 81 aa, A.fumigatus
NVVLDSNYRVLDKKEPGCPRSGSVIIYLGLGVPPLHSPQFPPPHLDNKLVLPLNLHLPLPRRASPVSFCSSASFYFVFTTG

SEQ ID NO: 23381 - protein, 71 aa, A.fumigatus
LLPYDYSHPYYMALDYSFFPLPMDESVDYMPLLFLSLSYLIREWSIQMEQQKNFSKFISGPSVKEGTSTDI

SEQ ID NO: 23382 - protein, 284 aa, A.fumigatus
  UNSURE (249): Identity of amino acid sequences at the above locations are unknown.
ILSSSPREDTLRAVSSGTCNAAEAQRLAKQHAEFGPLGHPSHLYVSKHSGGEIADPVLDEPPYFTAFTTYISFLILIFLGHFHDFCDKYFRSHTYKHLRPQNGYASLYSDFESFYTRRMKRRINDCFERPTTGVPGRYITLLDQQSNDNLHFRLTGTTTDTLNLSSYNYLGFAQSEGPCSDLAEETIRQNGITMAGSVAEPGTPQLHAEVEQLVARFVGKEDSIVFSMGFVNHATIFPALMEKGCLILXDEFNHASIRFGARLSRTAIQVFSHNNMADLEMRLP

SEQ ID NO: 23383 - protein, 166 aa, A.fumigatus
FGVADVMTPTRTKEPDQSYKPMNFPAGYSSHWPSMVIETAFSESQGTPANDARWWLNASGGELKIIITIAVQKKREAITIDKWEATSRPTRGDPGKTVPDVVQKVTITREGGDAPVHVTGAPLIIRFEKLFLRPAEEEKGEGDVLFTHDDLAEIADKVWSVLNTGN

SEQ ID NO: 23384 - protein, 186 aa, A.fumigatus
SSAAPGPGDDYAYTVDTLLDEIIDTLDQLNISKVHFVGESTSDMLDEALAAQFPSRLRSLTTISSPTLLPPAALRLFAFGYPSRPEACRQLGSRGWGERLARVPGTLSASDPAYEAWWLSQIAVSSSEGLAGYAGFLSTFDARAYLLRVSVPMLILAPAKSAATTLEEQLDLARQVKGSKLFSPTG

SEQ ID NO: 23385 - protein, 190 aa, A.fumigatus
PLQLQPRLVIILSAHYGDQASITGTLSDEPLSVHFIPSHSFLSFAAYNKTFKMHLILHPKTLILLLAVLVTIVCISIRRFLARRQFARQHGCQPVARSLNKDPFLGLDTIPETLRAASQHRILERSVELFRLYGNTFTVKELHKYAILTIEPENIKTILSLNFKDYGLSHRLQPFKPLLGESIFDTDGAH

SEQ ID NO: 23386 - protein, 84 aa, A.fumigatus
ASSRALIRPSFTRGQVTDLTALEDLMHDLFALLPGDGKNVLELRELFFRYTIESATDFLFGHSLRDLDEYSLRTGVSALLFIHP

SEQ ID NO: 23387 - protein, 172 aa, A.fumigatus
RLLRAPTSGGQYHWISMLAPRWTVKFLSYMCGWLTVIGWQATFATACYLCGTMVQGVAVLTRPNYQPQSWHPTFYFWAIVAFAVSINVVGRNVLPKFEGLILVVHILGFFAILIPLVSLADIGSAKDVFTEFVNQGGWPTQGLSFLCWLDRLCVCLCGRRCRSARKSTIALS

SEQ ID NO: 23388 - protein, 63 aa, A.fumigatus
  UNSURE (26): Identity of amino acid sequences at the above locations are unknown.
QSQHQKSKDGKPLATGDWLATLDNPXSGNFESGKRILNSPHCWPFRMGFSSNLAANSGICPQG

SEQ ID NO: 23389 - protein, 85 aa, A.fumigatus
VHRVRSSTRYSVLCASLAAPLIHITLHLGMHLKLGNYQPMCAFSNLLVVLNLRSTVTTGICPIRFKDSLSTEYPSVWCTARLLGD

SEQ ID NO: 23390 - protein, 150 aa, A.fumigatus
SSFLFTTSSSSSLSFPPDLRTAHTFKMRVSTLLPLALAAGTAAASKNGTLGFALGNKNEGGKCKVQSDYETDFDTLKEVTSLVRIYSASDCDTAKHIIPAAKAKNFKVVLGVWYGTRHITSALRQAARLLTLPRLVGPITTNLSPTTSTP

SEQ ID NO: 23391 - protein, 88 aa, A.fumigatus
LSIIPQQSQGCDGRLTCNLQPTLMEVLKQLHVSVSQNFDRLFDDAYKSLHTELTRRDEYVKKLDVELARTDRNNASAEVLKLNREISL

SEQ ID NO: 23392 - protein, 80 aa, A.fumigatus
KWQWPRFPTGSTYIPIDQHPQEPEQNAPAPFPTAASSKTRKHSGIHGINTTNHGQLWFTLPQGKYPPTGTQPESFWKLDS

SEQ ID NO: 23393 - protein, 88 aa, A.fumigatus
SGEEESVCASSDTTCSANTDNVRYVTDIEYFKETEVRNDPVAAKNNAAHWVIVVMDALTAGVEDIRGLSPKDEYINLEDFEHFMSDSD

SEQ ID NO: 23394 - protein, 303 aa, A.fumigatus
  UNSURE (286): Identity of amino acid sequences at the above locations are unknown.
DDFFFPACRQIMRIGIIHVGAPAGGMNQATRAAVGYCLTRGHTPLAIHNGFPGLCRHHDDQPVGSVREVKWLESDAWVNEGGSDIGTNRSLPSEDFETTAMCFEKYKFDALFVVGGFEAFTAVSQLRQARDKYPAFKIPMVVLPATISNNVPGTEYSLGSDTCLNTLIDFCDAIRQSASSSRRRVFVIETQGGKSGYIATTAGLAVGATAVYIPEEGIDIKMLSNDIDFLRENFARDKGANRAGKLILRNECASSTYTTQVIADIFKEEAKGRFESRSAVPGHFQXGGKPSPMDRIRALRMAV

SEQ ID NO: 23395 - protein, 69 aa, A.fumigatus
WMIGNYRHREVRGAIFRSRVHIRINGVHSNGFLLLKASSLEITALHLFTWFLYFSHCPPFLVFTPTSVN

SEQ ID NO: 23396 - protein, 64 aa, A.fumigatus
SSYTLSKVTIPPHFFYAFTPFLFRLPPPFQKPQTPPSKNPFFNFAQQLVSLPNASNSVSLKPLP

SEQ ID NO: 23397 - protein, 228 aa, A.fumigatus
FPIIHQSRSHSLPRLLVQLDFKMIPAATAKYDWILALTSITFVFSAFGNGANDVANSYATSVAARTLSMWQVGILAVCTEFIGAVALGARVTDTIKSGIISIDRFENKPGPLMLAMGCAEMGNAAWLMLATGMGWPVSTTQTIVGALVGVGFAAQAPIHWEWTKGSVSQIAASWGIAPAIAAGFSALMFGILKYSVLERKDPFKWAMRLIPGFHHGARRTANGLVKRA

SEQ ID NO: 23398 - protein, 289 aa, A.fumigatus
  UNSURE (203): Identity of amino acid sequences at the above locations are unknown.
YLLISNKPTAHSLTPPQSHKPQQKTPSSSYTTPTSTKAKRGCERNRMAPPTELHHLYTTMAAFVTSCMSAHDPSHNPAHVHRVVTLARTILEKEQLLHPDITYDEDVVKLAALLHDIGDRKYLTQVAAATSAAGEQQQQQAAVDPGRMVEQALLAHGADVALAAKVQTIVTHVSYSKEVKDPATVRRLIDEEGYVELAVVQDXDRLDALGAMGIGRCFTFLGAQGRKYLSPEEPWDMNNAIAHFQDKLERLEGMMKTQTGREMARVRTQRLIEFRKWWEEEMEEATHIP

SEQ ID NO: 23399 - protein, 139 aa, A.fumigatus
  UNSURE (39): Identity of amino acid sequences at the above locations are unknown.
AIALFISHGSSGLRYFLPCAPRNVKHRPIPIAPNASNRXASCTTASSTYPSSSINLRTVAGSLTSFEYDTCVTMVCTFAASATSAPCANSACSTIRPGSTAACCCCCSPAADVAAATCVRYFLSPMSWSKAASLTTSSS

SEQ ID NO: 23400 - protein, 64 aa, A.fumigatus
PTTEEGIRTDLSAVVRSAAFFAMSYVKKDEDADQVMIKLDRTSVFQDGKGILSSPEEATKLPSN

SEQ ID NO: 23401 - protein, 97 aa, A.fumigatus
TDQNSEEICNASTAPWSPWSCVAPILVSDLPTVRSLEFQEGLILYYSVVSYYYTADEGKPVWTVPLHATVAFTGNNSSEILRDNDANKESIILEVYL

SEQ ID NO: 23402 - protein, 96 aa, A.fumigatus
VLVIHESCTGISTTSGLTSILSFSRLIALFELAGMPMFDCTQIVACIPRSQEVTDSEIVRNLGWCGFNLTTLKPWVSEQCVEHCLSTKWLFLCAEV

SEQ ID NO: 23403 - protein, 392 aa, A.fumigatus
EDMRPGRRRWTPWVTPKAAASSNVGHSVCRVRGKELFMLATECARVLGYRDSYLLFNKNRSLHKIIASQIEKDDLIQQDVLPYSYRSRQIAIVSAKSIFRQFGSRVIVNGRRVRDDYWESKARKQGFTEDDLAGEKRPGAGKARDAAAAEAANAANLLPTLTHGDVIYSNALETMPHGLPVGGPASSSLASLPMIHMATTTDDPRLREYNSMPRARQEITGQPYQDRLQPSSAAEILNHASHTADFNKILSNQRSFRQKGLEEFYSSQREVPETADLAQPAQLDATVSVSQPLQSPQMASTGLISSTQPQAILPNQAPMMAGQTAFQAPTGPQQGAIAQSPIQPVPAVRANLMHQRSNPSMFWGHAGSRPGPYGYPAATATKWWGQSTFRRL

SEQ ID NO: 23404 - protein, 165 aa, A.fumigatus
ANILTSVFLLGLYYKLHGCYRPTTMKKSIIKRRKRVVPALRDQSPSGATYSSNGSSASPEASPAVLAHSHDDHYRYLSSDPTLQANHQRHYAVAPPPVDFTHFSATGSLSLPHHPPPPILLEPERLSAPSHSPIPQFGRRSISPSTSGSAKKRTLAETTSSTDTA

SEQ ID NO: 23405 - protein, 152 aa, A.fumigatus
ERVSFLPRRCKTGGQQSGDGFAQSESASQGHCQSNSGGGSCPGGGNCNGTGGAEGCDGCPAYNNRVYKSAARGTVPIHSWRATNSGSDRPLAETENDAGKNGATVEGGNMLVSCQNCGTTVTPLWRRDENGHPICNACGTSTLPQSCDKPIY

SEQ ID NO: 23406 - protein, 299 aa, A.fumigatus
TPEYGSSPGSSSRFDRADSSEVQTGGPNGTLGLGLGSLRVPTQLDPEHHIAFLEKQRKNKGALRIPSPREYDRGGVPEVLEEADDEGEGSKRTRSSESDDENSRNSEESDQVGPLEGPHITINEPDIQQTRTRNSTFPRLDTRPTYRDTKDLNDTSALERSRSRRPTLSNLVRSLTQERERTTLPYLSWNATVARNSNFVDLTEEQRDELGGIEYRALKTLAIVLTSYYLFFHILGMVCLVGWIMTTHWGQVVEQIGQGRPWWGIFTAGSAFNDVGFTLTPDSMTSFQVFTTGLEGSAH

SEQ ID NO: 23407 - protein, 169 aa, A.fumigatus
QIRETEPDLKGRFILQDRPIVIEENGRELESHGIEPMAHDFFQPQPVKGMGPIPVPSFPDCLRLNGIGALVYYVRRVFHDWPDDEVRQILVNLAAAMAQHSRILIVEFIMPEVGATMSNAYMDHTMMTFAGVERTEKNFASLLDQAGLKLVKTWRAPGVPVGVVEARLQ

SEQ ID NO: 23408 - protein, 62 aa, A.fumigatus
LLRQSKAVLQAFEAERTYLYVSTKARKPEPQPPELMTALHNASDTINNIREVFTTGADGSAL

SEQ ID NO: 23409 - protein, 189 aa, A.fumigatus
  UNSURE (189): Identity of amino acid sequences at the above locations are unknown.
NPGSSDSEGLRLLTGKRISMFLQSWYLFRKRVTILRRNPIPYLAALLIPVVAAGLVTLFLKGATKAGCSGDSAYRASGFESLASLENFEFVVGPRDRLSISALESFIGSLSGLIRSTRNTSLNLNSRFHLVNSLTEFEDYISHNYTNITPGGFYLGDANSAPTFAWKGDNSHFPLSGLHHRGRRIRGSX

SEQ ID NO: 23410 - protein, 180 aa, A.fumigatus
EDSRWACPAVVIYPNMYRLSTLLMALGSVTLADTNSNTFNPLHHLAGISPYFTPNDPQLDPSVPQGCNVTRAAYLARHAAIYANDFDYERYLEPFIQKLQNTTHDWSKGGSLSFLNKWNAPITEAHLEKITRIGLQGINHVWHQYPRQVSRLPNPKECMDSNIGENRQDCTRIYPWIHRQ

SEQ ID NO: 23411 - protein, 90 aa, A.fumigatus
QPQEFVSHYTKPIITRLQAQAPAFNFTSDDIVAMFELCGYETVIRGSSPFCSLGLFTATEWLAFEYGNDLMYFHNTGYGRDLSPAIGFPC

SEQ ID NO: 23412 - protein, 208 aa, A.fumigatus
TSGTRQSPKHISKKSPELVCKESIMFGINIHDKYPDFQTPKNVWTATSERTVKTAQGFILGYTGNETAQIKLTQVGGVQARRSRLVNPVQKLPGIQLQLWLQTVQCTYSPSPPLTARANNPRNSSPTTPNLSLRVSKPRPPPSTSRPTTSSPCSSSAAMRPSSAAPPPSAPSASSPPLNGSPSSTGTISCTSTTQATAVTYPPPSASP

SEQ ID NO: 23413 - protein, 61 aa, A.fumigatus
  UNSURE (16),(19),(31),(32),(35),(40): Identity of amino acid sequences at the above locations are unknown.
MEIPSYPHHMPLIAEXKEXGSRNTRKPLIHXXTTXQATQXAQRAQTGITHQPFFFPTPHFI

SEQ ID NO: 23414 - protein, 69 aa, A.fumigatus
  UNSURE (40),(57): Identity of amino acid sequences at the above locations are unknown.
LYIRPGSSLPKPKPGPDEKTGPVPEYDKGGSQAKRLSASXGPNGSSRGRAGRSKRPXDKDKTQGGRRVI

SEQ ID NO: 23415 - protein, 255 aa, A.fumigatus
  UNSURE (10),(12),(51): Identity of amino acid sequences at the above locations are unknown.
GVCGCFCYHXLXIPLLVAYDEDMRGFPFTRLPSKKLRSSVDAAPENLNPIXEVPPQQSPRRGRPPKKKKKKPERCPEESAGHTEKSAEMTSKRQTRRRRSPVTEPEPQPQSVTRSSARKREEAESVPKEKKRRKGRPSKTEVEARNGFVSPEPQQSSTAKIALPLADTPVIQRNKEMRKEAKSEKGGKGRRSSLGMRGRRASSLIDSGASNGTNGLVEFAMETAVLTTFQRCLTKRSTQPISTNILQMGSQNRGG

SEQ ID NO: 23416 - protein, 94 aa, A.fumigatus
SSAPARPVVKTSLLNPSNNVLNADRALFHPKVPLHLEGILALNLLSVYEYAQRGNLCTMTDRANEALTSAMKMSLHESLEEDEYGGGPGEGPGG

SEQ ID NO: 23417 - protein, 60 aa, A.fumigatus
PIPLFLLRLSCDDATRAMISLHSFTPLKFYYSLLRPIANNKAASYGRVAFPVNQILLDCQ

SEQ ID NO: 23418 - protein, 153 aa, A.fumigatus
NLFHTCAPRLKPIIQRLYTANIYHDLLYTLGFTEKAGNFEYNTNGQGGLGNDYVILNAQDGSGTNNANFATPPDGQPGRMRMYVWTESTPYRDGSFEAGIVIHEYTHGRTYYLAGFIDTRLTPFFSFQPTHWRPCQLQLPERPRVRRHGRRLE

SEQ ID NO: 23419 - protein, 76 aa, A.fumigatus
FHGDGHPSEARRQALDRLHHGRMGFQPGRRNPPVPVLDLAEHQPSNVHQRQLAERGARHWHGLGIHAVRGVVEFDR

SEQ ID NO: 23420 - protein, 153 aa, A.fumigatus
STSILTVVRITLLVLLTHDSPLFSVSNRLTGGPANSNCLNALESGGMGEGWSDFMATAIRLKPGDKRSTDYTMGEWASNRAGGIRQYPYSTSLSTNPLTYTSVNSLNAVHAIGTVWASMLYEVLWNLIDKHGKNDAPKPTLRDGVPTDGSTLP

SEQ ID NO: 23421 - protein, 219 aa, A.fumigatus
  UNSURE (176): Identity of amino acid sequences at the above locations are unknown.
RKQQSFSLSLLHTHPLVLSRSVLLISVFFIPLDTMEAPPQMPSISVVASSRAVISGRLTSATIVISRTTGKITAVFDSVILASEFPAGTPYTDYSPHVLLPGLVDAHVHLNEPGRTEWEGFYTGTQAAAFGGVTTVIDMPLNAIPPTTTVAGLKEKIQAAEGKCWVDVGFYGGIVXGNAGELKALVQQGVRGFKGFLIDSGVCICSLARSSVHTDRFIL

SEQ ID NO: 23422 - protein, 246 aa, A.fumigatus
VCRHLLTCHSGYYGPDGNHNQQEGGYYDAGQPHDHYYGDHYYDQGNGQQGYDNRGRRRGDSEEDSETFSDFTMRSETARAADMDYYGRGDERYNSYADSQYGGRGYGYRPPSSQISYGANRSSGASTPVYGMDYGNALPAGQRSREPYPAWASDGQVPVSKEEIEDIFLDLVNKFGFQRDSMRNMYDHLMTMLDSRASRMTPNQALLSLHADYIGGDNANYRRWYFAAHLDLDDAVGFANMKLVKS

SEQ ID NO: 23423 - protein, 131 aa, A.fumigatus
  UNSURE (3): Identity of amino acid sequences at the above locations are unknown.
MIXGSRGSEGIRVVLSDESVSVEPLDITKAKAAESILEQLPETPDFLFVTGGSRGDEALFRWANRLQGENKIPDVTTVTVGSHATEATAVLPTGMSIADVVNTLTSSSVNGANIANGHEPPVNGDNSALSS

SEQ ID NO: 23424 - protein, 285 aa, A.fumigatus
SPDFITYSMVARSRFSPTIFYANTPQSIREKSNLDPNLVEDVCVGNVLAPGSAYIARSAVLAAGFPVTAAASIANRFCSSGLLAIQNVANQIMAGSIDIGIAVGAESMSTNADGGAPEMSAQILSHPIASQNTQPMGQTSENVAAQFNISREQHDQFAAKSYQKAERAQKSGWTADEIVPVKTQVKDPKTGEVKDVVVDRDDGIRYGTTVESLSKIRSAFPHWKPSGPTRGKCHSNPRWAPGVFPINRSLAQEIRNTTIGKFGRTTFSGFGNPDFWVLGPPLDIP

SEQ ID NO: 23425 - protein, 235 aa, A.fumigatus
LRTLSARPSTLVVEDDPMGVMRFHFKSATDLRNLEKMGKSDPYVRVLLSGITKGRTVTFRNNLNPEWDEVVYVPIHSAREKLTLEVMDEESLNADRSLGSFEINASDYVHENENGEYETDDEKQLISSPLRLGHREKGVLNYTVAFYPAVPVVNPEDEEEEEAEEMEGLDVPAVRKSIDSRRKSSHSKNPSVDSKASKSTANGQNGAATNGTTTNGDELKVPVFTTGGRTIRAKH

SEQ ID NO: 23426 - protein, 254 aa, A.fumigatus
KRCLPAQDSLSIWLPCRAVLADCRHGFGKDIYDASVAQTCISNLLAIGYRRFLIDIYWSVEQRNWILCPVAKPQDAQVVTVSTTRSPTATASAVTGTLTAVAAPSGSLLYELGPYLCSDNLDLSGLVDIFAEHFRVTNSQWNVYTTFITVNLHVASSTASFDQPAASVTNEQLPLPSEYVSALFNARLSTYIYRPSELAKERKNLNESWYAVDDGYQPITEYFTLHEDANGKQSTPDGWPSSKYVQLAQERRIF

SEQ ID NO: 23427 - protein, 219 aa, A.fumigatus
RILQFFQQMCGGNLISVYASTIFEQNLGLSASLSKNLAACALTWKFICCFIAFFTIDRLGRRVVFMISGTGMAICMIALAITNSRGTDNKGASIASVVFIFLFNLFYPIGFLGGNFLYCTEVAPVRLRVAMSSISTANHWLWNFVVVMVTPIALDTIGYQYYVMYAVLSACIPLLVYFFYPETMNRNLELLNHVFRDASSPWKIVSMAKHLPQGEVTDA

SEQ ID NO: 23428 - protein, 104 aa, A.fumigatus
SMMGFFPVHGQDVYLITPPFFKEVSIRNQVTGKVATVRNTNFDPSYKAIYIQSAKRDGKLWTKNWISHDFFVDGGVLELELGPAESAWGTHVEDLPPSLGGYRM

SEQ ID NO: 23429 - protein, 324 aa, A.fumigatus
  UNSURE (319): Identity of amino acid sequences at the above locations are unknown.
CFKPRGKVRCSTPLTQHIGQQPASEPAVFRLLVLADPQLEGDSSLPSPDKELSARIKQHWTSIRSSVTDSGSPFHRDVLRNVTAALRTLAHEDVPRSIQAARKRLDLVGNDFYLAHIYRTLHWWSRPTHVTVLGDLIGSQWVTDEEFERRADRYWNRVFRGGERVSDDITVTGSAGYGAGSGDVSALEELNATDSAWTRRIINIAGNHDIGYAGDASEDRIERFERIFGRANWDIRFQHTLGNQAGGTADATVKPTLHLINLNTLTLDGPALSEQVQSNSYAFINDLITHRTYPVEDRTTFTLLLTHLPLHVFTAGLQXACYNN

SEQ ID NO: 23430 - protein, 62 aa, A.fumigatus
RGCQCCYIPSASALFSTSTNTFVTSYRAPSLYSPGYTSNAFSSHTFRHCSSLSPTRVDHNQR

SEQ ID NO: 23431 - protein, 270 aa, A.fumigatus
FSSRLVKTQFLKDKPLRRATMSSLPLPVTSQREPAHTQSSSTTTWAIPPPNHTFVPKSSKNVDLSSDATIPASDPALQDDMSDEGVNAATSQAPLRSSPPQPIRSSPPIAPPRFIRQGTPPTPSHPTPSATVPHSRQRESTTINDSGYFSSLESSAMRPKKTGHILTSDLDIDPPRIKRGRAEEEIARIRSSSHDISPRRPGMLTDAGVVTGSSPARGEYVSMLPPPLTPVNKFKKPVKPPPSVSPNTNLPESPQENPTNGQFSLKKIGA

SEQ ID NO: 23432 - protein, 81 aa, A.fumigatus
PCFFSFEGSTTQVAYTSTESGFLVFKFHEAQLSRSNVQLEVLMDDHMFPSYSTPKIRSKAAKLVDGLSPEGKSTGKEADSY

SEQ ID NO: 23433 - protein, 221 aa, A.fumigatus
  UNSURE (198),(203): Identity of amino acid sequences at the above locations are unknown.
DEHQYIEYARQQKAYKKLTTIFTDALRLHPTSVDLWIYAAQYNLDDHADMTMARTYMQRGLRFCKSSRKLWLHYAKLELIYIAKLVARQRILGLDQKIETTNPAEGSGFDDPNADMIALPKITGEDINPSAGDEDGVDHVALEKLNSTPALSGAVPLAVFDTAMKNFNNDDRFGHEFYDMVSEFEDLPCLRKILGHVXEVMSXHKPNSYHTHICNIKYPTA

SEQ ID NO: 23434 - protein, 245 aa, A.fumigatus
  UNSURE (208): Identity of amino acid sequences at the above locations are unknown.
RQDGKGEFSPLKAITERHHPYFVELLATEAGVEPADILDFEMILFDTQKSCLGGMHEEFIFSPRLDNLNSSFCATVGLIESVADSSALDDETSIRLISLFDHEEIGSRTAQGADSNLLPAVIHRLSVLPSTSSDQDDVSTAYEQTLSTSFLLSADMAHAVHPNYAAKYESDHRPEINKGPVIKINANARYATNSPGIVLLQEVARKAXENGGERIPLQLFLVRHNSSCGSTIGPMRSACTKCPNP

SEQ ID NO: 23435 - protein, 409 aa, A.fumigatus
  UNSURE (136): Identity of amino acid sequences at the above locations are unknown.
CLKPFGDNTFVQMKRLQLLRWSSSVRSPRPRTNSRLHQRVCASLRYQSTSSPVTQAEEHQSIEEQSLRSPIPPSNSRQSRYLLPSPPVEAARESAKLAALHARLYLPSRLPLETLARALVDASADPNPDFNNESLXTLGHDLLTNYTSEHLICTYPRLPLTVIFAAMYAYVGPKTLSAMAREWGVEMAVAPGGEVDPGLLQFRRVSPGTDLNAEPVTGTARPNDHRKSWRKSITSRVVYDNEFGDPVKEVADSAAQAVSETHGAQGVTAEQASATFVRAVMGAIYLHAGRPAAKRFFEQHILSRHLNISELFNFSQPARDLTRLCARENFERPVAKIISETGRKSRHPVFVVGIYSGQDKLGEGAGASLMEARSRAAVAALKGWYLYSPLNVRVPSSMEEEGAAPWKRL

SEQ ID NO: 23436 - protein, 193 aa, A.fumigatus
RFQWCDLSKTDAVSTNQSAAHLSKRTHRFFDSRGPDGSRAPRPDAGADGVRAVIQGGQVLTFKRDHHKLFSHHGYIYTMLLVRGLLESSPTEEVLVTGAGDGVVKLWRLDQDEAPSEMAALENGDPVLALAVDGSFLYCGLSGGALNIWNLDSRQLVKRITGHTGDLWAVDIVQGLVVCGDSNGVIKVCSWLY

SEQ ID NO: 23437 - protein, 79 aa, A.fumigatus
CWSVSDLVTRNLILDLKKWAAGLLTEERCLRLQPARFRDRLIYPSGGHDITVGNLDMTGGVLPAERTSPRPLTGKIENI

SEQ ID NO: 23438 - protein, 66 aa, A.fumigatus
  UNSURE (10): Identity of amino acid sequences at the above locations are unknown.
RTLSNEHTIXITQLMDHARNHISTHRGTHGRLGCKIERTQAYEGQITTTAYDIILSKIQQLQSVCV

SEQ ID NO: 23439 - protein, 146 aa, A.fumigatus
HSVDFQGRAPASLISLVVLRYCSSAPAAYLRIPGIKNNAHRLLGTKQACLFRDKYDYITSTGLSIYGLSADSIKANSSFKAKQSLPYPLLCDTASTLISSLGFKKTPRGTTRGVFAVDKQGKVYFCTLEGQMPHGKLLRNLSRRVT

SEQ ID NO: 23440 - protein, 68 aa, A.fumigatus
ASRKHRGTEFTREVIIGDDCWIGANVTILAGVTIGSGCSIGAGSVVKRDIPPYSIAVGSPARVIRSAV

SEQ ID NO: 23441 - protein, 64 aa, A.fumigatus
  UNSURE (3): Identity of amino acid sequences at the above locations are unknown.
LFXHRRIWPQNEYLDLGIYNTIFRALSHIPSFLSPIAYEKNNRLLISLANRRFDSNIVLSQEAE

SEQ ID NO: 23442 - protein, 80 aa, A.fumigatus
PGLRNERLCKLMFSLTKPQLTGLVTFQYLLWSYTSKQYHLLFKPIMMKDGISVPLPVVMWHRSLIIPPHCSSHRDCSCSC

SEQ ID NO: 23443 - protein, 79 aa, A.fumigatus
FFYCTDPSSPAVKTTDKSPIRTRSGAGQKKRGTKESDEGFSTVPPKKGAKPQTKEELEKFPDVPDVQGTNPFEELEKAA

SEQ ID NO: 23444 - protein, 62 aa, A.fumigatus
SIRLHPGVCVQEDPLKEWLNNVPSLINPCTSSPSTAKLPPVETVQNFEWKKKYSSAIVRIPH

SEQ ID NO: 23445 - protein, 94 aa, A.fumigatus
AVRVAADTLAGLDYAGNAADVGFAEVAAGLWAEQQYTHEVAGPHVENSAVTFAVAVGGAEVAAEAAECGVNLLPFLGLSVCRCCRCRFCWDGFF

SEQ ID NO: 23446 - protein, 301 aa, A.fumigatus
HHIQQPQQQPQHHLQQQQMSQQSSQHGGQPPHGYTAAQPTGQLPPQQNPHQQHYQHSPTPPGYQQQPGQLTFQQSPLQANFQQYNPGGSVSVPGRANGGQSNHGYMPGIPHYSQSQPTQVLYERARMAASAKSSPSSRKSGLPSQRRPWTTEEENALMAGLDRVKGPHWSQILAMFGPGGTISEALKDRNQVQLKDKARNLKLFFLKSGIEVPYYLKFVTGELKTRAPAQAAKREARERQKKQGEEDKAHVEGIKGMMALAGAHSQPVPLGHGHEAMSASPSLPDTGSHSTFDQTAESSPR

SEQ ID NO: 23447 - protein, 127 aa, A.fumigatus
ERKYFDSGDYALSKAGKASDVGVTNIGSKHPVPENIPHLTATSPGANNPAAASNGSSASSQGQQHHGSISGHPGSIGFQSRSPVKEASYLQRGTSVDDTEGVDDSAKGGNDPSVSPPPDRDGVPIRR

SEQ ID NO: 23448 - protein, 77 aa, A.fumigatus
HRWLVQLAEDKNYRRIFKNAVLLNSALYIVKLFTNNLLILTFSTLIVISPRILCFKLLIVIDKGRNLVLAYIELSTC

SEQ ID NO: 23449 - protein, 66 aa, A.fumigatus
PLSTALKTVIYESPRLTFSLYPFLSQYIFSNFNVLHGGQKGHSAESSRSVVEPRRSICGSENPVLE

SEQ ID NO: 23450 - protein, 302 aa, A.fumigatus
NNFPPRLIQPTHPPFKALKERLMLPGFGVHPHRRGVVDEFPSSALPTPAEATASGMPMGHHHHHHHHHHHHTSRPTASVANSAALSPMREPRTVVTIEPVVSSVAHLPRHHLGSTLYIPRIDIPSAKAPLESAKFGYTTTPLPIPRFEGKENCTFTVRVPRFRIDAGRREEICARRALWGTGIYTDDSDPVAAAMHSGFFRGAWSEEIDVDMLDLEIRDAYQHAPTTAEDMGLTGDRPRIPPVPPTDKDLHITLLILPKLERYESSVLFGLKSRSWDGNHDGMSFKVLRVEWVDEGVGRGGL

SEQ ID NO: 23451 - protein, 150 aa, A.fumigatus
QRSRRVYTEAIQPATMPSTPHQTSGRWVEQEGRIQLAISALQKNEVASIRRAAEIFHVPRSTLRGRLNGCQCRVEKRANHHRLSPTQEESRLATPHALRQSQKQASLVKKLLKQRSQSTSTTSKLAIQQIIKGCEMIMQGVFTTRADDPR

SEQ ID NO: 23452 - protein, 138 aa, A.fumigatus
AGRAFWDSCFEMISCVVILLLASLAAALSAVQFPDNANHIFNAIHSSMRQWGSSLHHNGMSFFLASVPAGTQLYHGTHQRDRVNGTEWLAFEPEHAMVFAAFGPGRGPPPGGPDSPDYDDPRRRSFRLHHEAAASAIV

SEQ ID NO: 23453 - protein, 219 aa, A.fumigatus
  UNSURE (200),(218): Identity of amino acid sequences at the above locations are unknown.
IRTIKRDGGLILTDVLLIDGLTKRFRLPGWRIAWIVGPKEFIDALGSAGSYLDGGANVPFQEAAIPMLEPSLVRAEMKALQRHFREKRDYVLKRLHEIGFRVKDVPQATFYIWLDLTSLEPPLPKEANISDGLNFFNALLTEKVIVIPGIFFDLNPAKRRDLFDSPCHHFVRLSYGPQMDFLKKGLDGIKKVIRRARGKXVELRPHTDPHWEDEVALXD

SEQ ID NO: 23454 - protein, 77 aa, A.fumigatus
ETPPATEYRVTSIRPSKFRFTTFVTHNGPFLQLITPSSKGGIPTGDNFIQSSINHFSQLLKIHEGQNLPPNTLPPQI

SEQ ID NO: 23455 - protein, 78 aa, A.fumigatus
  UNSURE (7),(26): Identity of amino acid sequences at the above locations are unknown.
SVVLVEXPLSFGLTLILTGKMKLPCXIKPSHRLTATLVISSFQHVETCYRNLPYESGISHLHNIMWQTKKPHLQRSIE

SEQ ID NO: 23456 - protein, 274 aa, A.fumigatus
WHLRLDGKGVFKQGLLSLRTKLQQRYYTSVAAFSADLASIFTSEIGVQPAGDTAELQMQISGRAPELPLEQREKRKLAKRIIKAIQPALEDAIKKESELNRKPFEKELKELDLMFENSVLSRRGSVEEGSAKPAEGEARIDNPVSGEVSDGVQEKVGSKAGLPAKVEPQEESSTSALPEKAEDTATLDAGNDRHIPDAQAQDTPMTDSAELTASAAVTEPEDQIAPGASATIPTSAEAQQEAGPSKEEANSSPLLAQLTESQKGSSHSCSPRGW

SEQ ID NO: 23457 - protein, 270 aa, A.fumigatus
TLVQSQSSTAVACIQWTQRKRSSAGSGGRIGGLAQQCSSQNLKSTKLKVPFAFHSAQVDPILESFEESAQGVIFHEPAVPFVSALNGEVITESNYSVLGPTYMVKHCREAVNFLGALEATRHAKLMDDATLWVEVGSHPICSGMIKSTFGPQATTVPSLRRDDDPWKILSNSLSTLHLAGVELNWKEFHQDFSSAHEVLELPRYGWDLKNYWIPYTNNFCLTKGGPVTAEVSAPKSTFLTTAAQKIVECREDGNTATLVVENNIAEPELN

SEQ ID NO: 23458 - protein, 171 aa, A.fumigatus
PFMKADWVHYISAVKCNDNKTLLTMLSRAGTGFDCASKKEMQQILQLGVNPERIIFAAPRKAEDHINYAHEHGIDKIVVDSEDELRKLAEIVPSATIFLRLRADDPTSRVRLSEKFGSDLLEARGILQVAVDLSVKVTGICFHVGSAASDPGAYVRSIAMAREVYDYNETL

SEQ ID NO: 23459 - protein, 162 aa, A.fumigatus
HPPKTSATVCSLPSVSPHKLTSLPACKIFRFCSEPCHKASLQKHLPYCIPSVSLRESKSLAVKPRCPPWVRDQALSKIRPLDRDRTVDVLASYTFYFDPRNFTTFRMKLSSLTNTLIIFSLDSDIRFATIDSSLSPSSSGHGNTSSSSPTTASANPRGIQWL

SEQ ID NO: 23460 - protein, 287 aa, A.fumigatus
SKAPCTPAVKTLALHDNAQESVASSLPGATAQNHQSQTGQTNEPTKSPSHRQNNSNTLLGGMSPSEAAVQWPLDRVLLWLAKNGFSRDWQETFKTLQIEGADFLDIGHGANGRGNFNKMHNEVFPQLAKECEASGTGWDKERELGEGKRMRRLIRQIHDDESFDVGIPAQKRRESQAPSEGAPDTSPKLSHEPQSAGPHSGTIENSPNLRAPQLAQPHRHSVQMRSVTLPIPTTHDIASSHFSHKDGISSRSDFSRSVLVGLGVDHRQQNPSMSSDNCNLVAPFRSY

SEQ ID NO: 23461 - protein, 66 aa, A.fumigatus
  UNSURE (40),(48): Identity of amino acid sequences at the above locations are unknown.
FWLGWLNSVIGKSTIEASNNPAQTDRLFLILRYIYRMDWXMQFTPRPXRLTRRAKISTGLPLEANL

SEQ ID NO: 23462 - protein, 105 aa, A.fumigatus
  UNSURE (95),(104): Identity of amino acid sequences at the above locations are unknown.
VCYTSLQNLKDSKGSFGMTWEKDGTSPSQHPSDIEACGTPDASKSNNDAATEGPTSAFKPLALLDRFLAVWIFLAMAIGIILGNFVPNNEQNSWXKGKFLCGVXG

SEQ ID NO: 23463 - protein, 324 aa, A.fumigatus
DGGIVRSIVGLDVFKRTYGYQHEGVYIIAARWLSAFNYATLLGAIIGALLSGLAYDRFGPRVMITICSCLSIGFIFVQFFSHTPAQLFVGELVNGCIIAFYPICASTYVSEVTPLVLRGFVATMTNLAFSIGSLIASGILKGAAAMDTTWSYKIPIAAQWALPTVMLLLVAFVPEPPYWLCKHGRDDAAIISLRRLTTAPAAEVYVARKLAHIRETLRLEESFQGDRPTYRECLRGPNLRRLVICVMAYNMQAFTGNVFFINYAVHFMEVAGLDASHAFSMNIGLTAIGLLGTCLSWFLLSYIGRRTMYLFGCVFTTRRQGPAV

SEQ ID NO: 23464 - protein, 241 aa, A.fumigatus
  UNSURE (232): Identity of amino acid sequences at the above locations are unknown.
SELARCSQSMDSWLSALPKDAQYIPASKTNFEDGEDVLLLHGAMLRMLYHATISALYRPWAYSRDPDKSRFEITQNARSKMHDAALGITHIIQGLNQLNLTRFLPQSGVTVIIPAAVAHLSNIMSNNPAVRETSLQHFQRCIQVLRGLRDLYPAADMEVANIEAAVKVQSDSVSTFLKIMEYSNVSIDQLQPPEPPLHKQSIDSNMHTACSPEGSSPDRRGSFVGATDAQPXEHRTGSLQT

SEQ ID NO: 23465 - protein, 87 aa, A.fumigatus
RGQLREREFRASLLFSRVPFLLPVPLFAPETDFNKSHMHHVSDQGGDAARYSRNGDKYVFLLPGGVLGQGAALYPRQPRVRRLRRLS

SEQ ID NO: 23466 - protein, 180 aa, A.fumigatus
ERCPSSPAIEDATASAGSRRTAPRARSPKSWARIRTCTRPMSTASHCRTTTAVLAAPPSSSSSSYKPPTPPNSLRRPRTSSTVSQPTSSKTCPGSRLPCSSASRPRCKRQATTSSRNTSCAPRAWTLRSSAARISCTGCRGTPMFHSSRRTGTGCIPDKSSCDFMILPLYPYLMAITFVP

SEQ ID NO: 23467 - protein, 133 aa, A.fumigatus
SDVLPARQLKTLRPLREVGERLHERGRRSPGRASGRARGQCLRRRIAEPRRPCWLRRHRLPAAVTSRQPLRTRCAVPERPRQSRSPRPQKPAPVRGSPVPPRHARDASDRQQQAAETRPAHRGRGPCARQRQG

SEQ ID NO: 23468 - protein, 152 aa, A.fumigatus
RRYGLCGKSENGSTSEVAEVLGAHPDVHEANVYGVALPNHDGRAGCAAIVFQQQLQAANPSELAAPSQNVLDSLAAHVLKNLPRFAAPLFLRVTPEMQATGNNKQQKHVLRTEGVDPALVSGKDKLYWLQGNTYVPFEQKDWNRLHSGQVKL

SEQ ID NO: 23469 - protein, 83 aa, A.fumigatus
LSSSMRTPAMVLRTMDTGSRICEFSLAAVIHTIRRSHEVNANYGTAQDLRYLANALHARGMYLMVDVVANHMVRRLLELYIII

SEQ ID NO: 23470 - protein, 81 aa, A.fumigatus
LVKGYNGAGNSVNYGVFTPFDSATYFHPYCLITDYNNQTAVDDCWLGDTTVSLPDLDTTSTAVRSIWYDWVKGLVANYSSQ

SEQ ID NO: 23471 - protein, 64 aa, A.fumigatus
MILTEIVDGLRIDTVKHVEKDFWPGYNDAAGVYCVGEVFSGDPQYTCPYQNYLDGVLNYPMYAL

SEQ ID NO: 23472 - protein, 60 aa, A.fumigatus
FPYGFDPDESRYYQLLYAFQSTSGSISNLYNMISSVASDCADPTLLGNFIENHDNPRFAS

SEQ ID NO: 23473 - protein, 222 aa, A.fumigatus
  UNSURE (4): Identity of amino acid sequences at the above locations are unknown.
VPFXPVVSTSAMRESILSVLTFFSLLLIVQARDDGRMKYNFNSGWKVLVGNPASAQSPSFNDNDWKDVTLPHAWNEDDAFRVDIANPSTGIAWYRKHFDLPATSRNKKVFLEFEGIRHAGEFYLNGKWIGRSENGVMAFGFDVSDITLYNQTNVLAAQIDNSWTYREKATSTPYQWNDKNFYANYGGINKNVFLHVTDRLYQTLPLYSNLQSFTARAGRIRD

SEQ ID NO: 23474 - protein, 110 aa, A.fumigatus
RHFPHAPVLTICSYTEDQMRAVQIAHREAKNWSDWVALGTVRVLRWGMDFVTGYRHPKPGQEHDAKFRMTEQKWLTRFIFLESVAGVPGMVGGMLRHLRSLRRMKRDNGW

SEQ ID NO: 23475 - protein, 134 aa, A.fumigatus
SSFPQFTLLLTIARIETLLEEAYNERMHLLTFLKLAEPGWFMRLMVLGAQGVFFNGFFLSYLISPRTCHRFVGYLEEEPVITYTPAIQDIETGKLPDWVKIGCPPIFPVPFWEICPRGLRKKKTTFGWLPAGAE

SEQ ID NO: 23476 - protein, 84 aa, A.fumigatus
RRTAESIVRIDRENLEAANFSSGLSLTMLNGQPMTGESYTSWGMTQEELDHPWWGNPQVINPAKPLAQTGKMGKPRSKTAKTLG

SEQ ID NO: 23477 - protein, 120 aa, A.fumigatus
NFLEFYPCSLNDLTLIDYLHVTKRFGIVAVAQLPTHFVLAIKSRYNPLALLFNTSYERLLPWHRISGRLIFLLIVVHATLYLNYFIQTATLQEHLASLKIILGIASFMSLFAMMSTSIEG

SEQ ID NO: 23478 - protein, 114 aa, A.fumigatus
EPQSQSETLNDNANENHGQSTTNKDGSKKRKKLPAVMERDEGGDVESHTTARTPTKSIQTPTKPSSVGTPVPSSAKNSIGAKTPTSAITRPSHDEMHPSKLHQSIRHAAGKTNV

SEQ ID NO: 23479 - protein, 89 aa, A.fumigatus
  UNSURE (12),(14),(21),(48): Identity of amino acid sequences at the above locations are unknown.
CRGQIYLRYIAXCXYNPPTIXRQETTANAIHKIYRNPVIPLAIPPCKXCTASLSSLSSLLFSLTRTNLNQVPSTAAPACNPIQIPSASR

SEQ ID NO: 23480 - protein, 199 aa, A.fumigatus
  UNSURE (182): Identity of amino acid sequences at the above locations are unknown.
DGSFGFTNFFPTLTSSLGYSHTISLLLAAPPFIFMTLYSFLHSLLSDRLQSRFWFFIYPIPIAIAGLLLFMTTDSLAAKYVATFLMMFCVCMNGTTLSWAASSMPRPPAKRAVAYAFMNGVGNTTGIWTPFTYRDQDWPYYRLALGICIGLQAGAAVLGTWLRFVLVRENKRLEREEREAVXGLHGGIASGITGFRYIL

SEQ ID NO: 23481 - protein, 213 aa, A.fumigatus
  UNSURE (206): Identity of amino acid sequences at the above locations are unknown.
SPMVIRVSVASRGEDGSTVKRVVLTSSFASVIDISKNPGPDFTYTGAHWNPITYEESVDPATSAVVAYRGSKKFAELEAWNFMDREGPPLDLVTLCPPMVFGPIVHPVASIAQLNESNAVLWSVAAGADPLPAARVSAWIDVRDLAEAHVQALLTPEAGGKRYVPASGEPFCYEYAADIIKEKFLWARETVTTNYEAGKKAGPTYXLDGAHSD

SEQ ID NO: 23482 - protein, 136 aa, A.fumigatus
  UNSURE (5): Identity of amino acid sequences at the above locations are unknown.
AFHGXNKPNQIIAVAALLVAPVLAAPTEFDTRACDYTCGSNCYSASAVRAAQEAGYELYSSDETVGSNNYPHKYNNYEGFDFPVSSPYYEWPILSSGKIYSGGSPGADRVVFNSKDELAGLITHTGASGNNFVACT

SEQ ID NO: 23483 - protein, 413 aa, A.fumigatus
WLEYRVGELARYPVHWVPPKPVNSGWSGSMGEIGWGDTGLAEAANWDIFTEFEWGGESTLWRAITSKFGGGKSDEQKPSSSLQVEVSTRMRASTLGIQLQEGLVIDNQLLSAPDVPAKRMIRFKLPSDMSYRCGDYLAVLPVNPSSVVRRAIRRFDLPWDAMLTIRKPSQAPKGSTSIPLDTPISAFELLSTYVELSQPASKRDLTALADAAITDADAQAELRYLASSPTRFTEEIVKKRMSPLDLLIRYPSIKLPVGDFLAMLPPMRVRQYSISSSPLADPSECSITFSVLNAPALAAASLPPAERAEAEQYMGVASTYLSELKPGERAHIAVRPSHSGFKPPMDLKAPMIMACAGSGLAPFRGCIMDRAEKIRGRRISVGADGQLPDVEQPAKAILYVGCRNKGKDDIHAT

SEQ ID NO: 23484 - protein, 96 aa, A.fumigatus
IPRVEARILVLTSTWRLDDGFCSSDFPPPNLDVIARHNVDSPPHSNSVKMSQLAASANPVSPHPISPMLPDHPELTGFGGTQWTGYLANSPTLYSS

SEQ ID NO: 23485 - protein, 169 aa, A.fumigatus
EALPCAPACTLDDDLDDIPKYDETHPSLDSSIKDVEGKPATDDSQASQLFKENSEHRKRESQGSNDSQATPVPHERSKEVVDGPHNTDDQELAGPKMAAITESLRRPVTPDMNEPASGPCTPDSVIRHPIDEEDDDSQTSSDESVPEPVATVKAPNGLKTRPSLTPADV

SEQ ID NO: 23486 - protein, 110 aa, A.fumigatus
  UNSURE (55): Identity of amino acid sequences at the above locations are unknown.
GRITSCVSLPDIMIKPFFPQVPGSLFRTVTVLITPTITHCSLATVIVLGVRVRLXQSLPPRFRVDVRIKEGTHSTADEVNKQLGDKERVAAALENGTLMGVIAKMLETCQ

SEQ ID NO: 23487 - protein, 116 aa, A.fumigatus
RGHVLSDGPIAGTPLYTVQGLIPVIDSFGFETDLRIHTQGQAAVSLVFDRWSVVPGDPLDREVKTKPLEMAPAMATARDFVLKTRRRKGLAEDVTVSKFLEPELWRGLKESGVLDS

SEQ ID NO: 23488 - protein, 188 aa, A.fumigatus
  UNSURE (171): Identity of amino acid sequences at the above locations are unknown.
DADLPPRGEDRSKDASTFIFKPEDFVTVSVRFTRVGYAQLKSQDFPAPKSWIGKLPPRNDRIAFDRAEVGMKLSCGFEMLLTDPQNQDKASVREMKLLLEDVDSGDERLPTDEEISRWDKRQDDEKWLDISFEDLDRELKGKDKSKASDGQARGAFGDATAQENLQRIVAXFEKFLNDDSAGFESADF

SEQ ID NO: 23489 - protein, 127 aa, A.fumigatus
VQRPPMNDCACLLTHFSDIGGGGYGQNIGYGVSADEIGVMITNLMYNDEFGYYDGLYGQANPDMTYFEKWGHFSQIVWKSSVSVGCATVVCNSLGNVDSSQPSPFTVCNYYPPGKCDQSLSLEVCRF

SEQ ID NO: 23490 - protein, 71 aa, A.fumigatus
DHIVQWHPTVLARMALVPQRSINAYSKDSTAASADGTYKDGDLVIRFFGCDSDPKRTCAHSSPRPTNPIHP

SEQ ID NO: 23491 - protein, 152 aa, A.fumigatus
  UNSURE (1): Identity of amino acid sequences at the above locations are unknown.
XRVRVLPGPVGEEAMASHPHSTYFFHLDAHTLIMNPSKSLESHILDKNRLQSLMLKDVPVVPPDSIIKTFSHLKPEDVDLIISTDNEDLNPGSFVLRQGDFARFFLDMWFDPLYRKYNFQKAEMHALVCFHPRFLMAGDDRTNSYPSFTRII

SEQ ID NO: 23492 - protein, 140 aa, A.fumigatus
  UNSURE (18): Identity of amino acid sequences at the above locations are unknown.
TIAHLSANSHKVHVDGLXSTPLSLSIQQLASEFPQHEVICALECAGNRRHTMRTMLKEVQGIDWGDAAVMNCKWRGPRLRDVLLRAGVKASQEGLHVEFSCYQVKCQEDGWFGASVPLERCLGEDGDAVLALQVPLSRSL

SEQ ID NO: 23493 - protein, 134 aa, A.fumigatus
MNDAPLPVNHGYPVRTILPGIVGARWVKWLDRITVSDHESPNFYQQHDYKVLPPAAVDQESAQPFWAQTPPMSDMPINSVVAVPEDNETVALSSSGVMEVTGYAVPHGADGPVTRVQVSVDGYSTRAWKVPRLR

SEQ ID NO: 23494 - protein, 124 aa, A.fumigatus
MCNLERHVDHEQACFIHPIVPSMLTAPGKGIVMFTGCSHVGVVNAAKHAIECMDGSDPLHAVVGGFHLATSEEQQMESTIKDLKKLDPAVLLPGHCTGWRAKFAIERLMPGTLVPCTVGIKVTF

SEQ ID NO: 23495 - protein, 90 aa, A.fumigatus
LTLITEIVIVKASSGPRYVVGCRSKVDKSKLKQGTRVALDMTTLTIMRMLPREVDPLVYNMSLEDPGQISFAGIGGLNESSPRGWKGPRN

SEQ ID NO: 23496 - protein, 94 aa, A.fumigatus
  UNSURE (1): Identity of amino acid sequences at the above locations are unknown.
XTQHPFEALPAGFAFPTMNGGSDPEREQALEDYKKSLLELREWEAKLKNLRMGIKDLQREFDISEENIKALQSVGQIIGEVLKQLDEERCMPFS

SEQ ID NO: 23497 - protein, 132 aa, A.fumigatus
  UNSURE (14): Identity of amino acid sequences at the above locations are unknown.
GYNSGNPKRAQLRXPHRLFLAPSSILKQPPVLTNAVNSTSRYVLLAVFYLSTAPQLVWESNHCLVFGFLVSIGRNGDREQSSQKKQGDTLLSSRHGLKNPWGALFALEDYWWLTGFLSSGSKNFSSWVDPLR

SEQ ID NO: 23498 - protein, 287 aa, A.fumigatus
  UNSURE (159),(220): Identity of amino acid sequences at the above locations are unknown.
RSGGTLQQLLIDPMYRYHTQSPEALFAHVPGVQVVMPRSPSQAKGLLLSAIFQSNNPVIFMEPKILYRAAVEHVPNEFYTLPLNKAEVVKPGNDVTVVSYGQPMYLCSEAIRAIEKDMGASVELIDLRTIYPWDRQTVLDSVKKTGRAIVVHEKGLNWXYFPQKKNPLLKTPRGGPRGFSRGGLGPLFGKKRGFLGPFGAPFKPPQIFPPPKRGKNLGGXPRAPPPFFFPFFLGGPGGPPPFLGGGKRGGGPLFFSPPQKRGFCGGKKKKKGAPPAGKKRGVFLGGG

SEQ ID NO: 23499 - protein, 185 aa, A.fumigatus
  UNSURE (68),(129): Identity of amino acid sequences at the above locations are unknown.
PPPKKTPLFFPAGGAPFFFFFPPQKPLFWGGEKKRGPPPLFPPPKKGGGPPGPPKKKGKKKGGGARGXPPKFFPLFGGGKIWGGLKGAPKGPKKPLFFPKRGPKPPREKPRGPPRGVFKRGFFFWGKYXQFKPFSWTTIARPVFLTLSRTVCRSQGYIVRRSMSSTLAPMSFSIALMASEQRYIG

SEQ ID NO: 23500 - protein, 193 aa, A.fumigatus
RIPRHSSQGPACPQSPEHCCILQRLCWQEVISPGPGFRYSENRHADFALHSFKSIDPTPCHQSAHPQQVDSTVAFTIRDTASETPNTVTVSEITTRHLRRLKQSASDYLGKDVNAAVITVPTDFTDVQREALIAAAGAAGLEVLQLIHEPVAAVLAYDARPEATVTDKLVVVADFGGTRSDAAVIACRGGLYI

SEQ ID NO: 23501 - protein, 182 aa, A.fumigatus
  UNSURE (17),(35): Identity of amino acid sequences at the above locations are unknown.
GQLILRKLAELFAEAAXSTQVEDGLAPTIVNEDEXCTVRQSLLYFSDVAFFIQTQPNFRSSGEGITQTESSATSSSFLQRQNSRPLSLSSSILQYHTLPNSLDEVSPRSSFSDTSSDLTITPLRIQKKAWMPPGPGSASKDPFVDSSTGGNHTAGNLDNMSQFQVSEGTALLFLVQNSYALQ

SEQ ID NO: 23502 - protein, 247 aa, A.fumigatus
  UNSURE (243): Identity of amino acid sequences at the above locations are unknown.
LRGEDGSIVSFSQTGEYGASGMDTTGYLYVPRACQPGSSTVCKLHVALHGCKQSYSMIGSKFVSNTGYNMWADTNDIIILYPQAVADNTMHTIWTGMPLPNPNGCWDWVGWYGANADQVGGESKSWLRAILFFFFFFFSFFPFFFTDSNALGVQMAAIVNQVARVVSGYGAGSSSSTTAATPTTTTGSITTTTTTTATVTTTAVAPLYGQCGGIGWTGPTACATGVCTAYNPLICTMSLGYCXDLEP

SEQ ID NO: 23503 - protein, 168 aa, A.fumigatus
YTYWIISLNQPSSYFARYKKAYESMKACPLVFQHPSEAQQLNGLGPKLCERLTEKLKAYCEENGLPMPEHPQKGAASKRTSDEGVDDPPAKKPRKAKPYVPSLRSGPYALLLGLATLDENASQGLTKAQLIEKAQPYCDSSFTAPPDPSKFYTAWNSMKTLVFDNSGR

SEQ ID NO: 23504 - protein, 218 aa, A.fumigatus
VLGSAVEAMGPAAVLEILPLNIIQQKNGQPGRVWFLPILRDSVTNTNLAHFRSELVPLSEALYQKVVDYGSAEKTVEKKIFETLVQQTWAILPGYCELPLDLVEAFDQSFAELLSNVLYKQTELRVDICNALQTLVESNQAILSIESEEDDLILQRRITKAAAKKNISHLAGFASNLLAVLFNVYSQTLPHYRGYILQCINAYLSITPEKVSHSLYQI

SEQ ID NO: 23505 - protein, 196 aa, A.fumigatus
CGIVAPFVLSDQPAGTSAFPRGHYLIPDTNALLNGMDLFEHTGAFYDVIILQTVLEELKNQSLPLYNRLLSLIKTDEKRFYLFFNEFRLETHVRRGQNESINDRNDRAVRAVAKWYSEHLRSTLKRGKKEKSVPAIVVITDDKENLRKAKEEGVTALSLSDYVSGLEDADRLLDMISEAREARVFTTGLEGSAVAL

SEQ ID NO: 23506 - protein, 92 aa, A.fumigatus
LFPALIGVDDLLNKQCQQNVACCQDNKSVAVSSFSSSLVGTLLTILDWRPHQHCHASLRCSRLYHLSQLRVPFSQTLVRYLRDQRLHIALGV

SEQ ID NO: 23507 - protein, 82 aa, A.fumigatus
  UNSURE (30): Identity of amino acid sequences at the above locations are unknown.
GGGMNMKGSGHTSKCTLPLFGGIRCPNHLXSFRSRNTVLAYLAWDLFVRVERFGTIRAWMNTSQYAIISLSSIMDSPQLQCD

SEQ ID NO: 23508 - protein, 136 aa, A.fumigatus
KLTGKQSRGKDTTSHQICTDFGICNVRASLRLVAWKRKRREDVSFMSSSEFHPINTDRAQSPDASTECHESDSLDKLRWWQKATIYQVLIQSFQDTDGDGKGDLRGIVNRLDYFVALGIDVIWISPIYESPMRDMG

SEQ ID NO: 23509 - protein, 103 aa, A.fumigatus
  UNSURE (32): Identity of amino acid sequences at the above locations are unknown.
YSSKHEWFQTSRRARKDPKLSKRERYFWSERXLNDLGIVYLQIMGEYIYWYVPNLSCSSPLLKPPYVWRTVLVWKLGQPGRRISLAYSAIPMANLGADGGILT

SEQ ID NO: 23510 - protein, 66 aa, A.fumigatus
SAVMDLMVSIYDTYLAPQKAAGVVSNGHLAYDATVQKQVEPMMEMVRDQREKLAREVERWCKERGV

SEQ ID NO: 23511 - protein, 69 aa, A.fumigatus
GCSRGSLVYTPGKWMIEPTLPLIRKDLQDDFIGFRDGILTHVDRMTNSDKGWLKGWQDDSPMFEILCSS

SEQ ID NO: 23512 - protein, 93 aa, A.fumigatus
EVLFPFSDTPMSTNTNTDTAGHTAKREESRLRAAKACRRCSQRKIKSDAVQNGLPCSRCRMDNTDDCTLTLSRRGTYYRKGGARPAIVICRSP

SEQ ID NO: 23513 - protein, 261 aa, A.fumigatus
HFEKKCICSQAISGDMLSIELLLSMATRFVFHLKGNVYPEDIEGVTLDAKLHVRNLFWICFTLDKMFSLRTGLQPFIDVTNCDLRLPRMQTVTGPLEGLQPFYRQYNHTMFLALIRLSLVQSKVYHGLYSFSAQRQSDADLLATIRSLDIALEEWRSSVPTSWGLPTPHENRMAGLLFEMQYHYTMAAIHQTSSRCTAWVRNQDTRAAGSSLALSVAARRSLLRKVLETDPQIEGQFSLVGDQSYVWSNVSLELITLEGFG

SEQ ID NO: 23514 - protein, 181 aa, A.fumigatus
RPADLIESPTFGRVLQGLNDECFDLLMQNCIQEAFQSSPQASESVPQSFTSVATVVPQVKTADVKTKLANVLAVMARQAHVIGNGTNPPNIYLSAMDQNVRNLEAFAAVIYSSNFDFQLPGAEQKEEQVTAERDHSDTSSTAPVMVDKDDTQDLNQASPSAVAENNSAFEKAWGKAVESSE

SEQ ID NO: 23515 - protein, 98 aa, A.fumigatus
SGASKWTTAQRRAFANDLTNPQLIAVTDNVNQAKGDDGPEAWKPPLSKFSFSPADNDANGLASYYCTYAKMWVRVKYVYDLTITSAEKNALVSMLDTC

SEQ ID NO: 23516 - protein, 189 aa, A.fumigatus
PSITPVMTLGYIFRLISARSPDSLVPYIGQSMFIILPPSLYAATIYMTYGRIVVYVGKPHLSIISPRKVTKVFVLGDVSAFLLQLGGGGMQTIDSMRNIGQKVLVVGLFVQLIFFGFFLYVSVSFQIRLRRSGFDLIGGLWRRLLQILFLASALDIARCVFRIIGYVKGTGGYSIFPRRLLCTSSDLIP

SEQ ID NO: 23517 - protein, 83 aa, A.fumigatus
  UNSURE (51): Identity of amino acid sequences at the above locations are unknown.
ERWSFQPRGEDTNMNFVLTRKFSRHRYSNRNSEEANYFPFTHKIQSAEDAXEKFPQLMVTADKFVMKRDWEVDEIFDGRKRTR

SEQ ID NO: 23518 - protein, 118 aa, A.fumigatus
AYRDLPLKLRRACKVCIDSAILSTEAFDGIEGRPIVTNIFGTAHAQFGNMLVLSATYMSCLSELVDRNVLEKLLKRTIKFLLQSRYISPSVRADARILTEIYEKIFGEPATSFTSAYS

SEQ ID NO: 23519 - protein, 120 aa, A.fumigatus
RCQTLRDLIKNGLYDDIDRSWRLFRQILDGLSHIHSHGIIHRDLKPDNIFIDVASNPRIGDFGLATSGQFTTAVRSSTTADFEGNLTRSLGTTYYVAPEMKSGFAGHYNEKVDVSIIESQ

SEQ ID NO: 23520 - protein, 263 aa, A.fumigatus
APSGCGALQTARASREAGLQQALLESGESSPNDSSTRINSQRADPYPATNTASKEASQSTKEDDETINLDDPRSQSGKYWKAEFDSYRARTTNEIRKLIQYRSAAKKFALMKEAEASRLAKKLKEEEVKVAEMERHVTQLASSMVAEKAKADREQLVQDLTKQTALALQYKHRVNTLRKLLEQHGVVGSEVDDIVGKREANNSSNDTSQELVKTQQALSQANARIEEMKLQQAEFDKLKELAQSSEQKASELARLDHTGENPR

SEQ ID NO: 23521 - protein, 260 aa, A.fumigatus
TNKSLGVAGLDTDLPTAVEAFFLDSLLGKAFFCTFQIFFYAVRPMFIYSPPFTYIHLLNLITQLSFDYALTKFCGGSLQPLLYLLLSSFLAGSLHPCAGHFIAEHYFFSRVESGGTESIEEQRKMRANSGASKQKQQPHPLDSLPPPETYSYYGPLNILTYNVGLHNEHHDFPAIPWTKLHELHRIAKEFYEPLPCHRSWVWVIWTFILDKNVGLWCRVKRAQGGRLVGGGNGRAGEEICAASPETDEEGDGWKESEIQN

SEQ ID NO: 23522 - protein, 184 aa, A.fumigatus
FLNRQAYNFQPFLLFVTTSFPVRFSYHPVFTQFHLSQQPRRPLHLIIFPNFILSTTTTTMTRKPLRVGVLLVGTVQLLDLAAVDLLFMIDPSYLTACTLPKPLIELGRPVSVVYIGKAGPQAHQETTSNLSLQLTHSPTDPAVQPGALDVILIPGPEPSTVPDAEYLDLVRAHNAAGTHILSIC

SEQ ID NO: 23523 - protein, 112 aa, A.fumigatus
DPNDNFLSGNTANYIDEMYLAWKKDPSSVHISWQTYFKNMEEGNMPIAQAFQPPPTLVPTPTGGVPQTMPGEGLGLSAGTDLTHHLKVQLLVRAYHARGHHKAKIDPLGIPP

SEQ ID NO: 23524 - protein, 269 aa, A.fumigatus
  UNSURE (2),(26),(28): Identity of amino acid sequences at the above locations are unknown.
AXFKPGDRVLGLGSELKDNNPAEAAXQXYTAIPAHVASPIPTGLSYENASVIPLGISTASCGLFQKDHLALRLPTSPRAASSGQLVLIWSGSSSVGSNAIQLAAAAGYEVVTTASTKNFEYVKSLGAGHVFDYHSPTLVDDISKVYDSKTGVGALAIGTEAAGPCCEVLSKVNSRKFVSLTNPPTGALPEGIESKFVFGAAVKDNEIGPAIFEAFLPKALAAGEFKSAPTAEVVGKGLGSIQAGLEQVKKGASAKKYVISLHRPPRLLF

SEQ ID NO: 23525 - protein, 208 aa, A.fumigatus
RQDMGYAQSKLVGEHICIHAAQQTGIRARVLRIGQVIGDQAHGIWNSTEAIPLMLQCAKTIGALPALDESPLWLPVDTVAGTVVDISLCDFPAVPPEHEQVFNVVSPHPFHWTRDLLPYLRAAGLEFDVLEQRAWVARLKQSNPDPAVNPPIKLVEFFASKYDTDAPRRGKNWHTGKTKEVSRTLAESKPLSQELVSKIVEYFCKECW

SEQ ID NO: 23526 - protein, 127 aa, A.fumigatus
SANTSASTPRSRPVSVPASCASARSSATRPTASGTPQRPSPSCCSAQRPSAPSPPSMSPRSGSLSIQWQVPSSTSPSATFRPYRPNTNRSSTSSARIPSTGPGICCRICAPRASSSTCWSSVPGWRG

SEQ ID NO: 23527 - protein, 63 aa, A.fumigatus
LSTLFVHPVVNIWIPIWTVFVALRSAAALVLPFAFLYAVSNYQLAVGSFNELIYCYMVHTNAG

SEQ ID NO: 23528 - protein, 232 aa, A.fumigatus
GHRHPCGPSTYGSIAGDAWYRAQYMLQDQKIGHYMHIPPRTVFFSQVFGTVLGIPMNYAVMRWVLSTKRDVLTGAKPDPLHQWTGQSLISSNTLGVQYAVIGPAELFKQSEMRPLPWSFLLGALLPPVLYGLHHLLPRWRIDLWNVSIFFSGLAVFYGNLSTGYTSAIIGGYVVMYWAYRKRFEVWKRYSYMIAAAFDAGFNLNMLLIFLFFGSAKQISCHHAEAGQIRTYA

SEQ ID NO: 23529 - protein, 94 aa, A.fumigatus
ISSFGPCTPLDYLYTCDVSLQPIKAIFPSSSCCDDDVSLTPNDYTIVWICALPLEAAAASAMLDKTHTLPPLSYGQAIPSMLFNTHLLVHTRDI

SEQ ID NO: 23530 - protein, 72 aa, A.fumigatus
LVYTRTRGLDLVKQHESIEFVYVNYSESSTSCKQASVCTGGERVAIRVTTFQGLIVKWIEKHELTIKVRYNK

SEQ ID NO: 23531 - protein, 86 aa, A.fumigatus
VARSFQPRGEDESNVWTNVWQNPTQHAKSGSDKNSLCQRFDSTTLLSFFVISDCFYFPPFSRHLTSISLCGRSCFVRPPGPSGSLN

SEQ ID NO: 23532 - protein, 66 aa, A.fumigatus
ADVVRWVDQTYIAVLGWRLIRCSRALRAFQSKDSTVGKLFAKHIKLEEAKQFLQRARYVHYDLGLN

SEQ ID NO: 23533 - protein, 293 aa, A.fumigatus
RPGLPASWADGSFPSSTVRNEAGHVTLQGWLAQWSMTTFQSPKTTLEYLAYLGFESSDRSNPSTTAALKVTRPRKKRKRPGRVGRNVVLGHVLGAPGSGKSALLDAFLARGFSHTYRPTIQPRTAVNTVELPGGKQCYLILDELGELEPAILENQAKLLDQCDVIVYTYDSSDPDSFAYIPQLRSKYPHLEELPSVFIALKADLDRTTQRAEHQPHEYTAMLNMPSPPLHVSATWSSIQEVFVHIADAAMEPNTCFPRSEEDVEGEMGGPGVSHLGANGLRLGLAARKNLANK

SEQ ID NO: 23534 - protein, 70 aa, A.fumigatus
AYLGIPSIFWYIFRTALVVINNNNHRQIVSISLIVIYNFFFIIILVLFLFQLALTPLDKRGQKSPSHRHW

SEQ ID NO: 23535 - protein, 272 aa, A.fumigatus
GEDTYTHGHHPSVLRSHTWRTAANSAAYLLPHLRPDMHILDVGCGPGTITVDLARLIPQGHITGVELSPSVLEQARALAADQALTNVTFLSADANALPFEEGTFDLVLCHQVLQHVRDPVHILAEMRRVTKEGGLVAARESDYAGFVWYPASPGLDVWRETYLKVCRANGGEPNAGRMVHVWAKQAGFAREQIKCSSSNWCYSTPEEVEWWSGLWAERTVASEFGRTARENAGVEAVELEGIATAWREWGAQEDAWFSVLSGEVLCVKGGRW

SEQ ID NO: 23536 - protein, 164 aa, A.fumigatus
RHLHSRPPPLRPPLPHLAHSRQLGRLPPPPPAPRHAHPRRRLRPRHHHRRSRPADPTGPHHRCGTLPLRPRASPRPRCRPGPHQRHLPLRGRQRPPLRGGNLRPGPLPPGPAARARPSTYPSGNAPGHERRRPGCSEGIGLCGVRVVPGFPRAGCLAGDVPEGV

SEQ ID NO: 23537 - protein, 100 aa, A.fumigatus
KESNSNHLDLITVVIYDIMSLAGANEGIIYHLPPLTQSTSPDKTENHASSCAPHSLQAVAIPSNSTASTPAFSLAVLPNSDATVLSAQSPLHHSTSSGVL

SEQ ID NO: 23538 - protein, 293 aa, A.fumigatus
PPWRGSFQPRGEDTGPKGSRAQSAIPVTNLPKPPIPAVANPPLASVPGNNVSQGPALSAITEATRAATAAVAAAMAKLPQPNAQKQSVQDAAVDAVTKQIGELKTHEGGRPPRGGHRGGRSGHRGHHQGPAKKVEVPDTDYDFESANAKFNKQDLVKEAIATGSPVTEAGAHVENGEVEAVDTAHHAPSTTASAYNKSASFFDNISSEARDREERSGGRPGGREWRGEEEKRNIETFGQGSVDGYRGHYRGRGRGRGYGGRGRGGYGRGYNTRDRGNYRGRSNSQSTGVPAPV

SEQ ID NO: 23539 - protein, 116 aa, A.fumigatus
RSPRASLRLSGMPSPGTFRTWPGDNTSPGVLGWVISMPRPSRCLMTTREKPVSASASVTSMLAVRSAPARRKTGCSSSTIWKTMSPGSWPGAWSASPSNTILSPSLSGYLARGFAP

SEQ ID NO: 23540 - protein, 195 aa, A.fumigatus
GANPLAKYPLREGDKIVLEGEADQAPGQEPGDIVFHIVEEEHPVFRRAGADLTANIDVTLAEALTGFSRVVIKHLDGRGIEITHPKTPGEVLSPGQVLKVPGEGMPLKRSDARGDLYLVVNIKFPDAKWKPSAAVLERLREMLPKPDPLIQADTVDEVDYDPKGNLDDFGARDGQGSSAWEDEEEDGEPAQCAPQ

SEQ ID NO: 23541 - protein, 133 aa, A.fumigatus
VNPRSRGWTELLTSVIRIQPTVDVFEKRIAALEGGVAAVAASSGQAAQFMAIAALAHAGDNIVTTSNLYGGTYNQLKVFLPRLGITTKFVQGDRPEDIAAAIDDRTKAVYVETIGNPRYNVPDFEAIAKGRSR

SEQ ID NO: 23542 - protein, 89 aa, A.fumigatus
  UNSURE (52): Identity of amino acid sequences at the above locations are unknown.
DQQLSRILAGYFLTDPLSTNRCSKFRLPTCVKPSWNWVGPCETNQLARHLVXCNNQFQFMNCRVNPTPNNNSPHISSRKRVPKGLSPGN

SEQ ID NO: 23543 - protein, 87 aa, A.fumigatus
TRQSRHIKELDGPSLSAVPMVPNSERNSNRTLNNLIRFANLASEIHQNIVSYPESNLYDLQNRKRTSSISNLDGAFQMLMGILRKPS

SEQ ID NO: 23544 - protein, 64 aa, A.fumigatus
SLAAIIRSTWAANSDWILTAAPIADNTIQNCDEVRDNMVDLIKPCKDSDSIGAGIGIFLLQHTC

SEQ ID NO: 23545 - protein, 285 aa, A.fumigatus
TPYLRVMIRYSRIAAKVWKFISAFNNTGELKKDEMNYLDWLVLQWAAAIPASLRLGADSSTEPRILRRLRSLLFLRANQLRMLIHRPVLHSAGHLVRYPAECQTAVDLANDTIRFITRLIETSDIYHLHQVAFNWFLMSALAVLFLAVVHAPIQFSSRCKEEFYMALELVNGFSTQSYISRRLWKSIKSLRKLGPQVGLRQSATDPRVRAAHQTVDMAPTSNPSQTPQDGAQMTQELMEWFEAVGTLETQIMGVTQVFDDGSGRMANGYMYDYGGDLSNVMRDLF

SEQ ID NO: 23546 - protein, 91 aa, A.fumigatus
RAYSPAHGQTPAPRSFPPPSQPPTAASPRTPNCPSAGACPSYPATDEGPPYPKHRHLTLLEHRRLTPIRGLDILDPQPFRPVPPPGNRLPM

SEQ ID NO: 23547 - protein, 132 aa, A.fumigatus
RARNHLEVISQTKTLSNRDSQTSSISTYLSCTIKPFNMKPSIVTFLMLAAVTAAVSAEDPTMSALKSRVEEIAGQVHGVEDQETTPDLSHCVEPKLCCGSLTTPLDPILDPILLSLGINAAQNNWFPLEWLL

SEQ ID NO: 23548 - protein, 86 aa, A.fumigatus
LLLDILGDPLRHLRRCCKCIGEGCGGRLLTERQNAVYEFEQCRLPKYSRYADLQELKSMTNLTITCTYTSLMFSQPLVGGVYIRSH

SEQ ID NO: 23549 - protein, 155 aa, A.fumigatus
GPLGKNDFRAFQLLHCGPFMDRQTGAKPDDRVGFEPDKWQKDVLDELDKNHSVFVVAPTSAGKTFISFYAMSKVLQEDDTGVLVYVAPTKALVNQIGAEIHARFRKRYSGPEQTVWAIATRDVRINDPLKCQILVTVPHFLQIVSAMNSAITISL

SEQ ID NO: 23550 - protein, 206 aa, A.fumigatus
  UNSURE (166): Identity of amino acid sequences at the above locations are unknown.
TQLSLFLYNYFLLTAVFKMLLSSANATTWAPRVKCIIFDEIHSIGHTDDGLVWEQLLLLAPCRIIALSATVGNPSEFADWLQSTQNNMGVTLKLIQHTQRYSDLRKYVYMPADRPFDGLSRPRHKGLLEPKFIPGLHPLHPITSLLSKQRQIPEDLSLEPRDCYTXWRCMVKYSSVDFPVPESLSPQLALPRFIRRSDVYEWEAQL

SEQ ID NO: 23551 - protein, 114 aa, A.fumigatus
ARAYLTIFISFLSLALSNDLVMSSILTLSASHLAWITRNQETKQLAYHHRGIAIKGLHKAIGTFSKENCEAILASSILLSWQASDWQTWASLQQGLSTVSILPVKKRFERGERN

SEQ ID NO: 23552 - protein, 79 aa, A.fumigatus
VIDWTCPQTSLAVIVPCVASPSSCTQASERDLKAKSFKPLAFSRDYSGQSNNTDLGGSQRYTYVAENAALRRTRICFED

SEQ ID NO: 23553 - protein, 396 aa, A.fumigatus
  UNSURE (11),(12),(18): Identity of amino acid sequences at the above locations are unknown.
VVSMCPAGAMXXRTVRPXDKKAASIEETRKSLPIYQFRDQIIQAVHDHQVLIIVGETGSGKTTQIPQYLHEAGFTKNGMKIGCTQPRRVAAMSVAARVAEEMGVKLGNEVGYAIRFEDNTSDKTVLKYMTDGMLLRELLTEPDLGQYSALMIDEAHERTVPTDIACGLLKDIAQARPDLKLLISSATMDAQKFQKYFDDAPIFNIPGRRYPVDIHYTSQPEANYLAAAITTVFQIHVSQGPGDILVFLTGQEEIEAAEQSLQETARKLGSKIPEMIICPIYANLPSELQAKIFEPTPPKARKVVLATNIAETSLTIDGIVYVIDPGFAKENVFNPRTGMESLVVTPCSRASANQRAGRAGRVGPGKCFRLYTRWAYYNELEESTTPEIQRTVFTTG

SEQ ID NO: 23554 - protein, 390 aa, A.fumigatus
VDSQYLYFPGCMIMSFDDPSTRTTEVKLVRVAQGINLQKLANTHRIYKNVVHDVIGVEEAIQELEDIQKKPPRFNKWIVVLVYGLASATVGPFAFNARPIDMPIIFFNGCLLGLMQQVFAPRSALYSNVFEVTAAVLTSFLARAFGSIPKAVIDGKRQFLFCFSAIAQSSIALILPGFLVLCSSLELQSHQIIAGSIRMVYAIIYSLFLGYGITVGTTIYGLMDPSAVSDIQCPKAGAFKNPYLQRFPFVAIMTVWLLIINQGKWKQLPVMSTIAMSGYITNYFSTKRMGSNSQVANTVGAFTIGIMGNLYSRLWHGHAATAILPAILVLVPSGLAASGSLITGVASADQIRHNISSPSGTSQPGAGLSTNSSVWTLAVAMVCLHAGAPQ

SEQ ID NO: 23555 - protein, 133 aa, A.fumigatus
APSTYGRLTAPLCAEFETSSVPTSTLSSTRMSPPTRPASSLLRRSRSLRASALARMFSTWRPAGLTLVTPTARLFPVPPSRLSPSSPLPTKSAPSLSSSPTLMTSGRSPVSSVSSATGVASTPSTKARVELAF

SEQ ID NO: 23556 - protein, 108 aa, A.fumigatus
DIVGANIHPFFNADVSADQAGKFVAQEIKVLESICPGKDVLNLETGWPHAGNANGKAVPGTSEQAIAIKSIADEVGSKSVFFSYFDDLWKEPGQFGVERYWGCFDTFN

SEQ ID NO: 23557 - protein, 387 aa, A.fumigatus
NPYEVTKEDKVQPENLPPAQISLTDCLACSGCVTSAEAVLISLQSHTEVLNTLDSYPELPLGSTSYQRGTQKVGSADSDGRIFVASVSPQVRASLAATYGITEREAKYMIDQFLMGPHGLRAGGKHGNGFTWVVDTNVMREAVLALTADEVTSSLLSTGSGSLPKSPILSSACPGWICYAEKTHPFILPHLSRLKSPQALSGTFLKSVLSKALGVPPSQIWHLAIMPCFDKKLEASREELTDIAWASTFTQSQTTPVRDVDCVITTRELLTLATARGLSLPNLPLKPLPASCLTPFPDQALESFLFSKSSSGQTVESGTSGGYLHHVLQIFQARNPGSKIVTQRGRNADVVEYVLMSSGDEPLFRAARYYGFRNIQNLVRKLKPARV

SEQ ID NO: 23558 - protein, 131 aa, A.fumigatus
APCVALCCLILTSTDQFFEKQSTQPSCPHLLLSLALPMAISTPMTTSLASSLPAECSLLLLTLSSTTRRDASYSKCFLAANRVNGWADGYHSGMQPRAVQGMLDFDFICKRSTPSVAGIIYTFGGQFVSKM

SEQ ID NO: 23559 - protein, 89 aa, A.fumigatus
LWNRRYWGTSETLLPVYQDVAKAMAKHPDVDTVVNFASSRSVYSSTMELMNYPQIKSIAIIAEGVPERVCLAYIYPHRVKKLTVGTACS

SEQ ID NO: 23560 - protein, 117 aa, A.fumigatus
RWEQRAREIMVTAKEKGITIIGPATVGGIKPGAFKIGNTGGMMDNIVASKLYRKGSVGYVSKSGGMSNELNNIISQTTDGVHDGIAIGGDRYPGTTFIDHLLRYHADPDCKILLLLG

SEQ ID NO: 23561 - protein, 62 aa, A.fumigatus
TRCAQCHTVESGGPHKVGPNLHGLFGRKTGSAEGYAYTDANKQAGVTWDENSLVCLSFSILA

SEQ ID NO: 23562 - protein, 188 aa, A.fumigatus
YRHRAFGLLLYLTTASLSFALVFDKRAMQHPKFLRHQIRLEIGQALRAMPVMAALTAPLFLAEVRGYSKLYDFPTGSPFPLYTYLQYPLFIAFTDFAIYWIHRGLHHPAIYKRLHKPHHRWIISTPYASYAFHPVDGWCQSLPYHVYPFLFPLQKAAYLGLFVFVTIWTVMIRESPELLISEAARCLC

SEQ ID NO: 23563 - protein, 96 aa, A.fumigatus
NECPDDGEYALDSPVINGSACHTIHHYYFNYNYGQFTTFWDRIGGSYRRPNRELFDKQQRLQQTEIQRQVEEMERLVKEVEGSDDRCYEQDTKKTS

SEQ ID NO: 23564 - protein, 224 aa, A.fumigatus
  UNSURE (186): Identity of amino acid sequences at the above locations are unknown.
VVMGSRTRSDLNLLCRYLTHGSWCLLWPVQLLILRIQKRKLSWEAFWRRHVYLLRTTAQMVESRDLHLTSRDLHRSPIPYMLRTTAFVTVALTIAGGSWYVAVNLTTASDLTAIYNCSAFFAYAFSIPLLNDKLRCDKVCTVVAAIVGVLEVAYGDRSECKQTPDGTVWKTKQDAQNRLWGNIIIXVGSVLYCLYYVLHKQYACSHEGTSAGRNMILATPSAVV

SEQ ID NO: 23565 - protein, 76 aa, A.fumigatus
LHYATSFAPLPCKTNTMEYSHMHMNMAFIHIPLPEYRDSSNYYRGNWSEAPTAPGFNSGFKDALEEEGILFVSCGQ

SEQ ID NO: 23566 - protein, 91 aa, A.fumigatus
LITSDHVNDYCMLNKDRDQKPSLWMCYGGGAGFGGYGGYGGYVRRVRFYDFDMNPGRVVTYKRLEYGEVEAKIDEMMIIDGGAVKGPDEHH

SEQ ID NO: 23567 - protein, 68 aa, A.fumigatus
RSFSLWYRELLSFKVWCLISTIMKVNATLTLLLLGLAVASPASEPNSEDSLQGMSHSLISGLIYNAIT

SEQ ID NO: 23568 - protein, 72 aa, A.fumigatus
YYRDDSSSADWNISIRIYDTGCKFCCHRKLFCHFIYNKLSDTSPWLNVSLESKTRTKKRAIDRLSCDTQKVR

SEQ ID NO: 23569 - protein, 264 aa, A.fumigatus
RNRGPSMPVVKALIYPQAQSGDFPHLLMYGPSGAGKKTRVIATLKELYGSGVEKIKIDARVFQTTSNRKLEFNIVSSVYHLEITPSDVGNYDRVVIQELLKEVAQTQQVDLSAKQRFKVVVINEADHLTRDAQAALRRTMEKYSPNLRLILLANSTSNIIAPIRSRTLLVRVAAPTEEQICSVLQNAGKREGWPEAPGLNKRIAKESDRNIRRALLMFEAIYAQTWVLSAICDCRCVTNNATQSGRRSRTTRQFPRLTGKLLSH

SEQ ID NO: 23570 - protein, 63 aa, A.fumigatus
QCYSIREKVTDNTPIPPPDWEALISLIADEILAERSPARLLQVRARLYDLLTHCIPPTTIIKV

SEQ ID NO: 23571 - protein, 288 aa, A.fumigatus
  UNSURE (22): Identity of amino acid sequences at the above locations are unknown.
GERMRGSFRPLWWKTTHADYPXKKRPRVDDDSHSSEVHDLVRPRPLSWRPSAPVEPPLQAAQLRSLGVLSILNSPTKSAPPCLVSSGGDNLSLVRHQSSAPPCSPSAPASHVRLHSSPTLRLASPSIHPAKQQSLSPGSVNRQILSPVSPTSRFVGAGGPYARKHSAMQSPLAQESRPGLYPLSSGSPLPLENATVNPNHGPETIAPVPVSIHSTQPFHSRGTSVNPTPTPNSQERSPTTPLSIYGTLGRSSPAIVGMPISQSAPAFANSQVYGTSETVSRLPSVVGE

SEQ ID NO: 23572 - protein, 74 aa, A.fumigatus
RCSAKKAGVTLFVTLPGNERGSEPIATIAKLKTHVYYKGNLVMIAKLANVVSVYVPGKCPAWTVEVAEGMVYLW

SEQ ID NO: 23573 - protein, 111 aa, A.fumigatus
RNKRPLYSILAWADHLPSVNNNLHISVSMPCIEVGTIGGGTILEPQAAMLDLLGVRGAHATNPGDNARQLARIVAAAVLAGELSTCAALAAGHLVSAHMAHNRSKVAAKTG

SEQ ID NO: 23574 - protein, 104 aa, A.fumigatus
RQLAWNLSAHSKAWHHQNYSHSKLPPALDTKDVDADPVPLHVKQHSQSLPGGDFTISTYPTDDSPLGTKLFSVKGDFGWLSSKRHLSDISGLPLFDAAAQKKPA

SEQ ID NO: 23575 - protein, 83 aa, A.fumigatus
RSLLLVYLVSKLAVCLKTDLLANYNFIFNLLDGLTLNRATIYTHIINYKFSFIKVCNETPTLIIITYYTYIGTISNTNFITAY

SEQ ID NO: 23576 - protein, 234 aa, A.fumigatus
FKCNRSDWQLDIKSLEFYEASSINAALRSFSHSINFRRTADINDISAKPQRKVVFPASAPVSRFVEKTAIRYRLKNTKYILEIARYDEYSRMTLPGYGGQSPAAITGPISEVPSSSWGASIFDPNWDNLLGQHANIPLGHTARYSPSLNTFFPSIEETTGGKCKGFWELIALVRQVAELLGSTNTAAENGKQRVPKSPSSEKSDEAGTARQKHQQFNNGPQMRVLLDADLGTLF

SEQ ID NO: 23577 - protein, 260 aa, A.fumigatus
  UNSURE (246): Identity of amino acid sequences at the above locations are unknown.
SKPAEPQGQPTTTSDYFASSKRNTKPGKSEDVAKTKEVRPSHTASLNGRDAEDASETKNKKTLDQSPRQSSRRTANKSTVVLQDDDGLGNDDIFATDYRKPGQYDDDYVEEDEHDGDDDFEKMEVKPASAASGQSSRRKNANAAESADVAMNDAPAEPKSASRTGQKRKSAAIDRDGDYEDCKTSKGPARTRAIPSAPAAKKQRGVATKKDEPESKEIQDIFDSIPTIKPPSPPPPSGEKAKFNFXATHRCRDPVEIRHG

SEQ ID NO: 23578 - protein, 276 aa, A.fumigatus
NHSRRFDRWNGRLVDKARGNRLFRFVSDRNEGNFSRLLTPFTGASSSVVPLRALLKHGFDLNFPASPNKPAERVPLKSQLLSTAPSGLIEQAFMDAFFLNYHTSYPFVHEATFKAQFYEQVPRPHGQAWQILLNTILALGAWSIGDDNSDLDITFYQEARSHLQQVSVFETGNLTLILALLLLSNYAQKRNKPNTGWNFLGLAVRMAMSLGLHKEFPGWKISLLQREMRRRLWWGVYIFDSGAAKTFGRPILLPEDSVMDAKHVLNIHDEVYQSPP

SEQ ID NO: 23579 - protein, 72 aa, A.fumigatus
ALTSTTTVLPTEENGPTIYSGMIAQAKFHLHTNSVYQRLISTPSLTAEETLGLSKPMEDWYVLHQTGCKDMR

SEQ ID NO: 23580 - protein, 71 aa, A.fumigatus
LTNTEYENLLPNGKTDQYIQCTRQRLDSPVKYHFFRPKTPGGRDILFLGSLELETTDDRLYTRKSSTWAAS

SEQ ID NO: 23581 - protein, 175 aa, A.fumigatus
  UNSURE (14): Identity of amino acid sequences at the above locations are unknown.
SLCISYPHILITGXEAMVILPVKSILRVISSSILFLRVLFWGKTHQTQESLDLLDQAIAVWTSDLLDDIYLVSRYAALLKIHVSRLGRPFANCSRFSSKGESYTQEPGTPVPTAAERFDWDPSMMDLGEANGSDDWLSLLLDPLMAPFGSWDNGLTDLGTASGDLNLDFVWNLPP

SEQ ID NO: 23582 - protein, 73 aa, A.fumigatus
  UNSURE (52),(55),(67),(68): Identity of amino acid sequences at the above locations are unknown.
HLFLISSMCLFNQYTHITSVPNFPCSTELSITTTEALGGKHKTQIPVYTWSXYCXNRPGWPEMGSIXXDSAAP

SEQ ID NO: 23583 - protein, 483 aa, A.fumigatus
  UNSURE (137),(140): Identity of amino acid sequences at the above locations are unknown.
GLFLRLLDSNIVINLRDYSFINTINFYSKLKQDISLLKLTISAPTMYELLAFITIPWVIAHPRLFMAVAAATTYFMHSTGRTFHNVHANMASQVTGILPEDLRRDDVLSNRMTVVFLHLFVFRYLRLIVHLISFWLXYHXTPVPKNPALSPSDCTIILPTIDPKNRDFEECITSCLRNTPGAIIIVTVGDQLTKLTKDIIAPYKRIFPNTEISVRTADEANKRRQVAHGLRYVKTKITVLLDDHVVWPTERFLPTILAPFEDPKVGIVGTNKRVRRTDTGFNIRSFWNMLGALYLERHNFEIRATNAIDNGVFVVSGRTSAHRSEILKDPKFIAEFTNERFFFGLFGPLNADDDNFITRWDVRHGWKVKIQYCPDAMIETTLGTYPKFLSQCLRWVRTTWRSNSASLFTDRTVWYTQPWCVYAVYWTSFVNFALFYDGALAYTLLKSPLGTADNLKYLAAWIFCTKMVKLTPYFLREPQDLVM

SEQ ID NO: 23584 - protein, 428 aa, A.fumigatus
NPWTRASRRRSPRPKGGKCSPRPNTRAEFGMFGEWGPSPPAMFGILRPRLHRSADTPSFLRPVPRFGSPLDTIPKRSSSFGRWTEQQRQNDRSMVSRPRNMGETAETTDPGSPMTVRPRTSLDGDLFQPSREGLFFPRPAPVSPLFSSHGAGGAGQVRPAAHPLSRTITQSSSNSSLADDSPTHEPMHKSERPRGVFDFSKSLPAGATRPGVVRHLNREDSTSSVDSFATPENYKLVKPLPAAFMSTGLISKKNRNAGDHQNMLGFNKNMPDTPCKRPINLFPTGQKPMSEWERPRLMPQADVVPSPSPSNPPSARPTSGPFARGMGIFGNSFNKPDLSRRGSLVSVDGDELTQSQSPCAQPDSQPLSEYDLPPTPTKQTFFPSRTYPPATQQIASLERLSEVLGNNSSPLHDRFQRSSPRGWKERVH

SEQ ID NO: 23585 - protein, 292 aa, A.fumigatus
  UNSURE (38): Identity of amino acid sequences at the above locations are unknown.
IYVGPVWERILSHIGGVYNIPNFHVRGGVCQTNIVSNXAFRGFGGPQGMFFAESFMEEIADHLDIPVEQFRQQNMYQPGDKTHFHQELKDWHVPLMYNQVLEESAYAERRKAVEEYNKKHKWSKRGMAIIPTKFGISFTALFLNQAGALVHIYHDGSVLVAHGGVEMGQGLHTKMTMIAAEALGVPQSDVFISETATNTVANTSSTAASASSDLNGYAIFNACEQLNERLRPYREKMPGASMKELAHAAYFDRVNLSAQGFYRTPDIGYVWGENKAQMFVFYHEAARIRVLG

SEQ ID NO: 23586 - protein, 175 aa, A.fumigatus
CATQNHPLPIYSHRFASSATYSLLSSRAVIDHRILISRIAIMTDMVGGQSDDVHQVPPPLPPAPMENYTFPEHRLKRKMDDPEKTPLLLVACGSFSPITYLHLRMFEMAADYVKFSTDFELIGGYLSPVSDAYRKAGLASAEHRYEISRLFYPLVQTADAMCLMTHQGCYVPTCG

SEQ ID NO: 23587 - protein, 131 aa, A.fumigatus
AKFPPLVLRPSVNESAHVAWPIADEALTQNLLDLVQQASHYRQLKKGANEGMPVWLSFCLLFLTDILPQLPRLSIVVPPKLSSSLPTPPPWLSCFTFLFFAKIRTYGFSFRYTSLLRSNTNYQSGSLRVRS

SEQ ID NO: 23588 - protein, 81 aa, A.fumigatus
  UNSURE (40),(73): Identity of amino acid sequences at the above locations are unknown.
ERTVSPSDILLYSGRILTINQVPYVYVPSKLALGRATGVXRPVIAASITTNEASDLMGQIRTIKDKVERLMIXTWFRSVDE

SEQ ID NO: 23589 - protein, 115 aa, A.fumigatus
KLSLFFYRLSLPVAITMPVTASRAVLRQSQFLTRRTAVRYASNTSEAASKASQTASSAVSKASEGLSRVTSTAGPAISNAAQGLGSALRKVGGRTGKVIAFVSSPTGLERSALCD

SEQ ID NO: 23590 - protein, 97 aa, A.fumigatus
RGSFEPRGEDYSGQNGKNQRVLTWLASDSRTDPQAKGKTTESFTGDLLPLITDLYSMTGEAYPSKSDYMGIFQFGTEAFSSSTNVTFWAPKFSVDLR

SEQ ID NO: 23591 - protein, 374 aa, A.fumigatus
FRAAYALGVLASGFADNLDQLKELCTKAFAVSPQVLIEKSMKGWKEIEYEVVRDCQDNCITVCNMENFDPLGIHTGDSIVVAPSQTLSDEDYNMLRTTAVNVIRHLGVVGECNIQYALNPFSKEYCIIEVNARLSRSSALASKATGYPLAFIAAKLGLGIPLNEIKNSVTKVTCACFEPSLDYCVVKIPRWDLKKFTRVSTQLGSSMKSVGEVMAIGRTFEEAIQKAIRSVDFHNLGFNETNALMSIDQELQTPSDQRLFAIANAMAAGYSVDDIWKLTRIDKWFLARLKRLSDFGKLMSTYNATTVPRPLLREAKQLGFSDRQLAKFLSSNELSIRRLRVEAGIIPIVQQIDTVAAEFPSMNNYLYLTYNASA

SEQ ID NO: 23592 - protein, 307 aa, A.fumigatus
PRRFSRKAKFKPGPNLGSFYPNPLGQERPVFLRPPPAQRLVKMSATPDTRRPRHTSGIDGTGTPATRHKQCSYRSFTPSLPGIEPPLGPLTGAGHNAIVGLLNAPSLRQLKTHIQRAEEKLTDSAGEVNERLTDARVRYQKERARKRRKANGEMPLAEGVGAKQEREDGSEDDDDDDGEERHRLARLEEQVQSVTEELEARMRQTIDAEVKLEGLKGVLADMAKEAEEATVAGAGARTAQLRSRRTRRRQGDDEGDQDPEEEGDEDYEATPEPQMPGIPPSRRLEQKLDEESARWAGQSLTQRYVLA

SEQ ID NO: 23593 - protein, 152 aa, A.fumigatus
LRGTYLHSPMAGRKEEWPKLKTYRYSTNNAYIGFYRIVHDAKHPGEDIPPLPHSSTWFAHMEDPHATTTSTTEQTSARRTRQRRSPSPADSDEIAIERERISLRCPLTLLPFRDPVTSTKCPHSFEREAITDMIAHSPTTVPVLTAGLENHA

SEQ ID NO: 23594 - protein, 179 aa, A.fumigatus
  UNSURE (61): Identity of amino acid sequences at the above locations are unknown.
KMDGVGGYAGWRWIFILEGLLTVAVALVAPFAIHDFPETATFLTEEERRWVIHKLRSQSGXDTTQDGTDHEESRFRVRYVLDALTDWQIYVALFSMLPLCVARRRLVGLMDQCTGESPPLSTVSRTSCHPSSRTSGTSLQRRSCSRCRFTSRPPLWLSHQPGCRIVASSDLHSFSSSCR

SEQ ID NO: 23595 - protein, 143 aa, A.fumigatus
CVDRLANLRGLVQYASPLRCATTTGWTNGSVYWGITTPLYGISYFLPSIIKDLGYKSSTAQLLTVPIYITAAIVAIASAWLSDRRKQRSPFIFFFMSLIAIGFIIVLASTGRGVPGVVYFGVLIAVVGKFFAHQQRTRLTRQG

SEQ ID NO: 23596 - protein, 65 aa, A.fumigatus
  UNSURE (51),(57): Identity of amino acid sequences at the above locations are unknown.
DQSCIVDPRISPCLARSDPFTGEYCSPLARQAFMDYTEIFRYQIGPMGYVXLTAAVXDQDLVKKG

SEQ ID NO: 23597 - protein, 112 aa, A.fumigatus
CCRSLVCSPSLGGAIGYAVAAAIYTNVFPGALESRLPADLKSNATSIYMGGYTVQQTYPMGSAARDAINYAWGRSQRFGAVAATCILILGIPAIAVWKNYNVNKHQNKGVMI

SEQ ID NO: 23598 - protein, 79 aa, A.fumigatus
ETLSNKPLPNTMSREAYQVPSLGAQNTFGTEGMAAGSMDGPVVAYLCGECNARVSLKRGDQIRCKDCGHRVLYKERTKR

SEQ ID NO: 23599 - protein, 78 aa, A.fumigatus
SADSDSEGSVTTEPVSVLSRDNQIHEFLNYWSEKVDIPLSRLAYTSYREVESDVGKTKNAPNETARVVELAGKIGGGW

SEQ ID NO: 23600 - protein, 316 aa, A.fumigatus
RKHVIPGDNRLQICLTSYSSKSRLCLNLRYPCIKSQLDSTCGLKSSYETCREHATMSKQDSLLTRKALASSVSGTTLLVMIQLVSRLFTFVANQLVLRNLSPATLGAATQLELFMVTILYFSREAIRLAILRQPLDSPSSPDISKQEKPRIACDKEMEAQSMATQSIVNMSYLSLAVGIALSILLGTFYIQFAAEQVAQTSFYRCSVAIVCLASTLELCTEPFFAVVHRYMLYKTRATVEMAAAFVRSLTTCGLLLWASWNGSNVGILPFALGHLFYALVLLCGYSATLSNSASRWHFSFLPSRIRSRYVEVITIK

SEQ ID NO: 23601 - protein, 178 aa, A.fumigatus
LYPPPKRLMESDGIKVNDTTPRAAQDLRFTPSFVDPNSLSYMNFPAQQSGYYTPNSEGLGPLFHSQAGDLHTPGMSMITPMSLTQQLPGPTLTAGGQAFSLDHYDQHYINPHFHNPQAFAPQPSFAPSAFVHRDSGYDAMDESVDEMSLNDVDIQGNTSQFATSAAHDLSDTPGSSEK

SEQ ID NO: 23602 - protein, 66 aa, A.fumigatus
THARSFQPRGEDSLTGRKNSQKPDDEFIQRFQKTFSEVVPLGSQRNAPGLGQVAGNQPITPSRYVI

SEQ ID NO: 23603 - protein, 67 aa, A.fumigatus
PFILVPIGSPDLLTSTHALSSNLTIVPSGLCISFFARTTTACRISPRRTLFAMPLLFVLSGPKFRCF

SEQ ID NO: 23604 - protein, 88 aa, A.fumigatus
RTWILIWLQLVIGDRIVVVVQKQRNFGPESTNNSGIANKVRRGDIRHAVVVRAKKEMQRPDGTIVKFDDNACVLVNKSGDPIGTRMNG

SEQ ID NO: 23605 - protein, 86 aa, A.fumigatus
QSRTATNFIDRGKGTPRRKVKNVHKSSGADDKKLQTTLNKMNVQPIQAIEEVNMYKEDGNVIHFTAPKGEFLTPASVSVSPNPEGR

SEQ ID NO: 23606 - protein, 72 aa, A.fumigatus
DAVPSSTAFFLRVSLLCFTTTCAHATMSEEPTPHDHGESIAAPPDLPPGWKYRQRRIFGFNIPWYASPSVQL

SEQ ID NO: 23607 - protein, 63 aa, A.fumigatus
GVGKSLKNSTLKMLLPLEYFKISKNLPMKCSEIHLFNYPASIMPPIPWSLNSQGPPRWWHFPP

SEQ ID NO: 23608 - protein, 162 aa, A.fumigatus
  UNSURE (115): Identity of amino acid sequences at the above locations are unknown.
LRTPYDCQSHQTQEDVECCCLACINRTRSYDGFMASLLKNVVKNPPYALFAIPGLPDIPMWWCNSCTAYLRKESTPVINIRSGWSAGLNTDWTAPDKITNTISNQQLWFYGWWIXITLKGGSPLANPNPTTEKIFLCSTLAKHRLISWIKGPTFLTPCLKAN

SEQ ID NO: 23609 - protein, 199 aa, A.fumigatus
ITYDDSKLASDLTSRLAQIYQKPEAFMMVTIQQDACLYFGNSALPAYLMKVFALPYLIAPITNLRNTILIQAALQDLLHVAPSRGIVLYIPISEENFATNGVTMMGEIARLEGHAEDQDAGILRSISRSMRRRIKSNSTTSAPLSVATTSSWTPGFDPCQQEWHDARRRNVSSEGESNTVRKPKSMRDFVCPAVLASDM

SEQ ID NO: 23610 - protein, 190 aa, A.fumigatus
DIAFPSFPSLSDQPYPFGYSRFLSIFVFFFFFTFAGLGPNSSMPSDSFDTDYAQRERSRSPRRRSRSPRRSRRSYSPRSRSRSRDDYRRSDRRSRSPMSTAQGATGGHSGSGYGGRSSYPPSRSFEERSVAKEQMMQSVRESSQQDRRVYVGNLSYDVKWHHLKDFMRQGEQGHIVSAVRRSFCWMKTCG

SEQ ID NO: 23611 - protein, 90 aa, A.fumigatus
HPSGRNPHPSGIEVHSVYGHIWSDDPYAGGVMPVRKPGFMGKYHDEIRKPQGNVHFCGSDFADGWRGFVSGAFEDAYRVTREVETSLSIK

SEQ ID NO: 23612 - protein, 217 aa, A.fumigatus
RLCSHILVYVSRTKNFQKGGNSYDAIAKKNDQMYALIAICVALHPTRLDDTIHSALREKYGEQLLRLQHGGPDALPLFEELFRSACPKFISPTPPDFDNPALNIDPVDHHTAIFMDEVKNTLYNPTIRSYLKLYTTMDLKKLAGFLEVQPEVLRSWLLVNKQRSRQVRWVEGGLLEGEVVSANDLDYALENDLIHVSETKAGRRLVDWYLRNLARVY

SEQ ID NO: 23613 - protein, 218 aa, A.fumigatus
SLGVRSGPGHINRPGRRGQGQQDLALPDRRDGGDVSDIEEESDEDFIDQYYGDEEYTLTPEQAEEGRRLQNNPQSQSGRATPRELTRSSQFPSSPSVHSDMGLAPPTRPFLEPGNRLSSASVLSVDSVVGDKKDFKLQKVDPFFTDSHGEYARLFEKSLENLNAANSETQLCIEEFLVKSEKEWFDKFRDAKLGRLNSPAPSVFRGSSPRGWKDPRGR

SEQ ID NO: 23614 - protein, 173 aa, A.fumigatus
  UNSURE (95): Identity of amino acid sequences at the above locations are unknown.
ACADPSGPPVVKTTGLVDSKLHGQRKTMFQRAIDLGLPASFVELRHEATHRELPSLVVLRNATQRSLEWLWDYYWAKTDSDVALASGRPASAVSXGAENGNVEEIRSVIRTALEHPANQGDLSEPPRKKRKSDQQSSFLAEQLGAICKASSRSPHSLSRVLIEDAIIVPKGRK

SEQ ID NO: 23615 - protein, 69 aa, A.fumigatus
SSLFCHLHCDHIDSTLVGNTDYLEILNSNYSPCNYLQIVTWPKWPQLMSLRGLMVRLLKRSAPHETNPD

SEQ ID NO: 23616 - protein, 324 aa, A.fumigatus
  UNSURE (307),(318): Identity of amino acid sequences at the above locations are unknown.
QLIVRSGRRHPFSSWMKRLTGLKGSSTDSGTIRWSHKRHDAHKNKRNNKNNPYPLSGTTNVVREYSSDFVPSVSDTNAANGPRSCSYSEPSIACSGHDNQVPATSAKSTAPTISTNGDTAISEAAYSKSGTMATAGGGISSQGGGEGSTFSSPAPSVRSLTTTLTTVQSAAPSIHFYNVQSTHQGLAHANSTHSNASQQVQFSQPFPSSPATAVPPHLVPHGHSHTYSTATANNILTDNASILTLASSSKRRRRNSLDTNASVRALAPSSVFGGSRESLPLSVLSANVGEPSNTSTFSTPGVLNRPXMVGLASAERIXVYSASG

SEQ ID NO: 23617 - protein, 106 aa, A.fumigatus
  UNSURE (100): Identity of amino acid sequences at the above locations are unknown.
RVNSTSSLQVHSIMYRFHPSVKYTTAYPSQQEIRDQIIDVWKRYGLQKRTAFDTPVTSVKQTKDGKWIINDNEEEYGRFDGVIASVFTTGLEDSRLSVRXWGAGGA

SEQ ID NO: 23618 - protein, 133 aa, A.fumigatus
TECSSSMAQSKAKSTIVDFFTHPFLVVFSLVYMLFQNILTWVFSPAPPPPASTANGLPKKRVAVIGAGLTGVSSAAHCIGHGFDVQLFEARPKDKGLGGIWSVCCVLYGVDLNSANAWAVSVSTLPHPCRFIV

SEQ ID NO: 23619 - protein, 66 aa, A.fumigatus
FEDLPVKPLTLTTAHPLPTDVLLKPTFSPFYVVIFKKNGLSVFCQIMLDSRHVYLSSMQIFYQLCN

SEQ ID NO: 23620 - protein, 309 aa, A.fumigatus
DGTIHPEGVWKKDSHMGTYEPSDTLSISKDVIVQHWQYGQSDPVSLANDGYIMINSEDQWAYMSLKNDHMPIFPAPYPYLFNTSRVLNFANIDGWQWTPALFNPFNVTEQPNKQAVQGAILAAWNDNGPDATTQLEAFYAMRNGIPIVASRAWTGDRGPRLDESSLSWSAKLLTARAAGQNLDRRFTGGVNHKTDSLFSWTSGKQSGERIHLGYGSKGMNYTLELDVAGPFVLSSEDCALSLSASGTLAFTSDGWEYPLRSVAENPDSTNVFGNELDKQNSLHAETRPNPLPRRSLFRTKVLGREHNLG

SEQ ID NO: 23621 - protein, 185 aa, A.fumigatus
LFAGQALSEFAEYADKQQSHRSAQVAPSDSGYSTAHATEDHAELDILDQLTLSDTPKTVKLKDLLLGTGEEAEDSLQLLGSILQARIDEGHGETIFDLGLEDGGDSMGFDLEQWNTALQRLREAAEALPAHCRTLLTCNVGDPEESKTKNDRIKGAWGKILIRQPADTVEEMADIRIPVVGNVDA

SEQ ID NO: 23622 - protein, 73 aa, A.fumigatus
SFDSWVPLVNFQSLCAYWRACSVLEGYRNGAVFAASKHAAVGMVKSAAFEVGSRGIRVNGILPCVFLLFYLTS

SEQ ID NO: 23623 - protein, 73 aa, A.fumigatus
LRDEVNQVYSGPIDTPMFHQVRENAGLSSSASDTPIPRPGQPEEVASIAVFLLGDQSSYVTGAVWNVDGGANA

SEQ ID NO: 23624 - protein, 60 aa, A.fumigatus
YPLSCHLVGDVSAPLKGNSTDNCIHGMGKHKFDSRAGEVVWMEEIARVSRYAVNHLEGRI

SEQ ID NO: 23625 - protein, 111 aa, A.fumigatus
SSDRSSPTSARASSNSRSSCWPNGSRTSRTVPANTTGSCGMMPTRERRSCSRTWARSVPSMWMDPDRASRQRRSARASEDLPAPVRPTIPTRSPARRVKVRPCRTGGRSGP

SEQ ID NO: 23626 - protein, 181 aa, A.fumigatus
VRRLRDHHLRHHPHPRRPPRRIRPQLRPGTLRAHLLAPLAVRQTRTRRQRRRAHSRVHAARPGTPIRHSRTRLLAARRRDPGDRSLRGLRARPPARPAGPHLHPARRRASRDRGPNRRRQILARPGAPPLPGRAVRIHPHRRDRSRPGAATRSPLARGHHPARTGCVCWHGARGSGPVRPA

SEQ ID NO: 23627 - protein, 342 aa, A.fumigatus
PSKFVASVTITFVTIRTLDAPLAGFALSFALELSEHISWLLSQYAKLELDANAAERIVEYTQLDQEPQSGIPVPASWPPAGEIQVTDLCVAYGPDLPPVLQGLTFTLRAGERVGIVGRTGAGKSSLALALLRCLDARSGSIHIDGTDLAQVRLHDLRSRVGIIPHEPVVFAGTVREVLDPFGQHDDRELLDALAEVGLLRSEDYAPGDYKDGFLLDATIIEGGRDLSQGQKQLLCLARALVSRAKILIMDEATASIDMESDIRIQRTLRQVIRGCTLLVIAHRLSTIADFDKIIVLDGGRVVEMGPPGELMMIENGIFRGLVQESGERAVIEGMIHGNTREL

SEQ ID NO: 23628 - protein, 310 aa, A.fumigatus
  UNSURE (295): Identity of amino acid sequences at the above locations are unknown.
SGSKTLRDQVGNPNNYAVIGLGADCLLYLFSVEFYKFLGLNQIQQLDFPENKFSLYFLAYNGPQSLQGDRHWTDRNAVLELTHNYGTENDPNYTVANGNTEPHRGFGHIAISVDNIEAACKRLEDAGYQFQKKLTEGRMKHIAFVKDPDGYWVEIIRRHDQDVGTATDPGTYRLNHTMLRVKSAETSLKFYQEVMGMTLVRTIENKDAAFNLYFLGYPASNPTAQEGAKNPVAEWEGLLELTWNYGTEKQEGKVYHDGNSEPQGFGHICKPPRHLLHRSNCADIDVPAGFLLTIXLHSQPWKEIILRTQD

SEQ ID NO: 23629 - protein, 105 aa, A.fumigatus
  UNSURE (47),(86): Identity of amino acid sequences at the above locations are unknown.
LYNYATSSSSSSRLSFQDQPSRAARELTTLTQPITKALTSILSLGFXTSLVLGSENAECGTRSAMAPPCPASAAAAARISEHFNNXLSSFSIPERYIHRWFPIIL

SEQ ID NO: 23630 - protein, 143 aa, A.fumigatus
CQIMAATHGRKSTADSNVSEPHVLRGNVSHQVQAFTDWSQARRFRILDTIKHDHSEIKSFYELIVSSPGPEEQTKYQNQFTWELARHTVGEELVIYPALEKYLDDGKELARKDRAEHQTVRSLFPFSFVCSGECVFPTDCNTA

SEQ ID NO: 23631 - protein, 131 aa, A.fumigatus
  UNSURE (130): Identity of amino acid sequences at the above locations are unknown.
AMAYSPAPASPATGTAGQTLSSSLHPRGRSPSPATNAPLSKRDKRRGALQERLHDLTATFSHNRDAQFRQQLHTLQCDMTLINNADPYSPGPLPDSAEEIAALVEKTIGGGAFAKEMANLSGMWYSRFVXE

SEQ ID NO: 23632 - protein, 181 aa, A.fumigatus
RFDITQEAEVRIRCPEREERADQLGTIGQVARWHRRRNQPCKAGDQLVEQGRRHRRHQSRRAGSGCARGRGVPAQHPLRQGRMRRPAGACIALLGGCRRAAAAVGTPDDEKDRKEFRATADEQGGADGRGARRGRRWQRPDALRRRGGRTAQRRRGEGERSLRCRRGAVVMLVGTEIGGGR

SEQ ID NO: 23633 - protein, 379 aa, A.fumigatus
  UNSURE (62),(137),(145),(146),(155),(156): Identity of amino acid sequences at the above locations are unknown.
DLSNLWVTRGFFWVRGLIIPGGGFFSFNWRETPTWGGIGGFPKVAGSWVARTPIHRAKLLFXKVGSPRNSGLHLTGRGWPWVFSPTPMATGGIHTTGPEELSPSNPSTPVFPSFSSQSQSVTRSGQQSPTAGMTMSXTRLTPHGXXQDISLSASXXTLGTSASTTNFGTDQHHHSPASTPQGSFPFPPPPLRRASTAPAQSIRPLPPPSPASPTAISTALLVSSCAKLFPILLVIWGPDGSGGSSTPAQQGNTSAGGTTHSTLTQRMLSRYTPTASAAAPGATGLVSSVSSSLLDKLVSSLAWLIPASVPTSYLTNCAELVGSLFSLGAADTHLGLLSNIEALYILLGCGYLRAVALAVTGLLARWMVQRVILGAVGIG

SEQ ID NO: 23634 - protein, 254 aa, A.fumigatus
  UNSURE (80): Identity of amino acid sequences at the above locations are unknown.
SKQWWLTMSKYAARGIGMAAFQGWQQIHIATHDSIGTGEDGPTHQPIALAALYRAMPNLLYIRPCDSEETAGAFIAAMQXTSTPTIISLSRQNLEQYPKFSSREGVQRGAYVFIEDEQAQVTLIGVGAEMVFAVRTRQVLQDRFNIRSRIVSFPCQRLFAQQSQEYRREVLKYRSGIPRVVIEAYAVTGWERYADAGFTMSTFGHSLPGAAAYKYFGFDEHVIAPEVAKLVDEVQRDGIESLRGDFRDLNPVRR

SEQ ID NO: 23635 - protein, 111 aa, A.fumigatus
SIMADITAVGEENPSPTQDDLQQAAGNGAADNRGPKRSRMSAEDDDDDDDKPGRERRKIEIKFIQDKSRRHITFSKRKAGIMKKVRTLASPCPRSSPVSRVSYFFLSCPLV

SEQ ID NO: 23636 - protein, 67 aa, A.fumigatus
RFNAIAKQAYELSVLTGTQVLLLVVSETGLVYTFTTPKLQPLVTKAEGKNLIQVSCLHHGRRKIRDA

SEQ ID NO: 23637 - protein, 101 aa, A.fumigatus
  UNSURE (53): Identity of amino acid sequences at the above locations are unknown.
ALISSYAAFRRHFRGLVLYLGTIPNRARKATIIQHHLPNISHNQIFHMIHTDXEGMLTLSISILLVWAIKVNQVNSSALPYAFPSLSGSPTALPDHGYASA

SEQ ID NO: 23638 - protein, 249 aa, A.fumigatus
LFSSRQTVLTIQVADLDLMDGHVSRLIDLVPKDGSAFDIQRLFFLLTIDSATHFLFGESVGSLHAGTDTGLLGRSAVGNAEGFAEAFNKAQEYLAARSRAVVFYWMINPKEFRDANKRVHEVVDHYVQLALESRRNPEKKQPGGRYIFAEALAAENDNPKVLRDNMLNILLAGRDTTASLLSSTFFYLARHPNVWIKLRQVIVDAFGDAEHPKEEITQTKLKDIPYLRYVLNEGTLTPRTQMSSPRGCK

SEQ ID NO: 23639 - protein, 109 aa, A.fumigatus
PVTMCAAPCRLVVKTELIAEQYGKYGNTFTQTIFGQPLVSTIEPENLKALLATQFNDFELGTRHREFYPLLGDGIFTLDGAGWSHARALLRPQFTRDQVSDCFRLVKLC

SEQ ID NO: 23640 - protein, 232 aa, A.fumigatus
  UNSURE (217),(220): Identity of amino acid sequences at the above locations are unknown.
AQEPPYHLLATGANISRKVRIIFTGCLLGESIAGGQKLICPFYSNLDWEIVIVDDGSPDGTLEVAKQLQTLWGSEHINLKPRAGKLGLGTAYVYGLQYVRGNYVIIMDADFSHHPKFIPEMIRIQKETDADIVTGTRYASRDGIKGGVYGWDLFRKFTSRTANLIADVMLMPGVSDLTGSFRLYKKSVLEKVIHSTQSKGYSFQMEMMVRAKANGFXVAXCSITFVDRLYGG

SEQ ID NO: 23641 - protein, 80 aa, A.fumigatus
DLKSVASESLQSITIKMKFNIIAVSSLLVLATAQSTTESAPSTTTSLSPEASCAAKCSYFYLFLNYPSHKANLAIAFRRF

SEQ ID NO: 23642 - protein, 116 aa, A.fumigatus
TIRLIKLTLQLHLGGSNDICCVAGCYNVPCPSDQQANDTISCVAACPQGSGTPSDTDKYAACQNSCYSSHFFPATMTNAGSAKTGVSSNTATTTGTGSSSSETGTSGMSLVLFGHF

SEQ ID NO: 23643 - protein, 62 aa, A.fumigatus
ILSRMPKLIGQSAGSDSTASGSGTATSSSTATSTPNAAVVSQMQLGVSAAGLLGFVLAAWAL

SEQ ID NO: 23644 - protein, 81 aa, A.fumigatus
CMEEVSYLVGSSPTMVRDLSRQFDNKSRESGTPHCIKLRCPCFLLAGKHMESSYYVWYDVVDFFPSAILEMKNYPWFIRKY

SEQ ID NO: 23645 - protein, 451 aa, A.fumigatus
  UNSURE (392),(422): Identity of amino acid sequences at the above locations are unknown.
SLFLPLFRSANHGIHAENKSFQPPIFLKCGPLLRYTGLKRVRIDGPNGPFDKETWRGSVMIVTKDSRSSYESPPTLRLFSQPMDLLPPPPVEVSDAQLAPEYVDPTAGLMKLGRDGRPLYVKPIDHTEEGVDLSFVENDDGVYEMSPSNLDYSSDGVKQSIPANRLHSVDGETVGAYKEIPGARLYADSARDVTFWRFNIEIELGETQQRIAYRLNHGPALGFWVPARGQSMNIMFYSCNGFSLGVDSNKFCGPDPLWRDVLNEHQTRPFHVMIGGGDQISNDRVMLDSPRFQEWIKVKNLTDKYDMPFDPEFRAEIESFYLENYSAWFSQGLFSLANSQIPMVNIWNDHDIIEGFGSYPDEFMATPVISGLGRIAFKYYLLFQHHSLTEEXEADEPSWLLGAQLGPYINQRNRNVFMSLGXEITFLGLDCRNERLVRIMCFPGGKEKGKC

SEQ ID NO: 23646 - protein, 118 aa, A.fumigatus
RRSEALKPLQANSIISECDIRLFKPVLMLLFLLLGCPTPQRIVTYSLSSNRQRPLAGAFHAAIFNTFRRFRSQVLYVVPPFVVAYAAMNWAIERYAPSCLASLFALQASNQSLIVAIV

SEQ ID NO: 23647 - protein, 107 aa, A.fumigatus
GRPIRTILAPSARALATSAPQRTPESKMTSRSFPTASTMSGSMSKDPTPPSCWRPPWLDTTIPCIPYSTASFASSTVCIPFSTIGPSQCCRRNWRSSHPWLIPGNII

SEQ ID NO: 23648 - protein, 221 aa, A.fumigatus
  UNSURE (3): Identity of amino acid sequences at the above locations are unknown.
VTXDTYIVGWRPSDLDNGYHPFLRKDHIGVATGFSDPVFQKKFAEKHGKSIPVDMATAAAEWAHMIFPGMSHGWEDLQFLRQHWDGPIVLKGIQTVEDAKLAVEYGMQGIVVSNHGGRQQDGGVGSLDMLPDIVDAVGKDLEVIFDSGVRCGADVAKALALGAKMVLIGRPYVYGLAIAGREGVRHVLQSTLGDLQLTLHLSGIRSVQPEHLNRSRLRRMD

SEQ ID NO: 23649 - protein, 124 aa, A.fumigatus
NHSCRCYVTLKIFIKSASMGQQLDDELQMYKRMERGSKNHPGRSAVRSLLDSFDVDGPEDKHRCLVHPPLWDSVLTFLHRNPEQRLPAPVLAFVLKRLFLALDYLHTECQIIHAGIYSGGPMDV

SEQ ID NO: 23650 - protein, 136 aa, A.fumigatus
KMASQIWNIFEGESLFTGYDPESHTYRSRAHLAEIIKLLGPPSPSLLARGKLSHKFFSDEGKPMPLSFQYPLTLSNVIDDLCAKVLSEGRIPLEKRETTLQGQDKADFLRLMLKMLQWDPANRSSARELQEDEWMS

SEQ ID NO: 23651 - protein, 89 aa, A.fumigatus
GEFLTYLCVLGFHTPSKFLSIDHLVRMESFDVTDISNALKEVTGEKIYKNVEASNLAREKGWVLPEQYDYTKLQQWVLLENPEDVTEQK

SEQ ID NO: 23652 - protein, 159 aa, A.fumigatus
ASSPDKKPPWLRTLGTTMTSTLPYLTSPPATHPSNSDHKKLRSACDSCHQCKVKCSGGSPCFRCTSKGLNCRYGYQNRAGKPKGSKNRKTLEREHQLRMEWLTSQLRDANGGLGNLNIDLSDPTTLLPSPFFQSTRWKQVSRCLCHPGYLLSLMLAGAN

SEQ ID NO: 23653 - protein, 68 aa, A.fumigatus
DREDSVCFGLLGALIDRTDFLSIPRLQLQGELQAKSEAVKKYKGVFHGVKGHFAKMKVLGGLFPGNRL

SEQ ID NO: 23654 - protein, 215 aa, A.fumigatus
AARYLLAPACVHPLRIDGNAYVWEQTPTGWKPTLVLLRINRAATFVRWSPSEQKFAVGSGARVIAVCYFEEENDWWISKHLKKPIRSTITTLSWHPNSVLLAAGSTDSHARVFSSFIKGIDTRPEPSAWGERLPFNTVCGEFLNDSAGWIHAVCFSPSGNALAFTGHDSSVTVVYPSAPEQPPRAMLNITTRLLPFTSLIWNGENEIIAAGHVSF

SEQ ID NO: 23655 - protein, 117 aa, A.fumigatus
DCEPFRFSGDESGWKLAGAIESKTGAGAGSVRDESALNMFRQMDLKGQTHADTQLKTIHQNTINTIRVYKETGGAVHQFSSELYMLHYKALALPERDITNGCVLASGVDGRVVVWTI

SEQ ID NO: 23656 - protein, 295 aa, A.fumigatus
  UNSURE (225): Identity of amino acid sequences at the above locations are unknown.
PSDLKNGSAYSLNGPRSSASSYTRDLPHSKDGSMHSLGNGSVRDPRESGRFSMTMDKDFTRKSSDAGASAGIGSAAGSISSAQQVNGISPSHRTTNGKSLVNGDRPQPSADEVVSQNSAAAANGNTIVASLPEDTSRLASEPDRLAASRTTTPHRYSSPPLPSASADASHPQDPAASSGLRHRHTLQVPRATSARRNSRDQGDETAYSNGRLSPTAGAIRRTSLXLVRRATKTNPADSVPDEANANDDAPRWAEAIMQRRASRRKRRDEHDDDRVFVGTTVDQKPLKWVTAFNML

SEQ ID NO: 23657 - protein, 99 aa, A.fumigatus
HLLSDLAPSLLKPEWFRSVFAVLDPQSAELLNLRISYDIRKNNNRNNQTTLTHDLHWANWSSSADPYLTYQYVRTLNTTGNWSVIWELYWQSCDEEAES

SEQ ID NO: 23658 - protein, 158 aa, A.fumigatus
SGSSTGKAATRKRNRDEKVLPSDHDGGVFEHYYSWWQHFTIDDSALKKVDLVAATANATCPGDRNAIAINVTDTTMHSPPGLNSAGRDTCVVTATTTASATRTTPDPCRVAIDADAEASMAAVHQKLLCDHLKNSNPPEVCPAEENGAQQLAALGVAS

SEQ ID NO: 23659 - protein, 133 aa, A.fumigatus
KRGALFSPKTPPQKKEIFFPFFPRGFFFPPKPPFFFPGAPPFSPPNFFWEIFPPKILNFPQIFFFFPPPPLKKSPKILKKKPPPQNPGGGPQTQKLGTSQVLRSLARATRASPSRSIHIQPASLRPSRPTCSV

SEQ ID NO: 23660 - protein, 118 aa, A.fumigatus
QNLSPLSQPTLSRPFSHSAPVSSSPFRLTSKPDTDHTIPPEPPLDGEPAPYYSPYKPKRQWPPDMSKLSPKHQFRLERKYRRRAALKFARPKWVKTTNLIQWGVIGCKFSVFVRGKAI

SEQ ID NO: 23661 - protein, 182 aa, A.fumigatus
QPPPGGGGFFLPLFFPPKKKKFFFFGGKTPPQKGVLKKGGPFFPKNPPPKKRNFFPFFPPGVFFSPKTSFFFSGGPPFFPPKFFLGNFSPQNFKFSPNFFFFSPPPFKKKPQNFKKKAPPPKPRGGAPNPKIGHFPGPAQPGKGHTRIPLPIHPHPARFIKAIPTNMQRMIFFIPSLVIPLL

SEQ ID NO: 23662 - protein, 62 aa, A.fumigatus
YAFRSRLVMNGGRSFSICLQSVIEGLIALENLSVSRHARVWYLLVVRSIESTSDTWAHRHIT

SEQ ID NO: 23663 - protein, 225 aa, A.fumigatus
GVNSRPDLGWNPSVKFVAWEGIQAGQKHGGEFGHWHPINGFVALRVTGLACPHTSSRILLHQQPHPQQQQYSSFPWDQLSKSPKPGISNLSKLESAFSSFLPGGSSREERVENVAPQHQAPYQHQQPDRPYQPHGQQPYETHSQPHHPQYYQPPPQQHPGGGYGEPHGGYQSTPYGDQYGHPPPVPGYRPPEHQHHEHHHQSHGHGEGYHGYPGSGYDNRYGSGY

SEQ ID NO: 23664 - protein, 126 aa, A.fumigatus
LGLFLFFIAVRLGVYNYSLKVLNEGQTILGTNEQHPPLMKSFTKQFWDMYLTVVHLMDPWNWALYYNYYNPHLWTIPVEFRCSIVLFLTIIATSRVTAVARLSLVSGLVWFCMRVFTDGGWKDTSF

SEQ ID NO: 23665 - protein, 195 aa, A.fumigatus
  UNSURE (152),(187),(195): Identity of amino acid sequences at the above locations are unknown.
HKHHPQDMLLIDKDTRPSPAIHDIPLDDLESGPYGSKSSFNWTNLSDYTPSRVLTRPDRLSSHVQHVSNHWQEYLDRWLKRLGIALTPSYLQHLVGGEPPQPTKFHAIAALDGLRGWACLLVFNFHFLFTYTWKVAVGWGFNNENYGIFHLXIIHFLFSGHIMVAIFFVISGYVLSYKPLKMIRTRXWEQTLATX

SEQ ID NO: 23666 - protein, 137 aa, A.fumigatus
TERGLDACIFQVRPAIAVETIFERALRSVSIHRRKSRQTFVFLHFQVLTHFVKMGFGQFDSICQKAALPLCSLVGPSSPISGSTGIIPNCYARNIELANTIIFEGAASFVHIIALGMTVIMILHVRSKFTAVGESRT

SEQ ID NO: 23667 - protein, 229 aa, A.fumigatus
TPIARFVQCPWWKNIFIANAGVMATPEGRTKDGFETQLGTNYLSHLLLFLLLRPALLAAATPQANSRVVLLSSIAHRYSEVEFDNLNLDGQYDRWKAYGQSKCALVWAANEIDRRYASHGLRAFSVQPGGIMTGLVHHLSEEEQSGFTEDPTLGPQFKSPQQGAATSVWAAVSRSLDGMGGKYLENVQIAEAYDASGGPWAPGYAPYAYSPEKERRLWDVSLKLVGVDE

SEQ ID NO: 23668 - protein, 352 aa, A.fumigatus
TRLFLGRVIAIRLVSAFIHQRIPSHVVDCAHSHQPNTQDPERGEVGRQEQLASAPNQANGSTERTPLLLQSKPPSRKSMPGAVERPALEPLRSRLTRRINQLMGGVKTQCDENGPCYGFSQTCGLECTKILTNTQMASVVEEMPRPSLITHHSIGVQLDSERVGFGEGAGPGLLPQSHDSTEDVSGQSDASNSQKNQSSASSLRTGLEVYPHKSSEDQNDSTKEPRAASAQQQQQHHHHVPQNAFLSIGLQTSLAIALHKLPEGFITYATNHASPTLGMTVFVALFIHNISEGFAMALPLYLALNSRWKAMFWSSLLGGISQPAGAALAAFWIWGARNAGHHDEKTGAKPRR

SEQ ID NO: 23669 - protein, 233 aa, A.fumigatus
RQTVSARTVALPTPSHGEDWRTSIGSVGNLLPNMEAKYMTMPEDGSEPREVPVGEVGELYLRGPNVFLGYHNNPEATAQCLSKDGWFQTGDVGYQDKDNNFYITDRVKELIKYKGLQVAPAELEGILVDNEAVDDVAVLGVESEAHGTEVPLAYIVRSAKSKNSNITAEEEATRIVQWLDGKVAYHKRLRGGVRFVDEIPKSPSGKILRRLLKKQAKEDASKALGCLLPKLSC

SEQ ID NO: 23670 - protein, 157 aa, A.fumigatus
AHMRGSFGPWARRLLQDPHYPWHALSRLNADKFFSDIIESVLGAIFVDSGGNLAPCEVFVEQIGLMAYLRRILDHGIDVRHPRSVVQQLAKTNIQFVLQRVPTEEGGASYQCSVQMEQAELFVVTGCLTAEEAEVTAAVEAIKFLTRDEGSTPLNKS

SEQ ID NO: 23671 - protein, 108 aa, A.fumigatus
TPGWGGSPPPLLGGKRCPFKDTRAILTPSHTGKLANVEYKPSNVFNLHVPKTCPGVPSELLNPKNSWTASTSFTDEVNKLAKLFNENFAKYADEATKEVIAAGPVPSQ

SEQ ID NO: 23672 - protein, 165 aa, A.fumigatus
FSDAARLLNFYQLWLDDLFPRAKFADGLAIIERLGHSKRLQAMRKEWIDEEKPKDASENHNDVLKASESSGSQSDDPVVAFGGLNMADTKRSKGDIAGDYMFDAERMRVEVNLNPSGQRKLDEGLFMTDNDDVAQQPDNLGAPDDDELDALLKEQELLLMNNASA

SEQ ID NO: 23673 - protein, 300 aa, A.fumigatus
PLCLQDRVARRRTTTGWLGSTREANSNSSNLRLLSPRSRIDRPQHWPRSCRTIRIPPGQPHSASSLPNLTAPSPAHTPSPAPTQRPSYPGSMYAQSPSSHTQPAPSGARDLGSQNQIYRPAVGSPTSRHNSIAYGSRQGPPTPVQSQTSLLGLGSRPPAPTVSAPAPSNHMSAHQTYQQHVQTMVNGAHQQQSHRGPLGLSTGYGHNSPQPQAQGSRAAGLPGPPSQAAAMGRSYTPPAILQPNPAGYGPSGPSSGMHPLQARPSGPGGVGEPLSSGHNPGHQRGYSQGSSGMPPQHGPR

SEQ ID NO: 23674 - protein, 229 aa, A.fumigatus
LTVVHLIANSLVAVGDEEGGIRLLDSAKDDKSGFSKAYLTFRPHMNAIMDLEFSSDDMLLATASGDQTAQVIDMATQKPIYCLSNHVSSVKRVQFQPAANNKVLATCSRDGNVNIWDLRCKGFERPSLQVRCSLESDSDNSLSLAYKMIYPQVLNTIHGAHAWTPQTSINDKPQPQNGTFRPQRKPYLTFVSPRSRKYLCDNLQSPCMPENKRISYHTQKPLRPPFPSR

SEQ ID NO: 23675 - protein, 188 aa, A.fumigatus
TTAMDASSSHRRQRSTSRQRDDHVESPPVSVKVKMHNDGRHVTLRRLTEEEAAASREARRRERRNSRRRAGSASSLSGNEGGYDRWRRVEELERQQQEQIQREQQAAAAAAGSAAPLGAAPPPSFVPPSSHFSPPPPPVPSSLPYGSIGSPGTFTGTDASGDYANNRRRRRAERARARQERQQSVDFT

SEQ ID NO: 23676 - protein, 342 aa, A.fumigatus
  UNSURE (14),(310),(322),(328),(329),(330),(331): Identity of amino acid sequences at the above locations are unknown.
PPPGMRGCPKHPKXVKPPPSQTSSGRSTPVPVKDRQKLGLEGGSRRPETREAMVESIGVLARIPSFMVELFVNYDCEVDRADLCEDMVGLLSRNAFPDSATWSTTNVPPLCLDALLGYVQFIYDRLEDEPRYEGFPSKELLKSQRKKKRIIIQGAQKFNENPKAGIAYLAAHGIIENPDDPVLVARFLKGTTRISKKVLGEFISKKSNEAILDAFVDLFDFSGKTVVDALRDLLGAFRLPGESALIERIVTTFSDKFVQKAHPKGVADKDALFVLTYGIIMLNTDAYNPNIRPQNRMTCNEFARNLRGVXAGRRICSLNSFXKIYELXXXXRDYFYPMKPEE

SEQ ID NO: 23677 - protein, 329 aa, A.fumigatus
  UNSURE (4),(9): Identity of amino acid sequences at the above locations are unknown.
LAKXGVVCXEHDDGLEIDGIDRSTLRQPAGGVFCYDDHRVAFSFSVLSLIALKPTLILEKECVGKTWPGWWDTLRQKFAVKLEGKELKEAESPVLTRAEKASASVFIIGMRGAGKTTSGHWVASTLKRPFIDLDDELERIEGMTIPDIIKQRGWQGFRDAELNLLQRTMKERPTGHVFACGGGVVEIPEARKLLIDWHKTKGNVLLIMRDIKQVMAFLNIDKTRPAYVEDMLGVWLRRKPWFQECSNIQYYSQHASAGLPRASEDFARFIKFVTGLEDSLGTIKKKQHSFFVSLTLPDVRGADQILEQACVGSDVFTTGLEGSAVVKSS

SEQ ID NO: 23678 - protein, 98 aa, A.fumigatus
VSEDQQSLTSVKRLLILNSHSSHQTAEFDAFYKENVIIYLYILPYTSHLLQPLDVGVFGPLKRAYRKLVKGIMVVGNNYIDKEDFLHLYPPAHEKVFN

SEQ ID NO: 23679 - protein, 83 aa, A.fumigatus
CRKRPIGVLSNIGIIPQASCTFLSRIKHSLKAASSDIDNLNYIIQACQVARNADDFTVYAILYAKSADRPCENELGSSIRPRT

SEQ ID NO: 23680 - protein, 69 aa, A.fumigatus
TSSAVPRVSIITSAFALFVSLDQVPIQVLSNGLAYIRMNDVTNSLLTEHFSYTPLVRFRPPRSSCDGQL

SEQ ID NO: 23681 - protein, 148 aa, A.fumigatus
  UNSURE (144): Identity of amino acid sequences at the above locations are unknown.
AMPRASTAPGARLRCRRACDSCKRRKQKCNGEQPCTICIQRRKEAECNFSDKPARLLKANAPKETMLLSEHMVPTPQRQTTMDRLLNALEDHSADLEQQTTDDNDGTAPVPKVPRLLPDGQGKFMYFGRFCKLFFSAKVLLRIXPFGQ

SEQ ID NO: 23682 - protein, 68 aa, A.fumigatus
WKTLPHPTMPGQVGGHEGVGKVVKLGPGAESSGLKIGDRVGVKWISSACGNCRMCHPIFQSFHVVISA

SEQ ID NO: 23683 - protein, 261 aa, A.fumigatus
QTSFAEPCQAGSDGLCFKQKISGYYTPGTFQQYTVGPANYVTPIPDGLASDEAAPMLCAGVTVYAALKRSRVRPGQWVVISGAGGGLGHLAVQLASRGMGLRVVGIDHGSKEELVKASGADHFVDITKFPSDDNGAAIAAHVQSLTDGLGAHAALVCTASNAAYAQALLMLRFNGTLVCVGIPEHTPVPIATATPGIMVAKHYTITGSAVGNRTEAIETLDLAARGVLKAHFRTEKLENLTAVFQEMGEVKLQGRVFLDLS

SEQ ID NO: 23684 - protein, 398 aa, A.fumigatus
  UNSURE (12): Identity of amino acid sequences at the above locations are unknown.
RPARIFDVCVRXPNAGTAVHGSLDYMIVQSDTHGQLLIAQSRLEYLEHMLKEDLTVIIPSIRGSELADQTKYRPLFKSADAEPQPIIAADFVTADSGSGLVHCAPGHGMDDYEACVPRGIPAFAPVDDHGRFTDKAMPSDPTRLSGKSVLGEGTVAVLEYIESQGYLLAKHEYEHKYPYDWRSKLPIIIRATEQWFADVADIRDSAVKALEDVRFVPSSGKQRLENFVQNRSEWCISRQRAWGVPIPALYNRATGDAVLTRDSVSHIMSVIDERGIDAWWTDDMNDPAWIPPTLREESASGYRRGTDTMDVWFDSGTSWTEIDTPPRDGCPADVYLEGTDQHRGWFQSGLLTYISHQLASGQTATPRAPFKNLVTHGFTLDEEARKMSILTAAWRYES

SEQ ID NO: 23685 - protein, 170 aa, A.fumigatus
  UNSURE (67): Identity of amino acid sequences at the above locations are unknown.
GDPVVAPILKHPDFYHIWASTRDPARPGAPEFIARGVEIPRADVDEGREDLTAAFDGAHIIYALTDXWQKQSATAEVEQGKAIADAAAATTTLQHFVWSALPDPVALSGRQFLNVHHWKGKSLVTEYIQKEKPELWAKTTTILFPNYFENCLTSPGRYLPVKVRQPSSLA

SEQ ID NO: 23686 - protein, 125 aa, A.fumigatus
DSLPAWHKRRWNGGVLTLEISTQDEAGTYTLKFPHSPNTVMPNVAIADTGKLVHLVVEAGSAYFTKVIAFWAQALSEAEKLAELGNCMVTPNHTVHISKFDVRPQCPNSLPPVQPLFATDWKIRV

SEQ ID NO: 23687 - protein, 240 aa, A.fumigatus
LARFLPAPVCEDQQQQEQAMAAAQQAIVQNQLERSRSQRQQQSRGPEPKQPTQMGHSQHANDHTTALQSPQKAQPVPAARPRQRARQSNAVDVRARLLAICTPGDPTKLYYNLNKIGQGASGGVYTAYQHGTNNCVAIKQMNLDLQPKKELIINEILVMKDSKHKNIVNFLDSYLHGLDLWVVMEYMEGGNLTTFSPSFFLPMPLPLLPLRKVSPPSVNSPSAATSLVFSLTSSSSLGIR

SEQ ID NO: 23688 - protein, 62 aa, A.fumigatus
FWTLHTLTRAYSKLISPALYAISEISTHTWKSAPFARPWTRCPHKTGIYAEHWLLPTRRMQW

SEQ ID NO: 23689 - protein, 60 aa, A.fumigatus
QPSSIKIINLTNQSRCLAQTTTFCFTNSEDFPLCSHIAKLMTGETKFPLLSHMPSVSDTN

SEQ ID NO: 23690 - protein, 94 aa, A.fumigatus
NTILKSLIAATAPESPSTSPPYRFTVNSTIVQQGLIDKSSAADGAVSNAGKRGMHSASGAFWDVNRDGMWTFKYPGAEERGLDVIVSVAWFALG

SEQ ID NO: 23691 - protein, 83 aa, A.fumigatus
ALGSRGHVYFCAMFKDPELTRIVPICTFKAHKDYLTRVFLSPDVRHLATCSADHTLKVWNLDPDFPPGQDGSDNSSQGQSHWQ

SEQ ID NO: 23692 - protein, 169 aa, A.fumigatus
RSGISILISPPAKMAAITAAKARATGNESPVPEAKEPVATDPVASPTSPKVQDLHVGADLGRSGELNPITYIRGNAPANPEPQQTFPVQPDGPPMDMATGTPFLETTLANHQRWVWDCAFSADSAYLVTVSSDHYARLWELASGQIIRQYSGHHRGAVCVALNDYSEPR

SEQ ID NO: 23693 - protein, 221 aa, A.fumigatus
  UNSURE (201): Identity of amino acid sequences at the above locations are unknown.
ASSYLCIYQNKRIGIKVDALLLGPIPPPAIQCSFDCLNNIMGHSVISPAIFYWGTPVVLATTVNKDGTPNIAPISSAWWLGNRAVLGLGRSSQTIANIIRTRQCVLNLPGDDMVQCVNALARTTGAKDVPASKTQRGYRDEKDKFGIAGLTPESSHLVQPPRIQECPVQMEAEVAGTHELFTDGPIELQGCVMAIEVHILXNYVTEKLRLAAYANTIDPDK

SEQ ID NO: 23694 - protein, 390 aa, A.fumigatus
GMDERRAKFRQDLISEVKPWSMNKRGPRRWQRHLHHFRHDEGPESEKPNGLPSIVVNDDANVENGPRHTPGRTDQEETESVYRSADGSRAGSIRSAHHYRSSSPLKRTKFGLAVPMMNPSTEDLASVKSGNSMLSLQVPETGSRAPSEYDEDDEDEKHQDIQEVWFPGGHADIGGGWKLGEGEEWPLSHAPLVWMVHEAERAGLQFDPRKLKKFECCEEYDGEISPLHEHLHWEQNMDMCQDPSHGEDDDEHMRFARKEDEQNASKSKRRFLEALYESSTKGILHDCLAYGNGLPFTSVLSWRIMEYLPFRRMDLQDDGSWKPIRWPLPLWRGARYSQGCSNPCLGHSPHEGQSRVPTGQPNHWRRRTWCQKSSSRVRHVLHHRAERSTS

SEQ ID NO: 23695 - protein, 376 aa, A.fumigatus
HLRRVSSNLGPQQHHGTPPPPPQNGFAYIPNPSMYHPNANPNIAQQPRPPQFAHYGPQQPLPPHAIPPHPMPQPVPPHHQAPQHLPQHPHPLAQQTPAMGLSQPPHASIPQVAQPFLPEQGRNSIPPAFPTEQSQPPRPVSLPDVSSADQMVGPLKVETSPSPPHQRSLSSKSRSIFTPIDDRGSVLARHFGLGPPTCESPRTESADVKAEAKQNDSKEIKPPAQPVAPPPPPRTTADAARSQSAPDIKPPPRTNSGQLPSKRPQLKVQIPSENSDRGSATADSSSSTGNQTVTPAKANPDTNHSGVVLPPPSPSAGAILSAGATGPPNPFARPPPPGTASQNSNAYNSNNNIETPISALPSRFVSSPRGWKGPLY

SEQ ID NO: 23696 - protein, 181 aa, A.fumigatus
SSSTREFEFGPAATSWNSTAPATKWVRIYSKSLDVSSQCQPQHSPTTAPTPIRTLWTATATTAARNTSTSHASTSPAAPSSPAASPPTSTSACSADTCDGTLATASCVNTTGRAAFLARTREKLDPSCVSDRAVATTSTGIPTRCFLGRSDGWSIKGGNKSLSSAPAIAVIQIAQYLHADR

SEQ ID NO: 23697 - protein, 165 aa, A.fumigatus
  UNSURE (6): Identity of amino acid sequences at the above locations are unknown.
GFFIGXTVRPTTFTHLLGHLISGRYPVQMKAAYPLLSDEAHSVIVDLPNYRWNHPAKYWYKREVSKDGRVRKVPHRDLGSEPSLGASMDTHNGVMARKTEELNQGMQKTPETTVFPGEYGDLLSKTLSSLSSMLQLTEPVDPEELLSSYGLDSLSRIQPRLWLNT

SEQ ID NO: 23698 - protein, 245 aa, A.fumigatus
FHIGVDSKSGQYTAAVKGPYGEWVMTNDSRVIFTQTLEKSMSSPGAGKENVYILAYRRVETQSNSAESNTGLSAAVTSSNPKASITGQSVTSSGHSNAGSSNEPGSRKGSLKGGVQMKGIIELEGRLIQWTINQQLLLDPGKGALVALGPRARTQRATLQLTLTSEDTGEILGGQVTTSLKPWGVQKPKRGPSKTADTKDSSAGTKKAADTVSGKAAKPKGVTKKPSSPPKGTRQSARLRSKAKQ

SEQ ID NO: 23699 - protein, 109 aa, A.fumigatus
ARIILETDGEGQRELGGGVDVAVEHVGNAVAAFVAAEPGLEEGLGFVGPGHGDGRAALDDYHCVGVCVEHAADHLVAAWGEVHVIAVVALCFPFAGETGEDNDLGGLGG

SEQ ID NO: 23700 - protein, 169 aa, A.fumigatus
SYESCSSTPGEDRADLQGRPAIRHRSNLRPRHARRRHLRARRLPLRRRPPRQPGGTHLQSCRASLPGLPSRYLRRSHQRMGNRGLRPRSHGPPPRQRRDDQPRARRKPRHSGSHPERHARHHALGPQSQGPPPGLVRRQRMRQRHCRRALRQRQPRRQAPAVLPRPSPG

SEQ ID NO: 23701 - protein, 245 aa, A.fumigatus
PMRAVPPPLVKTGQTYKVVLQFGTAPTSDLDMRGVVIFGPGGFRFGAARRVSQEELISKAAELASQASQVVIFAGLTSEWETEGYDRDHMDLPPGSDEMISRVLDANPDTVVVIQSGTPVTMPWAHKAKALLQAWFGGNECGNGIADVLYGNVNPAAKLPLSFPVRLQDNPCLPELPLRARPRPLRRGHIRRIPILREGRPGPALPLWPRPLLHDLLPLGSVPRHDPRETPAGRRRAYHGYRLCD

SEQ ID NO: 23702 - protein, 222 aa, A.fumigatus
SSRAARPSPCPGPTKPRPSSRPGSAATNAATALPTCSTATSTPPPSSRCPSPSVSRIIRAYLNFRSERGRVLYGEDIYVGYRYYEKVDLAPLFPFGHGLSYTTFSRSDLSLATTPEKPQLEDGEPITVTVSVTNTGSVAGAEIVQLWVAPPPTGVNRPVRELKGFTKVFLQPGETKKVEIVVEKKLATSWWDEQREKWASEKGTYEVLVTGTGDEVLKSRLQ

SEQ ID NO: 23703 - protein, 89 aa, A.fumigatus
PLVSPFLRVTSLSTGSLHAKIRPPGTFLAIQGVHGILSLFRAAKFDEQIVVVSRLESLPRVRCEQFADIFTFFFFGTNYSPNWKVHSTE

SEQ ID NO: 23704 - protein, 66 aa, A.fumigatus
  UNSURE (49): Identity of amino acid sequences at the above locations are unknown.
KKLYRFESHFTVAVNRINAYSCDANRIWTRAVRGPRLNQTTGTNQCGDXNGKSQPAEQFISGIIRI

SEQ ID NO: 23705 - protein, 66 aa, A.fumigatus
LTNRNTCPVDVVGRSSAVSLARPINDSRQPSPITDGPCGTLSSFYAFDMIRSKYIYQKKILLVYKN

SEQ ID NO: 23706 - protein, 86 aa, A.fumigatus
RCIFIIQSIHSKHTQGRQEENEQTGKETFPMTPLMSNMCDTRSSDTNVPHVDSNPNSARVERISDRRLILLGDGSSLFRTGNIDRC

SEQ ID NO: 23707 - protein, 155 aa, A.fumigatus
  UNSURE (30): Identity of amino acid sequences at the above locations are unknown.
SSAAPSMPGSSAASFTGSFGIAPSGVNSGXSTDWGSNFSAGVSSFSTPATGSVDQFVQMGFEPEFLQQLNDRYGEMHIDEMDGMMFGVEQEHTRNSALVPEGDVYKLAGSTDAAAPLSNVGSAPINIPSPKQTGAVAQQDQASIGDPFYPSAVGV

SEQ ID NO: 23708 - protein, 223 aa, A.fumigatus
KIRSVSHPTQVTIITVVGQAGAFVGANFFGYISTFFGRRLTMMVTCVIGGALVPVYILPRDMSLIAAVFWQQFCVGGVWGPIPIHLMEVNPPALRSLLVGLTYQLGNLASSASATIQSTIGSRYPLPPIEANKKRFDYGKVIGIFLGAVWAYILFFLFWGPEIAAEEREEEAEAAKYLENLRSEGVSLAEIGVVQARKAKGAGMPPRDNDEEKGNEAITEHIE

SEQ ID NO: 23709 - protein, 77 aa, A.fumigatus
HLLYPFFGGLARICEIAQSYEKAYGVKADLQRLGSLDDPYKLMHEKREQNPSDIYSYMSLYVLPWALFSTGLIGVRY

SEQ ID NO: 23710 - protein, 60 aa, A.fumigatus
VSDTDGFDRFFYYYWVNGQTLVGPETDNAKYPEVKPVSWEGFMSQWPLQQLPTAYFALNA

SEQ ID NO: 23711 - protein, 72 aa, A.fumigatus
ELTNRSTDVLEMSIVSADGRHRVINAYSDPEYFWAVRGGGGSAWGVCDLCYIPEPRIYWIGADLFILRLLHR

SEQ ID NO: 23712 - protein, 88 aa, A.fumigatus
PVHPQVVTSVTYKTHPVPQNLTIGFVQLNATDRSSSTRLTSESLKLIPAVTDAGYTGYGSFTQGFQAIFLQPNGTIESFNQTFAPFSN

SEQ ID NO: 23713 - protein, 87 aa, A.fumigatus
TQLPGVTGALAAYSATWNDYLRTLLQDPNIGTNIQDTSRLLTAEVIRDKADDLAELIVDNDQAAGFNFSKEGPVFSSWFHQVNPSLV

SEQ ID NO: 23714 - protein, 191 aa, A.fumigatus
FSRTSLCRCDPLIGQHTPTSNRSNGALRLEMANNFNNGDYYGNTSFRMTPTTSGSQSNTSHAALDCSNADMMMMTFAPFDPLRMGDFSFSESHGSDMLSSGISADELLGSSSSLPAPPVPLADQLPNALFPYDPLSGMENSVPMALDAASAIAYGHSSVYQQSSLMFEQTFNGQPMQQLPSFQNQTMSLVF

SEQ ID NO: 23715 - protein, 61 aa, A.fumigatus
  UNSURE (27): Identity of amino acid sequences at the above locations are unknown.
ATAHIFQSAPEVLGGYLWYIQFSCCAXQGNLFFKSFDGFRYYQGPFLSPTHALLLLVAQGN

SEQ ID NO: 23716 - protein, 119 aa, A.fumigatus
VCRLSLSLFTLWTILTDGHLIEVLSVPKNMKLLAVPLFELYDNTARYGPQLSAIPHLLSRYNFEFVDENDNVVAATPGAPLPEHQIPRTKVLAGETNDGQDAGMTDYTEGGENGGENAQ

SEQ ID NO: 23717 - protein, 95 aa, A.fumigatus
CSLCSRPGDYLHFDDDEVEGFKKRLNERLAPVGSQFSGEGVNEDWEIGDTLAQWWRPNFETFMYPFLPGHVTRPKECKKLYFIQLPKKSKFADCH

SEQ ID NO: 23718 - protein, 199 aa, A.fumigatus
LGRMVALHTELPIIADADTGFGGPLDISRTVRLYEHAGIAGLHIEDQVMAGSRSRCALICIDAQSHQVFPKRCGQLQGKDVVALEVFIEGVRSAVEARQDPDFVIIARTDARQAKRFGGPHAGSEAFHEGIKRLKAAVAAGADMVFMECPRTEDECRTLVKEMGDVPVPINVLPNVSKSGFEDTSRYAGLHHGAGRIRA

SEQ ID NO: 23719 - protein, 121 aa, A.fumigatus
ELCPSIGVVQIKLGDLESQNEDVSTDLTWSTILKWGIITYTSMLIVFISICNCCPSLIEVRLLSLLSHRSSSGPFLAYSHNVGHFRKPTGFDIVALVPYKHHEQTSVLDCYLQVLLDLILF

SEQ ID NO: 23720 - protein, 60 aa, A.fumigatus
LPPLSPLFFYLLFTLISTTSLIYFTSFLFFNRATASFTSSIIIIITIHYYYSPLIIYYYK

SEQ ID NO: 23721 - protein, 98 aa, A.fumigatus
STCALPWGVRIVQHRGKRREEAETRTNDKANYQHYLSITCKDSSLIPLFYLIFFPIWLVANLFYTLATKSTRLFPVLFPSPTITTSTLVTLIGYPPLA

SEQ ID NO: 23722 - protein, 197 aa, A.fumigatus
VLHRKYRCGNFSARLWLRSSIQNGAWKPYWRFAGSSPDINLNNLPLQVCQQIGWNGQPVLTHRTGDGDTSSRVTPVTDARRLRITFNGSVSDVLPWKFTPQQREVCVLPGETALAFYTATNKGPTDIIGVATYSVTPGQVAPYFSKIQCFCFEEQKLNAGESVDMPVFFFIDPDFVKDPAMKGIDTITLSYTFFSKR

SEQ ID NO: 23723 - protein, 181 aa, A.fumigatus
  UNSURE (14),(26): Identity of amino acid sequences at the above locations are unknown.
VDANMFQGSVAKAXTLYVITAYCVPXTIQANANEQPMNPTWVMELPRGDEKGAFFTMDMGGTNFRVCKVTLNGTAGKYDVIQMDNKIPKSLKSGTAEQLWHYVADCLQQFVDRYSISQKELAETPLAFTFSYPVTQTSISHGILQRWTKGFDIKGVEGTDVVAALQKVLKDKVSPTSVLFA

SEQ ID NO: 23724 - protein, 206 aa, A.fumigatus
  UNSURE (119): Identity of amino acid sequences at the above locations are unknown.
NLPARIVALVNDTVGTLMASSYVDPKTEIGSIFGTGSNAAYMEQCSKIPKLADQHLPDDAFMAINCEYGAFDNSQRVLPFTVFDAEIDRASPRPGQQRYEKMVAGFYLGEIFPLILLDXHNRKVIFDGQNSSKLSEPYVLDCLFLATIESDILGTCKPGKILLRKHSSLRLPRLDYAFANTCGTPIPCAGEDIPGRIGGEYKKPGI

SEQ ID NO: 23725 - protein, 313 aa, A.fumigatus
  UNSURE (298),(306),(308),(309): Identity of amino acid sequences at the above locations are unknown.
MMENDTIRLSERPYGSPVRESPSQITPAATPSSSSVLSGSGNRVTAPAQVFIQEKDLCLSDLNSYVAVGVLRKRNEPHDVDADPWADDDKYPGAEIAMLKKGNWVRTCEYTYVKHPQWCYVRVYVLPDDAGHKYVDRSSKTLREALKVVMSKVNRSVDAWDGIFFSDEQVTDGNSNDTGTEDESLWYIFNTLRNPEPQVEAVKDPYARLAMRQLLSEEDAGDTVLDSGVEGLKTPLYPYQRRSAAFMVQREAQPAQMLDPRLQLFKAPNGREYYYDEEEGTIYKEKKLYSEACGGILXETMGCWVXKXXNPNF

SEQ ID NO: 23726 - protein, 63 aa, A.fumigatus
GSLRFLRTPTATYEFRSDKHKSFSWMNTCAGAVTLFPEPDNTDEDEGVAAGVICDGDSRTGDP

SEQ ID NO: 23727 - protein, 197 aa, A.fumigatus
SVDAAFVRPIYAGNAILTVQSTDPIKVITVRGTAFQGTETEGGSAEVVEGADPKAPAQTEWVSEELAKSERPDLATASRVVSGGRGLKSKEEFDRIMVPLADALGAAIGASRAAVDSGFADNSLQVGQTGKNVAPQLYLCAGISGAIQHLAGMKDSKVIAAINKDPDAPIFQVADVGLVGDLFEKVPELTEKLKSQA

SEQ ID NO: 23728 - protein, 145 aa, A.fumigatus
  UNSURE (8),(9),(10),(11),(13),(16): Identity of amino acid sequences at the above locations are unknown.
GEEGRYLXXXXLXMEXLSVPSSPVVKTSDLYAFLQVLMLIEIQGLPENYAPLLVENIKKGEYTHVVAGHSAFGKSLLPRVAALLDVQQISDITAIESEDSMWPPDRVSLDYVMSHSHINPLMQLLSAQSTLEMPSSPFNRPIPSR

SEQ ID NO: 23729 - protein, 215 aa, A.fumigatus
KIIKGTSAMRSLYLRLALQLLGKLWDFLEKIANKAYISNLEDRSIRILVDSSNDLAVLHTSKVLDGTRNTSTQVELRRNVLACLANLKTVVGKSTVNRSAGSTNCSSQGVSKRHHDAVELLFRFQATTTRHDARGSSQIRALRLGELFRYPLGLSGSLGVSSLDDLSRAALGLSTLECSASDCDHLDGIGRLNGEDGISSVDWADKSCINGLICE

SEQ ID NO: 23730 - protein, 86 aa, A.fumigatus
  UNSURE (9),(34): Identity of amino acid sequences at the above locations are unknown.
WSRKPKAPXPYPSIYISIQRIATCIHACMLLVDXSTIYTIEAAAKMGASPLIFILATVIIAMGEDEEGEEGPMSVSQGEGETFVTQ

SEQ ID NO: 23731 - protein, 378 aa, A.fumigatus
  UNSURE (4): Identity of amino acid sequences at the above locations are unknown.
SISXAYEIQAFFKALNLAVMLFSTQWAQGKRGWDELHGASRCENFMDHKGEELGDEFEQALRQSIWEQAKRTLQDVSDLECFRVVFAELIFGLVQKPYSRNEYDPDATIGLATRNLCKSGTNSISPTIADIFAREGPPIFMERGARKMHALKYRFEAYQAGFRQGARSFESEPNAGAPQEMSAEDGQTIGLLYWLAVMFDTVSSSINERPVVVPDEECQHDGAQRAAKDPLELPVTNVRWKLDLYAQDDTERPSLLHWPCTYDVATRAVARSAAVKVLLFRHITYLQNGLRNCENGPAIEEIIKATLSVYRYWDVTHGAFFRDLIMNYESVPPRIRSWFPCISIPWHLGSLMLANLIDYVDENRLGCDSYRAKRLHVG

SEQ ID NO: 23732 - protein, 91 aa, A.fumigatus
SYQSKKGKMENKLCSQLAGRESPAPESQSAEQQIPFCWGRIPRSSQQRTEIQIQQTSDNIKPFQLESNPIHPLEGPEMAKYAGDKVRRLSY

SEQ ID NO: 23733 - protein, 167 aa, A.fumigatus
KPQHQRYVCIGTVYGLTLLIVQASTEAEPFEERWRATQLQSGSSMVSAAITCLPPRYVADFLVQIFFKYAQTNNFYVEEDWLLEKMHTCYTNPSSLSSDDAGSVCSILMVLAVGTQFAHMESATPVNRLSADSSINYDHNFSEDEVGLTFYQFASKLLPDIIATASV

SEQ ID NO: 23734 - protein, 108 aa, A.fumigatus
HRYRAAEVRPMCKYPQGVVLANLEPATPVGVAILASAPRQGPPGKPAPAPAASVPPVGTMVFILLLLSAPSTSSAGAAPPPANLPTRHRRGRGKKPKDQKADKGEGDK

SEQ ID NO: 23735 - protein, 68 aa, A.fumigatus
YWNVKCEYFCPLSASFGMPLPCCNKAQEDIATQSQYSRTAINVKIRRRKRECGVCSAKAGLGSWTCVP

SEQ ID NO: 23736 - protein, 154 aa, A.fumigatus
RAAIMQSGSVVERTSSRRFPAQELYDSLVASTRCAEAEDSLNCLRYIPYDEINNAFEKSPYGIGRMAEAFGGPSIDGNFLPNYGSLSLKDSRMVKVPVISGVVSHEGSNQIPGSVRDWADLRDYLISIKHSLVLKLCLVTDCCVRSHLISNNCG

SEQ ID NO: 23737 - protein, 220 aa, A.fumigatus
RHTLTSRFPDILWEGCASGGGRFDPGVLQYFPQIWTSDDTDAVERIFIQMGTSLVYPASAMGAHISAVPNHQTGRTVPLTFRAHVAMMGGSFGLELDPLKMCPEEKAVVPELIALAEKVNPIVLKGEMWRLSLPEESNWPAVLFVSEDGVKAILFLFQLSPTVNHTIPRVRLQGLDRQAMYSVDEQGPYSGDMLMNLGLQYSFSTDYASKVVFLERVDVM

SEQ ID NO: 23738 - protein, 97 aa, A.fumigatus
CYGLTQTQSTTGLIMSAFSKLPSGASIALKPFRVSIPEEELDEFQALLKLSKIAPPTFENSRPSGQYGITSDWLTTLRKQWQKDFDWYTILVLCERL

SEQ ID NO: 23739 - protein, 277 aa, A.fumigatus
  UNSURE (57),(272),(273),(274): Identity of amino acid sequences at the above locations are unknown.
VSGFHPSRIHETPKVIFPAVIPCPERRMVIQLGRRLRKGPEGRERHDLARKGGSDDXDGIFMGPCVGQTGSALRFGIPNLCLQDSPLGVRNSDHNTAFPAGITVGATFDKDLMYARGVELGKEFRGKGINVLLGPSVGPIGRKPRGGRNWEGFGADPSLQAIGGAQTIKGIQSQGVIATIKHYIGNEQEMYRMSNVGQRAYSSNIDDRTLHEVYLWPFAEGIRAGVGAVMTAYNEVSASTLCPSVKPSDELARQVNSSACSQYSKLLRDVPXXXIRN

SEQ ID NO: 23740 - protein, 226 aa, A.fumigatus
GRDPSLPGVRTSELQQFGLKMYVWHIALLLALWLISFHSYNANVKELQDTPGSEYFAFLSRKAHEGALNQAKIDVAEARMRGEIGEAEKKGRAKQEISKIDADTAVLETKRKAEKAKADSELMNRQTELDNSVRLAKISAQRQAEMRDAELQKQVESKRAETELERLRAVEVTKSKVARESSQEKADASFYTEQNAADAQLYKRKMEADATCTSLNLCFLSFFHLR

SEQ ID NO: 23741 - protein, 89 aa, A.fumigatus
PTKEAPVDTSATPTTFVTATKPATTAAPAAPSPSSGSNSGSDSCNSGSASGSVKIYGQCGGQNYSGPTSCEAGLICKEWNPYYHQCVSA

SEQ ID NO: 23742 - protein, 361 aa, A.fumigatus
ATNITRPTNNSTKLVSTRATKCRTIQVESGDSCASLATECGITPAQFTQYNPSSSLCSSLTPGKHVCCTAGTLPDFTPQPGADGYCYSYLVKTGDSCASLAAAYDLTNEEIESFNKETWGWNGCEKLFADYNICLSTGYPPMPAPIANAVCGPQVNDTAKAPPGTDLSTLNQCPLNACCNIWGQCGTTGDFCTPSNSSTGAPGTAAPGQNGCISNCGMDIITSSAPAETYSIAYFEAFSWKRSCLRMSVTSIDTSAYTHIHYSFITLNEDLSINIDEVADQLPLFKGMVGIKKIVSVAGWAFSTEPATYQIFRNAVATQANRKTLVSNIIRFLDDYSLDGVDWDWEYPADRLQQTRGSQIR

SEQ ID NO: 23743 - protein, 62 aa, A.fumigatus
LVLFHLPDTWQIYEWFDGSSAAHVPPGFCSLVPGASTSLEGFLSTAYPAAYGASCCIGGAYA

SEQ ID NO: 23744 - protein, 161 aa, A.fumigatus
GLGPLFKFGDVDLECDGRGITGGPDRGRGRKTETETGTRKSSQTRTSSSSSSSSSSSSGLSAGAAAGIGVGAGAGVILVGALVWVLFRRRRRHRAASHQPQSVYSPAGLGGQAYAPPMQQEAPYAAGYAVERNPSKLVEAPGTSEQKPGGTWAAELPSNHS

SEQ ID NO: 23745 - protein, 98 aa, A.fumigatus
SGGLYPSQKCWWIIIKVSSSDATDTKSSVSAEYFHCTDAAVKLHSSAVILLFIGGFLDLQSLYCISTCHTSKAGTELIFYALLGDVRHFFSYWCSLMP

SEQ ID NO: 23746 - protein, 101 aa, A.fumigatus
DSSLALLPPSSYASTTLRTTWSSSCTASRNFSGVPLLLAFGLSYSLIILIQSLPTCIVRFVLLDGSIMSYDVCHASVVKTTYMTDSLLPEASTLIPLFNLQ

SEQ ID NO: 23747 - protein, 212 aa, A.fumigatus
HNSFQPASVDADASRAGRSGDLDLEHSQSKRLRPSKPDVKYLPENYDQADPRDLVILISSMLMELIRFNDKIPLNNGRLTRFHSRSPPRISVQDYLQRLTTHATLSPPILLSMVYYIDRLCALYPAFTVSSLTIHRFLIASATVASKGLSDSFWTNKTYARVGGISMAELALLELEFLFRVEWRIVPQPEVLVDYYQSLVERCDGYEIQRER

SEQ ID NO: 23748 - protein, 92 aa, A.fumigatus
GGNGVDLLCITGRCATFLLILVQSNALGLFFGLVTTFFLCFYDLADYLVILLYSFTQFFGRSIVTSVWIIILPDHLDSISSYVYSQIRSFRW

SEQ ID NO: 23749 - protein, 62 aa, A.fumigatus
  UNSURE (40): Identity of amino acid sequences at the above locations are unknown.
TDRLTSGHLFSLSGIIFRYMSMANFGKQDNSGILRTVLRXRETTSVFSKSLTSLFLLMIPRL

SEQ ID NO: 23750 - protein, 127 aa, A.fumigatus
LPLPSAVLRPCGKDHAMINSQAHQLKDLAEERTHHATGLVKQYVGDYSAKAQEYIGHRRSTSPEATKAAGPVVKKEPSAEAIVKQEPIPEPVIKTTDFPEAPKQEPVAEPIEHNRQPLETREPLLAA

SEQ ID NO: 23751 - protein, 99 aa, A.fumigatus
YPQETPKSPLNGSEGFFEPDKVSMFGRPFSLDDAHTQFFRYGKWGYNTIRYVLTWEAIEHEGPGKYDDEWISFTIEVLRIAKQYGFYVFLDPHQDVVCF

SEQ ID NO: 23752 - protein, 315 aa, A.fumigatus
SASGCCMFLMKPTPRKERCVADNLKWSRLSGGSGAPAWTLYAAGFDPRGFKKTEAALVQNTFDDPAEFPKMIWSTNYTRLVSQTMFTLFYGGRDFAPKAIIDGINIQDYLQGHFIAACRYFAQKIHEAGDIENEVVIGWESMNEPNRGLIGVQDISVIPPEQQLQLGTSPTAFQGMLTGSGRACEESTWAFGGFGPYQTGRELVDPEGETAWLPADYDDTRYGWVRDPGWKLGECLWAQHGVWDPSSDKLLRKDYFAKNPQTGEPLNYDKFTNPYFMEHYRAYRDALRSVWPEAIIFCPPPVSSPRGWKDPRWRK

SEQ ID NO: 23753 - protein, 135 aa, A.fumigatus
ERIKSSLSFLCSCVPVFLHSCIPAFLPAIQQSKAAVALLLSLPPSRSHPCRSFPSPPNLHTMAPLKLNSRNLSQIAAAGGALVKIPTYQRGRAVKEGIVHIGVGGFHRAHLAVYIDQLSTKHEGLRPADAKQAPR

SEQ ID NO: 23754 - protein, 190 aa, A.fumigatus
LFNSTGAKCLPASQVSKARGLVLHDWHAEVLALRSFNYWLLSECHSLLAQEQHARSSSTNTPGAASSPFIRRRKSAERPSTAQSEPAPAWPPFELQPDIKIYMYCTCAPCGDASMELCMAAQDDPRPWDVAPGPERTESPGPGPELLDGRGYFSRLGIVRRKPARAEPEPTLSNSCSEQLALRHVSSPLS

SEQ ID NO: 23755 - protein, 88 aa, A.fumigatus
ASLGVSEGTPYNLVPSTKEVANAVRTRVYCTTIYWQKINILENNVQVLQKRIFHCTTYRLSNVERSIHNYSFVWHKSCSHPINAYDCS

SEQ ID NO: 23756 - protein, 264 aa, A.fumigatus
FLEQSTVFDDLAHQIVHQTTLSLHQASAQISSKSTADGKLFLMSHLLILKQQIVAFDIEYVAPEVSFDFSGITNTFWELRERGGLFNPRNLMRLVGHGLLPRVVENMLDAKVELDGRLRTVINDFINEFATKMTASLPAKFIDRRNLQQGELIYPTCQNIEKEVPNLRKILGDYLDDPRMKETLVGAVQDRVIQIYEDFFDRYTSSERSKGHSVSKKGKGREDAVWDVGSFAEWCENIFRVGIPEQDDEGLPSGSLSRSGSPGS

SEQ ID NO: 23757 - protein, 155 aa, A.fumigatus
NIPATPKESKPVWTLQAHDTSVSSFDINPAIPGFLVTGSTDKQVKLWNVENGRPSMVVSRKMDVGKVFSTTFAPDNEVGFRLAVAGSKGTVQIWDTSTNGAVRRAFVSRMPALEGEVKERTIGVQADDDESDDDAAGEEIGAQQGGDGWESMDED

SEQ ID NO: 23758 - protein, 82 aa, A.fumigatus
NKTFRFAYKDSCWSRCLNLRFIAEYAVIAYDSEGTVSLAATSPASILKLPVVNLLHVKIVELSVDSSMSQSNTTGHATQLSP

SEQ ID NO: 23759 - protein, 201 aa, A.fumigatus
ILCRKEINYVKMSQKEREQLTAEFNILSSLRHPNIVAYYHREHLKASQDLYLYMEYCGGGDLSMVIKNLKKTNKYAEEEFVWRILSQLVTALYRCHYGADPVEVGSNILGPAPKPSGLKGKQAQMTILHRDLKPENIFLGSDNTVKLGDFGLSKLMHSHDFASTYVGTPFYMSPEICAAEKYTLRSDIWAVGCIMYVFTTG

SEQ ID NO: 23760 - protein, 86 aa, A.fumigatus
NLISNKTHTGCGSFGIIRKVKRKSDGFVRTRFKFVTLVLGLINKLDTVSQRNQLRQNVAEGARTAHCRIQHPELPPTPEHRRLLPS

SEQ ID NO: 23761 - protein, 107 aa, A.fumigatus
TTSFLFLISILFQLLYARHHKREKRFGPSPANGYTYGTGTQRRGFWRRNKRTPETASADDMLPGHPTPHDVEMGDSAEKPGAFGGRFSRNNNAVANGYGGSAYTGNY

SEQ ID NO: 23762 - protein, 118 aa, A.fumigatus
PISPHKCEYQPPVFSIPRVESGNKPQIESQAKPQFGYKREPESPPKPKPKNNPVPEHAPEPKPSETAHAQGFSKTCEHGEILCGADGQTWAKCDWGKPVQMGPVAAGTRCSHGVIERT

SEQ ID NO: 23763 - protein, 78 aa, A.fumigatus
IKAQTVKASALNSRQTSLSPILPIYLLAISYNSSLSACPSITEKGRPPGIIEQYPRPLDDIFHVPVPGLDQTSSIGAI

SEQ ID NO: 23764 - protein, 66 aa, A.fumigatus
SVLLLLGPNLVYNHTPEIQFDNNSSHFDRAIWRKCRTATIRSRLPLLNAWTLDFGPCNTATRKGLS

SEQ ID NO: 23765 - protein, 63 aa, A.fumigatus
YLSEYAIYDCRGIYVLKLSDVMATQAYSDFIVGQALHGKATFLRGEWEIAYIDRYKARQSLSD

SEQ ID NO: 23766 - protein, 64 aa, A.fumigatus
  UNSURE (34): Identity of amino acid sequences at the above locations are unknown.
CGLSGRARYIFITMHPPRLDFSGAPDNDPTLLMXDQSLFGSVRPGDWIHQACLRFYVDLMISVA

SEQ ID NO: 23767 - protein, 65 aa, A.fumigatus
HGPEEATDPVTRTLHNPSQSYADHTKESGSSVAEKIAEAMQPGSYLLSRGEALPDGALILVSCRR

SEQ ID NO: 23768 - protein, 203 aa, A.fumigatus
  UNSURE (20),(22),(41),(71): Identity of amino acid sequences at the above locations are unknown.
VPLFAPVWTLTTLYTFLLQXYXPGDPPPPKIDNILDIIKMXTQHRILALVYNEFEALDLFGPLGAIVPRSXYYTLALVSLHNLDSPHGVETSMKNGIGVIPTLSLAEALREDQQFDTLFIPGGFGMMPLVWDPILLQRIGQLVDRAPNVFSVCTGSILLAATGRLDGRKATTNKRLYDELTPKRIIPPSCFQISRAHANIFFF

SEQ ID NO: 23769 - protein, 60 aa, A.fumigatus
PHSATADPSSPVVKTKEYELDLSFAQGYTSKCTLSTILAAWSVTDTTELNPSGYSRLLYT

SEQ ID NO: 23770 - protein, 76 aa, A.fumigatus
  UNSURE (67): Identity of amino acid sequences at the above locations are unknown.
SRRLVSRFPEHMLTFFFFNRLDPGVQWQKRARWVQDGKFLTSSGVTAGIDAGFAFLASTYVAPEDRXGAFPKTPPG

SEQ ID NO: 23771 - protein, 88 aa, A.fumigatus
  UNSURE (6),(36),(55),(57): Identity of amino acid sequences at the above locations are unknown.
RQRVVXAAGDDGAQWAEKIEGFELVVHKSKDAVLSXHFDYVQYIVYFGGGGVSWXVXLEEEGIQRGESPDRGKQWHLSHVRCRCLGAP

SEQ ID NO: 23772 - protein, 153 aa, A.fumigatus
TGSRLLMLLSGIAPKKEKKHGQAIQPTADCALASASSQPGLLHNIELQETPFMQVLFILLLLLSIYRSCLSSRDGKPIASSLNRRRQCWECRRRRLVCDFSLPGCRKCYTAGVECPGYDEKKPLKWVTTCEVDIPASEEDCSAEYCQAVCVRR

SEQ ID NO: 23773 - protein, 206 aa, A.fumigatus
RIGIFQPLAKTTSSGLPSSPVNVLPFNLSITSSGNPSNISVRTAPGATTFTLTGARSTANPRPSPLIAFPSIAPTLYPGGGRIATAPLVNVSEDRADCTMYVGTCFASIRPPRSRTVVRARMYAGSRAGSVGGRIWRASPAVKTIWSRRTFSLLPGVSALLGERLVGKRSGCVALSSKVKMFDSKVDSSPRSTVVPAILVVNCSSG

SEQ ID NO: 23774 - protein, 300 aa, A.fumigatus
YQTDLSDSLSVQDSPISSYINSPSTYKGISTMTTQTPHLVSINKLTGTRVLVIGGTSGLGFAVARAALEHGASVLVASSRPEKVQSAVSRLRTLYPDEQFTTRIAGTTVDLGDESTLESNILTLLDKATQPDLFPTNLSPNNADTPGKSEKVLLDHIVFTAGDALQIRPPTDPALDPAYIRALTTVRLLGGLMLAKHVPTYMVQSARSSLTLTSGAVAMRPPPGYSVGAMLGNAINGLGRGLAVDLAPVRVNVVAPGAVRTEMFDGLPEEVIERLKGRTLTGELGRPEDVVFAKGWKIPI

SEQ ID NO: 23775 - protein, 64 aa, A.fumigatus
GVVIVNTARGALIDEKALVAALDSGKVSSILAYFLELWVVTECDRSCRLVWMCMRTSRRSNLDL

SEQ ID NO: 23776 - protein, 76 aa, A.fumigatus
IIPTPSFPLCYMRRGGIRNWTWFSLMLGLCLHQVRYAAQDIPAAKSARARGSYLRVSFKNTRETAQAINGMKLQRA

SEQ ID NO: 23777 - protein, 85 aa, A.fumigatus
VMGSNGMRQVMSAGLDVYENEPEIEPGLVNNPRVMLLPHIGTATYETQKEMELLVLNNLRSAVEKGEMITLVPEQKDIFKGQNGK

SEQ ID NO: 23778 - protein, 320 aa, A.fumigatus
  UNSURE (314): Identity of amino acid sequences at the above locations are unknown.
SNRRGHGTYSNPLSTSIIATVAGTVQKTNKLLSVQPLRARYIPEIGDLVVGRIVEVQSRRWKVDIAAPLLAQLPLSAINLPGGILRRRTSADELQIRTFFSEGDLVVAEVQSVHSDGSASLHTRSLKYGKLRNGVFLAVAGTGGSGASSSTVKGGPGAGTASAGLLGTSGTGGVVRARRQQWTVNTANGGGEVNIILGVNGYIWIAKHADGAAAASSTTENVSITRMEEMVSSSIYSSQNDEIPPQTRREIARLAQCIRVLVQGGVRVDEETVMRAYDASLQVDLEVGDDEDEDERRREGREYLEGAKASGILXLATVAR

SEQ ID NO: 23779 - protein, 246 aa, A.fumigatus
SCASALAKNPDRFDVTLFDIAPCTGGQATSISLDESRYGADWLNDGVQGGSPIFRHTFHFFRRYGYEPRPVKLQVAFGKGVENFFTNVFPSPLVDQLSGEIKKLGRVLKWIKRLFPILGLLPIKVIMKLFRFSEEFTNKMVIPIMALFLGTGNQTPNVSAALLERLFCDPNMRLWEYDPDTLLPNQPTMYTFPKLGDFYRDWAGDLASRGVDIRLNTAVEILQRNNHSITLRPVFSHGARRSALAL

SEQ ID NO: 23780 - protein, 158 aa, A.fumigatus
DLSRVRISTPTSPRHISIIILSSRYNWLLKALSSPLRTTYSDTNPYQLLELFDSEDPRERDFLKTTLHRIYGKFLNLRSYIRRSINNVFFQFTYETERFNGIAELLEILGSIINGFALPLKEEHKLFLTRVLLPLHKVKSLSMCLHHGAGRIRSVRHN

SEQ ID NO: 23781 - protein, 133 aa, A.fumigatus
  UNSURE (39): Identity of amino acid sequences at the above locations are unknown.
RQELFMQKIDQCNIIFDFNDPTADMKSKEIKRLALHELXDYVANNRSVITEPMYPRVVEMFAKNLFRPIPPPVTPQGEAFDPEEDEPVLEVAWPHIQVVYEFFLRFIESQDFNTNIAKAYIDHHFVLQVQLAP

SEQ ID NO: 23782 - protein, 247 aa, A.fumigatus
CGQILPFLTPFLMRCNLSAPPSKDTTKKTDANGQAGANTNIPPPKTDKPRPHVCTTCGRSFARLEHLKRHERSHTKEKPFECPDCSRCFARRDLLLRHQQKLHMTTTPSSRPRNARRESTGAAGTGANRVRKNSIASNSNSIRPRANTISHIDGASLGIATNDPNHSVPATGHPGHAHHTSMSSMSMGANIDFHRGYSSSHPYSSSLPKLETHGLPMDLSGGLRTAPVYGNFDLTMGDFFMNPWDYD

SEQ ID NO: 23783 - protein, 95 aa, A.fumigatus
  UNSURE (30),(36),(39),(42),(46): Identity of amino acid sequences at the above locations are unknown.
LAVIPPPVMPPLRYNPPTDSMLGRKTPAFXLDETAXIPXMPXPRSXAPNSGIDEVVPPSAMSTWQAKLGITQGPEWIGTNRVFKLCFPAGINPFP

SEQ ID NO: 23784 - protein, 319 aa, A.fumigatus
RGSFGPCGEVWIPRGETKSLQLYHHIIWLSREGLLILEEFVLPMVEPFVELKILAYKLRASFYHIFVLFHNEPPVHAPGIMSLRSQSSATNNAAEAESTPKDQGSRFSFTSKPEVIPRPQDAASNPDDAARRRATQAPPGLAPVQPPKPASSFLLPSIDYTPTATACFNHAALLAERFLPGSHPLRLSIKLEYAAYLYDCLHDPNACRRLAKQAIADVYNAQEGMDDESFEDAAEIVRILGKMVKRSGKNSSTGPSSTSAGTPKGDISMSEGSLTPKVRKSVSQATTMTSVSPAPVNKSPVKSDAPSTALPNPSMTNPI

SEQ ID NO: 23785 - protein, 108 aa, A.fumigatus
SGGAVFPALWRLFIISAKPGSATDDRAADMTSATTGPFTYDAYGVLRHIGSTMGSGHYISLVRDAQRQCWRKFDDERATDFNPRDLRFKDRLQNEQAYIVFYERVPAK

SEQ ID NO: 23786 - protein, 64 aa, A.fumigatus
  UNSURE (64): Identity of amino acid sequences at the above locations are unknown.
APHVGRYISYSIPTLSTWGAAASCKNLCRALSDSFNFPDILMTELSLIASQALEIDHCHLRGAX

SEQ ID NO: 23787 - protein, 214 aa, A.fumigatus
  UNSURE (5): Identity of amino acid sequences at the above locations are unknown.
KLFVXCSTVHPDTSRRTHAALTPRGASFIACPVFGAPVFADAGQLVVVPAGDAAAIDRIRPFFEGVTARATIDMSGHDVGRASTLKILGNTLILNTVESIAEGLVAAEKFGLGADVYQQWVHGLVGGMFAKYADRMCTGDYYKREEPLFAVDLARKDLRHAASLAEAAGMRLRSVEITDAYLQEVKAEKGEKGDIAGVYGAIRKESGLPFENQQ

SEQ ID NO: 23788 - protein, 83 aa, A.fumigatus
FPGGERITFHPAAEDTATGSITPTATNNASGSTGSGGNTGNSQPENTNNGSNAQPNNNAAAGSAVSKAASVAAVVGLIGLAWL

SEQ ID NO: 23789 - protein, 206 aa, A.fumigatus
YYFGQLSLSSIPNLNTIVCGLLFSSNPLVQRIVQPSLPMSTLNMLPEQSAFGRSAMPGSDAVNPGPSPFAPPPNSFSGDFLGLSLPDEEHLWGMSPLSSSMPSWNGKNEQMFSNPNLERDLKHSHVRNGQPTPPPYGDNKTHTVGDLYSLSQCQFSNGAQNFQTHNDRRSFCEQSAINSNGGSSKRRKVRDAKMTQAEYNEQQQEK

SEQ ID NO: 23790 - protein, 124 aa, A.fumigatus
RPPAPGLLEVHFTRSEHKNHDNNALTSTTTTTKFFFSNTNSLTSSLYTFKMSLFHTFHTPGDFAPLFRLLDDYDFHRSTRNQASSVRSFAPRFDVRETNDAYLLDGELPRRLQPTGVEGQRLRT

SEQ ID NO: 23791 - protein, 193 aa, A.fumigatus
RGTDISAGDRVALECGVPCSKPTCSFCRTGKYHACPDVVFFSTPPHHGTLRRYHAHPEAWLHKIPDNISFEEGSLLEPLSVALAGINRSGLRLADPLVICGAGPIGLITLLAASAAGAEPIVITDIDENRLSKAKELVPRVHPVHVQKQESPQHLGARIVRELGQEAKLVLECTGVESSVHAGIYVGRLGPET

SEQ ID NO: 23792 - protein, 99 aa, A.fumigatus
AHSKACLIKIIDILLCNPILYDSDLYMVKPLPNYFRVFAFRSSIIIALIVACFQFITTSNELQSLIYTNYLNRPCTIHSKKNISYFLYIGRSGRCSILI

SEQ ID NO: 23793 - protein, 62 aa, A.fumigatus
NQQRLHNLTSLRVGFSFNLLRLFIGPEMLRINSFSCPVFINRTANSWEIKVLPFPPPRSPKI

SEQ ID NO: 23794 - protein, 102 aa, A.fumigatus
VIRREARYYLLSAMANQLRYPNSHTYFFSFAILRLFGVDNSEQDGSDIRQQIIRVLLERLIVHRPHPWGLIITLQELLQNRSYTFFHLPFIQAAPEVCHSSV

SEQ ID NO: 23795 - protein, 200 aa, A.fumigatus
SIFGFQVSISPQLCKETPFTDRTLDRTTPIGKLISSYLQGQSQADDHSIHLLFSANRWEIAKSIEDDIANGISVIVDRYSYSGAVYSAAKGNPNLSLEWAWQPEIGLPQPDMCLFLRISPEEAAKRGGFGVERYENETMQNRVRELFQTLFDLQQGDYIHTIDAGRSFDAVSQDIMKIVTDYIGRLDAMGPLKRLGALSN

SEQ ID NO: 23796 - protein, 103 aa, A.fumigatus
LIFHSMAIFTSPKSLQNVNALVPRQFMTQMPSGLMNAGMLQDGGHPSHPSFFHLVLLVFEAVLEVVCVSLPGYIVAKQGMFDAEAQKLVANLNVMLFTPCLSM

SEQ ID NO: 23797 - protein, 97 aa, A.fumigatus
  UNSURE (64),(88): Identity of amino acid sequences at the above locations are unknown.
YGAVFIKLGSQLTAEKITDLAIIPFIFIVQTFVSYSCAWAISRCFRFKKRQANFVAAMAVRIPXILHHIPYLIFSINRSSVTQTLYLXPLSCRSRRP

SEQ ID NO: 23798 - protein, 115 aa, A.fumigatus
ETQVYALELRTSGIRAWFFPRGSIPNDILDNIPDPTTWGTALADFPNTNCDIASHFSNQSIIANIDLCGQLGAQPQFYTHLYNCPGTCSSFVARNPANLTEAYWEFKSFKVYQAQ

SEQ ID NO: 23799 - protein, 264 aa, A.fumigatus
SVDIHCRRRYRLLPTKVPNPSLPPPDPSLWIVHYSRAPPTEHIPANRIPVSPQVQNMLAQRRFLQNQGQLARKDFMLHDRNNWPTINFPPQIAPQALAQPAGPYPNAMVGRQPFYPQPGQPAPPPAAAAPAKAPRGHRASTAAMTAAAADFALEDEDVSTGDLMDLLTPREVSKMRYQQHHEWMEEIFASPYAISQITPVSLGLGRKGELETLTAGFFDAPVGPASGDSKESTDSAQATKMEPERAKEFADRVAKKVGRHDCRN

SEQ ID NO: 23800 - protein, 165 aa, A.fumigatus
SAVPSSPWLMIDEGMEDIAADDGGLDPLLEEMEAALRGDNEAQPQGAPSSDTGLANLYQAGTPMATKPSTPAADTSGDESDSDADEEADVPENELDDEQLEQQRQFQQHREEIAELEALIRAETVKWENMQNQILKHKLAKRIQDLKRDLSLKKVSVGEGDDADT

SEQ ID NO: 23801 - protein, 194 aa, A.fumigatus
YPIACYVQLAMTYPHAYLLKHNFQLQFIPAYLFQATGSPVPARTAPFTSRFSSSFSFRCLSASLSAASPRGSSGLWSTRSPRIRSCSSLFRSMSAARSLSSPNPGCPGPCALPTGPACAPACARSLFCLTARAMSPSAGCSSTPYSKSTSEAACRFFCSCSRLCFSLASSSSLDGLESTVRRVMEETGSPRWRW

SEQ ID NO: 23802 - protein, 95 aa, A.fumigatus
  UNSURE (21),(50): Identity of amino acid sequences at the above locations are unknown.
WDCPPFIFKLVVPSRSPNRRXIFINKTAEIRRGTRKWGIHAKQEELEIDXPELLVTNFSRPLRLVVHEPLIVAVTVYLGFIYGLLYCFLTAYGFV

SEQ ID NO: 23803 - protein, 114 aa, A.fumigatus
QGVYHMNAGVGGLPLFGMVVGLFIGGAYICLFASRAYNQKLQANAGVPVPEWRLPPVIVGGALFAAGIFWFGWTGFTADVPWIASTLSGLFTGFGLLIVFIQLFNYLIDTYLML

SEQ ID NO: 23804 - protein, 109 aa, A.fumigatus
PFFFSNEFSAASAIAANTFCRSVLAASFPLFSRQMFNNMGIQWAATLLGCVATALVPIPVIFYLYGKRLRMRSRFAPILELDEAAHVPREMTENKGEEEANTQTEESQS

SEQ ID NO: 23805 - protein, 67 aa, A.fumigatus
TVLRHTSDVAVVVCLSLGIAMAIHLFMRAWNQNSIGIYTPQHFFSSKQGILGRLNLLSSLNNLPELA

SEQ ID NO: 23806 - protein, 186 aa, A.fumigatus
RFELSGTRDSLRGSAEERLQEGCTQIPSRYVIVNDICDGRIWSLTGRFIDKNANNPEAAEKFKEMSRAYEILSDPQKRQIYDQYGEEGLEGGAGGPGMGAEDLFAQFFGGGGAFGGMFGGGMRDQGPKKARTIHHVHKVSLEDIYRGKVSKLALQKSVICPGCDGRGGKEGAVSLHRPGLEGNAYG

SEQ ID NO: 23807 - protein, 69 aa, A.fumigatus
VEPNCFWGVSRRMASARVIISGQCLAHFIMGSAFIAYGIMLTILLLVGQYWLRRTGRSQEFFDSLVIAA

SEQ ID NO: 23808 - protein, 137 aa, A.fumigatus
GCVNTFTEHRWGGPWVHNDLQHTTMGIVWWCAGLLGIWMSRKRNGRPKRNLIPAIVILLTGYAMSAHPQTLMISTMVHTIFGYTLMAAGFTRIVEIAFVLKDKNTVSLDGSDPSSFQYLPPFVSSSCICLLEPGDRA

SEQ ID NO: 23809 - protein, 111 aa, A.fumigatus
AAGSYSNLNVVVNILLHIYAVHAWPNSAKPSAHSRSSSTTDPVQDSTYINGHARSASETQQVHDAEAFELQGLISDEEDEDVPGNRNHSMGPRKAEDEESTPLVGKEASSA

SEQ ID NO: 23810 - protein, 82 aa, A.fumigatus
VLNPPKDPYFIFSKLENNLSRSDDYDVIEILGSCWEWRCWIWCLAFRYFLTLSAVCYALYIYQKDGMTLQEFFTTGLEGHAL

SEQ ID NO: 23811 - protein, 76 aa, A.fumigatus
TRRSGVVWADKSFSQLLYASGFLFMGATEEQMQLLHDAGITHVSYVLILYSIAFILFLCKWIVFLLCPLLGCWFLF

SEQ ID NO: 23812 - protein, 134 aa, A.fumigatus
SFGPSGEDSQSSLFQVYLRLRPPVSQHQDPYAERCLVIESPEEKTNNAESDGAPSAPIPTHIILQPPNDARKRAVEKFGFTKVFDESASQLTVFEDTGLESLIRGVLLEGRDGLVATLGVTGSGKVRTIRTVWD

SEQ ID NO: 23813 - protein, 224 aa, A.fumigatus
HQTSYPWAKAKPSKKKSARQALIDEALTQGVQHCVYTSVDRGGDASTDNATTSRTFISKHRIEHHLFEQTHGTQMSWTVLRPVFFFDNITRDFIGRLVVTAWDAYLQGKPLQCIAVSDIGYFAAQAFLNPAEYRNRCLSLAGDVLTYEHMQETMKRKTGREAPTTFRLVCYAVLWIVKDLRTMFEWLYAHGYRADIPRLREMHPGLKDFERWLEEDSQFVNRRS

SEQ ID NO: 23814 - protein, 144 aa, A.fumigatus
YLPVAKSLNVRKMRSILVTGATGKQGGAVVNALLAEDADIEILAVTRNPQSSAARNLADKSPKIKVVQGNLDDPAGIFKNAHQVSSEPVWGVFSVAGTDYGVLTGSHPPKPLRAGSTDTKPATHGPRPNRRKRRALGKPSSTKL

SEQ ID NO: 23815 - protein, 122 aa, A.fumigatus
RLTISIISGIVTLIAYTTSPRELTPQSQDSLFRCGTSAAEAKAAGCHFDLMSFSWLPSACYNEDLTNEFLNYTDWKWSLDSEGRHLVPKEYVQQGDFEYLFTSYEYHVVHCVFMWKKTQCIL

SEQ ID NO: 23816 - protein, 68 aa, A.fumigatus
GSDTVGDHLTPGPTCRPISLTDFQNDQTSTAHNSTNITLIKAALEVIKLLELGKLINYTFFINKYGVS

SEQ ID NO: 23817 - protein, 152 aa, A.fumigatus
DLSSWILESRKQRMYACFALRLDLWFSNGLYLQTLIDSDAPVLLIRETPEHKTAVGTFDYSDLNAYLLLAAGLTQPNEELRESYEELARKARDGHKIPLKDVKELGRSEPLTTLPASANLMTAVETFGGGVHRVVVVDEHKNGEVVGIVSQF

SEQ ID NO: 23818 - protein, 81 aa, A.fumigatus
HKKHVSYSLDSSTLQRKAVLGFFTEPKAPGEVVGCICRHHKRPLASSKREDCREKWSNSPTKDQELEAESTAWIANINPRG

SEQ ID NO: 23819 - protein, 68 aa, A.fumigatus
VADAETGISLEAAHILPLYELLTTKYFLQKMTYFLLYLLSSSYEEIACSLEGNKDLQIEGCGYPRTGC

SEQ ID NO: 23820 - protein, 127 aa, A.fumigatus
  UNSURE (58): Identity of amino acid sequences at the above locations are unknown.
RVCTDHCSMLPAIAYTLDMYRRTGEFYGINEALFSSALAAMIFSVLGAQPLTIVGITXLISLFNYTIYDIVTIYEPAIYPNFMCWTAIWAAIFHWIVAVCNLCDYMRYVTDFFVPVVWCLCWDYLLE

SEQ ID NO: 23821 - protein, 102 aa, A.fumigatus
EQDKRGAAPEALRAGSDLLADLHATSCGLKALASTTAGEGLEICRRACGGHGYSSYSGIGPYYSDYLPTLTWEGDNYMLTQQVARYVSSCDLRGLSSMLMLD

SEQ ID NO: 23822 - protein, 173 aa, A.fumigatus
LLKSARAVLAGKGTGNDTSQILQAYLARRDKGASFDILEVDSDIVAAFAWRTAHLTFEALKHRDLEKRSWNSLLVDFWRLSTAHSQYLVVKNFYEAVSSPDLAAKLGPETTKIMHDLFRLYALHTLEREAAEFFSSGAVTVRQITLTRTNAVMKLLDEIRPHAVRLVDAWKIP

SEQ ID NO: 23823 - protein, 249 aa, A.fumigatus
YLSAYPASPVGEDAANLQATINSRDGLGQTAQILLLGPSRLDNQFARDAYPATATSAPDVEGLSHAEVHYVFEPTPLPGQSSRHGGNLSMSSFALSRYPLAWKLMSKPWAESNDSISDLSTRNEHGYQVAVGAIRPKTSMAQWILLVEQTQAEAFAPINKLRKIILACVFGTIGFIILIVPPLTHLAVAPILRLSEATRKSIEPPSQPPHDCPPSSGPYIVGTAEAETEPRAFGDHMDEKGLVAWVKHF

SEQ ID NO: 23824 - protein, 118 aa, A.fumigatus
QSRHPTCFLPGVCVVTGGLNQRRSRCLYHLLTVVPQILIHRIGGGDTTDVLGTDVVKRLTQLNISTCQEDTSNADLEQLVQFFVYDIPTSPCTVCTRGRKFETPDKSLGESCKLDCLR

SEQ ID NO: 23825 - protein, 223 aa, A.fumigatus
IAFNRYLALRSWTELITPMLACSEIEGGRKPTFILHSIQLVLPKLEAAIEEDLPEAIELARLAETLIGGLEFTSTSTDSARRSGDIIDEKLHQLFQICIRGIFLASGNVQLRETFYNIGSQYISRIASADTVNQNLRHHSQQVIKTAGSTLIETTCDDAYAGQEACRVSALLFLNLLATLDRETDSTLAELISQSNYLSLFLDAIRALPHELKNTQANGKLWR

SEQ ID NO: 23826 - protein, 431 aa, A.fumigatus
  UNSURE (246): Identity of amino acid sequences at the above locations are unknown.
SPSLGFQDHSDDTSNMITNGELPSVPPLHLGESRTPPSGDQHHQQHHESRKHSSRKRRKSVHPDIVARAMVDTTIAIIPASAFRRLTRVYPRATAHIVQVILTRLQRVTFATAHSYLGLSNEVLGIEKQMTKFTTYDLPNNMRGAALDRLKDKFIKERDRLGSEEVTKGIALHNPSAGRRRRSSSFLRKDAALQAKLMTPRRAATVVTPESAPAEHDTYGVSPGDLLSTIQSSRFGPRYEQPPAKXQTPLAEKENTHFRLPAMQARHTFRRQDTMDEDGLFRECILDCIMKGIGLTSSTRDALRKSNHSGEASPKLLSYDSRRQKAIFTNNAFGFIDPYEGSGDGETESLMSMSVTSAGGTSPVINLREELRNDIEIVYFPKGSVLVEQGERHPGLYYVIDGFLDVGVPIVDKGEDLVGSRLHHGAGRIRA

SEQ ID NO: 23827 - protein, 70 aa, A.fumigatus
SRCHSFLFANMVSSKLSFVATAVAALAPLASAFDASSRSNLAIYWVRFDRSNRLRFQFLHADHCLAGSRS

SEQ ID NO: 23828 - protein, 248 aa, A.fumigatus
  UNSURE (233): Identity of amino acid sequences at the above locations are unknown.
RYLSFSLVWPSHFASLRPLRDRPTCLQTFVCVLSLTLTVYTPFLCGSWLGFNPAVILFCLPTWCPASFLSSPRLLQPWLPWRLLSMPPQDPTLPSTGYVSTVAIAFASSFCMLIIVLQGQGPNQLRLSHFCQETSLDIINIGFINYFPDMSPGHWPGSNFGNQCDGSVYVTNDGVVTKLLSGCHQIMEDIPICQAAGKKVLLSIGGAYPPDQSILSEDSAVAFATFLWGAFAXSLEAGKVLVPLGCRR

SEQ ID NO: 23829 - protein, 106 aa, A.fumigatus
CSVIHLMLAGLNLLPSTSESHIVKYNLHFYASLFHSTNHLSSLILPQTCQSYLSILTQCLPIIVLHSLSFKNCLSCNFKRAFFSVIVTQVNFVAKMSPSSFPGAPA

SEQ ID NO: 23830 - protein, 166 aa, A.fumigatus
SGSHTIADPFVAVNMTSFLPVNNTSSPQTRPMEEVATAATPRPHTNVSATEENRSRTMNSGTEDATPLNLHKVQEDSASRTKPSLGHNGTSHGESDADRDGSDHDSDAAGNAPPSKKKKGQRFYCTDFPPCNLSFTRSEHLARHIRKHTGARPFQCHWSQRISRSG

SEQ ID NO: 23831 - protein, 337 aa, A.fumigatus
PALVASAQAYRIFEYTGTRCTGAEVGIFRVAGPSACTKLNEGVASSVLVKIDNIHDDQYSVNVYENEDCTGGIVGKITNINGCLDLYAFHKTVGKAVQVVPVSKKRDRSVSATKGLVTDFQYNLPEETEQKMKVPIMHGGFRTISKSDHAEDGTYLNEAFGLFLPLPEENLAAVHELWSTPLEMAPYDSANETSLHDLSERQFEWAYCEWHAICLGAADLGGRLSNSQVAQALANFAGSTPFRQFWKTVDVIVGHTANGITIISALTTYGTQNTKCDTDKTTGGLLKDLVNGVSTEGLTNAVFVVEDDEGRQFEVGIQLRPMGGRNPNSCGECALCQ

SEQ ID NO: 23832 - protein, 365 aa, A.fumigatus
RRLLACPRRLDKIPSHLKYPTERQDSHYNLQSLFLIPQHARMPPAPPDQKPCHQLQPAPYRALSESILFGSVDEERWWHSTAPILSRLLISSNYDVDVQYKYLSLYRHLVLPALGPYPQRDPETGIIATQWRSGMVLTGLPIEFSNNVARALIRIGVDPVTADSGTAQDPFNTTRPKVYLETAARLLPGVDLTRFSEFETELVITKAEEAVLQANPDLFRSPWKSQILTAMDLQKSGTVLVKAYFYPQPKSAVTGRSTEDLLVNAIRKVDREGRFETQLANLQRYIERRRRGLHVPGVTADKPPATAADKAFDACSFFPHFLSTDLVEPGKSRVKFYASERHVNLQMVEDMSSPRGWKRAAPSLT

SEQ ID NO: 23833 - protein, 67 aa, A.fumigatus
TLYFTYVVRWRALLTDNRNPGFSGSTTTWYFFDKIFALMSASTFSDASLSRESQRFVRPSFAPEWSS

SEQ ID NO: 23834 - protein, 204 aa, A.fumigatus
LLGPDGPRVPLTRVYSDLLAREVVEYGNRGLRVIALASVDDIADNPLLHNAQTTEEYAQLERNMTLIGLVGMLDPPRTEVADSVKKCRAAGIRVIVITGDNRNTAESICRQIGVFGEDEDLTGKSFTGREFDALSESEKLEAVKKASLFSRTEPSHKSKLVDLLQSLGHVVAMTGDGVNDAPALKKADIGVAMGTGTEFGGFFS

SEQ ID NO: 23835 - protein, 136 aa, A.fumigatus
SSPKEAPDDHLIWETDTSRSNMHSFYPDTQEDCYLLLNVFLANIDPIVRIVHCPSLARRFDGLIRTRYSLDKTQVDGSYSNCMAFNPHHSSAFEPLAMSSFYAATNSMKTIDVSTVFYTDKSHLWLMYSSDISIQV

SEQ ID NO: 23836 - protein, 216 aa, A.fumigatus
SNLNQFSLVQWAVSWHPAGKGSYQRSWLNIPGKLGWFLMEIVGPAKLLYILYKLPPALNITSLPLSNKLVASLYVIHYVNRAIISPFFAAPSMSPMHASVVSMAVLFNWLNSTCLAGWLVGYHVPVLGYKTDGAVSGVPGGPSSYSAATHFLPCLGMVLFAAGMIGNIHSERTLFHLRREAAEKRDAADKSDEDITQHGRRGPSDLYPGIVLVLVY

SEQ ID NO: 23837 - protein, 186 aa, A.fumigatus
ATSTRSAPSSICAAKQQRSATRPISPTRISPSMGDEDHPTFIQASSSSSSTDADANANAKGRKNKYDKVYVIPPARGVFRSILYPHYAFEWLEWLGFSLVGTAVFPAAQALAYASPPLPIVPWLKPAAALAETLQVPLPLPAVVFVVNAVANMLPHARWGRKWYVEKSGEKAVAGRGAAVPWCPWL

SEQ ID NO: 23838 - protein, 592 aa, A.fumigatus
  UNSURE (12),(540),(549),(550),(559),(577),(580): Identity of amino acid sequences at the above locations are unknown.
LEMSDRRRRTGXPLGTAVRPSLLACTECRKHHVKCDAKKPACSRCLDARLPCNYLPSRRGGRRKPRSSLLPPLQGVTPDFPGMAYQTPLSETAGGNPTTGPSSSPVTGKEASSVASRNSPQNAPLVVPDSRFVRLYYEHFHNAHPILVPASSYEERNYPSFLQHVVRFIGSHYSLQVSGDSFKDATMLQLSHSGERTPCMVQALLLYSIFLCARSECSEAEKTFSQATDIALELGMFRRDFATTFSNGNETEAESLRRTWWELFIVDVFMAARPPKVVLRCGNVPYDVPLPCEEYVYANRKEIPPPATFTAFKMRVFLEEDGDARFSRYSSFSYRIEAALILARVLVLNSLPETHRDHLQAVENALISWTNHLPTHKVDIVDMYGNVDEMLFQAHTTIQYAAMLLHLPRSNLRPEFPDLHVPICPTTPLRLSPSCTRHVHDVKATEASKQLSNLLSMRPSAQGYSPLIVSPLVLCGMVQLATSRIHSPECLDHHCNRVVLVLGCLKILSSSWPLARQAQQHLRRAAGDSFTSWIESQHLXGTAGLAPAXXNDAYRESSXDQNTWFSTGRHGEKREVXSLXLARHAPRGNSNP

SEQ ID NO: 23839 - protein, 171 aa, A.fumigatus
GFNPHPGRARIFEDETNTNVEKVGNTRSPSAHGGRSTSRSRRTPCLRMKQRRSDLRSAFSSAGENHLDEHKKQPNGENEPQQEPYLDYPIVDLRELDDMTGATTPTSTPSRGYLHERIPPVPPLPKNLAATAAKVDRRLARELWKMKNAQMQDSGQTPPKEEDFRWPEDIF

SEQ ID NO: 23840 - protein, 179 aa, A.fumigatus
TDTPSADPPSPVVKTIGVVFVHDAVGPVAEAVDVVFGVAADHGDEGEEDEAQEEEDFGRGHDEFGFAVVLDGDEVQREADDHGHGDPGRWVDVDLPVVHDEGDGGVFGADEHQPGVEIDPSPRQIFMVSACPPGTEEKKKKKKKKKKKRERQKALYMANPNAGSTYRAASSKIDPRMGR

SEQ ID NO: 23841 - protein, 170 aa, A.fumigatus
AGGAIRRPGVWIRHVKRLLPFPFFFFFFFFFFFLFGSWGTRTDHEYLSRGWVYFYAGLMLVCTEYSAVAFIMDYWQIDVNPAAWVAMAMVICLALNLVAVKYYGEAEFIMASTKILLLLGLIFLTFITMVGGNPKHDVYGFRHWTNGVMYEYYTDGLHHGAGRIRTWRIS

SEQ ID NO: 23842 - protein, 120 aa, A.fumigatus
SIVHRYMLAAMEKKAVLDDRQDTDAGSIVPFPQTQRGLTSRHVQLMAIGGSIGTGLFVGIGAYLRDAGPLSLLLGYLVWGIAFILPINLSVGEMCAYLPIRGSIFELAARYVDPAFGFAM

SEQ ID NO: 23843 - protein, 94 aa, A.fumigatus
CIVLAQHDKNDRIESLSTCQIIMPTLPTRPLGKNGPQVPRLGFGLMGLSTFYGTAKPDSERLALLDAAYELGETFWDSGMYFPLTDHEDHSRSI

SEQ ID NO: 23844 - protein, 100 aa, A.fumigatus
PTCTATARTSSANGSKPTPPNETTSSSPPNLRTAWAQTDNASSSLHRNTRAKHAIAPSPVSASRPSTCTTATGSTGRPPLKRPSKPWHSSRRKARSDTSV

SEQ ID NO: 23845 - protein, 196 aa, A.fumigatus
RPLTVNLADMYGDSEDLLGKWFQANPSKRDHIFLATKFANRVGPDGQRFVESSPEYAREACHRSLARLGVKTIDLYYCHRLDRKTPIEKTVEAMAQLKAEGKIRYLGLSECSADSLRRAHKVHPITAVQMEYSPFALEIESPQYRLLETARELGVAVVAYSPLSRGFLTGAITSPDDFEEGDFRRMSPRFSSLHRR

SEQ ID NO: 23846 - protein, 127 aa, A.fumigatus
  UNSURE (53),(54),(69),(98),(102),(104): Identity of amino acid sequences at the above locations are unknown.
SMKLLLSLLICIAAVFLSYQFASNSAHLESLSASLREQLPIALSQYLRRNNIXXTFFVPPLTHTEPIIXPLTDMAVPRAIRQVFLAIEKAEGAGARVXRSNXTXKLRNFNPFLMLEHLTIRPGAGFP

SEQ ID NO: 23847 - protein, 77 aa, A.fumigatus
YCREFWSKGIRLVVACAEMYEAFVSQVPGLLAQLKYYPSQAPSTDSLGSRIPLCSNSVALLFRTGANRYLERPQTPS

SEQ ID NO: 23848 - protein, 506 aa, A.fumigatus
SHFTCSYSNFASCGTIMPPAFEFRGNDRRSHNNNNPRHEFTFRYARSGTGERTLLTTKRETTPEPILGATAGDEKPAMKFAPISSLSDSEEAEMDMSDDDKDDEASHPRKKRALGTNTAAAPTPAPVTAPKWSNPDPYTVLPPPDETLGKRVDVVKLIRKARITENAKQPAPADAVTTNEDFISFSGLIDEEEEARMKVSDNAPSGPKRLQGRDSAPGSRKRTHDDEIKGYSKKTGRPMVRFYDDGSIIDEWRARSQEDATPWMLLMEPSLHLGSRLHNEILSFYHWVKPMQYEQIVRADLITRLQVAFQSRYYGVQLRPFGSFASGLYLPTADIDLVLLSSNFMRNGIKTFGERKGQIYAFAAFLKNLEIAVPNSIETIAHARVPILKFVDKMTGLRVDLSFDNDSGLIANNTFQNWKSEYPAMPVIVAVVKQFLLLRGLNEVPTGGLGGFSITCLVTSLLQHLPHGHTAPNLGSILMDFFEFYGNNFDFEKSSPRGWKDPSGLQ

SEQ ID NO: 23849 - protein, 86 aa, A.fumigatus
  UNSURE (10),(21),(28),(32),(33),(42): Identity of amino acid sequences at the above locations are unknown.
PLPPFAVHFXPCSGILSKGPXIVLNNYXLTSXXPPVSRRSLXRPISEFHIDSFLFLSFIAYRSLCMRGFFSPTSHLTLLAINQSYR

SEQ ID NO: 23850 - protein, 64 aa, A.fumigatus
VIFQSLSNNNFFFFFFFFFLFFNMSRSDTSSLLDYPEAAGSMGFRGSSPSPTNEISPCLPSCRR

SEQ ID NO: 23851 - protein, 319 aa, A.fumigatus
  UNSURE (9): Identity of amino acid sequences at the above locations are unknown.
WETPLFIRXKATFGRKPERNIFGKAEFQNPGGSVKDRAALFVVKDAEEKGLLKPGGTVVEGTAGNTGIGLAHVCRSKGYKLVIYMPNTQSQGKIDLLRLLGAEVYPVPAVAFDNPQNYNHQARRHAESLENAVWTNQFDNTANRQAHIETTGPEIWAQTDGKVDAFTCATGTGGTLAGITRYLKTASDGRVKCFLADPPGSVLHSYIQSGGNLIERSGSSITEGIGQGRVTDNLKPDIDLLDGSLTISDEKSIEMVYRCIDEEGLYMGASSALNVVAAKEVDEQLPKGSNVVTILCDGAYRYADRLLSSTWVQSKGLRR

SEQ ID NO: 23852 - protein, 159 aa, A.fumigatus
LNSSTVDPSSPVVKTSSHPVLVSAQGVDFTIVGSPSQRLCTVPRWECIGRKSGVDESEVRFVINIDEIMVVLVHLNWGQLTLVDNVSVAQGAQIEPISETNDVSGSFPKNIELALKGPLVERLRIGVFWLISLTICGLQDHKWLHDDRLSGQSSRSQDG

SEQ ID NO: 23853 - protein, 259 aa, A.fumigatus
HLSSLIARNLLCNMTHRGAVGSDARDGDGAGVMTSIPHKFFIKNFAREVGVELPPLGQYAVGNLFFKPDQESLKESTAKLEEIAESLGLRVLGWREVPRDSTILGPAALSREPIIMQPFVVLKSAYGEGNKPENTDPESFDERTFERQLYVLRKRATHVIGLANWFYLCSLSNRNIVYKGQLAPVQVYQYYHDLVNVDYEAHFALVHSRFSTNTFPSWDRAQPLRWAAHNGEINTLRGNKNWMRASLHHGAGRIHSATI

SEQ ID NO: 23854 - protein, 144 aa, A.fumigatus
LPANASRGGAGSAWLFDRGDVASEVEDGGAVYSAERGEGYAGCKGGGVREGGGVCDCRGGDTKPHGRRASHLRYGRVCGRFQRYAGAVSAGSGRFSVDERGEGRHAADSRGGGCLGGGYGVRAGSSDGVRGPQGSGGDGQVPGG

SEQ ID NO: 23855 - protein, 306 aa, A.fumigatus
LGHHVPVRKVDRAIKPGGNPIKGFWGINGAGTRFQQWEDNGDVFFQDTLRSAGQAFTRASSDERARRETLISTLASRSADAVHWLVDEKGVDLSKVAPLGGHSFPRTHRGAGRDPPGFSIVGTLLRKLKMEGLFTLRNGARVTRVVKEEGCVKGVEYVTVEGETQNHTVEGPVIFATGGFAGDSSGMLAQYRPDLADFPSTNEAREGTQPILEAVGASVVDMECVQVHPTGFVDPKDPAAMAKFLAAEMLRGEGGILLNSDGSRFVNELETRQHVVDAIRQSTSPMETATRQWDVTLLLDEFSPAV

SEQ ID NO: 23856 - protein, 84 aa, A.fumigatus
LLRQMWMGTYPTVPSKILATGEMLADYIKNNPQLIGKAVLDRYGPEIPFLPKVHTVSRKTTCMTLTNEYSDPILRQSPPTSNPP

SEQ ID NO: 23857 - protein, 147 aa, A.fumigatus
LMNTQILSFAKALPLQIHPDKALAEKLHATDPKKFGDPNHKPEIAIALSNFELFAGFKPLKDIESLMKLKPLERFVPPHDTFDDELLRQICKALLSAPPVAVAETINELQSIPEPQFGPNSSYIPGMLERLRKQYCLQPPGLEGPAL

SEQ ID NO: 23858 - protein, 372 aa, A.fumigatus
RHQPRPSASPFAQRMQQYQYGQQPPASNHNPVGQSPAQPQATAQPQGNWRTNQPLNRTAANYNRPTWNHNGRQSWNQGPSRVGPPRERAYAANVHVEPTVEHPSPSPRYDEPEYSPYVESNERYESNEPYDQHDQPDDEDPGYQAFLHHPAFERGDFPESKDEPCAFAVDVGPVVTTCNGCGATFPSRNRLHTHLSECPRTQEPIPVTPTTNDPTAVRIIESTHKPTGLVGIRSWRCATAKIGINSTSEYHEICLDTGCSSTIGNTEFIEALPSVTITELTDGITVSGIGSRHRSNRSAMLTLWFPGLMNDGGSANAFAKITIRCHLVDGLKPKLLIGTDVICGEGFMLNFERGIATFGSCSSINLPNHRAS

SEQ ID NO: 23859 - protein, 94 aa, A.fumigatus
PAGRINLDWNHYISSYWLTMSSPSSKSATKHPLQLSSLVPLPKGTSLIPTSTPAPPIPQTTLFYYLNPLEFPTIGTSISPKFEFPLPSSILKNL

SEQ ID NO: 23860 - protein, 166 aa, A.fumigatus
  UNSURE (162),(164),(166): Identity of amino acid sequences at the above locations are unknown.
TDLPKNATLFLCSTVPASYAQSVAAELQSRGRADIRFIDCPVSGGAKRAADGTLSIMAGASEEALNSGREILQVMSDQNKLYLVPGGVGAGSNMKMVHQVLAGIHILGASEAMGFAAQLGLDAKTTAEKIIGSEAWTWMHENRLQRMVEEDWNSVSRGPGPXLXDX

SEQ ID NO: 23861 - protein, 131 aa, A.fumigatus
TLKRVGFASRSNHKFNPTFRVHTYKGHQIITMSKPTIGFVGPGAMGFRMATNLVREGYPVVGCDVFPASVQRFQSQGGIPASSLRESAEGKDFYICMVASAPQVQSVLFGDDGVVQCTLLPLQASQYEEQR

SEQ ID NO: 23862 - protein, 69 aa, A.fumigatus
NTSSSIHVTTPSVASQSGLTITPLRWVAGHSQQEGESTAYTIRLTTSVVHSKWIERNCLHHGAGRSRAI

SEQ ID NO: 23863 - protein, 321 aa, A.fumigatus
IIQLQNREVSCYVGMLYLFRSVMERKGLASVWVMEKRGGFIWVLEEIQENVAYIFCDDSWTITGTRGETDKIWGQGVVKLGSHITDLLPHLPTDCLKASPSKGILKLADIKYFAARASAEICIPAIVGKEEDPRCLRVSSFPHVAGMMVLSSSTLKVISSNPVFSSALFGHARPEGMHVNDLIPGFDTLLNVLSEEENLPLVEGVVIPEPSFRRARTLSILRDGKANVASVFLEPMGITAAHRDGSTIAVDVQLRVVESETFFRQNHSEDMESHDESSDYQEDAIAIKELVYALWVTYSRKIHSIGPSATVFTTGLEGSVQ

SEQ ID NO: 23864 - protein, 82 aa, A.fumigatus
TFQMRFHARSFQDYHFIALHRVYRGQSPKDLDEFQRISGVNQILSFGDWDFLIMPEICQIFRNSVKPTNRLTMETKIASFIK

SEQ ID NO: 23865 - protein, 224 aa, A.fumigatus
  UNSURE (206): Identity of amino acid sequences at the above locations are unknown.
KTTCTRCTPLSQMQIALSSHSNTFDMATHQAIILPGINLPLTLASVPTPAPQSGQVLIKVLASPILAYYRTILPGKRPYPLSLPLTPGVSPIGRIEATGSDTTALKPGQLVYVDLAVRARDDPLKEHGTIVLQGLFVGITPEARILSENDWRHGSWAEKQLVPLENVHVLDESLLCAQMGYSPARLTWIKHPACSVRRINVGGPAXGETVIVCFATGHFGGAGD

SEQ ID NO: 23866 - protein, 83 aa, A.fumigatus
LTTHPRLSPNTSPPIRPSPHQGPRQPYPRILPHNPPRQTSLSPLPPPHPWCIPNRPHRGHRIRHNSTQTGPTSVRRPCRTRTR

SEQ ID NO: 23867 - protein, 91 aa, A.fumigatus
TRLTLHLALLSDEDLKEYDLDHYDSDEVDEDGEKITMFGNVKSLAYHQPNEEDPYLVIPEEEEDEEREELQILPTDNLLLAGKVEDEVAHL

SEQ ID NO: 23868 - protein, 94 aa, A.fumigatus
GKHFTMSSMITTTAWVRRGVAAQFPTKYEIDEEEMNRISKLARMQLEEAQGDLEAAREGKDQDGETMEEDQKEEAQDAMEDDSEEKKGKTSFNE

SEQ ID NO: 23869 - protein, 76 aa, A.fumigatus
LSGTFKPFYMSPLEVRPRPDPDGVWGPCSRNGPGPRPQMSGSNVSSAHEIAVSPVIRVCANKEIQAIQGTEGWRQA

SEQ ID NO: 23870 - protein, 303 aa, A.fumigatus
EIRAKNYASWIPGAKPYVDQAFDDLEEIKRKHGQEFNEIVSNAYKDLREATKKGSLDVNTAVKIRDILQEHFKRLYELAGESASDILDNHPEIREKVGGSLDQLKEMGNAYGPQAKEEVDRTWQQVKDIVTSGVNPETIQKIQKLAQEKREKLQKFGDEAWQKGMEEIKPYLDRNPKVKELVERNSDALRKGNYGELWDLIKESASSGNLGNLEGYINKTVDQAKKSGFNLDSLADKFPGGSDILSQLQSLQDIAQKKGPEAEKILKDTLNDIQGSYRKEPNRPRPLLSLLPQGVETAPVRKK

SEQ ID NO: 23871 - protein, 201 aa, A.fumigatus
GSNFKPTHETPQNIYIYILNTDRCLKMSANLSPKHHHIVFLQADYCPIPNFRFPPGHTFTTAVYQQTSLSELHSRIHDASIVVFSYIPFDAHTLSPEVTPHLKLIAVAAVGTDCIDLEACRKRGIIVSRSVGANVDSVSEHAIGLYFASRRRILDMHMLTRAGEWAHKKGTIMYQLLDKHGQPPLSCQDEVVGIIGYGVCW

SEQ ID NO: 23872 - protein, 201 aa, A.fumigatus
LVLLDMGFVGESVQAPIWIPSIVALEADKTNVGQRIAQLARNLGMKVLISARKDPATSSSLSTVDNIERAPFDAVIRQSTVIFVAVPLSPSTRNLISNPELKNMSPHTVIVNVSRGGIVDEDALLEALKKGTIAGAATDVFRQEPAGLDNSPLLSDEAKNLNLIVTPHLAWLSKKTLANYSQMVQQAIEGWSAGQPCNVVT

SEQ ID NO: 23873 - protein, 393 aa, A.fumigatus
PSSSDLLKRHSTIHAKNAGRQYLSDAPLPDPAGPAHLGNVNQQLQQPHPRAEDIYESHMHIVLRSSDSRHAHSFDSRYPETFSAIHDTTQDVEVSRGLIGGPDQVQDYRASLDPNAYSSSKSISQSSPNSDSPWPYATYGMYGEGCLDTDLAWILDIGSVDYPSPQKDHHLGLDSVQIQEYPSRHSERCLPGVVSTVGDTASRHRNGQACDYPADDTQNDWPDEDPVPGAPPSSEIPPTDIPSQESWVEPDEVRLFQDRLKNVNWQFLRITPDVRARMLATLADSASIEHGHLPPDESKFPVPEVLEYFLSFFFEFVHPRFPVLHKPTFSTATAPPYLLLAIMLLGSSHSRSNRGKFVAVYLHLATTVFMRLHALKPSFVRVFTMGLDRAALM

SEQ ID NO: 23874 - protein, 379 aa, A.fumigatus
ILVLNQSVTIVSSRIQISEMSQEHRFVEDGRRTQPHTAGLYDRAEIEQFVVSAPSERSPKSSNHSPLSSVTQPRTLQSRPDMMSLTSILGGSMDGIHQCSTQRSSLSRGSFLHSCDRQQCPENNKGPLGIEKEAEHKENNRTYHEFHRGKYMLPNDEEEQDRLDFLHHALLQVTGRLTHVPHPTDARVLDLGCGTGIWAIDFAEAFPDSFVVGVDLSSIQPSGHPPNCHFYAPFDFEFPWAKLGEESWDVIRLQMCGGSVVNWPSLYRRVSAHLRPDAWFEQVDIDFQPRCEGRALDGSALYNWCHNLRQATSDAARPISHQFHAIIDHLQNAGFTDIKHKQFVLPLNRWHSDLWMRHIGGWYGRALFDSIEPLSLAPF

SEQ ID NO: 23875 - protein, 72 aa, A.fumigatus
RARYLPAPVREDEVNSRDFVELLSFAMKVPCFLLFLAATVSAQRVAVGLPAEGEKLAPGSSTVVQIQRPVCF

SEQ ID NO: 23876 - protein, 203 aa, A.fumigatus
  UNSURE (6): Identity of amino acid sequences at the above locations are unknown.
LATLVXNELHSFRKNQQMHMMQQMQREHSDMDMNGHRPQSPSSAENAPSPSKRPRLENGPMNGQQLAPNGRGQGQAMPGQPNSQALLMQNGLNPRAMNPAQFAGFQQQGPAAQQKSIQVYAQNLALHHSRSALNNQGIPNGLMNPGVMPNQTDLVPMPDGQGMYPMNGDYYGTNGQMAQVRAGMQTPGGQHGNHALQDYEVQL

SEQ ID NO: 23877 - protein, 88 aa, A.fumigatus
HTLITYPNNIPDSGYASRSISLPDISDTDQRLCCAPYLLLSSPQSMILPLSYPSPWRDISPIEVRGLAFSSPPLRAERDRAFSISPYE

SEQ ID NO: 23878 - protein, 281 aa, A.fumigatus
  UNSURE (257): Identity of amino acid sequences at the above locations are unknown.
GGKKYLAKIDKSIMAGFTVGDYLAERLSQIGIEHPFVVPGDYNLILLDKLQAHPKLSEIGCANELNCSLAAEGYARANGVAACVVTYNVGAFSAFNGTGSAYAENLPLILISGSPNTNDAAQFHQLHHTLGTSDFTYQLQMAEKITCCAVAVGRAQDAPRLIDRAIRGALISKKPAYIEIPTNLSGAPCTRPGPISAVVDPIQSDRASLLAAIDCAADYLSGKEKPIILAGPKVRKAGAETELLCLAEAMGCAVVVXPAAKGSFPEDHFQYAGVFWGQVST

SEQ ID NO: 23879 - protein, 194 aa, A.fumigatus
SRGSTGQGRRPTYAPQGPRAARIEHMERRSSVGDPRATRQPGQFFAIQSLPESTTDPPQTAVFKNQIDWIPLSTGSIRPTQGRTLAIAQVCGGSQSFNAVNSLRILGRWMRMFVIPNQSSIPKAYTHFPDAGQPGDYHLMPSGNRDRLVDCMEEFVKYTILMRPHLDLFADRYSEREERRLKQAALAAKAGPDV

SEQ ID NO: 23880 - protein, 75 aa, A.fumigatus
IIEGEEWKTAFRTKFRHFKYLVMLFRLTNAPASFERFIEEVLHKVLHYFIVVYLDDILIFSKNKNEHVEHIKEVL

SEQ ID NO: 23881 - protein, 80 aa, A.fumigatus
FIGLVNYYQQFIKGYVKTMTLLFKLLKKGKEFKWTKECKTAFTRIKEKIITALILVQHDPDKETTIKTDASNYTIGMRIT

SEQ ID NO: 23882 - protein, 108 aa, A.fumigatus
ALLVCVTRSPITSTAISFSRDKGVVAVMSSQASSSSRSTSSIPPSSPTGSSSSSALATLTLRPAIITSWPTRSLAASPRDTSRSVSSCSMQAKRPLTTPSRKGAKCSP

SEQ ID NO: 23883 - protein, 255 aa, A.fumigatus
  UNSURE (208),(211): Identity of amino acid sequences at the above locations are unknown.
LLQEFATVKDSEEELDLRASVTDAMGEMSAAAGAERYQPYVEPLMRATEEALHLDHSRLKESTYIFWGAMSKVYGEHFAPFLDGVVKGLFACIEQDETDLDVSLGEAAKDLVGQEVIIAGRKVKVASADDDDEPVGEDGGIEDVDLDDEDAWDDITATTPLSLENEIAVEVIGDLVTHTKSAYLPYFEKTIEQVLPLAEHPYQGVRRXTIXTLHRSYAMLFAIAENTGQMAKWKPGLPLEVQPAQEGPEVWVKSR

SEQ ID NO: 23884 - protein, 68 aa, A.fumigatus
YHDLRQRQTLQMYRVPQKITEASSCSTSQERCKQYIILADPTRFKPVFQFYSPLPSRLQTTPPNKQFD

SEQ ID NO: 23885 - protein, 139 aa, A.fumigatus
KKSIGGWALPFWDLKAFITDQIPGLAGPESVHPTSAALAFQLANLYGLLSILGIGVCYSTTEPRVLRNYLYALAIADVGHIYVTYRCMGHDRFVDVINWNVLTWGNIGITGFLMINRIAYLAGLFGDAKGAANKIEKRV

SEQ ID NO: 23886 - protein, 147 aa, A.fumigatus
EHRKQAMSTLPPNPLACFWQNNPHKLHDHRSTEDLPTHSDVAIIGAGYAGVSTAWHLLHKHPNINSITILEARGACSGATGRNGGHLRPDLYGHIPTYIDRAGPEAAAEIAEFEIAHIQAIKKLVESEQIDCDFRLVFTTEGSKDPR

SEQ ID NO: 23887 - protein, 62 aa, A.fumigatus
RQELQMHRLHWKNMASYLPLPNLKAKPSPGELEQGDKTLVKYRQLAWPPDHINPKVLILLPN

SEQ ID NO: 23888 - protein, 188 aa, A.fumigatus
DNQCAGSSTPVVENAAEVQIDTLTGDWTPLRADIKMDVGRTINPSIDYGQIEGAFIQGQGLFTTEESLWHRASGQIFTKGPGNYKIPGFRDIPQVFNVSLLKDVEWENLRTIQRSRGVGEPPLFMGSAVFFAIRDALKAARKQWNVTEVLSLQSPATPERIRVSCADPIIERVRVTPREGEKSFFVAI

SEQ ID NO: 23889 - protein, 64 aa, A.fumigatus
  UNSURE (5),(30),(53): Identity of amino acid sequences at the above locations are unknown.
WYLDXPSGVRQVVIGPGVSFPSRGFRFSTXNKIGARTIPINAHEFPYEDYDPXLYGLCAETSSN

SEQ ID NO: 23890 - protein, 62 aa, A.fumigatus
  UNSURE (24): Identity of amino acid sequences at the above locations are unknown.
MLLQAPAPRYEASTSTVVASVPFXVSSTHHEDEKLGFAGERQYGSALKVDGAADLRGSSYVE

SEQ ID NO: 23891 - protein, 100 aa, A.fumigatus
LALMLPRLEFPAILTAYILTNMLLGYEKLSSKVFFLDSFMIDYSKGTDACQNKVLRDFICQCFERNQKDICGPNPETKGIQNQLPNAHGWEFKVLTSLGP

SEQ ID NO: 23892 - protein, 135 aa, A.fumigatus
VHISQRRRAPVYVCLTCYDHQMRLLSMIVKSVFGGSRPKRSEYFEFPAMRVWELILNTLRFRIRSANILLITFKALANEIAKNLVLAGIGTLTIVDHETVKEEDLGAQFFISEEHVGQNVCCQYRWKFQARQHKS

SEQ ID NO: 23893 - protein, 119 aa, A.fumigatus
  UNSURE (42),(68): Identity of amino acid sequences at the above locations are unknown.
LPLEWAALTAKPNNNLRGANLPPTHIRVSPSMLKARNGRKGXDAWTSYQGKVYNITPYLPFHPGGKGXLLRGAGKDSGKLFMEIHPWVNWDAILGECLVGILVSENEAKANESSLDTMD

SEQ ID NO: 23894 - protein, 66 aa, A.fumigatus
WLTYGFILFSRWDEGLLDMCVGEKRTLTIPPEYGYGERGIGPIPGGATLIFETELVQIEGVNNDEL

SEQ ID NO: 23895 - protein, 90 aa, A.fumigatus
ASLSLGLAGRSNGHANQRDVADKLTEVISSASQSFSERFNKVLPPQSPFQTAEYSEFSKAMLSNLVGGIGFFHGDDIVDRSAASRSLNEQ

SEQ ID NO: 23896 - protein, 185 aa, A.fumigatus
RILPAPWWTTGFRHTCEQNEGMAGYGWDEYDIRKGGRQTIHDTGNSLDLTIDFIKVPGGQHGGSWAARVRGIPREDGSPDQPTSIVFYATLEGLGNLGVATESGPIGYQGDVKLMGYTTELGDFSIDVTAGPETNEHPEHGHPSYEDKPLDRTLVSSSTIAPENLWQVKRRLSIPRNCSLIWNWR

SEQ ID NO: 23897 - protein, 124 aa, A.fumigatus
  UNSURE (11): Identity of amino acid sequences at the above locations are unknown.
LRPFQCADGLXLWRRLRLLHLTYFLLHPSYCSNVPASACAYHTNMVHLATVKRDSEDVEPLVKRVDSIELETTDDDGFYSTVYGTRFAAEQLPQNEMPEKEMPREVAYRMIKDELSLDGNPMLK

SEQ ID NO: 23898 - protein, 133 aa, A.fumigatus
FEQEEEAEKLMTDSFSKNFIDYEEYPQSAEIQNRCVSMIARLFNAPINSDDEHPVGTSTIGSSEAIMLGTLAMKRRWQNKRKAEGKDTTRPNIIMNSAVQVCWEKAARYSDVQELYDSANKLTNLEIIALPKS

SEQ ID NO: 23899 - protein, 73 aa, A.fumigatus
KVISSSCMTRSNRNEDIFQPVKAYLISSLSIRTNFNPAIVWELYIFIPALYMDLSFEDNAWRKRLAGRIDTFN

SEQ ID NO: 23900 - protein, 64 aa, A.fumigatus
TTNEIGLHWLKNIFIPITSSHTTGRYHLLILNSHGSYLTPQFNQLCSENNVIPIYMPAHSSYKL

SEQ ID NO: 23901 - protein, 114 aa, A.fumigatus
INPLSIRGKMHGLHDFDTLQTIHSAAFRHYNFNMISFRQCLAIAALPLAHTALALNDISSRAQSATNLCGDNDYIILESSPWIVYNMLYNAAQMVGTQGTNCLHSRSSQDRTLM

SEQ ID NO: 23902 - protein, 130 aa, A.fumigatus
KPWTLAIEQSLAQSSVRPLIHLLAEDINRVNMTISYDYPSRVPATTSMATLEDRFEVIKEVGDGSFGSVAVARVRTAGSNVARRGTMVRNPLADEISPSGHGPTRADIMPGCNQDYEKDLRLFGPLLRAA

SEQ ID NO: 23903 - protein, 109 aa, A.fumigatus
GTHLRTRSAPRGMDRPVLILCQVAIKTMKKTFDSLAPCLELREVIFLRTLPAHPHLVPALDIFLDPLSRKLHFCLEYMDGNLYHLMKFRDHKYLEGKPVEKYPSLLTPQ

SEQ ID NO: 23904 - protein, 129 aa, A.fumigatus
ELIADPPTLVVKTQPPTPFPPPRPHRVHSPSHAAQPLETDFQTHGTDPRASRTSPLPHPEAAQTDSNAQKAPSPVEPYAAPHDTAGTPTPTPLAHYPRQKNHPFAHPAARSPPAGTPPTRPAPSPSAGP

SEQ ID NO: 23905 - protein, 307 aa, A.fumigatus
AVTAITLNQQSLHITAPSSDAQFTHHVSLLSSKSDTQRRDSLAHLTTSLVSRPVDSPLPQPVSVLLPTLLPLILDASSSVRTQLLKLLRALPANDIQDHVPQLLPYIRAGMTHLAADIRVSAVEVLSWLVDVAGAEVVSCAGGWIKTLNCFLSVLGWHTEESSKWSGNRASFGKSGAKGQPMVKVLAALAVFLQAGIGRPDERMDDSSDEDSAPGVSGWEFPLCHAAQHMVPQATAPFVHLNLFGQPRDEEGEMYETREDRYRVFENRFLGAVQRGLESARGEGGEVGRASAAVSSPRGSADPRLIL

SEQ ID NO: 23906 - protein, 97 aa, A.fumigatus
QRLLATVVDSLALECHTRRFCLIPNGKDVHQGFREVTFRDLCCAVNRMSWWMEKHVASSVKGATIAYLGSNDIRYIILMLASHKTGCTVSLHSLEME

SEQ ID NO: 23907 - protein, 163 aa, A.fumigatus
VLDESSAAAAGSHMDFYVAKGLMKKVTVGGLDLPTVKTLQEYGDVVSGRKEDPFGRKSFGHWKLTEVLPEYAVYVGQVTPVIHFTMGGVVIDERSRVIGTDGTPIEGLWAAGEVTGGVHGQNRLGGSSLLECVVFGRIAGTEAAAWHKEHYPEAPPSSDVTRS

SEQ ID NO: 23908 - protein, 128 aa, A.fumigatus
ISYASIIYNLAIVPYPAMFSVIVPGRACLTDIVAVDAQPNGQATKFAFTFPLNPPFTEIVVFFLPGTVLPQDTAAAIYIQLPESTPSPNGPPFRFIGALANEKPSAVFKVQRRVLTNTAPPLRNRRAR

SEQ ID NO: 23909 - protein, 249 aa, A.fumigatus
CCARYIFNSVVEKFYWPEDCWSVDFTDRTVTLVTLPNATADQRSQLVAETFREVVKRGPFDILKGWRNELYPVYGPGGEFLLEMERSASPLFGIVSYGVHCTCYVEDEHGLRIWVPRRSRTKQTYPGMLDNSVAGGMSTKENPFECLVREAMEEASLPEDVVRQNARSVGCVTYVYVRGARAGGETDLLQPEVEYVYDIKLNADVIPRPCDSEVEEFNLYTIEETKKALANGEFKPNLHHGAGRSAHAL

SEQ ID NO: 23910 - protein, 102 aa, A.fumigatus
IILSADAGHPSVVKNYRSGGIGMETLLMEYAASTMMLINMLVDAPENDLQLRCHIRAHFISCGTNRLLTKMEGFQYEVIDKQIERSRENEAIDYEDLLQREQ

SEQ ID NO: 23911 - protein, 501 aa, A.fumigatus
  UNSURE (393),(418): Identity of amino acid sequences at the above locations are unknown.
LISRSSGPEKMRPLTTRISFSESSSSMKDSIEGEVKDMSDPLQITDAILTRLNGTRAYDYFLSAMQHMLLIRENSGEDGLRMFQLVDAMLSYVAMDRRLPDLDFRQGLTFTVQSLLDRLHTDAEARRAYDESLEARQIAEAAIAERDEMKAQVEMGADGLVKKLQKQIDEQTSIIELQTRQNDALKAELADVQRLRAQELQRNELETRELYLMLRDAQDIAASNAKKNNLAETDPSHMKGILERDRMLERLEKQLERTKTQFKLEGKVWGQHGPSDRLRELREQMDGEPDPEDFQEQARRNLETSALGSVHRKRSHVPEMDVANGQERPSHQDGPLLVNFGRPRMDPEQASDLLGEIASKVPKIDAEDAETDEFNAQPTQLETEEARVGQVEXVKPEDETEKPEEKPVSVPAPPPPPXSPTPPPPPGGAVGIPPPPPPPPPPPPPPGAQGLGSSASGGSSTPSWLCWKDCLHPPPAPARFGLEKPLPPSAPPGVWRKVGEF

SEQ ID NO: 23912 - protein, 155 aa, A.fumigatus
  UNSURE (68),(93): Identity of amino acid sequences at the above locations are unknown.
GFFQTEPGGGRRGVEAILPAKPGGGGGAAGGGTPQTLGTRRRRRRWWRWWRRRNAYRTTWRRWRGGGXGRRGRCRHGYRFLFGLFSLILGLDXFNLTDPSFFSLKLSWLSIKLVGFGIFSVNLWNFRSNLPQQIRRLLRIHSGSSKVDEKWPILV

SEQ ID NO: 23913 - protein, 112 aa, A.fumigatus
  UNSURE (85),(110): Identity of amino acid sequences at the above locations are unknown.
GNSPTFRQTPGGAEGGRGFSKPNLAGAGGGWRQSFQQSQEGVEEPPEAELPKPWAPGGGGGGGGGGGGGGMPTAPPGGGGGVGEXGGGGGAGTDTGFSSGFSVSSSGLTXST

SEQ ID NO: 23914 - protein, 90 aa, A.fumigatus
HRRRYTFSHSDSRTKLTEYADCVSFKPNSTNILVQNLHCNGSHGISVGSLGQYKGEVDIVQNVLVYNISMYNASVGVSRLPEFLLANSFF

SEQ ID NO: 23915 - protein, 75 aa, A.fumigatus
DGARIKVWPGVSSAMSEDLQGGGGLGSVKNVTYNQMYIENVDWAIEVTQCYGQKNLTLCNEYPVRPFFLIHNDHY

SEQ ID NO: 23916 - protein, 99 aa, A.fumigatus
WSHASDGMSWQPIIKSYYQTLPRFKAVSAYSIPDEHLCAVNIQKALVDLVNAVSLSHTLSRRRTYIGADEVIRSLGTLHVDVLSVDVRANLRVLEPLLL

SEQ ID NO: 23917 - protein, 181 aa, A.fumigatus
TETPDGMARGFRGKPSQFRSSFKVNREAREKPLREFVPYFRTEVSPHACIYLAPERDTVRLGEAVLAYLGEAERHALQRMIIEVNDYLLFETYGLESLGCMQRLKEVDLIVSQTPVASYHRRDIVEVIRDAFQEYVRNHTQWQIPHVRVVSALGKQMGSFTIDPAEMDTVQPSVLFDGHAG

SEQ ID NO: 23918 - protein, 225 aa, A.fumigatus
FLAAMNPNSIHQGDPEGELFLNSASRPPAESPVVGPLRISKRDTPSPASQGSAPLPYPDDRPRLGQMRSSSGSTGSSPTAGESGRHGSPISSVNNLSSMPAGSSATRPSEYPAALRPRDGREPKPATLAERRGNTAPKPLPESPGPDAPDREALFGRKYQRLPASSALSSDGMQREEGIAYPDYQQQYWPPPQPSTPSALSTRVGVSQSLQPPVFTTGLEGALPL

SEQ ID NO: 23919 - protein, 91 aa, A.fumigatus
  UNSURE (9): Identity of amino acid sequences at the above locations are unknown.
WRRATKVLXISILAHAAQFAFLVFVENPHIEKTYNPPPPRKRTIEQDNVSITPQRSDSPSAPASVDEQVPMRQVIQRSTPSVHKLLGFRKP

SEQ ID NO: 23920 - protein, 271 aa, A.fumigatus
  UNSURE (251): Identity of amino acid sequences at the above locations are unknown.
LTNSIVCTVPQTQDMVSQLISPSEPKNLSDVIVLAILAAHILLLWRLPAGVKVPVFAFIYLFWRGAYNAGIGWLLHNQSNHRTLVRWAEKTKIFVNPATGQNPHANLYKLIKRELETKIPADYSFEDAPIEYNTWLVFRRLVDLILMCDFTSYCLFAIACSQRPFDEGTLMTVLRWSAGIVLVLFNLWVKLDAHRVVKDYAWYWGDFFFLIDQELTFDGVFEMAPHPMYSVRLCWILRYLANGGELQRSCXSLFSPMQHNSLSWSSSRIRT

SEQ ID NO: 23921 - protein, 92 aa, A.fumigatus
  UNSURE (58): Identity of amino acid sequences at the above locations are unknown.
STTEPPIPPNRRFAANIIEFLEPSNQHIISLPLLLKMPLSKENRMQMAISAYKKGQFXSKAAAAKVFGVSKKTLPDRLCGIKTTRKNTPLIA

SEQ ID NO: 23922 - protein, 328 aa, A.fumigatus
  UNSURE (322),(323): Identity of amino acid sequences at the above locations are unknown.
YSNFWQTDFSRYPCLICRDFLSGVVSLVAPSQQASLATLFTYTTLRFIMLNSITELPEGVAKNSEIHSLAIRILVVVFNSIALYNAVELVILIFLTFNRYSGLYFWSLLLSGVLGVIPHAVGHLLQFFRIGPIGLAISIATIGFYFMVPGQSFVLYSRLHLVVQNQKLLRRVLYIIIIDSIVLLIPTTVLNYLTVYVGTQPVIKGYNFVERMQISWFTAQEMFISGIYIVETIKLLRLRPDKASSRNKIMYELIAINLVMVLLDVALLVLEYLRLYTLPVTLKGAVYNVKLKLEFGVLKKLVSLIHAPQVSNLQRRRMSIPXXSTHLE

SEQ ID NO: 23923 - protein, 86 aa, A.fumigatus
CVHSFAESQRDNYLFAATSDSAIAKAEGVKQPSIVLYKDFDEKNAVYDGAIEQEAILSWVKTASTPLVGEIGPETYSSYITVCFCP

SEQ ID NO: 23924 - protein, 147 aa, A.fumigatus
AGIPLAYIFAETKEERDQYAEDFKPVAEKHKGAINIATIDAKMFGAHAGNLNLDPQTFPAFAIQDPEKNAKYPYDQSREFNAKEIGKFIQDVLDGKVEPSIKSEPIPETQEGPVTVVVAHSYQDIVINNDKDVLLEFYAPWCGHCKA

SEQ ID NO: 23925 - protein, 178 aa, A.fumigatus
ANVSFHSLAPKYEELAALYAGDFKDKVTIAKIDATANDVPDSIAGFPTIKLYPAGANDSPVEYSGSRTVEDLANFIKENGKYKVDALVAASEKVEERPDVTASPSATSTDAEAPAATGDEKGDHDELYTTTLAEGRRFSIQISSFMIIFYPSRFYFPLSVSSGPIPKEPHYPADKIAH

SEQ ID NO: 23926 - protein, 150 aa, A.fumigatus
LKSFADSDSRQPFSDSSSLARHRRIHSGKRPYKCPYANCQKTFTRRTTLTRHQNHHTGTIEEAAAETEANLRQNKERVRAPGDGGFSEHASVHSTPSPAHHPVSIPPPGDLPPLNMPRSAGDYYMGNGSIPPHVRGDFSQASPRSSPTAT

SEQ ID NO: 23927 - protein, 84 aa, A.fumigatus
GVATSLDMVRFPWEYMREVKHQATDHILERIHTGIRPHACDWPGCGKQFIQRSALTVHSRVHTGEKPHMCERCGKVCRYTVFYS

SEQ ID NO: 23928 - protein, 62 aa, A.fumigatus
LILGTYLDITFIISKLAYFTRNPSPNYFIIVKYIFYYLAGMLLLLLFYSFILSNLNSFVNTS

SEQ ID NO: 23929 - protein, 255 aa, A.fumigatus
FFSIFGVDNPALNTVPLIVIVVATAIKDAIEDWRRTVLDNELNNSPVYRLVEWNNVNSTEDKVSLWRRFKKACTRATISTYRWIRRLMKKNKDVPQMFQDERRASILTTVTPRASVYSQRGDHGMEEDAIQMTPVPSPSAEARADWPLPAGDSDQFLHPDKRNRDSLQAVTSPVTPPRKGGSVVDPSKQTIGKARFKRDYWKNIQVGDFVRLYNGDPIPADIVVLSTSDPDGACYVETKNLGLHRGSERVRSMGN

SEQ ID NO: 23930 - protein, 197 aa, A.fumigatus
YFKLLNTPESFTYNQLQSPDHPKAAATHSPHPSYNCGNSRTVPCLSSTSRTSSRRSHTRRASCFDTRLHRLRRTGSRTRRSGNPQTTRLARHCGHRVPCSRRARRRSKRRCRRSRTRPIPREIARLVGRGTGVQLRASGIIMLGRGAAAATVGDVADFACVGDVPDHAGFVPLVAGEGGDTASQVGAGGDGGGESCR

SEQ ID NO: 23931 - protein, 207 aa, A.fumigatus
RTAPYFASDTPLLRTLSSKMRFFLLLATTLASTVSARTDLRGCISSLTRNQWNEASMIWYVPDTGEICDIPDCGGGRAPPKHDNPACPELYTGTATYEPSYLPGYGPGAAASTPTLAATASASTTGDAMTTMSSEASSLRITAAPSTTASATETMKTSVKAGSSSSVASTTTGSAGATETGNGAGIPAVVTWVGAVGCRCLWVVRAL

SEQ ID NO: 23932 - protein, 133 aa, A.fumigatus
LQDAPNRLYKSFSCRTVSTIAACWCPDVPPPTLSGPPWRERTTCNALSARPGFCRLFSLCLSCLFFLLLFSSPYFPVIARNRGLREQPARRKNPTQGKTNQSTNFPGPGISKKQTRLLRFINTCPFLGAPSAD

SEQ ID NO: 23933 - protein, 70 aa, A.fumigatus
PPSSERSLFSLSRGKAQDPEPARRPIHYLVLPWNPLSGVFTPGGSFVSLFYFCFNNPLIYLFGVPWYVFP

SEQ ID NO: 23934 - protein, 245 aa, A.fumigatus
RLFTMLSSISGVIGQKGQANYAGGNAFQDAFAEYRRALGLPAISIDLGPVEDVGVIHGNEDLQNRFDGSTLLSINEGLLRRIFDYSILQQHPDPQHRLNVTSQGQMITSILVPQPEDSDLLRDCRFRGLRALGEHSPRSRRDPTKDKEIQSLLFLAQSQDPDRAALRAAAITVVGARLAKQLRLTDAVDPARPLSYYGLDSLAAVELRTWVRMTLAIELTTLDVMNAASLGELCEKVIGKMGFGM

SEQ ID NO: 23935 - protein, 75 aa, A.fumigatus
VVKDSAQQALIDAEQSATVEPILEVFVTVNDSDVFYGSEVNTDGGQPQCAAILCKGVLECIATSVVGLSLLAYDA

SEQ ID NO: 23936 - protein, 67 aa, A.fumigatus
  UNSURE (4): Identity of amino acid sequences at the above locations are unknown.
GGGXELNSSMPPLRQVTLFVSWADSSKKEYNTLECRGTYGCVKYKRPVGWKDGSFTAKPYRYIRVVD

SEQ ID NO: 23937 - protein, 61 aa, A.fumigatus
VSNFIQWHDDLISKYTHKYDYQRAKYKDPEVINQWFNLVKNTIVKYGILKQDIYNFDETGF

SEQ ID NO: 23938 - protein, 374 aa, A.fumigatus
NDGESWSSLRSTVQTRKFTPFFLASCIEKDPECLSECRHLILSMWLSSLVARVSMLKFQHRLTEALLNLDTMNPLLHNLPFSKDRQNDRYSISLDDLGQRRLSLLSSLLSNMRAHVQGLEDTESRELSSTRRDYRELIQRMMASMKANYQELGSGGASAQGAYVDFVHRIVGFLQQYSRDICPIDPFFTDPTSFPLPSADPTYIVARLKSYEPKLCSEKVVKTLIVFVQGVSERAAIDGQQVYLVDQLHTSMADIYETGDPCKPTLRAVLLQCVFSAYIECAFSNPAAWLLSRPIIQTVSLVFRDLLFFMDITDAMCRSSVLASLGAVFRSSYQAFQYITGYPLMPTDSTVIATLTNSVEMVTSAIPVVEYFDP

SEQ ID NO: 23939 - protein, 118 aa, A.fumigatus
TGQRDALTSHYSRVRTAALEHCVKRQPNQSQEKTRRALANITMLLMQKYLKPDGVVGIDNTRWQADPILFLSATQSVSTVQELTKVSQAFYARSEYSQYPTDLPPPLIYQTPLVCTAP

SEQ ID NO: 23940 - protein, 64 aa, A.fumigatus
KTPFTFKLGKGEVIKGWDIGIAGMAVGGERRITIPPHLAYGKKALPGIPANSKLIFDVKLLEIK

SEQ ID NO: 23941 - protein, 94 aa, A.fumigatus
DEIGAEEGLLKNYLLYIYLAEFIDLYNNSETLLIEYLVYLKLSVLLGLVIIITITILALKSGKKYVKASNLYLYSSYKVQVRFQKAIIKYLSKI

SEQ ID NO: 23942 - protein, 244 aa, A.fumigatus
TVCLHPDSGPVMVTEALKPYGAEDMTLHFVSNIDGSHIAEALKHSDPETTLFLIASKTFTTAETTTNANSAKKWFLESAKDEAHIAKHFVALSTNEEEVTKFGIDKKNMFGFASWVGGRYSVWSAIGLSVALYIGFDNFHQFLAGAHAMDKHFRETPLEQNIPVLGGLLSVWYSDFFGAQTHLVAPFDQYLHRFPAYLQQLSMESNGKGITRTRRIPSSTPTGPILFPVSLATTANTVFFSWCT

SEQ ID NO: 23943 - protein, 127 aa, A.fumigatus
  UNSURE (14),(26): Identity of amino acid sequences at the above locations are unknown.
EVQAVPLPTPVDNXEIFFDFSKNFLXEETLAFLVKLAREAGVEELRDAMFKGDPINFTEDRAVYHVALRNVTNEPMQVNGKSVVEDVNSVLEHMKEFTEQVRSGEWKGYTGKKITTIINIGIGGSDL

SEQ ID NO: 23944 - protein, 213 aa, A.fumigatus
RYSPGAGDAFAVALHGELLQVGREAMQVLVERCYEVGLGAEEVAVPDAEQTTENRNVLLEGRLAEVLIHGVSTSKELVEVVEADVEGNRETNGAPHGIATADPGREAEHVLLVNTKLGDLLLVGGESDKVLSNVGFILGRFKEPLLRGVCVGGGLCSGECLGSNQEKGGLGVGVLESFGNVAAINVGDKMKGHVLGTIWLERLGHHDRAAIGV

SEQ ID NO: 23945 - protein, 143 aa, A.fumigatus
  UNSURE (106),(118),(133): Identity of amino acid sequences at the above locations are unknown.
VADLQIRTTDTNVDDCRNLLACVTLPFAASNLLRELLHVLKHGVDILNDALAVDLHGLVGDIAQSNVVNRTVLGEIDGIALEHSIAEFLNTGFSGELYQEGKGLLXEEILGKIEKDLXVVNRGGQRYRLNFSXRRRVLLKIFL

SEQ ID NO: 23946 - protein, 153 aa, A.fumigatus
  UNSURE (131),(140),(142): Identity of amino acid sequences at the above locations are unknown.
LGSPSASLFTSFGFNQPNYTSSQLMVIDFLFKLQCSGGPPPCNSCKTADAECVFDESLDLRRKVAAKRNLEELSYYRSLLYALLESLRNSDETELNEILDHIRGSPSLNSIAAIVAKPTIDPSDVSSEDLXGGSEESSSXAXTAEPVYLDIHS

SEQ ID NO: 23947 - protein, 74 aa, A.fumigatus
  UNSURE (23),(25),(34): Identity of amino acid sequences at the above locations are unknown.
EDIARFLHGYSRVYIEVYGFRGXSXRAGLLRPTXEVLGTDIAWVYGRLSHDGRNAVERWGTAYVIQDFVQFGLV

SEQ ID NO: 23948 - protein, 168 aa, A.fumigatus
TEFDEVAMASKALNELYGYKLSNSTKTGIRLSFSKNPLGVRSGQPGSMNASNHLSAQGSIPGGSSLGGIHSHMFSTVSGPPPGLAAPPGLAMPMALRNNGAMHLPGNPHAPMPTNGSFNSNSGLGIRGNNMNSLMSPTPPLTGGVGGTSTGSNVGGFNSFYPDYMLGR

SEQ ID NO: 23949 - protein, 75 aa, A.fumigatus
LQLLEDTQYNLIGGLAMLDIQYLGLSAGIYDPNNWRICGQSTHCQSINAGVLPQMYATFVAMATIARCSWVSARI

SEQ ID NO: 23950 - protein, 385 aa, A.fumigatus
TVLGKEGYFAHPSTGGSNSGRNPGTPSDGSHGHKGGVHLRQNPSIDGLTMGALPANSPVIRVIYTGGQTKVLDIKHCKTADEIILCVLKKLQLPEHQYRNYCFYVLDGLEPDPSNCRRLTDQELMEICEGSSRSERGRLILRKIHAGEPDTDELRRASQLALDESQMTHMNALSSSNVRNQIKIQQLTGEPWHHIKQPLSPVSARQPQAHNDHDQSLQMSTERPSVAKLRSFFGARPPSEMIIHELTSYFPGHQREDIEKTMRMSIRRSQRLSRAASRLSVLSNTSYASSLRDAPPIPSIADTWLNPGAPSTRASRPLSVSRFNLPQTSYRDSIASSSLQPLQEESPIEPNRKSYVSFDSGSDDPSNSRQSLLDVFTKGAGHRQA

SEQ ID NO: 23951 - protein, 149 aa, A.fumigatus
VSTFIKRRDEIKTQYARRYNYSRAQCEDPKVIKGWFNCLQQIQMQYGISYEDIYNFDETGFAMGLIATTKVVTRANMPGKPHLIQPGNREWVTTIECINTTGWVLPSCIIFKGKVHIEGWYQDQALSPDWRIEVSQNGWTTDEIGLRWL

SEQ ID NO: 23952 - protein, 255 aa, A.fumigatus
VSTCFPSDLVVLCILTEDRCCHRTFAFVVGFSTFLTNCIDYHKVRGSKSLNDILIKQCTTKMSLSSTFLLWLLTLFWIGKAFQCLLDITKLKHMHDFYYYLLGVSDTDIQTISWQEIVSRLMTIRDANPATAGAVSARHRKFMGSQSKQRMDAHDIANRLMRKENYLIALINKDILDLTLPIPFLRNKQLFSRTLEWNINLCIMDYVFNEQGQVRTLFLKDTHRKALSEGLRRRFIFAGIMNIFVFTHGDGRIRA

SEQ ID NO: 23953 - protein, 63 aa, A.fumigatus
TSSPHVADNTDNSLGLRSVALEFLYGLETLGAIFARHMNMTERLFEIFKQIRLHDEAPVPRYV

SEQ ID NO: 23954 - protein, 252 aa, A.fumigatus
QTLIQAAPEADPETGLYRLRDPSLSPTGSDTSTVGKSGAKSGVSPSPSTHSLSKMSRPGLRRSRSSAASLSTQSQSEQPSTSPPTSVPEGRESSSNISSAPTGIAGEVGQMDSHDFQVYKIPLTLKNKERWEDKHSPEIIVKAKYMPYRALRQQFWRLMLKQYDADDSGRIDKVELTTMLDTLGSTLKESTIDSFFRRFSSGNEPVETVDLSFDQVVMCLEDTLQALQTAPEGPWPTFRFLTPSFIVVQKTD

SEQ ID NO: 23955 - protein, 60 aa, A.fumigatus
ATFIRLSTHPDRVILDNSEVVLRLFTHEFFLEENSVNYSECFFPSPLLRTCFRMLPLSNI

SEQ ID NO: 23956 - protein, 72 aa, A.fumigatus
SLLSIFLLFFFISLITATLILGLTLPVSPRNGADAMAYGLHGRCGADGNLAQCCLSIILSALEPNRTANGLS

SEQ ID NO: 23957 - protein, 71 aa, A.fumigatus
  UNSURE (35): Identity of amino acid sequences at the above locations are unknown.
FFRLWNPTEPPMVSHRVPFLGSTISYGIDPYKFFXACREKASLKIVVRHSILRALLEYCFLNRQYGDIFPF

SEQ ID NO: 23958 - protein, 177 aa, A.fumigatus
  UNSURE (4),(7): Identity of amino acid sequences at the above locations are unknown.
YACXRSXGQDVLGYISGSTRVANLIGATLVDAAKTSAKVTMGGAVIVGLLNMIVLSSLRHYIPLLFTSDEEVIKLVAGVLPLCAAFQLSDALAANCNGIMRGIGRQEIGGYVQLFSYYAIAMPISFGTTFGLNWGLFGLWSGVAIALCLVSIIEMIFLTRADWNRAVTDALRRNAMA

SEQ ID NO: 23959 - protein, 163 aa, A.fumigatus
GVGDDLAPPGEDISAKIAYWRYGLNVAGSWKRKLRQQVPDSWTTVADNLAPPPQVDGLYAVYQGLNSSWWNDTSLTKDPRSLIMLQGILPDTPAVDAKVALATAQKVWEVWTDDKIRGWGRPVLAINAARVGSPERAIGHLTAYDYWVFHDAGMCPASAIAQS

SEQ ID NO: 23960 - protein, 86 aa, A.fumigatus
YYPIGFAVRGGDGKTLLPCDLLSPLTNSTYTGGTPPPFMPGNAGFLYAVAYMAAGWHGSHGDAPVFPSDGSWAVKHEGLRKAPYTL

SEQ ID NO: 23961 - protein, 149 aa, A.fumigatus
PADMYFGGETGIQWVAEPGRFIVSEAFYLVCRVLGTRKRLVEYVDGPNQNHYFHAELFVNDGIYQNFLNALVEGYIPTPIPLDPSGRPYGLPEREDKSYSYTIWGQTCCGADKIKSNCRLRCEMQAGDLLCFPSMGGRISVDCMHMIDC

SEQ ID NO: 23962 - protein, 171 aa, A.fumigatus
TYYFPSPGVLNKTQSVAVASQSLSYYLAQSRGRSLVSVRSFGRVSGVIATHSSAGRSLKVLTTPIFPPYLPSRGLSRSPEPVRMPASAVAPDDTLQVGIVPEATKSNDEPFQDFPSDPESDDEVPVEAEELQDALSRPPPANSSYLPLPWRGRLGYVSHVDSRILSDAGPL

SEQ ID NO: 23963 - protein, 147 aa, A.fumigatus
ACLNTYLRNANQPVFCSRTCRIASILENRHPLADPSQPPHPTKNRPDRDRTPDIARGQAYVESLGLANARDLIKILRWNDKYGIKFMRLSSEMFPFASHKEYGYKLASFASEVLAEVGRVVAELGHRVSVHPGQFTQLSSRRAGRDT

SEQ ID NO: 23964 - protein, 62 aa, A.fumigatus
PKYVSSSIKIEPNSRNDELCRRRAVSVDGNGNKKKTEGYYSSKITQGPKRLGWWVRRKETRK

SEQ ID NO: 23965 - protein, 200 aa, A.fumigatus
AFFPQTGPHSLAPAGQNSAEIEPRTVSFLRFQQQPTGFHPARSVSRWLGWHSPWGYQPQSQLGIQQLQQQQTGFQGLAPHPTGFEGYHRQLQPQQPMPTGINSILPPALQPQPTGMNGASSMPYTVTSPPPVPPIPQQPTAAPLQPQKTGPPPPVRFGVKHDAPKKLTPQPTGLRANLAQASEFSPLPRRAILPPFGQGH

SEQ ID NO: 23966 - protein, 170 aa, A.fumigatus
  UNSURE (30): Identity of amino acid sequences at the above locations are unknown.
ELWRLTLAHSYSLVVAAFAFHWIPVNHDLXVIHTQQMNWASIFLFVTIIIYVAFFAAGVAPIAWVGTEFLPLEVRALGTMMNTVTCWGCNIIISSTFLSMMKAMTPSGAFGFYAGICFVGWVFIIFCYAEVHNMPLESVREVYRHGFGVKYAKQLQRQRILQERQKPVDA

SEQ ID NO: 23967 - protein, 82 aa, A.fumigatus
ELVQCQRTAHCALCTVHNLREMEYNQKDTQPRGLSNTVDFTIDNAMEKDGEDEFAVSRLLIVVAGWRLDEQGNDLHSWGWII

SEQ ID NO: 23968 - protein, 60 aa, A.fumigatus
YPLKFIVIFLDLLPAVLVIYYILFIVYYMLFLRFNLGLIFQVLIYISFYPLFNLFKGLLI

SEQ ID NO: 23969 - protein, 323 aa, A.fumigatus
RPPGYPRVLGFRPSAAFFQPLNGFVLGGNASNPFRPRAGSVLSTPNHFGPIGVGGGWQSKYIVSPSALSHPTAVLSSIRPKKKLKALHWDKVDTPQVTVWAIRDPTPQAKEQKYSELAKKGVLDEVERLFMAKETKIFGAGSGAKQRKDKKQIISNDLSKTFQIALAKFSQYPIDDVVRMIIHCDPEILDNMVVMDFLQREDMCTIPENVSKLMAPYSKDWTGPDAASSEREQDPTELTREDQIYLYTAFELNHYWKARMRALALTRSFEPDYEHLSTKIREVVRVSESLRDSVSLMNVLGLILDIGNFMNGLHHGAGRSRAI

SEQ ID NO: 23970 - protein, 62 aa, A.fumigatus
CNNNLDNELSYTMARMHTCEILPVLFLINRCSRFERQEFDWGSRCGAYSELENARPYSVIDK

SEQ ID NO: 23971 - protein, 69 aa, A.fumigatus
RTALVGWGRTQTDPAFGATYDSTSIKAKSVNLIASVRTVMRSKLLSILPSIFACSVASLDRKLGYMGLS

SEQ ID NO: 23972 - protein, 200 aa, A.fumigatus
QALLVFPKSARRFTSRRSNLVTQLICWKYRSILSGTQKIASSGIMRYSWLIGAVCAAGALAKPVDKRSYVTDWTIVTVTETITLPYQPPPTSTPAYSPIQAVQLTQTVTTVDPAPAPAPVEPETSSASPIPTTEAVNTAPVGVVEELPGAAAWASAWTSAWTSAWTSAWTSSAPDAAQPTTLATSTSTTAPASVPTAAGS

SEQ ID NO: 23973 - protein, 159 aa, A.fumigatus
PHSTKLIFSSDFSVPGKSNSFGYVPSKANYIRPGKRPLSSITPAIVTRPDGKLFFLAGSAGGSRIITATVQNIIRVIDQGLTAAQALAQPRLHDQLIPNQVSFEYTYDNSTVDFMKSRGHNVTWVAPGQSTAQAIRVLPNGTFDAAGEPRQLDSGGFSI

SEQ ID NO: 23974 - protein, 72 aa, A.fumigatus
FHFPYIHGYKVMNVNWLNNEVYCHLNYIYAMIREIDLHSNNQIEKPPESNCLGSPAASNVPFGRTRMACAVL

SEQ ID NO: 23975 - protein, 124 aa, A.fumigatus
SIASFNGDLSSLTAPPFILSGTSLTEYSAYWAEHPSLFVAAAKEADPEKRALAVLKWFLSTLRQQYCSRSEKLGSEKKPLNPFLGELFLGKWETDPDAGETTLISEQVRFVFPWLAQRRPDTDP

SEQ ID NO: 23976 - protein, 169 aa, A.fumigatus
  UNSURE (114): Identity of amino acid sequences at the above locations are unknown.
LQGYNAQKASFSNTIQIKQIGHALLTITPPSADKNDPAQKERYLITLPYLHVESLIYGTPFMELERSTMIASSTGYIAKINYSRQGWLSGKKNTFNAVLYHEKHGERKPLYTAXRQWSDTFLIKDARTNKEDRPLHWQRLEDHPVEPLPSGRTGSIGEAGKLGAKSLSP

SEQ ID NO: 23977 - protein, 67 aa, A.fumigatus
GSSIYHSSEAGIFVNSIASIYRGCKIPYKFAKLFPRPIVNSIPDLVPSNVSIDKKSLVYWCRSRKCQ

SEQ ID NO: 23978 - protein, 147 aa, A.fumigatus
QRCQPLKNDRWRIPKSRYASNSTYISQDPRLRKEYLDPELIVDEDIKKRLIEGGMDDLLATHFAHLFIRDPLVIFSEDLDELDLNKADHFENLQSTNWQHMRFKPPPPDKADIGWRVEFRSMEIQMTDFENPAFSILHQRLEGSTMV

SEQ ID NO: 23979 - protein, 178 aa, A.fumigatus
RGSAASVEKTDEGANPHIRFPTLAANIRSRRGRKVELNVPIFVDKNTPVPFKDPTVDYDLHNWPEDDDVRNGAAKEGHVYMDAMAFGMGSCCLQITFQAKNITEGRKLYDQLSPLGPILLALTAATPIYKGFLVDTDVRWNQIGNAVDDRTREELGELVRNLASSVYRRNGINKDASL

SEQ ID NO: 23980 - protein, 256 aa, A.fumigatus
MRFFQPLGVKTNQASLTAFVMSRSIVLHFAPASIHRLSCLDPFPLLLIGMSNRAPTFLRLVGVMTGLAGEQGRSFSIGYRHTAIHGYQHYWLTGSFFSQLQEFFLSLLSSATTKREAKSYLARLKAQHPKSPDANKPEPEKSATAPTLPSGVNLGSFYGASRSVYESPVFRQGPSPSAPPSLEPVERLHLALVRLSTPQSLDDNIIDGVAKTLSQLNRLGLTCCVVVDPGTEGVASALRQVASLHHGAGRIRGGAF

SEQ ID NO: 23981 - protein, 70 aa, A.fumigatus
ARSTTSLLNSCRSLRTTTSNIPQTNPLLLRPMLLLLNLPSIPSYPKALALLLLSLLNNPGALLFRGMSIC

SEQ ID NO: 23982 - protein, 140 aa, A.fumigatus
TTLFWLSLLSSATLRSTPKLGPEKLKEMRSIAHVVWALTGFGIPSAMSLSIPSPQQILKSWSGTNNICPLAPKVEVPEDGLLSALRYVQNETIRLQQVDRLSRAVQIPTTVNDYMTDPFDEGFAPFVEFQELLESLFPLM

SEQ ID NO: 23983 - protein, 68 aa, A.fumigatus
LERNPSRQRRLAATYARVTIAGGFHKAIKPIVHAAVIVASDQRATGWENTNGIVLRAPVVSATPSRKS

SEQ ID NO: 23984 - protein, 217 aa, A.fumigatus
SARQTSPMPRQRSKGRIPCKIRRKKCDERKPTCVACVRNVLLCAWDSESPPSQPHNSSSRGLKAKSPRLGRHQLAPKRMSSDLALSAAPNLIHPQLAHPKTNFLYSFFYARAAQTLSIRDREGNPFVHVLMPMAATSDIVFQAMLAFSGVVYEQQHSSNLATTTWEHYAQAIRSLKHALTLYVDHQVDRGAELVATVLLLLALEVGRICPFGSGWSR

SEQ ID NO: 23985 - protein, 228 aa, A.fumigatus
VMIADDRVVICGSANLNDRSQLGDHDSEIAVIIEDYTPVQSTMNGKPWTASRFAASLRRQLFRKHLGLLPTQDYQRPDANSEPVGVPNDFDFEAPESQIVADPLADTLQSLWNTRARTNTEFFRKVFHAVPDDTVRNWATYREFYSYYFQNADKASYGKDEKVKPPRYEYGHVVRDDFPPGPEGVRQVKELLSQVKGTLVEMPLMFLIEEDVAKSGLALNDLTEPLYT

SEQ ID NO: 23986 - protein, 62 aa, A.fumigatus
CGPTYCTVYKKSKTMMFAMIKDRPQMETAEMKEVLFTQLEILEPNLPLLSEENTRCRPLDID

SEQ ID NO: 23987 - protein, 303 aa, A.fumigatus
  UNSURE (256): Identity of amino acid sequences at the above locations are unknown.
RCEYWPLRKLATITDSDIERILQAYSAGKESASDMNRTALLSKKGKIVLAGSGPGHPDLLTRATYHAIQNADIILADKLVPAPVLDLIPRRTEVHIARKFPGNADQAQEEFMQMGIEALRQGRYVLRLKQGDPYLYGRGGEEFEYFRGEGFTPLVLPGITSALSAPLFADIPATHRGVSDQVLVCTGTGRKGAAPEPPTYVPTQTVVFLMALHRLSALVESLTTLPVADDGSPSENSLAQGYSMPPRGTGLMLRLXGLFVQLLKNFCFTFGSLRFSPLPGLLPGPEPLGLFLPRTERPKLELV

SEQ ID NO: 23988 - protein, 173 aa, A.fumigatus
SMQRHQEDDCLSRYVSRRLWSCAFPSSAGADQNLVRNTTMGSRDIREQWGTERAGDSGKNQGGKPFASEVLKFLSSSTIEIRIPLLQPEYVPPLTQGFDSHLHKLFLRLIRVSGEFSRNMDLGPAWYQVQDWSRHKLIRQYNVCILDRMISCASEQIGMARTRASQNNLSLLR

SEQ ID NO: 23989 - protein, 63 aa, A.fumigatus
VGGSGAAPFLPVPVQTRTWSETPRWVAGISANNGALSALVIPGRTKGVNPSPRKYSNSSPPRP

SEQ ID NO: 23990 - protein, 73 aa, A.fumigatus
IFIITLEDLKATLRIRKAQKEDPTNLLPNKFKDYANIFSPKKAKRLLLYYLYNYNIKLLEGKTPLFSPLYTMS

SEQ ID NO: 23991 - protein, 215 aa, A.fumigatus
FDQRRPSSPVVKTVAPTVFIYPGVYEEQLVLNRSGTTILIGYSTSTFDYNSNQVTIQYNAAVDTQADQSNSDSATVYATGNYFQAININFVNDFGTTKNYASLGFAVKSSKYASLYGCQVKGNQDALLINGYFFASNSYIEGNIDMIWGSGAGYFLKSAIAPNKDGINLTAHKRSTNTSAAGFVFDQCAIVPSTGAGTMSDISLGRPWNSLALVA

SEQ ID NO: 23992 - protein, 117 aa, A.fumigatus
VDSYLDSCVTAAGWEQWSSSTPNTDGLVFGEYGNYGPGASTAQRASFATQLDGSGVSQFQLSSFFAVTSWIYFTHVSGTPFVPGNIISTSVPVQSATPTSSTDGSTLYCDNHNDRDR

SEQ ID NO: 23993 - protein, 89 aa, A.fumigatus
  UNSURE (63): Identity of amino acid sequences at the above locations are unknown.
SAQVCLCSQRRRPRVPMVPPFTVTTTMTVTDKETLYTTLTSADKTSTTKYTVTEDVGTTLSAXQSFKTTTQKNYVTDTVIVTEPTVNEH

SEQ ID NO: 23994 - protein, 87 aa, A.fumigatus
LSHDVHYMHSFTLKVLDLILEWIYQAMSLTSMLPTSKLLSSLKKGNSKLYTKLPTKIDSMALSQLIASITNDLSAFGKWSQVNMYHG

SEQ ID NO: 23995 - protein, 63 aa, A.fumigatus
LLPIVKEAGRKPPPFPFIFFKPNTCVHDHGEPVVIPRIAQNDQADYEGELVCLIAFFLPSTIS

SEQ ID NO: 23996 - protein, 84 aa, A.fumigatus
RLDGRILRGEPILPAESTIDLGFVTDADQLQARVIQGQDIYNTTGETKVTDEIVTVKQILSPLAPSDVPIIRCVGLNYAKHSAL

SEQ ID NO: 23997 - protein, 78 aa, A.fumigatus
PRRARGDPADRAERPSGLRGRIGLSHRVLSSIHDLLTRLQCLVIGKDAKDVPVERALEYVAAYTAATTFFSPAGRDQR

SEQ ID NO: 23998 - protein, 122 aa, A.fumigatus
LYRLAQWITDDKPRVILIDRTWDFIGTEGTTTGKCCSMPSTTVCSGGTSKGQAWIQDHCDGGSWVSCKYDNAALTPLDVGSNKSIVGVGNKGVIKGKGLRVRNGNKNVIIQNIHITVSLCIP

SEQ ID NO: 23999 - protein, 132 aa, A.fumigatus
SKQNLNPQYVWGGDAITLDNADKVWIDHNKVRLRLPAPTAKMTLTETGRSPSSAANSSSAAGAKRATSPSPTTNSTAAPPGPPAAMASTTGLYSSSASRTTTPSKATGCTTCPAAPRTWEPTTPSRRSSSTA

SEQ ID NO: 24000 - protein, 179 aa, A.fumigatus
CHHPRQRGQGLDRPQQGTSTSSCPHGKDDSDRNWQISLIGRQFIVSGWGKAGHVTISNNEFDGRTSWSAGCNGKHYWTLLLLGEQDYYTFQGNWLHDVSGRAPHMGTDHTKSQIFFHGVNNYFQNVGGHAFDVDTNTWVLLEGNYFENVNTPLTDTSLRAGGKLYTTSSSPRDWQVRVC

SEQ ID NO: 24001 - protein, 199 aa, A.fumigatus
GPCVWSSTQFLPLFSDMFFADKERFIDSIEKDRLLTIARSAFNIVTVFLASPALVTPNLPMFIYTTIWYGLLVLSKLSLLSDTATESKVVYNKDVSNLGLAAMQKMETMSRGDNVWDNCRAVIGSMISWLESSRGQPQSMQAPGNTKDAGDAHMLPQPTPEDAPRPTESAAVAEDWDATVRQQMLQDLTWIGLPVEQQL

SEQ ID NO: 24002 - protein, 226 aa, A.fumigatus
INIPKMIRACEEANLWPELVFLYCHYDEWDNAALAMMERAADAWEHHSFKDIIVKVANLEIYYRALNFYLQEQPLLLTDLLQVLTPRIDVNRVVRIFQSSDNIPLIKPFLLNVQSQNKRAVNDAINDLLIEEEDYKTLRDSVDNYDNFDAVQLAQRLEKHDLIFFRQIAANIYRNNKRWEKSISLSKQDKLYKDAIETAAISGKSDVVEELLRYVCLSLIDLFFSP

SEQ ID NO: 24003 - protein, 89 aa, A.fumigatus
TRCAMLTLQSTNIGNAKLAGLQKDLNMTNDQYNDSLTIFFISYSVFEPITNVLLKRWRPSRFIPAIMFGWVDATCTCSKFELMESRAYA

SEQ ID NO: 24004 - protein, 117 aa, A.fumigatus
WRCVASYSSFIDQAPMPVVIRYDINNQQVRWFLGLTEAGLFPGVGYFLSCWYKRTEFGVRMAIFFSAAALAGSFGGLLAAAIAQMDGVGGRPGWSWIFILEGLATIVNWRPVPLDSP

SEQ ID NO: 24005 - protein, 60 aa, A.fumigatus
LVETLLYFADFKLTASAQLPFKVPTASPLAHRQQKSVSQPRAIFLTRPNCQQNRMKGSLQ

SEQ ID NO: 24006 - protein, 248 aa, A.fumigatus
DAYFLIRRLGNDLNMCGPHLLNRISRFILIWNVGSFIITMIVLLATNDHKQPAAFVFSEFQNFTGWGPAMAAIVGILQSCFGMCCYDAPAHMTEEMKSASKEAPKSIILSVVLGAVTGFAFLLTLCFCIGDINETASTSTGVPVIQIFYDSTGSKVGACFLSSMIAVIVIVAGNNLLAEGSRSVYAFARDHGLPFSKVFAKVESKRQVPVNAVLLTLAVQLALDAIDFGTTTGFETVIAIATEGFCMS

SEQ ID NO: 24007 - protein, 119 aa, A.fumigatus
SSIDLSYAMALFSRLLGYVTGYQREMKGPFSLPPWISITLNVLGLLFLLFASITFNLPTQYPVNRDSMNYTSAAIGVVALISLVTWFTTGQKHFTGPGGMSVLHGREEVAQSEAEVEKK

SEQ ID NO: 24008 - protein, 73 aa, A.fumigatus
GKIALYLNPHHGDPSMIDNGLRPERLFFESYNFHDCAVLDIESVNYSVGALALVREAISTCPSFAGIICHGLR

SEQ ID NO: 24009 - protein, 66 aa, A.fumigatus
TSRYWRPSILWRCSPKTLPTMYALLRRWAKTLAYVLHTKSGQKYGSYLQAYIVRQFLLMYLNHCVR

SEQ ID NO: 24010 - protein, 70 aa, A.fumigatus
GTNGLPVVPKTAENFRALCTGEKGVGKQGKPLSYKGTTSVLSLQVRFRVLRFELRIHFPPCDQAVYDPGW

SEQ ID NO: 24011 - protein, 76 aa, A.fumigatus
SIAKKGWSSPLRPSIPQLFLTNFSHFLTQHFHSATVCLYYSLLSTFIHYCTTSSAQSWLRLNVRTAPSSVGFWASG

SEQ ID NO: 24012 - protein, 194 aa, A.fumigatus
ATRVRPPSCLFRCDSESYGSSLGSIFHRVIKQFMIQGGDFTNFNGTGGESIYGEKFPDENFELKHDRPFLLSMANSGPGTNGSQFFITTVPTPHLDGKHVVFGEVINGKSIVRKIENMPTQADKPTTDVTIVDCGELSGEDYENATKQVADATGDPYEDYPDDHQGEELNAQVCFKIASELSSPRGRRSANGWG

SEQ ID NO: 24013 - protein, 78 aa, A.fumigatus
RRMVLRCTRPNSFAFGIDDGQPCFAQEVMAILQKENILVTFFVVGSGLRDEETNFTQVYREMLRRGHQIALHSNTHRK

SEQ ID NO: 24014 - protein, 73 aa, A.fumigatus
PCPKLWLNMPAKGSAARYFRPPFGTIGSRTRQRLAVYTSDPQIVNWSVDIEDWLWGDTETPERQLEAFYRDVR

SEQ ID NO: 24015 - protein, 70 aa, A.fumigatus
TLSWHIKPKLRTRSPTLNSQETPECSDIPDDFVVDVFDGLQTFHPSTIVSAGKRSCKGAHFRCVLEWRAI

SEQ ID NO: 24016 - protein, 202 aa, A.fumigatus
LLSTSFGKFGSHYLKREFYFDVHPPLGKMLVGLSGLLAGYNGSFEFKSGEKYPEDVNFTFMRVFNAAFGVACVPLAYYTARELGFRKATVWLISLMVLFENSYATISRFILLDSMLLCFTFMTTMCWAKFHRLQHASFSGQWFTWLFLTGISIGCVCSVKWVGLFCTALVGLYTIEDLWNKFGDLRMPKVSTEGSSRRLLCT

SEQ ID NO: 24017 - protein, 236 aa, A.fumigatus
PFEQTVLVNHLLARVVGLIIIPAVVYMLSFYVHFWILENSGPGDAQMSSLFQANLKGTEVGKDSPLEIAVGSRVTLKNMGYGGGLLHSHVQTYPDGSNQQQVTCYHHKDANNDWFIYPNRHEPEYDASGPLSFVGDGDVIRLIHGQTGRNLHSHAIPAPITKSQYEVSCYGNITIGDDKDHWAVEVVDDVASRDRSRIRTLNTAFRLRHIVLGCYLRAGNVKLPQWGFKQIETTCV

SEQ ID NO: 24018 - protein, 223 aa, A.fumigatus
KKQGPPYYTPPLFGNGITIYYDQLASNMESPTPFESFSFRGNRIIAYLQTLAKAKKGLPHGVPVCVSPSHTITNTESLLTLASLVGPHVAIFQVHADIIDDWSDETVRQLTLLAKRHAFLIWESGRILNATVDVVGKTTTESREVRNELVDLIRKKYTKGVVKAASWAGIATAWASGVTVGNQEADILIPTLKAAAREAVADSVQTIRTEITAVNAPTESLVN

SEQ ID NO: 24019 - protein, 296 aa, A.fumigatus
DKCDGLRPSCSACRASGQTCSYDPHAKKRGLPEGYVRGLEKLWALSICNIDGFEDTMLALLGTTPDSAGRRDKLLSMWMDDSASETLHESWKTSRLYGTLEKMLSHSDMSSSHGSSKRPRDDNDTGALDSTSGWGFRLDCSSTPLAHDAPRVVRLSSSQNVKRPRLSQLGDGVSVSQTTGRPQPLKLPPQTSQLLDTYFAVTHSWFPIVAKHNILRASYLYASAPLSVESMSPGSGEHAALWAVLSYTVSHSRTNAPDGAFDALATTNEYYPIAPRLIPSENGTLRPWACAGAAGC

SEQ ID NO: 24020 - protein, 111 aa, A.fumigatus
ACLCPGRRKRKDTTYVEERYHHHAHGSKPEGRTWLGTRPSASEGGEKKSKWGSLATIGIILGALALCLGLRRRKDEDEKSDYTYPSSYYYYSDYYTSASMSPLLLRLAVSS

SEQ ID NO: 24021 - protein, 279 aa, A.fumigatus
  UNSURE (272): Identity of amino acid sequences at the above locations are unknown.
WHGPFQPRVKTAHVRSRLEDLDIKTIIPYVVGHTTHVVQSKRNTAKGLQALVNGKYIVQDSYIDALVYAATPSDLETLESLSPLETDFDAAWPDPTEHLPPPGKEAVPRPAEAFVPRADRINIFEDYTFVFWDASQFSNLQDPISNGHGKALLYPLENGVTTAEEIVQFMKNAAGQKGLGGERVGRGGVVLVRFRSKGEWEKWSIELSNQVALMTDQRVIEQNEFLDAILANDASCLCQPLPEAESSPEVGRTPTSQPPTTPNEHVEVIGDXQVIKGGE

SEQ ID NO: 24022 - protein, 91 aa, A.fumigatus
CVLRGESEPRVFAHMGMFGSCNFLRPCSDNHQCMAVECVAVSIAMYCLIQFYYQIKDDISQYSPLLKIVSIKLVIFLSFWQSVSRALSSDS

SEQ ID NO: 24023 - protein, 130 aa, A.fumigatus
SSDSMISTPRFCLPLYTRLGLMSGPVLSSIIRILWMIPIYSLVAWLSTYFYKNAVYYELIGNSYEAFTIAAFFALLCHYIAPDLHSQKEYFRGITPKQWLWPIPWLQKCCGGEKGMWRVPRSGLTWFNVS

SEQ ID NO: 24024 - protein, 175 aa, A.fumigatus
TPVTSAFANTSTVSPFGSLGASKSKEDDGPTKPAAVTSASAFASSSLAAFAGSEQSPFGSLGASTPSVFKSPAASETEKPAAAGFAAGANTSGFAALGSGFSVFSGGFGTAAKPGGLTSFASPAAPSPFGSSTKDKPFGAADADEEEEEEDEAETGPKEFEAEKPDERFFERQSM

SEQ ID NO: 24025 - protein, 125 aa, A.fumigatus
YCALWTASELTPFLSTTVETGEEQEKTYFSGKAKLFQFTNKEWKERGIGTFKVNVRVTDGQEDKKAARMIMRADGVLRVMLNTPLFKGMKVGDPSGNEPKSKQIHLAGGQGRPYCPPPAQGKAFL

SEQ ID NO: 24026 - protein, 150 aa, A.fumigatus
MAWTTDAQQSADTNNAMGLGGGSNSRSSSRGRKRSFDDDEAESDGEEHGHRRKRSRDSTSEGDDQPPRSENDLPRKILSPKKKRSRDKLDEDGSGERATEKADTKIENMESEQKPESEGQPEKKRHRDNSTERKPVRVDRHIVSLAGKGR

SEQ ID NO: 24027 - protein, 73 aa, A.fumigatus
  UNSURE (41),(65): Identity of amino acid sequences at the above locations are unknown.
ENESGTVRNHSIIYYLLATSDSALWVREMLGTDNKCQDDIXCKGEDPARYPNRLLNPRGGPGYVXHEDSNGFQ

SEQ ID NO: 24028 - protein, 75 aa, A.fumigatus
TRKRLELENITLCRYGLNFIAWLIDVSKSAEIHLGAFWPGVPKTRRVVLRSSQSNVKRERDSKPQNVERACGYCT

SEQ ID NO: 24029 - protein, 94 aa, A.fumigatus
MADTLAYSFFSTNFLFQYTFNSGKCLVWIMYLTTWHSCIMARTPPMLSFSHNRFFSIDPAALDSASSSGDNMKHDTDVESLVSSLTSILAFGSP

SEQ ID NO: 24030 - protein, 73 aa, A.fumigatus
VLKHMLANQKPLLRLSKACLDMSKVGFKTYEPRRSMINAVYYRYFRVMLKPLLGRSKSHNEYRLMQQGGHVSL

SEQ ID NO: 24031 - protein, 66 aa, A.fumigatus
MIPWDSCKYSCLRGLLVAAGRLGSSAYKCNSVPFSQVGFASLEASLDSMTLFYSKSWGSSLTQSMV

SEQ ID NO: 24032 - protein, 145 aa, A.fumigatus
GHYRLIPDAFPLSTMILLGLATTAFDAEPDSARPDNADQMTSHNLAQTCWRRPEVARAGNPESSSAYNSACAMVLLRQKIQHVSFNYREDLLRFEHLVDRAVSFSFLNQRTSHSPLGEVQTDLILNFLPGEPSSHQNLEDIVFSR

SEQ ID NO: 24033 - protein, 196 aa, A.fumigatus
  UNSURE (6): Identity of amino acid sequences at the above locations are unknown.
RRLIEXARTRGEDFEVINPLFLLTAKPVVYLVNLSEKDYIRQKNEYLPKVFEWIQKNSPGDPLIPISVSFEERLAAFGDDARAAEECKALNTKSALPKVIVTMRQVLNLASFFTTGSDEVRQWTIRKGTKAPAAAGVIHTDFEKTFIQAIVYNYTTLREYGDEAAVKAAGKIMTKGKDYVVEDGDILLIKAGAAKG

SEQ ID NO: 24034 - protein, 144 aa, A.fumigatus
VGTAISYWRLKLANGMPFGHRLWCDVQVRDSMAASTKLEPVGEAPRAPEQQAEAAPVDDTERTGSQMIFPTLDKESPVGSAHQAMVEAPLTAPSVSNPSEHDILEDVETLTLDDTNTETGFLTDEEYDVLDASDQDYLEAQSRV

SEQ ID NO: 24035 - protein, 214 aa, A.fumigatus
  UNSURE (74): Identity of amino acid sequences at the above locations are unknown.
SSWAPKKGGINPGHRYDRAGAKAGTDQRLAYGGHAAPVMWTAFHPAKGPVDLGDLMLSSSLDWSVKLWRVRPPXTTAPATSAAIATTQVVSPIFDLNREDVVYDARWSPHRPGVFSLVDGAGNLEVWDLCSDTEVPVVRTTPTRGRGGILTRSLNKVAWEEREGKHLATGGLDGVITVFEVGKGLSGTPEEVPSDEWTAMKRLVGKLEQRDRVN

SEQ ID NO: 24036 - protein, 171 aa, A.fumigatus
RPESGKEESVERIKEEPADDDADVDMERSYNDIEDEEDLKERIKREDSQLQQISGTGLEEETTLDQGLGATLNMLKQRGLVKPSDAVEHNALLRARQRFLHEKIHLETEAEKRARQQRERDRASGKLDRMSAREREEYARWENKQRDQQRCTTHGGSLQQGIQARCTTQVR

SEQ ID NO: 24037 - protein, 175 aa, A.fumigatus
ICSSNAAWSSHPMLLSTTHSCGLVSVSCTRRFTLKRRPRNALGNSVNATEPLVNLIGCRPVSVKNTHGGKTSNVTNKDARHMAEVFNKEYKPDVQLKYVDEFGRLMNQKEAFKHLSHQFHGKGSGKMKTEKRLKKIEEEKKREAMSALDSSQHTGMNNAMGATARKNRQAGVRLG

SEQ ID NO: 24038 - protein, 72 aa, A.fumigatus
  UNSURE (62): Identity of amino acid sequences at the above locations are unknown.
GADSLVNPASDRILRSLFVKVSGEANSVNHNPHYGRLDSKLKVVTPHQQWQERMLTVSISLXYETHHTRCCL

SEQ ID NO: 24039 - protein, 191 aa, A.fumigatus
ATWSCPSVVLLFVADRARPRSSPMEVVNGVEMPSFRGDNINGFAATAESRRPDPSRLVSAYFHSAATLNYMRASLSSGLADLHSPLDWGLGHVIEPSIKEKYERIVNRVKDALRFMHTVGIDTDRGVETVDVFTSHQGLLLEFEQSFNPLFVQPTYHNFHNPQGSLLRHLPETFLWDRGNAPRPTSTGAHC

SEQ ID NO: 24040 - protein, 68 aa, A.fumigatus
ASLWVVKVVVGGLHKKRVKTLFEFKEKTLVAGKNVDGLDASVCVDSDGVHKTQRVFDSVDDALVLLFD

SEQ ID NO: 24041 - protein, 98 aa, A.fumigatus
  UNSURE (95): Identity of amino acid sequences at the above locations are unknown.
ARPFKYSLISLFLPIDTHFLCTTTVLIIMASWLQIPKNSPFSLANIPFGIISSAKITSPVAAVAVGDYALNLSIFASSGGFSQLPVIQPHLGVFXQPT

SEQ ID NO: 24042 - protein, 99 aa, A.fumigatus
TSRTEAVKGALPVGQNSPQKAPYGLYAEKLSGTAFTAPRHENKQTWVYRILPAAAHENFKAEDADSYHTSMTTETHKIHHIPNQVRVFTSDRPSGLAKK

SEQ ID NO: 24043 - protein, 78 aa, A.fumigatus
RLLAFSCSRSIWFLRRPDSPSQPDLIVVYLPFNVPVNLQIFDIMPVTQFSHPDPYSYQTGFDSYHEYERKSLASIYRS

SEQ ID NO: 24044 - protein, 86 aa, A.fumigatus
SDNTSSWVERTFSGKRAQDSSVKEWLCGPDGLIETMTIGNWYKLLTWSTPVFQLVEGFCSLLVIQAAGQITRWLVNRGGRSDSWMV

SEQ ID NO: 24045 - protein, 197 aa, A.fumigatus
  UNSURE (183),(197): Identity of amino acid sequences at the above locations are unknown.
MDANLHLQIALLVLSASIISSSVYFLWRVLQFPEISNVDAALIGVSITCAVILCAWGIGSGRGNPVESSLLFAYVVLCIYQIFTDYQPSFPVEQGSSPSQTGDFPPLPPIIMASYSTLMHALSSLPSIIHAAFNVITAVFSAVTPSVLISLAYRIFVLYASTRIIPAVRESGARALSQEASLXDTDAAGSFLGFLSX

SEQ ID NO: 24046 - protein, 299 aa, A.fumigatus
YLTNAEIEVLQTPLQEDCGTRSPRTHNYWSWVVGMISPEECSDGSVSNHPCRNLRKIKILLQEFERTGKHVDYYALDLSLSELQRTFVEVSSDEYSHVDLHGLHGTYDDALAWLSNPQNLQRPTVVMSMGSSIGNFSREGAAEFLAQFARLLKPSDLMIIGLDACTDPDKVYKAYNDSKGITQRFYENGLLHANAVLGYEAFQLSEWEVVTDYDVAGGRHRAFYSPKQNVTIDGVLLQKGEKLVFEEATKYSPQQREQLWRDANLVLCEELGNSSEEYRKLVLASRSAVVAEMYGRSVD

SEQ ID NO: 24047 - protein, 267 aa, A.fumigatus
DRGCGFPGAMPSKQTTASGNGGKQIPWAQITSFPEDTDSDVIRLDFTFSYHPWSIGQQLYLCFPDLSIWQSHPMTPCSVLTPGREQTHTYIIRAKAGLTRQLALLARSDQPSTSIVLAGPYGQSILSTELLQKDVNILCIAGGTGVTFVLPVLLQLSRQTGFASRRGLVEFIWVIRRKADMEWLQSEMDELVAAAELCANFRSRVFVTREGDASTQAKAQDLEKKVLVSDAMQRTESTASQDGEAPFTVQCMGSNSGDGGFARGVLH

SEQ ID NO: 24048 - protein, 78 aa, A.fumigatus
SPQHYADFAPRETRKDSPKTSGILRAASRPILCNAGWYHSSAPAGVYDQTDTDTTEDYIWCEGAEQEIGVAFIPQGSG

SEQ ID NO: 24049 - protein, 159 aa, A.fumigatus
HAACVRCCHWPDADGQHPCCAAGCRCIPIDGWGMTPLHYAAENGHRNIVRIILDSPGTNAWHTSIYDKTPLALAAERGHLDIVKFLLDSRQQVPGDAVWKALSPASSARAKFQLGLETLQSRGEGISVKERLLRDTYSRRLNEVRDILLLFCDYLERGN

SEQ ID NO: 24050 - protein, 368 aa, A.fumigatus
GAAPSSPVVKTKTMKPNFKFVKTVRDDEVPTHLTVPQKYVILRGYENAMPALLEFVTKYVEGEKENPNQRPFKAIVYFNSTVQTNLVYETFRNIVEQRHHPLRRVRVYEIHSQLTQARRTRSSDFFRAAKSAILFSSDVTARGMDFPDVTHVIQVSIPRDRATYIHRLGRTARANKTGEGWVLTHRGELPEFLKQLEGIPLNLDKETFATATVDMTKPELDPKSPATRFIQEIKDAVREVPESLKRRAYTSLLGPLRGYFARKQDLIQAINNCVVHGYGLPVPPQLSPTLARNLGLDRVPGVRIANYRGSSDNMSTRPDYRGGDRDMWASNSRRGREFNSDRRESRFGNHRNADDFFGGRRRAYRDDY

SEQ ID NO: 24051 - protein, 64 aa, A.fumigatus
SSSAHADGCSWPDISAQLLRYVADRTGILSFANVPLLWLFAGRNNIIYLAYRMEAFRTFNIFPI

SEQ ID NO: 24052 - protein, 65 aa, A.fumigatus
  UNSURE (48): Identity of amino acid sequences at the above locations are unknown.
ASCHHGCQRFPSFFNIAEAYLQDSSCDEKRTESHFCCTGSCQVEFLLXVQTPRALVALLTRMECP

SEQ ID NO: 24053 - protein, 78 aa, A.fumigatus
EAITITKLGDPYRQVEWPVASMVYVSRWIHRYAVSQMILACVSDMVGIWTLMGLETLVDAILTLLYKYRRTNLGYPCG

SEQ ID NO: 24054 - protein, 161 aa, A.fumigatus
TVDATEEVQSTLYIASSSQWFPLPLALGISPRAYKIKQTSMTSPAYSHHFSINNLPFGVASSSQHPQPQCVTRLGNTVIFLGDLQRAGLFREVTSLPRGVFDNRTLNAFAALDKQVHKHVRQALQSALQDSGVKKLPIGSTEPITAVRMHLPVSIPAFTGK

SEQ ID NO: 24055 - protein, 141 aa, A.fumigatus
HLADFSCSLNHVKNAGRAILNDDTPPPGFFHFPIGYGGRASTIVPSGTPITRPLGHFYDRSAGIEKKTVAYGPSQAMDYELEIGVVVGTPVPAHRGLDATDADEHIFGLVLLNDWSGEPPPPFRRYVFTTGLEGSAVVQMG

SEQ ID NO: 24056 - protein, 343 aa, A.fumigatus
STTQTPPSVSTRIQSRVDPAAQKASNPQSLTSTAQNQLNKSNTTMENTSGSATPKPRADPSDKPNRPVQVASPTDQNGSQGDKKRKLPAEENASEKSQPAPDRPVSKRKRMEERHQKLRKRGRTPPSAYSRRDAEETSSAADRNGPTCRCTSPLPPPRSHTPEDQPRQRKRPGGGARMGLVDRETLRRRQEERERAQVEEAMRASQSRGVADVVRQHYNAVPQRGREWRKTESKIKGLRSFNNWVKSTLIQKFSPDEEFLARFNGTKEWAEDGGVPPVEEKRLLVVDLGCGKGGDLGKWQLAPQPVDLYVGLDPAEVSIVQARERYNGMNLHHRAARRRVQGE

SEQ ID NO: 24057 - protein, 227 aa, A.fumigatus
NVQVSFNYVSASSKAAADALVQELRNENKEALAIQADMTDIDAPSRIVQATLAEFKTEQIDILVNNAGAGDNRPLEEVTVDVYQNLMDVNVRAVIFMTKAILSYIPRNGRIINLSSISARGGYATQSVYAATKAAVEGLTRVWATELGHKYGVTVNAINPGPVDTDMYRAAGPVHLARMEEQNKKVPAGQRCGTVDDIADIVTFLAQERSRWVTGDVICANGGMLYI

SEQ ID NO: 24058 - protein, 89 aa, A.fumigatus
EDTTMSLQGKVAIVTGGARGIGAGIVRSLSKEGAKVRHSSDCYGRNIKLTDKMFRSPSIMSLHHQRQPQMLSSRNFAMKTKRPSPSKQI

SEQ ID NO: 24059 - protein, 209 aa, A.fumigatus
IDSEPVKKAEKHRKGSTSNDSTAGKALKRKRDGDNTQKDPQLQEYLSVIERPSKTKTWANGDDFLNTIQNQPATSELREEQRDDTSEKVEEHSHKQRKKPRVDDVPKAAHDREPEPMVLDKTEEEHERANADGQVEAIPPTQEEAEPVSDADWLRSKTSRLLGLLDEDEQAEFDSTAQRKPDPSSEPETVSKPGAQHFLHAGHGRTRAP

SEQ ID NO: 24060 - protein, 122 aa, A.fumigatus
DTIMENTRVFVSGLPPTFTNDQLRKHFSSRFQITDAHVLPKRRIGFVGFKSSEAAQQAASYFNKTYVKMSKISVEIAKPVCHFLRTTLILVPMFFCHFHLHPLTCCKVGLETDHNGRLTLSL

SEQ ID NO: 24061 - protein, 75 aa, A.fumigatus
SQRTNIKAFRITCPGSPPAQQTVPCTVRDSNPPTWSPPPSMANPILSSLQEGFGKSVNPGQRTSKKLGQETNLPN

SEQ ID NO: 24062 - protein, 286 aa, A.fumigatus
LLRRTFCPRLFHLQTPQLDLLFKSVWIGLAGIDRKIFGASLIPKICECLGLTEKNIRLTNDVDLLVAAATSHRDCSSAVVVIAGTGSVAMRYNRSVDGSEYSRVARSGGWGHFLGDEGGGYAIGLEAIKYTLTVLEEMRLGICTEPLGLLEQAVLKRLGCASCGPKQIDLLSEILVQQHKQTIKARIAGMAEVVLSLNGQNDTSSAIVSRQLDYLASRTVGRLLDPACAGYIPTEHSGLILSGSILNNQAYQDQFLNVLAKSGAKFAYVERVSDAGLLGVRHLTSP

SEQ ID NO: 24063 - protein, 96 aa, A.fumigatus
PAIQSPRSTLLFSQGAHLGEEIDGISVYLDFEHQPSNNALTELGLNLTGCVWTVDQETHNTVTVEFYDRELHRDFHFTDPYLYDRACLSMEHYPAV

SEQ ID NO: 24064 - protein, 64 aa, A.fumigatus
RFLDENGTLFSNNPTDGSPATIFYRPHETWTTRADWRTQLPQGELIRGRHCEPDSFKDWRLTEI

SEQ ID NO: 24065 - protein, 134 aa, A.fumigatus
VPIRGARRLWRRQAGNVLSENGRVVITYGGGHTMSNHRRERVMEDVRRQSQHFVGDGAYFDHDRLFNHLVDEGWVLVQGEPMADAAGVEENGVHQIVVGRVPVSQGLTGVEKEGDSQVQVLSLLPEPDQFGGQV

SEQ ID NO: 24066 - protein, 127 aa, A.fumigatus
  UNSURE (81): Identity of amino acid sequences at the above locations are unknown.
RDWGRIPRGVWSGRYPDQLGADRGDFKPGIVGRLSRGRHQTGGNPQRWFQRKMVHTGQEDIDPNLEFWWNVMIEEIEKFQXTEKGKNFWGARVIWSDTRSKNREKITQSKSAFRVTIRGNLTNRSQA

SEQ ID NO: 24067 - protein, 170 aa, A.fumigatus
PVSGMKIALERKQRFPELFSGYDLVAQEDLGRPLSDLAPELIWFREQTEYLNLTIPFFFHAGETLGDGNSTDYNLVDAILFNSRRIGHGFSLYKHPTLIDEVIEKAVMVEVCPISNEVLRLATDILHHPLPAMIAHGVPTAISNDDPAILGQDIPGLSSPQAPSTANRNS

SEQ ID NO: 24068 - protein, 135 aa, A.fumigatus
RPHEDRARPCPPRPKHRFPPPHRPLQLPEPHARGPRCGGPPPGYLEHLPRPRNSATGGGRSRQEIRRRDPLRGPRACRFKRGFLPPGLPNRLPASRKTGRLADRVNDSAHPALVAGEPGDCRGAVADWRRAARHA

SEQ ID NO: 24069 - protein, 223 aa, A.fumigatus
LPYVRADPGSSRGEDLMKIARDHARLDPNIDSHLRTGRFSYLNRTLEDLVAEVLRQDTSSTSPVPETAPQAEAEADRRFDVVTLFEVLEHVDSSAGSSPLAFLTDCLRLVRPGGWLIGSTIARTLPSWLVNQVIAEAPWPIGVVPRGTHEWSKFVNPDELEGWMQEGLMRSSDGAAARAGSEALQGMKWKCTGVMYFPGLGWKLIPGSESWGNYFWAVRKGGY

SEQ ID NO: 24070 - protein, 154 aa, A.fumigatus
HPCISTSYPAAPHCPHAPQPHPNSSSTPPASTPPVHLDSRTCSIHACRAARRQSATAPRQSPGSPATRAGCALSLTRSASRPVLRDAGSLLGRPGGRNPRLNRHARGPRRGSRRRISCLLRPPPVALFRGRGRCSRYPGGGPPQRGPRACGSGS

SEQ ID NO: 24071 - protein, 337 aa, A.fumigatus
  UNSURE (333): Identity of amino acid sequences at the above locations are unknown.
IPSPAESLPIAVRMSSLSQGDSPSLTATASSSSSSSTSGSRTPKANNSFNQSAASYFSYPVTHVVSGLYRRLTEPNITKASRKDSNSPNRKMNARNNRDSSTTSPDIFVPIRTASPFQPPPLTPLTLTPGPGVPQQQLLTRALAEEIRLLVPARLQLVDTWRLAYSLDRDGASLSTLYEHCRDFSHRSPRAGYVLIVRDSSPAGAVFGAYMTDPPHPDSHYFGTGECFLWRASVLPSPSNLLNINGPQSEEMLERAGLPLPPSADTTHAGRSTTLRGDSRGHGDGRLAAPRANGGTGAGAASGASTPERIRFKAFPYSGVNDYMMFCETGFLXLGGG

SEQ ID NO: 24072 - protein, 139 aa, A.fumigatus
AKASREVAVNKPLRRQVTALRELKTKHADKASTWPILLGNNFLCLLAVDAYQTIAEDFADLIHPFRFNQAQQAAITRLRALPGGVGIIQGPPGTRKTYGQCDHPSCFSLPTTVILTGGHHHIMLTRAVDRGRSRSPGRD

SEQ ID NO: 24073 - protein, 227 aa, A.fumigatus
FPRFKRGSAHPRGEDSSSGCVDSPNSPPSEILENMSLHGGSSPKENMPAFIQPNFSLPPSAFTFTPPASPRQSLGNQPSPAQSRRSLTPSSEDEMLPLSPSKRPLEKIVEEPSLPFTSSADPYTDIAASTAELSSPHTAPTLADSSHGSDLDIFISTDSSANFKHEFPDLSDPDMAAFPDYVNGSTFEPGMDLFSSKTFSAGTSMNEDFFSLQFQVDDMTKEFFMDC

SEQ ID NO: 24074 - protein, 95 aa, A.fumigatus
KIRLLPVLSSPGSPSLWNSLSLDLPVVILQSIAMAVSRDLEAPTVVNDPTADDAVVEKKEYADGTPANDPFGNEECGEGLHHGVERIRGGAIGVQ

SEQ ID NO: 24075 - protein, 321 aa, A.fumigatus
YTDSCPSEVLRSSRQGYTKAVDLWSLGCVTTVLLTGEPPFNTPSPKCETSQGNRQGALDSLEANLTCNMIGKRAKDFVLRLLVFDEAKRMDVKQALGHCWFTNPVHKEAFEALYKRSIRDWKPRAPKEPLMVDLDLIQVRKTNGDVAQTHSQESLPSKLFKSAVPRANGSKESILEESSSPELRRDLSPTLSDPELPPHGQLDDNPHQAYDLGNDPAEIESEAGKLDALEQRLESSEQSEVLRSESEEFNQYEWAIPPIIPNFSTANTALLKNINNSSTRKKRASNTWEEFGNEVYEEVKNSITGKRHRLLYGANFVANWS

SEQ ID NO: 24076 - protein, 78 aa, A.fumigatus
ADVILVLPQWLAVNQGSPAYRGDKLIAGAYHLAGKPGTSGIQDQLIIHSIDLSPQINCRSQHSSYPIVYATVNVSFPL

SEQ ID NO: 24077 - protein, 164 aa, A.fumigatus
YTHSAEPSSPVVKTVEIDRIPFILTLQSLINWKAETHIGVPSDQLLKCAQCGPSSSYAKSNFLHLLLLLIQPHMGQSVCESAHPHWVSIQAFIDRFEICTNTKLLRRLETTRIQEGGHGRPNALYVVKKDIDTKVTQSFDPLDQISGPFAVVPSFFQKIIKVAV

SEQ ID NO: 24078 - protein, 150 aa, A.fumigatus
RMGGIIGIESKVLQTWAIWRTSSMDSTVRIPSLRSVWFCQYVHHGLDGDLNNLLKKAGNDRKRTRDLIKGIKGLGDLGVDIFLNNVQCVWPSMAPFLDARSLKTAEELGIGTDLEAIYESLNRDPMRMSRFANGLSHVRLDKKQQEVQEV

SEQ ID NO: 24079 - protein, 267 aa, A.fumigatus
TICGPSEKKCSFERGNRNTMKHSSPAVEDYETDGTPVPVPEKRQRDQKIHETSDRDDSEQPPNKVSKSASEESSSKNENKADPNLNSKGWNKDNKGKQGLGVKTAAKQNQKHDEEDGLEGAEGQFEDEEHAKPSESPKVHKIIEEFGRQPLEGTSLAKGPLIASPETVLAMVLDAMLKSRPISHDLSQRAVTELIDEGYHDIKKLGESSWEERTMVLKDGGYNRYREQGATNLGDLADFVNGQYGTHPFLEISLVLSVCSPRSRRRP

SEQ ID NO: 24080 - protein, 84 aa, A.fumigatus
GGDLITVVEDVYIVVICDIFFFVLSLPALSPLQPPTHNSIAPPLSSLYFSPTTLYWLCFPLTNLTLFFPAPRHKTLYFSLCVSA

SEQ ID NO: 24081 - protein, 80 aa, A.fumigatus
ERVIFQPRREDKTRVWVSHYSDNVTVTVVWFSLTLPSQAQAQRERPSPTGLLHPAGDEGQYNSDFLFLLLNSMETPDSSI

SEQ ID NO: 24082 - protein, 84 aa, A.fumigatus
SSSNMKPLTYLALLLGISATTAFAALRPDATPDEVAAAEAECGSLGVMRIDPAELPEGITMSDVRMCANHPLGPGAYPGLGPGA

SEQ ID NO: 24083 - protein, 179 aa, A.fumigatus
QHQGIHPPNLKLLYQDSSLHKASRPLKMKFTTPISLISLFVSSALAAPTPENEARDAIPVSVSYDPRYDNAGTSMNDVSCSNGVNGLVTKWPTFGSVPGFARIGGAPTIPGWNSPNCGKCYKLQYEQNTIYVTAIDAAPGGFNIATSAMDQLTNGMAVELGRVQATYEEADPSHCASGV

SEQ ID NO: 24084 - protein, 67 aa, A.fumigatus
GSLLNGPTNSTGLGWDGVRPEAEKRGLRPTTWQDWERIDKAERERGQQKGKARDKFGRVEEMLEVIS

SEQ ID NO: 24085 - protein, 178 aa, A.fumigatus
VHVHFHPRGEDCVIHSCTCLFPGLLIRTLYLEPISVRGKMAEFKYPVRSAHLNRKAAGVFEVPHLPPWAQSHVQHAQNLLECSDEPIEYDHDDEDYSDNCFFFPEDCSWSPPPNWVIEDDRSEDDIADGTDSEHDYDNTMIPGLPDIRMLDAEALSDLLEDNLSPPEITTIMYADVIP

SEQ ID NO: 24086 - protein, 229 aa, A.fumigatus
HFPTHRVFATNGAIFAYASSLSSRQLRNLSATYGAAYTCYAKNASSGNLTGVNPASHPSSYVTAQSVSLGDVGSIVFELDDSVAVVTRIADKVLLAAVGPSKSDTDEADSADGTPVHQNGFAKLGTEATSATESNAHRPTTNSTHTNQAPSTTTSTPTSISRNESKADVQADADLETQYEIDRNSNLARLASLNLSASPSTLLALESKAAALGRFLSQKLADFESPDDF

SEQ ID NO: 24087 - protein, 119 aa, A.fumigatus
  UNSURE (84): Identity of amino acid sequences at the above locations are unknown.
DSFSSPSGHSIRRVATAQIVPTPTHNQIATWAIVNPDPTHRIADDCSTCPIRIVASTNPVFGKTMLQYGSDMRSAPVPANTRHXARTPDNRNAQGKKLALSPTKEAPPTRRSPRQRLPG

SEQ ID NO: 24088 - protein, 119 aa, A.fumigatus
  UNSURE (35): Identity of amino acid sequences at the above locations are unknown.
PGSLCLGLRRVGGASFVGDKASFLPCALRLSGVLXKCRVLAGTGALRMSLPYWSMVFPNTGFVLATIRIGQVLQSSAILWVGSGLTMAQVAIWLCVGVGTIWAVATRRMLWPEGEEKES

SEQ ID NO: 24089 - protein, 183 aa, A.fumigatus
  UNSURE (10): Identity of amino acid sequences at the above locations are unknown.
SNGLRTGLGXCPHASKEKATDGSQSLYSDQAMAAQSIRFLSVNQVQRLHGLWISPTAQPVQLPLLESAINSPMNLKHYGNQGDVFQLAANLSEKIMKNHAYQDGNKRTALLAADIFLKINGYRLQKVPFADDPINKGLANAHVAVVTNQWTVDQLGNFYRSVAKPLEQFTPDIEEFRKAAIEY

SEQ ID NO: 24090 - protein, 92 aa, A.fumigatus
VTAHSILGKQELRDPGWNSLYLENHDQSRCVSRFGNPDPRYRAVSAKMLATIQLSLRGTPFIYQGQELGTPHPQNWKIEDYNDVETHGYYNA

SEQ ID NO: 24091 - protein, 111 aa, A.fumigatus
AILGQSPLGLLFTDAFYSQYKARKEKDPSKEPDMSDVMDVIRLKGRDNARSPIMWNNAPNAGFTSPDAKPWLRMNDEYANINVQAQTRDPDSVLNYYKKLLHIRKQHPLMV

SEQ ID NO: 24092 - protein, 68 aa, A.fumigatus
EMPCGVDEYESSQYVAKERQELSMVFQFHHMDLDGENGDKWKPRKWELWEFEKVFRIWQQHMLGNNGR

SEQ ID NO: 24093 - protein, 211 aa, A.fumigatus
VAILNSVLGFFGYSHFTGGFAGGLSEFVRVPYGDVNLLNLPDDVPDEKGLYLSDVLGTSWNAVVDTGVKEGNTVAIWGAGPVGQMAAEYSFFHGAKRVILIDGGQGKWRLDFIKKILPKLETIDFANLPKGESVPSTLKKMCDGHGPDVAIECAAGEYEKGWAHYFQRLLGMETDTSELVNEMLMSVRGFGHCGITGVYAGYVRGTFFMVR

SEQ ID NO: 24094 - protein, 101 aa, A.fumigatus
DKSADDIIQCNHFDIGALMECGIKLHGNGQAPVQKYWKELLRYIQEDKIHPLDMVTHRFKLEDMEKVYDLFDKREQGMQKVFIQTRFSAPPSPGSRPLTVL

SEQ ID NO: 24095 - protein, 383 aa, A.fumigatus
RPGAGGMLMDPAAIDALTKDQRALFKQQLEIIARYLKMDLRAGQKAFIASQETQNALQAQLDLWQAEHGDVYASGIEPAFDSLKARVYDSSWNWARQDALSMYYDIIFGRLKVVDREIVSQCIRIMNRSNPLLLDFMQYHIDNCPTERGETYQLAKELGQQLIENCKEVLGVAPVYKDVAIPTGPQTTIDARGNIAYKEVPRASARKLEHYVKQMAEGGPISEYSNRTKVQNDLKNVYKLIRKQHRMSKSSQLQFNALYKEVIRALSMNENQIMPQENGHSKKAGRNGVKRNGSPRAGKVETIPFLHLKKKHEHGWEYNKKLTGIYLDVLESAARSGLTFQGKNVLMTGAGAGSIGTEVLQRLITGGAKVIVTTSRFSREVTE

SEQ ID NO: 24096 - protein, 106 aa, A.fumigatus
AAVVVDVSLSPSKSSLASLPLNQPTYNVWTQLMDPNSSTDMHSSNSSTHQSTPASLQSQTGSIVVVGEAGIRLSIVPDGHPQGGNDCTILERKTGASLLTDLIVSA

SEQ ID NO: 24097 - protein, 213 aa, A.fumigatus
DLPDLPTATSPLDSAINGLKFFSKLQLPPGNWGCEYGGPMFLLPGVVIAWVVTETPIPQAYAIEIKNYLMARANPVDGGWGLHSEGDSSVFGTSLNYTVLRLLGVDSEHPVMVQARGLLHRLGGALNAPHWSKFWLAVLGVCDWEVVNPVPPKAWLLPHWVPVAPWEMVGAYPASPSSRCRGSGLKRWKAAGNGTLLRGPANGNLFVPPLGIN

SEQ ID NO: 24098 - protein, 119 aa, A.fumigatus
KKKVRDRRITENIVKYEDTREDGIKGETAEMPAEFGMCYEKTELNGWSFFNQLTNKQEMAISPAALDRYRTKNKLSDIENTEAALKGKSLTGLKLRAAATTILHEMTHFYSLFGAGKTG

SEQ ID NO: 24099 - protein, 123 aa, A.fumigatus
VRLQPLSIHSECTNCLLMHSDDVLRAVKSLGPLGSGFSIVQVGSKQYIRSIPKELNTDQATVLEAIQILGYVSLSMLQLNLNWTKARAQTVIDDLVADGLVWVDTQGEENEYWSPQNLLDDSG

SEQ ID NO: 24100 - protein, 151 aa, A.fumigatus
ANHGGNLRSAHLESLQTQLSVFQSLLHTFALEHGSTIKSNPTFRAEFARMCNAIGVDPLAASNVKGKNGRRGERASFWTQIMGGDMNDFYFEVAVRVVELCRSTRSDNGGLLGVEECRKKVGKGKAIGSGLEVTEYGFNPFPFIRSVLTVF

SEQ ID NO: 24101 - protein, 69 aa, A.fumigatus
FNRGLRHSGWSQHGHGHQPFPAGNRASCSGLHYISSLREFPELIENMEVQLQFEKYNVRRGAPDYHFPE

SEQ ID NO: 24102 - protein, 79 aa, A.fumigatus
EGQMSQRPTSSHDSSAPHHIPVDDCLTYDTGYRPNLPGQRTWWVFCPVTGAFDNSYALLGAMIECVARGKATLGTGLGT

SEQ ID NO: 24103 - protein, 70 aa, A.fumigatus
LEVRYFEQGRVEKREERRAGYPKDNGDGEKNVHFEQTSYEIYICREQRNETHSVDIRHYFGTSRQDGDVL

SEQ ID NO: 24104 - protein, 92 aa, A.fumigatus
PTCKAKKWPNFVSIGLRNELRQPSTSNTQYPYNWGTWYTQVTTAAKRVNAANPDALIFLSGLNYDTTLAPHPDSIGSRQRGEVPSLRLQLCE

SEQ ID NO: 24105 - protein, 152 aa, A.fumigatus
GGDATVQNSLIYALGSTNGTKVFDQIRKVNPQIKSTTTRLEVFDMVAAECNKQGLYIHLDNHISKAMWCCSQTDGYAWFGDTYFDVAKWMRGLEYMVSHVSHLPQPDARHADRPARPKNGPTLSVSDCAMSFASPPQATRSTRTTGGHGTHR

SEQ ID NO: 24106 - protein, 142 aa, A.fumigatus
TTIPRSRPIPTASDLGNGVRFRLSDFSFANKLVLELHNYDTGATSCSALSGALWNAGFKAQNSSDPSIVNPMPVVLTEFGFLQDSTTWKNVYASCLRTWIPEQRAGWTTWVIAGSYYIRQGTQDMDETWGKSHSKGVAVLKC

SEQ ID NO: 24107 - protein, 361 aa, A.fumigatus
DKHDILRTAFRQSEDNAQILPRTTGSGDCAALWAVLTLASMQERSIAATRQMGASPNRPRSSQLYATARALIPAEKGIHEIGHVQALLILSLVKLGQQEWKDAWVLVGQAIRIARWLGLGSPLTGSAENEKGSARSKHVFLGCFVLETLISSKTGQAPSLRKEDLVKTGPINEDGLEEWHPWEDQTGLRAPESSRGSSHRGPLHALSTFNRMVSLMCILNDACCTKRLENNPAPQLEALERQLQHWVSALPGSYRVDLQSPTRLASPHIFGLEMMFESSVTALSLDTIRQGDKRLSDLRKTRAIESLKRLMLLLQKYMETYSLAATSPIFGMLLTFGISSGEGQGARGEFELDIGLKNKLE

SEQ ID NO: 24108 - protein, 126 aa, A.fumigatus
  UNSURE (59): Identity of amino acid sequences at the above locations are unknown.
RPDLGALCIAIEEKFTDKLSGSGSVLDTPAGVSSSKVQPFSASVADQGTSPYADVGQVXSLPCANLSVPKLIGYAAHLIDDVLAPPLVHFNICCGLWKRDNLVTLATSVYRLIGAGVNLRGHDCGA

SEQ ID NO: 24109 - protein, 64 aa, A.fumigatus
GFYFSSDAFLEMHFPNLPFLLAPFLYNVVVSGWQASAADDLSVLATETANAVFTHRDWPDQRHC

SEQ ID NO: 24110 - protein, 195 aa, A.fumigatus
  UNSURE (4),(23),(195): Identity of amino acid sequences at the above locations are unknown.
LIRXYESMSDPGETAQVHPYVFXTSIAKLAEEKGAEIKLGSVTKIGYAGDAVESVTYNDKESGESRTISATDVIIAAGPWTRTVMPEAPISAMRAHSVVIRPTKPVSAHTLFTNIEIPANFDPSKPSRPTVVSPEIYARPDETVYACGEGDQVVPLPKTTADVEVDQRRCQDIIDQVGSISDELRDGQVCARQAX

SEQ ID NO: 24111 - protein, 65 aa, A.fumigatus
YLPNVSVRGGPLIGHTGTKGLYLAAGHTCWGIQNAPGTGKLISEFFFDGDAKSAKIGSLDPRNFL

SEQ ID NO: 24112 - protein, 81 aa, A.fumigatus
FAVLPRKSVGDDTYHYGGKRWPKNAAGVENPRAVFYDGGRENTISRTGHGAEIKGALLNHFMGNGGLRPTLEKRAFLGRSA

SEQ ID NO: 24113 - protein, 64 aa, A.fumigatus
RSTTITAGDKTFLVNSRTRIDNAGSFRPWRSNMGYLLPMTLATFETAIRHTLTSSCIGFLQTSS

SEQ ID NO: 24114 - protein, 226 aa, A.fumigatus
DSEANVDEYGEFLHIPGQKFYDFNKIREEIVRETEQKVGRNAGISPAPINLRIYSPNVLTLTLVDLPGLTKVPVGDQPKDIERQIRDMVLKYISKPNAIILAVTSANQDLANSDGLKLAREVDPEGQRTIGVLTKVDLMDEGTDVVDILAGRIIPLRLGYVPVVNRGQRDIENKRPISYALEHEKNFFESHKAYRNKASYCGTPYLARKLNLVCIIGRIISPWSLS

SEQ ID NO: 24115 - protein, 100 aa, A.fumigatus
  UNSURE (31): Identity of amino acid sequences at the above locations are unknown.
SKCSPANHSRRANASQTPQLDFEEPIAALGXWTDLLLSILLDLETKPGNASPRQSHSATRPATPPIIALDTLGECVSPSTCNTVSGQLSEERTRTVPGAV

SEQ ID NO: 24116 - protein, 326 aa, A.fumigatus
  UNSURE (307): Identity of amino acid sequences at the above locations are unknown.
QPAWYELREDALSQPDRTDPIELDDTFMHCLNVSGSKFIISTPDLSQFVCVDLPHIALNLGSFDGISVGAIELVTAADLQQYSPTGLIPAKRSVRDLCVLIYTSGTTGNPKACAIRNMMNMVTSNPLSTDVRNPAKYYPLRTYSSLPLFHGTAYFTGLCYSVGNAGTLCLRRKFSASQFWKDVHDSKATRILYIGELCRYLLATPPSPYDQDHACIVASGNGLRGEIWERFRQRFNVPEIREFYRSTEGVAKFDNHGVGAWGAGKIGFSGPIRRILGGRPSSSWKIDPGYRDRPARDPKDRVPGSKXQLGPRRKRPMARIKGPELC

SEQ ID NO: 24117 - protein, 160 aa, A.fumigatus
TASVPIRVNMVSEFEKHRQSPSLHSVTQIELGDCGSSSTVCQSRYQRWTRSFKTLETRGIEPVSPDDRQKPTTSDLFHMLLIWFSMGMAVNHMVVGSIGTLVMNLNFTDAALCAVFGNLIGGLAVGYMSTWGPRSGNRTLVWPFTISSLLCSRRVEDNAS

SEQ ID NO: 24118 - protein, 80 aa, A.fumigatus
SRGRKKRAMVEGAGGRGLFRGNQRDLTARDIGFTSLLNGPSEFSFTKYVIPAPTLLTGLPTAFPDYHPGRIRLHLANAEQ

SEQ ID NO: 24119 - protein, 66 aa, A.fumigatus
PLPDAAEPDGLCKQPLKGAPYAQILPYIKKGICTLNDYQDILDILERAFGDPNRVNNARNELFSLR

SEQ ID NO: 24120 - protein, 72 aa, A.fumigatus
PPPSTFQRRLLKQIAVAGLSVNYLVNYFCLPVIQYLDTSLGVDTVRMPTPLPPFLPGDPEEFSEHVASHSTE

SEQ ID NO: 24121 - protein, 78 aa, A.fumigatus
  UNSURE (28),(39): Identity of amino acid sequences at the above locations are unknown.
VYFAFTWPFIIKFLRWVSMFACDNRTPXRNIEYRFFPSXYPEFRHCDLKRSADIAWAKQALVKSQKYSSLCIVQHSMD

SEQ ID NO: 24122 - protein, 60 aa, A.fumigatus
TDNLKIWSLTRYQLRHSPECIYFVLIYVAKCANSSRKASSLLLVHKLLHMQSCNKHEVPC

SEQ ID NO: 24123 - protein, 74 aa, A.fumigatus
LSVLIAPVKPALCYWCTNCYICNHATNMRCLVDQLPDYFSLSNHVYYYIRDTESYMSNYDFRSFSTRTSKSSFI

SEQ ID NO: 24124 - protein, 158 aa, A.fumigatus
QCRNYKNYPTTSIMNTELHQVLNVWDRIRVNSPIYAFLLNDVEIYSAQKGKINARVRVTSHHLNSKNTLHGAFSACVTDWAGGLAIASCGHDSTGVSTDIHVNYMSTATTGDWLEIEGCADKVGKTLAFTTVIISKKSEEGKMTIVAKGSHTKYLRTT

SEQ ID NO: 24125 - protein, 215 aa, A.fumigatus
PSRSRASSTTSSPRRTSSSPPTPVALSTRTSRPSTPLPTAWPRPSPPRSLSPSPTSPLSCPLALPPPFRRVSTPTRTPPALPALLPLLPLPLRPRPPPRPPLPLAPSPRRPLPPLSSPPVPRLAAPPLPPPPPLPPPRAAPAPAPAPALVLPLPPPAPTSSPLAPPARSTSATPSAVPSSRPPSPSLSKRPLSDFAYWLSESNTSRTADGGKAPQ

SEQ ID NO: 24126 - protein, 132 aa, A.fumigatus
DRDRHRDLHCHWHRHRDGHFHPCHPHRYRVWQRLRYPLHHRYPHHGRLRLRLRLQHWYCHCLHQHQPPLHWRRQQGALQLLPRRCRRRGRHRRRSLSALFLTLPIGSLSQTQVGRRTAEKHPNDANGTLMTN

SEQ ID NO: 24127 - protein, 291 aa, A.fumigatus
YYPSLVKMRFSALLVTLGLTGALATPTLVSREAPAVGVISDISAQTSALASAVSSYNGGDPSAVKSASEKLVSTINSGVDTVKSGPALSTADALALTSPVQDLTKQVEGVIDDLISKKDKFVAANAGGTVYEDLKAQYTAADSLAKAISAKVPESLSDIAAQLSAGITAAIQKGIDAYKDAASSTGTASSSAPATETATATETSTATGTVTETATSTPVIPTGTASGSASATPSTTATPTTGGSGSGSGSSTGTATASTSTNLLSTGAASKEHFSYSLGGAVVAAAIAVAL

SEQ ID NO: 24128 - protein, 305 aa, A.fumigatus
AKSERGRLESDGDGGRDDGTAEGVAEVLLAGGASGEEVGAGGGSGSTSAGAGAGAGAARGGGSGGGGGSGGAARRGTGGDDRGGSGRLGDGASGSGGLGGGRGLSGRGRRGSSAGRAGGVLVGVDTLLNGGGNASGQLSGDVGEGLRDLGGDGLGQAVGSGVLGLEVLVDSATGVGGDELVLLGDEVVDDALDLLGQVLDGRGQSQSISGAEGRAALDGVDTGVDGADKLLRGGLDGGGVTTVVGGDGGGQSRGLGRDVGDDTDGRGLTRDQGGRGQGTGEAESDEEGRETHFDQRRVVLEISCI

SEQ ID NO: 24129 - protein, 180 aa, A.fumigatus
RQMPIFAITHWYAFSWHDYADPTISAARLPVVYALRDAFGAKDLVEDTKMTLRGENYEYRRFDSGDHIIPHAESKSRVKRVMDGMRYERGGKAKYWIPKPGEVNSRTPLLADAESSNRSRRSSALERFRSNSDMEETTLDPDDEDLFTKARALEFGDWNVSLAHIDDEERSGELIFSSTR

SEQ ID NO: 24130 - protein, 165 aa, A.fumigatus
PVPPDIIDRCIYFRAFQRPLQGSKAKYLHRFLCRSRLNNLLQVRKGGNASFQIVEERPGHSKFRAIWAFKELLKRGKYSCKCIGLLLKVDDIFPSNFHFINVFSTYFHDAPSQLDNTDNTGCTGKRVYNQRGCRVQDRSIPCQGNDGKSANEVLMEIFERKRGRC

SEQ ID NO: 24131 - protein, 120 aa, A.fumigatus
LLHFFRGFTTHIDHSISLSRLRTAKGAAFNSYENQHDECLLGTRTKLLSDIEKWAISPQGKCIFWLYGMAGTGKSTISRTVAHRLKKKGPFTASFFFKKGEKDQRSAQNPLSINDNHSPI

SEQ ID NO: 24132 - protein, 145 aa, A.fumigatus
TVSSSRGSTSGPARLRPPTLPSLRLLPSATLWLPPPPLLLRSPALPTPTVLHPPASPPTGPTPLPKASTALTDSVAGPSPAAPVSSTRATLVNPGAATSSRSPPRTPRSTSTSLSLLAATLTPGPLSSWTQGFHTRRMAGSTLVG

SEQ ID NO: 24133 - protein, 201 aa, A.fumigatus
ITQVHPFFAMQLKNSMLLLTALAAGSSVARLHGHERRHLHHAGEKREVGDTVYATINGVLVSWINEWSGEAKTSDAPVSQATPVSNAVAAAAAASTPEPSSSHSDSSSSSGVSADWTNTPAEGEYCTDGFGGRTEPSGSGIFYKGNVGKPWGSNIIEVSPENAKKYKHVAQFVGSDTDPWTVVLVDTRFSHSPNGRINASR

SEQ ID NO: 24134 - protein, 68 aa, A.fumigatus
IICPIQTRIPHTASSILNHQSCTLLLSFPFLFIIIIEKINSYQVQYNIVFNFCQQEIINIVIPISGNI

SEQ ID NO: 24135 - protein, 82 aa, A.fumigatus
TRPPGCEVDGVGIVTIIDKPTGPELLLQKQYRPPIDKVVIEVPAGLIDAGETVEECAVRELKEETGYVGVAEQTSTLMFNGE

SEQ ID NO: 24136 - protein, 121 aa, A.fumigatus
QSRQALSCLMVSDALILHAIFRDQAPVQPSEAWCKTLIEGITDPGMCNTNLNMVHVRVDLSLPENQDPKPQLEDNECIECFTLPLSTLFSELKRLEADGYAIDARVGTLAEGIELANKLKL

SEQ ID NO: 24137 - protein, 276 aa, A.fumigatus
  UNSURE (3),(12),(24),(25),(26),(28),(29),(30),(39),(41),(46),(49),(50),(97): Identity of amino acid sequences at the above locations are unknown.
QKXKNPPPNKPXQPPQTPQTPPQXXXKXXXPFTHSLPQXIXHAISXSTXXMVACLMMTPARVLKQNAQVTNVNTGKGGQNAKSAMTQVIARFKHRPXKLWSGYTALVGRNLPFTGLNFPLFELFRSHLVEWRKRRKEDDAMQTREWGPVVERAALTGMAASMSGMIASVVTTPIDVIKTRMMLSASCHNNDDSNKSTKKKMAGWGTLRVGKEIYRNEGIRGLFKGGAIRAAWTAASLSMYLSIYEGGRFYLENRRREKHGLNTRVEVDGSKEEAAI

SEQ ID NO: 24138 - protein, 127 aa, A.fumigatus
DMRTSRLTVALLEEQDLWESRRAWRDVASAIERGDMDATSVAKSKIENAQRELRKVEKAENREWERRFFKRVDETADEEFQRLARMVGLTSLESDKTGGVWRFDKERAANAKPPYHQIGGEGLGVSE

SEQ ID NO: 24139 - protein, 143 aa, A.fumigatus
  UNSURE (110),(138),(141): Identity of amino acid sequences at the above locations are unknown.
NRRLRPLLANHLRLHRPAHPIRPRRHRPQCQPRRLNECPRPARQSHHRRRPRRPRPHRRGRVCPGLGGRRVPVPLPRAELVRASLLWAGGAICQCACVWAGGGGPDPPPXVSGVVGVASGRSGTVCARRKRKVPRKNXEKXAS

SEQ ID NO: 24140 - protein, 226 aa, A.fumigatus
  UNSURE (192),(221),(224): Identity of amino acid sequences at the above locations are unknown.
DMHAVVRADNLTIPQIGHATSYSQSDPSTLNLDDSQSGYISLLPLTLFEPPAIHPFTSMTMSTDKSARHYIETISTRPQKPIEIVDYDPSWPTTFASIAQRIRSALGATALSVSHVGSTSVPGLPAKAIIDVDLVVPDPTAEDEYAPALEAAGFQFLFREPNWYEHRFFGLAEPYANVHVFGPGAADLIRHXRFREWLVSHPADRELYVHGEKGRCPGKTXKNXLV

SEQ ID NO: 24141 - protein, 79 aa, A.fumigatus
TTSPLYQVGDELYVNIALDFRLMLCVSDCKFNKDAPNVVHMTVKPQEIVDEEDAKAAKAPYSREREASERSPGCRCIIQ

SEQ ID NO: 24142 - protein, 78 aa, A.fumigatus
  UNSURE (14): Identity of amino acid sequences at the above locations are unknown.
EPLTKVNPRPNQTXEHQPHDISDYARFANTMEFNSSGRQYENKKYALNFCSRTVGTAWQEDLDLGCLGQSTRPPVERP

SEQ ID NO: 24143 - protein, 69 aa, A.fumigatus
TELPWSVKMHDHIPVELVFLQTNGWNFCHIQLPISHAGDYDKKQDLGDVTEVTICTYFQSIYNSDPGSS

SEQ ID NO: 24144 - protein, 86 aa, A.fumigatus
WKYIHKPGYSPNNLNLSDLQSSRLLRSMTCVKVRFCNADDPNCHGAHIHFRPNPAHVGATLYMCQGWHKFITQGIRYIPCSYDMQE

SEQ ID NO: 24145 - protein, 137 aa, A.fumigatus
ACSEAIINTCSSGSWPKTWIIGNKNESRDLRGNPMENFKLLIAEQRLSNTGAALTGFQKEIFDSPYVSCGSHKGTTSDDDMNLKPNSLPGERPSFLTLACLISLELTQPNKVYPFVLELKLSKPNRLICHGILDLHL

SEQ ID NO: 24146 - protein, 115 aa, A.fumigatus
WSAFNMPVFQAKPFRRATTASSSLGERIGAAYRGNLQKHPFLLFGLPFIMIIVAGSFALTPAAALRYERYDRKVKQLTQEEAMELGLKGADGEEGIRRNPRRRVLGDEREEYYVS

SEQ ID NO: 24147 - protein, 61 aa, A.fumigatus
HLTDLMTIYLALRVNFGLDNVDCIYIFVPYWWTLAWHCNNVIHDISRSDMPLRNVGPTSPG

SEQ ID NO: 24148 - protein, 61 aa, A.fumigatus
MDSFICSYSRTNRRGPIGACIPLLTVDLTDKYSTDEKWSSDKLISIDTNRDVFTTGLEGSA

SEQ ID NO: 24149 - protein, 93 aa, A.fumigatus
DNAVNGLNVIHVSGTKGKGSTCAFTRSFLRAHSVRTGLPKKIGLYTGPHLQCVRERIQIDDHPVAEELFTRYFFEVWDRIMPADIELDAGVAK

SEQ ID NO: 24150 - protein, 108 aa, A.fumigatus
LCDSRIQFYIRRHNAIPHFEEISGKQFFRDWMVINLYSFANALQMWPRIEPNLLGEPCPHAMCTKEAACKSAGATLPLRAADMDYIQAVYRIILEQVSRRCVAVHNSY

SEQ ID NO: 24151 - protein, 145 aa, A.fumigatus
LQATQHPNLPASAATLFKAKAQKKLSFEQIAQHIGRNEVATAALFYGQAKASPEDIQKLSELLNISPQVLEEQLSGFPDRGRSVEMPPKEPLIYRLYEIVQNYGYAYKAVLNEKFGDGIMSAISFSTKVEKETEPDAKKRGRLKF

SEQ ID NO: 24152 - protein, 81 aa, A.fumigatus
CGQLGRFQKIFAWGIIRYVYRYFQSLEEKGEDCSSISGATSAFYKVMRDIFSNTEITLCGERKVRQLSLIGNLLLPSALSR

SEQ ID NO: 24153 - protein, 130 aa, A.fumigatus
RGSRSQGRRRIWASGRIWRHSTSSEMWPLASRLEGWMATMVEFVSAYSSPRNFHQADRSIPERWLPQVIENPASPFFLDNRAVFQPFSIRPRNCLGRNLAYTEMRMILARGLWTFGCSVKRVVTGRIGAH

SEQ ID NO: 24154 - protein, 88 aa, A.fumigatus
FITAQAWKDIYGHGHLQLPKVQISTINGKNIFATNDVDHARFRKALSHAFSAKGLQAQECLVTRYIDKRIERLKGFTESGTAADMGKW

SEQ ID NO: 24155 - protein, 355 aa, A.fumigatus
  UNSURE (5),(39): Identity of amino acid sequences at the above locations are unknown.
ASGRXARFEFEVGKGNDGTKILMIEWDDEDSGRSSNCLXGSWHVSWEGKTTVLPADERTSENTRRFYFLLPPHATIPPVVTLSYEPPATCSTSSTPTQKTSSLQLNPLPAIFPPELGATGRSAGKKGVLHTIWAKKRLQVLDKEIREECMNNAEGVALHMALQEKEWIESNFGVGSKSEAQTQSMQDSQYPMGPATPVSPTSGGKLGEKLKGLKLQTSQRELSPKADGMGSSRSSSSMPTNGVVASSNARHLLSPQSPDVAVSSFNSFHTMQPMSNVLHPSPAPDTSLRTVVHYPPESIQAQQNSSEHNSGFASMTTITRTSSADSGEDLFAKALSPRSPDLPRSPFSFAPETVI

SEQ ID NO: 24156 - protein, 66 aa, A.fumigatus
RSLRFATIAIHQPTLLKDKIFIFRIILCHLKYSFALFIVAIYNTHQRSSPTIIFLQRCGLAPTKRP

SEQ ID NO: 24157 - protein, 308 aa, A.fumigatus
  UNSURE (247),(248): Identity of amino acid sequences at the above locations are unknown.
FSCDHKILPTERKYLTRRMYYPGINSLLLWLLCFAPPGLAYGRSSESPPGPNAILLSRVQSLTLRANRLTSSRRVSPIPQLKCVGPSKTICDKYKIETMRCTNAGYDYDEEDVQWTCTAQLPEEFMLGATDVICEGYRNADDKWVLKGSCGVEYRLLLTERGESRFGRIQEDDMRSIPLATKGWRRGMDALVDLIFLGFWAAVLVMIFWPMVRSCFGLRGRRGRTNVGRGWGGFWGGGGGGGGDRGXXHSRPSPGPPPPFLALPLSSSLSASLCVSAGLFGPVLPLVAFVLLPYGFATPSACPFVPPS

SEQ ID NO: 24158 - protein, 140 aa, A.fumigatus
  UNSURE (1),(2): Identity of amino acid sequences at the above locations are unknown.
XXPRSPPPPPPPPQNPPQPRPTLVLPRRPRSPKQERTIGQKIITRTAAQNPKKMRSTRASIPRRHPFVASGMDRISSSCILPNRLSPRSVNSSRYSTPQLPFNTHLSSAFRYPSQITSVAPNMNSSGSCAVHVHWTSSSS

SEQ ID NO: 24159 - protein, 149 aa, A.fumigatus
YDSSDPSTPVVKTPPDHRDREGFKFENPSTDCKYVSQMHIWDSFKDLEKDMNKLFTLIHKNVSFTVVGHHPIAGHYNDLLHFYVNALRRVSVLFLDHADKFEIHPQAIHGGCNERWSVQEVNFRGVMNSGEVTAVISVNGADIRTIHRR

SEQ ID NO: 24160 - protein, 89 aa, A.fumigatus
TVLILEQYTGDDFDIVNVWVTRWDRGQMVEIRTYIDSARIMEALHKNEIWWNGTTFRDNIHYMPGPAGMPDLKKLEDLMGYPDGRKYED

SEQ ID NO: 24161 - protein, 115 aa, A.fumigatus
NRAALSSPVVKTATQSETHHSGLSTPSKRKSARLAKRKHSETEDNMELSAPDRASDGGDGDLFIQGMCDIVMVRIDNLRPTELQFNEQDFLDDELSGDEDWNGNDFDATAAGHAW

SEQ ID NO: 24162 - protein, 66 aa, A.fumigatus
LIDAGHFQWDGVDFSHSAQDVHFAIEGGGQVPVLRAQLANQDGEFQDADVNLSERIENINGEFVFH

SEQ ID NO: 24163 - protein, 143 aa, A.fumigatus
QYANTESMTDEQPQARLQCIPCGRTKEPDGKDAVPNPAPWDDRRCCRWAPPAQPVSTDGSTARPGSSRRRPRRKRRSRGTHPARRPDRSPSHAAECPPAGGRSSNPPWSWPSCAWRSGARGWRRERADPPALRGHIGCCPRWW

SEQ ID NO: 24164 - protein, 345 aa, A.fumigatus
SFQPGGEDQERKFWSKYLEGAPQRLDIPRYPGQMTFEGRSRVSEFKGDLVRRAVTLGQEHGLSQHQLVCAAVAQTLQWLAGSNDVVLGSPWANRGHTVEQESMGLFLDRLPLRFKTPVNADCATILQSTRAASQAAVCNSIPFEQVLNLLHLPRTIQQHPLFEAMVTFHLKGAVEDCLAIEGLEVKREMCFASGAKFLLMFEWTEIEADHWTLRIEYDDHQLDDATVTTIEDSIRCVLEGLADRLSRAAIHERLNAMHKTARTKVDWNFYRRLVGILQREMATCLGVSLDEFPCSVSFFEAGGDSIQAWRLSRQLKRVGLEVPICNIFDHPTAQDLAQRLYRQVL

SEQ ID NO: 24165 - protein, 354 aa, A.fumigatus
RPEEGKDFETVIDCGQDQLDMVVPQGLTVRAVAELYGPEERVEVIDVKSQQGEDKRWNMQKWADYYESTGSKVVRNVISLEVSQSKLGKLIRRPKIVRDLDLQDAVWPEELKAIGDYPKVQFYCLMSVADCYTDFHIDFGGSSVYYHILKGKKTFFFIPPKDKHLKKYEDWCNSPAQDSTFLGDQTKECYRVDLSEGDTMLIPSGWIHAVWTPTNSLVIGGNFLTRLNYGMQIKVAKIEKDTKVPRKFRYPFFQRIQWYTALKYLEDDPIPQSVLNAFAEDENYRFHRAYPIYYEFGERENKAPAGDPYHNSRFYSQAELEGLPDLAKYLLRTALIASGYIVEGGLHNAGRRTK

SEQ ID NO: 24166 - protein, 197 aa, A.fumigatus
  UNSURE (20),(32): Identity of amino acid sequences at the above locations are unknown.
SFLSGNLQPRMSAQRQASFXSQTPHFSPAELXYLYTSLALPDSPIRPDGRSPTQFRPLTAETDILPGTNGSARVGFADGTQAIVGVKAEVEKTALAADALKVSQLSSGDDYTADQGADGKEGMGAAGGHESWVQISIEIPGFRDDDALPVFLSEMMREPLIESVSSAQGGDVEMAGGLKGRLVISSPTEAGRTRVQK

SEQ ID NO: 24167 - protein, 99 aa, A.fumigatus
CRGECVGTQDNVLWGSGFTGNPDFWLDSCPDLREIGKSVCVTAYTVIVWTSLRVDAKGSKMCATTSGDTTRTTRLNKSMIPEPRCVLHSTTVQLRSESA

SEQ ID NO: 24168 - protein, 81 aa, A.fumigatus
PRFGYTSSNPLWITTINLPAGTTFQYKFIKKETDGRVIWESDPNRSYTVPTGCSSTNGTATGRLAGELGRGMGKCWVDFLS

SEQ ID NO: 24169 - protein, 163 aa, A.fumigatus
LEQVVDEDFPPLGTPLKDKRPVDSFGFLLRSHLPNDTQGTTRAGTPTLPPGLPLPHAHPASSLFQSPLNPSSPSLSISMPPPGLNITRSKPGTPSQNFSEIESQRPSPEPRETPESVPPSKFKNISEISLGSPLPKSAQIARTQAKPELSASVFTTGAKDTHK

SEQ ID NO: 24170 - protein, 71 aa, A.fumigatus
TLSAGPSTPVVKTKQARSLLHPVERQQHANKLPKRRKARRKPIWRWKTETVSPWRPCSILVRRRGCAGSAR

SEQ ID NO: 24171 - protein, 264 aa, A.fumigatus
RGSFDPRGEDEASPKLIASGRTPAARKQATEAAEGQEEANLEVENRNRITMAAVLDPRPKARMRWERKMIVREVRRRGRLTKTERIMRTERESLSKSHWFKTSVKKLGPLARQIAGKNIDEAMLQMRFSKKKVAKDVLEHLEHAKNVAIVRSGMGLGNAADQKPITITLKNGERKTITNPSSIYIAQAWVNRGPYGVDYDHRARGQINRLRPPYTSLSVLLKEEHTRIREWRDREAEALRKRKAQLWTQLPDRKITAQNQYYSW

SEQ ID NO: 24172 - protein, 98 aa, A.fumigatus
  UNSURE (13): Identity of amino acid sequences at the above locations are unknown.
SSRTFTVQNFGKXYRACGNCSKQFKRTVEISGVKASSGKAFVGINSNYGDTATISGCASSVKEICVEYEGTDNNKKEPAKKSSGPSNACKYKEPLASC

SEQ ID NO: 24173 - protein, 77 aa, A.fumigatus
LKWHISLSIPISVLQFFNHNCNNLSHLQTTANKTHHNVLLCYTFPTLPTAILQETRLPQLQSREGRKTVSLCMAIQG

SEQ ID NO: 24174 - protein, 64 aa, A.fumigatus
ISSTQLTRPGFGIANYLNDFQAQQARYQLQEEERIRQNQKLMDAYGDKDSLHDVQHALEAYEIQ

SEQ ID NO: 24175 - protein, 392 aa, A.fumigatus
RVYRPTPVDQNHKLTMSRLPSVSSLMSPPESKPFENFNTSFSPYSTSQDYCSFVHGMRLPPISGERKRTQSEMDLPSPPVTPYTGNKKRKSEVSEEIERDVVLGSSRDPVLFPHHDSLTDVATDEPLFGQILPAPAEALMEQHIDSHMARFDNKVNKPTRDEYILALSCVPVVSAQYNRNPAAWAKEERETLERQLFMMNRHRPQSMDANLKKIAPARSKRAVVTQPRAQRTPRAKRSPRSTPHQKGHEFFDLHTQTSARAPRGIGTNRDDTDYTSIQDFSPSPETLGGNAKALKADWKGQMLDFSQDPDRHLLSPAELSLASTLRLSCATYLCSKRRIFEARVRALRIGKEFRKTDAQQACKIDVNKASKLWTAYDRVGWFDSEHFRQYVE

SEQ ID NO: 24176 - protein, 60 aa, A.fumigatus
KVIHIKKASRQLITQCQFNNLLISPAYRTMTMADYQQTQTRSSNKSNAFCPSLAFSFNHA

SEQ ID NO: 24177 - protein, 110 aa, A.fumigatus
SHLNHLNPLNPNILHPVNPDHPLTDDMPSSRLSYCTMLLLIASIFAKVQVREFTAKRGHRIIQPTLSKKLFRVQDSSLVTPGPIENKNVDNVSESAMLWSSPRGWKERCQ

SEQ ID NO: 24178 - protein, 193 aa, A.fumigatus
  UNSURE (136): Identity of amino acid sequences at the above locations are unknown.
STLPDEVPATYHNSTTTSGATSDGMTSAYSKVKELTTASSAQVLTVSGYLSAFLLSFTINRAFLASALLPLYLLSLAYRVLPTIFRNAPRLLLPNWWKTLVRDAEQYRQRVDALAQSPLEGTYRFQDDEILRTDRXGKGWMADMPWKDNVEESTVCGANARYVHLKPSYPSIRTEYNASPRTIVLPAWESPPG

SEQ ID NO: 24179 - protein, 258 aa, A.fumigatus
  UNSURE (16),(19),(20): Identity of amino acid sequences at the above locations are unknown.
QTELVAVRSPEKVLTXFFXXSKPMECFWLPEKEFSFQFMTLPFFSKISFITPDMGMVYAGMVPDYRVLVDKARKVSHTGYKRIYNEYPPTRILVQDVARVVQEATQSGGVRPYGVSLLIAGWDEGIEPETGESQRGDEEGDLKKATVATGKTGGILKGGPSLYQVDPSGSYYPWKATAIGKHATSAKTFLEKRYTEGLELEDAIHIALLTLKETIEGEMNGDTIEIGGCYLSKSNVATKHETDLRRYCRPSCGSSSGL

SEQ ID NO: 24180 - protein, 263 aa, A.fumigatus
RTIVAGVGAVMCSYNQINNSYGCQNSQTLNKLLKAELGFQGFVMSDWSAHHSGVGAALAGLDMSMPGDISFDDGLSFWGTNLTVSVLNGTVPAWRVDDMAVRIMTAYYKVGRDRLRIPPNFSSWTRDEYGWEHSAVSEGAWTKVNDFVNVQRSHSQIIREIGAASTVLLKNTGALPLTGKEVKVGVLGEDAGSNPWGANGCPDRGCDNGTLAMAWGSGTANFPYLVTPEQAIQREVISNGGNVFAVTDNGALSQMADVASQSR

SEQ ID NO: 24181 - protein, 137 aa, A.fumigatus
SFLTIANSVSLVFVNADSGEGFISVDGNEGDRKNLTLWKNGEAVIDTVVSHCNNTIVVIHSVGPVLIDRWYDNPNVTAIIWAGLPGQESGNSLVDVLYGRVNPNAKTPFTLGQDFGSLTGAPLLTEPKQWAMVASPG

SEQ ID NO: 24182 - protein, 124 aa, A.fumigatus
RRTNVAATWDKTLAYLRGKAMGEEFNDKGVDILLGPAAGPLGKYPDGGRIWEGFSPDPVLTGVLFAETIKGIQDAGVIATAKHYILNEQEHFRQVGEAQGYGYNITETISSNVDDKTMHELYLW

SEQ ID NO: 24183 - protein, 68 aa, A.fumigatus
CLAVAITPASWIPLIVSAKSTPVRTGSGEKPSQILPPSGYLPRGPAAGPSKMSTPLSLNSSPMALPRR

SEQ ID NO: 24184 - protein, 86 aa, A.fumigatus
SQWPADGRSVIHRADYHRILLDKARDLGVAIRLGALVEKVLVDDTAVIVGSETIAGDVIIGADGSFSLSNSHLVFTTGLEGSTGDL

SEQ ID NO: 24185 - protein, 145 aa, A.fumigatus
  UNSURE (131): Identity of amino acid sequences at the above locations are unknown.
RHSFFLHFVILIFVSIVTLTWLGAAAALVLSTWPTAASANPGFRKAASPRYRSSVSACPERYSDAGPNTGNWSVYADFKLIHKCKENMFYHFSLFDDVDDQERPHRLSSLLLLWGQTLAVSLPPLRRIASXRVWLMLNLNSGWWV

SEQ ID NO: 24186 - protein, 128 aa, A.fumigatus
PGVGGFVDEIGGVIGVQKINVDQLRADVKKYIDNIKNVQASLDAGNLSDPKKFHPQDRVSQIVQRSMKDARRKAEQMQLYLEEMVKTYDDIMVFYGEDNTDEGARRDFFAKLASFLVEWKVSFCVRSL

SEQ ID NO: 24187 - protein, 242 aa, A.fumigatus
RQTVASAALLLAQVNCVLTRPQGTNILKVSTSDVVQPGGLANIYLDWRESYSGIIEAIYASCLSPDTSSTQIIGRFTVDGHPPQRLAWAVSDDAPTDNCIYVHGTQSDRLEPNLLGKSEPVRLSQMVKKRSVADANVPLLKDFDSLGAWFDGVAAIKQKTATHGGVASSHSSKDSKIAIVGAGISGLATGLMLDSVGVHNWEIIEASDRVGGRFRTRYVAGTQEWAEMGPMRLPLFCHLQAQ

SEQ ID NO: 24188 - protein, 322 aa, A.fumigatus
  UNSURE (307): Identity of amino acid sequences at the above locations are unknown.
SACPSSPVVKMSRQIDSINESLADFSLGQKFRMPSFYEHSRGILLYGPKGTGKSALLHQIQAAGWKKTFSLGSSMFSRNISDSETKVRNVFQEAVRCQPSAIIIDQLDFIAPKRASLDSQSLTSVLCECLDMAKSALVLVVAATRHPNDVDDALRTPHRLAIEIEMQVPTAQDRAEILRAICGSSTRQLSEELIETIAEKTHGYVGADLFALLQLVCRKARQRQLCQSHSPTRLCDVTSSPDLVAGVEHIEENMVVDLDIEESDVMSALQETRPTAMREVFLETPKVRWTDIGGQHDIKKRLQKAVXRPLKVSSGPLALLTR

SEQ ID NO: 24189 - protein, 131 aa, A.fumigatus
HPVDPSSPVVKTIISDNIRRQFSRTLFDSSFIYQQQRFGAPIKYSDKEPLQDLYNIRPGRTFDPPPTPRARMAYILIDMLFELASASQPNRMNEYHLPPQKKRQVIRSKRQPVFCSRALSPRISYSDAPCP

SEQ ID NO: 24190 - protein, 157 aa, A.fumigatus
LLILLKPLLITRVMFTVTMASLGQEEGGARTLSPPPPPPPPPPSDAHSKISPYVLKLRSAPPNYFYKPQIKPEHTDPFAAPTGPYFFYGTLTDPLMIAEILELNEEPKLRPAHINGFECKMLGAIFQLGLIGPNSGGGKTHRTCSALRRMPNRLAAF

SEQ ID NO: 24191 - protein, 104 aa, A.fumigatus
GLSFPHLIIEHFVVDALTYQLVSLSDKASSPRGYRTSSRLTYEFERVRIIILQLVQRDKCSGPVMRKVDMCIANIKTRGQLHLGHWSGDNNNNNNMAWPFRRSR

SEQ ID NO: 24192 - protein, 88 aa, A.fumigatus
RPLSAALSDGKSAYIYPNDEQELDRLDMQHHMIKLVNDGRLFFAPIHSPKRILDIGTGSGIWPIEMGASSSCHSITHSTQILTVPLLL

SEQ ID NO: 24193 - protein, 257 aa, A.fumigatus
HLITDSISGGIIRDAENADAQLLLAWRRAWFAQGFRPVVLGRGEAMNNQLYEMVQTLKINKDLEYDLFRWLAWGHMGTGLLADWRCFPMARYDDPLLSYFRRGVDPAQITRFDHIGSALFAGEKTRINDVLKNVVQNALKSVDDKARSMLDIIPGEIFKVEQPSALAFYTSATITTHYPTLAEKIVSSPTAGRLALLELVNSHLHNTFQNSFQAGIAVLKPFPEHTTALVEPALRLAKALGQCPSSPIPESCPPNLP

SEQ ID NO: 24194 - protein, 71 aa, A.fumigatus
SGAHMTPGKPPEQIILKIFVDFQGLYHLVELVVHRLATAEYDWPKPLSEPSPTPGEEKLSISILRIPYYPP

SEQ ID NO: 24195 - protein, 112 aa, A.fumigatus
GRLSFQPGGEERGNMSQKIGIFPASGGLGTSIINHLVKLVPASQLILIARNPEKLASFSRDGATIRRADYDDRASLERVFDGVGVLMLISYASFEIQHRVEVLFNLVLQSEP

SEQ ID NO: 24196 - protein, 222 aa, A.fumigatus
IFKVTKQPGPQSRHRRRPPQRRQTHLLLLPRLRRRPGRVQPRARHGRPPRNGKVPRRTPRPLHLHRHPRRPLLRVLPDLHRVVRPAPARRGDHHPAPGDGARGGVGETRRAGRGHRQDDICVCEEPGGLPVSEPGGAAFGTEGGESGGDGGGAGAGGGEACADPGDLGGRVCGAAADWGQAYVPRGESVEGVGDSVGGDPGGGDGRRVASSGGHSGEGAGGF

SEQ ID NO: 24197 - protein, 267 aa, A.fumigatus
RNNQAHKAAIDAARRSGVKHIFYSSLAFAGDLGESSLAHVMGAHLATEKYLAELPGHFTYTAIREGLYSESFPIYTAWFDPHQPVEEITIPHPGTGPGVAWAKRDELGEATAKMIYAYAKNPAGFPYLNRVVLLSGPREVSLAETAEVLGRAVGKPVRIREISVDEYVALPQIGDKHTYHGVNLSREWATAWAAIRAGETAVVSPLLGDILGREPEDFETTIRALVGARYSPAWIGRCRFPATGLSSGTSFPTVMLGSISYSVCPRL

SEQ ID NO: 24198 - protein, 137 aa, A.fumigatus
EQRQEGLICTSRDRKFRFSSGMKHQKRRPFPHRLPDKSDPPISVRMLPSGNTSPCFNHCSLTGLMKGAFCDITTCIPIRQKDETAMNDKMLNTQSPELSQKNGMWTAIRTQYYMLITLTSTRTLGWIFVKSSLRHLC

SEQ ID NO: 24199 - protein, 71 aa, A.fumigatus
LQQELSDGYSSSRVCAIYVDNPSAYPTDHAGVSGLPAPKTPSRSGLMRVLLGIWEFAMDQWFLIVIGLLIA

SEQ ID NO: 24200 - protein, 162 aa, A.fumigatus
IVGPSSRRGRRSGIETLSFSSPPLTLLAAGSVDGSIALFDAAHRFAVRRHIKEAHEGAAVVKVEFLQTNLAALASRPAAAATQGRPWLLTSVGMDGVVRRWDARGGTAAAAEGLLKEWKGHLGLVENGEGEQSGGIMGFVQGFDGKRVVTAGDDGVALVFEE

SEQ ID NO: 24201 - protein, 270 aa, A.fumigatus
  UNSURE (24),(34): Identity of amino acid sequences at the above locations are unknown.
GIECGPDRTNPDTAIFPMFSKPIXTFSGAGAGAXIIHTLDEYWRSFVPGHMWSALLTGEHISTDIAVDAGRAVWFAHTKGVAGPDKTWEYWEVNTPVEPSLEKYITDFVEPHLAGYTGMMNVETIGGKIIEVHLRFSPQWPNMYGSWFIASLVDLYCGKGWTGPSASKIASPVGYSVPLWDDEKYAETGTTLTENAVRRLESMFNVESIVESTTMQYGQEKPLESTPRASGGFRIAWVNGYDLARCKLARSALQAYLYQLDDTDKGYQVL

SEQ ID NO: 24202 - protein, 76 aa, A.fumigatus
VEFSPWSSRLVRASINLGNIPPTHILQRNVGIPLCNILVSPILPANQELRLPNFCNFTRVPDFFSCRVPGFQTRTD

SEQ ID NO: 24203 - protein, 91 aa, A.fumigatus
KRGWNALYWENHDQPRSIDRYTQAKEEHRLVASKLLATILTLQAGTPFIYQGQELGMRNVPVEWGIEEYKDIDCLNHWHEYVFTLPVHEHD

SEQ ID NO: 24204 - protein, 214 aa, A.fumigatus
ETCQWNGESRSIRILTASTIGMSMYSPYLFMNMTDAHRLLKTKQFDTKAQQIAKQEYQKKSRDNARTPVQWSSGPNGGFTGPNVKPWMSVNPDYVRINAEAEVNDPNSTYHYWASVLGLRKKYLDIFVYGNFEMVDGDSQEVFAYTRQYENQKALVVGNFTDKTLEWSPAANGIKGVREVLLNTYEEAKKASPRFAGEKWSLQPYEAVAVIVQE

SEQ ID NO: 24205 - protein, 67 aa, A.fumigatus
TILMVLVSLLSLFAAVFYYYITVAPSCYNSNSNNNTPHLLEADILGTIAVQENMLICLLANTIHMTF

SEQ ID NO: 24206 - protein, 70 aa, A.fumigatus
  UNSURE (25): Identity of amino acid sequences at the above locations are unknown.
MEQRQWIAGYPIEATPFVRMLVDRXRMEKDLLFVTVTHYSSCYEPMEAMNAIQCPKLVYMIWLAFSPLHS

SEQ ID NO: 24207 - protein, 83 aa, A.fumigatus
RISTTSRARKDLHSVLIQRLTRPCYRNNVPKGYSFVGLTQNLETKLSAISSIPAVYNWTRTNTTEFKGATTTLRRKCVPADHL

SEQ ID NO: 24208 - protein, 116 aa, A.fumigatus
SPVGNICFDFMTNDVKGDSTSSSSRELMLWLQYEGGQLPIGWTNGPAATIDNLFGTSWTLYEDINTDTGITVSTLMPTKQFEGSFSGDLKNWLLAMADLGRFTESTYVNVGNAGYL

SEQ ID NO: 24209 - protein, 226 aa, A.fumigatus
NVDFCAFQLPAVSSRQNGFIRSHRHCRCPQPCRLLSTWGASALQPYLPGPLCYFRRRRHRTRPLQLYPGVSRQPLYQHPRIPSPPPSAALFSRPARRPRLGSLVHPPKAQCISEPPGLTQPIWPNRAHRPLRPLHHLPVRRARHLRRPIRLHERPLVRPVVPVSSPATLPQRQGAPRPPADLDPRVQRQDGPRLRAAHPNLPAAAHRPADGAPDRRVFARRWKTEG

SEQ ID NO: 24210 - protein, 213 aa, A.fumigatus
AAGKMDSYVLIAIAGVLSHVVYFRRGEHQLYSHIYLVLFVISAAVVTVLVHYSYILVYLASLYTSILVYRLLLHPLRSFPGPLAARVSGLWYIHPKHNAYLSLQALHSQYGPIVRTGPSDLSIIYPSAVPAIYGAQSACTKGPWYDLSYPSRPLQHCRNAKEHHARRRTWTPAFSDRMVRGYEQRIQTYQQQLIAQLTARQTVEYSPGAGRRK

SEQ ID NO: 24211 - protein, 166 aa, A.fumigatus
PDSCSIQVVDAIKDLVQDCNFDCNDSGIALQAMDNSHVALVSMLLKAEGFSPYRCDRNIALGINLVSLTKVLRAAQNEDILTLKADDSPDAVNLMFESAETDRISEYDIKLMDIDQEHLAIPETEYAATVEMPSAEFQRICRDLNALSESGELWNSVIGNFLTEPC

SEQ ID NO: 24212 - protein, 499 aa, A.fumigatus
  UNSURE (412),(433),(447),(454),(456),(457),(465),(468),(476),(484),(490): Identity of amino acid sequences at the above locations are unknown.
YDAPTPRRTFFQAFMSLLQFHLKKENLQDFNGVCDESIQLSIRKWLQLPKNITNAHIPILQHFQLLVELHDASHICASLSQTNERNLDTKSAELKLLLGTWRDRLPNLWDDINAWQDLVTWRQHIFQLINATYLSLLPPQTNNVASNSYAYRGYHETAWIINRFAHVARKHQMPEVCINQLSRIYTLPNIEIQEAFLKLREQAKCHYQNPKELNSGLDVINNTNLNYFGAQQKAEFYTLKGMFLAKLNHVNEANEAFGVALYYDLRLAKAWSEWGQYSDQRFKADPSDYELASNAVSCYLEAAGLYKNAKSRKLLSRILWLLSLDNEEGRIAGAFENFKGDTPVWYWITFIPQLLTSLSHREARLCKAVLVKIAKLYPQALFFLLRTNREDMLSIKKQHDQKQEKLNRARQXQASPHTKPSPATADSSPAQGXQPANSNTPAQGQAXQPPQGQXQXXSQSLPQGXNPXPRPKSRPXKPPPQNQXQPPRNXPQPPRFRLL

SEQ ID NO: 24213 - protein, 88 aa, A.fumigatus
DKCGTYVDVLTCSPTGGGSAYFFEGDSSLQPFHSRPLVNRLTNGYKRIDQAAQPTRVTLSILGGDKAQEIVVNPTATRPALDLAFRSL

SEQ ID NO: 24214 - protein, 230 aa, A.fumigatus
  UNSURE (96),(143),(155),(182),(214): Identity of amino acid sequences at the above locations are unknown.
PVGLASLRKSPVFSLYNNSVPEGRSILASFKTGWKQRSREGEKDQKVTQYSESRCTYPCPGSASVFPSFRGLKVFLVTIAQVSHSSTMSGGVREIXEEGVAPSCSSNGGGNVIQYHVEKPAEASSGSDPSALEAQKAMTLEAXRETDGGAHSAFXKKEKRFIVFMISMASFFSPLSAQIYFXVMPTLVENYHLTTALINLTITTYLILQSLAPXFIGTFADSGGRRPAYI

SEQ ID NO: 24215 - protein, 141 aa, A.fumigatus
EGPERKVQGWASGGGIYDDFLRLVTAKNGKRDPSRLSRLVNALVTIGETIDKGSGVEGLEARVAFKEISRAAASWTTREDVNVSTAFVSTLLLSLNSNITDEQQAIELSSVLNLPLTGDARIMQTAEMSRRYYSTIMAGGY

SEQ ID NO: 24216 - protein, 123 aa, A.fumigatus
SIILYLLLFWLTVLKMGAPNFYRSGLVSLLFVSLCVSSLANADYNRFCPDKTSQIQVDSTFYTVACDTSYISPAPKKVREGASPQDCARLCTGGASIPCHSVVSWKPLGGPKNQRRLIPVPGA

SEQ ID NO: 24217 - protein, 98 aa, A.fumigatus
SGIGSACMSNDGTNKPQFTPTFPGTCPFITAVGGTQSYAPEVAWDGSSGGFSNYFSRPWYQSFAVDNYLNNHITKDTKKYYSQYTNFKGRGFPDVSAP

SEQ ID NO: 24218 - protein, 105 aa, A.fumigatus
NANLIAPDSLVEMYNLGDYKPDASSGSRVGFGSFLNESANYADLAAYEQLFNIPPQNFSVELINRGVNDQNWATASLGEANLDVELIVAVSHPLPVVEFITGGSP

SEQ ID NO: 24219 - protein, 61 aa, A.fumigatus
ISPFVPNADEPTAADNQNEPYLQYYEYLLSKPNSHLPQVISNSYGDDEQVSILMILLYNRH

SEQ ID NO: 24220 - protein, 260 aa, A.fumigatus
HRIAVFRTVVKTVTGASDGIGFGFAQELCKRGFNVFLHGRNHDKLLRKRDELLAEFPNRKIRIIVFDAFKSSEDLRWIAQEIGDARLTVLVNNAGGEVKLFERLADLIHEDVQATISLNSTFTAQITRVLLPVLERNSPSLILAVSSAAAYVMPTLTVYSASKGFVESFTRSLQAEMTLDGKDVEVLGLRVGNTKSQGNDVAVGLFTPSSRTLASAALNRVGCGKPVVWAYWPHFLQGLSFHLIPGKMLMLILGDPLSMP

SEQ ID NO: 24221 - protein, 293 aa, A.fumigatus
LWCNSVLLTKPYRQESLAEATLMPMGKGFAITSDLNLRNILLHGYDKHTRRPDEDEPSSKRRKLFALPKLKIAAITNDAVATLASLAYSVKSLPNSRVAMGIIVGTGCNATIPMKLESLHESKAEHVKSKIPEAKETIVNTEWTISGASPPLKELNIITKWDEELDKACARPGFQPFEYMTGGRYIGELIRLILFDYLTNIVGLEKKQLPATLVQEYALTTSYISDKVARPQRDEDLAAELNQSLPPPESCEWCWDSLTAGAFRKIARVVQTRSAGLIESGLHRGHKDRGGSF

SEQ ID NO: 24222 - protein, 66 aa, A.fumigatus
YRKDTGNTDTITVITVMPGASVTNIDHSCISCISITCFYSALFCCQGSSDNNPGSTFKLHCHRRLS

SEQ ID NO: 24223 - protein, 152 aa, A.fumigatus
KHVMLIQLIHEWSMLVTEAPGITVITVMVSVFPVSFRYYYITAFSCHPQGPKTISIILPRDQHIWDGRNMPEYDHDKVPDFPWELGVYDAHCHPTDAMSSISDIPGMKAATLTVMATRAEDQDLVFQIAKDLNNAKLTVQDAETDRVPPSFG

SEQ ID NO: 24224 - protein, 328 aa, A.fumigatus
DLPVNSVHQHGKLIAALLPQLDDTPGDFLARLRDAEAAVKTESLVELIDVTEKLYYSLYARLVMEIANVELCSHFDLNLRRMLVKETFTLPETSHLRDIFITFKDILDAPEICSGLDYDLVKQHQDSIIRNATDKLAITGFSAHDLIGYRTSTLKIVSDETHPFVLKWRGLVYLYQMPGVETITAMSEKYLTIMPQVSATEEFPAIELPFIDRDSIQPEIWQRENVLDNRQATLAKLEGRSVGDMRRDDSRRRLLDFVKEKKCICRSSCSCATDCTMGVVLPCPCSERILCIAHGKRYERAGEQGFPAQYAGALAKSLLWKGWAIGRS

SEQ ID NO: 24225 - protein, 136 aa, A.fumigatus
IPRTRFLLAPWRDYKEDSPRGAMARRHLKSRADTASNSTAPQVDVGAIVKGVIDDIRANGDTAVRKYSERFDKWSPASFRLSREEIEASIAACPPQTIEDIEQVQRNVRAFAKAQRDSIKDFEYEIQPVSLTLGAF

SEQ ID NO: 24226 - protein, 65 aa, A.fumigatus
TDNNSYIPGGRYPLLASAHMTILTAKEAGVPKVIGCTPPIAGKIPQATIAAVFTTPKEGKIVPEK

SEQ ID NO: 24227 - protein, 161 aa, A.fumigatus
  UNSURE (124): Identity of amino acid sequences at the above locations are unknown.
VSLGPAKYVRRMTYRNGQVITASQLRDLAGVTEGSSHDDGLVPMLLVVVENALNGLDTGILLGAEVALVRSLVPVQDTADEGGDEESTSLSSSNGLDKGEHDGQVAVDAVLRLQDVGGLDTLPXGGDLDKNTVLGRCLVARKAARVSYVSLSADSIKSGVP

SEQ ID NO: 24228 - protein, 204 aa, A.fumigatus
  UNSURE (27): Identity of amino acid sequences at the above locations are unknown.
RNIADSRSFTSNKASSKDGILIKIASXWEGIKAAHILQSQHGINCNLTIMFSLVQAIAAAEAGAFLISPFVGRILDWYKAAHKRDFSPEEDPGVKSVQSIFNYYKKHGYKTIVMGASFRNTGEITELAGCDYLTISVCHPSNIFGRTKTNLEVAQPTRGVVQLDSLRPQEARCRQRRQPRHPQTQLHQRRGCLPLRLQRGGYGR

SEQ ID NO: 24229 - protein, 78 aa, A.fumigatus
PNLLEELYNSTASVPKKLDAASAASLDIPKRSYINDEAAFRFDFNEEAMAVEKLREGISKFAADAVTLKELLKQKIQA

SEQ ID NO: 24230 - protein, 228 aa, A.fumigatus
DGTMQPAQENHENDDHQPGTPPRPPYSPVTPVLSHLAPANDSAMRNGASHSFEPPATSLSPTTPALPYASLSNFPDTQGQAVFGQEPAPVPVSESENPDAIALRSAISILQLQKQQSIRDIQTLEKLKKVASADPEGFARELAAGNLTTAKDQGAYINFTHKDDKAVSDTTGESTSEALADIGPIPAPQNVVRMPPINWAKYQVVGEPLDRMHEDQLRHPSPGEPRRP

SEQ ID NO: 24231 - protein, 196 aa, A.fumigatus
TSVTNLEADKRRAGKNQAAALPAGQRAAAARETSGSNPHRNRLDQPVSGPASHPARYNAAAALHPPTRATWNAPPVAPRTKWTTTRPPPPRPTRTANSASTTAISAVNRPPAAAGQVPAPPTSKLPSRPPPQAESPSSQSPCPLFLASSRRQPLHHRGSPRSTPRIPACPTTKVVSTDLIARRRRTIRSRRSSSRR

SEQ ID NO: 24232 - protein, 227 aa, A.fumigatus
TQSRKKSSGSASGRAASSSGQGDQRKQPAQEQARSTGFRPSQSSGTLQRRGGSSSTDSGYLERSASRTANEVDNYQTPAASPNQNRQLSVNYGNLGREPSTGRRRAGASTTDQQVAQPSPTAGGVPIIAEPVPPLPRQQPPAAPASQGIPSEYPSYPSMSNYEGSLYGSHSQETAYDPEQALELPSVTEHSESDPYRRFPGSPGVQQRYPDDHSRNWNQSRPPYGGQ

SEQ ID NO: 24233 - protein, 111 aa, A.fumigatus
YEHCRILHQSPSKRNTLLLATADQPATGAHNCTVSVLQDTDEAVRIRKRRSFGDQTDYFSDIWTPRLCCSGQILAAPDFTGEVGQVSAQQGCLQVCMARMVRVDQPMSNVL

SEQ ID NO: 24234 - protein, 164 aa, A.fumigatus
LPCSTIWPLCMTMMLSALVIVDKRWAIVMIVLPEAMLEIARWMRCSLRESRDAVASSSMSTAGSFTRALASATRCFWPPLISRPLEPTTVPYPCCRTLMKPSASASDAALVTKPTISATFGPRASAAAVKSLPPLTSLARSARSVLNRVAFRCAWLGWFELISP

SEQ ID NO: 24235 - protein, 503 aa, A.fumigatus
  UNSURE (8): Identity of amino acid sequences at the above locations are unknown.
WQVDHCGXGDTTLRSHAGPILFDGHDLRDVNPRDLRSFLSLVQQEPSLLDRSLLENIAHGLINSNHPSHAHLKATLLSTDLADLASEVRGGKDLTAAAEARGPNVAEIVGLVTKAASLADADGFISVLQHGYGTVVGSSGRLISGGQKQRVALARALVKDPAVLILDEATASLDSRSEQRIQRAISNIASGRTIITIAHRLSTITSADNIIVMHKGHIVEQGNHATLMAKNGTYAELVKLQTLASKDETTINIDAASKSDQTSSSEADIEKSAILLDDFGDAEKIPVSTTAAPVADAAEEAEEPETPKKSLWALAKGYAPALRPHLLFIFLALLGSSVVGGAFSGEAVIFGNTVGSLNPCHSADSIRSRGNFFGLMFFILAIIEFFANVVSWSGFGWVSEKIVYAVRVLSFRSLFEQDLQWHQSEGRTPALLLSYITRDGNALAGLSGSVIGTLFSISVNLIAAIILTHIIAWRIALVCLALVPLLLGAGLMELHVLGKFEER

SEQ ID NO: 24236 - protein, 133 aa, A.fumigatus
  UNSURE (8),(83),(106): Identity of amino acid sequences at the above locations are unknown.
WPILKENXDLVPLFKWAPSSTSCSQRCLLSRSWGGNIDREPLMTSTSGSEHRVTQAEGGFEFKDVSFKYPSRPEITVLDNIIXSIPANKHTAIVGLSGSGKSTIAXLVTRLYDPTQGQFFSTATTCVMSTLGT

SEQ ID NO: 24237 - protein, 104 aa, A.fumigatus
VSVIEHVLMFAPGTVALREIRRYQKSTELLIRKLPFQRLVREIAQDFKSDLRFQSSAIGALQESVEAYLVSLFEDTNLCAIHAKRVTIQSKDIQLARRLRGERS

SEQ ID NO: 24238 - protein, 227 aa, A.fumigatus
ALIYFHRGVKTAGCERKYPKSVVIFSAPTSLVATVGHQTHRMRRKLLNNFFSRRSIENIEPVIHNSLSRFLDGLTTAYKEGSVVELIDRLQGLTGDVITEYAYGENYGLQDPENYGKGIVKVVQEGTDQIHFFRFFPLVSQLLRIIPSWFMGQVFPARAAIYQLLDGVRKQSILALQQKNVSTAPQRMTIFQALTAPEVPPEERNLQRLQDEGLVLFAAGTENTATT

SEQ ID NO: 24239 - protein, 207 aa, A.fumigatus
NAWMAHTQTPVIFNHHEPYVVNDSSIINVDLNGIQSTRAAKENKERVLILTPLRDAAPHLEKYFDLLYNITYPHELIDLAFLVGDSQDDTLAVLARELKRIQDQVEDKIAFRSATIIQKEFGAETGMNVEDRHSFAAQGPRRKAIARARNYLLYSALKPDHSWVYWRDVDIVDSPPTILEDFISHNRDILVPSMSKLFYSSCLSANV

SEQ ID NO: 24240 - protein, 368 aa, A.fumigatus
VIGALRPLCFSAPRSSSGLDQLFSSAGLWATAGASETSQFWKLREELNRTDADVSIFFVNANSVMYEYPTDDPIFSAHVSALSQLRKMGMNTSIAEFDDWYSADTLTTIFGCIDQFQICNARTEVCSDLQGIQAWASLDGMLAFIDAYDLSPLQADTLSVLVNYLVLNNMYYSIYGRSSYALRAQETLSNLNQVAQLPSNQWQIEVQSWFETNLAKLQERSVQFATGPRSSREGKQRVALTDQTPLCKAQKVRCPAGMTSFSVLGVSCLLAVGGLIILSNLSLDSIMARVGPKWFPGSAYRHLNWALDDKLQLQRKAFEGAGVGHWHGQTAAVPVTDTGETFLAWANNEDPAPKSDHLDTSDDHATRE

SEQ ID NO: 24241 - protein, 131 aa, A.fumigatus
SSRQLQEDRTRPIQRRKSSLRGSAPSAPCTGGSDPSGPLAVFPHGSCEAPWQTVRCAPAAWPGWSRTTIAPQSATGCSAAAQPGSGSTASPGRAMRTMTARRYCSTYCSAPGSSRVPRVCRPGAGLGRRRQ

SEQ ID NO: 24242 - protein, 69 aa, A.fumigatus
LWWSKSDSGNSVIDINISHFRTEYIAFFPHKYQKSAYLFSHRHPRTFFNRRFSSSRVYYWQWCSTTERN

SEQ ID NO: 24243 - protein, 163 aa, A.fumigatus
NIEGGWLLSYEWRWSLADFDRDFGMQWSLVHTFRNEDDGETIRTLSWGSPDELLLGNSHLTLWFLNDVPRLIWKQKLANPVKFAQFSPDSTLVATTGQYDRMVKVWRRLSFGADDVRFEVSYLPHQAVVTGIHWRKPIHREQSLDNVFYTLSADNKIRVWAAI

SEQ ID NO: 24244 - protein, 124 aa, A.fumigatus
VYISGHALVILTGPQTLLQTIYVDETKTLEAVTIDEASGKIAVCGGPDVFIYQPYGIQHETLKVGGYCPMNGGGRLLTLIVILECSGPLYIPFATKTMARQSEPCRGALPMSYSWAIRTSHCGS

SEQ ID NO: 24245 - protein, 144 aa, A.fumigatus
QDNRVYVGYPNIAQGDINDSTLEIKEMIISDPKPDSFYLDQTQVIGSHSMFHPTIYAFDAAVSLLGAATFATVKVPQVKANDGTVVHISQTLDLSDVGAFGGFATAVMQNEEIKLNIYGKPDLKQGGLPKIDVTYNKTVTMKGE

SEQ ID NO: 24246 - protein, 76 aa, A.fumigatus
SGLGQTHGVRTQLIMQTLALNKLEGFAITEMHALSGKSANGANFGGTVYIPNPSPMTISMVCCFSVPEWYRSPGWT

SEQ ID NO: 24247 - protein, 94 aa, A.fumigatus
RLELPAIADHQSSDINYLVMDYLITNGYPAAAKKFAVEANIQPRADIESIQERVEIRTAIHSGNIQAAIEKINDLNPQVCIFFYSCPPALPPIL

SEQ ID NO: 24248 - protein, 64 aa, A.fumigatus
VNHSCYSRWTTYNLHLSAVKTDCSGLQAGYFVCIGVAGSTTTTTSNPHSPQQTGIAANCTVAID

SEQ ID NO: 24249 - protein, 86 aa, A.fumigatus
VKGLDRCNVAMSAHSQTISTIRFAVLHTSANLVIPLPTFRFISFPYFHLPLILTPLLLTSLLHFSTLIFTPISPPSLSFLPTLFST

SEQ ID NO: 24250 - protein, 111 aa, A.fumigatus
SINSYKDHRFTAPGKTVIKLLNRVNINIPPKLQPTIPETSSNQTTLPPLFASFPRHLLHPPIILQLVIRPIMAILDLVIMPPHFLGYIWTQVPVLVDVGRLPSADGRPGVV

SEQ ID NO: 24251 - protein, 160 aa, A.fumigatus
PQKCRTFSKHKESTQTSSSITSRSPIRTPTFLSSATSAISSSTTFSTSPPPAIFPPGSPPPIIKRSTKPAVSPPSSTPSASPSPSHSNARLSPVSQTSSKKPYSRPPTQPPSGPTRTHKSPSSGPSPSAASRPRTAQNGLGSYIPSPKRLPVMGSTSGRS

SEQ ID NO: 24252 - protein, 165 aa, A.fumigatus
  UNSURE (8): Identity of amino acid sequences at the above locations are unknown.
LGVRVRPXVSDRLNPRNAGRFPSIKSLHKHHHRSHQGLPSERRPFSPLRPAQSRPVPPSQPPLRPPSSHLVPHPPSSKDLRNLPSRRPHLRRRRHLPPPIPMLASPPSRKPPPRNPTADPRRNPPLDPPARTNRPPLGPHPRRHRGREPPRTGLVRTYPRPSGFQ

SEQ ID NO: 24253 - protein, 179 aa, A.fumigatus
RVYTNIIIDHIKVSHPNADLSLLCDQRNLVQYHLLNLPSARHLPTWFPTPHHQKIYETCRLAALIYAVGVTFPLPFQCSPLPRLANLLQETLQQTPDATPLWTHPHAQIALLWALTLGGIAAENRPERAWFVHTLAQAASSNGIYFWPKLKSVLEFMLWYDAACDEAGYSLWLEVAGLL

SEQ ID NO: 24254 - protein, 176 aa, A.fumigatus
RLLVGFLDNKSTGKTADTNGSATEGSEEDSRPVYASTGMSSEEDLSVETDIVKDYQTFKFLDLNKPLLLQLWNSGFSKEFYLQQIHRPRHYKGGESAPLFGNFLEPLSKTAWYVVPLLWLPPVTYGSFVGFAGLGNVPTAASYWLFGLFLWTLIEYLMHRFLFHIDGYVIYCCLPF

SEQ ID NO: 24255 - protein, 93 aa, A.fumigatus
RVRNLLLSALLTSPDVLAFLRYLPDNRVGITLHFLLHGIHHYLPMDKYRLVMPPALFVILATPFWKLAHTVFFYNWYAAVTVFCGGVFGYIWL

SEQ ID NO: 24256 - protein, 209 aa, A.fumigatus
QVRVCLSHFPCHRPGLSSAGLTTLPVSPSASHVIVCSRSMSMRIYALTPFDETSRTVETSLLRTLKPHTGPVVTSTVDPTSTLLATGAADGSIKVWDIRGGYITHTFHVHGGVISALCFFQSPVQDGDTKSSKKKQSKKMSVDLDGDDDMAESDFAVGFRLASGDEEGKVRVWDLNKRKSVTTLESHVSVVRSLSYSSFGECIAICCSR

SEQ ID NO: 24257 - protein, 184 aa, A.fumigatus
YEACHILPSENALLSAARDKTVIVWDVRTFKTRRIIPVLESVEAATFVAESGLCMVAGENGKLRVWDCNRGGEVTKEQEAGPEFEAVVAIHYFPGMKFAMTVHADQTLRLHSLESLSAFKPGSTLDPLTVVRRISGNDDDIIDLAYVGPDRSMLALATNTDSIRIISVAPSEDRPSTQDREYFG

SEQ ID NO: 24258 - protein, 164 aa, A.fumigatus
SVKRLTVYPERPAMQPQFRVEVVSDDDFPELYRALWEAFENPYQGIVRLFFPIHNDDREGSLKACVKSQLEEYHKEQPHVTWIKVVDTEANKIAAAAKWYFYPENPFAKKEGPIVADWFPEGVTREWATQAVRQFEHPRESMARRPHACQFGHLHPRGRWGKLC

SEQ ID NO: 24259 - protein, 80 aa, A.fumigatus
VSAVKHNHIMSVNSQGKYLSEDPGSQYEETIYESTVRSPIDLIMPYETYNLRQIATQQSEKSRILSYACAPYVTTRTIAD

SEQ ID NO: 24260 - protein, 228 aa, A.fumigatus
  UNSURE (23): Identity of amino acid sequences at the above locations are unknown.
PSSNIIFSLTSANVVTGSETGHXHILNPATLKPELVTPVTPGSPLVTVLWHERLNQILTGSANAETHVLYNPNMSTKGAALVMSRAPKRRHIDDDPSLTMDLSAGISGDSVVVGSNGVPHYSSATWSARHPTVGLTASGRSRDPRRPHLPATTPFAKSQPDERHIRENIPLSSMRDEDPREALLKYAEKAEKDPIFTKAWKETQPVPIFRELSDDEEEQEPNKKRAKR

SEQ ID NO: 24261 - protein, 126 aa, A.fumigatus
RKFPDPELIRWANDMSRKGGRTSSIRSFKDQTIGTGIFLLDVLNGMKSSYVDYDLVTPGRSDEEAYANAKLSISIARKLGATIWLVPEDICQVRSRLVTTFIGKLGSSPQRSCLITHSNRFSDGHI

SEQ ID NO: 24262 - protein, 71 aa, A.fumigatus
RPSSNLNRILLKRRVLDYFQFLVNRTVERAKKASQGAEHFHVHISHNGPLLPNGDFKGKNYANAERLSSMA

SEQ ID NO: 24263 - protein, 168 aa, A.fumigatus
SSHHPTENGSTLSPSNSSKSPSSPRTRAPLCPLGPPTNTSKTGTSPTSARSSSITPLTRPTAARNSLRLFTSFRDSGEPAPAPAPASVPVPAPAGKLALLSSRFRIQITSAPIASRTTRASSPENSTAHCAGEGGAALSPSPAVCVRVRSSVAVWRGISSTHIGMSAV

SEQ ID NO: 24264 - protein, 296 aa, A.fumigatus
  UNSURE (12): Identity of amino acid sequences at the above locations are unknown.
GLMKKLQYTHNXDAHVRALGQKYMGIRPNVHQELLEENSLNDMSRHDVLVDNFLNAQCKASELSSSSILQYSLTLLIDFSEISLGTPPQKFKVVLDTGSSNLWVPGSDCSSIACFLHNKYDSSASSTYKANGTEFAIKYGSGELSGFVSQDTLQIGDLKVVKQDFAEATNEPGLAFAFGRFDGILGLGYDTISVNKIVPPFYNMLDQGLLDEPVFAFYLGDTNKEGDNSEASFGGVDKNHYTGELTKIPLRRKAYWEVDFDAIALGDNVAELENTGIILDTGTSLIALPSTLADLL

SEQ ID NO: 24265 - protein, 110 aa, A.fumigatus
RDSLPDLTFTLAGHNFPIGPYDYTLEVQGLLPSAPFNGAWTSPIPVGPPCLFWGKTLSCRKVGTRFTNLWVTTPVGSGLRAQINVFSAWQPPLFIPNCDCHERLRLFPSL

SEQ ID NO: 24266 - protein, 130 aa, A.fumigatus
HIHAPQFTDPWTSAHTSSHSTPPVYATSMGINHTKPEEVSRPTLSMPYSSVPVSAPSMVTSGNFSTAPTGYSGAEVIGLQHDMPRTTFEQAPTYTTASSMSSFTPATYAPISYAPPLAHPHPDSRRVSHV

SEQ ID NO: 24267 - protein, 195 aa, A.fumigatus
KHKPLTSSFHSSDPRGNHSQPPSGPTFGDALDASRGMVALSQDLTPRNIYAPRARGSGDSYGFLAAHSSGSSISSGGNYPYYSASVASVESSVTDYSSTTSESYENGHLSRTLPRPSNLLSGSAPPGPQSMMSQFSSKMPSNTQKKHKCKVCDKRFTRPSSLQTHMYSHTGEKRKYFVIFLVEAFGTDFETSVCM

SEQ ID NO: 24268 - protein, 135 aa, A.fumigatus
  UNSURE (53): Identity of amino acid sequences at the above locations are unknown.
YFSLKPSVLTLKLAFACDVERCGRHFSVVSNLRRHKKVHKGEKKNVSGGEDEXKARSLLCTRRTMPFPFLCHLMDARSFSAWVIALSGRPNHLPTNLVGSRPLYNKFIPRCFCYFFPFFLFLFYISLLISARPEN

SEQ ID NO: 24269 - protein, 326 aa, A.fumigatus
  UNSURE (265),(313): Identity of amino acid sequences at the above locations are unknown.
WVPVGALVFTEPCRSFQPRGEDSAVYVCALKFVDIGPASQSVRRPDAGRLESTALRLLIESLPHATISTIQAGLLLMEKSTIATHALNAQLVTAGFELGLHQDCSGWNMETWEKGLRKRLAWALYMQDKWSALIHGRPSHIFAFNWTVKDLVEQDFTEAFHTDNAQQDDADVGHGPLFFCHMVALTTILSDILDRFYTLQAIEEFKAAGANRTRMILERAKPAQIRLKEWFASLPPQLKMDSSIDLFDTVTEDTARNGPLHLSYXATRNHPPPLHHSVLLPGHGRRPTFSTFAAPAQKTRLNFNHGLCQPAAXSLPPLFLPGGFPD

SEQ ID NO: 24270 - protein, 159 aa, A.fumigatus
PCGFPAVVQVCQPAREGFDPSSTAIRQTDSRAGKPIDADACQNFKDNVLFQSWQTRSDVLNFCAGVATSPDPDDPDLILRQEESAKEREKIVDERLDPYSARYFPKELRTESLANLVRNQRTVEDIIRARTWSVVTERCSDSAYTWEEALNNWRQTKQR

SEQ ID NO: 24271 - protein, 67 aa, A.fumigatus
  UNSURE (14),(19): Identity of amino acid sequences at the above locations are unknown.
RPVHFELTDLRDTXEPKVXGGSPSQVAAINHGNYFLHAAMESLLKERHQHPCRQSGRTLSGPSDYEK

SEQ ID NO: 24272 - protein, 90 aa, A.fumigatus
KISRGLWYSARFVIVGHLDDRSSAKIPCYVQRGRKNGFRCRRRIRFCSNGLFLWSAHNSSGAPFDTGTSYRPGARFGPSGIRQGSRRLNL

SEQ ID NO: 24273 - protein, 96 aa, A.fumigatus
YSGDVVCLLSLKNIFDRANWSRYDNAWAIQQIEEGHNSLLMRKPFTDADAEGLSRAGKTLPRIITLGGDHTITLPLLRSINKAYGPVTVIHFDSHL

SEQ ID NO: 24274 - protein, 65 aa, A.fumigatus
PWIVAPATGTPETGGWSTRELRTIIRGLDGLNFIGADIVEVAPAYDTNAELSTMYVPCLFDLKCN

SEQ ID NO: 24275 - protein, 80 aa, A.fumigatus
LPMLTMVVWQGSRKLGFSGGYNVPLEANPFVSELKVLDCGDIPVTSYVSYLSKIFLTVLTGLDTTMLGPSSRLKKDITAC

SEQ ID NO: 24276 - protein, 61 aa, A.fumigatus
LILVVWGNKPTACRHGQGTFRRSIHCHMRTPPICLILKLQVKQLAINNFLLPLSFLLPFQE

SEQ ID NO: 24277 - protein, 141 aa, A.fumigatus
  UNSURE (125): Identity of amino acid sequences at the above locations are unknown.
IIFFYLYPSFYPFKNKHTGVYQIMENSSSSEGRDPSAFLGEIIGAPVTVKLNSGVVYKGFYIISILCISIFVLIISTGELQSVDGYMNIALERSEEFVDGKLKRSYGDAFIRRKIMVRSCNQSFXDPPSILMNLVLYISAQ

SEQ ID NO: 24278 - protein, 267 aa, A.fumigatus
TLERQTISSVFSVIHSADLLVFQPPRCPSLLRPRRHGASLPWLTMPFIFFDYQFWHLPVSPLLPVVSYTLSKSAALTLRLTIFQSLVWLETDRVSSELIYPRNVPADARTNVPSPRQFGISDYEDLQIPTPDGESLHAFFIRPANKQHARNITVLMFHGNAGNIGHRVPIAKVLQEILGCNVLMLEYRGYGLSTGVPDEAGLKIDAQTGFDYLRQRAETRNTTIIVYGQSLGGAVAINLVAENQASGDVGGLILENTFLSIRKLIPT

SEQ ID NO: 24279 - protein, 222 aa, A.fumigatus
YGRSGLKNPREPKWISGLDQRYQSAVVGSTVFEAVRLHALTDIRSHGWPYLDLKVAFSGPLLSGYCILSLFPFFLFFMLPSISTFSSLPVSLSFSDPFSSPVFSSPPSLDYVFAPSPSYPRISYFLLSPCVLLPFSSPLLPLFLSLDSLPLLFSPFLHFLLPLFLIPSFPSLTLSLGISCLFSIYCVLSHVFSSFLSSLLLSSFNFSFRPYFFFVTLLASFP

SEQ ID NO: 24280 - protein, 169 aa, A.fumigatus
KWPFLGPSFPAIAFFPFSPFFSSSCFHPFLPSLPFPFPSHFLIPSHLPSFLPPPLLTMYLLLLPLTPAFPIFCSLLVFFSLFPPPSFLSSCPWTPYLFFSLHSYTFSSPYFLFRPSPLSLFLLASPVFSLSTVSYPMCSLHSFLLFFSPLSISLFVPTSSSSPFLHLFL

SEQ ID NO: 24281 - protein, 142 aa, A.fumigatus
  UNSURE (4): Identity of amino acid sequences at the above locations are unknown.
AGFXRETAPSSPVVKTIIQGIPAFALACGIWFMPFSPRWLVKVGRDQEAQSTLAWMRKLPIEHDLVQMEYLEIKAEALFEKRAFPNTAEKGILKNQWAQYANCFSTMDNFKRVCTAWLVMFFQQWSGIDASMSVNSVFLALS

SEQ ID NO: 24282 - protein, 82 aa, A.fumigatus
RLKVPVFEQTEEKNEAMTRDVEESVREFTRSLEDSLKEEGETSTREHERRRWEDALGVEDVIRDFIYDLQRGSRTAHIRKEE

SEQ ID NO: 24283 - protein, 149 aa, A.fumigatus
DPHPTIFASRYIWLTMLSLACRMEAQKREEELLKEKEAQEARLRALEEQVRQGKIRKQEEKRRKEEAERLAKEKEAALAAQRAEIERAKERERQLQLELERLDEESSSDDEGPVNITPEDSTPTQSQLLPTVTPPAPVFYPRGPEVTAQ

SEQ ID NO: 24284 - protein, 70 aa, A.fumigatus
DRPRRPPRQIRRSPPPPVSPRRAEQRPSPDHQPGVPAAQAGRLHPVGRPELPRRRGRQGQCPARRGHSRS

SEQ ID NO: 24285 - protein, 242 aa, A.fumigatus
  UNSURE (60): Identity of amino acid sequences at the above locations are unknown.
ESTPVRIADLATGTAIWLLDLFRDPAVARYKSIRLDGFDIDLANALLPEWLPTPITLRQXSLFETVPGDLRGKYDVVHLRLLVLVVQNSDPLPIINQAYQLLKPGGYIQWDDLNYPDGAVVKANALRDVATPAHDAFLRFARSNGRNDWVLDLPHHLMSRHGGFEDAHICNYTDRVELRKANGDQYILVMEEFSARLKRAGKMEDAHNIDLMIRGLAEESRRGVGLSMPKAVCVARKKGDRA

SEQ ID NO: 24286 - protein, 331 aa, A.fumigatus
AGIPIFIRLEVPNSIAAFPRSVENGAIPQLGGSLSLNGRDSKFHITDYDVGGFNLIYSSAEVFTWAKGDNKKRVLVLYGGAGELHEFALPKHLPRPTVVEGSYVKIAKQGSAWVVQWEVAAQRRDLRAGKLEIHLLWRNDAYQHWVLELPAKQPIANYSSPSKETVIVKGGYLLRSAWITDNDLHLTGDVNVTTPLEVISAPKRFDGIVFNGQSLKSTRSKIGNLAATVHYQPPAISLPDLKRLDWKYIDSLPEISTEYNDEGWTPLTNTYTSNTREFTGPTCLYADDYGYHGGSLIYRGHFTANGDESWVFLNTSGGVCFANSVWLNQTF

SEQ ID NO: 24287 - protein, 159 aa, A.fumigatus
  UNSURE (140): Identity of amino acid sequences at the above locations are unknown.
VIFTIMNVCGANANLCIVPGIGHRVKSRNNPDLRVELVKEFAKKHFPSTKLLDYAIAVETVTTSKNDNLILNVDGCVAVCFVDLMRNCGAFSPEEVEDYMKMGVLNGLFVLGRSIGLIAHYFDQKRLRTGLYRHPWDDIXYLLPTLQKGGAEGRVEVNI

SEQ ID NO: 24288 - protein, 82 aa, A.fumigatus
RGSFQPRGEDHGPAVSGAMNTIITTRAGKDLISALVSGLLTIGSRFGGALDGAAEEFTKAFDKGMSPRDFVDTMRKENKLSK

SEQ ID NO: 24289 - protein, 103 aa, A.fumigatus
WVRAPSAIISLSRLRLKNDEISYTNFKSQDSSTFELSIRTVFQLPQRKKNTLSRRLGYPRDFNNAYQLGPASKIVTSSSKSSNHYRSSWPTSSTNKKKLAFAG

SEQ ID NO: 24290 - protein, 224 aa, A.fumigatus
VRIPRAIRYDSNVKEKAGPTLKRPMSSLLDRRHDLLIGRTLLNPARQINDGDIRGWHPHSHASDLTLQLRDHLTNRLRGTSTAGYDILRGCTPTPPVLGRRPINQLLRRGVRMDSSHTPLHEAELLIDNLDQGSDSVRGARCVGHHVRRAVVFLLVDPHHVHRGISGRSRADDFFGSAAKMCFGFVDRREDAGGLDDVLGSSFVPGNAGGVFHRRRTSPCALGW

SEQ ID NO: 24291 - protein, 218 aa, A.fumigatus
  UNSURE (193),(210),(211): Identity of amino acid sequences at the above locations are unknown.
VALFSIRHVKSMTETSEVGTRIAMPVTLPCSSGITLPTAFAAPVLLGMIFSAGARPPLQSLDEGPSTSFCVAVYAWIAVIRPSTKPNFSSTTLTKGAIAFVVHDALDTTSAVPSYFSSLTPITYIGASADGAELTTFLAPPRRCALALSTVVKTPVDSMMYSAPVSCQGMRAGSFIGVELHLAPLDGERAFVXGDFVLEAAVGGLLFEHXXSAAAVSV

SEQ ID NO: 24292 - protein, 109 aa, A.fumigatus
RAGLRRVRPMRRSWRRSRRLLMGLLRVGPAFSFTFESYLIALGILTYTEDDIVSKDIIGNPHSSIFDIKAGISLNANFVKLVSWYDNEWGYSRRVLDLVAHIASVDARE

SEQ ID NO: 24293 - protein, 77 aa, A.fumigatus
  UNSURE (13): Identity of amino acid sequences at the above locations are unknown.
ESTHGRFEHEISXDEGSLTIQGRKVKFYADERPRPHSLARNWSRVHHRVHRRLHDGRQSQSTSSRRSQKSRQLGSVR

SEQ ID NO: 24294 - protein, 221 aa, A.fumigatus
SSTPMKDPARIPWHETGAEYIIESTGVFTTVDKAKAHLRGGAKKVVSSAPSADAPMYVMGVNEEKYDGTADVVSNASCTTNAIAPLVKVVDEKFGFVEGRMTAIHAYTATQKLVDGPSSKDWRGGRAPAENIIPSSTGAAKAVGKVIPELQGKVTGMAMRVPTSDVSVIDLTCRIEKSATYEEIVAAIKEAAHGPLKGRACLFFHVRIISNCSRYPDLYRG

SEQ ID NO: 24295 - protein, 221 aa, A.fumigatus
FALIAASFQPRGEDLQPLKIYKMATAEKTKEQQKEPILQQDDYSDDYSDDYSDEDYETDDYEVSGDEAEAEDPKNQVKHRQRQQQQQQRSRQPDAVEEADDEDYSDEDDYYSDEYDDEDEDYDNQVASGKAMQPYQPAGGNQSLSQNGSMNVIPQEKQGSSLDDEEGMKLKLELNLEIEVELKAHIHGDLTLALMYVTPLLPPDIPFTRSIRIGVDPRCSA

SEQ ID NO: 24296 - protein, 61 aa, A.fumigatus
PLAKNILSDIKWSPNTVPPQYTDHADQFIEKGPSLRLKILGVKPDVAAINAIGTIKEDYLG

SEQ ID NO: 24297 - protein, 68 aa, A.fumigatus
VHHNLYIVKHRQSKSYHFHPRKLNTCTKLPIENNSNAPPCPPQPQSPPSTNPKTPCTTATDTARPSPQ

SEQ ID NO: 24298 - protein, 95 aa, A.fumigatus
EMCCWLGNKNNHRHLSPLICYFLLYIFSNQQTLIHLHDHDNTATGYKCTDCATAQYASQNIQSQWCLTSCGKAPRHPSLKPCSLKWTSQCFWAKS

SEQ ID NO: 24299 - protein, 71 aa, A.fumigatus
ARDPPAPVVKTFNSTLKNYSVPSCFHGPTCVAFIYAQLVGCQDQAVSYKDGRQNGQILYGSSILFICYITW

SEQ ID NO: 24300 - protein, 90 aa, A.fumigatus
ITKDMLLFNRATYLYDREDASPLYFKLLLINLQAQPHMACGLIHSTPAEERFWDKIPIRLADPTRNMGGFGMGLTQLTWVWVINIKPIWV

SEQ ID NO: 24301 - protein, 120 aa, A.fumigatus
LLFTDRPSVSNLGGTFPRYFILKLVDFFTVATCIPPAVPPAAEKLKGDLVTSAFSCALEPDKNRCVNGGGVCETSRDGYYITNILCVLVGTVTFIMFIQPAVLKLQSLPLRAWRLSNGDR

SEQ ID NO: 24302 - protein, 169 aa, A.fumigatus
  UNSURE (2),(4),(23): Identity of amino acid sequences at the above locations are unknown.
RXKXRQGSGNSITDVYQSMWDIXKLKDIQTIIVIHLIAKIGFQANDAVTSLKLLDKGFGTDNMALVVLIDFPFEIGLGYYAGKWSTEYTPMRLWCWAFIGRLAAAVLAQATVMIYPSSEAVPFWYILVVIGEHVLSTFMNTVMFVAVSAFHARIADPAIGGTYMTMLAT

SEQ ID NO: 24303 - protein, 169 aa, A.fumigatus
EICQTPGHLIILAITTPRYGRFDEPLRCQLYAPSFPPSFAGPLSLHATSSVRHEKKEKKEKEKKRKEKKKRKQKRKKERKKERKKERKKERDQKKYRYSLRNCFKHLSPIHPTINRQIMRNGLGQARSQTSRLPLCSSASMDSSSGHRRILQLVLTCHFSLAVQFTTAS

SEQ ID NO: 24304 - protein, 530 aa, A.fumigatus
  UNSURE (49): Identity of amino acid sequences at the above locations are unknown.
RIKNFHNFFRNSFHYSRLFIEGQRLVDSFSLKNATFLSQSIYLTVDVPXRLYPMICFQGQTGSDFSSLDIVQLVASSTCSVLVPVLSPTLNTSVKGAYHPRDTCSPLARWWLYTWVSPLVRVGYERNGSINKEDLYPQKNEASVETWQQAYASCDSESLPFKSILWKLFRMRLATMALFSGLCGFFELVGTIGLHQLLLSLQSPSVARLQPWFSVTLFAVSPIIRGLCMQTFEYFATHTIGDWKALIVAAVYRKMMILEADADINIGQLQSIISVDIDRLGTLRYTAMTAFMIPVEFVTASILLYRAMGWYYIPSLLFLLVTRYPISRFIISEQTKSQSAIVQATDKRITRTSESIRALLMIKILGNAQTFIRRILDERKQELDAIWLKMRVIILSESLSSSCSFLAMVFSLCLFISAGEKPLAPDIVFTLVAVFNIIKSMLTLSVLGVGQYAQAMVSLQRLSDFMDRKTSPVVTDKTQHTMQAQRLDQRVPSSSTAQVLGEFSHTQVRLDVKFARGGLNVTTIFRPRGW

SEQ ID NO: 24305 - protein, 197 aa, A.fumigatus
  UNSURE (37): Identity of amino acid sequences at the above locations are unknown.
CRWPDLLFARMQKYRPTSSFAFVNQAAGGNRILADGXGPNVLSRLDRDVLAHSGVRYAMIFEGVNDIGVASADPAAQQRIGDELLVAFRQIATRVQAAGIPIFGATITPFGTPVGSNYTQPYSSDEREQTRQRVNDFIRSSGVFDAVLDFDKVLRDPRAPGVLAEEFDSGDHLHPNVRGYQALADHFPLEVFDRFHW

SEQ ID NO: 24306 - protein, 472 aa, A.fumigatus
WEEDGMESVEGEICIVGLVLAWGYFHDPERTNSAFVEWNGVRIYKTGDYGRRTKHGLQFCGRRDSVVKNRGFLINLEADVEPALLSYDKVDSASAFMSQGQLIAFVTPTSAKEGLREYLENTVSSFLVPDTIYSLDEFPRTSNGKVDRRSLMRMHELEQGSDTASLERGLGAVESVRRGLSHVLRLPESQILPASSFRHLGGHSLAAVMLVSVLRRMGFGISVAEVLLLDTVENIAAAVVELSDIPHALSAQEDLIERLRHDISTTRPLDEGVTIAPMTDMQTRLLGASVATPGLSFIKTSFTLDHPEKEDLTSTLRAAWVRLHQTHEILRTAFVLTASNGAQIISQEPDFSWKEKFVTESEWESVCRREEHLDVADFPDFDAENRASLSRVVLIIAPRRRTRFVWTVHHSLIDGWSMATLMRDFASCLDGKPIPAPPQFAQVAQAIGQLKAESSDRAVSFCRAYLDVYTTA

SEQ ID NO: 24307 - protein, 387 aa, A.fumigatus
CQYVLRHNSIFQLPWQRIINATEAVAASHETFAQKIDEDVERPLREYSSKNRELASMPGIQSDLAALAKSFEANQKKVEKAREKGPKGAEKLAAAISAAEELREQWDSRAPFVFEQLQAADEGRVNHLRDTLTQLQTHESDQVERCRQAAESCLNVLLNVETADEIKTFAAKVNGGRPVAPRRQESIPSGGPGAPLAPPPRIQDDAASQRSETSGPVRTPPGKSSLHHSHRMFANHGCVVAPEPRTTALGGLKRLGTVMGRRKSVVHTPGGWPLFGYKKHRNPFASFKRGDSREMQIPESPTGTDRPGTALTTQDIHGESAPIPSEIHERGLPGSLPTSPKPLQTPATTNGGVAQEVHNEPTPAAAVTATEVCVDDNEHLDWTNDDA

SEQ ID NO: 24308 - protein, 61 aa, A.fumigatus
EPFRVDSRLCVIISPIQMFIVVHTYFGRSHSSSRCRLIVNLLSYSPIRGRWCLQRFWARRQ

SEQ ID NO: 24309 - protein, 71 aa, A.fumigatus
VYAAMHSLFKLTVPSAGIGGMAAALALGQRGHRVIVLESAPKVCFTNNLKTGQKFGVTLINPMKSVPGYPR

SEQ ID NO: 24310 - protein, 127 aa, A.fumigatus
WRTGETVACFDIIMPEVSEVAGGSLREHRLPNIIQNMRDHGLIKQRLYPAAGAGETPTTQTAPEQPLYPHLQPYEDLGHLQWYADLRRWGSAPHGGFGLGFDRFISYLAGVSSVRDVVAFTPILWPG

SEQ ID NO: 24311 - protein, 294 aa, A.fumigatus
  UNSURE (289): Identity of amino acid sequences at the above locations are unknown.
QHEFHFHDLFDHLDSRGYVILIRMRRQLTKRACDECISRKVKCNGSSPCDTCLKTSKEADCTYLKPPGRMGPKAKRYTSKSRSACDGSIGHAHTEEAAARTQSVENRPAIPADVHADTERDESLSSCISKTVLVYIVRLYQTFSYSVWPVVDADAVLQQLGNGTCDAQTLCLVLALCAATMAQLQLAPMAGDDGHMVDSSQLKSACMQLRERSDYRENLDVKGVLVSFFLHVYHAKINQRKSAMLFIQEAIASARLLGLDTNERNAVVTDGVVANREIVFVLLWVSERXVTVNL

SEQ ID NO: 24312 - protein, 92 aa, A.fumigatus
ARAWLVLLTVSLLSKYGVAISVVGQVLTAAIICPWYLRRPSHVQNCRGCHTSILTFSFFLPTESLILEAFYSMEIIRRKAPPCLHQGGGGPE

SEQ ID NO: 24313 - protein, 167 aa, A.fumigatus
LQDRHVRMRQIYETIDRQGYQWIVVFVAGVGFFLDGYTVSQPGYLQWTRTRTQRRQLFASNMALPMVSYVYWQNNLSSKKLTYINIATLAGTLFGQVLFGYLADRNGRKKMYGVELMLMITSTLGVVMSSTGENGSMDVFAWLVWWRLVVGVGVGADYPLSAVITSE

SEQ ID NO: 24314 - protein, 114 aa, A.fumigatus
SRQRWVSSCPRPERMGAWMCLPGWFGGDWWWELGSGRIIPSVLSSPRSKAMHSAYRSPRLIIGVRFAPAKHRARMMASVFFMQPLGQIAGNIVTLIVVAVGKNQQHDDVIRTSS

SEQ ID NO: 24315 - protein, 64 aa, A.fumigatus
KCNVPQNDRRIKRASKSVDCPPPPANKKIGNGALVGSRNSATEYLVFMESLFIDHIISFEAHGY

SEQ ID NO: 24316 - protein, 160 aa, A.fumigatus
VKGLFFLGMRVRHFHIFSSNSLTFILGGFFVFFILFFLTLLLCILVTLLLGPFFLRCGLLIGFSCSLALFVLCLFLLLIMVAIPHLLIHCGVVEVVDAAYFLIDIFFFFRAAGVFIFLFVLCLAINLLALHLFVIHVNCLCRSLHVLRRLLILFLLSKLR

SEQ ID NO: 24317 - protein, 353 aa, A.fumigatus
EGVEDISKDVGDDEDLSELAQQEQNEKPSEDMEASAEAVNMDHEEMQGEEVDREAKDEEEDEDASGSEKKKDVDEEVGSVNDLDDTAVDEKMWDGDHDEKQKETENEQGKGAAESDEQTAAQEERTQEKCDKDAEQEGEEEENEEDEEAPEDEGEAVGREDMEVTDPHAKEEETLDLPEEMQLDGEEKEDDGAESDDGMDDMSDFGPAPAEDEQQAEGNEDNAENPDMDDPTDEQEPDRVDEEAMEDQEANEAEGADEANAAEEEELEARQEEFLTQHDDNEAGGEEVAPSEAVNGGLGTDEDQNKEQGAAGNAQQEDGSTDPATDAEKPTGGAKEGEDSQRKKDAGGADDVS

SEQ ID NO: 24318 - protein, 79 aa, A.fumigatus
SLESKMTLPSNVHVSSHPCLQAKLSQLRSHSTSPRETRSLVHDIATILGVEAFAAGLKAASGGKVVILPDQELQYRKPI

SEQ ID NO: 24319 - protein, 136 aa, A.fumigatus
SVSEKMTSSVASDYPQPISSPPPVYLRSSPPLSPSQSQSTPRSIPQQRATQHIARKALPGSQSENGYPPVPPVYIHTDMNLSQSSNMTHEDTRNGHVANSMPTTALANMSLEDQSQNPQNSNGPFPPRRDSYAPPP

SEQ ID NO: 24320 - protein, 118 aa, A.fumigatus
SDHLLRLLHIHWTKSRCRQISKASPSSITLAPDQFDSLLNRRQYRNPVSCRCRHLIRVRENDKLGSKRLPSTNIVPSPGLSSIISPAFAVSESINPQIDTPTARHTTHCTEGFAWLSI

SEQ ID NO: 24321 - protein, 374 aa, A.fumigatus
  UNSURE (370),(371): Identity of amino acid sequences at the above locations are unknown.
RRRAKIEALQNRRLEGPVISYWSGIATWVNGRLTRVGKVDITPKPEKEETTRKKSKKTEKEEKSTAEKPAQNALAGPATSQTASLGSSTPQETPAQEDSAKAPQKTEETKSVAQEQDTDKATTASEPTQATSAPENSTIPEGSAASAESSNPAPPVESTTIPSEASTEKVPDSELPKIKADSSKEPVKVESKTTGEAQQENETAAAGSKSPGEEPKDPTQTAAQVSEERPTPNADQSKPEAPLSGVHPDGASRTTDAEAPTNEKPSSESKVAPPATSPPATQIPIAEPTQIGQQEEPKVSASTEQKQVAPEIHADQPDFSSDGAPQPQIPAPPPVVEQTGRCLTILENFDEETAQSRECLHQGPEGPRMXXERA

SEQ ID NO: 24322 - protein, 141 aa, A.fumigatus
YYYRLLQERNPTLIMSRPFPYTYISCPCADTPVPDRSRKRRSRESPAKKPEQGDRSTAADTEEEEEQTFDPRAPRSNFSLYPPEQLLYCEDCHQIKCPRCITEEIVCWYCPNCLFETPSSMVRSEGNRWVPLGSVSQVVPR

SEQ ID NO: 24323 - protein, 231 aa, A.fumigatus
HPRGSFQPVVKTKQKSIKDQSVEIAASAGISTESLASVISLFSSTLCCSSPSDCCSCSRAARSRSSSSSCSTFSSSSSQLSATSAAGGVERFFFAAPTPDRRTSFSFLGRPQLPLSLPARAANFEPDHGLGLATGVVLRVELTPLLRRDAATWAQPLSPAVSADCCALAASLSALASAAARRCASRSLRRWRSRSLTHSPTLLPPMPIEFSGPTPRSGGVQVVGFRTKTWR

SEQ ID NO: 24324 - protein, 299 aa, A.fumigatus
RPTTTAASNLSPSTLPYSTETLDLYVQLSSTSPLSTLQTYESTLHSLAISTTQRSVRFQPAKSPLRAFIHSLAADWGFASESFDPEPHRHVFVLKPTTWTPPLLGVGPENSIGIGGKSVGECVKLRERQRLKEREAQRLAAAEAKALKEAAKAQQSADTAGDSGWAQVAASRRSNGVSSTRSTTPVASPSPWSGSKFAALAGSDSGSWGLPRKEKLVLRSGVGAAKKNLSTPPAAEVADNWEEEEEKVEQEEEEERERAAREHEQQSEGEEQHRVEENNEMTDARDSVEMPAEAAISTD

SEQ ID NO: 24325 - protein, 361 aa, A.fumigatus
KYPFPQIFSGSMGPGQLRMNWNFGKSSKNRAVFLKRFFHASSFPSLCRHMVKKVPPKFTTCWFIGASEVEVPSQMTRSNSSFSLIGLDASIANASRRILMAEVPTLAIEYVFVHNNTSVIQDEVLASRLGLIPLKGSVEGLNWMRWFKKPTEDDPESGSTPADYNTIVLRLDVECTENPNAAPGEDDPRKLYKNAHVYAKDITFHPVGRQEQFFTGDGAVQPVNPDILIAKLRPGQKIDMELHCIKGIGADHAKFSPVATATYRLMPDIKILRPIIGEDAKKFAKCFPKGVIELEPVTSREAAQKGSEYEGRAGEMKAVVRDPFKDTVSRECLRHEEFQGKVKLGRIRDHFMFNVESTVSV

SEQ ID NO: 24326 - protein, 140 aa, A.fumigatus
  UNSURE (1),(43): Identity of amino acid sequences at the above locations are unknown.
XTIPWTTTRGFWPVDFASGIVDGKTIARSGNKAIADTGTPLAXVDDETCQAIYDAIPGAHYDDESQGYIFPSTTTADKLPVVSLAVGDKQFVVQREDLGFAEAKSGYVYGGIQSRGSMAMDILGSTFLKGIYPVRLSDHC

SEQ ID NO: 24327 - protein, 203 aa, A.fumigatus
  UNSURE (169),(191): Identity of amino acid sequences at the above locations are unknown.
KSETFCFCLSRLQPTDINLGTVPWSASSYHHQPPLLNISSFSLLANYCYKSLATIVTRSTMARQYPALLHQRMLTHIQHLPLELREKLALLPESPSREEIYVLWTHLLQRYFPFRLHGSLPNLVDLPDETAVKYALGYHQESESSHIALAVGRDYGPFDRLSFLHVSCXAEKKEKWHLEEMQDKWKDEMMXFSHCENAPGARE

SEQ ID NO: 24328 - protein, 220 aa, A.fumigatus
  UNSURE (32): Identity of amino acid sequences at the above locations are unknown.
GIFFLLEKGVDAWHTFAIPRLGIPSIRTPTGXNGARGTRYLTGVPSACLPCGTALGATFDRDLIFSLGQLLAAECRAKGAHVLLGPTINIQRGPLGGRGFESFSEDPVLSGLAAASYCSGVQDGGVVPTLKHLVCNDQEHERVAVSALVTPRALREIYLLPFQLAIQGARPGAVMTSYNKVNGLHASENPGLIRDILRGEWGYEGAVISDWFVRLFTMML

SEQ ID NO: 24329 - protein, 115 aa, A.fumigatus
  UNSURE (114): Identity of amino acid sequences at the above locations are unknown.
QKPQMLTTIILYGRPTRRTRKLFNTSGFVGNAASYLARMLTMGKEMLNHRGYIYTAKHEGCILSSDETFYPPTQVQNSLEPSTGRKNMVFGPRNRMLSGGTIAHYARFQLKREXK

SEQ ID NO: 24330 - protein, 133 aa, A.fumigatus
QGNQGLIGSLRFSLWIPVSQYSYMELSTAAFEHVHGLSLDFHLGKKTGEVLSALSKGSSINTFLEQVTFQVVPMLVDLCVAIGYLLIALDAYYALVVTIVTFCYLYVTVRMAQWRAEIRRQMVNASRQEDAVK

SEQ ID NO: 24331 - protein, 305 aa, A.fumigatus
  UNSURE (286): Identity of amino acid sequences at the above locations are unknown.
RLTWWIRNDSMVSYETVKYFNAEEYEFNRYRGAVSDYQKAEYHVLFSLTLMNTSQNTVFMLGLLIACFIAAYQVSLGQRDVGQFVSLLTYMAQLQGPLNFFGTFYRSIQSALINSERMLELFREQPTVVDKPGAMPLAVCKGDIKFEDVEFAYDTRKPALNGLTFHCEPGTSTALVGESGGGKSTVFRLLFRFYNARNGHIRIDGHDVEDITIDSLRRHIGVVPQDTVLFNETLMYNLKYANQNATDEEVYEACRAASIHDKIMSFPDGYNTKVGERGLRLSGREXQRVAIARNILKDPRNHPLG

SEQ ID NO: 24332 - protein, 150 aa, A.fumigatus
  UNSURE (106): Identity of amino acid sequences at the above locations are unknown.
TRAVNYLTMLLIWSTSTAAQLAEYEKEVRRLRSQTNTHTPRTGSASSTLSTPSNESEHSRSSPPQAQQQSRLSTLTSLLPYRRPSTASPTQTMAQPAQPVPSPDQXTTELQTALEREQSLRKAAEKQLTHASSELEELTPQLFSPANEMV

SEQ ID NO: 24333 - protein, 81 aa, A.fumigatus
  UNSURE (41),(50),(51),(52),(53),(54),(55),(80): Identity of amino acid sequences at the above locations are unknown.
EIHIIVNYGISPSLVSGVDVSETPFCAEKLKAPAFFFVWGXKTIIRGEFXXXXXXREVKGHCFRDRVPKNLPRRYWNFDXI

SEQ ID NO: 24334 - protein, 66 aa, A.fumigatus
  UNSURE (8),(33),(34),(35),(36),(37),(38),(47): Identity of amino acid sequences at the above locations are unknown.
KGVLNSNXVKIPISSGEVLWYTVPEAMTFNLPXXXXXXKLSPDNRLXPPNKEKSRSFKLFSTEGGF

SEQ ID NO: 24335 - protein, 101 aa, A.fumigatus
FAESIAIIAVYNLTVVDHGITALRPTSSNVEDTSLKEEEKKNPRSRGYVISILSVPGPTQVSPGIVDGSPYYAFGGFDYVEFLPTNGVSHYSVFNKAEKTD

SEQ ID NO: 24336 - protein, 110 aa, A.fumigatus
TNKGDAAGIRRPEAQRTGTAANPTMYPTSPMTMDKPLKAILHCRGRGMPWFEENNTDGCWEWPICHRFRCAICPSSDDGTNPNCNGSSTCIVRYPKALQHSNESCPILPE

SEQ ID NO: 24337 - protein, 280 aa, A.fumigatus
  UNSURE (7),(84): Identity of amino acid sequences at the above locations are unknown.
DWARTKXYSGGQPSMVGPWESRERFPDLARASHRAVATRATNWTGVPAPSPISHVERTFVSRPPNGTIPQFGEFPAPQLRRSTXWPRANTGPLPGVGWRTMRTLASSTSCASPASRDSPGGTIAPTRNGAYTEPYFALFPAMPMDQQYDGYKYLPDIDGNSFSGRYRGFLLSTSLPIKATIYDEWHDSRLIPWAHFVPMDSTFPDVYGLMEYFIGYGGRGHDEAARTIALDGKAWAEKVLRREDMQIYMYRLLLEYARICDDRRDTLGYTADILRVGQRT

SEQ ID NO: 24338 - protein, 202 aa, A.fumigatus
  UNSURE (5): Identity of amino acid sequences at the above locations are unknown.
GGVPXGRGPTPGRFPELVGGPCGRWLHPLRVLPLRPGTALGVRSHRPAMGPTRNHTSPCSPPCPWTSSTTATNTCRTSTATPLAAGTAASYCRRLCPSKPPSTTNGMTPVSSPGPISCPWTRRSPTYTASWSTLSGTAGGAMTRPRARLPWTARRGRRRCFAGKTCRSTCIGCCWSMPGSVMIAGILWGIPRISYESGNGHE

SEQ ID NO: 24339 - protein, 439 aa, A.fumigatus
RLGGKHNVRELGRAFGAVWGCNILCEEPAGPCRLGDGLAVYKALSPGPRASGAKGMASSSSPSSSGGAKIFSIGHVLRYSPHNIIVRKLLLLDRVIGDIVSLEHTEPVGWWHFAHSYVRGNWRRATALGDGYLLTKSCHDIDFIMWLLSSPPEYVQGKGEGSTQPQPQPHHHHHPRSITSTGTLTQFRRARKPPAAGPATNCLSCPAERECIYSAVRIYRDLHLSRGDTGWPVKIVVPDIEDVLRSAAGDSEAATAEAEAHLLARLREDYSRGAMSDEEIARRPWYGRCVYEADNNVCDDQVVTITWDDEDEDEDEDKDEANPHAARRRAKTAVFHMISPTEKQCERRGRVYGTRGEITYDSRTISIYDFATRSTTTIEVPKQPPEEEEAHGGGDYGLARSFVRAVDAVENEGWDVLRAQAHLVVFTTWLQGPALSVNE

SEQ ID NO: 24340 - protein, 233 aa, A.fumigatus
HLPGFACGCWRLGTLRRTTARMAHNGISRSQRLTRLMKQKHRTRHEGVEPASRPGKKPAGSLISSMKKPHVLDHNKHHGSPGEVSHDDSAYSLGKRQDSSAIPPGSQTEALATAVTSVDEAPADTGAALPTVISDPASSQPAVSVPVETLPAAVPSTTSLNEIPVPSPDPTSFTTDLSATTTADDLTSIPTTSVFLSLDLSVSLSVSVPTSIAIINSASSTQSSALIPSAQSS

SEQ ID NO: 24341 - protein, 72 aa, A.fumigatus
WLTTDSGRLELRDTDKNVLSQLNGKKASGYGTFDGATVQTTSYLPNCVNFCLVFTGRQDLSSNQGIDRSFAL

SEQ ID NO: 24342 - protein, 113 aa, A.fumigatus
  UNSURE (11),(53),(55),(61): Identity of amino acid sequences at the above locations are unknown.
TAENPSFPQRXSIVMEYVHLVEHTIYGSTWNWNHWLQCSLMPWFRFSYTLADXFXIYSSSXPTIVHAPKDSVQLSEITLIIDRVRLFRPYIEIGERANFSLHSSEAHYCVRNI

SEQ ID NO: 24343 - protein, 227 aa, A.fumigatus
GARPFQPRGEDLIHSPSQSLEGRFALISFRISPAPASSSLPASSSPSASASSIASTLAVMRSSTLRVPSRLTTIASILKSPDDIHSVSTPIGTLHPPSRVLIRDLSARQASVDFRSASWPSNSCIFRSPLRISKPRAPCPTAYRMPPSLEPRYWLMRCLRPTRSRPAADMTMHMYSLCGSSTFARRVSTLPRRLAKRRCGYRRRSWAERRTDDVPTTAPSRRLFKLV

SEQ ID NO: 24344 - protein, 176 aa, A.fumigatus
  UNSURE (148),(174): Identity of amino acid sequences at the above locations are unknown.
FSVSCGLFFNLSFVGMSLDDKYIPIFYGLCRNPSPLNFQPPSSSDNMVETSPTPQLPLRIGTRRSNLAMVQTEGIRDRLQKIGPDRTYEIEALRTAGDRDQLTALYDFGAKSLWKTELEEKLTSGELDVIVHVLKGNTRIPSRSSFDXLQCRVCTRHRYADHAPRHLRVGSYPXPR

SEQ ID NO: 24345 - protein, 265 aa, A.fumigatus
  UNSURE (14),(40): Identity of amino acid sequences at the above locations are unknown.
KVILEFRPVHLLMXCSAEFAHDTDMPTTLPDTCELAAIPXRDDPRDALIIKAGLPYTSLKSLLEGAVVGTSSVRRSAQLRRLYPHLRFANLRGNVETRLAKVDDPHSEYMCMVMSAAGLERVGLKHRISQYLGSRDGGILYAVGQGALGLEIRKGDRKMQELLGQLADRKSTLACLAERSLMRTLEGGCSVPIGVETEWMSSGDLRMDAIVVSLDGTRSVEDRITARVEAIDEADALGEELAGRLLEAGAGEILKDINANRPSKD

SEQ ID NO: 24346 - protein, 244 aa, A.fumigatus
  UNSURE (5): Identity of amino acid sequences at the above locations are unknown.
EQSNXSFPRKLPPDILSLPGLRYPAMATPQELVPQTESIAEVYATDDASGTSAAPEHQSRFNGLVAHFNKLYGHRPDFVARSPGRVNIIGEHIDYNLYDVLPTAVSVDVIIAVKVVPPTGSEPFVKISNVSPEKFPSREFTVPRDTDIEIDPKKHEWVNYFKAGLLGALKFLRKQKADGSFTPASFEVLVDGNVPPGGGISSSAAFVCASALAVMKANGHNVSKQDLLDLAVVSERAVGVYSGG

SEQ ID NO: 24347 - protein, 143 aa, A.fumigatus
VDHCSGIWYCALTSLCCMMDQAASIFSRRGYLLYTQFYPNFAFQHVPIPQGPMKDITFLMAQSFVTSNKAETAPRHYNLRCPECTLAVVVLVAQHGITLTKDNNSLGYSLRNFHEELMRQEARLRGPTGIPEPLRDSVHHGNS

SEQ ID NO: 24348 - protein, 180 aa, A.fumigatus
TESQSSPSSNPPAVHSRSHPIAPCASPPPSPFPPPRQITTGHPPTTHPRDKTHPAPQNPHPFLVGPPRMGRSPPAQAPGSQTRGTTANCSPACPCRAGRAATQRCGSAWPRPGGERRRPARTGARKRAPLLRPCAGRRGRWRPIFPGWPGSVPARMPSIHGWGTMVMAVHGAGAEVNGKA

SEQ ID NO: 24349 - protein, 286 aa, A.fumigatus
RRAPPSSRDLARPFGSSGPSFMPCHLPRPRPHGRPSPLSPSRGSRASGPAQTPAIPEIWGAIAHGDQRMVEAEVLACALLFAPDAFFRRQDEAMQNHIVAWLRGLHGKDMPVNNWRWFRVFANLALVLVANVPYEEVRPEMDADFAVLDGFYLGGGWSGDGPWLSAEGEEREREEGMRTGRWDAIGCGRQADYYSGSFAIQFSQLLYVKFASHLDPERAERYRAQAREFGASFWRYFDKNGTPGDLGTGATSSADGSRRRHPLWTLPDVSLRVWSVLRCAGCRRHP

SEQ ID NO: 24350 - protein, 223 aa, A.fumigatus
TIGGGSACLRTWRLCWWRTSHTRRSDQKWMRILRCWMGFISGVGGRGMARGYLPRGRKGRGRRGCARGDGMRSAVDGRRITTRGALRFSLASCFMSSLRAIWTRSERRGIAPRRGSLGPVSGGILTRTVRLVISGQVRRVQLTGVGGAIPFGRSLTYRFACGAFFAALAVADIPDMPDPLASMGAVKGFLLRHLRWWAAHSTDVFYADGLHHGAGRIRGWCQI

SEQ ID NO: 24351 - protein, 156 aa, A.fumigatus
EDHTSSDSMTGHPALQPLDASGQQEMRAMFSTPNSFLTSSWTRTPNVEDNVTLSLPTPARAAGPSHHASQLQIPAQRPHSSISSAPKLINDGSTIPDIPSPFPVNTPQYQQTYSDPNLHLGPFMDIERYASLRRPRIAPDLDALFDELASLDGTEK

SEQ ID NO: 24352 - protein, 156 aa, A.fumigatus
KNSPMGKFNSSYIRGPQLNPLGPPVSPIIYGNPTIAEVETSSKAHAKSLGATWATFKSKPEGAIIVRIQPPAGNVDGIIIIPGAFTHTSVAIRDALLGVGIPFIELHVSNVHAREPWRHHSYFSDKAAGIIVGLGVYGYKVAVEHVALNFKERAAL

SEQ ID NO: 24353 - protein, 167 aa, A.fumigatus
  UNSURE (65),(104): Identity of amino acid sequences at the above locations are unknown.
LPSLPSDCIVLMPLFQSWTRPPSRRIYLTLVSPVIGLLLVYLFFAFDTDAFTPKVVVTPISLTQXTATCPPLRGIEDVLVIFETGVTEALEKVPVHFQTTLRCXPDYVLFSDFEEEINGTRVNDGLGTVNETIKRTRADFDLYNRIHEHGRQGLTPADLSRSPTCIW

SEQ ID NO: 24354 - protein, 206 aa, A.fumigatus
RNVLAWSFLVGARISFVFHELYSNGIKAVDPFDQVKDIDIRTILYNSSGSSPALFVGTTAFELIVKQQIKRLEDPSLKCISLVYDELVRILGQLLNKQLFRRYPMLKEKFHAVVINFFKKCMEPTNKLVHDLISMEACYINTGHPDFLNGHRVSDVWSQFLLSTILTECRLWQLSMNASKRASLHRWTRRRANLCLLVQTARRSMP

SEQ ID NO: 24355 - protein, 102 aa, A.fumigatus
RLVPISFVNDPDRMQAMAIVNERQQASKPTQVDPKTGKPLPPRANSPSVDAVAATENSGSGFFGSFWASKNKKKMAAMEPPPPTLKGSAVFTYGSCQDPRLM

SEQ ID NO: 24356 - protein, 233 aa, A.fumigatus
SSFLQSFSLSIFFPVLFFLTSPQQKETITMRASFLLPVAIYVLTAYADDKTTTVGYFIPSWSVTLLSYGVWTSTGASVAGINAAATTYHLGCLKDAPKTDCNIKNSWTIIQGPETVSATGVYTASTSGKETSYDITVTESYECKIRSRTESASCTMSVGMTGSVGGAAITSSTSTSATYSPATSSYYELVVTAGVDKFTVPEATKTPGVAAAGPAGALITAGPVVAAAVAALL

SEQ ID NO: 24357 - protein, 486 aa, A.fumigatus
KSGGRHSQSTTDHSLDFHSRDKILGIVLSQMKQPIPAVLSSFPSAQLLDSLIRYYLTAPFSTANTWIHRATFRPRQVCPELLLAMAASGAVLTPDPSLRKLGFAMQEVVRLQLPSVFERNNTTIRDLHLHQAYLLYLEIGLWSGNSRKIEISEAFRQPLLTMVRRGGNFHHSAYPPLPARLEESGRSLEDTWRAWVYKEAYKRLVYRLFRLEAQVSMALFTSPLVTYVEMGPPLPAPAYLWEASSASQWKDAYHSSPLPSTGRIRTLNECVANLDLLETSRRVADIRLACGAVMHCIWGLVWEFRQLSSLLNGHSRYWDNDLLMVARHGQLSRILECFRIGYRDEVPVQLHFVMMHMYVSLEEVETLATSDDAGRAWEQPALSDWFKSEHCRHAIWHAGQVVRGIKCLPLQGLRDFMAIALYHASLTLWAYGVVFFHNMDNQSQQLAGPTLQQKVWLDGLECEDIQRFITLHRGIPVLQGLGHAEE

SEQ ID NO: 24358 - protein, 216 aa, A.fumigatus
WSIALELAKEYQMYDWVRALLDPTEIPQTPKKQITPPPKFELPPIEAPTQLSAPSQRTRRGRSASPSKRATLSPRKPRKTRAAKEASVEEASAASASLQNALDMTASNADAGSANGTVESSVEEHVEEKVVTVTGDTTKPASRKKVAAIPEENEVEEEKVKVDVKTTADTVDDVRTTQTTISVEMPVSLPEAPSAEDTDKCLGWHSCSPRRMKDIC

SEQ ID NO: 24359 - protein, 72 aa, A.fumigatus
LVRDFHKLTTQLRDSQAPTQSDISGSKNSLDYLLTMKTEYASFYHGIEQIDPTAPVFAHIRLFRKKKMACSS

SEQ ID NO: 24360 - protein, 227 aa, A.fumigatus
RGLVRQMVRFLVMPGRRRKSRRSVSRERSFARIATNADYETTESWAPQASLIPHSTAPLASRVSVPPLASALPPPLHPTPLRELNTDAQEAVILEDLLFVFMGFEGRYIHYHHTFDPTAEKDRLAGPAFQLPSGLDPTLRDLTSSMLKMATHYSALESFVEVQSRAEYGAVNHALCATIRRILKDYLILVAQLETQLLNHSNFTLHMLLLHTVPTRSSPQGPRTAHE

SEQ ID NO: 24361 - protein, 92 aa, A.fumigatus
EVVTDPRDLGLTESKISGDQQNGADVLSPQAKNRKFMEITMETPLSVLNRFFEWNSAAIVTERDEHGTMRPLAVATKVDLLTWMLHHNENSS

SEQ ID NO: 24362 - protein, 279 aa, A.fumigatus
IVVFWGSQSGTAEGFAHRLAREVSLRFGQEAMTADLSDYDPDSVSRIPNSKLAIFILSTYGEGDPSDNTAEFWDWIHKSQNVSLSNLRYAAFGLGNSNYKFYNRVVDVVVEALDRFGAKSLMPVGKANDAEGTTQEDFMSWKENLFATFKQQLGFQEAEVKYMPTLSVQEDESLAPIDLHHGEPDIRRDSVKSAAQCSPVRAVDISSSRELFASSDRHCLHIELDLSSQPEFTYKTGDHLAVWAGNPDAEVDILVNALGLPPSRHEIPISITSLDPATK

SEQ ID NO: 24363 - protein, 224 aa, A.fumigatus
RTLFAMSRLRKLGYDLSPSSLPSSFSGFKHRRTLTVPCKSFVSDCSPIRSAGASSFAEVRRGTYLSTRSFRASATAPAPAPARSAPSLPAPSTRFVRAPVPARTGTGATLTRSLPSQSRGAAQQDGPLDVVHSIMERARLRSQALRSRYGLPERLRFDPRTQTRVEQSSTSLDPTTRPTRFAERIRILAEEAAASSANRRATLSKFAAFDEVVARVRARKQSTS

SEQ ID NO: 24364 - protein, 163 aa, A.fumigatus
IIGTKCANLRQRRSSNKHAAGTVFSRQSAHLRLQGLALSRARRNINTTCPPVLQRLSFQQRHQLALDCTEWSRGAIMHIRSLLTIPVLLGPLTHAAAIPAGSSSTESIQSRQAANGPGYWLESISHQGIAPLGPSGYRVFRNVKDFGAKCESHPQWATIRPIL

SEQ ID NO: 24365 - protein, 332 aa, A.fumigatus
PRPPSLRRSCPPREDARGKERSYVASLEGYCERLEKQIASLRYRKESSSTDERGTVRESSITSASSSDCVAQSHRKEVSDIDDLVGDFGFLSVHVRSAVVVSLLTSCSRSVNATSRDFHGITSSTSFANLLLSLAIAEPLPKLSSQSLPSRHEITPLLRHYFDNLYTQLPFFVETSFWTSVDAVYQSGGRFAKPFDHWILRLVLAISSASTSYQPGDRDHQRALSLISGALKYAEEVLRPGSVVGIQGILLLAQYSFFDPNHFRSWYLVGTAVRAMVDLGLHQDPPLEELSTPDRLDIRRIVYHCVYCLDRFVSPLHSDTSSILLIWLRKGV

SEQ ID NO: 24366 - protein, 144 aa, A.fumigatus
SPAPECPDLKKYSSPFLWPKWRKSMMTWISCAVTALAGYSAGEISPSSAELTKEWGISQVVYNLGITLFCIGFALAPMVLAPFSEINGRRPIFIASGILFVGMVRLMNDRQSFPNANLRSKPASLPVGALTLLEECLLHDSSRA

SEQ ID NO: 24367 - protein, 155 aa, A.fumigatus
ADVCQSSHRHSCHRSLLTAAATFSTMVGGVISDIYHAEDRNTPMALFSGAALFGTGLAPMLAGAVVQHTTWRWVWYSHAIVSAVFVIIIYFFFKETRGSVLLSRKAKALNTYYEKLESAGHYGVIMSDKETVKRIRWKVKSDEESSPRAGHPRKR

SEQ ID NO: 24368 - protein, 106 aa, A.fumigatus
RTSSAYILFSLEHPCEETFERLKVALPVSISNSVKLWPAVTAFSFVYVSPPFRSIFAGVIAVGWQTYLSWLNQKAAREVEAEMAESDRSSHVLVSGSISPSTTIKA

SEQ ID NO: 24369 - protein, 130 aa, A.fumigatus
YEFITIITGMSCPPTSYIVMSDDLDDCSDYGSDFTPDEEELLNDLLAKVATEYATAQASATATATTTTASKTVQATVTTGADIEDYAESPASQRVPKVLGREKPDFLWQKRMVQQVTDLSVFATRLEGPR

SEQ ID NO: 24370 - protein, 63 aa, A.fumigatus
LHQVELIGYIGRCLSASQSPNWTLGPYIMQSTLLLVAPALFAASIYMELGRMSSPRGWKEPRH

SEQ ID NO: 24371 - protein, 75 aa, A.fumigatus
THWSLIQKGVKVTGSNIGSPDDIRAMLQLAAEKEVLPWIQERPMHDINAALADMDANKARYRYVLSNEMGAQSKL

SEQ ID NO: 24372 - protein, 62 aa, A.fumigatus
IIAMLLKRGYEGWVAYEYYPSMAAGVIFVVLFGIVTLLHTFHLFRTRTWFCISLVIGGYCTF

SEQ ID NO: 24373 - protein, 190 aa, A.fumigatus
QSHIGWTTRIFAPIFALGAFYGIMHSRGKDSAFDMSTAYTSLSLFALLADPLLSLVMALMTFVGSIGSFSRIQEFLEKDDHVDCRLKPLHASYESFESKAMVLVDDSDATETASDRSIHRGKSVYHDALTVKNATFAWNVEKEPVLKGLTISIARGSFTMIVGPSGCGKSTLLKAILGLYHRRRKSTLSL

SEQ ID NO: 24374 - protein, 112 aa, A.fumigatus
VRQLFQQSSQTKSPVSVHTATQSKMKYLSLAVAFLPLLAAAAPAADPEVEADGELDLEKRASAQTCKIVNVDTYVNCRYDAKLDAGAIFGFPKGEKLTFACWKHGDCYNGVW

SEQ ID NO: 24375 - protein, 148 aa, A.fumigatus
QSVTNRNELLGRRPHHAATPENPYAQSSLPQSSSFANTSSSRSGLSFGASPADYTRETHALREQSFFANTNSQLDEFLDRGRAVLADLGQQREVLKGTQRRLYSVANTLGVSGDTIRKVERRAKQDKWIFWGGLLVCLPLLLVGYYTF

SEQ ID NO: 24376 - protein, 64 aa, A.fumigatus
NSFDQQSDPKVEDGLANTTKGHIYLVKQKFSRSNILLNERSNSTIIRFPIYNNTPSLQLPDYGK

SEQ ID NO: 24377 - protein, 290 aa, A.fumigatus
HLAVNTVLVHAFIPFAIHWAYVVYTGRNITPVAAFIFYSTAFKAIGIHELHILRRLGHRLGFFDGDKHERDGVPDVGVAKVVQSLLSTSTFRPMFTVFLSYQTNLPPSSINWLWLPLEIGLYGIVLDFWFYWYHRLMHDIGSLWKYHRTHHLTKHPNPLLTLYADSEQEFFDIAGIPVMTYFSLKLMGLPMGFYEWWFCHQYVVFSELAGHSGVRLHTFTPSTLTWLLRLVNADLVIEDHDLHHRYGWKSSYNYGKQTRLWDRIFGTCRERVESRPDNIDYNNKVTLPLW

SEQ ID NO: 24378 - protein, 199 aa, A.fumigatus
AAPPPPPPFFFSPPSNGQNLTRPGGSGADHCGEIDFKYGCPLPEGSHHMDLSDIAMGRLQGNGSLADGVIPIRYRRVPCPKPGNIYIWLHDGAGPYYFALSAVNTNGPGSVISIEVQAGGSGPWVALEHDPNYTSSRPQERYGSWVLPQGKGPITVPVSMRLTAPNGQQVVKEGAITSYTPPATAVEGFWYIDLGVQFT

SEQ ID NO: 24379 - protein, 112 aa, A.fumigatus
RVDPSSPVVKTEKERDFYFAKLRDIELLLQNAIEADPELEKDEDSLVKHIQGILYSTEVRVCDALPLFFASGANSLYRKGLRSQLKRRSAMSWRHSTFMAKDVFSLIIPLYH

SEQ ID NO: 24380 - protein, 407 aa, A.fumigatus
PWRGSFQPRGEDPPATSGPEFSNQTPHTSHVDSHAHLATSGYAPNDNQLAGLVEAATAAAGQDVSEWAAAAAVAAAAGAAGHQHHLDSYGPEIHIEDDGFGDGSFGAGMSAGRQLRGSGSASVNDQGQSSGLSRSVSKKRKRGEDALDPALTAAGGVGLPGGPQQSQQQQQHHLQPPSHHYDGDNLDIRAVPPQSLSDARAAGVHSAAALFRQPSSNKKHTRPPMSKLFASLELSPENFLHLQAAAKAYMLDPKHPERRECVGQRGKGDTEMVKLRLWNCVRHFLEVEGNGERFFSENVVNEGMGPRSYIWPRDQQKIISLVIPLIRRMVTNERQRQYAVETRKGGGADERRRRKTNESFQTFTTSASPPRFSSDGQLQMHPHHHMPEEYSSYQVPSLHHGGRRIRT

SEQ ID NO: 24381 - protein, 123 aa, A.fumigatus
EERKLLFKLDTAILTFASLGSTSTVNLVAKLTVMQGYFIKYLDQVNINNAFVSGMYVCLADIDIDPLTGYRKEDLNLYGNQLNYMQTCWTVGYVIGEIPSNLLLTRIRPRYWIPAMEVSADFF

SEQ ID NO: 24382 - protein, 76 aa, A.fumigatus
CPVVGRGRVVTATGLAESTFYPGMQYIIGSWYRKDELAKRSCIFHTSGGIASMFSGYLMAGVYHLGGRGGFKGWQW

SEQ ID NO: 24383 - protein, 174 aa, A.fumigatus
YAVESQIRHHNLDPKDAMVLIEPEDLDRPILDTKYILRVIDENAHSTALILLPAIQFYTGQYFDIQRITAHAQSKGILVGWDCAHAAGNVDLRLHDWNVDFAAWCTYKYLNAGPGGMAALFVHERHGRVDIEQAASGKEAFHPRFSGWWGGDKQTRFLMNTRMLSRRFRLCFLY

SEQ ID NO: 24384 - protein, 147 aa, A.fumigatus
SVILSLLLTQSLRRMGSRLHVQVIHGGPPLPYKDDIRAFGKEYAEQLDAQDPLRRFRDEFIIPSKKDLKRKTLFPNDGMYSCGHPICFANTSCACVHAAETEETSDEKCIYLCGNSLGLQPRSTRKYIDHYLRTWATQRRNRSFCSA

SEQ ID NO: 24385 - protein, 163 aa, A.fumigatus
KERLCSQTMVCIRVDTPFASLIQAVPASMLQKLKRHPMKNVSTSAATRLAFNPVAPGNTSTTTFGHGQPKGVTGHFVPHEAQLLPPFVDVDEAGAKLMAPIVGALKSEVAVMGTLTANLHLLMASFYRPTPERNKIIIEGKAFPSDHVRFMDLISSSKLCGQS

SEQ ID NO: 24386 - protein, 399 aa, A.fumigatus
LFYRYLRRAIQWGCEYIDVELWLPEEIRRRLAEQKGHSVIMSAFHDFSGTWKWTSPEAARIFAESARYADIVKMIAMVHTIEANYELEYFRSTVKARGAGDSSPLLSAVNMGQMGQLSRALNTVFSPITHPLLPMIAAPGQLTAAEINEAMHIMGALPKRDLYVIGSFRATPQSMFMEKCFNELSLPHTLTSIDRGPKGTIEGVIMQPSFGGASVNPPISAATPYIPAVSEAARAIGLVDTIVVGESQSQSQSQSQSQSQSQSQSHPHGPPTARTLIGENATWKGIRATLTRDYVPSAYRGRAAIILAGSESDASAAIYALRSLGVGSIYTVGFRATGPLAAGLEPFTSIQSVKLVEQPFVMVSALPPEKSLLVQPLLRHYRSNGRTSVFTRGWKEPLY

SEQ ID NO: 24387 - protein, 72 aa, A.fumigatus
FTNFLIAEQLPTVTLDFSTRDSGSTQEAANCISTTTFTRQIGMHSDMVSISIIDSRISHTYNYLMNSTVSQF

SEQ ID NO: 24388 - protein, 72 aa, A.fumigatus
LNNPLVSNLLLPTIINRHWKTKELSYFWPNILEDTSIKQYNTSLFYKNMNIFTNYIKDIINYKGKPFVKANL

SEQ ID NO: 24389 - protein, 90 aa, A.fumigatus
  UNSURE (63),(82): Identity of amino acid sequences at the above locations are unknown.
KLRLINIHEMTLIAYSILLFSPLYIISYIIAYSLRWFPHGGRFPSLVLPFSSSFSTQSIVSRXNGGGRQKAWGLANWSLHLXRYHPGFRT

SEQ ID NO: 24390 - protein, 116 aa, A.fumigatus
TDGPFQPRGEDDAGRKVFPGLGVYSASKFFVEATLQSLRLETAGMGLRVTAVQPGNTATDLLGMSTDAEAIKKYGEPSGAKILDPEDVANSIVYALRQPAHVAVNEVLIEPRDEPI

SEQ ID NO: 24391 - protein, 185 aa, A.fumigatus
KIIRPVFYVNSSIITTPLLEKWLRILELLPSSLKQAWTQGKTNKVWEIRIVRLVCLFCDGLSDVFAAEATLRQEEQKPGFSLQLLQITASTSYPYNTRLASALCFKNFIKRNWTDEDGNYKLQLDEVATIKRELISLMISVPAGIQSQLGEAVSVIADSDFWERWDTLVDVSSTNKYFFVVLYLY

SEQ ID NO: 24392 - protein, 405 aa, A.fumigatus
VKPRFSFLLHKPTDDSVEIAVGLTREVGQHLEEMSPPIALAVFDQFRNILHEADIDKRVQYMIEVLFQVRKDRYKDNPAIKDELDLVEEEDQITHRIGLDDEIDTQDGLNVFKYDPQWEEHEEAYKKLKAEILGEGSDDDEEDEDETDESSDEEEEERQMEIKDQSNTDLVNLRRTIYLTIMSSIDFEECCHKLMKISLPPGLEPELPSMIIECCSQERTYSKFYGLIGERFAKINRLWSDLFEAAFAKYYDTIHRYETNRLRNIARFFGHMLSTDAIGWHVMSVIHLNEDETTSSSRIFIKILFQDLGEHLGLAKLQERMRDEILRPSFEGLFPLDNPRNTRFSINYFTSIGFGILTEDMREHLKNLPKPTVPALPARDAKSDSESVSSHSTCSTCTGSSRSRS

SEQ ID NO: 24393 - protein, 241 aa, A.fumigatus
MYQNQFQKYNPELFVEADVPPHVMNDEGPVVAPWVCKAALQRSVAKIFYHTGFEEYQPSALDVVTDIASDFFLKIGETMKSYIEAPKVPPTETSSSTSQWKRAYTEPEIVLHTLSSVGTDVESLESYIKDDVERLGTKLATVHERMRSLLSELLRPALADGGEDGSKAFADGSEQFIGGDFAEDIDEDFFGFKELGLDREFGLATLSVPLHLLQNRMYNAAQAQNPRYVTFLYTLTAEHWS

SEQ ID NO: 24394 - protein, 255 aa, A.fumigatus
PANPRVPKASGKRVKVLHLSDFHLDPRYSVSSEGNCSSGLCCSNNNFNSAAKDQVLISAPAYGTFKCDTPYDLGLAALQAIGPLTGTGKGKDQDSLAWSLYTGDLVSHDPVQAMSREYVEYTETSIYGIFKEYLTGPVFAALGNHDTSPENINAPHNLPGPLGEQQSWKYEHVAGLWKHEGWIDEKADQEARTHYGGYSVKTHYGLRIIAFNTGKYLDIGNYARTDPIRFLVREKLLQQHQLYQSRQLRRLFLDH

SEQ ID NO: 24395 - protein, 64 aa, A.fumigatus
RASKGRRCRRACLDHRPCYTADGRAPIPSLILPIYSTKLLERYSPHVIANYLLSGLPPKNPFLI

SEQ ID NO: 24396 - protein, 151 aa, A.fumigatus
PGLSLLRWGTTIQALRTSMLLTISQGLWANSRAGNTSMLPDSGNMKDGSTRRLIRRRAHTMVDTLSRLTTVCALLRLILVSTWISAIMRGLTLSDFWYAKNYFNNINSTNPDNSGVFSWIIDELQKAEDAGERVWIIGHVIQRMGGLQFPP

SEQ ID NO: 24397 - protein, 331 aa, A.fumigatus
FIQFVERPHMQKLYGRSLRRDAGLTKSLKRSLLPSLQQLHGSVDKIFDESFEFIEELIDTARPKLAAGVNTFVKDTSALFQKYPARVTISRIDEDLAGYDLRDYSLEIEGTDSLSPNDNDQSGREGANARMPLDRRGDLKNLVFEYGSPIKVKWTAPLNHSKKDWIGLYRVTDNTSREVTRVSSQGRWIAVNEGSYDNLTCEKGIVSSDILIPASQRKDNENRDLASGEVIFSGDKLFWTQGVFEFRYHHNGKHNVMAISRPFEIRISRFDEDEIPLMNPTSVELSLFPVVRNCLDRDPQIAPETVDEPFGGLVERDGKYAKRVVFAVHQM

SEQ ID NO: 24398 - protein, 154 aa, A.fumigatus
VSSKTKMKLAVFSAKSYDKLFLDSSLEKDYASFCEIVYHSFALSSETVSLAKGSDAVCAFVNDTLDAPVLKSLHRYGIRAILLRCAGFNNVDLQVAEELGFFVANVPSYSPEAVAEFAVALIQTLNRKTHRAYNRVREGNFNLEGFLGHTLHGK

SEQ ID NO: 24399 - protein, 109 aa, A.fumigatus
SGGPVANFKSATRISDQIQSMLREAGLKVATQKYEYTSSGITHEGQNVYAIIHAPRGDATEAIVLVAAWKTADGELNLNGVSLALTLARYFKRGSILVTMVEEGSFKPC

SEQ ID NO: 24400 - protein, 208 aa, A.fumigatus
RRSSLGWSLWSKDIIFLFPPDSKSGTQAWIDAYHDMQTSSVQPLPLKSGALQGGLVIEYPFDHRFESLHIVYDGVNGQLPNLDLFNTAISIAGGQMGIGTSLQEMWEHDDSYQKRLQTIIRGMVKQGLGHATGAHSSFMPYHIDAITLQTKGDGWQDEMALGRTVESLCRSLNNLLEHLHQSFFFYLLMHTNRFVSIVFTPGPEGNAY

SEQ ID NO: 24401 - protein, 90 aa, A.fumigatus
SGNQGIQSFAFWSRLDCEYERPRSCRYALRYFFFFFFFFFFFFIWLLSNFTSDMDKLVSIKGLVIRTTPIIPDMKEGTIHLLDIHLIRLS

SEQ ID NO: 24402 - protein, 171 aa, A.fumigatus
STEGTGIHQHVEHHGQLEVTSLNLDAKNLKAYPSTLKLWHQLHAYPQEIIPLMDQTVKDVMVELAIKEMERLRAQNQRNQNHNRGLSSGPAVPSSDALSETGRMPQNEIPDLVGEVETKAFKVLPFGLDSTVNMRDLDPAGMHYDIFFFFFFFFFFFSFGFCLTLLQTWIN

SEQ ID NO: 24403 - protein, 100 aa, A.fumigatus
LIFPAFFRCQVCNHGVQVDIDRGKIAEPTECPRPVCKERNSMQLIHNRCVFADKQVIKLQETPDSIPDGQTPHSVSLCVYDELVDVSSPRGWKEPLNGHS

SEQ ID NO: 24404 - protein, 122 aa, A.fumigatus
QGLVKMPVTAYPIYLHLCGSIHFELLVLERRQKDQLAGIENQVLKTLWMVLMCYFIFFHILCFLVVVLWIWLTPVFGQSVMVDGVKTFRWELFTAGSSFKVLGYTLTPDTMVSFKNAAFPST

SEQ ID NO: 24405 - protein, 323 aa, A.fumigatus
  UNSURE (276): Identity of amino acid sequences at the above locations are unknown.
LGKRTLLYSTAEVLTTPVFENRLTLVLWVPTGESGEFAIKGAKSGKVENGDGCSGIKFKREKDYLVVNFSQAKGLSVLRLDNGVRVVLLDKAAAYRFWAPALTDDPNVQETETGECTSYRVHCRFILMVTVLVHGPYLVRSASISKTTLALRGDSVEKTTLEIFAPHSVRKITWNGKEVQTSHTPYGSLKATLAAPPDIKLPALTSWRSNDSLPERLPSYDDSGPAWIGRLDPIYKTWPNLIRSTEANHMTTSNPSPPATFPVLYADEYGMSTPVXPIYHWFNPHTSFHNGVRLWRGYFNGSASGVSLNNPRRKRLGTSLSPS

SEQ ID NO: 24406 - protein, 61 aa, A.fumigatus
TGKLFSTHLLDFTDIIQGLADVRGLSPRERARVIIKQCAHPDYQPILTDYLDRAEYECLKK

SEQ ID NO: 24407 - protein, 318 aa, A.fumigatus
RHITMSEVPPRRKPYLIMQPEDRIGTPHIPVDPEKVVAIVESDYPDQTQPNAPEDATSQAIASNLIEFLKHEVRHGRLPQNLLPIQSGIGNIANAVIGGLSKGGADFTNLKVWTEVLQDSFLDLFDSGNLDFATATSIRFSPDGFKRFYDNWEHYAGKLLLRSQQVSNSPEIIRRIGCIGMNTPVEVDIYAHANSTCVMGSRMLNGLGRSADFLRNSKYSIMHTPSTRPSKVDPTGVSCIVPFCTHIDQTEHDLDVVVTEQVSYSQPIYWTLLTLSRVSPTYVVCLPVSVLVSSSSSAPTPTTSPSLQTTWTALNTSA

SEQ ID NO: 24408 - protein, 282 aa, A.fumigatus
SPIDGLRIAYLFSHNHIQIVLSLINVSAERHNAADTGRINLAGAGTGGVHDTVLGIAEEVGRSSQTIEHPRAHDTGAVGMGIDIHLDGSVHADTSDTADDLRRVGNLLRTQQKLAGIVLPVIVEPLESVGGEPDGGGRGKVQVSRVKKIQEGILQHLSPHLEVGKVGTALAQATNDRVGDVSNTGLDGEQVLGQTAMPDLVLQKLNKVAGNGLRGCILGSVGLRLIRVVRLDNGDDLLRVDGDMWSSNAVLGLHDQVRLPARRNLRHGDVSSPGAGRTAACA

SEQ ID NO: 24409 - protein, 83 aa, A.fumigatus
PPWRDADGDYGQKSGQPQRYFCQKSAVSAHIVCDHIFEGSKGGKMVCVLALIINQDVDTGAIKAIKKTRLHIIGLHRGLKGTQ

SEQ ID NO: 24410 - protein, 145 aa, A.fumigatus
CPPGAVDYIFGDASAWFGECELVSVGPGYITAMSRTTADETTWYAIDHCNIYGKPGVDLTSAVYLGRPWRVLARVIFQNSQLSNIINPKGWSPMATGATPLYYEYNNKGAGADTSKREYESPISGAVSIATVLGGGWNSWVDTTY

SEQ ID NO: 24411 - protein, 187 aa, A.fumigatus
PPPPPPPFPGLLEDEQSFVRTSRRPEQPHCRLLTSGTRMYLPSLVLGLLGFGLTASTSPIEERSNRSKAPAGCLTVGSSGTYATIGAALSALGSSTSDACIFIGAGTYQEQITIDYKGKLTMYGETTDTSSYKQNLVTITHSISSPEAGSLDKSATVNVRSDGFKMYNINVINGYGKGAQAVTYVVL

SEQ ID NO: 24412 - protein, 225 aa, A.fumigatus
PLRRRVADRDMLGSSPMPTNLASTDAVLSATKTLSTPRPVVNTTLTATSRVGSFPPPSIHASPAYANVLQEPLTTSSVTPRPGSANANSCPSAPATLPPCRARRRTRPPGTRSTTATSTGSPASILPARCTLVGLGVCLPVSSSKIPSCRTSSTPRAGAPWQRGPHRFTMSTITRVLERIPRRESTSLPSLVLLASPRFLAAVGTAGLIPRIKSRWWAGRFAHGC

SEQ ID NO: 24413 - protein, 69 aa, A.fumigatus
PKPVRWSRPPGEDLHDPSDFSDTHFVSVNTIVFYVKINSYRWTQPCMKRPRALAIWSESSPRGWKETRH

SEQ ID NO: 24414 - protein, 291 aa, A.fumigatus
  UNSURE (251),(260),(263): Identity of amino acid sequences at the above locations are unknown.
VCNSVGSRFSSHGILSVDLALASSVVSLIIRICVQIEHTSGSFTRLKSQSQRTELLQLADQTVNILHLTAALARRRFCHGQHPLCITTREKRRKPTSNLNCLQPPLILNPEILQLLLLKRLLLRLHDVRQTSIPRLVQPQIRRNNHGQLSTQRLNTPIHLVSHLHRALVVLDLDLARLRRLRPPQQTRQHLARLPLVTVNRLLPPEHQVDVLLLHHCLQHLNHGQRLHAPVIAIGDLDVERPGPRPLPMLXGAYQRTWLXQRXSAKIFFDFQGGPCASREAGRPSLIERLN

SEQ ID NO: 24415 - protein, 74 aa, A.fumigatus
FRSKSNHKNMRTDRAYVWLIYTIEITITAHRAPSACRSDRQHPPPYRRPGAQEVLSWSASALHYNKGKKKKTYQ

SEQ ID NO: 24416 - protein, 249 aa, A.fumigatus
  UNSURE (37),(40),(49): Identity of amino acid sequences at the above locations are unknown.
QAFPSTPLIKSLDQGRPSRLPRGARAPLKVEKNLGTXPLXKPSALIRSXQHGQWARTGPFHVEVPDSNDGGMEPLTVVKMLQAVVKQENINLVLWGKQAIDGDQGQTGQMLPGLLGWPQATQASKVEIKDDKGTVEVTHEVDGGVETLRAQLPMVITTDLRLNEPRYASLPNIMKAKKKPLEKKKLEDFGVEDKRRLKTIKVTGRFSSFFPCCNAERMLTMTEPPARQGGGKVEDVDGLIGKLKELGAL

SEQ ID NO: 24417 - protein, 60 aa, A.fumigatus
KVGWICLYNFSKYKVYIYFPIIVIISNSLLYLLLSFLYRYYILKFFNKSSTFSLIENKMS

SEQ ID NO: 24418 - protein, 86 aa, A.fumigatus
ETLITKYNTRAIIALHNEIEVIIGFIPKYNIGRVIHALQLINYNLFKLYITTNMIIRHPTPAPKDETMVFQNFTRVATKSSNKGKK

SEQ ID NO: 24419 - protein, 185 aa, A.fumigatus
IKMSHIARTAVHRTTLAVRLQWPLIRSRFSTSARRPLMELTGFTEEQLTVRDAISAITSKFPNTYWQECDQNERDPKEFHAALAKDGWLGIALPEHLGGAGLGQYIHVSTLSDTAILTLNRNLRSYNDDADHHSIWCRNGRCSGHPCQRVCHTTAGQIRHQGAARGDDSQDHQWDMADLLRRHRA

SEQ ID NO: 24420 - protein, 261 aa, A.fumigatus
TGISEATMMMQTITQSGAGMAGAQAIHANVYATQPLAKFGTKEQLEETIPKIINGTWRTCFGVTEPNTGLETLKLKTTATKNASGDSYSVTGQKIWITCAQVASKMILLARTTPIEEIKRSTHGLSMFCIDLDRDKPGLDMRKIKKMGGRAVDANEVFFDNYQIPTNTLVGEENEGFKIILHGMNAERCLLAGEALGLGYAALERATQYANDRVVFGRPIGQNQGIAHPLADAYMKIEASKGQTHVFSIGDATPAVIEPPD

SEQ ID NO: 24421 - protein, 62 aa, A.fumigatus
HALVCSATIASTFGVAAGAFALFFFGEVPRVRNDILRKVPFLDEYFDRSIPAEDNVRTFESC

SEQ ID NO: 24422 - protein, 71 aa, A.fumigatus
SILCLNQEQTEYCGSLACPRWSRPAGNNLGLPPVKPSPALENSLAKGLNRLSFLLAGDFRVKFRIFAFTLE

SEQ ID NO: 24423 - protein, 62 aa, A.fumigatus
ASWRNVRNLNHQPVVESRIADPKNSDSAPGIPVKGIHAALNPANSVAQYFWMKTLNELEFPG

SEQ ID NO: 24424 - protein, 398 aa, A.fumigatus
RHANMDEIRVTIDRESGEISVWNNGRGIPIEIHAKEGIYVPELIFGHLLTSSNYDDTQKKVTGGRNGFGAKLCNVFSTEFTIETQDSRQKKKYKQTWTNNMSKMGKAKITDAKGEDYTKVTFKPDYAKFGMEGMDDDFEALVKRRVYDLAGTTKVAVKLNGSRIPVRNFKKYMEMYTKAIRRERGEEDTNAKDEIITCSPDPRWEIGFAVSDGSFHQVSFVNSIATTSGGTHVNYIADQICARLADQVKKKNKNGATLKPAQIRNHIFIFVNALIVNPAFTSQTKEQLTTKSSQFGSKCVLEEDFYKKILRTEVMNNILHFAQAKADQLLKKTDGGRRTRMNNPKLVDANKAGTKDGHHCTLILTEGDSAKGLAMAGRAVVGPDLLNRRDERTCAPGK

SEQ ID NO: 24425 - protein, 376 aa, A.fumigatus
TTRNGSPPYVLSQVEKASASATEFSTAFNNFIADGPNSPHAEIIRTVSIFSGSIADVLSNTKGLTRFANDDKSADQLLNAARKSAQATVRFFRGLQSFRLEGLEPLQKTDVVINNNLEVQKDLQSLSKLVDAFAPKSTKISTSGDLGDLVDKELSKAADAIEAAAARLAKLKTKPRESFSTYELRINDVILAAAIAVTNAIAELIKAATESQQEIVREGRGSSSRTAFYKKNNRWTEGLISAAKAVATSTNTLIETADGVISGRNSPEQLIVASNDVAASTAQLVAASRVKATFMSKTQDRLEAASKAVGAACRALVRQVQDIIAERNRDEGETVDYAKLSSHEFKVREMEQQVCLILSDLLHCFSRASLSKLLTR

SEQ ID NO: 24426 - protein, 147 aa, A.fumigatus
  UNSURE (4),(5),(6),(7),(9),(10),(11),(12),(14),(15),(16),(18),(19),(21),(22),(23),(25),(26),(28),(29),(30),(31),(32),(33),(39),(40),(41),(42),(44),(45),(47),(48),(49),(50),(51),(52),(53),(54),(55),(56: Identity of amino acid sequences at the above locations are unknown.
PPPXXXXPXXXXPXXXPXXPXXXPXXPXXXXXXPPPPPXXXXPXXPXXXXXXXXXXXXPPPPPPPPMVIGEWALVFLVRNFAHLSKALTCPGQTVLELKDFDLFTRNQRVSNLERDAREKQCNRSDKIRHTCCSISRTLNSCELSFA

SEQ ID NO: 24427 - protein, 112 aa, A.fumigatus
MKLMRSFQPRGEDTNIPTIGEKGYGWEKLVKWASCVEELTESERQATRLLAGLMELDPYKRLSAREALQHEFFTNPIEHDVEWGGLPEDSADTGEDEEGDRDDDEADEVAMV

SEQ ID NO: 24428 - protein, 250 aa, A.fumigatus
SAIPSSPGAMTTAQDEDDGKVSLTRKAHEGVSDDPPEIASPEHSGTFVLRIMPDDNSCLFRAVGSAIMGGMDTMTELRSIVAQTIQANPDVYSEAVLEKKADDYCRWIQQENSWGGAIELSILSKHFDIEICSIDVQTLRVDRFNEGPPTRCVLVYSGIHYDTIALSPSDPPYTHAYAPPEFDTKVFDAADPVVLEKALALCEILQRKHYYTDTAGFRIRCNTCGGIFIGEKGATTHATQTGHYNFGEAS

SEQ ID NO: 24429 - protein, 69 aa, A.fumigatus
FRFFHNDYFLLIRLGSIEVSSLFYSLMFFFPFFLFYKNHINILFLFILFYFFLIFNFRLHHEAAGSAIS

SEQ ID NO: 24430 - protein, 281 aa, A.fumigatus
  UNSURE (212),(253),(273): Identity of amino acid sequences at the above locations are unknown.
VFCCFPALERLHALKRAGSQIAINSREAVRFLDRVTSGKDNIPADSIVLQGPMEQYENWEEAEKFFLPEFEEEPEAPNGDDTEEQSPRETPAEKMKSSTKKNGAAPDDLSQMLLNKLNFKTESDAASIPSAGTHSNPASSPSSRSSRTSPEDSNLRTAADNRVTNEATLKIESGHRRTASGSVVPTVPVVLRPLLSAILWRLHSGPDATNAXKACILVTNDKVTGLWAQKFGIAVKNIHQLQTSIQYEEREFXKRCKFVEKNQVSEPKSLLLXRRTKATRM

SEQ ID NO: 24431 - protein, 76 aa, A.fumigatus
RSLRAMSAGRKVFHCAVDETALTTNISEIKRWTTSGAITLIVPLYSKYIDFRDAIPPSRSLIRFSAVFQPLNACMR

SEQ ID NO: 24432 - protein, 153 aa, A.fumigatus
QGDPPTAEDLRARGAAGARQQREPCASSCAAAASSSTSSAAATASPSAAECAILLPSAGTVHVASDAGPGCDSASTALDGAFPAAAAAPGPGSAAADKRVVSLGSDGRRTIRRCIKSAARCFDMIPVHYWSVGVRHTDSTIDTTILMRLTHVR

SEQ ID NO: 24433 - protein, 222 aa, A.fumigatus
PPRLIFQPAGEDGKEPVADPTGSPVNVSASPTVQSGAALQNQKPAAVAPNAKANDKQPASSRPAETQVTKPSPTPAPAQAPAPTQQQKTKKKQELSRKEEEKRTKKRLEEEEKARRKRQAEIDKETRRLQKIYGREEQQVRASSVNLARPPAQPPRPPAPPRQQQPHPPPRPNARYYYHQQAPSMLHLTPGPVATPPRPHSTVHSLQPPQPQDQGQQPPTKE

SEQ ID NO: 24434 - protein, 140 aa, A.fumigatus
FSSRLVKMGRNLWLIRQAVLSMLVLAQRYRVVRPCRIRSLRRSPRMQRPTTSSLHPRAQQRLKSRSQAQRQRPPKPQLQRSSRRRRRSKNCRARRRKNGPRKDWKKRRRLVASARPRLTRRPADCRRSTGARSSRCAPAA

SEQ ID NO: 24435 - protein, 182 aa, A.fumigatus
CTGIISKHRAALFMHLRIVRRPSEPKETTLLSAAADPGPGAAAAAGNAPSSAVEAESQPGPASDATWTVPADGSSIAHSAAEGDAVAAAEEVLEDAAAAQEDAQGSRCWRAPAAPRARRSSAVGGSPCQSRPGACDEPSPLLPVFSWSVFPPPCATVLASSSSSAAALELGLGRALALGLAS

SEQ ID NO: 24436 - protein, 98 aa, A.fumigatus
  UNSURE (73),(75),(83): Identity of amino acid sequences at the above locations are unknown.
LTWSFSGAPLMSDPAIQEMAKKYGVSPATVLISYHVNRGVVVLPKSTQENRILSNRQVIPLSPEDMDVLNGLXAXRKAKRINXPLFGWDLGFDDWYQQ

SEQ ID NO: 24437 - protein, 121 aa, A.fumigatus
KRWTFQPRGEYETSELLPVNPDGTRSVDRSWDQSETWRQMEEIYKAGKVKAIGVANWSIPYLEELKKKWTVVPAVNQVELHPFLPQHALKEWCDKHGILLEAYSPLGSEGECPWTRYVRFP

SEQ ID NO: 24438 - protein, 381 aa, A.fumigatus
  UNSURE (1),(26),(376): Identity of amino acid sequences at the above locations are unknown.
XDRFKEITSSAIYNPSAKRFASQMTXTPKGIPIKKPRQSALSRAQPVEVSVTSLQDIQDYQMRVKVERMLKVMPQKSVQACMQALVFKRGNYEDALDHLANTEERDAPGSSDDELITAQQAEQIAPAKQNIKARGTIQDKWSAMNLQKNLASQKVQSQSQPQPLNEEEAKPRRRLMRGPKSRGISPSPARSETPPKKKPGRLVQGRKQPSPARSESPEAPLIMTDDSDSGVGDALENVESEIKVLRFINTCQAVELADLAATTEDVAQVIISHRPFRSLDEARAVPAPSTEQNTKPRGARGRKTPKPIGDKIVDKCLDMWVGYEAVDSLVAKCEALGRPVAAEMKNWGVDIFGKRERELDLVSINQESHDSGIGDXASSAF

SEQ ID NO: 24439 - protein, 64 aa, A.fumigatus
LSNYPILLGLFFGSFSKHFTQNFSKGVLTNGVDKNYPTSYSLDRRHFAIHESDNVVRGSVVPWL

SEQ ID NO: 24440 - protein, 93 aa, A.fumigatus
IDHKMRPKANASYLNRNDDERPRAYIVLKPGHHAAANDIVAFMDGKVSAIKRITGGVVFVDAIRKNPFGKILRKVLRERAKEETQKNGVIAKL

SEQ ID NO: 24441 - protein, 119 aa, A.fumigatus
ANYYVSNRTTCSILGWNPSEKSYSASVGELNANCEAKIMADDGVTEYGHNQRGELWVRAPNIMKGYWKNPQATEETKTADGWLKTGDIAYVDDNGRFHVVDRKKVSPNFPTEPMLNDFG

SEQ ID NO: 24442 - protein, 240 aa, A.fumigatus
  UNSURE (101),(146): Identity of amino acid sequences at the above locations are unknown.
YRDRLSFARLILNHLTLVHNLFWEEYTYDAYHRVDVSRVLVLATNANSSCRVFFIPANPNASTALATITERLHSAVAEEPVAIGRWALEHKLMRDTPSCVXGSGPQRHAHPRYMQFLSLSYYPNHGFIYTSQPPEKTAQSPAPNAXTPQTGLTPALGSATPSNAAAAGGSGMVMITVPLPSSGALFKHFVYACQPFWCHRHTVAVPGGMVYDVGDFRVRIGDVRQTQRLHHGDWQDPSLR

SEQ ID NO: 24443 - protein, 318 aa, A.fumigatus
RLTNYSSAVFQQTDFAADFTEYDIIQTSITTGVSILPWTSANRSFVPITIKDPDSDALYGANTLGIGADLACEELSIADSLVVNPQNGSAYWEYQTFDDPSRHCKVDMSMLQHPHENITLSIHFLSPVVTEDDTYDCQTSTVVVLGRWNYTAGSPITDKNTIALHCEPRIKLENYSITFDTKGQIQDLSPIAGTAITSGPMYDNATISVGQFNKVFAAIPQSYISNSTYDRKTYITSYDWAGVLVARLYRRRDPGFMALNPDDLMDMSRIVYQGVYSTLFYQSGGGINLQPVGQTGGWFGTLRGIFDPWDHGNRHSPL

SEQ ID NO: 24444 - protein, 372 aa, A.fumigatus
  UNSURE (372): Identity of amino acid sequences at the above locations are unknown.
YRIPNNPGEHQPASGITGEAGIGPMGIGTKNSGELARQHIDEQATSAIPGYRAGTRVAKRRTAALGQRLPISSILGQDLPPTEIMYSLLEDYFDAVHWFSLAIYEPTFRRKLLSVADGFAYPSQKSFLLLLAVVLGMGAWYRSQRRTTDSTDNGDWQQLSANLLKIVESHVVELMDQPSVTAAQICILFGSHHVYHGRPNLSFSLLGATIKISQAAGLHRELPRGNFEDIEERKRVWWTIYTWDRFASITYGRPLGINDKDCNLNMPADTFENPYFVAPRSEQGYTVCYSTYQRELNRLYLMASTALEVIFGSRTSGSSEELAGDAYVALVKEATQNLRRWRDELPEHLVLDLERDFPPDRSSPRGWKDRRX

SEQ ID NO: 24445 - protein, 62 aa, A.fumigatus
RYRPLSNFFIKSTSITIRLDNSLIYPFLSILLRYLHRASSSSYNIVNRGLYSSNFLLSSYIL

SEQ ID NO: 24446 - protein, 65 aa, A.fumigatus
LIISSPAKHVVWDTLRSSGTPSDHSSAPKWACDQEVSVTKAPPHRSALRVSHSETTNHTESTIFR

SEQ ID NO: 24447 - protein, 243 aa, A.fumigatus
DAKKRLCGIQPFGFVAAERIEELLDPDHGDLIVIQARERAPFTGGSTPIGDLRRALHTAAVSSGFKPAPTGFDFLWVVDFPLFSPSSDSEPGQGGAAGISSTHHPFTAPKTAADVDQLLTDPTKAVADHYDLVVNGVELGGGSRRIHDAAVQEFILRDILQMKPERLADFSHLLDALRAGCPPHAGLALGFDRLVAVMLGKESVRDVIAFPKTGKGGDDAMVKAPSMMTKEALETYHLRLKDE

SEQ ID NO: 24448 - protein, 79 aa, A.fumigatus
EVEPRGSGLESGRDCSGVECTAKVADWSGATGEGGSFTGLDDDQIAVIGIQEFLNAFSSYKTEWLDATQTFLGVLHEDT

SEQ ID NO: 24449 - protein, 163 aa, A.fumigatus
LGGILFAWQFPHFNALSYMIREEYKAAGYRMLAWTNPAANARVALRYSLLMFPFSVGLWWVGVVGNGFLVGSTVANGWLVKEAYKFWRHQGANGSARRLFWASIWQLPILLVGGLVTKKGLWDGVWNNVFGQPVEDEDDYLWEDEDEVAEAERRMIPAKTSSS

SEQ ID NO: 24450 - protein, 64 aa, A.fumigatus
  UNSURE (22): Identity of amino acid sequences at the above locations are unknown.
VLYHNLLALTQDYIGVSMRQLXTDRPKKAREKRLGIMSILMYNSAERPAATASSYTHSSFKRRW

SEQ ID NO: 24451 - protein, 105 aa, A.fumigatus
VSNASFVIMLGALTMASSPPLPVLGNAMTSRTDSLPSMTATSRSKPSASPACGGHPARKASSRWEKSASLSGFIWRISRRMNSCTAASWIRRLPPPNSTPFTTRS

SEQ ID NO: 24452 - protein, 260 aa, A.fumigatus
AQSPQTAAAANPQFTYPAPYAGTGSPFPQAASPVYPNFSPGAQAQYPIQHTPTGYTPQPYPVGTAPQATPPYGTTPPPFPLPPHQQASPSHTVPQTAPAFPQRSGSLPAAPSLPQRPAFQPPPVNAYQMQQIHMGHPLPNAGVHTAVPDGGRAPGAEAASISSSVNDLVSGAAKEADQATAKAAASAGATTEEKPSKKDKGKPTRLVYSDNETSPEEKMARLSRYAFVPDRRGETTLEELPAAVVVGTIRESDKIFDSAQ

SEQ ID NO: 24453 - protein, 65 aa, A.fumigatus
DACNMIINARPNNDLCTESMPKFSDINNTGYLAMFLLLTSTQTDSSAQSWVSNVCGNLIRRRNIF

SEQ ID NO: 24454 - protein, 205 aa, A.fumigatus
RGRAAPVVKTMDKNILDGLLDLEDEFYQEGYNLGATDGAQAGYTEGSVFAVEKGFEKFLELGRLYGKALVWAQRLADSEISRNSSQESDGTDTRKSQPYNEGDLLLEPFVCKEMLPLPSSSRLAKNLEILLELVDPASLPMENTEEAVTDVDERLKGAAIKAKLIQRALGEREGASDIHPDVKDTQVAGDGTGSIEDISSLKVRH

SEQ ID NO: 24455 - protein, 355 aa, A.fumigatus
YPRDGLLGRGEEQKESAEARTELGLTGRKTIVFCDEIHRFSKSQQDVFLGPVESGQITLIGATTENPSFKVQNALLSRCRTFTLSKLSDEDVKSILDRALRVEGPNYSPSSLVDDELIEYLARFSDGDARTSLNLLELAMDLSKRPSMTKEELKRSLTKTLVYDRAGDQHYDTISAFHKSIRGSDPDAALYYLARMLQSGEDPLYIARRLVVVASEDIGLADNSMLPLAIATHSAVEKIGLPEARINLAHATVAMALSKKSTRVYRALNNTFAALAEPGVAGLPVPIHLRNAPTRLMKELGYGKEYKYNPNYLDGQVVQDYLPEKLLGRKFLEDRDLGTKIDPDLIAQDERHLEP

SEQ ID NO: 24456 - protein, 261 aa, A.fumigatus
HNDKVQEISIDYSECAEKAPSYPVSIADRVKSSFKSSTGQSTPTWERRIENGTTICRLSFEVPDDLGPPVFLYYRLTNFYQNHRRYVKSLDIDQLKGKAVDNKTIDGGSCDPLKLDPTGKAYYPCGLIANSQFNDTIHSPELLSDLNPTVYFMTNKGIAWDSDKELIKTTQYKPWEVVPPPNWHDRYPNGYIDGIPDLHEDEDFMVWMKTAALPAFSKLSRRNDSAPMKAGSYRLDIEDRSFALCNTPYQLANWALRVSGY

SEQ ID NO: 24457 - protein, 66 aa, A.fumigatus
TSHALKTLLIQRLNNLSLAPVDALSTADPHLTRSGSGLVPNLGITLVLVSVSLLVICTSQLKGQAW

SEQ ID NO: 24458 - protein, 182 aa, A.fumigatus
WCGTFQPRGEDEPRACRRLAHRRKYSPIASTQISEPHRLFGRKIDHDEPIDTGLLTILEHTLLTVPQDRVIVAHQKQRGLEASASSLTDHVQHCGDRDAIGQSLGVGPLNGGAICDGICEGNAQFDDICRNPTDCVSIEASWSGVRECECEGARRGKEPYLRLHFLAPEECQLSPRRWDSRL

SEQ ID NO: 24459 - protein, 79 aa, A.fumigatus
AVSRSPFTHAMEGIKSTFARCQEQKRAALVAYITAGYPTVEETVDILLGLENGGAGMAPYPAAHPHIRTPGPRTRKPQC

SEQ ID NO: 24460 - protein, 139 aa, A.fumigatus
KMEAQVWLLTPPRTLTFALPDPGPGSLNANAIRWISTDIIELGIPFTDPIADGPTIQRANTQALANGVTVTTVLNMVRQARSRGLKAPLLLMGYYNPVLRYGEERMLKDCKEAGVNGFIMVDLPPEEAVRFRDLCASNG

SEQ ID NO: 24461 - protein, 63 aa, A.fumigatus
LCDTPSPPLPISRHIHPPTMSDLYATIETPQGKYEQPLGLYVFPLHSIVTYSILHVVLIASRS

SEQ ID NO: 24462 - protein, 220 aa, A.fumigatus
LLLVPRFINNEFVKGVEGKTFETINPATEQPIVAVHEATEKDVDIAVAAARKAFEGPWRQVTPSDRGRMLNKLADLMEREIETLAAIEALDNGKAFSIAKLDMAGAAGCIRYYAGWADKIHGQTIDVNPETLTYTRHEPIGVCGQIIPWNFPMLMWSWKIGPAVATGNTVVLKTAEQTPLSALYAAKLIKEAGFPPGVINIISGFGRTAGAAIASHMDVD

SEQ ID NO: 24463 - protein, 111 aa, A.fumigatus
RMQPAAPAMSSLAMLKALPLSRASMAARVSISRSIRSASLLSIRPRSEGVTCLQGPSNALRAAATAMSTSFSVASWTATMGCSVAGLMVSKVLPSTPFTNSLLMNLGTRSN

SEQ ID NO: 24464 - protein, 226 aa, A.fumigatus
VDVHMASNSSSSSTSEAGNNVDDARGEASFLDQLGGIEGGQRSLLSGLEDNSVTSGDGRTDLPRPHQHGEVPRNDLTADTDGFVASVGECLRVDVNGLAVDLVSPASIVANAASSTGHVQLGDAEGLAVVKGLNGSEGLDFALHQIGQLVKHTATVRGSNLSPGTLECLASSGNGNVDILLSGFVDSNNGLLGGGVDGLEGLAFNTLHKLIVDEPRNEKQLERHEE

SEQ ID NO: 24465 - protein, 181 aa, A.fumigatus
  UNSURE (111): Identity of amino acid sequences at the above locations are unknown.
QSKTPTTKVLDVNLTGCLYVARIASVYLRQNRPENADRSITLISSVAGFKESPGMFVYQASNHGVLGLMRSLRLYLSSPTHHIRVNAICPWMTTTAMVKGVQEAWMKAKLXCNTPADVAYIIAGVLADSALNGKSMYVEGGRAWEIEANIDRLEPQWLGEEQSRSLAQGQAVLGSGMDWAQ

SEQ ID NO: 24466 - protein, 188 aa, A.fumigatus
WEALFWLISDGASVLPVNTSKMATGGSSAGGNLASIITHKALTLSPPVRFHAQLLSVPVMDNTATVDNNESYRLYEHTPALPAAKMIWYRNHYLPNIADRANPEASPLFYDDDWSQLPPALIMVGELDVLRTEGEQYAAKLRKTGVKVDLQVMKGMPHPFLAMDAVLKEGRRSITLMCDTLKRIFWES

SEQ ID NO: 24467 - protein, 248 aa, A.fumigatus
KAVDQRTLERYQREAEKIGKGSFALAWVLDQGTEERARGVTIDIAMNKFETENTVFTIVDAPGHRDFVPNMIAGASQADFAVLVIDSGTGNFESGLRGQTKEHALLVRSMGVQRIIIAVNKMDAVEWSRDRYEEIEQQISSFLTTAGFQAKNIAFVPCSGFRGDNVTRRSDDPNASWYTGRTLVEELEATEPYSYALDKPLRMTISDVFRGGVQNPLSISGRIDAGSLQVGDQILTMPSGETATIRSL

SEQ ID NO: 24468 - protein, 160 aa, A.fumigatus
  UNSURE (69),(77),(98): Identity of amino acid sequences at the above locations are unknown.
TPPTINQNQIRKFSPSGLVPLLECHSLSSTMRINDSLAICEFLAESNPHLSLWPPDAFFRTMARSPAAXMHFGFAAXRYTYPTNFIVQYTGNIPVPEXAKKDIQRLFTIWDNARQAAKTRLAELGEKDDGFLFGGFSIADAFFWPVLWVRANSLVYCVCY

SEQ ID NO: 24469 - protein, 77 aa, A.fumigatus
RFRTYNLPLEGASADVVKWIETMWNDPTMQKLAHKYYRQAELPESHMERYENIFPDRDDIQYARFPEDWKFTVPGKL

SEQ ID NO: 24470 - protein, 276 aa, A.fumigatus
  UNSURE (6): Identity of amino acid sequences at the above locations are unknown.
SYTKLXTHGQVNIDSDHHPSLIGLLLSGPFFRRQSTGGHILLFPSVELSHEGHHHQKGPFTRVKEYLGQRRSRVTSCIASGWEKSTTAVYSRLPSRIQKPVSVCARGIKTFFRGLWDFMNPPLWAMLVSIIVASVPSLQHLFFDEDTFVNNSVTRAINQNAQVAVPLILVVLGANLARNTLSQEALEDMPHPKEENKLIIASLVARMLLPTLVMAPFLALLAKHVPISILGDPIFIIVCFLLTGAPSALQLAQICQINNVYVSAMSKLLFQSYVVW

SEQ ID NO: 24471 - protein, 88 aa, A.fumigatus
LVRNRTEIFGTDGTKPLRNVYMVGDNPESDIRGANSYRSGNGSNWHSILVRTGVYRGGEPAWTPKVIVDDVKKAVEWGIKSSGWKLTE

SEQ ID NO: 24472 - protein, 109 aa, A.fumigatus
DPFDSPRQPILAVSPRRGSFRVTCLYSCALGISLYGCLGKANEMYLNRFYNNATCSESNSIQKVRGISDMDLLKRRSANTTYIHALLSSTGINPNAMQSVRSIENELSS

SEQ ID NO: 24473 - protein, 84 aa, A.fumigatus
FGVEDYTIWTIYQSRPAINVFSGFPPPSLFLVCDLLLSASLADDPVSLIVFFHHSPPLLTIYLFSVFHQFISLCHRTTPYFSDY

SEQ ID NO: 24474 - protein, 179 aa, A.fumigatus
PVTFSPGCFALDRILGPPSKSRLLSPHITRPALSPLLLLRLCPSIFPAGCSSCLLTASLQIILALILLFMADTCIVCLGDLGESASDSLAIAAEAVPRPDLQVEGKSSDASTKTGGVDDNEDAGQIAQLLPCGHILHNNCLKPWVERANSCPICRRSFNLVELSDRLGGMSFHFHLTLT

SEQ ID NO: 24475 - protein, 95 aa, A.fumigatus
TPFSSTTIVRILTIHYVHQTFPYIYTSRLTNLIHRAVFSLIIINKAGGLIYQREFQPGLRKLSTNDYLVLAGTFHGYVASNYRRATGESLFESNC

SEQ ID NO: 24476 - protein, 68 aa, A.fumigatus
RKVKPRAVKYGLDHWKKFYLPDSQLYEAVKLLHKGSLISADNIDMPELLDTWFMSRLGVEEGRDCSVW

SEQ ID NO: 24477 - protein, 75 aa, A.fumigatus
MSYFLNRRVTLQKNFVADSTVFDVGSLIGVVRLRGVFTWTMQRTSWLTATVPQQTFVEIGLINMSLCEKCCKTRY

SEQ ID NO: 24478 - protein, 144 aa, A.fumigatus
  UNSURE (142): Identity of amino acid sequences at the above locations are unknown.
KQLLTATVVHSVHAITRSITPKIPISSPLPTTPASSNVALSSPSGTSTPTPAASAYSLPNPGAPVTGLESLETDKFRLTCFQTLTGTKFLLFTDPLMANIDAVMKKIYELYSDYVMKNPFYQLEMPVRCEAFDRHLGGWLRXRT

SEQ ID NO: 24479 - protein, 212 aa, A.fumigatus
IDLFGIQQPQSYLYTSRSKCFDVPGVDDSAEFRDTLNAMNVIGMTEGEQDEVFRMLAAILWIGNVQFAEDDSGNAVITDQSVVDYVAYLLEVDAAQVNKAFTIRVMETARGGRRGSVYEVPLNTVQALAVRDALAKAIYFNLFDWIVQRVNASLTARGEVANSIGILDIYGFEIFEKNSFEQLCINYVNEKLQQIFIQLTLKAEQDEYESSP

SEQ ID NO: 24480 - protein, 382 aa, A.fumigatus
  UNSURE (1): Identity of amino acid sequences at the above locations are unknown.
XTVYSRIWACFFLLALQSGISGNGINNAYSGFMSAPQISTANILSSIIGGVLKLPIAKILNLWGRAEGFLVFVGVYTIGLIILAACNGPDSYAAGYVLFWIGYDAIYLILDVFVADTSGLRNRAFTFAFASTPFICTAFTAPLAASSFLRMTTWRWAYGAFAIIMPVALAPLAVVFKRYQLKAEKMGLYVRQPSGRTWAQSVAHYIHEFDSMSNQHPVLSINELQLTSLPVIGAFLLMAAWVLLLLPFSLASNGRAEYKSAAFIAMVIIGFCLFFAFAAWEKWFARVHFINYELLKQRTVLGACVMAATLYFSFYCWDLYFYNFCTVVYNLNAAMTGYMTQIYNVGSCFWGVVFGLWVRWTKHFKHTCLFFGLPLMILGAGL

SEQ ID NO: 24481 - protein, 78 aa, A.fumigatus
RQVPPGAVANAPEGTPKGPETNDQPDMDSSRLSLEARNEKEIEQHPNQVTADAHLGVQKVEAAALVWSKKAVWATYAW

SEQ ID NO: 24482 - protein, 107 aa, A.fumigatus
  UNSURE (107): Identity of amino acid sequences at the above locations are unknown.
NAPSGPETHHRFHHFRQRKKVLHRLCPQWHRQRGRAREQPLRSPNVSYSKIPFAVREHWLIVIDPSIFLYFFLLACFAGTVYFLYTIWIAPYFPQMRKAGNAADFSX

SEQ ID NO: 24483 - protein, 144 aa, A.fumigatus
DTTENTQDIPEVQKLAVSAEASFPASEIFGVKLVNGHPTQALITFTNEEAAPVTVNFVGGSLSTLDEKSQIVRNLTATRYGIEIPAGQKESVSYSFATEMHPQDLRLTIASIISDSERKFFTVYAHNGTVSVVEPENSLFDPQM

SEQ ID NO: 24484 - protein, 63 aa, A.fumigatus
NSWMRMQGHFLLPCTWVLTNATILGFLCAIATANPVLARAQGTASGKVALDRLYAPMAPIGWR

SEQ ID NO: 24485 - protein, 170 aa, A.fumigatus
YHNFPARLTERGYEIKYEEGLQIGYRHPQSQRTAQWQFGHGLSYTTFEYSGLTVSGQKMTEEAGDSDLKISVRVKNTGIYPGHEVVQLYISPPDSTKVWRPARELKGYAKVWILPGESETVTISLNKKHAFSYWDEDAKQWRLEPGTYRLLVGPFSTPFEIEHSLVWSGR

SEQ ID NO: 24486 - protein, 354 aa, A.fumigatus
EPFGLNTGRTLYAPFKKVGPCPQGRAPQEESNIRDCPAGGCLGHNGDVGADFLPYTSAVGYDTAYTLREHLKELLLDVANYIRERAIAAGASEADTPHMVLRFTGGWVRDKLLGVDSHDIDVGISSMTGYQFGMALKDYLDIPENLEKYKRNHPNGHMKEAIVSLHKIEANPEKSKHLETVTTKIFGFDIDLVNLRKEMYTDDSRNPQMEFGTAEEDALRRDATINALFYNLNESKVEDLTGRGFSDMRDKIIRTPMEPYQTFKDDPLRVLRLIRFASRLGYKIDPNTERAMQNSDISVALKLKISRERVGTELEKMLKGLQNPVRFETEPHVNFGSGPDPRGALQLIVSIPRG

SEQ ID NO: 24487 - protein, 238 aa, A.fumigatus
AKGPEGPPLGPKGSSPLGRQVPGTQFIDVATKALVGRDVLKPVDLMTEKRDYLATKVPQFSWTRLAGADPFLGVEMASTGEIACFGKDLVEAYWASLQSTMNFRVPEPGEGILLGGDINNPALAQIVDYLNPLGYKFFAASPEVQAHLQSATKDKVSVQVIEFPKEDKRALREVFQKYDIRGCFNLAKTRGKTLLDEDYVMRRNAVDFGVPLFMETKVCGSSLPSTTCTCIMCTNRLY

SEQ ID NO: 24488 - protein, 197 aa, A.fumigatus
  UNSURE (194): Identity of amino acid sequences at the above locations are unknown.
GSHILTSLLENPAIARVDTISRRTPSAAAAAPQTKLTTFVSDDTSRWAAQLSSLTPTPSIFISAFGTTRAAAGGFENQYKVEHGLNVEMARAARDAGTKVYVLISSGGANKASSFAYPRMKGEIEEDVKALGFERTVILRPGLISGQRQESRPAEAALRFIAGIAGKVHSGLKDGWAQDADVIARSSGQCRSQXSGT

SEQ ID NO: 24489 - protein, 130 aa, A.fumigatus
  UNSURE (9): Identity of amino acid sequences at the above locations are unknown.
RWLERTHHXRRPTSSFSSWVISVVLFSMVCYQFVQGGGGLPFPRDNADDRHCPVMELAVLLAAGLRDWIDLGVICGILLLNAVVGWYQEKQAADVVASLKGDIAMKAVVIRDGQEQEILARELVTGDIVS

SEQ ID NO: 24490 - protein, 219 aa, A.fumigatus
FPLPLQIVVEEGTVIPADIRLICDYDKPEMFETYKEYLATANDDTLKEKDDDDEDGGIEARVGVSLIAVDQSAITGESLAVDKYMADTCYYTTGCKRGKAYAIVTATAKQSFVGKTAALVQGAKDQGHFKALMDDLGSSLVVIVMFWILAAWIGGFYRHLKIDTHEHEDNNLLHYTLILLIIGVPVGLPVVTTTTLAVGAAYLAEQNFHHGGARLRAQR

SEQ ID NO: 24491 - protein, 222 aa, A.fumigatus
GSRILGHCLVRSSSAMVISTKYIFALCVLLLTFSLSSAYEDPLVELDYGQFQGKYDSTYNLSYFRKIPFAAPPTGENRFRAPQPPLRITHGVYDTDQDFDMCPQRTVNGSEDCLYLGLFSRPWDATVAPSSASRPVLVVFYGGGFIQGSASFTLPPSSYPILNVTELNDYVVIYPNYRVNAFGFLPGKAIKRSPTSDLNPGLLDQQYVIQVVSFAPRGRNPV

SEQ ID NO: 24492 - protein, 305 aa, A.fumigatus
SADPSSPVVKNFCSLSLQPFSHPVCTPSGTIFDLTSILPWIKKHGTNPVDGSPLKSSDLIKLNIAKNESGEYVDPVTYKVLTDNTHIVALRNTGNVFAWDTVERLNIKGKLWRDLVTDEEFSRKDIITLQDPQNIESRNLSTFNYLKEGESALTEQQIREREDPSNNVNFNALGNAAKILKAKEAVAKARAERAQRAESGAASKGLTKPGMSATAASQKTVSHQAGKPIPYNAARHTTGLAAASFTSTGMTPHTSAELALLSDEEYMLKRGRVKQKGYARISTTLGDVNLELHTEYAPKAVGISS

SEQ ID NO: 24493 - protein, 252 aa, A.fumigatus
PGAVVEEDIVLGPPKTAFASASRTPGSKSSVDFTDRSSRQVESDEASNERFNLRDKFFKDRETGDRDFDRRDGKPTPFNGRRGEREEWNNGRPRRTFGQEDQDRKPRRNVEFDRWNRDQREQNPDRGVTEKEAQFTPRKDGTPGRARHEGSWFRNDNVQDGPETEDEKLSVRNRDWRRDRHGADRDWNRGAKFEQDPEWMDTNDRDESRKVHTQEDFERWKERMKAGSSQAQLEEKKEAPSDLHRRARRTSA

SEQ ID NO: 24494 - protein, 93 aa, A.fumigatus
  UNSURE (15),(57): Identity of amino acid sequences at the above locations are unknown.
ATNREPDRSLANVPXWEAMNHPDRPKHPLIVRNGKLEPASWDEAMSLIVHHTKDVQXRLTNHGIGFYTTGQLFLEEYYVLAMIGKAGLNTLHM

SEQ ID NO: 24495 - protein, 366 aa, A.fumigatus
  UNSURE (164),(183),(248): Identity of amino acid sequences at the above locations are unknown.
RDGNTRLCTAMAAASMRESFGSDGQPGSYTDIDFTDCIFMVGHNMANTQTVLWSRVLDRLAGPDPPKLVVVDPRESETARHATVHLAPKGGTNVALLNGLQHLLFENGWLNEEWVEQHTVGRQELEKTVAKYTPEYVENITGVPADMLKDAAEIIGTSGSLLSXALQGVYQSNQATGAACQIXNINFLLEHIGKPGSGILQMNGQPTAQNNRETGCNGEYPGFRNFQNEKHMKEIADVWKIDFVQTPXWNQPTHIQNMLNYIEDGSIQMFWVSGTNPFVSLPHLYRVRELLTKPELFLVVQDIFVTETAAIADVVLPAAQWGEKTGCFTNVDRTMHLSLKAVDPPGEARADLDICLQPRGLEGTAL

SEQ ID NO: 24496 - protein, 160 aa, A.fumigatus
GAVGGRITRSPYRSSWSPRQRLTPRSISHLPIDYGDRKQKDSVVFQTARQWTPGNRTGHRPGHHGPAGHAHEAQVQHPQHHRRGLQHLQQLGRHRRQFCYCRAVWRGGVVALRHRRRHYCHAVHWRHAGGAGQRLSHGRRTVPFHLYSGIRAMEPPSVVL

SEQ ID NO: 24497 - protein, 202 aa, A.fumigatus
LVVHIEVAGLLAKGSHHAPYRIFQLTMEIESKRTASCSKPHDNGPLEIELATGQVIMGLPDMPMKRKFSILSIIAVGYNISNSWVAIAASFAIAVQSGGAVSLLYGIVAVTIAMLCTGVTLAELASVYPTAGGQYHFTSILASERWSRHLSYFSGLAAVFSWITLAASIAVASTQALMAVVIRWAARVCASGVALLPGVSAL

SEQ ID NO: 24498 - protein, 60 aa, A.fumigatus
WRWLSAGQPEYVPQAWHYFLVYQLFNIAMVVHNIFLTNRTLWVYNVGCKFPSVLTSPFVD

SEQ ID NO: 24499 - protein, 183 aa, A.fumigatus
TFAILTLHPTVLLSLGTFLTITVTCPARSHTTVDSFAIWTQFINGSGGWPNGISFLTGLSTPQFMLSGLDATLHLAEECLEPERIVPKAVLVTVVVGFLTAFPFSIAIIYSYRDVESSLSSPTGCVASLFLHNYNYSHLLRLRFPIYFIWEKATRSPTAATVFMAALVVIFCFHHGPEGPRMR

SEQ ID NO: 24500 - protein, 82 aa, A.fumigatus
LHLWHGKYSVAVKNVGIQAFRFLKARRRQSWLSNPEPEVSRKDAPHPSLPATTAPSNSGQWWPKSITRRDSFAEKDLPYPAD

SEQ ID NO: 24501 - protein, 347 aa, A.fumigatus
PIPEPLVELDTEYRPYLFDSDVMAIRVFVRELVDQSIVPYMENRVAVWNDQVASRRRGISGRFMSMSRKWAGFGYSSRSGINGSGGGNYDFARGFYKPDTPEAILRKMADFAFMLRDWKLSASTYELLRSDYTNDKAWRYHAGAHEMCAVSTLLNPMAMPAKPRLEAIDQMLETACYSYLTRCSDAPNALRCLCLAMELLKSRGGFATESAAKWAMRAMDLGLVGGIGQILFSERISACYAFRPPLTGVRWGGRRRKAGMWSILAADLWLRVGKPTLASSCLEEAERLYADVLDSDGVFPMPEMQSFVDNLRHTVKVEYLGARGLGPQEEVSTTEQLEQLEPEDTSE

SEQ ID NO: 24502 - protein, 239 aa, A.fumigatus
  UNSURE (60),(74): Identity of amino acid sequences at the above locations are unknown.
AHSLRWPKGSNNQSHLASGITNSLQNTARFLNSAFFGTQQDKAAIFSIIHRYHARVRAEXYDANDPELHKWTAXTLFVAVVIVHETFFGELPRDKMEALYRESAVFGTSLRMPPEMWPTTLAEFWEYWNHNIETLEVTDMARKLSRDLLYPVHLPMWMRVLAPLSRLLTIYFLPERLAKEYDLQPTMLSRIQFQATVRVMRIAYPSMPQHLRQTLHRQYMEDLGKAVDRIRKTGHWAGV

SEQ ID NO: 24503 - protein, 96 aa, A.fumigatus
QQPELAVNMEQHLDWKPDLPLPSIEDFIDPRILEDRTWEPNFELAETKSTSSAGSQDVLSLSSDFETDPKYEMLRSEDSEIDDYSLSDYVSADASR

SEQ ID NO: 24504 - protein, 103 aa, A.fumigatus
KPGDLPDKPHDIPPPKSPATVNDHPLGLNADGTFSKTGTKSGQQVEGSAFHSLIFSFTMIVVSEIGDKTFLVAALMAMRHPRLLVFSAAFSAVFTTGMERAAP

SEQ ID NO: 24505 - protein, 216 aa, A.fumigatus
RRQEFLIITIAHTAPRDTHSKLVQAAAKAGVPYIMPNGYAGDIDHIKLGEDTLLGPVAKANRDEIEGLGMQWITVCCGFWYDYSLAGGESRFGFNFGKRSLTIYDDGNTKISTSTLSQVGRALAKVLSLNELPEDENDKSLTLSTFLNKGLYLESFVVSQNDMFESVKRVTGTSDADWTITHEEPKKPYEDGLALVKRGNMAGFSKLLYPRAFYPG

SEQ ID NO: 24506 - protein, 150 aa, A.fumigatus
LFMQQPIISNSKTGDLLRLHPVEPDLLDLLGGISTYKIEYTSVDPDDSTVSATAFVAFPFVQRGSPFNIVAFAHGTSSIFRSCAPSTSSSLHDYDTVIPLLSSGYVVVGTDYACLGNNYTSLEYTSARANGIKCKICRCCFYDAIRSGRR

SEQ ID NO: 24507 - protein, 95 aa, A.fumigatus
HPDLARSTREEPPKLGFLLITIRYLSALSGNIILNASVTSILHPFNMYSTSSFVRTDNHALHKFKVAAESLDRFFRDTLNETGALQVLQVIRSIH

SEQ ID NO: 24508 - protein, 104 aa, A.fumigatus
SSAGMCALLHLVQLDIIHEILHIMDEYTVVLQIPGIDCTFQALLQIMIELLNCWVNAPVFVCWSILHNFTGNVFGKHGPKICYNIFKSSGHWICEYSRIKTRRW

SEQ ID NO: 24509 - protein, 257 aa, A.fumigatus
STLLMVTSMYVAMANSLKQNDQAENGPAEAGHADEATEENKPAEGHATEEPQIPQPADEGMPQAQGPTPMFPNAMGFNMGPSAFPNMAWNNASGDFNPMAQFMANGMFNFPNPMGRSLLICLSKHPNTDMMTSAMSGMGMDPMAANQGMLGGYGMNMNGMNSGMNMGMNFDASQGMYGGWDGSQNNMWNGGQDKFNPNAFANGMGPQYEGPSGFGGYNMSQPNGVHAQMQQQQFPSQDFQNGYYGPGYGRSNFRGRG

SEQ ID NO: 24510 - protein, 294 aa, A.fumigatus
KGLVPRPLSEKQPPIRVETGRHTLQTILRQKKQSRKSLYLIKPGGIQGYVGAVASYRSYTDVVAKTDVYVGFLPRASLERIAERYPIALLTLAKRLTSILPRLLLHIDFALEWVQVNAGQVIYRQGDESDAIYLVLNGRLRSVLESPGNKLAVVGEYGQGESVGELEVMTESTRPATLHAIRDTELAKFPRSLFNSLAQEHPGITIQVSKLIAQRMRDLVERPVTEKGVERSNAGSVQTATSTVNLRTVGILPVTAGVPVVEFGNRLLHALHQVGVTDGVTVFTTGVEVSAVIS

SEQ ID NO: 24511 - protein, 71 aa, A.fumigatus
  UNSURE (13),(38),(39),(48),(49),(53),(70): Identity of amino acid sequences at the above locations are unknown.
GFLNCNELLAFQXKNTGLPIGNLVVQAGIFLVYPELPXXINAVAKFLXXYVIXNQPIANMTFKTCSSVTXQ

SEQ ID NO: 24512 - protein, 85 aa, A.fumigatus
YWRLHPANWRSSSTNLCLHNWVSVVDVIAAPAHTAASDESISDKFHGRQINSNNEIFGEKYMLLLEPSYNKINHAKYPLPQICTP

SEQ ID NO: 24513 - protein, 75 aa, A.fumigatus
LTLGALAKPRDGSWPLLYNTVAAIGAFVGGTKATNCDIPLYKEACKHLTMDVLEKGSLSYVQAIVLMANYLQKRN

SEQ ID NO: 24514 - protein, 101 aa, A.fumigatus
RNHRPNQSIKETQGTSVLNLRSRMAPRKRKTAAIPSSDDGTTQQPSKREKLDLSRPHPNAQQAENFGIVLREFYPPEMSNERCQAYNDGRLERPIETLQRA

SEQ ID NO: 24515 - protein, 223 aa, A.fumigatus
  UNSURE (5),(46),(89),(113),(116),(141): Identity of amino acid sequences at the above locations are unknown.
STCPXRPQSSSTKNSSEIPNSHAEMVAFLNLCFRALAELGQSFENXKRTRDFFVSLQRRWQAHLRRSGSGKKRQVSKLLPQQSAGSGPXPSTESDPSRKKSRISAPRNHKQSXYPXPPAPSSSMPSTHNLFQLRPHSNSQXQHPPHQSLSQSQSQRFGACQPGDLDWIRDSDFQLLAENLGDGRLAQMGTGNQFEGENVLPSLSDIEPWWDSPNGHTFGGSSL

SEQ ID NO: 24516 - protein, 118 aa, A.fumigatus
WGGDTLSAAPSTPVVSMASMQMAISAYKNQKIKSKSKAAEIFGVPESTLHKWLSGVKPYIETCVNSHRMTVIEEKSLIKHLLDTDKQGFLIQPKFLHRIAQILLQAHTYNPTTTLDVN

SEQ ID NO: 24517 - protein, 73 aa, A.fumigatus
KLTNSANSWTTDKIGLKWLKEVFNPFSHLHLTGAKQLLILNSHSSYQTAEFDDFYKENIIICLYMPPHTSYLL

SEQ ID NO: 24518 - protein, 128 aa, A.fumigatus
  UNSURE (121): Identity of amino acid sequences at the above locations are unknown.
QLLLAIPHGTFIFQKPPVYGWYLSVSAVGLNVSWSLHNVIAWMKSKPFYSRNVSMAYIASVVAVQPYWLLEIYANFAYFNNINRVFEVTRAMEPVLPSVMNPNSAIPGPNSCYFEESTNAXGRSPVPN

SEQ ID NO: 24519 - protein, 148 aa, A.fumigatus
GISSHRCRPPDAAPVSVPRPLLPSPSLLKPPFPGPPRSPWSPSLSSSLDPSSPDMEPLEALLSGSSSPSPSSIASVSSCPVNRHSSASPVSLLSYSPARHHYPLLRLIIHQRTRPHSGVRCAHGSRSGTSFDQRGGGGGGGGLAATIV

SEQ ID NO: 24520 - protein, 159 aa, A.fumigatus
EGIKEIKQRITHSSAIQKMDGQKTMNGLRNLQSSMSPARRSASISTTATATIAIVTQAAISGSTTVTVVAVAIVITRPIVAGYGAIGGTAVGIIITITIIHRVRLVMSGQQTQQRKPGKSSLLLPRPAPLSFVAANNTSENTATLRRSMRPRKQVRYKF

SEQ ID NO: 24521 - protein, 399 aa, A.fumigatus
CHYSSLSVPADTLSTANMSFQVPYGSSPSTPDKSRSFLSDISATPGGAPPSATKSFTPRGPPPSTIFGSSQMSSRSQLDSPQSLFTKSGGIDFNDSIFNSSVGSFHQPAPRAKNAASGKPSAQSQSLFSMTNNTRFGESTRFGMSNGFNSQMNAETKADDEQMIPEEEDDVQEEDEMDMGNAAHRLSFLDSQFGNSTQAQLTSHVQRKSIYSNPGNAKRPKLDEKWAQQSPLRKGKLSPKKDSPIPSIVGNFASRAGPASVNEPSDVIISTEDEMCRMYDEVRQSEFTNRDIQIILSEVCSRLTNSWKPSMEGSLVPKAPGAGTDIGPGDRAPDVAKASFLGSLLLQLHHPPLSTPKQGSLSNNLGFAAPRSLVVTASKSDTPTPRPKVVFTQGSKEPR

SEQ ID NO: 24522 - protein, 87 aa, A.fumigatus
MCVSPRVISLDSCICRCKCRSYAPNLKHSRSATEPATYYVFCTEYSEGDSTISNQERRSTCPVEQCPNSISGLEFGPAALNPLTYCS

SEQ ID NO: 24523 - protein, 104 aa, A.fumigatus
VSIIALKDNQIRVVQASMLGSILSNILLVLGCCFFIGGLRFSEQTFNSTVASTMSSMMTVASASLIIPATLYASLSPSHSKTTTDNNILILSHGIHHGVPGPCI

SEQ ID NO: 24524 - protein, 238 aa, A.fumigatus
FRLNPEHFFFPIFQSLFLGLFPHTKAALLFHFLPINSAGKILRRILLRTWLIGFGRFLIQQRQGIFRSAFRRHSWGPKKSSMTGFSSSPNGAGEPSERDALINDIPRINSGMSQHRRHKRGPRWLNIPAQVMHLTWETLVRDYVNVLLVFVPLGIISGALHWDSTVVFSLNFLAIIPLASLLSFATEELAATMGQALGGLMNATFGNAVELIVGLSVRVVSCLTIADLEDNGRSASSL

SEQ ID NO: 24525 - protein, 216 aa, A.fumigatus
PGQKCWISEEYEAVRLWTHYIWIFLAEFGTVCLYAVMWFQLRAQIKQSAILGSNHTASLKRLRRVIGYMVIYPIAYIVLSLPLAAGRMATARGNTPSLAYFCVAGAIITSSGLVDVLLYTLTRRNLILESEPSEDHSYNRFASSKNRRNDNHLTTITADPKHTRTDISVLRTRRGHDEEEDHVDSPTRDGSTDNIVQPGVELAPMVFTRGGEQRRR

SEQ ID NO: 24526 - protein, 254 aa, A.fumigatus
GPGMRGCWYYVKLRPGLESFLQNVSELFELHIYTMGTRAYAQHIAGIIDPDRKLFGDRILSRDESGSLTAKNLQRLFPVDTKMVVIIDDRGDVWRWSPNLIKVSPYDFFVGIGDINSSFLPKKQELGGVVQPAEQDAKGTKELPMQQPPPNRAIAKPAAEVSTLEQLVTMGGGDNPRLLREQCVAQEETIMHQVEDRPLLQKQKELDAEDEAAESGDSASSVEDTQDSTKHPTSFIGGQRSGTLRTGRTTGADT

SEQ ID NO: 24527 - protein, 75 aa, A.fumigatus
SLEILSRQAAAFVAAEDAITKKLTVRIYNASYMLCVGSSTHGVNVQLEKLRDILQERLEPRSQLDVVPATAHART

SEQ ID NO: 24528 - protein, 68 aa, A.fumigatus
YRKSCAGWIIILNTREIYIGDSFRRMCMASYNDSLNIGTHPNTANTSGYPVNQNYRDYWNTWTNRHWV

SEQ ID NO: 24529 - protein, 288 aa, A.fumigatus
PVQSFLQLEIISAYNLLVHLVHQASNPDIFLSRICTYLAKPITTSPQFGPTLAISILTTIFNTLAPTDSSRFHVLLAIVAVIRQSGSSYAFEALKPQLAAQLPTWLSAWELDDEDAQKLHLAIADAAQASGDLELAQTHVVQALQTIPANESSSKEARDLAVRALTSALKSPAVFDFTSLTAADAIQALRSSDSTLFELLEIFTADTLDAYEDFIAATPLETISGGVLVDGAEALQTKMRLLTLASLAASTPSRSLPYTTIASALRVPVEDVEKWVFTTGLQGSATMR

SEQ ID NO: 24530 - protein, 280 aa, A.fumigatus
AHCRGSLEPRGEDPLLHIFNGHAQRRGDGSIGEGARGSRSRKRSQGQQAHLGLQSLGAIDQNTARDGFERGGRDEILVGVQSVSGEDLQQLEQGAVAGAKSLDGIGSGQRSEIENGGALQGGGQGTDGQVARFLAGGLVGGDCLQGLHHMGLCQFKIARSLSGIGNSKVQLLSILVIQLPGRQPGGQLSGQLRLQSLEGVRRAGLANDGDDGQEDVETAGVGGSESVEDGGQDGDGEGGAKLRRGGDRFGEVGANAGEENIRVGGLVHQVHQEVVGGNDF

SEQ ID NO: 24531 - protein, 75 aa, A.fumigatus
  UNSURE (37): Identity of amino acid sequences at the above locations are unknown.
TMTLSTPGGKAAAMTLGPLLPIVLRHLGPLYVFWTLXISLFSNAITNRFCPSTAISAFSSQLYTNTEIDCHEPPG

SEQ ID NO: 24532 - protein, 64 aa, A.fumigatus
SMIPMFATFINAAHAQYDPIRLCSYFSVSSDGKFLLHGQCGTQAVQFCAGLVAGVAFPERILLM

SEQ ID NO: 24533 - protein, 325 aa, A.fumigatus
  UNSURE (46): Identity of amino acid sequences at the above locations are unknown.
QGYTTPPRCDFDTVRINLTVTFRGRQYDRLAIMYLGDAEVFRTSTXEPTTNGIVWTYIKEMSHYNALWKEPQKLIFDLGNLISDAYTGSFNATLTAVFSQRGTTIRTADMILPISARKSAANASSALIVPSDNVEIAYRLPSNTSRAIVSISACGQSTEEFWWSNVFSPDTESFVNTVGELYGYSPFREIQLYIDGLLAGVIWPFPIIFTGGVSPGFWRPIVGIDAFDLRQPEIDISPFLPLLTDGQKHSFEIKIVGLELQANGTVRLSDSVGTYWVVTGNIFLYLEEDASHSRTDQSSVPQITAPTPQFTITRLLTKNATGAND

SEQ ID NO: 24534 - protein, 94 aa, A.fumigatus
HTGLLDYAAPEVLQGKSYRGKEQDIWALGILLYTIVYKENPFYNIDEILDHPLRIPFLPFSEECIDLIKKMLDRDVDNRLTITEVMEHPWMLYN

SEQ ID NO: 24535 - protein, 74 aa, A.fumigatus
ATTLPALPTRDEILFFWITAGTNLGIKSSIYRHFFAGRNMATCSYYGFLFMNHSSTTLASNPPMVFVSFRLRSC

SEQ ID NO: 24536 - protein, 175 aa, A.fumigatus
EVKLARLKKNPSKKVVLKYVTKKRILVDTWTRDRRLGTVPLEIHVLDYLRRDGLKHPNIVEMEGFFEDDVNYYIEMMPHGLPGMDLFDYIELKVNMDEVECRNIFRQVVDAIHHLHTKALVVHRDIKDENVILDGEGRIKIIDFGSAAYIKNGPFDVFVGTIGKSITMLLLTVIV

SEQ ID NO: 24537 - protein, 265 aa, A.fumigatus
  UNSURE (11),(14): Identity of amino acid sequences at the above locations are unknown.
PSYALMAGAWXDEXAGGAASKSSLITRDVPTKTITCEVKSDDEIYEWIDKIYERCPGMGGVSNPTNFSHRVHVGFDPQTGAFVGLPPEWEKLLTASAITKEDYKKNPQAVIEVLEFYSDIKMREQNPQYYAGLAGPPSGQQSKPNNNNNNNNSVGSLIAPPRPPPPGPAQRLDNGHSQTSRSANSSPSQRAESDRALDQQQQLERMKEMAEQERRRVEDETRRARQREDEQNKLDQEAYNASIPKTRVPLAKQELGRLRRRRFDG

SEQ ID NO: 24538 - protein, 172 aa, A.fumigatus
TVQRPAPAPPNTSSNGSAKNSPNARYAPNDPRSQAARAHGNGTKTAQGPPPSKLPAPVQAVKPLNIANKQTTQKGNVPDSVRQAEAALTKKAEPRHKEVRMSAMSENEVMDRLRSVVSKDNPNESYSKQRKIGQGASGSVYVARVKEHAVSPVARELYRQYGLHHGAGRNRA

SEQ ID NO: 24539 - protein, 65 aa, A.fumigatus
SLDNSLDKISKPLLPTLYRLLSKSRTHMASDNNAKCPIVCTEEAAQYDVHPTVPVPNGRARQGNN

SEQ ID NO: 24540 - protein, 315 aa, A.fumigatus
GLGDSVDAYRKFSGRAHLSTRNVVSNKMGTVFKTAYMLTIPELLYSIKRAWSGGVNMVVLRGYTYSGNYHNTTWPGYAAFNFEVSEMWNQFQPAWIHMKDYLDYISRNQYVLQQGRPQVDLALYLYETPWSAVDLLHSNNITAAGRLSLMCFKMELTLMTGYTYDYVAPDNLVSPQATVRAKVLAPDGPNYKALVFASPEYNISTFNLVREDVAARVVKFAQKGLPVVFVGGLPQVTSNSQAGQIVEDGWRRLRNLPSVQFISSLADLPGDLSKAGVRPDVLPSCTTGTLRVVKRSRPDDEVDYVFVHNDQLYKQ

SEQ ID NO: 24541 - protein, 296 aa, A.fumigatus
  UNSURE (282): Identity of amino acid sequences at the above locations are unknown.
HTWQSYRDRYLKRLRGKSRPGGESASTGQAPAEPGSTTRQFQVPGPAPAKSHERCENAPATTKKIDARKRKRSLDGDEPDRTEGQRTDDRPKKRPVPATLPEKSTTAARHRVHEEHPTHTEPEVATASKRTDQQRKEEPKPKDKGGTTVVQVHKTQQLSEAPDSIPDNFLFELPFFPSSPESQEEPPQEQDIDTWIDDRLRTGRADNEEQVIEALQCTSMDPRLADKVLEYLAAGKGIPEDMPGVWTPEDDECVEVGDSRAIERVLKKHGSEAFEARWNYLXMARAASLSGGGMGD

SEQ ID NO: 24542 - protein, 118 aa, A.fumigatus
VGDKRGSLPPSWLKTVQSLGVHPLLNQIRIRFIDLDSACPLLNPYFQLSGNLCTGLWSDRILYALNEFRPQARFVELRDGIYPQYGPNSQIVGAVLPRARPLSIHACAYRIIADAGKP

SEQ ID NO: 24543 - protein, 81 aa, A.fumigatus
  UNSURE (11): Identity of amino acid sequences at the above locations are unknown.
PQTAPSCIYSXAGGAPHRRLDRSLFIRQMLPVGVRHPRSYLGKKSLAGTMLAQTFAFVTFNKVCTSQVRSFFVVHLPIETC

SEQ ID NO: 24544 - protein, 84 aa, A.fumigatus
GVRQGNMIRSGSRWIFTPKLFGAATEGGTNVLEVKYFKRNAYLAQSPQLYKQMCIAGDMESVFEIAPVFRAEDSNTHRHLTEVC

SEQ ID NO: 24545 - protein, 230 aa, A.fumigatus
SFFLKFAGLDFEKTFRSHYHEVLEFAENLLVFILSQLKERYKDQIAIIQKSYPKAGDFKLPKDGKALRLNYMDGVALLKEAGVDVSEQERFENDLTTAMEKQLGQIIRDKYDTDFYVLDKFPMAVRPFYTKACPQDPRFSNSYDFFMRGEEIMSGAQRINDIKELEESMIAKGLDPKQEGFEDYLAAFRQGCPPHAGGGLGLNRIVMFFLGLPNVRLASLFPRDPQRLRP

SEQ ID NO: 24546 - protein, 86 aa, A.fumigatus
ATPRRTISCRQLTSVSLSQQVEETAFQTVEALATFVARIVTVQFANERVTVRVEKPSALSFVERSGIEITRSQAFFEKSDLEGGRV

SEQ ID NO: 24547 - protein, 128 aa, A.fumigatus
LGSVAQRRLPWESTTQASATLALVNPVLWYLIDRTKAGFLLSTVVGLAGTGVVLGLKPELVPASADTPATTIPLLNGTVLEYGLPTGLTQEGVSVRIWLASVLFCACVCFGNVGRQLAIGGTGRDRLG

SEQ ID NO: 24548 - protein, 72 aa, A.fumigatus
  UNSURE (4),(46),(47): Identity of amino acid sequences at the above locations are unknown.
GSKXPQYMINALIKKPETLEASVKVEKSAPMAPNNAVMNYMAHLSXXSIFHTKVDIRIKCNQAKTYHSNPQE

SEQ ID NO: 24549 - protein, 395 aa, A.fumigatus
  UNSURE (35),(80),(326): Identity of amino acid sequences at the above locations are unknown.
FMTALFGAIGALFSTLTEASKVSGFLISALIMYCXYLEPYHAMHPWFIWIYWINPLAYALDALLSIEFHNKIIPCVGNNXVPFGPGYDDTTFQSCAGVGGAVRGMTYVTGDQYLASLTYSYSHVWRNFGILWAWWALFVAVTIIATSRWKSAAEAGNSLLIPRETVAKHHAVVRKDEEAQLNEKAGHKGTSTDSEAQSNVDQHLVRNTSVFTWKNLTYTVKTPSGDRVLLDNVYGWVKPGMLGALMGSSGAGKTTLLDVLAQRKTDGTIRGSIMVDGRPLPVSFQRSAGYCEQLDVHEPFATVREALEFSALLRQPRHIPREEKLXYVDVIIDLLEWHDLEHTLIGRVGARLSVEQRKRVTIGVELVSKPSILIFLDEPTSGLDRSSPFNTVRFL

SEQ ID NO: 24550 - protein, 231 aa, A.fumigatus
  UNSURE (71),(75): Identity of amino acid sequences at the above locations are unknown.
ISRGIRCLGKNRFCNRYWWVERHGMPYGGMPNSSTAEAHYANVRFWVQGPDEMERVGFIDVPDDQRKQYQXEFHXTPAERKKNEEGPTRLSTAHEWGYYDDPDVIDKLIDWLDPRGNRESRLRKELQLQRDHIVKYMKCRKKYLEQTAERAESEELQTKRMTTRNKTYVDDHKHRCLKWRNTTALSENGHLHVDPSRPSKRAKRVTDESKEIKATSRQGKPLTRQGTRYNF

SEQ ID NO: 24551 - protein, 68 aa, A.fumigatus
SATCIYKYPNNPPTFPNTINSFTRALDAMLFRSGYIKMNPNFHGLVAKVCRRKRNAKTLVALPMPTRK

SEQ ID NO: 24552 - protein, 202 aa, A.fumigatus
RNCTTTSHMQGAVILLIVRLRLRCFTIDNVLILPVTRICEVDHLCFSQTLEIQKYINKPGTWAALGVPEAVRNFSIESTEVASAFETTTDLYSNVMKDIKYTLEHGVDVLIYNGNLDLACNTAGNLRWAEALRWNGQAPFTSEKLKPWYSNVRGSRVKAGSFKEVFASIPNGVSGKQRFAFVTVDKSGHMVSASVIAAEYGS

SEQ ID NO: 24553 - protein, 119 aa, A.fumigatus
ANYSPLFFIFFCVFDTGDKLKFRDLLPPKPDDPPRVSHAVTPTRSGIIWSGKELNQSCFDCTTLPVPKYVQMVQYIFSSPCNSTYPHHSSPQDGKFYGVNQLLQFHPVELNATYRHSHH

SEQ ID NO: 24554 - protein, 151 aa, A.fumigatus
VLGIALTDTFGTPAFLDAFRKPIPHHTSAGVGAVATIASGASTTSESQPQSEAETKPPVTAPLHENDSQHSPKTYAQVYTGVRQDSGDPTYFVKMVRDFYDNEGIKEKKTVVFSDSLNIEHCLEYKTIAEEAGFAPIFGVGTFFTSEFYPV

SEQ ID NO: 24555 - protein, 247 aa, A.fumigatus
RRQATHHHTRSSVLPSPIHSVPRLSSTPSASRSLTIPAQVSAPSPQLHRERAQQASRSLRVRPKPNPQSPLPSMKTTPSTLRRHMRRSTRASVRTPATQPTSSRWSATFTTMRGSKRRRLSCFQIRSTSSTASSTRPLPRRLASPPSSVSGLSSPVSSIPSSPQSTVSLTVLLADDFTNKSDGKKSKPLNIVIKIATANGRPAVKLSDNMGKNTGDKNMVQEVKKRLGYIEHYWEEGDESNRWAKHG

SEQ ID NO: 24556 - protein, 114 aa, A.fumigatus
KLSAGSCRPRLVEDEWFVAIAAITDDYENANELALRYWLGCFGEGVRISSLLDDADKPLIIILGPRYCPHRYIRYPGFPRRLPQADPSPYQRRCRRRRHNCIGSEHNKRVAASE

SEQ ID NO: 24557 - protein, 70 aa, A.fumigatus
MLRERGKGTYTVPFPSPRRINAVSNSTAYVYDVMERFYFRLGTLDEHSDVLPQLSAQLHDLIKRMVLVAC

SEQ ID NO: 24558 - protein, 312 aa, A.fumigatus
  UNSURE (110),(150): Identity of amino acid sequences at the above locations are unknown.
GYVTTMIARFPASRPAYVDDVLFLTTKGIGHPTTVSPSSYVTPYTPLVSDAQEAETTLKAGEIVKIQLGAQIDGFGTIVCDMVVVADKESPKDVVTGREADLIHATHYAXELLLRLMVPPGLLASGTEEEKKKAAAEKPPTQSQISALIXKVAKAYDCNVVENTTSWLIERNEIEGGKKIILAPGSGVKGEGVPDVGEVWGVEVGLSLGSGKVKTLPHRATLHRRTTTTYILKRPSSRQTLSEIVKKFGTFPFSLRQLEDEKSAKVGVVECVRGGVLRQYEPAGDADNAPVSRLLTTIGMFITCSTEYSRFR

SEQ ID NO: 24559 - protein, 66 aa, A.fumigatus
RGLIAITKNGITRLAAPNPPDLSKFQTDKKIEDEEILKILERPLARNTGNKNKKKKKPTKDSKDEE

SEQ ID NO: 24560 - protein, 155 aa, A.fumigatus
LHAAGVYLKNRINRGWSPVEDSPLRAPIPEAEKPGFRERLIPALASTPPNVRAQLVPLLQKILQHDFPEQWPGFLDITLQLLGTNNANSVYAGLQCLLAICRVYRFKAGEKREEFDKIVEHSFPQLLNIGLKLGDEESLEAAEMLRIVVQSYKPC

SEQ ID NO: 24561 - protein, 127 aa, A.fumigatus
  UNSURE (103): Identity of amino acid sequences at the above locations are unknown.
RPKFAFNFRDVTSGIFKDIPRNELFIRVQPNESVYIKMNSKLPGLSMQTVMTELDLTYRRRFSDLKIPEAYESLILDALKGDHSNFVRDDELDASWKIFTPLXHYLDDNKEIIPMEYPYGMCHNILF

SEQ ID NO: 24562 - protein, 246 aa, A.fumigatus
  UNSURE (220),(246): Identity of amino acid sequences at the above locations are unknown.
SADVFDCSDIEHIWQMAWRLGFYRGGPVFMSAISGIYIALWDLKGRRLGVPVHQLLGGKVRNKLSVYAWIGGDRPGDVEAAGKARLAQGFKAIKMNATEDINWLDSPSVLDSCVERLKAVKALGLDAALDFHGRLHKPMAKQLAKALEPHRPLFLEEPLLSEHPEGIKQLADQVSCPIALGERLYNRWDVKRFLEDASVDILQPDISHCGGISELRRIAXMAETYDVAIAPHLSLGPDCLGGMHAX

SEQ ID NO: 24563 - protein, 93 aa, A.fumigatus
PSSVLSPQPYWPSSSTILNNNHPGTDPEIFDPPDLGPWCPIPAGNCRGNFGIMELPPPSLNLTKIRPGWNNNWNGPKFNPIIPLLCPKGSIFF

SEQ ID NO: 24564 - protein, 241 aa, A.fumigatus
  UNSURE (201): Identity of amino acid sequences at the above locations are unknown.
VWRINRERAVDYLNTRNRIYVIDGYAGWDERYRISVRVVCARAYHALFMRNMLIRPSPEELEHFHPDYVIYNAGSFPANRFTEGMTSATSVAINFAEKEMVILGTEYAGEMKKGVFTILFYEMPVKHNVLTLHSSANEGENGDVTVFFGLSGTGKTTLSADPKRALIGDDEHCWTDRGVFNIEGGCYAKCIGLSAEKGPDXFNAIRFGSVLENVVFEPISRVGHYDDSPSLRTTAAPTPLS

SEQ ID NO: 24565 - protein, 140 aa, A.fumigatus
  UNSURE (27): Identity of amino acid sequences at the above locations are unknown.
IIVVTHTADRFEDDVLEHGSEADGVEXIGSFLGGEANALRVATTFDVEDSAVSPAVLIITNQCTLGVSRQSCLASAGQTEEHSHIAVLTLVSRGVQGQDIVLHRHFVKENGENTLLHLTGVLGTQDNHLLLGEVDSYRCS

SEQ ID NO: 24566 - protein, 89 aa, A.fumigatus
FPIAPPSDPSSPVVKTIVYLEAQKTRLIEDNDEPAPFRYEIASFPELHYPELHSSWKNRFDISHSILDNVDHSSTYLDVLYRTLVWFTI

SEQ ID NO: 24567 - protein, 263 aa, A.fumigatus
  UNSURE (253): Identity of amino acid sequences at the above locations are unknown.
HIAFNIRQRRPFFYLSGCPLPDSCLVYDLSEDQLTLFIPPVDPEDVIWSGLPMSTEEAQNQYDVDRVLVTTELNSTLASIVSSHGGKAIAFTIADQVSESTQFHGFSEVNHSVLKGVIEQSRVVKDEYEVALLRKANDISAKAHIAAIKASQTAVNEREIEGAFIATCIANGAREQSYHPIVACGENGATLHYGKNDDTLIDPVTNQKKRNVLIDAGGEYRTYCADITRVIPVGGEIHWQKRGRTTKLARQMXNRMYWQALGS

SEQ ID NO: 24568 - protein, 137 aa, A.fumigatus
KTFTPVNEVIPKTLMFPPWNNKGISPSWGQRQTVYSRDSPAQKKEFNRKTKIGARKRIRKSRLLKDYDPNKVPDPERWLPFRDRSTYRPKGRKGKQRAVKRMQGGVVTRKAEDTLAPTQPKAQGGGASSKKKKKGKR
